United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 81

SEQ ID NO: 3702957 - RNA, 19 nt, Human
ugcauuuuugugaaaugaa

SEQ ID NO: 3702958 - RNA, 15 nt, Human
ugcauuuuuuaaaac

SEQ ID NO: 3702959 - RNA, 17 nt, Human
ugcauuuuuuaaaacaa

SEQ ID NO: 3702960 - RNA, 20 nt, Human
ugccaaaaaaagacagggcu

SEQ ID NO: 3702961 - RNA, 19 nt, Human
ugccaaaaaggauacauaa

SEQ ID NO: 3702962 - RNA, 21 nt, Human
ugccaaaaagugaaauaaugu

SEQ ID NO: 3702963 - RNA, 19 nt, Human
ugccaaaacccagcugcac

SEQ ID NO: 3702964 - RNA, 20 nt, Human
ugccaaaacccagcugcacc

SEQ ID NO: 3702965 - RNA, 21 nt, Human
ugccaaaacccagcugcaccc

SEQ ID NO: 3702966 - RNA, 22 nt, Human
ugccaaaacccagcugcacccc

SEQ ID NO: 3702967 - RNA, 17 nt, Human
ugccaaaauucauuucu

SEQ ID NO: 3702968 - RNA, 20 nt, Human
ugccaaacauuaauguugau

SEQ ID NO: 3702969 - RNA, 17 nt, Human
ugccaaagaagcagacc

SEQ ID NO: 3702970 - RNA, 14 nt, Human
ugccaaagaucacu

SEQ ID NO: 3702971 - RNA, 19 nt, Human
ugccaaaggaugugauaua

SEQ ID NO: 3702972 - RNA, 11 nt, Human
ugccaaaguac

SEQ ID NO: 3702973 - RNA, 17 nt, Human
ugccaaauuaaaaaaga

SEQ ID NO: 3702974 - RNA, 18 nt, Human
ugccaaauuaaaaaagau

SEQ ID NO: 3702975 - RNA, 19 nt, Human
ugccaaauuaaaaaagaua

SEQ ID NO: 3702976 - RNA, 23 nt, Human
ugccaaauuuuggccaaaguguu

SEQ ID NO: 3702977 - RNA, 23 nt, Human
ugccaacaagaaugcauugauau

SEQ ID NO: 3702978 - RNA, 15 nt, Human
ugccaacaauccuag

SEQ ID NO: 3702979 - RNA, 19 nt, Human
ugccaaccuguaauaaaua

SEQ ID NO: 3702980 - RNA, 20 nt, Human
ugccaaccuguaauaaauau

SEQ ID NO: 3702981 - RNA, 16 nt, Human
ugccaacuguggcugg

SEQ ID NO: 3702982 - RNA, 17 nt, Human
ugccaacuguggcuggu

SEQ ID NO: 3702983 - RNA, 23 nt, Human
ugccaacuguuguaacuaggcuc

SEQ ID NO: 3702984 - RNA, 12 nt, Human
ugccaagacaaa

SEQ ID NO: 3702985 - RNA, 17 nt, Human
ugccaagacugcugugg

SEQ ID NO: 3702986 - RNA, 21 nt, Human
ugccaagacugcuguggccag

SEQ ID NO: 3702987 - RNA, 22 nt, Human
ugccaagacugcuguggccagg

SEQ ID NO: 3702988 - RNA, 19 nt, Human
ugccaagagcccgucugcu

SEQ ID NO: 3702989 - RNA, 14 nt, Human
ugccaagcacugug

SEQ ID NO: 3702990 - RNA, 15 nt, Human
ugccaagcacugugc

SEQ ID NO: 3702991 - RNA, 22 nt, Human
ugccaagcucaggaccaggcaa

SEQ ID NO: 3702992 - RNA, 13 nt, Human
ugccaagcuccaa

SEQ ID NO: 3702993 - RNA, 16 nt, Human
ugccaagcuccaagcc

SEQ ID NO: 3702994 - RNA, 17 nt, Human
ugccaaggcagaggccu

SEQ ID NO: 3702995 - RNA, 19 nt, Human
ugccaaggcagaggccugg

SEQ ID NO: 3702996 - RNA, 21 nt, Human
ugccaaggccagaguggccug

SEQ ID NO: 3702997 - RNA, 17 nt, Human
ugccaagggcauaaauu

SEQ ID NO: 3702998 - RNA, 21 nt, Human
guacuugugaaacacagcugu

SEQ ID NO: 3702999 - RNA, 15 nt, Human
guacuuguggacaca

SEQ ID NO: 3703000 - RNA, 12 nt, Human
guacuuguuugc

SEQ ID NO: 3703001 - RNA, 22 nt, Human
guacuuucauauuuuaaacaga

SEQ ID NO: 3703002 - RNA, 11 nt, Human
guacuuucugu

SEQ ID NO: 3703003 - RNA, 14 nt, Human
guacuuucuguuaa

SEQ ID NO: 3703004 - RNA, 18 nt, Human
guacuuucuguuaaaaug

SEQ ID NO: 3703005 - RNA, 19 nt, Human
guacuuucuguuaaaaugc

SEQ ID NO: 3703006 - RNA, 16 nt, Human
guacuuugauucacau

SEQ ID NO: 3703007 - RNA, 17 nt, Human
guacuuugauucacaug

SEQ ID NO: 3703008 - RNA, 23 nt, Human
guacuuugauucacauguuuuca

SEQ ID NO: 3703009 - RNA, 23 nt, Human
guacuuugucuaagaaacauugg

SEQ ID NO: 3703010 - RNA, 14 nt, Human
guacuuuuaagacu

SEQ ID NO: 3703011 - RNA, 16 nt, Human
guacuuuucauucucu

SEQ ID NO: 3703012 - RNA, 20 nt, Human
guacuuuucauucucuuuua

SEQ ID NO: 3703013 - RNA, 12 nt, Human
guacuuuuuggc

SEQ ID NO: 3703014 - RNA, 20 nt, Human
guacuuuuuuaaauauuuuc

SEQ ID NO: 3703015 - RNA, 20 nt, Human
guagaaaaaaaaacagcucu

SEQ ID NO: 3703016 - RNA, 13 nt, Human
guagaaaagcuau

SEQ ID NO: 3703017 - RNA, 17 nt, Human
guagaaaaugugacccu

SEQ ID NO: 3703018 - RNA, 15 nt, Human
guagaaacugcaggg

SEQ ID NO: 3703019 - RNA, 18 nt, Human
guagaaaugguuguauua

SEQ ID NO: 3703020 - RNA, 15 nt, Human
guagaacacuaauuc

SEQ ID NO: 3703021 - RNA, 16 nt, Human
guagaacgccagggac

SEQ ID NO: 3703022 - RNA, 18 nt, Human
guagaacguaaccacgga

SEQ ID NO: 3703023 - RNA, 19 nt, Human
guagaacguaaccacggaa

SEQ ID NO: 3703024 - RNA, 22 nt, Human
guagaacucacucugggcugua

SEQ ID NO: 3703025 - RNA, 17 nt, Human
guagaacuuacuauuca

SEQ ID NO: 3703026 - RNA, 15 nt, Human
guagaagcauuccuu

SEQ ID NO: 3703027 - RNA, 22 nt, Human
guagaagcauuccuucuuugau

SEQ ID NO: 3703028 - RNA, 18 nt, Human
guagaagggaaagcccau

SEQ ID NO: 3703029 - RNA, 19 nt, Human
guagaaguuuuuguacugu

SEQ ID NO: 3703030 - RNA, 23 nt, Human
guagaaugaccuuguaauguaac

SEQ ID NO: 3703031 - RNA, 14 nt, Human
guagaauguauugu

SEQ ID NO: 3703032 - RNA, 18 nt, Human
guagaauguauuguaccu

SEQ ID NO: 3703033 - RNA, 18 nt, Human
guagacaaucauuguuuu

SEQ ID NO: 3703034 - RNA, 18 nt, Human
guagacacgcucuucuau

SEQ ID NO: 3703035 - RNA, 19 nt, Human
guagacacgcucuucuauu

SEQ ID NO: 3703036 - RNA, 18 nt, Human
guagacaguauauaacua

SEQ ID NO: 3703037 - RNA, 16 nt, Human
guagacaguuggguuu

SEQ ID NO: 3703038 - RNA, 13 nt, Human
guagacaguuuug

SEQ ID NO: 3703039 - RNA, 17 nt, Human
guagaccccuggcuggu

SEQ ID NO: 3703040 - RNA, 17 nt, Human
guagaccuagggaggac

SEQ ID NO: 3703041 - RNA, 21 nt, Human
guagaccugugagaaaacguu

SEQ ID NO: 3703042 - RNA, 21 nt, Human
guagaccuuguuacuucugag

SEQ ID NO: 3703043 - RNA, 22 nt, Human
guagaccuuguuacuucugagg

SEQ ID NO: 3703044 - RNA, 21 nt, Human
guagacggcucaguauagaua

SEQ ID NO: 3703045 - RNA, 17 nt, Human
guagacuauauacaugu

SEQ ID NO: 3703046 - RNA, 18 nt, Human
guagacuggccugaacca

SEQ ID NO: 3703047 - RNA, 12 nt, Human
guagacuuuuau

SEQ ID NO: 3703048 - RNA, 13 nt, Human
guagagaaacacu

SEQ ID NO: 3703049 - RNA, 18 nt, Human
guagagaccgagccucug

SEQ ID NO: 3703050 - RNA, 10 nt, Human
guagagccag

SEQ ID NO: 3703051 - RNA, 12 nt, Human
guagagccagcu

SEQ ID NO: 3703052 - RNA, 16 nt, Human
guagagcggagaaagg

SEQ ID NO: 3703053 - RNA, 18 nt, Human
guagagcggagaaaggaa

SEQ ID NO: 3703054 - RNA, 15 nt, Human
guagaggagaaacug

SEQ ID NO: 3703055 - RNA, 16 nt, Human
guagagguauaauugu

SEQ ID NO: 3703056 - RNA, 19 nt, Human
guagagguauaauugugug

SEQ ID NO: 3703057 - RNA, 14 nt, Human
guagagguuuuguu

SEQ ID NO: 3703058 - RNA, 12 nt, Human
guagagucugag

SEQ ID NO: 3703059 - RNA, 12 nt, Human
guagaguuaaga

SEQ ID NO: 3703060 - RNA, 18 nt, Human
guagaguuaagaagcugu

SEQ ID NO: 3703061 - RNA, 14 nt, Human
guagaguugcugag

SEQ ID NO: 3703062 - RNA, 21 nt, Human
guagauaaacucagaaauuua

SEQ ID NO: 3703063 - RNA, 16 nt, Human
guagauaauuucaggg

SEQ ID NO: 3703064 - RNA, 15 nt, Human
guagauacaaucagc

SEQ ID NO: 3703065 - RNA, 20 nt, Human
guagauacaaucagcugcuu

SEQ ID NO: 3703066 - RNA, 17 nt, Human
guagauauguauucuuu

SEQ ID NO: 3703067 - RNA, 18 nt, Human
guagauauguauucuuuu

SEQ ID NO: 3703068 - RNA, 17 nt, Human
guagauauuacuuuauc

SEQ ID NO: 3703069 - RNA, 18 nt, Human
guagauauuacuuuauca

SEQ ID NO: 3703070 - RNA, 13 nt, Human
guagauauuuggc

SEQ ID NO: 3703071 - RNA, 19 nt, Human
guagauauuuuuucugaau

SEQ ID NO: 3703072 - RNA, 21 nt, Human
guagaugaaaaagcauguaca

SEQ ID NO: 3703073 - RNA, 20 nt, Human
guagaugcauuuggguccag

SEQ ID NO: 3703074 - RNA, 22 nt, Human
guagaugcauuuggguccagga

SEQ ID NO: 3703075 - RNA, 17 nt, Human
guagaugggagggaggc

SEQ ID NO: 3703076 - RNA, 17 nt, Human
guagauguaugcacaca

SEQ ID NO: 3703077 - RNA, 23 nt, Human
guagauguucagauugcuuugau

SEQ ID NO: 3703078 - RNA, 14 nt, Human
guagauucagguaa

SEQ ID NO: 3703079 - RNA, 15 nt, Human
guagauugauuguau

SEQ ID NO: 3703080 - RNA, 14 nt, Human
guagauugcuucug

SEQ ID NO: 3703081 - RNA, 15 nt, Human
guagauuuguuuugu

SEQ ID NO: 3703082 - RNA, 16 nt, Human
guagauuuguuuugug

SEQ ID NO: 3703083 - RNA, 14 nt, Human
guagauuuuccaaa

SEQ ID NO: 3703084 - RNA, 16 nt, Human
guagauuuucuuuaaa

SEQ ID NO: 3703085 - RNA, 23 nt, Human
guagcaaacccugucaaacauua

SEQ ID NO: 3703086 - RNA, 17 nt, Human
guagcaaaugagacagc

SEQ ID NO: 3703087 - RNA, 21 nt, Human
guagcaaguucuagagaagag

SEQ ID NO: 3703088 - RNA, 14 nt, Human
guagcacaggcuga

SEQ ID NO: 3703089 - RNA, 16 nt, Human
guagcacauguaugcu

SEQ ID NO: 3703090 - RNA, 13 nt, Human
guagcacuuacug

SEQ ID NO: 3703091 - RNA, 11 nt, Human
guagcagcugg

SEQ ID NO: 3703092 - RNA, 15 nt, Human
guagcaguagaugca

SEQ ID NO: 3703093 - RNA, 23 nt, Human
guagcagugugaaguacaauaau

SEQ ID NO: 3703094 - RNA, 12 nt, Human
guagcaugagag

SEQ ID NO: 3703095 - RNA, 13 nt, Human
guagcauuucauu

SEQ ID NO: 3703096 - RNA, 17 nt, Human
guagcauuucauucuuc

SEQ ID NO: 3703097 - RNA, 19 nt, Human
guagcauuucauucuucuc

SEQ ID NO: 3703098 - RNA, 14 nt, Human
guagccaaagguuc

SEQ ID NO: 3703099 - RNA, 13 nt, Human
guagccacaccag

SEQ ID NO: 3703100 - RNA, 15 nt, Human
guagccacaccagga

SEQ ID NO: 3703101 - RNA, 15 nt, Human
guagccagccggggc

SEQ ID NO: 3703102 - RNA, 21 nt, Human
guagccaggucccccugcagc

SEQ ID NO: 3703103 - RNA, 23 nt, Human
guagccaucccaugaacacacug

SEQ ID NO: 3703104 - RNA, 14 nt, Human
guagccccaagaag

SEQ ID NO: 3703105 - RNA, 17 nt, Human
guagcccccuggccucu

SEQ ID NO: 3703106 - RNA, 15 nt, Human
guagcccgccugcca

SEQ ID NO: 3703107 - RNA, 17 nt, Human
guagcccgccugccagu

SEQ ID NO: 3703108 - RNA, 14 nt, Human
guagcccucccacu

SEQ ID NO: 3703109 - RNA, 15 nt, Human
guagcccuggccaga

SEQ ID NO: 3703110 - RNA, 21 nt, Human
guagccucgccgucugugaau

SEQ ID NO: 3703111 - RNA, 22 nt, Human
guagccuggauauuauucuugu

SEQ ID NO: 3703112 - RNA, 23 nt, Human
guagccuugcccggauucuggga

SEQ ID NO: 3703113 - RNA, 17 nt, Human
guagcgucuuucuuuuu

SEQ ID NO: 3703114 - RNA, 14 nt, Human
guagcuacagagaa

SEQ ID NO: 3703115 - RNA, 18 nt, Human
guagcuacagagaaacca

SEQ ID NO: 3703116 - RNA, 14 nt, Human
guagcuagaggaac

SEQ ID NO: 3703117 - RNA, 13 nt, Human
guagcuauaucua

SEQ ID NO: 3703118 - RNA, 12 nt, Human
guagcucaggug

SEQ ID NO: 3703119 - RNA, 22 nt, Human
guagcucuaggagggcuggcaa

SEQ ID NO: 3703120 - RNA, 14 nt, Human
guagcugccacuug

SEQ ID NO: 3703121 - RNA, 16 nt, Human
guagcugccccuggcu

SEQ ID NO: 3703122 - RNA, 12 nt, Human
guagcugggacu

SEQ ID NO: 3703123 - RNA, 12 nt, Human
guagcuggggcu

SEQ ID NO: 3703124 - RNA, 23 nt, Human
guagcuggggcuuugauguuccu

SEQ ID NO: 3703125 - RNA, 13 nt, Human
guagcugugaccu

SEQ ID NO: 3703126 - RNA, 16 nt, Human
guagcuuaagaaaaaa

SEQ ID NO: 3703127 - RNA, 22 nt, Human
guagcuuaccagaagcuuccau

SEQ ID NO: 3703128 - RNA, 14 nt, Human
guagcuucagucau

SEQ ID NO: 3703129 - RNA, 14 nt, Human
guagcuugcucccu

SEQ ID NO: 3703130 - RNA, 19 nt, Human
guagcuugcucccuguguc

SEQ ID NO: 3703131 - RNA, 12 nt, Human
guagcuuugcuc

SEQ ID NO: 3703132 - RNA, 14 nt, Human
guaggaaaaaaaua

SEQ ID NO: 3703133 - RNA, 19 nt, Human
guaggaauauuauauuugg

SEQ ID NO: 3703134 - RNA, 21 nt, Human
guaggacaaggugcaggcagg

SEQ ID NO: 3703135 - RNA, 15 nt, Human
guaggacuguagaaa

SEQ ID NO: 3703136 - RNA, 20 nt, Human
guaggagacuguuuggaaau

SEQ ID NO: 3703137 - RNA, 22 nt, Human
guaggagcugccuuggcucaga

SEQ ID NO: 3703138 - RNA, 23 nt, Human
guaggagcugccuuggcucagac

SEQ ID NO: 3703139 - RNA, 14 nt, Human
guaggagguuugga

SEQ ID NO: 3703140 - RNA, 15 nt, Human
guaggaucuaaggcu

SEQ ID NO: 3703141 - RNA, 12 nt, Human
guaggcagacac

SEQ ID NO: 3703142 - RNA, 22 nt, Human
guaggcagacacagggacuuga

SEQ ID NO: 3703143 - RNA, 15 nt, Human
guaggcagagccuuu

SEQ ID NO: 3703144 - RNA, 18 nt, Human
guaggcaggauuggggaa

SEQ ID NO: 3703145 - RNA, 22 nt, Human
guaggccaagguguccuacaga

SEQ ID NO: 3703146 - RNA, 23 nt, Human
guaggccaagguguccuacagaa

SEQ ID NO: 3703147 - RNA, 19 nt, Human
guaggccuuuuaacauuuu

SEQ ID NO: 3703148 - RNA, 13 nt, Human
guaggcuacagag

SEQ ID NO: 3703149 - RNA, 12 nt, Human
ugagcccuggcu

SEQ ID NO: 3703150 - RNA, 13 nt, Human
ugagcccuggcug

SEQ ID NO: 3703151 - RNA, 19 nt, Human
ugagccgagaucacgccac

SEQ ID NO: 3703152 - RNA, 17 nt, Human
ugagccgcaucuucucc

SEQ ID NO: 3703153 - RNA, 23 nt, Human
ugagccgcaucuucuccaucugg

SEQ ID NO: 3703154 - RNA, 14 nt, Human
ugagccgcccaagg

SEQ ID NO: 3703155 - RNA, 17 nt, Human
ugagccgcccaaggccu

SEQ ID NO: 3703156 - RNA, 19 nt, Human
ugagccggucaggcacaca

SEQ ID NO: 3703157 - RNA, 19 nt, Human
ugagccgugaacugugcau

SEQ ID NO: 3703158 - RNA, 13 nt, Human
ugagccuaaaaau

SEQ ID NO: 3703159 - RNA, 14 nt, Human
ugagccucacagca

SEQ ID NO: 3703160 - RNA, 16 nt, Human
ugagccucacagcagu

SEQ ID NO: 3703161 - RNA, 15 nt, Human
ugagccucagcaucc

SEQ ID NO: 3703162 - RNA, 18 nt, Human
ugagccucagcauccugg

SEQ ID NO: 3703163 - RNA, 13 nt, Human
ugagccucucacc

SEQ ID NO: 3703164 - RNA, 15 nt, Human
ugagccucucaccug

SEQ ID NO: 3703165 - RNA, 16 nt, Human
ugagccucugcucccc

SEQ ID NO: 3703166 - RNA, 17 nt, Human
ugagccucugcucccca

SEQ ID NO: 3703167 - RNA, 15 nt, Human
ugagccugcagggaa

SEQ ID NO: 3703168 - RNA, 11 nt, Human
ugagccuggca

SEQ ID NO: 3703169 - RNA, 16 nt, Human
ugagccuggccagccu

SEQ ID NO: 3703170 - RNA, 17 nt, Human
ugagccuggcuggcaca

SEQ ID NO: 3703171 - RNA, 14 nt, Human
ugagccuucagucu

SEQ ID NO: 3703172 - RNA, 18 nt, Human
ugagccuucgugcccccc

SEQ ID NO: 3703173 - RNA, 19 nt, Human
ugagccuucgugccccccc

SEQ ID NO: 3703174 - RNA, 14 nt, Human
ugagccuugaacuu

SEQ ID NO: 3703175 - RNA, 18 nt, Human
ugagccuugaacuuugac

SEQ ID NO: 3703176 - RNA, 21 nt, Human
ugagcgaguggagucugccac

SEQ ID NO: 3703177 - RNA, 23 nt, Human
ugagcgaguggagucugccaccc

SEQ ID NO: 3703178 - RNA, 12 nt, Human
ugagcgccagga

SEQ ID NO: 3703179 - RNA, 18 nt, Human
ugagcgccugugcacaca

SEQ ID NO: 3703180 - RNA, 13 nt, Human
ugagcgcuugggc

SEQ ID NO: 3703181 - RNA, 13 nt, Human
ugagcgggaggca

SEQ ID NO: 3703182 - RNA, 14 nt, Human
ugagcgggaggcag

SEQ ID NO: 3703183 - RNA, 21 nt, Human
ugagcuaaauaaagauauugu

SEQ ID NO: 3703184 - RNA, 18 nt, Human
ugagcuacgccugccucc

SEQ ID NO: 3703185 - RNA, 22 nt, Human
ugagcuagaagcuggaggacua

SEQ ID NO: 3703186 - RNA, 16 nt, Human
ugagcuaggaagaguc

SEQ ID NO: 3703187 - RNA, 14 nt, Human
ugagcuauguauua

SEQ ID NO: 3703188 - RNA, 15 nt, Human
ugagcuauuaaaacu

SEQ ID NO: 3703189 - RNA, 15 nt, Human
ugagcuauuucaucu

SEQ ID NO: 3703190 - RNA, 19 nt, Human
ugagcucacaaggcagcaa

SEQ ID NO: 3703191 - RNA, 17 nt, Human
ugagcucagacccccac

SEQ ID NO: 3703192 - RNA, 18 nt, Human
ugagcucagacccccacu

SEQ ID NO: 3703193 - RNA, 20 nt, Human
ugagcucagacccccacucu

SEQ ID NO: 3703194 - RNA, 15 nt, Human
ugagcucauguagca

SEQ ID NO: 3703195 - RNA, 12 nt, Human
ugagcuccagac

SEQ ID NO: 3703196 - RNA, 14 nt, Human
ugagcuccagaccc

SEQ ID NO: 3703197 - RNA, 16 nt, Human
ugagcuccagaccccc

SEQ ID NO: 3703198 - RNA, 19 nt, Human
ugagcuccagacccccagc

SEQ ID NO: 3703199 - RNA, 20 nt, Human
ugagcuccagacccccagca

SEQ ID NO: 3703200 - RNA, 15 nt, Human
ugagcucccacaagc

SEQ ID NO: 3703201 - RNA, 21 nt, Human
ugagcucccacuucugccaga

SEQ ID NO: 3703202 - RNA, 21 nt, Human
ugagcucccaggugcagccag

SEQ ID NO: 3703203 - RNA, 23 nt, Human
ugagcucccaggugcagccagag

SEQ ID NO: 3703204 - RNA, 21 nt, Human
ugagcuccccaaaaaccucac

SEQ ID NO: 3703205 - RNA, 23 nt, Human
ugagcuccccaaaaaccucaccc

SEQ ID NO: 3703206 - RNA, 15 nt, Human
ugagcuccccaccac

SEQ ID NO: 3703207 - RNA, 22 nt, Human
ugagcuccccaccaccccagcu

SEQ ID NO: 3703208 - RNA, 23 nt, Human
ugagcuccccaccaccccagcug

SEQ ID NO: 3703209 - RNA, 13 nt, Human
ugagcuccucugg

SEQ ID NO: 3703210 - RNA, 14 nt, Human
ugagcuccucuggg

SEQ ID NO: 3703211 - RNA, 18 nt, Human
ugagcuccucugggcagg

SEQ ID NO: 3703212 - RNA, 21 nt, Human
ugagcuccuguccccugcuac

SEQ ID NO: 3703213 - RNA, 19 nt, Human
ugagcuccuuaaggcucuu

SEQ ID NO: 3703214 - RNA, 14 nt, Human
ugagcucgguggac

SEQ ID NO: 3703215 - RNA, 17 nt, Human
ugagcucuacccagggc

SEQ ID NO: 3703216 - RNA, 19 nt, Human
ugagcucuacccagggccu

SEQ ID NO: 3703217 - RNA, 12 nt, Human
ugagcucucugu

SEQ ID NO: 3703218 - RNA, 17 nt, Human
ugagcucugaaaucuuc

SEQ ID NO: 3703219 - RNA, 15 nt, Human
ugagcucugagaggc

SEQ ID NO: 3703220 - RNA, 17 nt, Human
ugagcucugagaggccc

SEQ ID NO: 3703221 - RNA, 19 nt, Human
ugagcucugagaggcccug

SEQ ID NO: 3703222 - RNA, 22 nt, Human
ugagcucugagaggcccuggau

SEQ ID NO: 3703223 - RNA, 23 nt, Human
ugagcucugagaggcccuggauc

SEQ ID NO: 3703224 - RNA, 23 nt, Human
ugagcucugcauuugucuauucu

SEQ ID NO: 3703225 - RNA, 12 nt, Human
ugagcucuucau

SEQ ID NO: 3703226 - RNA, 16 nt, Human
ugagcucuucauguuu

SEQ ID NO: 3703227 - RNA, 23 nt, Human
ugagcucuugugaggaaagucau

SEQ ID NO: 3703228 - RNA, 15 nt, Human
ugagcucuuugcacu

SEQ ID NO: 3703229 - RNA, 16 nt, Human
ugagcucuuugcacua

SEQ ID NO: 3703230 - RNA, 17 nt, Human
ugagcugaaaugcugca

SEQ ID NO: 3703231 - RNA, 18 nt, Human
ugagcugaaaugcugcau

SEQ ID NO: 3703232 - RNA, 18 nt, Human
ugagcugaaggugaaaca

SEQ ID NO: 3703233 - RNA, 15 nt, Human
ugagcugaccagccg

SEQ ID NO: 3703234 - RNA, 24 nt, Human
ugagcugaccagccgugagcaugu

SEQ ID NO: 3703235 - RNA, 19 nt, Human
ugagcugagaucgugccgu

SEQ ID NO: 3703236 - RNA, 13 nt, Human
ugagcugagcagg

SEQ ID NO: 3703237 - RNA, 14 nt, Human
ugagcugagcaggg

SEQ ID NO: 3703238 - RNA, 13 nt, Human
ugagcugagccag

SEQ ID NO: 3703239 - RNA, 14 nt, Human
ugagcugagccagg

SEQ ID NO: 3703240 - RNA, 15 nt, Human
ugagcugauauaaau

SEQ ID NO: 3703241 - RNA, 15 nt, Human
ugagcugcagaaacg

SEQ ID NO: 3703242 - RNA, 20 nt, Human
ugagcugccuguaacuugag

SEQ ID NO: 3703243 - RNA, 19 nt, Human
ugagcugcuuuuuuugaaa

SEQ ID NO: 3703244 - RNA, 12 nt, Human
ugagcuggaagg

SEQ ID NO: 3703245 - RNA, 21 nt, Human
ugagcuggaaggagugagagg

SEQ ID NO: 3703246 - RNA, 22 nt, Human
ugagcuggggaccugguacccu

SEQ ID NO: 3703247 - RNA, 20 nt, Human
ugagcugugcacaaaguggc

SEQ ID NO: 3703248 - RNA, 20 nt, Human
ugagcuuaaaauacaagacu

SEQ ID NO: 3703249 - RNA, 22 nt, Human
ugagcuuaaaauacaagacugc

SEQ ID NO: 3703250 - RNA, 15 nt, Human
ugagcuuaucaugcu

SEQ ID NO: 3703251 - RNA, 20 nt, Human
ugagcuuggcagcugaacua

SEQ ID NO: 3703252 - RNA, 16 nt, Human
ugagcuuggccagaag

SEQ ID NO: 3703253 - RNA, 12 nt, Human
ugagcuuuaaaa

SEQ ID NO: 3703254 - RNA, 22 nt, Human
ugagcuuucugaacagcuggug

SEQ ID NO: 3703255 - RNA, 23 nt, Human
ugagcuuugcauguuccacuaac

SEQ ID NO: 3703256 - RNA, 14 nt, Human
ugagcuuugcugcu

SEQ ID NO: 3703257 - RNA, 15 nt, Human
ugagcuuugcugcua

SEQ ID NO: 3703258 - RNA, 16 nt, Human
ugagcuuugcugcuac

SEQ ID NO: 3703259 - RNA, 23 nt, Human
ugagcuuuggacacacacagcuu

SEQ ID NO: 3703260 - RNA, 21 nt, Human
ugagcuuuggacgcacacagc

SEQ ID NO: 3703261 - RNA, 22 nt, Human
ugagcuuuggacgcacacagcu

SEQ ID NO: 3703262 - RNA, 23 nt, Human
ugagcuuuggacgcacacagcuu

SEQ ID NO: 3703263 - RNA, 15 nt, Human
ugaggaaaaauaugu

SEQ ID NO: 3703264 - RNA, 18 nt, Human
ugaggaaagcaagaauca

SEQ ID NO: 3703265 - RNA, 22 nt, Human
ugaggaaagucauuggcuuuau

SEQ ID NO: 3703266 - RNA, 15 nt, Human
ugaggaaaucaaagu

SEQ ID NO: 3703267 - RNA, 17 nt, Human
ugaggaacuguacagaa

SEQ ID NO: 3703268 - RNA, 19 nt, Human
ugaggaagaacggggcucu

SEQ ID NO: 3703269 - RNA, 23 nt, Human
ugaggaagaacggggcucuucuc

SEQ ID NO: 3703270 - RNA, 23 nt, Human
ugaggaagaugggggcaagaaga

SEQ ID NO: 3703271 - RNA, 15 nt, Human
ugaggaagcaaaagc

SEQ ID NO: 3703272 - RNA, 18 nt, Human
ugaggaagccgcuggggc

SEQ ID NO: 3703273 - RNA, 21 nt, Human
ugaggaagccgcuggggccag

SEQ ID NO: 3703274 - RNA, 23 nt, Human
ugaggaaggaggggaagcugcag

SEQ ID NO: 3703275 - RNA, 17 nt, Human
ugaggaauaauuauuua

SEQ ID NO: 3703276 - RNA, 22 nt, Human
ugaggaauccagacccggcugc

SEQ ID NO: 3703277 - RNA, 15 nt, Human
ugaggaauucuguau

SEQ ID NO: 3703278 - RNA, 16 nt, Human
ugaggaauucuguaua

SEQ ID NO: 3703279 - RNA, 22 nt, Human
ugaggaauuucaccuguaaacc

SEQ ID NO: 3703280 - RNA, 19 nt, Human
ugaggaauuucuguucuuc

SEQ ID NO: 3703281 - RNA, 13 nt, Human
ugaggaauuuucu

SEQ ID NO: 3703282 - RNA, 20 nt, Human
ugaggacaaauugagacagu

SEQ ID NO: 3703283 - RNA, 12 nt, Human
ugaggacacaug

SEQ ID NO: 3703284 - RNA, 15 nt, Human
ugaggacagcugucc

SEQ ID NO: 3703285 - RNA, 18 nt, Human
ugaggacagcuguccucu

SEQ ID NO: 3703286 - RNA, 21 nt, Human
ugaggacauguuuuuguuuuc

SEQ ID NO: 3703287 - RNA, 19 nt, Human
ugaggagcagcaggagggg

SEQ ID NO: 3703288 - RNA, 13 nt, Human
ugaggagcugcug

SEQ ID NO: 3703289 - RNA, 12 nt, Human
ugaggagcuggg

SEQ ID NO: 3703290 - RNA, 20 nt, Human
ugaggagcuggggaucccuc

SEQ ID NO: 3703291 - RNA, 13 nt, Human
ugaggaggaggcu

SEQ ID NO: 3703292 - RNA, 14 nt, Human
ugaggaggccucca

SEQ ID NO: 3703293 - RNA, 21 nt, Human
ugaggaggccuugggcucugc

SEQ ID NO: 3703294 - RNA, 16 nt, Human
ugaggaggggagggua

SEQ ID NO: 3703295 - RNA, 22 nt, Human
ugaggaggggaggguaaauaaa

SEQ ID NO: 3703296 - RNA, 20 nt, Human
ugaggagggugggggaggga

SEQ ID NO: 3703297 - RNA, 14 nt, Human
ugaggagucugagg

SEQ ID NO: 3703298 - RNA, 21 nt, Human
ugccaagggcuuuguuuugca

SEQ ID NO: 3703299 - RNA, 17 nt, Human
ugccaaguccagguccu

SEQ ID NO: 3703300 - RNA, 20 nt, Human
ugccaaguccagguccuggu

SEQ ID NO: 3703301 - RNA, 21 nt, Human
ugccaauauuaaaucugcugg

SEQ ID NO: 3703302 - RNA, 16 nt, Human
ugccaaucucaacacc

SEQ ID NO: 3703303 - RNA, 21 nt, Human
ugccaaugaggucugaaaugg

SEQ ID NO: 3703304 - RNA, 18 nt, Human
ugccaauggaaccuccuu

SEQ ID NO: 3703305 - RNA, 19 nt, Human
ugccaauggaaccuccuuu

SEQ ID NO: 3703306 - RNA, 18 nt, Human
ugccaaugggagcucaug

SEQ ID NO: 3703307 - RNA, 15 nt, Human
ugccaauuagcaauu

SEQ ID NO: 3703308 - RNA, 13 nt, Human
ugccaauuugcac

SEQ ID NO: 3703309 - RNA, 18 nt, Human
ugccaauuuuugccuuca

SEQ ID NO: 3703310 - RNA, 19 nt, Human
ugccaauuuuugccuucau

SEQ ID NO: 3703311 - RNA, 21 nt, Human
ugccaauuuuugccuucauua

SEQ ID NO: 3703312 - RNA, 18 nt, Human
ugccacaacgccuggcua

SEQ ID NO: 3703313 - RNA, 19 nt, Human
ugccacaaggacuuccugu

SEQ ID NO: 3703314 - RNA, 23 nt, Human
ugccacaaugcaguucugagcac

SEQ ID NO: 3703315 - RNA, 22 nt, Human
ugccacaccaagcugugccacc

SEQ ID NO: 3703316 - RNA, 21 nt, Human
ugccacaccccccaccccuag

SEQ ID NO: 3703317 - RNA, 14 nt, Human
ugccacacuucagg

SEQ ID NO: 3703318 - RNA, 22 nt, Human
ugccacacuucaggcucuucuc

SEQ ID NO: 3703319 - RNA, 17 nt, Human
ugccacagaguguagcc

SEQ ID NO: 3703320 - RNA, 18 nt, Human
ugccacagaguguagcca

SEQ ID NO: 3703321 - RNA, 21 nt, Human
ugccacagccuccccugccag

SEQ ID NO: 3703322 - RNA, 22 nt, Human
ugccacagccuccccugccagg

SEQ ID NO: 3703323 - RNA, 12 nt, Human
ugccacagcucu

SEQ ID NO: 3703324 - RNA, 13 nt, Human
ugccacaggacac

SEQ ID NO: 3703325 - RNA, 12 nt, Human
ugccacaggccu

SEQ ID NO: 3703326 - RNA, 14 nt, Human
ugccacaggccucc

SEQ ID NO: 3703327 - RNA, 20 nt, Human
ugccacaggcuuagggacag

SEQ ID NO: 3703328 - RNA, 17 nt, Human
ugccacaguauauuuuu

SEQ ID NO: 3703329 - RNA, 16 nt, Human
ugccacaucuuaaacu

SEQ ID NO: 3703330 - RNA, 15 nt, Human
ugccacauuagaacu

SEQ ID NO: 3703331 - RNA, 17 nt, Human
ugccacauuagaacuuc

SEQ ID NO: 3703332 - RNA, 22 nt, Human
ugccacauuuauuuuuauaucu

SEQ ID NO: 3703333 - RNA, 17 nt, Human
ugccaccaacuggcccu

SEQ ID NO: 3703334 - RNA, 19 nt, Human
ugccaccaacuggcccucu

SEQ ID NO: 3703335 - RNA, 20 nt, Human
ugccaccaacuggcccucuu

SEQ ID NO: 3703336 - RNA, 15 nt, Human
ugccaccaccucugu

SEQ ID NO: 3703337 - RNA, 16 nt, Human
ugcccgcacacccuca

SEQ ID NO: 3703338 - RNA, 18 nt, Human
ugauaacaaccuggagac

SEQ ID NO: 3703339 - RNA, 20 nt, Human
ugauaacaauguuuuaacaa

SEQ ID NO: 3703340 - RNA, 16 nt, Human
ugauaacagaacuuuu

SEQ ID NO: 3703341 - RNA, 23 nt, Human
ugauaacagcuaccaugacaacc

SEQ ID NO: 3703342 - RNA, 20 nt, Human
ugauaacagggauugauuuu

SEQ ID NO: 3703343 - RNA, 21 nt, Human
ugauaacagggauugauuuua

SEQ ID NO: 3703344 - RNA, 22 nt, Human
ugauaacagggauugauuuuaa

SEQ ID NO: 3703345 - RNA, 16 nt, Human
ugauaacuggaaacuu

SEQ ID NO: 3703346 - RNA, 15 nt, Human
ugauaacuuugcuug

SEQ ID NO: 3703347 - RNA, 20 nt, Human
ugauaagaaccuuuugagug

SEQ ID NO: 3703348 - RNA, 19 nt, Human
ugauaagagggcacacacu

SEQ ID NO: 3703349 - RNA, 22 nt, Human
ugauaagaucuuuuauuuugcc

SEQ ID NO: 3703350 - RNA, 18 nt, Human
ugauaagggaaaagauaa

SEQ ID NO: 3703351 - RNA, 19 nt, Human
ugauaagggacugauguuu

SEQ ID NO: 3703352 - RNA, 12 nt, Human
ugauaaguaaau

SEQ ID NO: 3703353 - RNA, 13 nt, Human
ugauaaguucaua

SEQ ID NO: 3703354 - RNA, 19 nt, Human
ugauaaguucauacauugu

SEQ ID NO: 3703355 - RNA, 14 nt, Human
ugauaauaaauuga

SEQ ID NO: 3703356 - RNA, 23 nt, Human
ugauaauaaauugaaauugugaa

SEQ ID NO: 3703357 - RNA, 16 nt, Human
ugauaauaauauuguu

SEQ ID NO: 3703358 - RNA, 17 nt, Human
ugauaauaauauuguuu

SEQ ID NO: 3703359 - RNA, 15 nt, Human
ugauaauagaagagu

SEQ ID NO: 3703360 - RNA, 14 nt, Human
ugauaauagauucu

SEQ ID NO: 3703361 - RNA, 17 nt, Human
ugauaauauauuguguu

SEQ ID NO: 3703362 - RNA, 20 nt, Human
ugauaaugaacagaacauag

SEQ ID NO: 3703363 - RNA, 14 nt, Human
ugauaauguuaaau

SEQ ID NO: 3703364 - RNA, 17 nt, Human
ugauaauguuaaauuug

SEQ ID NO: 3703365 - RNA, 18 nt, Human
ugauaauguuaaauuugu

SEQ ID NO: 3703366 - RNA, 16 nt, Human
ugauaauugcauucau

SEQ ID NO: 3703367 - RNA, 18 nt, Human
ugauaauuuaagagcuaa

SEQ ID NO: 3703368 - RNA, 13 nt, Human
ugauaauuuuaaa

SEQ ID NO: 3703369 - RNA, 21 nt, Human
ugauaauuuuccuuuaauaug

SEQ ID NO: 3703370 - RNA, 20 nt, Human
ugauacaaauugcagacugu

SEQ ID NO: 3703371 - RNA, 15 nt, Human
ugauacaaugcugug

SEQ ID NO: 3703372 - RNA, 17 nt, Human
ugauacauaacuaaauu

SEQ ID NO: 3703373 - RNA, 19 nt, Human
ugauacauaacuaaauuug

SEQ ID NO: 3703374 - RNA, 22 nt, Human
ugauacauaacuaaauuugaua

SEQ ID NO: 3703375 - RNA, 13 nt, Human
ugauacauuccca

SEQ ID NO: 3703376 - RNA, 18 nt, Human
ugauacauuuuuuaagcu

SEQ ID NO: 3703377 - RNA, 18 nt, Human
ugauaccagaagggaaag

SEQ ID NO: 3703378 - RNA, 21 nt, Human
ugauaccagaagggaaagcuu

SEQ ID NO: 3703379 - RNA, 13 nt, Human
ugauacccagagc

SEQ ID NO: 3703380 - RNA, 16 nt, Human
ugauaccccuggggaa

SEQ ID NO: 3703381 - RNA, 17 nt, Human
ugauacuaaaaguucuu

SEQ ID NO: 3703382 - RNA, 16 nt, Human
ugauacuaauaaacua

SEQ ID NO: 3703383 - RNA, 17 nt, Human
ugauacuacaguuuguu

SEQ ID NO: 3703384 - RNA, 18 nt, Human
ugauacuguugcacgugu

SEQ ID NO: 3703385 - RNA, 17 nt, Human
ugauacuucgacacugu

SEQ ID NO: 3703386 - RNA, 21 nt, Human
ugauacuucgacacuguucuu

SEQ ID NO: 3703387 - RNA, 21 nt, Human
ugauacuuuugacaacaaauu

SEQ ID NO: 3703388 - RNA, 21 nt, Human
ugauagaaggcuauggggaua

SEQ ID NO: 3703389 - RNA, 18 nt, Human
ugauagacaauugaggua

SEQ ID NO: 3703390 - RNA, 21 nt, Human
ugauagacacauaugaggggg

SEQ ID NO: 3703391 - RNA, 17 nt, Human
ugauagauuugaccucc

SEQ ID NO: 3703392 - RNA, 16 nt, Human
ugauagcacagacccu

SEQ ID NO: 3703393 - RNA, 18 nt, Human
ugauagcacagacccugc

SEQ ID NO: 3703394 - RNA, 20 nt, Human
ugauagcacagacccugccc

SEQ ID NO: 3703395 - RNA, 23 nt, Human
ugauagcacagacccugcccugu

SEQ ID NO: 3703396 - RNA, 15 nt, Human
ugauagcacuuucua

SEQ ID NO: 3703397 - RNA, 15 nt, Human
ugauagcauaugaca

SEQ ID NO: 3703398 - RNA, 23 nt, Human
ugauagcauaugacaaauguuuc

SEQ ID NO: 3703399 - RNA, 16 nt, Human
ugauagcauuguaagc

SEQ ID NO: 3703400 - RNA, 16 nt, Human
ugauagcguuggaauu

SEQ ID NO: 3703401 - RNA, 21 nt, Human
ugauagcuaacauuuuaaaua

SEQ ID NO: 3703402 - RNA, 22 nt, Human
ugauagcucuuuggcagucuau

SEQ ID NO: 3703403 - RNA, 14 nt, Human
ugauagcuuuauuu

SEQ ID NO: 3703404 - RNA, 22 nt, Human
ugauaggaagaggggaagcaga

SEQ ID NO: 3703405 - RNA, 21 nt, Human
ugauaggaaugugaaagcacg

SEQ ID NO: 3703406 - RNA, 17 nt, Human
ugauagggauacaugcu

SEQ ID NO: 3703407 - RNA, 19 nt, Human
ugauaggguuugugacagg

SEQ ID NO: 3703408 - RNA, 17 nt, Human
ugauaguuacuguugug

SEQ ID NO: 3703409 - RNA, 14 nt, Human
ugauaguugugugu

SEQ ID NO: 3703410 - RNA, 14 nt, Human
ugauauaaauaaaa

SEQ ID NO: 3703411 - RNA, 19 nt, Human
ugauauaaaucagauucuu

SEQ ID NO: 3703412 - RNA, 13 nt, Human
ugauauaaaugca

SEQ ID NO: 3703413 - RNA, 16 nt, Human
ugauauaacuuuagaa

SEQ ID NO: 3703414 - RNA, 15 nt, Human
ugauauaccaaauua

SEQ ID NO: 3703415 - RNA, 16 nt, Human
ugauauaccaaauuaa

SEQ ID NO: 3703416 - RNA, 22 nt, Human
ugauauagaacagugcuugcca

SEQ ID NO: 3703417 - RNA, 21 nt, Human
ugauauaucucaaauuguaau

SEQ ID NO: 3703418 - RNA, 13 nt, Human
ugauauauuuuac

SEQ ID NO: 3703419 - RNA, 14 nt, Human
ugauauauuuucca

SEQ ID NO: 3703420 - RNA, 19 nt, Human
ugauaucacagucuaauuu

SEQ ID NO: 3703421 - RNA, 21 nt, Human
ugauauccauucuuucugaua

SEQ ID NO: 3703422 - RNA, 17 nt, Human
ugauaucuauaaaauag

SEQ ID NO: 3703423 - RNA, 15 nt, Human
ugauaugaaaaauau

SEQ ID NO: 3703424 - RNA, 12 nt, Human
ugauaugaguau

SEQ ID NO: 3703425 - RNA, 18 nt, Human
ugauaugaguauacaaua

SEQ ID NO: 3703426 - RNA, 15 nt, Human
ugauaugauuuaaaa

SEQ ID NO: 3703427 - RNA, 15 nt, Human
ugauaugcacaaugu

SEQ ID NO: 3703428 - RNA, 18 nt, Human
ugauaugcauauuuguuu

SEQ ID NO: 3703429 - RNA, 19 nt, Human
ugauaugcauuuccugcug

SEQ ID NO: 3703430 - RNA, 17 nt, Human
ugauauggcagaagaca

SEQ ID NO: 3703431 - RNA, 20 nt, Human
ugauauggcagaagacacca

SEQ ID NO: 3703432 - RNA, 14 nt, Human
ugauaugggacuga

SEQ ID NO: 3703433 - RNA, 18 nt, Human
ugauauggguaguauuuu

SEQ ID NO: 3703434 - RNA, 21 nt, Human
ugauauguaaacauaauucuu

SEQ ID NO: 3703435 - RNA, 15 nt, Human
ugauauguauuguuu

SEQ ID NO: 3703436 - RNA, 16 nt, Human
ugauaugugaacaguu

SEQ ID NO: 3703437 - RNA, 19 nt, Human
ugauauguugguagauucu

SEQ ID NO: 3703438 - RNA, 16 nt, Human
ugauauuaaaggaguu

SEQ ID NO: 3703439 - RNA, 23 nt, Human
ugauauuaaaggaguuaagagua

SEQ ID NO: 3703440 - RNA, 20 nt, Human
ugauauucaaauggacaaac

SEQ ID NO: 3703441 - RNA, 16 nt, Human
ugauauuccaugaaug

SEQ ID NO: 3703442 - RNA, 20 nt, Human
ugauauuccaugaauguauc

SEQ ID NO: 3703443 - RNA, 21 nt, Human
ugauauuccccccacuuaaga

SEQ ID NO: 3703444 - RNA, 13 nt, Human
ugauauugugaac

SEQ ID NO: 3703445 - RNA, 13 nt, Human
ugauauuucagaa

SEQ ID NO: 3703446 - RNA, 14 nt, Human
ugauauuucucuag

SEQ ID NO: 3703447 - RNA, 15 nt, Human
ugauauuuguauuua

SEQ ID NO: 3703448 - RNA, 21 nt, Human
ugauauuuguauuuauucuuu

SEQ ID NO: 3703449 - RNA, 13 nt, Human
ugauauuuuaaaa

SEQ ID NO: 3703450 - RNA, 21 nt, Human
ugauauuuucaacgcagcccu

SEQ ID NO: 3703451 - RNA, 23 nt, Human
ugauauuuucaacgcagcccugc

SEQ ID NO: 3703452 - RNA, 15 nt, Human
ugauauuuucucuag

SEQ ID NO: 3703453 - RNA, 15 nt, Human
ugauauuuuuuuaag

SEQ ID NO: 3703454 - RNA, 20 nt, Human
ugauauuuuuuuaagucuuu

SEQ ID NO: 3703455 - RNA, 17 nt, Human
ugaucaaaaauaaugca

SEQ ID NO: 3703456 - RNA, 19 nt, Human
ugaucaaaaucaauuaaaa

SEQ ID NO: 3703457 - RNA, 15 nt, Human
ugaucaaauguuuaa

SEQ ID NO: 3703458 - RNA, 17 nt, Human
ugaucaaauguuuaauc

SEQ ID NO: 3703459 - RNA, 22 nt, Human
ugaucaaauguuuaaucauaua

SEQ ID NO: 3703460 - RNA, 15 nt, Human
ugaucaaauucauuu

SEQ ID NO: 3703461 - RNA, 22 nt, Human
ugaucaaauucauuuuuuucac

SEQ ID NO: 3703462 - RNA, 14 nt, Human
ugaucaacaucuuu

SEQ ID NO: 3703463 - RNA, 12 nt, Human
ugaucaaggccu

SEQ ID NO: 3703464 - RNA, 15 nt, Human
ugaucaauaaaaugu

SEQ ID NO: 3703465 - RNA, 16 nt, Human
ugaucaauaaaaugug

SEQ ID NO: 3703466 - RNA, 18 nt, Human
ugaucaauaaaaugugau

SEQ ID NO: 3703467 - RNA, 19 nt, Human
ugaucaaugacagagccuu

SEQ ID NO: 3703468 - RNA, 16 nt, Human
ugaucaauuaaaugua

SEQ ID NO: 3703469 - RNA, 22 nt, Human
ugaucaauuauaguuucugagg

SEQ ID NO: 3703470 - RNA, 16 nt, Human
ugaucacacuauuuua

SEQ ID NO: 3703471 - RNA, 15 nt, Human
ugaucacacucuggg

SEQ ID NO: 3703472 - RNA, 17 nt, Human
ugaucaccgacugaaaa

SEQ ID NO: 3703473 - RNA, 14 nt, Human
ugaucacgccuggc

SEQ ID NO: 3703474 - RNA, 15 nt, Human
ugaucacgccuggcu

SEQ ID NO: 3703475 - RNA, 18 nt, Human
ugaucacggcucacugca

SEQ ID NO: 3703476 - RNA, 21 nt, Human
ugaucacggcucacugcagcc

SEQ ID NO: 3703477 - RNA, 22 nt, Human
ugaucacggcucacugcagccu

SEQ ID NO: 3703478 - RNA, 14 nt, Human
ugaucacugaaaua

SEQ ID NO: 3703479 - RNA, 21 nt, Human
ugaucagaccaaacagugcug

SEQ ID NO: 3703480 - RNA, 22 nt, Human
ugaucagagccgugguccuuug

SEQ ID NO: 3703481 - RNA, 23 nt, Human
ugaucagagccgugguccuuugg

SEQ ID NO: 3703482 - RNA, 17 nt, Human
ugaucagcuguuuguca

SEQ ID NO: 3703483 - RNA, 20 nt, Human
ugaucaggaccuccaagcca

SEQ ID NO: 3703484 - RNA, 22 nt, Human
ugaucaguaguuugcauuucag

SEQ ID NO: 3703485 - RNA, 20 nt, Human
ugaucaguuaagaaauuuca

SEQ ID NO: 3703486 - RNA, 21 nt, Human
ugaucaguuuuuucaccugga

SEQ ID NO: 3703487 - RNA, 22 nt, Human
ugcccgcacacccucacucugc

SEQ ID NO: 3703488 - RNA, 15 nt, Human
ugcccgcacagcagc

SEQ ID NO: 3703489 - RNA, 17 nt, Human
ugcccgcacagcagccu

SEQ ID NO: 3703490 - RNA, 20 nt, Human
ugcccgcacagcagccugcu

SEQ ID NO: 3703491 - RNA, 12 nt, Human
ugcccgccugcc

SEQ ID NO: 3703492 - RNA, 14 nt, Human
ugcccgccugccca

SEQ ID NO: 3703493 - RNA, 23 nt, Human
ugcccggagauuggacggccuga

SEQ ID NO: 3703494 - RNA, 22 nt, Human
ugcccggauucugggaggaagc

SEQ ID NO: 3703495 - RNA, 15 nt, Human
ugcccggcgcccucu

SEQ ID NO: 3703496 - RNA, 16 nt, Human
ugcccggcgcccucug

SEQ ID NO: 3703497 - RNA, 18 nt, Human
ugcccggcgcccucuguc

SEQ ID NO: 3703498 - RNA, 12 nt, Human
ugcccggcugcg

SEQ ID NO: 3703499 - RNA, 21 nt, Human
ugcccgggaaggucaccagca

SEQ ID NO: 3703500 - RNA, 17 nt, Human
ugcccgggagcucagga

SEQ ID NO: 3703501 - RNA, 19 nt, Human
ugcccgggcgcggccagcc

SEQ ID NO: 3703502 - RNA, 18 nt, Human
ugcccggggaaaggcaag

SEQ ID NO: 3703503 - RNA, 22 nt, Human
ugcccggggcagcagcagcccu

SEQ ID NO: 3703504 - RNA, 23 nt, Human
ugcccggggcagcugccagagaa

SEQ ID NO: 3703505 - RNA, 18 nt, Human
ugcccgucucucucccau

SEQ ID NO: 3703506 - RNA, 14 nt, Human
ugcccguguacaua

SEQ ID NO: 3703507 - RNA, 20 nt, Human
ugcccuaaaguguauuuuuu

SEQ ID NO: 3703508 - RNA, 15 nt, Human
ugcccuaauaaaaag

SEQ ID NO: 3703509 - RNA, 22 nt, Human
ugcccuacagcacccugugguc

SEQ ID NO: 3703510 - RNA, 17 nt, Human
ugcccuagagcacacug

SEQ ID NO: 3703511 - RNA, 14 nt, Human
ugcccuaggcuccg

SEQ ID NO: 3703512 - RNA, 18 nt, Human
ugcccuaggcuccgucag

SEQ ID NO: 3703513 - RNA, 19 nt, Human
ugcccuaucacccaacgcu

SEQ ID NO: 3703514 - RNA, 15 nt, Human
ugcccuaugggccug

SEQ ID NO: 3703515 - RNA, 17 nt, Human
ugcccucauggccccuc

SEQ ID NO: 3703516 - RNA, 19 nt, Human
ugcccucauggccccucug

SEQ ID NO: 3703517 - RNA, 23 nt, Human
ugcccucauggccccucugaccu

SEQ ID NO: 3703518 - RNA, 19 nt, Human
ugcccuccaagaccuucuc

SEQ ID NO: 3703519 - RNA, 20 nt, Human
ugcccuccaagaccuucucc

SEQ ID NO: 3703520 - RNA, 17 nt, Human
ugcccuccacugcccuc

SEQ ID NO: 3703521 - RNA, 18 nt, Human
ugcccuccacugcccucu

SEQ ID NO: 3703522 - RNA, 21 nt, Human
ugcccuccacugcccucuguu

SEQ ID NO: 3703523 - RNA, 18 nt, Human
ugcccuccagcucuuucc

SEQ ID NO: 3703524 - RNA, 19 nt, Human
ugcccuccagcucuuuccu

SEQ ID NO: 3703525 - RNA, 15 nt, Human
ugcccucccaucccg

SEQ ID NO: 3703526 - RNA, 22 nt, Human
ugcccucccccuccucuccacc

SEQ ID NO: 3703527 - RNA, 21 nt, Human
ugcccuccccucucugcaccg

SEQ ID NO: 3703528 - RNA, 15 nt, Human
ugcccuccucuccca

SEQ ID NO: 3703529 - RNA, 20 nt, Human
ugcccuccugugcucagccc

SEQ ID NO: 3703530 - RNA, 22 nt, Human
ugcccuccuuguccacccaccu

SEQ ID NO: 3703531 - RNA, 13 nt, Human
ugcccucgcugcu

SEQ ID NO: 3703532 - RNA, 14 nt, Human
ugcccucgcugcuu

SEQ ID NO: 3703533 - RNA, 17 nt, Human
ugcccucgcugcuucug

SEQ ID NO: 3703534 - RNA, 20 nt, Human
ugcccucguggccagcccgg

SEQ ID NO: 3703535 - RNA, 12 nt, Human
ugcccucuccca

SEQ ID NO: 3703536 - RNA, 15 nt, Human
ugcccucucccaccc

SEQ ID NO: 3703537 - RNA, 16 nt, Human
ugcccucuccccucag

SEQ ID NO: 3703538 - RNA, 16 nt, Human
ugcccucuccugggca

SEQ ID NO: 3703539 - RNA, 18 nt, Human
ugcccucuccugggcagc

SEQ ID NO: 3703540 - RNA, 14 nt, Human
ugcccucugggcuc

SEQ ID NO: 3703541 - RNA, 15 nt, Human
ugcccucugggcucu

SEQ ID NO: 3703542 - RNA, 17 nt, Human
ugcccucugggcucuga

SEQ ID NO: 3703543 - RNA, 19 nt, Human
ugcccugaccaugcauuuu

SEQ ID NO: 3703544 - RNA, 12 nt, Human
ugcccugaccuc

SEQ ID NO: 3703545 - RNA, 13 nt, Human
ugcccugaccucc

SEQ ID NO: 3703546 - RNA, 15 nt, Human
ugcccugaccuccca

SEQ ID NO: 3703547 - RNA, 11 nt, Human
ugcccugagaa

SEQ ID NO: 3703548 - RNA, 15 nt, Human
ugcccugccaccugu

SEQ ID NO: 3703549 - RNA, 14 nt, Human
ugcccugcccaccu

SEQ ID NO: 3703550 - RNA, 15 nt, Human
ugcccugcccaccug

SEQ ID NO: 3703551 - RNA, 16 nt, Human
ugcccugcccaccugg

SEQ ID NO: 3703552 - RNA, 20 nt, Human
ugcccugcccaccuggccuc

SEQ ID NO: 3703553 - RNA, 16 nt, Human
ugcccugcccccacga

SEQ ID NO: 3703554 - RNA, 16 nt, Human
ugcccugcccuagcuc

SEQ ID NO: 3703555 - RNA, 12 nt, Human
ugcccugccuga

SEQ ID NO: 3703556 - RNA, 19 nt, Human
ugcccugcgggucacagga

SEQ ID NO: 3703557 - RNA, 13 nt, Human
ugcccugcucccu

SEQ ID NO: 3703558 - RNA, 21 nt, Human
ugcccugcugccgccucccag

SEQ ID NO: 3703559 - RNA, 14 nt, Human
ugcccugcuguuua

SEQ ID NO: 3703560 - RNA, 16 nt, Human
ugcccugcuuucagau

SEQ ID NO: 3703561 - RNA, 18 nt, Human
ugcccuggaugcccagga

SEQ ID NO: 3703562 - RNA, 16 nt, Human
ugcccuggcccugagg

SEQ ID NO: 3703563 - RNA, 17 nt, Human
ugcccuggcccugaggu

SEQ ID NO: 3703564 - RNA, 12 nt, Human
ugcccuggcugc

SEQ ID NO: 3703565 - RNA, 14 nt, Human
ugcccuggcugcug

SEQ ID NO: 3703566 - RNA, 15 nt, Human
ugcccuggcugcugc

SEQ ID NO: 3703567 - RNA, 16 nt, Human
ugcccuggcugcugcc

SEQ ID NO: 3703568 - RNA, 21 nt, Human
ugcccuggggcugaucucagg

SEQ ID NO: 3703569 - RNA, 22 nt, Human
ugcccuggggcugaucucaggg

SEQ ID NO: 3703570 - RNA, 17 nt, Human
ugcccugguagggcagu

SEQ ID NO: 3703571 - RNA, 17 nt, Human
ugcccuggugcugccac

SEQ ID NO: 3703572 - RNA, 15 nt, Human
ugcccugguggagaa

SEQ ID NO: 3703573 - RNA, 23 nt, Human
ugcccugguggagaaagcacuga

SEQ ID NO: 3703574 - RNA, 17 nt, Human
ugcccugguuucacugg

SEQ ID NO: 3703575 - RNA, 15 nt, Human
ugcccugguuuccug

SEQ ID NO: 3703576 - RNA, 12 nt, Human
ugcccugugcaa

SEQ ID NO: 3703577 - RNA, 18 nt, Human
ugcccugugggcccccaa

SEQ ID NO: 3703578 - RNA, 17 nt, Human
ugcccuguucucuacca

SEQ ID NO: 3703579 - RNA, 19 nt, Human
ugcccuguucucuaccaag

SEQ ID NO: 3703580 - RNA, 19 nt, Human
ugcccuguuguguauagau

SEQ ID NO: 3703581 - RNA, 18 nt, Human
ugcccuuacacuuacugu

SEQ ID NO: 3703582 - RNA, 15 nt, Human
ugcccuucaccccag

SEQ ID NO: 3703583 - RNA, 20 nt, Human
ugcccuucaccccaguggcc

SEQ ID NO: 3703584 - RNA, 16 nt, Human
ugcccuucccuguccc

SEQ ID NO: 3703585 - RNA, 17 nt, Human
ugcccuucccugucccu

SEQ ID NO: 3703586 - RNA, 20 nt, Human
ugcccuucccugucccucua

SEQ ID NO: 3703587 - RNA, 14 nt, Human
ugcccuucuuucua

SEQ ID NO: 3703588 - RNA, 13 nt, Human
ugcccuugucuga

SEQ ID NO: 3703589 - RNA, 21 nt, Human
ugcccuuuacuugucuuucug

SEQ ID NO: 3703590 - RNA, 19 nt, Human
ugcccuuuguccuccugcu

SEQ ID NO: 3703591 - RNA, 17 nt, Human
ugcccuuuuuucugccu

SEQ ID NO: 3703592 - RNA, 18 nt, Human
ugcccuuuuuucugccuc

SEQ ID NO: 3703593 - RNA, 20 nt, Human
ugcccuuuuuucugccuccu

SEQ ID NO: 3703594 - RNA, 13 nt, Human
ugccgaaacugga

SEQ ID NO: 3703595 - RNA, 16 nt, Human
ugccgaaacuggaagu

SEQ ID NO: 3703596 - RNA, 13 nt, Human
ugccgaaccagga

SEQ ID NO: 3703597 - RNA, 15 nt, Human
ugccgacagaaggaa

SEQ ID NO: 3703598 - RNA, 21 nt, Human
ugccgaccagagccccacacg

SEQ ID NO: 3703599 - RNA, 16 nt, Human
ugccgaccgaggcugg

SEQ ID NO: 3703600 - RNA, 21 nt, Human
ugccgaccucguccucccccu

SEQ ID NO: 3703601 - RNA, 22 nt, Human
ugccgagaguccaucagccucc

SEQ ID NO: 3703602 - RNA, 19 nt, Human
ugccgagcaaccguggccc

SEQ ID NO: 3703603 - RNA, 21 nt, Human
ugccgagcaaccguggcccuu

SEQ ID NO: 3703604 - RNA, 18 nt, Human
ugccgauuucuguaaacu

SEQ ID NO: 3703605 - RNA, 12 nt, Human
ugccgcagcccu

SEQ ID NO: 3703606 - RNA, 14 nt, Human
ugccgcagcccugc

SEQ ID NO: 3703607 - RNA, 16 nt, Human
ugccgccucaaugugg

SEQ ID NO: 3703608 - RNA, 13 nt, Human
ugccgccucccag

SEQ ID NO: 3703609 - RNA, 17 nt, Human
ugccgccucccagccug

SEQ ID NO: 3703610 - RNA, 18 nt, Human
ugccgccucccagccugg

SEQ ID NO: 3703611 - RNA, 10 nt, Human
ugccgccugc

SEQ ID NO: 3703612 - RNA, 16 nt, Human
ugccgccugcacuccu

SEQ ID NO: 3703613 - RNA, 16 nt, Human
ugccgcgaugggucag

SEQ ID NO: 3703614 - RNA, 20 nt, Human
ugccgcgucgcccucccagg

SEQ ID NO: 3703615 - RNA, 13 nt, Human
ugccgcugauguu

SEQ ID NO: 3703616 - RNA, 22 nt, Human
ugccgcugauguuuggccguga

SEQ ID NO: 3703617 - RNA, 15 nt, Human
ugccggagaggaaga

SEQ ID NO: 3703618 - RNA, 20 nt, Human
ugccggcucuuuccuugcuc

SEQ ID NO: 3703619 - RNA, 22 nt, Human
ugccgggcugagggccugcugg

SEQ ID NO: 3703620 - RNA, 20 nt, Human
ugccgguaaacacgccugca

SEQ ID NO: 3703621 - RNA, 16 nt, Human
ugccggugagaauaag

SEQ ID NO: 3703622 - RNA, 19 nt, Human
ugccgucagugcugugcug

SEQ ID NO: 3703623 - RNA, 12 nt, Human
ugccgucucugg

SEQ ID NO: 3703624 - RNA, 13 nt, Human
ugccgucucugga

SEQ ID NO: 3703625 - RNA, 23 nt, Human
ugccguggggccgccgccucuuu

SEQ ID NO: 3703626 - RNA, 20 nt, Human
ugccgugugagugugacagg

SEQ ID NO: 3703627 - RNA, 22 nt, Human
ugccguuacuuuucauauuugc

SEQ ID NO: 3703628 - RNA, 20 nt, Human
ugccuaaauaaguuauaaag

SEQ ID NO: 3703629 - RNA, 15 nt, Human
ugccuaaauccauuu

SEQ ID NO: 3703630 - RNA, 22 nt, Human
ugccuaaauccauuuggaaauc

SEQ ID NO: 3703631 - RNA, 21 nt, Human
ugccuaaauuuaaugcugccu

SEQ ID NO: 3703632 - RNA, 14 nt, Human
ugccuaacaccagc

SEQ ID NO: 3703633 - RNA, 13 nt, Human
ugccuaagacaug

SEQ ID NO: 3703634 - RNA, 14 nt, Human
ugccuaaggacuuc

SEQ ID NO: 3703635 - RNA, 16 nt, Human
ugccuaaggacuucuu

SEQ ID NO: 3703636 - RNA, 23 nt, Human
ugccuaaggacuucuuuaauuuu

SEQ ID NO: 3703637 - RNA, 14 nt, Human
gucaacuacacaaa

SEQ ID NO: 3703638 - RNA, 17 nt, Human
gucaacuugagcauguu

SEQ ID NO: 3703639 - RNA, 21 nt, Human
gucaagaauagcauuguaaaa

SEQ ID NO: 3703640 - RNA, 19 nt, Human
gucaagauucagcuagugg

SEQ ID NO: 3703641 - RNA, 14 nt, Human
gucaagauuuugaa

SEQ ID NO: 3703642 - RNA, 16 nt, Human
gucaagcauguauuuu

SEQ ID NO: 3703643 - RNA, 14 nt, Human
gucaagcccaggag

SEQ ID NO: 3703644 - RNA, 17 nt, Human
gucaagcuccuccuccc

SEQ ID NO: 3703645 - RNA, 20 nt, Human
gucaagcuccuccucccugc

SEQ ID NO: 3703646 - RNA, 13 nt, Human
gucaagcugcucu

SEQ ID NO: 3703647 - RNA, 14 nt, Human
gucaagcugcucug

SEQ ID NO: 3703648 - RNA, 17 nt, Human
gucaagcugcucugagc

SEQ ID NO: 3703649 - RNA, 18 nt, Human
gucaagcugcucugagcc

SEQ ID NO: 3703650 - RNA, 19 nt, Human
gucaagcugcucugagcca

SEQ ID NO: 3703651 - RNA, 14 nt, Human
gucaagcugcuugg

SEQ ID NO: 3703652 - RNA, 12 nt, Human
gucaaggccagc

SEQ ID NO: 3703653 - RNA, 16 nt, Human
gucaaggccugcuccc

SEQ ID NO: 3703654 - RNA, 20 nt, Human
gucaaggcuuagacccucau

SEQ ID NO: 3703655 - RNA, 21 nt, Human
gucaagggcagcuuugcucau

SEQ ID NO: 3703656 - RNA, 22 nt, Human
gucaagggcugucauugcacau

SEQ ID NO: 3703657 - RNA, 20 nt, Human
gucaagggcuuacuauuucu

SEQ ID NO: 3703658 - RNA, 22 nt, Human
gucaaguggcaaagcuguucuu

SEQ ID NO: 3703659 - RNA, 11 nt, Human
gucaaguuauu

SEQ ID NO: 3703660 - RNA, 17 nt, Human
gucaaguugugcuuguu

SEQ ID NO: 3703661 - RNA, 15 nt, Human
gucaauaaaauccau

SEQ ID NO: 3703662 - RNA, 17 nt, Human
gucaauaaacaacagcu

SEQ ID NO: 3703663 - RNA, 20 nt, Human
gucaauaaacaacagcugaa

SEQ ID NO: 3703664 - RNA, 14 nt, Human
gucaauauuaaaua

SEQ ID NO: 3703665 - RNA, 17 nt, Human
gucaauauuaaauacag

SEQ ID NO: 3703666 - RNA, 20 nt, Human
gucaauauuaaauacagaca

SEQ ID NO: 3703667 - RNA, 17 nt, Human
gucaaucccaaaaguca

SEQ ID NO: 3703668 - RNA, 18 nt, Human
gucaaugaacaagcauuc

SEQ ID NO: 3703669 - RNA, 15 nt, Human
gucaaugcagccccc

SEQ ID NO: 3703670 - RNA, 13 nt, Human
gucaauggcuugu

SEQ ID NO: 3703671 - RNA, 21 nt, Human
gucaauggcuuguucaucauc

SEQ ID NO: 3703672 - RNA, 22 nt, Human
gucaauuacaggaaguacugga

SEQ ID NO: 3703673 - RNA, 20 nt, Human
gucaauuaccagaaagauaa

SEQ ID NO: 3703674 - RNA, 17 nt, Human
gucacaaagaauuuaaa

SEQ ID NO: 3703675 - RNA, 17 nt, Human
gucacaagagcccagca

SEQ ID NO: 3703676 - RNA, 21 nt, Human
gucacaagccucgaggugccu

SEQ ID NO: 3703677 - RNA, 11 nt, Human
gucacaauaaa

SEQ ID NO: 3703678 - RNA, 19 nt, Human
gucacacauuacaaaguua

SEQ ID NO: 3703679 - RNA, 18 nt, Human
gucacacgcuuuugaauu

SEQ ID NO: 3703680 - RNA, 21 nt, Human
gucacagccuccucugucugc

SEQ ID NO: 3703681 - RNA, 12 nt, Human
gucacagcugua

SEQ ID NO: 3703682 - RNA, 13 nt, Human
gucacaggaagua

SEQ ID NO: 3703683 - RNA, 17 nt, Human
gucacaggacucugccu

SEQ ID NO: 3703684 - RNA, 18 nt, Human
gucacaggacucugccuc

SEQ ID NO: 3703685 - RNA, 12 nt, Human
gucacaggcagg

SEQ ID NO: 3703686 - RNA, 13 nt, Human
gucacaggcaggu

SEQ ID NO: 3703687 - RNA, 11 nt, Human
gucacagggca

SEQ ID NO: 3703688 - RNA, 17 nt, Human
gucacagggcaguaccu

SEQ ID NO: 3703689 - RNA, 13 nt, Human
gucacagggccaa

SEQ ID NO: 3703690 - RNA, 15 nt, Human
gucacagggccaacu

SEQ ID NO: 3703691 - RNA, 14 nt, Human
gucacauaaaacuu

SEQ ID NO: 3703692 - RNA, 14 nt, Human
gucacauacaauua

SEQ ID NO: 3703693 - RNA, 15 nt, Human
gucacaucacaggac

SEQ ID NO: 3703694 - RNA, 17 nt, Human
gucacaucagauaagac

SEQ ID NO: 3703695 - RNA, 21 nt, Human
gucacauggccuaugcacaua

SEQ ID NO: 3703696 - RNA, 23 nt, Human
gucacauggccuaugcacauaug

SEQ ID NO: 3703697 - RNA, 14 nt, Human
gucacauucaggaa

SEQ ID NO: 3703698 - RNA, 17 nt, Human
gucacauugcauucuau

SEQ ID NO: 3703699 - RNA, 18 nt, Human
gucacauugcauucuauu

SEQ ID NO: 3703700 - RNA, 21 nt, Human
gucacauugcauucuauugcc

SEQ ID NO: 3703701 - RNA, 22 nt, Human
gucaccaaaucagcugcuacua

SEQ ID NO: 3703702 - RNA, 17 nt, Human
gucaccaagcucacagu

SEQ ID NO: 3703703 - RNA, 14 nt, Human
gucaccaaggaaac

SEQ ID NO: 3703704 - RNA, 20 nt, Human
gucaccaccaccccuaccac

SEQ ID NO: 3703705 - RNA, 16 nt, Human
gucaccaccuucccag

SEQ ID NO: 3703706 - RNA, 22 nt, Human
gucaccaccuucccagcucucc

SEQ ID NO: 3703707 - RNA, 21 nt, Human
gucaccacgacuggccagggc

SEQ ID NO: 3703708 - RNA, 17 nt, Human
gucaccagacggggcug

SEQ ID NO: 3703709 - RNA, 14 nt, Human
gucaccagcuccuc

SEQ ID NO: 3703710 - RNA, 23 nt, Human
gucaccaggaauguuaaagucag

SEQ ID NO: 3703711 - RNA, 13 nt, Human
gucaccagguacu

SEQ ID NO: 3703712 - RNA, 16 nt, Human
gucaccaucucaggcc

SEQ ID NO: 3703713 - RNA, 17 nt, Human
gucaccaucucaggcca

SEQ ID NO: 3703714 - RNA, 20 nt, Human
gucaccaucucaggccaccu

SEQ ID NO: 3703715 - RNA, 23 nt, Human
gucaccaucuuaagagaugccuc

SEQ ID NO: 3703716 - RNA, 20 nt, Human
gucacccaggcuggacugca

SEQ ID NO: 3703717 - RNA, 16 nt, Human
gucaccccaaguaguc

SEQ ID NO: 3703718 - RNA, 20 nt, Human
gucaccccagagccacacau

SEQ ID NO: 3703719 - RNA, 15 nt, Human
gucaccccggccacc

SEQ ID NO: 3703720 - RNA, 17 nt, Human
gucaccccggccaccug

SEQ ID NO: 3703721 - RNA, 20 nt, Human
gucacccuagcccucucccu

SEQ ID NO: 3703722 - RNA, 16 nt, Human
gucacccuccaccucu

SEQ ID NO: 3703723 - RNA, 16 nt, Human
gucaccggauccuggg

SEQ ID NO: 3703724 - RNA, 21 nt, Human
gucaccguggaccuuccugcc

SEQ ID NO: 3703725 - RNA, 16 nt, Human
gucaccuagcaagcug

SEQ ID NO: 3703726 - RNA, 23 nt, Human
gucaccugcccagaucccagaag

SEQ ID NO: 3703727 - RNA, 13 nt, Human
gucaccugugcuu

SEQ ID NO: 3703728 - RNA, 19 nt, Human
gucaccuuccaggaccccu

SEQ ID NO: 3703729 - RNA, 17 nt, Human
gucaccuuuuaaauccu

SEQ ID NO: 3703730 - RNA, 23 nt, Human
gucacggagggugacggggguga

SEQ ID NO: 3703731 - RNA, 16 nt, Human
gucacguacugucuga

SEQ ID NO: 3703732 - RNA, 23 nt, Human
gucacgugcgcugggcacuuccc

SEQ ID NO: 3703733 - RNA, 14 nt, Human
gucacuaauacaca

SEQ ID NO: 3703734 - RNA, 14 nt, Human
gucacuaccuggcu

SEQ ID NO: 3703735 - RNA, 16 nt, Human
gucacuaccuggcugc

SEQ ID NO: 3703736 - RNA, 14 nt, Human
gucacuacucacag

SEQ ID NO: 3703737 - RNA, 22 nt, Human
gucacuacucacagucucuuua

SEQ ID NO: 3703738 - RNA, 19 nt, Human
gucacuaugggaugagaaa

SEQ ID NO: 3703739 - RNA, 20 nt, Human
gucacuaugggaugagaaaa

SEQ ID NO: 3703740 - RNA, 14 nt, Human
gucacucauugcug

SEQ ID NO: 3703741 - RNA, 18 nt, Human
gucacucauugcugagcc

SEQ ID NO: 3703742 - RNA, 22 nt, Human
gucacucauugcugagccucug

SEQ ID NO: 3703743 - RNA, 18 nt, Human
gucacucccaagcccccu

SEQ ID NO: 3703744 - RNA, 21 nt, Human
gucacuccuggggccucuugg

SEQ ID NO: 3703745 - RNA, 12 nt, Human
gucacucuggca

SEQ ID NO: 3703746 - RNA, 13 nt, Human
gucacucuggcag

SEQ ID NO: 3703747 - RNA, 17 nt, Human
gucacucuggcagcuca

SEQ ID NO: 3703748 - RNA, 18 nt, Human
gucacugagacagcccgg

SEQ ID NO: 3703749 - RNA, 12 nt, Human
gucacugagacc

SEQ ID NO: 3703750 - RNA, 16 nt, Human
gucacugccacuuugc

SEQ ID NO: 3703751 - RNA, 17 nt, Human
gucacugccacuuugca

SEQ ID NO: 3703752 - RNA, 20 nt, Human
gucacugccauggaggcaca

SEQ ID NO: 3703753 - RNA, 23 nt, Human
gucacugccucucccuggcccuc

SEQ ID NO: 3703754 - RNA, 15 nt, Human
gucacugcucuggac

SEQ ID NO: 3703755 - RNA, 12 nt, Human
gucacuggaaag

SEQ ID NO: 3703756 - RNA, 20 nt, Human
gucacuggaaaggggagagc

SEQ ID NO: 3703757 - RNA, 19 nt, Human
gucacuggaccacugggca

SEQ ID NO: 3703758 - RNA, 18 nt, Human
gucacuggagguugaagc

SEQ ID NO: 3703759 - RNA, 20 nt, Human
gucacuggagguugaagcca

SEQ ID NO: 3703760 - RNA, 19 nt, Human
gucacuggcugccuccacu

SEQ ID NO: 3703761 - RNA, 17 nt, Human
gucacuggggcccaaga

SEQ ID NO: 3703762 - RNA, 21 nt, Human
gucacugguagaccaaaauaa

SEQ ID NO: 3703763 - RNA, 14 nt, Human
gucacugucccucc

SEQ ID NO: 3703764 - RNA, 16 nt, Human
gucacugucccuccug

SEQ ID NO: 3703765 - RNA, 17 nt, Human
gucacugucccuccugg

SEQ ID NO: 3703766 - RNA, 14 nt, Human
gucacugugguccu

SEQ ID NO: 3703767 - RNA, 17 nt, Human
gucacuguuuccugggc

SEQ ID NO: 3703768 - RNA, 14 nt, Human
gucacuuaaaaugu

SEQ ID NO: 3703769 - RNA, 18 nt, Human
gucacuucgcgugcccuc

SEQ ID NO: 3703770 - RNA, 17 nt, Human
gucacuucuucugucca

SEQ ID NO: 3703771 - RNA, 24 nt, Human
gucacuugugcuuugcucuugucc

SEQ ID NO: 3703772 - RNA, 16 nt, Human
gucacuuugcucuggg

SEQ ID NO: 3703773 - RNA, 17 nt, Human
gucacuuugcucugggu

SEQ ID NO: 3703774 - RNA, 11 nt, Human
gucacuuuuag

SEQ ID NO: 3703775 - RNA, 17 nt, Human
gucacuuuuugaggcaa

SEQ ID NO: 3703776 - RNA, 15 nt, Human
gucagaaacaggacc

SEQ ID NO: 3703777 - RNA, 15 nt, Human
gucagaaacuaaaac

SEQ ID NO: 3703778 - RNA, 13 nt, Human
gucagaaacuguu

SEQ ID NO: 3703779 - RNA, 16 nt, Human
gucagaacagcagacu

SEQ ID NO: 3703780 - RNA, 16 nt, Human
gucagaacccugccau

SEQ ID NO: 3703781 - RNA, 21 nt, Human
gucagaaguuucugccgcagc

SEQ ID NO: 3703782 - RNA, 13 nt, Human
gucagaauagaaa

SEQ ID NO: 3703783 - RNA, 17 nt, Human
gucagaauagaaauuag

SEQ ID NO: 3703784 - RNA, 13 nt, Human
gucagacacagau

SEQ ID NO: 3703785 - RNA, 13 nt, Human
gucagacauaaag

SEQ ID NO: 3703786 - RNA, 14 nt, Human
gucagacccuggag

SEQ ID NO: 3703787 - RNA, 15 nt, Human
gucagacccuggagg

SEQ ID NO: 3703788 - RNA, 18 nt, Human
ugaucauaagugaauuua

SEQ ID NO: 3703789 - RNA, 24 nt, Human
ugaucauccacugugccaugugcc

SEQ ID NO: 3703790 - RNA, 15 nt, Human
ugaucaucgccagag

SEQ ID NO: 3703791 - RNA, 16 nt, Human
ugaucaucgccagagg

SEQ ID NO: 3703792 - RNA, 16 nt, Human
ugaucaugcauuguug

SEQ ID NO: 3703793 - RNA, 17 nt, Human
ugaucaugcauuguuga

SEQ ID NO: 3703794 - RNA, 23 nt, Human
ugaucaugcauuguugagguggu

SEQ ID NO: 3703795 - RNA, 17 nt, Human
ugaucauguacuuuuua

SEQ ID NO: 3703796 - RNA, 18 nt, Human
ugaucauguuuaugagaa

SEQ ID NO: 3703797 - RNA, 19 nt, Human
ugaucauucaccaguacau

SEQ ID NO: 3703798 - RNA, 13 nt, Human
ugaucauuuauuu

SEQ ID NO: 3703799 - RNA, 20 nt, Human
ugaucauuuauuuuaagcac

SEQ ID NO: 3703800 - RNA, 22 nt, Human
ugaucauuuuccccccacucuc

SEQ ID NO: 3703801 - RNA, 14 nt, Human
ugauccaacuaaug

SEQ ID NO: 3703802 - RNA, 13 nt, Human
ugauccaagcugg

SEQ ID NO: 3703803 - RNA, 15 nt, Human
ugauccaagcugguc

SEQ ID NO: 3703804 - RNA, 21 nt, Human
ugauccacccaacccuaucuc

SEQ ID NO: 3703805 - RNA, 21 nt, Human
ugauccacccaccucagccuc

SEQ ID NO: 3703806 - RNA, 22 nt, Human
ugauccacccaccucagccucc

SEQ ID NO: 3703807 - RNA, 20 nt, Human
ugauccacucgccuucaucu

SEQ ID NO: 3703808 - RNA, 19 nt, Human
ugauccagcagauuauuca

SEQ ID NO: 3703809 - RNA, 21 nt, Human
ugauccagcagauuauucacu

SEQ ID NO: 3703810 - RNA, 15 nt, Human
ugauccagcccugag

SEQ ID NO: 3703811 - RNA, 17 nt, Human
ugauccagcccugaguu

SEQ ID NO: 3703812 - RNA, 22 nt, Human
ugauccaguuuuguuuggacca

SEQ ID NO: 3703813 - RNA, 12 nt, Human
ugauccauguaa

SEQ ID NO: 3703814 - RNA, 15 nt, Human
ugauccauuucuaau

SEQ ID NO: 3703815 - RNA, 21 nt, Human
ugauccauuucuaauuaugua

SEQ ID NO: 3703816 - RNA, 19 nt, Human
ugauccccacgccacagcc

SEQ ID NO: 3703817 - RNA, 19 nt, Human
ugaucccuguguugucucu

SEQ ID NO: 3703818 - RNA, 23 nt, Human
ugaucccuuccaccugcucugcu

SEQ ID NO: 3703819 - RNA, 22 nt, Human
ugauccguuccauugcaagcuu

SEQ ID NO: 3703820 - RNA, 13 nt, Human
ugauccuccaaca

SEQ ID NO: 3703821 - RNA, 17 nt, Human
ugauccuccaacuucau

SEQ ID NO: 3703822 - RNA, 15 nt, Human
ugauccucccaccuc

SEQ ID NO: 3703823 - RNA, 18 nt, Human
ugauccucccaccucagc

SEQ ID NO: 3703824 - RNA, 22 nt, Human
ugauccucccaccucagccucc

SEQ ID NO: 3703825 - RNA, 14 nt, Human
ugauccucucaccu

SEQ ID NO: 3703826 - RNA, 21 nt, Human
ugauccugcggagaacacccu

SEQ ID NO: 3703827 - RNA, 16 nt, Human
ugauccuggaggccca

SEQ ID NO: 3703828 - RNA, 20 nt, Human
ugauccuggaggcccaguuc

SEQ ID NO: 3703829 - RNA, 21 nt, Human
ugauccuguauucagacagau

SEQ ID NO: 3703830 - RNA, 15 nt, Human
ugauccuuacaaguu

SEQ ID NO: 3703831 - RNA, 18 nt, Human
ugauccuuuuggagucag

SEQ ID NO: 3703832 - RNA, 17 nt, Human
ugaucgaaaaaauaauu

SEQ ID NO: 3703833 - RNA, 17 nt, Human
ugaucgcacaaccugca

SEQ ID NO: 3703834 - RNA, 14 nt, Human
ugaucgccuucccc

SEQ ID NO: 3703835 - RNA, 17 nt, Human
ugaucgccuuucccagg

SEQ ID NO: 3703836 - RNA, 19 nt, Human
ugaucgugacgcugaauaa

SEQ ID NO: 3703837 - RNA, 21 nt, Human
ugaucgugacgcugaauaaau

SEQ ID NO: 3703838 - RNA, 15 nt, Human
ugaucuaggaagacu

SEQ ID NO: 3703839 - RNA, 19 nt, Human
ugaucuaggaagacuuugg

SEQ ID NO: 3703840 - RNA, 21 nt, Human
ugaucuaggaagacuuuggaa

SEQ ID NO: 3703841 - RNA, 14 nt, Human
ugaucuagguuuaa

SEQ ID NO: 3703842 - RNA, 20 nt, Human
ugaucuagguuuaacucaga

SEQ ID NO: 3703843 - RNA, 16 nt, Human
ugaucucaaacuauga

SEQ ID NO: 3703844 - RNA, 18 nt, Human
ugaucucagcucacugca

SEQ ID NO: 3703845 - RNA, 14 nt, Human
ugaucucagggaag

SEQ ID NO: 3703846 - RNA, 14 nt, Human
ugaucucccugccg

SEQ ID NO: 3703847 - RNA, 15 nt, Human
ugaucucccugccgc

SEQ ID NO: 3703848 - RNA, 16 nt, Human
ugaucucccugccgcc

SEQ ID NO: 3703849 - RNA, 17 nt, Human
ugaucucccugccgccu

SEQ ID NO: 3703850 - RNA, 18 nt, Human
ugaucuccguggcuuugg

SEQ ID NO: 3703851 - RNA, 18 nt, Human
ugaucucggcucacugca

SEQ ID NO: 3703852 - RNA, 13 nt, Human
ugaucucuuccug

SEQ ID NO: 3703853 - RNA, 14 nt, Human
ugaucucuuccugu

SEQ ID NO: 3703854 - RNA, 23 nt, Human
ugaucucuucuuuuggcuuccau

SEQ ID NO: 3703855 - RNA, 17 nt, Human
ugaucugagucccagga

SEQ ID NO: 3703856 - RNA, 20 nt, Human
ugaucugaugcaagcaagaa

SEQ ID NO: 3703857 - RNA, 21 nt, Human
ugaucugaugcaagcaagaaa

SEQ ID NO: 3703858 - RNA, 13 nt, Human
ugaucuggaaccc

SEQ ID NO: 3703859 - RNA, 15 nt, Human
ugaucuguauauaca

SEQ ID NO: 3703860 - RNA, 22 nt, Human
ugaucuguauauacaauaacau

SEQ ID NO: 3703861 - RNA, 17 nt, Human
ugaucugucuguggcaa

SEQ ID NO: 3703862 - RNA, 16 nt, Human
ugaucugucuuguaau

SEQ ID NO: 3703863 - RNA, 13 nt, Human
ugaucuguugcaa

SEQ ID NO: 3703864 - RNA, 18 nt, Human
ugaucuuaauauauuuga

SEQ ID NO: 3703865 - RNA, 19 nt, Human
ugaucuuauuuuucuaaac

SEQ ID NO: 3703866 - RNA, 20 nt, Human
ugaucuuauuuuucuaaacg

SEQ ID NO: 3703867 - RNA, 14 nt, Human
ugaucuucaacaaa

SEQ ID NO: 3703868 - RNA, 12 nt, Human
ugaucuucacua

SEQ ID NO: 3703869 - RNA, 20 nt, Human
ugaucuuccucugcuaaauu

SEQ ID NO: 3703870 - RNA, 18 nt, Human
ugaucuugcucuaucuca

SEQ ID NO: 3703871 - RNA, 15 nt, Human
ugaucuugugacaua

SEQ ID NO: 3703872 - RNA, 14 nt, Human
ugaucuuuaaaaua

SEQ ID NO: 3703873 - RNA, 19 nt, Human
ugaucuuucuuuccuuucu

SEQ ID NO: 3703874 - RNA, 21 nt, Human
ugaucuuugcagacaggcaag

SEQ ID NO: 3703875 - RNA, 23 nt, Human
ugaucuuugcagacaggcaagca

SEQ ID NO: 3703876 - RNA, 21 nt, Human
ugaucuuuuaaaguguuacuu

SEQ ID NO: 3703877 - RNA, 16 nt, Human
ugaugaaaagcuuugu

SEQ ID NO: 3703878 - RNA, 18 nt, Human
ugaugaaaauauuuaaag

SEQ ID NO: 3703879 - RNA, 18 nt, Human
ugaugaacucuuaaucaa

SEQ ID NO: 3703880 - RNA, 13 nt, Human
ugaugaacuuucu

SEQ ID NO: 3703881 - RNA, 14 nt, Human
ugaugaacuuucuc

SEQ ID NO: 3703882 - RNA, 23 nt, Human
ugaugaacuuucucuucauacuu

SEQ ID NO: 3703883 - RNA, 12 nt, Human
ugaugaagaaaa

SEQ ID NO: 3703884 - RNA, 11 nt, Human
ugaugaagaag

SEQ ID NO: 3703885 - RNA, 15 nt, Human
ugaugaagcaaggaa

SEQ ID NO: 3703886 - RNA, 23 nt, Human
ugaugaagcaaggaagauauaca

SEQ ID NO: 3703887 - RNA, 24 nt, Human
ugaugaagcaaggaagauauacau

SEQ ID NO: 3703888 - RNA, 14 nt, Human
ugaugaauacugua

SEQ ID NO: 3703889 - RNA, 13 nt, Human
ugaugaaucuugc

SEQ ID NO: 3703890 - RNA, 20 nt, Human
ugaugacaaaaaauguuuua

SEQ ID NO: 3703891 - RNA, 19 nt, Human
ugaugacaacuggaauagu

SEQ ID NO: 3703892 - RNA, 18 nt, Human
ugaugacauucccugcua

SEQ ID NO: 3703893 - RNA, 14 nt, Human
ugaugaccaaaguc

SEQ ID NO: 3703894 - RNA, 15 nt, Human
ugaugacccaggcug

SEQ ID NO: 3703895 - RNA, 18 nt, Human
ugaugacccccccagcuu

SEQ ID NO: 3703896 - RNA, 21 nt, Human
ugaugacguacaaguaguucu

SEQ ID NO: 3703897 - RNA, 17 nt, Human
ugaugacuggaauuuuu

SEQ ID NO: 3703898 - RNA, 18 nt, Human
ugaugacuggcauuuuau

SEQ ID NO: 3703899 - RNA, 23 nt, Human
ugaugagaauuucuaaaaagauu

SEQ ID NO: 3703900 - RNA, 15 nt, Human
ugaugagcuccucuu

SEQ ID NO: 3703901 - RNA, 16 nt, Human
ugaugagcuccucuuc

SEQ ID NO: 3703902 - RNA, 24 nt, Human
ugaugagcugugcacaaaguggca

SEQ ID NO: 3703903 - RNA, 15 nt, Human
ugaugaggcccucca

SEQ ID NO: 3703904 - RNA, 23 nt, Human
ugaugaggcccuccacaccugcg

SEQ ID NO: 3703905 - RNA, 13 nt, Human
ugaugagggcagc

SEQ ID NO: 3703906 - RNA, 15 nt, Human
ugaugagggcagcag

SEQ ID NO: 3703907 - RNA, 22 nt, Human
ugaugagggcagcagccagccc

SEQ ID NO: 3703908 - RNA, 23 nt, Human
ugaugagggcagcagccagcccu

SEQ ID NO: 3703909 - RNA, 13 nt, Human
ugaugagguauuu

SEQ ID NO: 3703910 - RNA, 13 nt, Human
ugaugaguuguga

SEQ ID NO: 3703911 - RNA, 21 nt, Human
ugaugaucagcuguuugucau

SEQ ID NO: 3703912 - RNA, 13 nt, Human
ugaugauccauua

SEQ ID NO: 3703913 - RNA, 14 nt, Human
ugaugauccuaggc

SEQ ID NO: 3703914 - RNA, 17 nt, Human
ugaugaucuuuaaaaua

SEQ ID NO: 3703915 - RNA, 21 nt, Human
ugaugaucuuugcagacaggc

SEQ ID NO: 3703916 - RNA, 22 nt, Human
ugaugaucuuugcagacaggca

SEQ ID NO: 3703917 - RNA, 20 nt, Human
ugaugaugaaaugaggucag

SEQ ID NO: 3703918 - RNA, 14 nt, Human
ugaugauguaauug

SEQ ID NO: 3703919 - RNA, 18 nt, Human
ugaugcaauccuuacaaa

SEQ ID NO: 3703920 - RNA, 19 nt, Human
ugaugcaauccuuacaaau

SEQ ID NO: 3703921 - RNA, 20 nt, Human
ugaugcacagagaagcuggg

SEQ ID NO: 3703922 - RNA, 19 nt, Human
ugaugcaggauuuguucuc

SEQ ID NO: 3703923 - RNA, 15 nt, Human
ugaugcagucuccuc

SEQ ID NO: 3703924 - RNA, 21 nt, Human
ugaugcagucuccucuuuaaa

SEQ ID NO: 3703925 - RNA, 22 nt, Human
ugaugcaucagaaagggagggc

SEQ ID NO: 3703926 - RNA, 18 nt, Human
ugaugcaugcacuguucc

SEQ ID NO: 3703927 - RNA, 21 nt, Human
ugaugcaugugguuugguucc

SEQ ID NO: 3703928 - RNA, 21 nt, Human
ugaugcauuaaaagaaaauaa

SEQ ID NO: 3703929 - RNA, 15 nt, Human
ugaugccacaccaag

SEQ ID NO: 3703930 - RNA, 18 nt, Human
ugaugccacaccaagcug

SEQ ID NO: 3703931 - RNA, 14 nt, Human
ugaugcccugcccu

SEQ ID NO: 3703932 - RNA, 19 nt, Human
ugaugcccugcuccaggga

SEQ ID NO: 3703933 - RNA, 14 nt, Human
ugaugccucugucu

SEQ ID NO: 3703934 - RNA, 21 nt, Human
ugaugccucugucuucuggac

SEQ ID NO: 3703935 - RNA, 21 nt, Human
ugaugccugugaacugaacuc

SEQ ID NO: 3703936 - RNA, 23 nt, Human
ugaugcgggccagugcuccagcc

SEQ ID NO: 3703937 - RNA, 23 nt, Human
ugaugcuacaggauuugaaauug

SEQ ID NO: 3703938 - RNA, 14 nt, Human
ugaugcucaggcuu

SEQ ID NO: 3703939 - RNA, 13 nt, Human
ugaugcucauggu

SEQ ID NO: 3703940 - RNA, 14 nt, Human
ugaugcucccuccc

SEQ ID NO: 3703941 - RNA, 20 nt, Human
ugaugcucccuccccugccc

SEQ ID NO: 3703942 - RNA, 21 nt, Human
ugaugcucccuccccugcccu

SEQ ID NO: 3703943 - RNA, 15 nt, Human
ugaugcucuuuccca

SEQ ID NO: 3703944 - RNA, 19 nt, Human
ugaugcucuuucccaccca

SEQ ID NO: 3703945 - RNA, 14 nt, Human
ugaugcuggagagg

SEQ ID NO: 3703946 - RNA, 20 nt, Human
ugaugcugggaguucuaaca

SEQ ID NO: 3703947 - RNA, 16 nt, Human
ugaugcugggcugggu

SEQ ID NO: 3703948 - RNA, 22 nt, Human
ugaugcuucuucagagacuccu

SEQ ID NO: 3703949 - RNA, 19 nt, Human
ugaugcuugauauuuucua

SEQ ID NO: 3703950 - RNA, 18 nt, Human
ugaugcuuucagauuaaa

SEQ ID NO: 3703951 - RNA, 15 nt, Human
ugauggaaacaaagu

SEQ ID NO: 3703952 - RNA, 19 nt, Human
ugauggacacuccagggac

SEQ ID NO: 3703953 - RNA, 16 nt, Human
ugauggcaacagaucu

SEQ ID NO: 3703954 - RNA, 22 nt, Human
ugauggcacuuagcuaucagaa

SEQ ID NO: 3703955 - RNA, 17 nt, Human
ugauggcccauucuacu

SEQ ID NO: 3703956 - RNA, 16 nt, Human
ugauggccuuaauuuc

SEQ ID NO: 3703957 - RNA, 18 nt, Human
ugauggccuuaauuuccu

SEQ ID NO: 3703958 - RNA, 17 nt, Human
ugauggcuuaugauagc

SEQ ID NO: 3703959 - RNA, 14 nt, Human
ugaugggaaagcau

SEQ ID NO: 3703960 - RNA, 19 nt, Human
ugaugggagaguagauggu

SEQ ID NO: 3703961 - RNA, 17 nt, Human
ugaugggauucuggaca

SEQ ID NO: 3703962 - RNA, 24 nt, Human
ugaugggauucuggacaggaugug

SEQ ID NO: 3703963 - RNA, 14 nt, Human
ugaugggauuuggu

SEQ ID NO: 3703964 - RNA, 21 nt, Human
ugaugggcaacccccagccug

SEQ ID NO: 3703965 - RNA, 14 nt, Human
ugauggggaaggag

SEQ ID NO: 3703966 - RNA, 24 nt, Human
ugauggggcaagggcacaaguccu

SEQ ID NO: 3703967 - RNA, 13 nt, Human
ugauggggcccug

SEQ ID NO: 3703968 - RNA, 19 nt, Human
ugauggggcccugccuccu

SEQ ID NO: 3703969 - RNA, 22 nt, Human
ugauggggcccugccuccuuug

SEQ ID NO: 3703970 - RNA, 14 nt, Human
ugauggucagaggg

SEQ ID NO: 3703971 - RNA, 15 nt, Human
ugauggucuggucua

SEQ ID NO: 3703972 - RNA, 15 nt, Human
ugauggugacuuccu

SEQ ID NO: 3703973 - RNA, 15 nt, Human
ugauggugcaaugac

SEQ ID NO: 3703974 - RNA, 21 nt, Human
ugaugguguagcccucccacu

SEQ ID NO: 3703975 - RNA, 19 nt, Human
ugaugguucuucaccuccu

SEQ ID NO: 3703976 - RNA, 14 nt, Human
ugaugguuguacau

SEQ ID NO: 3703977 - RNA, 21 nt, Human
ugaugguuguacauauaagug

SEQ ID NO: 3703978 - RNA, 18 nt, Human
ugaugguuuccaauuuca

SEQ ID NO: 3703979 - RNA, 15 nt, Human
ugauguaaaaucuug

SEQ ID NO: 3703980 - RNA, 19 nt, Human
ugauguaaaaucuugucau

SEQ ID NO: 3703981 - RNA, 21 nt, Human
ugauguaaaaucuugucaugu

SEQ ID NO: 3703982 - RNA, 15 nt, Human
ugauguaaaugaagu

SEQ ID NO: 3703983 - RNA, 17 nt, Human
ugauguaaucucucugc

SEQ ID NO: 3703984 - RNA, 23 nt, Human
ugauguaaucucucugcagcugc

SEQ ID NO: 3703985 - RNA, 22 nt, Human
ugauguaaucuugaauuguaac

SEQ ID NO: 3703986 - RNA, 11 nt, Human
ugauguaauug

SEQ ID NO: 3703987 - RNA, 17 nt, Human
ugauguacagucuguca

SEQ ID NO: 3703988 - RNA, 15 nt, Human
ugauguacaguuggg

SEQ ID NO: 3703989 - RNA, 18 nt, Human
ugauguaccaugaaacaa

SEQ ID NO: 3703990 - RNA, 19 nt, Human
ugauguacugauugagaag

SEQ ID NO: 3703991 - RNA, 18 nt, Human
ugauguagugccucuuuc

SEQ ID NO: 3703992 - RNA, 12 nt, Human
ugauguauauuu

SEQ ID NO: 3703993 - RNA, 18 nt, Human
ugauguaucugaguugcc

SEQ ID NO: 3703994 - RNA, 23 nt, Human
ugaugucaauuucuguguugcca

SEQ ID NO: 3703995 - RNA, 15 nt, Human
ugaugucauacagag

SEQ ID NO: 3703996 - RNA, 16 nt, Human
ugaugucauacagaga

SEQ ID NO: 3703997 - RNA, 18 nt, Human
ugaugucauacagagaag

SEQ ID NO: 3703998 - RNA, 19 nt, Human
ugaugucauacagagaagu

SEQ ID NO: 3703999 - RNA, 21 nt, Human
ugaugucauacagagaaguca

SEQ ID NO: 3704000 - RNA, 13 nt, Human
ugauguccagaag

SEQ ID NO: 3704001 - RNA, 23 nt, Human
ugauguccagaagaauauucagg

SEQ ID NO: 3704002 - RNA, 15 nt, Human
ugaugucccuaugga

SEQ ID NO: 3704003 - RNA, 21 nt, Human
ugauguccuguaaacacucag

SEQ ID NO: 3704004 - RNA, 12 nt, Human
ugaugucuccua

SEQ ID NO: 3704005 - RNA, 12 nt, Human
ugaugugaaacu

SEQ ID NO: 3704006 - RNA, 14 nt, Human
ugaugugacauuug

SEQ ID NO: 3704007 - RNA, 16 nt, Human
ugaugugacauuuguc

SEQ ID NO: 3704008 - RNA, 18 nt, Human
ugaugugcaaaaauuuuu

SEQ ID NO: 3704009 - RNA, 23 nt, Human
ugaugugcaaaaccuuuuacugg

SEQ ID NO: 3704010 - RNA, 20 nt, Human
ugaugugccuaaauaaguua

SEQ ID NO: 3704011 - RNA, 13 nt, Human
ugaugugccuggg

SEQ ID NO: 3704012 - RNA, 18 nt, Human
ugaugugcucaucagaaa

SEQ ID NO: 3704013 - RNA, 13 nt, Human
ugaugugcuuaac

SEQ ID NO: 3704014 - RNA, 19 nt, Human
ugauguggcccuggcugcc

SEQ ID NO: 3704015 - RNA, 23 nt, Human
ugauguggcccuggcugccggca

SEQ ID NO: 3704016 - RNA, 20 nt, Human
ugauguggugaggcaggcuu

SEQ ID NO: 3704017 - RNA, 14 nt, Human
ugauguuaaaaaaa

SEQ ID NO: 3704018 - RNA, 16 nt, Human
ugauguuaaaauucca

SEQ ID NO: 3704019 - RNA, 21 nt, Human
ugauguucuaaggcucugaga

SEQ ID NO: 3704020 - RNA, 20 nt, Human
ugauguugacaucacuggca

SEQ ID NO: 3704021 - RNA, 15 nt, Human
ugauguugaugcaau

SEQ ID NO: 3704022 - RNA, 19 nt, Human
ugauguugaugcaauccuu

SEQ ID NO: 3704023 - RNA, 13 nt, Human
ugauguuggaaga

SEQ ID NO: 3704024 - RNA, 16 nt, Human
ugauguuggcugggaa

SEQ ID NO: 3704025 - RNA, 17 nt, Human
ugauguuuguggccuca

SEQ ID NO: 3704026 - RNA, 17 nt, Human
ugauguuuuaaggaugc

SEQ ID NO: 3704027 - RNA, 23 nt, Human
ugauguuuuccaugaguccccug

SEQ ID NO: 3704028 - RNA, 12 nt, Human
ugauuaaaccaa

SEQ ID NO: 3704029 - RNA, 20 nt, Human
ugauuaaacgugcagacuau

SEQ ID NO: 3704030 - RNA, 12 nt, Human
ugauuaaagugc

SEQ ID NO: 3704031 - RNA, 18 nt, Human
ugauuaaauaagauucua

SEQ ID NO: 3704032 - RNA, 14 nt, Human
ugauuaaaugacac

SEQ ID NO: 3704033 - RNA, 16 nt, Human
ugauuaaauucuugca

SEQ ID NO: 3704034 - RNA, 19 nt, Human
ugauuaaauucuugcaaag

SEQ ID NO: 3704035 - RNA, 14 nt, Human
ugauuaacaaauau

SEQ ID NO: 3704036 - RNA, 13 nt, Human
ugauuaacuugga

SEQ ID NO: 3704037 - RNA, 14 nt, Human
ugauuaacuuggau

SEQ ID NO: 3704038 - RNA, 17 nt, Human
ugauuaagauuuuacaa

SEQ ID NO: 3704039 - RNA, 13 nt, Human
ugauuaaggcagu

SEQ ID NO: 3704040 - RNA, 17 nt, Human
ugauuaaggcaguacaa

SEQ ID NO: 3704041 - RNA, 18 nt, Human
ugauuaaggucucucuuu

SEQ ID NO: 3704042 - RNA, 13 nt, Human
ugauuaauccaga

SEQ ID NO: 3704043 - RNA, 21 nt, Human
ugauuaauucaccuuccagug

SEQ ID NO: 3704044 - RNA, 14 nt, Human
ugauuacacaaaac

SEQ ID NO: 3704045 - RNA, 17 nt, Human
ugauuacacaaaacaaa

SEQ ID NO: 3704046 - RNA, 16 nt, Human
ugauuacagugcagug

SEQ ID NO: 3704047 - RNA, 16 nt, Human
ugauuacucuuugaga

SEQ ID NO: 3704048 - RNA, 21 nt, Human
ugauuagaaggcaaguuucua

SEQ ID NO: 3704049 - RNA, 11 nt, Human
ugauuagauga

SEQ ID NO: 3704050 - RNA, 15 nt, Human
ugauuagcagaagaa

SEQ ID NO: 3704051 - RNA, 18 nt, Human
ugauuagcuuuguguuug

SEQ ID NO: 3704052 - RNA, 13 nt, Human
ugauuauauguca

SEQ ID NO: 3704053 - RNA, 22 nt, Human
ugauuaugaauuacauuuguau

SEQ ID NO: 3704054 - RNA, 14 nt, Human
ugauuauucagugu

SEQ ID NO: 3704055 - RNA, 14 nt, Human
ugauuauugcagaa

SEQ ID NO: 3704056 - RNA, 13 nt, Human
ugauuauuguauu

SEQ ID NO: 3704057 - RNA, 12 nt, Human
ugauuauuugca

SEQ ID NO: 3704058 - RNA, 14 nt, Human
ugauuauuuucaag

SEQ ID NO: 3704059 - RNA, 21 nt, Human
ugauuauuuuuuuuuucuucu

SEQ ID NO: 3704060 - RNA, 11 nt, Human
ugauucaaaug

SEQ ID NO: 3704061 - RNA, 16 nt, Human
ugauucaaucuguaaa

SEQ ID NO: 3704062 - RNA, 12 nt, Human
ugauucaauuca

SEQ ID NO: 3704063 - RNA, 14 nt, Human
ugauucaauuugau

SEQ ID NO: 3704064 - RNA, 18 nt, Human
ugauucacauguuuucaa

SEQ ID NO: 3704065 - RNA, 20 nt, Human
ugauucacauguuuucaaau

SEQ ID NO: 3704066 - RNA, 21 nt, Human
ugauucagaaaauguucuguu

SEQ ID NO: 3704067 - RNA, 22 nt, Human
ugauucagaaaauguucuguuu

SEQ ID NO: 3704068 - RNA, 13 nt, Human
ugauucagacagc

SEQ ID NO: 3704069 - RNA, 14 nt, Human
ugauucagacagcu

SEQ ID NO: 3704070 - RNA, 19 nt, Human
ugauucagacagcugccug

SEQ ID NO: 3704071 - RNA, 21 nt, Human
ugauucagacagcugccuggg

SEQ ID NO: 3704072 - RNA, 14 nt, Human
ugauucagcucugc

SEQ ID NO: 3704073 - RNA, 13 nt, Human
ugauucagucaca

SEQ ID NO: 3704074 - RNA, 16 nt, Human
ugauucauaguaacuu

SEQ ID NO: 3704075 - RNA, 19 nt, Human
ugauucauaguaacuucuu

SEQ ID NO: 3704076 - RNA, 19 nt, Human
ugauuccacuacaccuggc

SEQ ID NO: 3704077 - RNA, 18 nt, Human
ugauucccaagcucugcu

SEQ ID NO: 3704078 - RNA, 22 nt, Human
ugauucccaagcucugcuccuc

SEQ ID NO: 3704079 - RNA, 17 nt, Human
ugauucccuccugcuac

SEQ ID NO: 3704080 - RNA, 18 nt, Human
ugauucccuccugcuacu

SEQ ID NO: 3704081 - RNA, 16 nt, Human
ugauucccugauuuaa

SEQ ID NO: 3704082 - RNA, 18 nt, Human
ugauucccuuguuauuca

SEQ ID NO: 3704083 - RNA, 14 nt, Human
ugauuccuuccugu

SEQ ID NO: 3704084 - RNA, 22 nt, Human
ugauuccuugauggagauauuu

SEQ ID NO: 3704085 - RNA, 17 nt, Human
ugauuccuuugaagagg

SEQ ID NO: 3704086 - RNA, 21 nt, Human
ugauuccuuugaagaggaaaa

SEQ ID NO: 3704087 - RNA, 18 nt, Human
ugauucgaaugacacugu

SEQ ID NO: 3704088 - RNA, 19 nt, Human
ugccuaaggcugaacuugu

SEQ ID NO: 3704089 - RNA, 15 nt, Human
ugccuaaguauuaaa

SEQ ID NO: 3704090 - RNA, 20 nt, Human
ugccuaaguauuaaaacauu

SEQ ID NO: 3704091 - RNA, 22 nt, Human
ugccuaaguccaguguuucuuu

SEQ ID NO: 3704092 - RNA, 18 nt, Human
ugccuaauaaacauccuu

SEQ ID NO: 3704093 - RNA, 21 nt, Human
ugccuaauaaacauccuucaa

SEQ ID NO: 3704094 - RNA, 18 nt, Human
ugccuaauacauuaaagc

SEQ ID NO: 3704095 - RNA, 17 nt, Human
ugccuaauaugaugacu

SEQ ID NO: 3704096 - RNA, 23 nt, Human
ugccuacagaacuucagaaagac

SEQ ID NO: 3704097 - RNA, 20 nt, Human
ugccuagcaagcuggccucu

SEQ ID NO: 3704098 - RNA, 22 nt, Human
ugccuagcacucacaugcugga

SEQ ID NO: 3704099 - RNA, 17 nt, Human
ugccuaggaauucccag

SEQ ID NO: 3704100 - RNA, 20 nt, Human
ugccuaggccugggcagugg

SEQ ID NO: 3704101 - RNA, 17 nt, Human
ugccuaguauugacaaa

SEQ ID NO: 3704102 - RNA, 18 nt, Human
ugccuaguauugacaaaa

SEQ ID NO: 3704103 - RNA, 13 nt, Human
ugccuaguuuuua

SEQ ID NO: 3704104 - RNA, 17 nt, Human
ugccuauagucccagcu

SEQ ID NO: 3704105 - RNA, 18 nt, Human
ugccuauagucccagcua

SEQ ID NO: 3704106 - RNA, 20 nt, Human
ugccuauaugagaagaauag

SEQ ID NO: 3704107 - RNA, 22 nt, Human
ugccuauucccacaccuccaca

SEQ ID NO: 3704108 - RNA, 19 nt, Human
ugccucaagccccagagug

SEQ ID NO: 3704109 - RNA, 22 nt, Human
ugccucaaugugaaucagaccc

SEQ ID NO: 3704110 - RNA, 24 nt, Human
ugccucaaugugaaucagacccua

SEQ ID NO: 3704111 - RNA, 18 nt, Human
ugccucaaugugaccagg

SEQ ID NO: 3704112 - RNA, 19 nt, Human
ugccucaaugugaccaggg

SEQ ID NO: 3704113 - RNA, 19 nt, Human
ugccucacauuuuuuucua

SEQ ID NO: 3704114 - RNA, 22 nt, Human
ugccucaccgcuucccuccugc

SEQ ID NO: 3704115 - RNA, 12 nt, Human
ugccucagcccg

SEQ ID NO: 3704116 - RNA, 16 nt, Human
ugccucagcccugacc

SEQ ID NO: 3704117 - RNA, 15 nt, Human
ugccucagccucccg

SEQ ID NO: 3704118 - RNA, 16 nt, Human
ugccucagccucccga

SEQ ID NO: 3704119 - RNA, 15 nt, Human
ugccucagccuccug

SEQ ID NO: 3704120 - RNA, 16 nt, Human
ugccucagguuccuau

SEQ ID NO: 3704121 - RNA, 15 nt, Human
ugccucaguguauuu

SEQ ID NO: 3704122 - RNA, 21 nt, Human
ugccucauuuuuuuccuugca

SEQ ID NO: 3704123 - RNA, 19 nt, Human
ugccuccaccaccacuggc

SEQ ID NO: 3704124 - RNA, 22 nt, Human
ugccuccaccaccacuggccac

SEQ ID NO: 3704125 - RNA, 18 nt, Human
ugccuccaccgcugccua

SEQ ID NO: 3704126 - RNA, 15 nt, Human
ugccuccacucccac

SEQ ID NO: 3704127 - RNA, 17 nt, Human
ugccuccacucccacuu

SEQ ID NO: 3704128 - RNA, 17 nt, Human
ugccuccagaagcacug

SEQ ID NO: 3704129 - RNA, 17 nt, Human
ugccuccaggaaccaca

SEQ ID NO: 3704130 - RNA, 20 nt, Human
ugccuccaggaaccacacca

SEQ ID NO: 3704131 - RNA, 16 nt, Human
ugccuccaggugcaga

SEQ ID NO: 3704132 - RNA, 21 nt, Human
ugccuccaggugcagagguac

SEQ ID NO: 3704133 - RNA, 15 nt, Human
ugccuccaggugugc

SEQ ID NO: 3704134 - RNA, 20 nt, Human
ugccuccauggugccucugg

SEQ ID NO: 3704135 - RNA, 13 nt, Human
ugccucccaucac

SEQ ID NO: 3704136 - RNA, 19 nt, Human
ugccucccaucacccgcua

SEQ ID NO: 3704137 - RNA, 15 nt, Human
ugccuccccaacccu

SEQ ID NO: 3704138 - RNA, 19 nt, Human
ugccuccccaacccugccc

SEQ ID NO: 3704139 - RNA, 22 nt, Human
ugccuccccauuucccaucugc

SEQ ID NO: 3704140 - RNA, 18 nt, Human
ugccuccccggcucgagc

SEQ ID NO: 3704141 - RNA, 17 nt, Human
ugccuccccucuccuuc

SEQ ID NO: 3704142 - RNA, 16 nt, Human
ugccucccgcccccuu

SEQ ID NO: 3704143 - RNA, 23 nt, Human
ugccucccucucguaagauuucc

SEQ ID NO: 3704144 - RNA, 13 nt, Human
ugccucccuggug

SEQ ID NO: 3704145 - RNA, 13 nt, Human
ugccucccugucc

SEQ ID NO: 3704146 - RNA, 12 nt, Human
ugccucccuuga

SEQ ID NO: 3704147 - RNA, 22 nt, Human
ugccuccgcgugaucaaagcca

SEQ ID NO: 3704148 - RNA, 24 nt, Human
ugccuccucacccccagcuuugcu

SEQ ID NO: 3704149 - RNA, 11 nt, Human
ugccuccuccc

SEQ ID NO: 3704150 - RNA, 12 nt, Human
ugccuccucccu

SEQ ID NO: 3704151 - RNA, 13 nt, Human
ugccuccucccuc

SEQ ID NO: 3704152 - RNA, 20 nt, Human
ugccuccuccuucccaaagg

SEQ ID NO: 3704153 - RNA, 14 nt, Human
ugccuccugccggc

SEQ ID NO: 3704154 - RNA, 14 nt, Human
ugccuccugccugc

SEQ ID NO: 3704155 - RNA, 13 nt, Human
ugccuccuguggg

SEQ ID NO: 3704156 - RNA, 13 nt, Human
ugccuccugugua

SEQ ID NO: 3704157 - RNA, 20 nt, Human
ugccuccuguguacuguguc

SEQ ID NO: 3704158 - RNA, 13 nt, Human
ugccuccuuccuc

SEQ ID NO: 3704159 - RNA, 18 nt, Human
ugccuccuugauauuugu

SEQ ID NO: 3704160 - RNA, 22 nt, Human
ugccuccuugauauuuguauuu

SEQ ID NO: 3704161 - RNA, 18 nt, Human
ugccuccuuugugaggaa

SEQ ID NO: 3704162 - RNA, 13 nt, Human
ugccucgaaacac

SEQ ID NO: 3704163 - RNA, 23 nt, Human
ugccucgaaacacagaaaccuuu

SEQ ID NO: 3704164 - RNA, 19 nt, Human
ugccucgaacuggcugcaa

SEQ ID NO: 3704165 - RNA, 20 nt, Human
ugccucgaacuggcugcaaa

SEQ ID NO: 3704166 - RNA, 18 nt, Human
ugccucggcuccugcugc

SEQ ID NO: 3704167 - RNA, 22 nt, Human
ugccucggcuccugcugcacca

SEQ ID NO: 3704168 - RNA, 23 nt, Human
ugccucggcuggcuccccugcag

SEQ ID NO: 3704169 - RNA, 20 nt, Human
ugccucggcuuuucucagcu

SEQ ID NO: 3704170 - RNA, 18 nt, Human
ugccucgggaaccucacu

SEQ ID NO: 3704171 - RNA, 23 nt, Human
ugccucgggaaccucacucuugc

SEQ ID NO: 3704172 - RNA, 23 nt, Human
ugccucuacugggaaggcuacuu

SEQ ID NO: 3704173 - RNA, 14 nt, Human
ugccucuagcugaa

SEQ ID NO: 3704174 - RNA, 13 nt, Human
ugccucucacaca

SEQ ID NO: 3704175 - RNA, 15 nt, Human
ugccucucacacaca

SEQ ID NO: 3704176 - RNA, 18 nt, Human
ugccucucaucaacugaa

SEQ ID NO: 3704177 - RNA, 13 nt, Human
ugccucuccaggc

SEQ ID NO: 3704178 - RNA, 13 nt, Human
ugccucucccagg

SEQ ID NO: 3704179 - RNA, 15 nt, Human
ugccucuccgccccu

SEQ ID NO: 3704180 - RNA, 14 nt, Human
ugccucucucaggc

SEQ ID NO: 3704181 - RNA, 17 nt, Human
ugccucucucaggccaa

SEQ ID NO: 3704182 - RNA, 12 nt, Human
ugccucucugca

SEQ ID NO: 3704183 - RNA, 21 nt, Human
ugccucucugcaggucccuaa

SEQ ID NO: 3704184 - RNA, 21 nt, Human
ugccucugacacacagcucug

SEQ ID NO: 3704185 - RNA, 17 nt, Human
ugccucugaggccagcc

SEQ ID NO: 3704186 - RNA, 18 nt, Human
ugccucugaggccagccu

SEQ ID NO: 3704187 - RNA, 20 nt, Human
ugccucugaggccagccugg

SEQ ID NO: 3704188 - RNA, 21 nt, Human
ugccucugaggccagccuggc

SEQ ID NO: 3704189 - RNA, 23 nt, Human
ugccucugaggccagccuggccu

SEQ ID NO: 3704190 - RNA, 19 nt, Human
ugccucugauaugggacug

SEQ ID NO: 3704191 - RNA, 11 nt, Human
ugccucugcca

SEQ ID NO: 3704192 - RNA, 22 nt, Human
ugccucugccaaaggaugugau

SEQ ID NO: 3704193 - RNA, 11 nt, Human
ugccucugccu

SEQ ID NO: 3704194 - RNA, 15 nt, Human
ugccucugccucuga

SEQ ID NO: 3704195 - RNA, 17 nt, Human
ugccucugccucugaca

SEQ ID NO: 3704196 - RNA, 20 nt, Human
ugccucugccucugacacac

SEQ ID NO: 3704197 - RNA, 14 nt, Human
ugccucugccuuag

SEQ ID NO: 3704198 - RNA, 14 nt, Human
ugccucugggacug

SEQ ID NO: 3704199 - RNA, 14 nt, Human
ugccucuguccccu

SEQ ID NO: 3704200 - RNA, 17 nt, Human
ugccucugucuagcaug

SEQ ID NO: 3704201 - RNA, 11 nt, Human
ugccucugugc

SEQ ID NO: 3704202 - RNA, 12 nt, Human
ugccucugugcu

SEQ ID NO: 3704203 - RNA, 21 nt, Human
ugccucugugcugugugugac

SEQ ID NO: 3704204 - RNA, 14 nt, Human
ugccucuucccucu

SEQ ID NO: 3704205 - RNA, 16 nt, Human
ugccucuuucauccac

SEQ ID NO: 3704206 - RNA, 17 nt, Human
ugccucuuucauccacu

SEQ ID NO: 3704207 - RNA, 12 nt, Human
ugccucuuuccc

SEQ ID NO: 3704208 - RNA, 17 nt, Human
ugccucuuucccuagga

SEQ ID NO: 3704209 - RNA, 14 nt, Human
ugccucuuuccugu

SEQ ID NO: 3704210 - RNA, 19 nt, Human
ugccucuuuuaccugcugc

SEQ ID NO: 3704211 - RNA, 21 nt, Human
ugccucuuuuaccugcugcuu

SEQ ID NO: 3704212 - RNA, 21 nt, Human
ugccucuuuuuaaaguucaaa

SEQ ID NO: 3704213 - RNA, 13 nt, Human
ugccugaagaaca

SEQ ID NO: 3704214 - RNA, 19 nt, Human
ugccugaaguuggagugag

SEQ ID NO: 3704215 - RNA, 13 nt, Human
ugccugacacacu

SEQ ID NO: 3704216 - RNA, 23 nt, Human
ugccugacccuacuucuuuugcu

SEQ ID NO: 3704217 - RNA, 21 nt, Human
ugccugacuagggagccaugu

SEQ ID NO: 3704218 - RNA, 18 nt, Human
ugccugagaggcaggcau

SEQ ID NO: 3704219 - RNA, 19 nt, Human
ugccugagcaccucccagc

SEQ ID NO: 3704220 - RNA, 14 nt, Human
ugccugagggcccc

SEQ ID NO: 3704221 - RNA, 15 nt, Human
ugccugagggccccu

SEQ ID NO: 3704222 - RNA, 17 nt, Human
ugccugagggccccucu

SEQ ID NO: 3704223 - RNA, 18 nt, Human
ugccugaggggcagccug

SEQ ID NO: 3704224 - RNA, 22 nt, Human
ugccugaggggcagccugccuu

SEQ ID NO: 3704225 - RNA, 19 nt, Human
ugccugagucacccaugaa

SEQ ID NO: 3704226 - RNA, 19 nt, Human
ugccugagucgugaccugc

SEQ ID NO: 3704227 - RNA, 23 nt, Human
ugccugagucgugaccugcuagg

SEQ ID NO: 3704228 - RNA, 16 nt, Human
ugccugaugacaauaa

SEQ ID NO: 3704229 - RNA, 21 nt, Human
ugccugauucggcugucucag

SEQ ID NO: 3704230 - RNA, 15 nt, Human
ugccugauugccaag

SEQ ID NO: 3704231 - RNA, 15 nt, Human
ugccugcaccaggag

SEQ ID NO: 3704232 - RNA, 20 nt, Human
ugccugcaccaggagacaga

SEQ ID NO: 3704233 - RNA, 15 nt, Human
ugccugcagagagaa

SEQ ID NO: 3704234 - RNA, 15 nt, Human
ugccugcagaguuug

SEQ ID NO: 3704235 - RNA, 15 nt, Human
ugccugcauguauuu

SEQ ID NO: 3704236 - RNA, 12 nt, Human
ugccugccaugu

SEQ ID NO: 3704237 - RNA, 18 nt, Human
gucagacgccugaggaac

SEQ ID NO: 3704238 - RNA, 20 nt, Human
gucagacugcugggacuggc

SEQ ID NO: 3704239 - RNA, 20 nt, Human
gucagagccaugucuucucc

SEQ ID NO: 3704240 - RNA, 21 nt, Human
gucagagccaugucuucuccc

SEQ ID NO: 3704241 - RNA, 22 nt, Human
gucagagccaugucuucucccu

SEQ ID NO: 3704242 - RNA, 16 nt, Human
gucagagccugcaguu

SEQ ID NO: 3704243 - RNA, 13 nt, Human
gucagagcuggga

SEQ ID NO: 3704244 - RNA, 16 nt, Human
gucagaggagagauag

SEQ ID NO: 3704245 - RNA, 19 nt, Human
gucagaggauggccagugu

SEQ ID NO: 3704246 - RNA, 18 nt, Human
gucagaguaagcugcuuu

SEQ ID NO: 3704247 - RNA, 15 nt, Human
gucagauacaaugua

SEQ ID NO: 3704248 - RNA, 16 nt, Human
gucagaucugccuaag

SEQ ID NO: 3704249 - RNA, 19 nt, Human
gucagaucugccuaaggac

SEQ ID NO: 3704250 - RNA, 20 nt, Human
gucagaucugccuaaggacu

SEQ ID NO: 3704251 - RNA, 21 nt, Human
gucagaugagaacaaagcugu

SEQ ID NO: 3704252 - RNA, 21 nt, Human
gucagaugcccgagggagggg

SEQ ID NO: 3704253 - RNA, 22 nt, Human
gucagaugcugugcaaauguua

SEQ ID NO: 3704254 - RNA, 18 nt, Human
gucagaugggaagacaug

SEQ ID NO: 3704255 - RNA, 15 nt, Human
gucagauguuuaaaa

SEQ ID NO: 3704256 - RNA, 19 nt, Human
gucagauguuuaaaacacc

SEQ ID NO: 3704257 - RNA, 14 nt, Human
gucagauuccuuuc

SEQ ID NO: 3704258 - RNA, 15 nt, Human
gucagauucuugcau

SEQ ID NO: 3704259 - RNA, 21 nt, Human
gucagauuuccagucuccacc

SEQ ID NO: 3704260 - RNA, 23 nt, Human
gucagcaaaaagcaaaaucauuu

SEQ ID NO: 3704261 - RNA, 22 nt, Human
gucagcaaauuaauuggcagca

SEQ ID NO: 3704262 - RNA, 23 nt, Human
gucagcaguugcugguaaaauga

SEQ ID NO: 3704263 - RNA, 15 nt, Human
gucagcaugaauuug

SEQ ID NO: 3704264 - RNA, 20 nt, Human
gucagcaugaauuuguaaug

SEQ ID NO: 3704265 - RNA, 14 nt, Human
gucagcauuugauc

SEQ ID NO: 3704266 - RNA, 13 nt, Human
gucagccacaugg

SEQ ID NO: 3704267 - RNA, 13 nt, Human
gucagccacuguu

SEQ ID NO: 3704268 - RNA, 19 nt, Human
gucagccaggaccauaccg

SEQ ID NO: 3704269 - RNA, 15 nt, Human
gucagccaggagcug

SEQ ID NO: 3704270 - RNA, 20 nt, Human
gucagccaggagcugucacc

SEQ ID NO: 3704271 - RNA, 16 nt, Human
gucagccagggccagg

SEQ ID NO: 3704272 - RNA, 22 nt, Human
gucagcccaaaccaccagaagc

SEQ ID NO: 3704273 - RNA, 22 nt, Human
gucagcccuaggguggagagcc

SEQ ID NO: 3704274 - RNA, 16 nt, Human
gucagccgagccgggc

SEQ ID NO: 3704275 - RNA, 14 nt, Human
gucagccuccagcc

SEQ ID NO: 3704276 - RNA, 18 nt, Human
gucagcguugcaugucgu

SEQ ID NO: 3704277 - RNA, 17 nt, Human
gucagcuacuaaugaug

SEQ ID NO: 3704278 - RNA, 16 nt, Human
gucagcucucaucuga

SEQ ID NO: 3704279 - RNA, 14 nt, Human
gucagcucucugcc

SEQ ID NO: 3704280 - RNA, 17 nt, Human
gucagcucucugcccug

SEQ ID NO: 3704281 - RNA, 18 nt, Human
gucagcucucugcccugu

SEQ ID NO: 3704282 - RNA, 21 nt, Human
gucagcucucugcccugugua

SEQ ID NO: 3704283 - RNA, 20 nt, Human
gucagcuugcugcccuaggc

SEQ ID NO: 3704284 - RNA, 17 nt, Human
gucaggaaacccagucg

SEQ ID NO: 3704285 - RNA, 13 nt, Human
gucaggaaagaga

SEQ ID NO: 3704286 - RNA, 17 nt, Human
gucaggaacagaaggau

SEQ ID NO: 3704287 - RNA, 18 nt, Human
gucaggaaggaugagcau

SEQ ID NO: 3704288 - RNA, 19 nt, Human
gucaggaguccaagaccag

SEQ ID NO: 3704289 - RNA, 18 nt, Human
gucaggagugugugugag

SEQ ID NO: 3704290 - RNA, 19 nt, Human
gucaggaguuagaggccag

SEQ ID NO: 3704291 - RNA, 23 nt, Human
gucaggaguucgagaccagccug

SEQ ID NO: 3704292 - RNA, 16 nt, Human
gucaggcacugggcau

SEQ ID NO: 3704293 - RNA, 20 nt, Human
gucaggcagccagugagaug

SEQ ID NO: 3704294 - RNA, 14 nt, Human
gucaggccacggca

SEQ ID NO: 3704295 - RNA, 15 nt, Human
gucaggcccuggaac

SEQ ID NO: 3704296 - RNA, 21 nt, Human
gucaggcccuuauuuucaaga

SEQ ID NO: 3704297 - RNA, 15 nt, Human
gucaggccgggcaga

SEQ ID NO: 3704298 - RNA, 17 nt, Human
gucaggccgggcagagc

SEQ ID NO: 3704299 - RNA, 17 nt, Human
gucaggcuccauuagga

SEQ ID NO: 3704300 - RNA, 16 nt, Human
gucaggcucucugggc

SEQ ID NO: 3704301 - RNA, 20 nt, Human
gucaggcucucugggcugac

SEQ ID NO: 3704302 - RNA, 15 nt, Human
gucaggcugcuggcg

SEQ ID NO: 3704303 - RNA, 14 nt, Human
gucagggaccccug

SEQ ID NO: 3704304 - RNA, 13 nt, Human
gucagggagugcu

SEQ ID NO: 3704305 - RNA, 14 nt, Human
gucagggagugcug

SEQ ID NO: 3704306 - RNA, 21 nt, Human
gucagggcccaagucccuguu

SEQ ID NO: 3704307 - RNA, 14 nt, Human
gucagggcccagag

SEQ ID NO: 3704308 - RNA, 15 nt, Human
gucagggcccagagg

SEQ ID NO: 3704309 - RNA, 17 nt, Human
gucaggggugacacaga

SEQ ID NO: 3704310 - RNA, 17 nt, Human
gucaggguuggugugcu

SEQ ID NO: 3704311 - RNA, 15 nt, Human
gucagguagggggga

SEQ ID NO: 3704312 - RNA, 14 nt, Human
gucaggugacccug

SEQ ID NO: 3704313 - RNA, 13 nt, Human
gucagguuuaaca

SEQ ID NO: 3704314 - RNA, 20 nt, Human
gucaguaguuuaaaaguucu

SEQ ID NO: 3704315 - RNA, 20 nt, Human
gucaguaucuguaucucucu

SEQ ID NO: 3704316 - RNA, 17 nt, Human
gucaguauguggaagug

SEQ ID NO: 3704317 - RNA, 23 nt, Human
gucagugcagcccguguggcccc

SEQ ID NO: 3704318 - RNA, 23 nt, Human
gucagugccgccgccucgcccac

SEQ ID NO: 3704319 - RNA, 16 nt, Human
gucagugcugccuguc

SEQ ID NO: 3704320 - RNA, 22 nt, Human
gucagugcugccuguccccaug

SEQ ID NO: 3704321 - RNA, 15 nt, Human
gucaguggcucuuuu

SEQ ID NO: 3704322 - RNA, 18 nt, Human
gucaguggggcucucuga

SEQ ID NO: 3704323 - RNA, 24 nt, Human
gucaguguccaaagcagggucugg

SEQ ID NO: 3704324 - RNA, 14 nt, Human
gucaguguugagau

SEQ ID NO: 3704325 - RNA, 13 nt, Human
gucaguuguauca

SEQ ID NO: 3704326 - RNA, 13 nt, Human
gucaguuucuaca

SEQ ID NO: 3704327 - RNA, 13 nt, Human
gucaguuuucaua

SEQ ID NO: 3704328 - RNA, 12 nt, Human
gucauaauugca

SEQ ID NO: 3704329 - RNA, 14 nt, Human
gucauaauugcauu

SEQ ID NO: 3704330 - RNA, 18 nt, Human
gucauaauugcauugacu

SEQ ID NO: 3704331 - RNA, 17 nt, Human
gucauacaauccauucu

SEQ ID NO: 3704332 - RNA, 15 nt, Human
gucauacagagaagu

SEQ ID NO: 3704333 - RNA, 16 nt, Human
gucauacagagaaguc

SEQ ID NO: 3704334 - RNA, 16 nt, Human
gucauaccaggccgcc

SEQ ID NO: 3704335 - RNA, 21 nt, Human
gucauacuaucuacucuccuc

SEQ ID NO: 3704336 - RNA, 18 nt, Human
gucauacucgagucugag

SEQ ID NO: 3704337 - RNA, 13 nt, Human
gucauagaaauua

SEQ ID NO: 3704338 - RNA, 17 nt, Human
gucauauacugccaugu

SEQ ID NO: 3704339 - RNA, 16 nt, Human
gucauauguuaagcag

SEQ ID NO: 3704340 - RNA, 14 nt, Human
gucauauguuugcu

SEQ ID NO: 3704341 - RNA, 20 nt, Human
gucauauuuugauuauugua

SEQ ID NO: 3704342 - RNA, 23 nt, Human
gucaucaauuaaaggcaaaggca

SEQ ID NO: 3704343 - RNA, 20 nt, Human
gucaucagagcuccucuguc

SEQ ID NO: 3704344 - RNA, 17 nt, Human
gucaucaucagggccug

SEQ ID NO: 3704345 - RNA, 21 nt, Human
gucaucaucauggccagcugg

SEQ ID NO: 3704346 - RNA, 18 nt, Human
gucaucauguuuugauuu

SEQ ID NO: 3704347 - RNA, 14 nt, Human
gucaucccauuguc

SEQ ID NO: 3704348 - RNA, 19 nt, Human
gucauccucaaagaaagug

SEQ ID NO: 3704349 - RNA, 23 nt, Human
gucaucgcucguguguucuaucc

SEQ ID NO: 3704350 - RNA, 15 nt, Human
gucaucuaguuuuaa

SEQ ID NO: 3704351 - RNA, 16 nt, Human
gucaucuaguuuuaaa

SEQ ID NO: 3704352 - RNA, 17 nt, Human
gucaucugauuggacag

SEQ ID NO: 3704353 - RNA, 20 nt, Human
gucaucuugaccaagcagga

SEQ ID NO: 3704354 - RNA, 22 nt, Human
gucaucuugaccaagcaggaag

SEQ ID NO: 3704355 - RNA, 15 nt, Human
gucaucuugcuacca

SEQ ID NO: 3704356 - RNA, 22 nt, Human
gucaucuugcuaccaguauuua

SEQ ID NO: 3704357 - RNA, 22 nt, Human
gucaucuuuuucucuaaaauag

SEQ ID NO: 3704358 - RNA, 23 nt, Human
gucaucuuuuucucuaaaauagc

SEQ ID NO: 3704359 - RNA, 18 nt, Human
gucaugagcugagcaggg

SEQ ID NO: 3704360 - RNA, 21 nt, Human
gucaugaggagauucugccuu

SEQ ID NO: 3704361 - RNA, 22 nt, Human
gucaugaggagauucugccuuu

SEQ ID NO: 3704362 - RNA, 14 nt, Human
gucaugaucucccu

SEQ ID NO: 3704363 - RNA, 16 nt, Human
gucaugaucucccugc

SEQ ID NO: 3704364 - RNA, 17 nt, Human
gucaugaucucccugcc

SEQ ID NO: 3704365 - RNA, 19 nt, Human
gucaugaugcucuuuccca

SEQ ID NO: 3704366 - RNA, 15 nt, Human
gucaugauggcacca

SEQ ID NO: 3704367 - RNA, 20 nt, Human
gucaugauguuuuuaaaauc

SEQ ID NO: 3704368 - RNA, 16 nt, Human
gucaugcaaaggcugg

SEQ ID NO: 3704369 - RNA, 18 nt, Human
gucaugcaaaggcuggga

SEQ ID NO: 3704370 - RNA, 14 nt, Human
gucaugcauaaaua

SEQ ID NO: 3704371 - RNA, 12 nt, Human
gucaugcaugaa

SEQ ID NO: 3704372 - RNA, 18 nt, Human
gucaugcccuccucuccc

SEQ ID NO: 3704373 - RNA, 17 nt, Human
gucaugcuccccugugc

SEQ ID NO: 3704374 - RNA, 13 nt, Human
gucaugcugccuu

SEQ ID NO: 3704375 - RNA, 12 nt, Human
gucaugcuucau

SEQ ID NO: 3704376 - RNA, 13 nt, Human
gucauggccacac

SEQ ID NO: 3704377 - RNA, 17 nt, Human
gucauggccacacugug

SEQ ID NO: 3704378 - RNA, 21 nt, Human
gucauggccacacugugacac

SEQ ID NO: 3704379 - RNA, 20 nt, Human
gucaugguuacaaacuacag

SEQ ID NO: 3704380 - RNA, 11 nt, Human
gucaugugacc

SEQ ID NO: 3704381 - RNA, 18 nt, Human
gucaugugggucuuccag

SEQ ID NO: 3704382 - RNA, 13 nt, Human
gucauguguauaa

SEQ ID NO: 3704383 - RNA, 14 nt, Human
gucauguguauaaa

SEQ ID NO: 3704384 - RNA, 15 nt, Human
gucauguuuaagaaa

SEQ ID NO: 3704385 - RNA, 15 nt, Human
gucauguuugcaggg

SEQ ID NO: 3704386 - RNA, 15 nt, Human
gucauuaaacugguu

SEQ ID NO: 3704387 - RNA, 23 nt, Human
ugccugccauguaccuccccugc

SEQ ID NO: 3704388 - RNA, 15 nt, Human
ugccugcccaggccc

SEQ ID NO: 3704389 - RNA, 18 nt, Human
ugccugccccaaacaaau

SEQ ID NO: 3704390 - RNA, 12 nt, Human
ugccugccccgc

SEQ ID NO: 3704391 - RNA, 20 nt, Human
ugccugcccgcacagcagcc

SEQ ID NO: 3704392 - RNA, 15 nt, Human
ugccugcccuuuguc

SEQ ID NO: 3704393 - RNA, 21 nt, Human
ugccugccugucugucucucc

SEQ ID NO: 3704394 - RNA, 11 nt, Human
ugccugccuua

SEQ ID NO: 3704395 - RNA, 13 nt, Human
ugccugcgucuuc

SEQ ID NO: 3704396 - RNA, 15 nt, Human
ugccugcgucuuccg

SEQ ID NO: 3704397 - RNA, 17 nt, Human
ugccugcgucuuccgcc

SEQ ID NO: 3704398 - RNA, 19 nt, Human
ugccugcgugggugugugc

SEQ ID NO: 3704399 - RNA, 20 nt, Human
ugccugcucccauccugugu

SEQ ID NO: 3704400 - RNA, 22 nt, Human
ugccugcucccauccugugugu

SEQ ID NO: 3704401 - RNA, 16 nt, Human
ugccugcucgcucccu

SEQ ID NO: 3704402 - RNA, 21 nt, Human
ugccugcuuuucacugcugca

SEQ ID NO: 3704403 - RNA, 22 nt, Human
ugccugcuuuucacugcugcaa

SEQ ID NO: 3704404 - RNA, 22 nt, Human
ugccugcuuuuuauggccugug

SEQ ID NO: 3704405 - RNA, 18 nt, Human
ugccuggaagagcagccc

SEQ ID NO: 3704406 - RNA, 20 nt, Human
ugccuggaagagcagcccua

SEQ ID NO: 3704407 - RNA, 23 nt, Human
ugccuggaagcuuuguccccugc

SEQ ID NO: 3704408 - RNA, 21 nt, Human
ugccuggacauuugccuugcu

SEQ ID NO: 3704409 - RNA, 12 nt, Human
ugccuggacccg

SEQ ID NO: 3704410 - RNA, 18 nt, Human
ugccuggagcuccuggga

SEQ ID NO: 3704411 - RNA, 16 nt, Human
ugccuggaggaccuga

SEQ ID NO: 3704412 - RNA, 21 nt, Human
ugccuggaggaccugagccug

SEQ ID NO: 3704413 - RNA, 23 nt, Human
ugccuggauccccucugucuaca

SEQ ID NO: 3704414 - RNA, 16 nt, Human
ugccuggauggggcug

SEQ ID NO: 3704415 - RNA, 23 nt, Human
ugccuggcaggcugucuggccag

SEQ ID NO: 3704416 - RNA, 20 nt, Human
ugccuggccaggcagaucug

SEQ ID NO: 3704417 - RNA, 17 nt, Human
ugccuggcccccugucc

SEQ ID NO: 3704418 - RNA, 15 nt, Human
ugccuggccggccag

SEQ ID NO: 3704419 - RNA, 17 nt, Human
ugccuggccggccagcc

SEQ ID NO: 3704420 - RNA, 17 nt, Human
ugccuggccuggcacac

SEQ ID NO: 3704421 - RNA, 20 nt, Human
ugccuggccuggcacacauc

SEQ ID NO: 3704422 - RNA, 15 nt, Human
ugccuggcggggugg

SEQ ID NO: 3704423 - RNA, 22 nt, Human
ugccugggcucccuugugcgug

SEQ ID NO: 3704424 - RNA, 17 nt, Human
ugccugggcuguuggca

SEQ ID NO: 3704425 - RNA, 19 nt, Human
ugccugggggaguuuuccu

SEQ ID NO: 3704426 - RNA, 20 nt, Human
ugccugggggaguuuuccuc

SEQ ID NO: 3704427 - RNA, 23 nt, Human
ugccugggguguuaguggcaccg

SEQ ID NO: 3704428 - RNA, 21 nt, Human
ugccuggguggacauggcccc

SEQ ID NO: 3704429 - RNA, 19 nt, Human
ugccuggguggaugggcca

SEQ ID NO: 3704430 - RNA, 17 nt, Human
ugccuggucacagggca

SEQ ID NO: 3704431 - RNA, 20 nt, Human
ugccuggucuccugccccca

SEQ ID NO: 3704432 - RNA, 19 nt, Human
ugccuggugcacugugucu

SEQ ID NO: 3704433 - RNA, 14 nt, Human
ugccugguggcagc

SEQ ID NO: 3704434 - RNA, 19 nt, Human
ugccuguaaucccagcacu

SEQ ID NO: 3704435 - RNA, 19 nt, Human
ugccuguacucgcuugugc

SEQ ID NO: 3704436 - RNA, 13 nt, Human
ugccuguaguuag

SEQ ID NO: 3704437 - RNA, 23 nt, Human
ugccuguaguuaggaaauaaaac

SEQ ID NO: 3704438 - RNA, 16 nt, Human
ugccuguauacuuuag

SEQ ID NO: 3704439 - RNA, 16 nt, Human
ugccuguccagccugg

SEQ ID NO: 3704440 - RNA, 14 nt, Human
ugccugucugcccc

SEQ ID NO: 3704441 - RNA, 16 nt, Human
ugccugucugccccag

SEQ ID NO: 3704442 - RNA, 21 nt, Human
ugccugugaacugaacucuga

SEQ ID NO: 3704443 - RNA, 15 nt, Human
ugccugugagccagu

SEQ ID NO: 3704444 - RNA, 16 nt, Human
ugccugugagccaguc

SEQ ID NO: 3704445 - RNA, 17 nt, Human
ugccugugaggcagggg

SEQ ID NO: 3704446 - RNA, 20 nt, Human
ugccugugcacggccagcug

SEQ ID NO: 3704447 - RNA, 21 nt, Human
ugccugugcacggccagcugc

SEQ ID NO: 3704448 - RNA, 19 nt, Human
ugccugugccacccaccag

SEQ ID NO: 3704449 - RNA, 14 nt, Human
ugccuguggaacug

SEQ ID NO: 3704450 - RNA, 21 nt, Human
ugccuguggaaucuggaguga

SEQ ID NO: 3704451 - RNA, 21 nt, Human
ugccuguggcgccgucuccag

SEQ ID NO: 3704452 - RNA, 11 nt, Human
ugccuguggcu

SEQ ID NO: 3704453 - RNA, 13 nt, Human
ugccuguggcugc

SEQ ID NO: 3704454 - RNA, 14 nt, Human
ugccuguggcugcg

SEQ ID NO: 3704455 - RNA, 15 nt, Human
ugccuguguccaugc

SEQ ID NO: 3704456 - RNA, 22 nt, Human
ugccuguguccaugcgcucagg

SEQ ID NO: 3704457 - RNA, 12 nt, Human
ugccugugugcg

SEQ ID NO: 3704458 - RNA, 20 nt, Human
ugccuguuauaacucugcac

SEQ ID NO: 3704459 - RNA, 11 nt, Human
ugccuguucag

SEQ ID NO: 3704460 - RNA, 20 nt, Human
ugccuguucagcuccagcuc

SEQ ID NO: 3704461 - RNA, 18 nt, Human
ugccuguucaguuacaga

SEQ ID NO: 3704462 - RNA, 19 nt, Human
ugccuguucaguuacagaa

SEQ ID NO: 3704463 - RNA, 22 nt, Human
ugccuguucaguuacagaaagu

SEQ ID NO: 3704464 - RNA, 16 nt, Human
ugccuguugggccagg

SEQ ID NO: 3704465 - RNA, 19 nt, Human
ugccuguuucccaggccca

SEQ ID NO: 3704466 - RNA, 15 nt, Human
ugccuuaaaauggaa

SEQ ID NO: 3704467 - RNA, 20 nt, Human
ugccuuaaaauggaauugaa

SEQ ID NO: 3704468 - RNA, 17 nt, Human
ugccuuaaaccuaccuc

SEQ ID NO: 3704469 - RNA, 13 nt, Human
ugccuuaaagaaa

SEQ ID NO: 3704470 - RNA, 15 nt, Human
ugccuuaagugagga

SEQ ID NO: 3704471 - RNA, 21 nt, Human
ugccuuacccucauguucuua

SEQ ID NO: 3704472 - RNA, 18 nt, Human
ugccuuaccuccugccca

SEQ ID NO: 3704473 - RNA, 21 nt, Human
ugccuuaccuccugcccagga

SEQ ID NO: 3704474 - RNA, 18 nt, Human
ugccuuacucuucuugaa

SEQ ID NO: 3704475 - RNA, 19 nt, Human
ugccuuacucuucuugaaa

SEQ ID NO: 3704476 - RNA, 20 nt, Human
ugccuuagaaauguaaacug

SEQ ID NO: 3704477 - RNA, 22 nt, Human
ugccuuagaaauguaaacugcc

SEQ ID NO: 3704478 - RNA, 23 nt, Human
ugccuuagaaauguaaacugcca

SEQ ID NO: 3704479 - RNA, 21 nt, Human
ugccuuagaaccuuucuuaca

SEQ ID NO: 3704480 - RNA, 14 nt, Human
ugccuuagaggagc

SEQ ID NO: 3704481 - RNA, 16 nt, Human
ugccuuagaggagccc

SEQ ID NO: 3704482 - RNA, 21 nt, Human
ugccuuaggccuaccugaugg

SEQ ID NO: 3704483 - RNA, 15 nt, Human
ugccuuagucucagu

SEQ ID NO: 3704484 - RNA, 15 nt, Human
ugccuuauggaacac

SEQ ID NO: 3704485 - RNA, 16 nt, Human
ugccuuauuaaaguuc

SEQ ID NO: 3704486 - RNA, 17 nt, Human
ugccuuauucagggaag

SEQ ID NO: 3704487 - RNA, 20 nt, Human
ugccuucaacuaaaaacaaa

SEQ ID NO: 3704488 - RNA, 17 nt, Human
ugccuucagcucuacag

SEQ ID NO: 3704489 - RNA, 24 nt, Human
ugccuucauggaacucagcugucu

SEQ ID NO: 3704490 - RNA, 17 nt, Human
ugccuucauuaccuuuu

SEQ ID NO: 3704491 - RNA, 19 nt, Human
ugccuucauuaccuuuuuu

SEQ ID NO: 3704492 - RNA, 12 nt, Human
ugccuucauuug

SEQ ID NO: 3704493 - RNA, 13 nt, Human
ugccuuccacgcu

SEQ ID NO: 3704494 - RNA, 17 nt, Human
uguaaggaugggcaugg

SEQ ID NO: 3704495 - RNA, 21 nt, Human
uguaaggcuuguuccaaugcc

SEQ ID NO: 3704496 - RNA, 19 nt, Human
uguaagggaaacugccagc

SEQ ID NO: 3704497 - RNA, 15 nt, Human
uguaaguaaacgguc

SEQ ID NO: 3704498 - RNA, 21 nt, Human
uguaaguaacuucacauuaaa

SEQ ID NO: 3704499 - RNA, 18 nt, Human
uguaagugaaaaacauga

SEQ ID NO: 3704500 - RNA, 16 nt, Human
uguaagugcuacauaa

SEQ ID NO: 3704501 - RNA, 14 nt, Human
uguaagugugagua

SEQ ID NO: 3704502 - RNA, 15 nt, Human
uguaagugugugugu

SEQ ID NO: 3704503 - RNA, 16 nt, Human
uguaaguugaagcaaa

SEQ ID NO: 3704504 - RNA, 14 nt, Human
uguaaguugggcuu

SEQ ID NO: 3704505 - RNA, 18 nt, Human
uguaaguugggcuugcua

SEQ ID NO: 3704506 - RNA, 15 nt, Human
uguaaguuucaggug

SEQ ID NO: 3704507 - RNA, 16 nt, Human
uguaaguuucagguga

SEQ ID NO: 3704508 - RNA, 19 nt, Human
uguaaguuucaggugacau

SEQ ID NO: 3704509 - RNA, 20 nt, Human
uguaauaaaaaguauauguu

SEQ ID NO: 3704510 - RNA, 14 nt, Human
uguaauaaacccuu

SEQ ID NO: 3704511 - RNA, 16 nt, Human
uguaauaaaguauaua

SEQ ID NO: 3704512 - RNA, 19 nt, Human
uguaauaaaguauauaauu

SEQ ID NO: 3704513 - RNA, 16 nt, Human
uguaauaaaguguuuu

SEQ ID NO: 3704514 - RNA, 17 nt, Human
uguaauaaaguguuuuc

SEQ ID NO: 3704515 - RNA, 15 nt, Human
uguaauaaauaugag

SEQ ID NO: 3704516 - RNA, 17 nt, Human
uguaauaacugugaagu

SEQ ID NO: 3704517 - RNA, 12 nt, Human
uguaauaagaca

SEQ ID NO: 3704518 - RNA, 14 nt, Human
uguaauaagacaua

SEQ ID NO: 3704519 - RNA, 17 nt, Human
uguaauaauaccucaau

SEQ ID NO: 3704520 - RNA, 20 nt, Human
uguaauagaaaacugaaaau

SEQ ID NO: 3704521 - RNA, 13 nt, Human
uguaauauuuaca

SEQ ID NO: 3704522 - RNA, 14 nt, Human
uguaauauuuugua

SEQ ID NO: 3704523 - RNA, 22 nt, Human
uguaauauuuuguauuauugcu

SEQ ID NO: 3704524 - RNA, 13 nt, Human
uguaaucaauaaa

SEQ ID NO: 3704525 - RNA, 15 nt, Human
uguaaucaauaaacg

SEQ ID NO: 3704526 - RNA, 16 nt, Human
uguaaucccagcuacu

SEQ ID NO: 3704527 - RNA, 16 nt, Human
uguaaucguuaugugu

SEQ ID NO: 3704528 - RNA, 18 nt, Human
uguaaucguuaugugugu

SEQ ID NO: 3704529 - RNA, 19 nt, Human
uguaaucucguuucaaaaa

SEQ ID NO: 3704530 - RNA, 14 nt, Human
uguaaucucucugc

SEQ ID NO: 3704531 - RNA, 18 nt, Human
uguaaucucucugcagcu

SEQ ID NO: 3704532 - RNA, 20 nt, Human
uguaaucucucugcagcugc

SEQ ID NO: 3704533 - RNA, 19 nt, Human
uguaaucuuguugauaaaa

SEQ ID NO: 3704534 - RNA, 13 nt, Human
uguaaugaaaacc

SEQ ID NO: 3704535 - RNA, 18 nt, Human
uguaaugaaaaugaauau

SEQ ID NO: 3704536 - RNA, 21 nt, Human
uguaaugaaaaugaauaucua

SEQ ID NO: 3704537 - RNA, 20 nt, Human
uguaaugaaacaccuucucu

SEQ ID NO: 3704538 - RNA, 11 nt, Human
uguaaugaaua

SEQ ID NO: 3704539 - RNA, 19 nt, Human
uguaaugaauuccuagaau

SEQ ID NO: 3704540 - RNA, 12 nt, Human
uguaaugcaaaa

SEQ ID NO: 3704541 - RNA, 22 nt, Human
uguaaugcgauuuuauuacugg

SEQ ID NO: 3704542 - RNA, 13 nt, Human
uguaaugcugcac

SEQ ID NO: 3704543 - RNA, 15 nt, Human
uguaauguaacugcu

SEQ ID NO: 3704544 - RNA, 21 nt, Human
uguaauguagcguguuuacau

SEQ ID NO: 3704545 - RNA, 20 nt, Human
uguaauguaggggaaaguuu

SEQ ID NO: 3704546 - RNA, 23 nt, Human
uguaaugucaccaccuucccagc

SEQ ID NO: 3704547 - RNA, 19 nt, Human
uguaaugugugaaaaagau

SEQ ID NO: 3704548 - RNA, 22 nt, Human
uguaaugugugguggccucagc

SEQ ID NO: 3704549 - RNA, 15 nt, Human
uguaauguuaauauu

SEQ ID NO: 3704550 - RNA, 14 nt, Human
uguaauguuacuga

SEQ ID NO: 3704551 - RNA, 22 nt, Human
uguaauguuacugaucaugcau

SEQ ID NO: 3704552 - RNA, 16 nt, Human
uguaauguuuguuacc

SEQ ID NO: 3704553 - RNA, 21 nt, Human
uguaauguuuucuuugcaaag

SEQ ID NO: 3704554 - RNA, 14 nt, Human
uguaauuaaaagca

SEQ ID NO: 3704555 - RNA, 16 nt, Human
uguaauuaaaagcaaa

SEQ ID NO: 3704556 - RNA, 18 nt, Human
uguaauuaaguacuaugu

SEQ ID NO: 3704557 - RNA, 21 nt, Human
uguaauuaaguacuauguauc

SEQ ID NO: 3704558 - RNA, 22 nt, Human
uguaauuacuuaucccugccca

SEQ ID NO: 3704559 - RNA, 15 nt, Human
uguaauuauaucuga

SEQ ID NO: 3704560 - RNA, 16 nt, Human
uguaauuaugauuugg

SEQ ID NO: 3704561 - RNA, 13 nt, Human
uguaauuauuuga

SEQ ID NO: 3704562 - RNA, 16 nt, Human
uguaauuauuugaaug

SEQ ID NO: 3704563 - RNA, 14 nt, Human
uguaauucagugua

SEQ ID NO: 3704564 - RNA, 15 nt, Human
uguaauuccuaccuc

SEQ ID NO: 3704565 - RNA, 14 nt, Human
uguaauucuucagu

SEQ ID NO: 3704566 - RNA, 23 nt, Human
uguaauugacgguuuuuuauuau

SEQ ID NO: 3704567 - RNA, 14 nt, Human
uguaauugcuuaca

SEQ ID NO: 3704568 - RNA, 21 nt, Human
uguaauuguguggauucuuua

SEQ ID NO: 3704569 - RNA, 19 nt, Human
uguaauuguuccuuuuauu

SEQ ID NO: 3704570 - RNA, 23 nt, Human
uguaauuguuguuuguauguaua

SEQ ID NO: 3704571 - RNA, 18 nt, Human
uguaauuuaaaauuguga

SEQ ID NO: 3704572 - RNA, 22 nt, Human
uguaauuuaaaauugugaugug

SEQ ID NO: 3704573 - RNA, 15 nt, Human
uguaauuuaaacagg

SEQ ID NO: 3704574 - RNA, 19 nt, Human
uguaauuuaaacaggccca

SEQ ID NO: 3704575 - RNA, 22 nt, Human
uguaauuuaaacaggcccagca

SEQ ID NO: 3704576 - RNA, 19 nt, Human
uguaauuuaaggucuguuu

SEQ ID NO: 3704577 - RNA, 20 nt, Human
uguaauuuaggguacuaaau

SEQ ID NO: 3704578 - RNA, 21 nt, Human
uguaauuuaggguacuaaauu

SEQ ID NO: 3704579 - RNA, 15 nt, Human
uguaauuuauaaaau

SEQ ID NO: 3704580 - RNA, 18 nt, Human
uguaauuucuuugccugu

SEQ ID NO: 3704581 - RNA, 21 nt, Human
uguaauuucuuugccuguuca

SEQ ID NO: 3704582 - RNA, 23 nt, Human
uguaauuucuuugccuguucagu

SEQ ID NO: 3704583 - RNA, 16 nt, Human
uguaauuugugauaca

SEQ ID NO: 3704584 - RNA, 17 nt, Human
uguaauuugugauacaa

SEQ ID NO: 3704585 - RNA, 21 nt, Human
uguaauuugugauacaaugcu

SEQ ID NO: 3704586 - RNA, 13 nt, Human
uguaauuugugua

SEQ ID NO: 3704587 - RNA, 15 nt, Human
uguaauuuguguaau

SEQ ID NO: 3704588 - RNA, 20 nt, Human
uguaauuuguguaauaaagu

SEQ ID NO: 3704589 - RNA, 14 nt, Human
uguaauuuguuuga

SEQ ID NO: 3704590 - RNA, 23 nt, Human
uguaauuuuacacgcuuuuguga

SEQ ID NO: 3704591 - RNA, 16 nt, Human
uguaauuuuauaugaa

SEQ ID NO: 3704592 - RNA, 20 nt, Human
uguaauuuuguguaagaaau

SEQ ID NO: 3704593 - RNA, 15 nt, Human
uguaauuuuucugua

SEQ ID NO: 3704594 - RNA, 17 nt, Human
uguaauuuuucuguaua

SEQ ID NO: 3704595 - RNA, 17 nt, Human
uguacaaaaaaaucuuc

SEQ ID NO: 3704596 - RNA, 22 nt, Human
uguacaaaagggacaugaaaua

SEQ ID NO: 3704597 - RNA, 22 nt, Human
uguacaaaauaaacaaauaaca

SEQ ID NO: 3704598 - RNA, 17 nt, Human
uguacaaaauaaaguua

SEQ ID NO: 3704599 - RNA, 14 nt, Human
uguacaaaauggaa

SEQ ID NO: 3704600 - RNA, 20 nt, Human
uguacaaaauggaauucauu

SEQ ID NO: 3704601 - RNA, 19 nt, Human
uguacaaaguagaagucuu

SEQ ID NO: 3704602 - RNA, 23 nt, Human
uguacaaaguagaagucuuagau

SEQ ID NO: 3704603 - RNA, 13 nt, Human
uguacaaaguauu

SEQ ID NO: 3704604 - RNA, 18 nt, Human
uguacaaaguauuaagca

SEQ ID NO: 3704605 - RNA, 19 nt, Human
uguacaaaguauuaagcau

SEQ ID NO: 3704606 - RNA, 16 nt, Human
guucuaaguuucuaag

SEQ ID NO: 3704607 - RNA, 21 nt, Human
guucuaaguuucuaagauucu

SEQ ID NO: 3704608 - RNA, 19 nt, Human
guucuaauaauuucuaaug

SEQ ID NO: 3704609 - RNA, 17 nt, Human
guucuacccguuccaaa

SEQ ID NO: 3704610 - RNA, 16 nt, Human
guucuacucaggcugg

SEQ ID NO: 3704611 - RNA, 13 nt, Human
guucuagaaaaac

SEQ ID NO: 3704612 - RNA, 15 nt, Human
guucuagagaagagg

SEQ ID NO: 3704613 - RNA, 23 nt, Human
guucuagagaagaggcuggugcu

SEQ ID NO: 3704614 - RNA, 19 nt, Human
guucuagcauggcauauuu

SEQ ID NO: 3704615 - RNA, 14 nt, Human
guucuagucuccuu

SEQ ID NO: 3704616 - RNA, 17 nt, Human
guucuaugguuaugaaa

SEQ ID NO: 3704617 - RNA, 14 nt, Human
guucuauuuaagug

SEQ ID NO: 3704618 - RNA, 23 nt, Human
guucuauuuaaguguacuaauua

SEQ ID NO: 3704619 - RNA, 18 nt, Human
guucuauuucagugccaa

SEQ ID NO: 3704620 - RNA, 13 nt, Human
guucuauuuggaa

SEQ ID NO: 3704621 - RNA, 15 nt, Human
guucuauuuggaauu

SEQ ID NO: 3704622 - RNA, 22 nt, Human
guucucaaacgguacacagacu

SEQ ID NO: 3704623 - RNA, 12 nt, Human
guucucaaugaa

SEQ ID NO: 3704624 - RNA, 15 nt, Human
guucucaaugaaaaa

SEQ ID NO: 3704625 - RNA, 17 nt, Human
guucucaauuccaacag

SEQ ID NO: 3704626 - RNA, 17 nt, Human
guucucacacccaccgu

SEQ ID NO: 3704627 - RNA, 23 nt, Human
guucucagaaucccuuaacaguu

SEQ ID NO: 3704628 - RNA, 19 nt, Human
guucucagcucccccuguc

SEQ ID NO: 3704629 - RNA, 17 nt, Human
guucucagguguugcca

SEQ ID NO: 3704630 - RNA, 19 nt, Human
guucucauggguggcacuc

SEQ ID NO: 3704631 - RNA, 20 nt, Human
guucucccucccaccuuaaa

SEQ ID NO: 3704632 - RNA, 17 nt, Human
guucuccugcugcuccc

SEQ ID NO: 3704633 - RNA, 18 nt, Human
guucuccugcugcucccu

SEQ ID NO: 3704634 - RNA, 21 nt, Human
guucuccugcugcucccucag

SEQ ID NO: 3704635 - RNA, 22 nt, Human
guucuccugcugcucccucaga

SEQ ID NO: 3704636 - RNA, 12 nt, Human
guucucuagaaa

SEQ ID NO: 3704637 - RNA, 18 nt, Human
guucucuaucauuuaaua

SEQ ID NO: 3704638 - RNA, 17 nt, Human
guucucucugccuguga

SEQ ID NO: 3704639 - RNA, 14 nt, Human
guucucugaggaca

SEQ ID NO: 3704640 - RNA, 18 nt, Human
guucucugcccuccaaga

SEQ ID NO: 3704641 - RNA, 12 nt, Human
guucucugggag

SEQ ID NO: 3704642 - RNA, 20 nt, Human
guucucugggagaaaaucau

SEQ ID NO: 3704643 - RNA, 16 nt, Human
guucucuguccagcag

SEQ ID NO: 3704644 - RNA, 21 nt, Human
guucugaaauauuuuaccacu

SEQ ID NO: 3704645 - RNA, 14 nt, Human
guucugaagaagau

SEQ ID NO: 3704646 - RNA, 23 nt, Human
guucugacauuaacaguuuucca

SEQ ID NO: 3704647 - RNA, 21 nt, Human
guucugagauggcucccaggg

SEQ ID NO: 3704648 - RNA, 14 nt, Human
guucugauuagaaa

SEQ ID NO: 3704649 - RNA, 20 nt, Human
guucugauuagaaaugacca

SEQ ID NO: 3704650 - RNA, 22 nt, Human
guucugcaaaaauauuuauaaa

SEQ ID NO: 3704651 - RNA, 18 nt, Human
guucugcaaauagaaaac

SEQ ID NO: 3704652 - RNA, 19 nt, Human
guucugcaaauagaaaaca

SEQ ID NO: 3704653 - RNA, 15 nt, Human
guucugcacacagca

SEQ ID NO: 3704654 - RNA, 16 nt, Human
guucugcacacagcac

SEQ ID NO: 3704655 - RNA, 13 nt, Human
guucugcacugaa

SEQ ID NO: 3704656 - RNA, 14 nt, Human
guucugcacugaaa

SEQ ID NO: 3704657 - RNA, 12 nt, Human
guucugccagga

SEQ ID NO: 3704658 - RNA, 19 nt, Human
guucugcccccagcccaaa

SEQ ID NO: 3704659 - RNA, 17 nt, Human
guucugccugccagcug

SEQ ID NO: 3704660 - RNA, 23 nt, Human
guucugcucaucauucucugucu

SEQ ID NO: 3704661 - RNA, 16 nt, Human
guucugcuccagacag

SEQ ID NO: 3704662 - RNA, 20 nt, Human
guucugcuccagacagggaa

SEQ ID NO: 3704663 - RNA, 13 nt, Human
guucugcuccucu

SEQ ID NO: 3704664 - RNA, 16 nt, Human
guucugcuccucucca

SEQ ID NO: 3704665 - RNA, 18 nt, Human
guucugcuccucuccagg

SEQ ID NO: 3704666 - RNA, 22 nt, Human
guucugcucugguuguuucugu

SEQ ID NO: 3704667 - RNA, 16 nt, Human
guucugcuggccugga

SEQ ID NO: 3704668 - RNA, 21 nt, Human
guucugcuucaauaaaucuuu

SEQ ID NO: 3704669 - RNA, 14 nt, Human
guucugcuuucucc

SEQ ID NO: 3704670 - RNA, 23 nt, Human
guucuggcagaguugaagacaga

SEQ ID NO: 3704671 - RNA, 12 nt, Human
guucuggccaga

SEQ ID NO: 3704672 - RNA, 13 nt, Human
guucuggccagaa

SEQ ID NO: 3704673 - RNA, 21 nt, Human
guucuggcccucaccccugcc

SEQ ID NO: 3704674 - RNA, 16 nt, Human
guucuggcucuuccag

SEQ ID NO: 3704675 - RNA, 12 nt, Human
guucugggacac

SEQ ID NO: 3704676 - RNA, 23 nt, Human
guucugggacacaguucaauucu

SEQ ID NO: 3704677 - RNA, 21 nt, Human
guucuggggggacccagugca

SEQ ID NO: 3704678 - RNA, 17 nt, Human
guucugguccuuuuugg

SEQ ID NO: 3704679 - RNA, 19 nt, Human
guucuggugaggccuugcu

SEQ ID NO: 3704680 - RNA, 20 nt, Human
guucuggugaggccuugcuc

SEQ ID NO: 3704681 - RNA, 12 nt, Human
guucugguguua

SEQ ID NO: 3704682 - RNA, 15 nt, Human
guucuguauuugaaa

SEQ ID NO: 3704683 - RNA, 12 nt, Human
guucugucacca

SEQ ID NO: 3704684 - RNA, 17 nt, Human
guucuguggaaagugua

SEQ ID NO: 3704685 - RNA, 14 nt, Human
guucugugguuccu

SEQ ID NO: 3704686 - RNA, 23 nt, Human
guucuguguauuuaauuguaaac

SEQ ID NO: 3704687 - RNA, 18 nt, Human
guucuguguauuuucagu

SEQ ID NO: 3704688 - RNA, 23 nt, Human
guucugugucuuucacagcuccu

SEQ ID NO: 3704689 - RNA, 15 nt, Human
guucuguguuuaauu

SEQ ID NO: 3704690 - RNA, 22 nt, Human
guucuguguuuaauuucuucaa

SEQ ID NO: 3704691 - RNA, 13 nt, Human
guucuguuacaaa

SEQ ID NO: 3704692 - RNA, 20 nt, Human
guucuguuacaaaauguaac

SEQ ID NO: 3704693 - RNA, 21 nt, Human
guucuguuauauccccugcua

SEQ ID NO: 3704694 - RNA, 13 nt, Human
guucuguuucaag

SEQ ID NO: 3704695 - RNA, 13 nt, Human
guucuguuugcug

SEQ ID NO: 3704696 - RNA, 22 nt, Human
guucuguuuguuauuguuuugu

SEQ ID NO: 3704697 - RNA, 16 nt, Human
guucuguuuuguuucg

SEQ ID NO: 3704698 - RNA, 16 nt, Human
guucuguuuuguuuug

SEQ ID NO: 3704699 - RNA, 23 nt, Human
guucuguuuuguuuuguuuuuua

SEQ ID NO: 3704700 - RNA, 13 nt, Human
guucuuaauucuu

SEQ ID NO: 3704701 - RNA, 13 nt, Human
guucuuaauugca

SEQ ID NO: 3704702 - RNA, 15 nt, Human
guucuuaauugcacu

SEQ ID NO: 3704703 - RNA, 16 nt, Human
guucuuacugcuuaau

SEQ ID NO: 3704704 - RNA, 18 nt, Human
guucuuagauaucuuuuu

SEQ ID NO: 3704705 - RNA, 17 nt, Human
guucuuaguuugcaguu

SEQ ID NO: 3704706 - RNA, 14 nt, Human
guucuuccaaagca

SEQ ID NO: 3704707 - RNA, 13 nt, Human
guucuuccucagc

SEQ ID NO: 3704708 - RNA, 18 nt, Human
guucuuccucagccagcc

SEQ ID NO: 3704709 - RNA, 15 nt, Human
guucuuccuguaauc

SEQ ID NO: 3704710 - RNA, 14 nt, Human
guucuucgggaaga

SEQ ID NO: 3704711 - RNA, 19 nt, Human
guucuugccacugcacucc

SEQ ID NO: 3704712 - RNA, 13 nt, Human
guucuugcugcua

SEQ ID NO: 3704713 - RNA, 14 nt, Human
guucuugcugcuag

SEQ ID NO: 3704714 - RNA, 15 nt, Human
guucuugcugcuaga

SEQ ID NO: 3704715 - RNA, 17 nt, Human
guucuugcugcuagaac

SEQ ID NO: 3704716 - RNA, 20 nt, Human
guucuuggcaauaaauuuug

SEQ ID NO: 3704717 - RNA, 12 nt, Human
guucuugucuga

SEQ ID NO: 3704718 - RNA, 14 nt, Human
guucuuguucuguu

SEQ ID NO: 3704719 - RNA, 18 nt, Human
guucuuguucuguuuugu

SEQ ID NO: 3704720 - RNA, 23 nt, Human
guucuuguuuuuaaguuugcacu

SEQ ID NO: 3704721 - RNA, 16 nt, Human
guucuuuaggagauuu

SEQ ID NO: 3704722 - RNA, 13 nt, Human
guucuuuauauac

SEQ ID NO: 3704723 - RNA, 19 nt, Human
guucuuuauauacaauaau

SEQ ID NO: 3704724 - RNA, 12 nt, Human
guucuuucagaa

SEQ ID NO: 3704725 - RNA, 20 nt, Human
guucuuuccauaauaaaagg

SEQ ID NO: 3704726 - RNA, 14 nt, Human
guucuuucuuccuc

SEQ ID NO: 3704727 - RNA, 15 nt, Human
guucuuucuuccucu

SEQ ID NO: 3704728 - RNA, 16 nt, Human
guucuuucuuccucug

SEQ ID NO: 3704729 - RNA, 21 nt, Human
guucuuugagggacugccucu

SEQ ID NO: 3704730 - RNA, 23 nt, Human
guucuuugcugcauucugccucu

SEQ ID NO: 3704731 - RNA, 11 nt, Human
guucuuuggaa

SEQ ID NO: 3704732 - RNA, 18 nt, Human
guucuuuggaaggaguga

SEQ ID NO: 3704733 - RNA, 17 nt, Human
guucuuugggccagaca

SEQ ID NO: 3704734 - RNA, 20 nt, Human
guucuuuguucauagcccag

SEQ ID NO: 3704735 - RNA, 21 nt, Human
guucuuuguucauagcccagu

SEQ ID NO: 3704736 - RNA, 13 nt, Human
guucuuuuaaagg

SEQ ID NO: 3704737 - RNA, 16 nt, Human
guucuuuuguuguaaa

SEQ ID NO: 3704738 - RNA, 15 nt, Human
guucuuuuuaaguua

SEQ ID NO: 3704739 - RNA, 17 nt, Human
guucuuuuuaaguuaau

SEQ ID NO: 3704740 - RNA, 21 nt, Human
guugaaaaaauuuaaaaguaa

SEQ ID NO: 3704741 - RNA, 17 nt, Human
guugaaaaacagcugag

SEQ ID NO: 3704742 - RNA, 17 nt, Human
guugaaaagacuccaaa

SEQ ID NO: 3704743 - RNA, 22 nt, Human
guugaaaagacuccaaagaaau

SEQ ID NO: 3704744 - RNA, 23 nt, Human
guugaaaagacuccaaagaaaug

SEQ ID NO: 3704745 - RNA, 12 nt, Human
guugaaacauau

SEQ ID NO: 3704746 - RNA, 12 nt, Human
guugaaagcaaa

SEQ ID NO: 3704747 - RNA, 16 nt, Human
guugaaagcaaaaaug

SEQ ID NO: 3704748 - RNA, 21 nt, Human
guugaaagcaaaaaugcuaau

SEQ ID NO: 3704749 - RNA, 20 nt, Human
guugaaagguuuuuuuucag

SEQ ID NO: 3704750 - RNA, 20 nt, Human
guugaaauuauguauguuua

SEQ ID NO: 3704751 - RNA, 15 nt, Human
guugaaauuguaauu

SEQ ID NO: 3704752 - RNA, 16 nt, Human
guugaaauuguaauua

SEQ ID NO: 3704753 - RNA, 19 nt, Human
guugaacuguuagaaugua

SEQ ID NO: 3704754 - RNA, 21 nt, Human
guugaagaccuaaccagggcc

SEQ ID NO: 3704755 - RNA, 16 nt, Human
guugaagacuuuguuu

SEQ ID NO: 3704756 - RNA, 17 nt, Human
uggaggccucaggugcu

SEQ ID NO: 3704757 - RNA, 19 nt, Human
uggaggccuuccagcugcu

SEQ ID NO: 3704758 - RNA, 21 nt, Human
uggaggccuuccagcugcugu

SEQ ID NO: 3704759 - RNA, 22 nt, Human
uggaggcggugcggcagggaag

SEQ ID NO: 3704760 - RNA, 19 nt, Human
uggaggcugacgugugagg

SEQ ID NO: 3704761 - RNA, 14 nt, Human
uggaggcugucuuc

SEQ ID NO: 3704762 - RNA, 15 nt, Human
uggaggcuuccugcg

SEQ ID NO: 3704763 - RNA, 22 nt, Human
uggaggcuuccugcguccuccu

SEQ ID NO: 3704764 - RNA, 13 nt, Human
uggagggccuggg

SEQ ID NO: 3704765 - RNA, 18 nt, Human
uggagggccugggccugg

SEQ ID NO: 3704766 - RNA, 21 nt, Human
uggagggcuagaaucuggaga

SEQ ID NO: 3704767 - RNA, 21 nt, Human
uggagggcuggaaucuggaga

SEQ ID NO: 3704768 - RNA, 14 nt, Human
uggaggggcagagc

SEQ ID NO: 3704769 - RNA, 20 nt, Human
uggaggggcauggccagcag

SEQ ID NO: 3704770 - RNA, 23 nt, Human
uggaggggggaggugggauccuc

SEQ ID NO: 3704771 - RNA, 17 nt, Human
uggagggguaggggcug

SEQ ID NO: 3704772 - RNA, 14 nt, Human
uggagggguguggc

SEQ ID NO: 3704773 - RNA, 15 nt, Human
uggagggucccaagc

SEQ ID NO: 3704774 - RNA, 16 nt, Human
uggagggucccaagcu

SEQ ID NO: 3704775 - RNA, 20 nt, Human
uggagggugggagagcccag

SEQ ID NO: 3704776 - RNA, 18 nt, Human
uggaggucacauucagga

SEQ ID NO: 3704777 - RNA, 20 nt, Human
uggaggucacauucaggaag

SEQ ID NO: 3704778 - RNA, 20 nt, Human
uggaggucagcauuugaucu

SEQ ID NO: 3704779 - RNA, 20 nt, Human
uggaggucgguagguucagc

SEQ ID NO: 3704780 - RNA, 23 nt, Human
uggagguggaaaagcaacauuca

SEQ ID NO: 3704781 - RNA, 17 nt, Human
uggaggugggagcagga

SEQ ID NO: 3704782 - RNA, 18 nt, Human
uggaggugggagcaggag

SEQ ID NO: 3704783 - RNA, 19 nt, Human
uggagguggggccuggagc

SEQ ID NO: 3704784 - RNA, 15 nt, Human
uggaggugggguugg

SEQ ID NO: 3704785 - RNA, 17 nt, Human
uggagguuaaggcugag

SEQ ID NO: 3704786 - RNA, 20 nt, Human
uggagguuaaggcugaggaa

SEQ ID NO: 3704787 - RNA, 22 nt, Human
uggagguuaaggcugaggaaag

SEQ ID NO: 3704788 - RNA, 15 nt, Human
uggagguucuaaggc

SEQ ID NO: 3704789 - RNA, 15 nt, Human
uggagguugaagcca

SEQ ID NO: 3704790 - RNA, 18 nt, Human
uggagguugaagccaagu

SEQ ID NO: 3704791 - RNA, 14 nt, Human
uggagguugauaac

SEQ ID NO: 3704792 - RNA, 14 nt, Human
uggagguugcagug

SEQ ID NO: 3704793 - RNA, 16 nt, Human
uggagucaaaaagaac

SEQ ID NO: 3704794 - RNA, 14 nt, Human
uggaguccagucuc

SEQ ID NO: 3704795 - RNA, 14 nt, Human
uggaguccccucac

SEQ ID NO: 3704796 - RNA, 14 nt, Human
uggagucggaaggg

SEQ ID NO: 3704797 - RNA, 13 nt, Human
uggagucuccuga

SEQ ID NO: 3704798 - RNA, 22 nt, Human
uggagucugccacccaggaucc

SEQ ID NO: 3704799 - RNA, 18 nt, Human
uggagucuggagugggca

SEQ ID NO: 3704800 - RNA, 15 nt, Human
uggagugcagggagg

SEQ ID NO: 3704801 - RNA, 14 nt, Human
uggagugcagugag

SEQ ID NO: 3704802 - RNA, 16 nt, Human
uggagugcuguuuugu

SEQ ID NO: 3704803 - RNA, 17 nt, Human
uggagugcuguuuuguu

SEQ ID NO: 3704804 - RNA, 16 nt, Human
uggaguggagugagag

SEQ ID NO: 3704805 - RNA, 16 nt, Human
uggaguggcucgccag

SEQ ID NO: 3704806 - RNA, 16 nt, Human
uggaguggggcaguag

SEQ ID NO: 3704807 - RNA, 15 nt, Human
uggagugugagccac

SEQ ID NO: 3704808 - RNA, 21 nt, Human
uggagugugaggguccugcag

SEQ ID NO: 3704809 - RNA, 19 nt, Human
uggaguguguauuguuccc

SEQ ID NO: 3704810 - RNA, 18 nt, Human
uggaguguuauguauuuc

SEQ ID NO: 3704811 - RNA, 19 nt, Human
uggaguguuccccuuccac

SEQ ID NO: 3704812 - RNA, 22 nt, Human
uggaguguuccccuuccacuga

SEQ ID NO: 3704813 - RNA, 18 nt, Human
uggaguucauucauauua

SEQ ID NO: 3704814 - RNA, 16 nt, Human
uggaguuccugaaccu

SEQ ID NO: 3704815 - RNA, 20 nt, Human
uggaguuccugaaccugaug

SEQ ID NO: 3704816 - RNA, 14 nt, Human
uggaguucuugugc

SEQ ID NO: 3704817 - RNA, 22 nt, Human
uggaguugaaagaguuaagaau

SEQ ID NO: 3704818 - RNA, 17 nt, Human
uggaguugaucuggaac

SEQ ID NO: 3704819 - RNA, 11 nt, Human
uggaguuggag

SEQ ID NO: 3704820 - RNA, 21 nt, Human
uggaguuucauguacaagaug

SEQ ID NO: 3704821 - RNA, 16 nt, Human
uggaguuucuaagguc

SEQ ID NO: 3704822 - RNA, 17 nt, Human
uggaguuuuuuguacca

SEQ ID NO: 3704823 - RNA, 18 nt, Human
uggaguuuuuuguaccaa

SEQ ID NO: 3704824 - RNA, 17 nt, Human
uggauaaaauaaugcug

SEQ ID NO: 3704825 - RNA, 19 nt, Human
uggauaaaauaaugcugca

SEQ ID NO: 3704826 - RNA, 16 nt, Human
uggauaacaaagauau

SEQ ID NO: 3704827 - RNA, 17 nt, Human
uggauaacaaagauauc

SEQ ID NO: 3704828 - RNA, 21 nt, Human
uggauaauuuugcauaaaauu

SEQ ID NO: 3704829 - RNA, 18 nt, Human
uggauacauacaccagca

SEQ ID NO: 3704830 - RNA, 14 nt, Human
uggauacuuggauu

SEQ ID NO: 3704831 - RNA, 15 nt, Human
uggauacuuggauuu

SEQ ID NO: 3704832 - RNA, 14 nt, Human
uggauagaugcccu

SEQ ID NO: 3704833 - RNA, 17 nt, Human
uggauagaugcccugcu

SEQ ID NO: 3704834 - RNA, 16 nt, Human
uggauagcaugucuuu

SEQ ID NO: 3704835 - RNA, 17 nt, Human
uggauagcuaauaauga

SEQ ID NO: 3704836 - RNA, 12 nt, Human
uggauauaaaua

SEQ ID NO: 3704837 - RNA, 13 nt, Human
uggauauaaauau

SEQ ID NO: 3704838 - RNA, 23 nt, Human
uggauauagcuaggugacauaua

SEQ ID NO: 3704839 - RNA, 14 nt, Human
uggauaucuguuag

SEQ ID NO: 3704840 - RNA, 16 nt, Human
uggauaucuguuagau

SEQ ID NO: 3704841 - RNA, 15 nt, Human
uggauauuagucaua

SEQ ID NO: 3704842 - RNA, 17 nt, Human
uggauauuauuagaaau

SEQ ID NO: 3704843 - RNA, 18 nt, Human
uggauauuuucaaauugu

SEQ ID NO: 3704844 - RNA, 22 nt, Human
uggauauuuucaaauuguaucu

SEQ ID NO: 3704845 - RNA, 14 nt, Human
uggaucacaaagug

SEQ ID NO: 3704846 - RNA, 16 nt, Human
uggaucacaagaugga

SEQ ID NO: 3704847 - RNA, 14 nt, Human
uggaucacagcugc

SEQ ID NO: 3704848 - RNA, 16 nt, Human
uggaucacagcugcuu

SEQ ID NO: 3704849 - RNA, 19 nt, Human
uggaucacgacgcugcaga

SEQ ID NO: 3704850 - RNA, 17 nt, Human
uggaucagcguggccuu

SEQ ID NO: 3704851 - RNA, 18 nt, Human
uggauccaauguuagaga

SEQ ID NO: 3704852 - RNA, 21 nt, Human
uggauccacuggcuggacaaa

SEQ ID NO: 3704853 - RNA, 14 nt, Human
uggaucuccaagga

SEQ ID NO: 3704854 - RNA, 15 nt, Human
uggaucuccccacuc

SEQ ID NO: 3704855 - RNA, 22 nt, Human
uggaucucccugagaugggcuu

SEQ ID NO: 3704856 - RNA, 22 nt, Human
uggaucucuucuuaauguacau

SEQ ID NO: 3704857 - RNA, 19 nt, Human
uggaucugggacccuuucc

SEQ ID NO: 3704858 - RNA, 23 nt, Human
uggaucugggacccuuuccuucc

SEQ ID NO: 3704859 - RNA, 20 nt, Human
uggaucuguccaaggaaacu

SEQ ID NO: 3704860 - RNA, 14 nt, Human
uggaucuugaaugu

SEQ ID NO: 3704861 - RNA, 19 nt, Human
uggaucuugaauguggucu

SEQ ID NO: 3704862 - RNA, 17 nt, Human
uggaugaaauuuucuag

SEQ ID NO: 3704863 - RNA, 19 nt, Human
uggaugaagauucuccugu

SEQ ID NO: 3704864 - RNA, 22 nt, Human
uggaugaagauucuccugugcu

SEQ ID NO: 3704865 - RNA, 23 nt, Human
uggaugaagauucuccugugcua

SEQ ID NO: 3704866 - RNA, 15 nt, Human
uggaugagcccucag

SEQ ID NO: 3704867 - RNA, 17 nt, Human
uggaugagcccucagaa

SEQ ID NO: 3704868 - RNA, 23 nt, Human
uggaugagcucccacaagccuga

SEQ ID NO: 3704869 - RNA, 20 nt, Human
uggaugauacuaauaaacua

SEQ ID NO: 3704870 - RNA, 19 nt, Human
uggaugauauuuuuuauca

SEQ ID NO: 3704871 - RNA, 13 nt, Human
uggaugcaaagua

SEQ ID NO: 3704872 - RNA, 13 nt, Human
uggaugcagccuc

SEQ ID NO: 3704873 - RNA, 23 nt, Human
uggaugcagugcucgcuguugcu

SEQ ID NO: 3704874 - RNA, 22 nt, Human
uggaugcauguuuuccagcucc

SEQ ID NO: 3704875 - RNA, 22 nt, Human
uggaugccagggccgaccagag

SEQ ID NO: 3704876 - RNA, 13 nt, Human
uggaugcccagga

SEQ ID NO: 3704877 - RNA, 14 nt, Human
uggaugcccaggaa

SEQ ID NO: 3704878 - RNA, 20 nt, Human
uggaugccucauuaugucaa

SEQ ID NO: 3704879 - RNA, 14 nt, Human
uggaugccuggugg

SEQ ID NO: 3704880 - RNA, 18 nt, Human
uggaugccugguggcagc

SEQ ID NO: 3704881 - RNA, 19 nt, Human
uggaugccugguggcagcu

SEQ ID NO: 3704882 - RNA, 21 nt, Human
uggaugccugguggcagcugc

SEQ ID NO: 3704883 - RNA, 13 nt, Human
uggauggaagggg

SEQ ID NO: 3704884 - RNA, 15 nt, Human
uggauggaaggggcu

SEQ ID NO: 3704885 - RNA, 23 nt, Human
uggauggcuugucuauacuccuu

SEQ ID NO: 3704886 - RNA, 17 nt, Human
uggaugggagugagaca

SEQ ID NO: 3704887 - RNA, 21 nt, Human
uggaugggggaaauggugccu

SEQ ID NO: 3704888 - RNA, 21 nt, Human
uggaugggggaacucagaucc

SEQ ID NO: 3704889 - RNA, 23 nt, Human
uggaugggggaacucagauccag

SEQ ID NO: 3704890 - RNA, 14 nt, Human
uggauguccccagc

SEQ ID NO: 3704891 - RNA, 15 nt, Human
uggauguccccagca

SEQ ID NO: 3704892 - RNA, 16 nt, Human
uggauguccccagcag

SEQ ID NO: 3704893 - RNA, 23 nt, Human
uggaugugggguccccaucaucc

SEQ ID NO: 3704894 - RNA, 20 nt, Human
uggauuacuucucuauaaaa

SEQ ID NO: 3704895 - RNA, 15 nt, Human
uggauuaggucucug

SEQ ID NO: 3704896 - RNA, 17 nt, Human
uggauuauauuaugaag

SEQ ID NO: 3704897 - RNA, 14 nt, Human
uggauuauccugag

SEQ ID NO: 3704898 - RNA, 13 nt, Human
uggauuauucauu

SEQ ID NO: 3704899 - RNA, 16 nt, Human
uggauuauucauuuaa

SEQ ID NO: 3704900 - RNA, 17 nt, Human
uggauuauucauuuaaa

SEQ ID NO: 3704901 - RNA, 18 nt, Human
uggauuauucauuuaaaa

SEQ ID NO: 3704902 - RNA, 19 nt, Human
uggauuauucauuuaaaau

SEQ ID NO: 3704903 - RNA, 20 nt, Human
uggauuauucauuuaaaaug

SEQ ID NO: 3704904 - RNA, 16 nt, Human
uggauuauucuuucuc

SEQ ID NO: 3704905 - RNA, 21 nt, Human
uguacaaaguauuaagcauau

SEQ ID NO: 3704906 - RNA, 12 nt, Human
uguacaauaaaa

SEQ ID NO: 3704907 - RNA, 20 nt, Human
uguacaauaaaaacauugcc

SEQ ID NO: 3704908 - RNA, 15 nt, Human
uguacaauauuuaaa

SEQ ID NO: 3704909 - RNA, 14 nt, Human
uguacacacuuuau

SEQ ID NO: 3704910 - RNA, 17 nt, Human
uguacacauauuugaag

SEQ ID NO: 3704911 - RNA, 12 nt, Human
uguacacugaau

SEQ ID NO: 3704912 - RNA, 15 nt, Human
uguacacugaauauu

SEQ ID NO: 3704913 - RNA, 17 nt, Human
uguacacugaauauuua

SEQ ID NO: 3704914 - RNA, 13 nt, Human
uguacacuuuuuu

SEQ ID NO: 3704915 - RNA, 19 nt, Human
uguacagaauuuuggaaga

SEQ ID NO: 3704916 - RNA, 14 nt, Human
uguacagacauauu

SEQ ID NO: 3704917 - RNA, 17 nt, Human
uguacagacauauuuaa

SEQ ID NO: 3704918 - RNA, 20 nt, Human
uguacagacauauuuaacug

SEQ ID NO: 3704919 - RNA, 22 nt, Human
uguacagacauauuuaacuggu

SEQ ID NO: 3704920 - RNA, 19 nt, Human
uguacagacguaugcuuau

SEQ ID NO: 3704921 - RNA, 11 nt, Human
uguacagagcc

SEQ ID NO: 3704922 - RNA, 12 nt, Human
uguacagagccc

SEQ ID NO: 3704923 - RNA, 13 nt, Human
uguacagagccca

SEQ ID NO: 3704924 - RNA, 21 nt, Human
uguacagagcccacgccccca

SEQ ID NO: 3704925 - RNA, 19 nt, Human
uguacagaugaaugauaaa

SEQ ID NO: 3704926 - RNA, 19 nt, Human
uguacagauucuuucaguu

SEQ ID NO: 3704927 - RNA, 20 nt, Human
uguacagauugcugcuucug

SEQ ID NO: 3704928 - RNA, 19 nt, Human
uguacaggaugcuuugguu

SEQ ID NO: 3704929 - RNA, 18 nt, Human
uguacaguagauuuucca

SEQ ID NO: 3704930 - RNA, 14 nt, Human
uguacagucugucu

SEQ ID NO: 3704931 - RNA, 19 nt, Human
uguacagucugucuucugu

SEQ ID NO: 3704932 - RNA, 11 nt, Human
uguacaguguu

SEQ ID NO: 3704933 - RNA, 13 nt, Human
uguacaguguuac

SEQ ID NO: 3704934 - RNA, 16 nt, Human
uguacaguguucuguu

SEQ ID NO: 3704935 - RNA, 20 nt, Human
uguacaguguucuguuuaau

SEQ ID NO: 3704936 - RNA, 21 nt, Human
uguacaguuaucuaaguuaau

SEQ ID NO: 3704937 - RNA, 14 nt, Human
uguacaguucaguu

SEQ ID NO: 3704938 - RNA, 15 nt, Human
uguacaguugggaaa

SEQ ID NO: 3704939 - RNA, 22 nt, Human
uguacaguuuguuuacacacgu

SEQ ID NO: 3704940 - RNA, 17 nt, Human
uguacauaacugaaaau

SEQ ID NO: 3704941 - RNA, 19 nt, Human
uguacauacgauuuaaggu

SEQ ID NO: 3704942 - RNA, 11 nt, Human
uguacauagcc

SEQ ID NO: 3704943 - RNA, 14 nt, Human
uguacauagugcua

SEQ ID NO: 3704944 - RNA, 17 nt, Human
uguacauagugcuaaca

SEQ ID NO: 3704945 - RNA, 15 nt, Human
uguacauaguguaau

SEQ ID NO: 3704946 - RNA, 16 nt, Human
uguacauauauauauu

SEQ ID NO: 3704947 - RNA, 18 nt, Human
uguacauauguaaaauaa

SEQ ID NO: 3704948 - RNA, 21 nt, Human
uguacauauuagcgacaacag

SEQ ID NO: 3704949 - RNA, 22 nt, Human
uguacauauuagcgacaacaga

SEQ ID NO: 3704950 - RNA, 18 nt, Human
uguacaucccauguaaca

SEQ ID NO: 3704951 - RNA, 23 nt, Human
uguacaucccauguaacagaaag

SEQ ID NO: 3704952 - RNA, 19 nt, Human
uguacaucuauuuuggauu

SEQ ID NO: 3704953 - RNA, 20 nt, Human
uguacaucuauuuuggauug

SEQ ID NO: 3704954 - RNA, 23 nt, Human
uguacaucuauuuuggauuguau

SEQ ID NO: 3704955 - RNA, 14 nt, Human
uguacaucuggccu

SEQ ID NO: 3704956 - RNA, 14 nt, Human
uguacaucuggcuu

SEQ ID NO: 3704957 - RNA, 16 nt, Human
uguacaucuggcuuau

SEQ ID NO: 3704958 - RNA, 14 nt, Human
uguacaugaaaaca

SEQ ID NO: 3704959 - RNA, 20 nt, Human
uguacaugaaaacacauuuu

SEQ ID NO: 3704960 - RNA, 19 nt, Human
uguacaugaaauuuuugua

SEQ ID NO: 3704961 - RNA, 20 nt, Human
uguacaugaaauuuuuguaa

SEQ ID NO: 3704962 - RNA, 20 nt, Human
uguacauguauuaaauuaca

SEQ ID NO: 3704963 - RNA, 14 nt, Human
uguacauuaauuac

SEQ ID NO: 3704964 - RNA, 15 nt, Human
uguacauucuaaaau

SEQ ID NO: 3704965 - RNA, 20 nt, Human
uguacauuuaaaauugcuau

SEQ ID NO: 3704966 - RNA, 20 nt, Human
uguacauuuaugauuuaaua

SEQ ID NO: 3704967 - RNA, 10 nt, Human
uguacauuuc

SEQ ID NO: 3704968 - RNA, 22 nt, Human
uguacauuuccaaauucacaag

SEQ ID NO: 3704969 - RNA, 17 nt, Human
uguacauuucuauaaau

SEQ ID NO: 3704970 - RNA, 16 nt, Human
uguacauuucugaaau

SEQ ID NO: 3704971 - RNA, 16 nt, Human
uguacauuugggaguu

SEQ ID NO: 3704972 - RNA, 19 nt, Human
uguacauuuuguuguaaaa

SEQ ID NO: 3704973 - RNA, 21 nt, Human
uguacauuuuguuguaaaaag

SEQ ID NO: 3704974 - RNA, 14 nt, Human
uguaccaaaauuca

SEQ ID NO: 3704975 - RNA, 15 nt, Human
uguaccaaaauuuua

SEQ ID NO: 3704976 - RNA, 19 nt, Human
uguaccagugaauuuuugc

SEQ ID NO: 3704977 - RNA, 21 nt, Human
uguaccaguuaauuuuuccaa

SEQ ID NO: 3704978 - RNA, 18 nt, Human
uguaccauaugaucuguu

SEQ ID NO: 3704979 - RNA, 17 nt, Human
uguaccauguacaugaa

SEQ ID NO: 3704980 - RNA, 19 nt, Human
uguaccaugugcuacaggg

SEQ ID NO: 3704981 - RNA, 15 nt, Human
uguaccauuaaaaua

SEQ ID NO: 3704982 - RNA, 18 nt, Human
uguaccauuuuaaaguua

SEQ ID NO: 3704983 - RNA, 21 nt, Human
uguacccaguauucuagguag

SEQ ID NO: 3704984 - RNA, 12 nt, Human
uguacccaguuu

SEQ ID NO: 3704985 - RNA, 20 nt, Human
uguaccccccaaccccugag

SEQ ID NO: 3704986 - RNA, 14 nt, Human
uguacccccgccca

SEQ ID NO: 3704987 - RNA, 15 nt, Human
uguacccccgcccag

SEQ ID NO: 3704988 - RNA, 22 nt, Human
uguacccccgcccaggcuggcc

SEQ ID NO: 3704989 - RNA, 17 nt, Human
uguacccucugaaauac

SEQ ID NO: 3704990 - RNA, 15 nt, Human
uguaccgcaauguga

SEQ ID NO: 3704991 - RNA, 16 nt, Human
uguaccgcaaugugac

SEQ ID NO: 3704992 - RNA, 19 nt, Human
uguaccgcgucuacccugg

SEQ ID NO: 3704993 - RNA, 15 nt, Human
uguaccuccccugcc

SEQ ID NO: 3704994 - RNA, 18 nt, Human
uguaccuccccugccuug

SEQ ID NO: 3704995 - RNA, 22 nt, Human
uguaccuccccugccuugcugu

SEQ ID NO: 3704996 - RNA, 20 nt, Human
uguaccucuggcugacuaaa

SEQ ID NO: 3704997 - RNA, 22 nt, Human
uguaccucuugagccuugaacu

SEQ ID NO: 3704998 - RNA, 16 nt, Human
uguaccuguguacaua

SEQ ID NO: 3704999 - RNA, 19 nt, Human
uguaccuguguacauaacu

SEQ ID NO: 3705000 - RNA, 18 nt, Human
uguaccuucuuucacucu

SEQ ID NO: 3705001 - RNA, 15 nt, Human
uguaccuuuuaacac

SEQ ID NO: 3705002 - RNA, 22 nt, Human
uguaccuuuugaggagccccag

SEQ ID NO: 3705003 - RNA, 21 nt, Human
uguaccuuuuuuguuuuuuca

SEQ ID NO: 3705004 - RNA, 23 nt, Human
uguacgacgucagauguuuaaaa

SEQ ID NO: 3705005 - RNA, 21 nt, Human
uguacggauuuucaguuacuu

SEQ ID NO: 3705006 - RNA, 14 nt, Human
uguacguccagccu

SEQ ID NO: 3705007 - RNA, 17 nt, Human
uguacgucugacaggca

SEQ ID NO: 3705008 - RNA, 15 nt, Human
uguacguggagaggg

SEQ ID NO: 3705009 - RNA, 17 nt, Human
uguacguuuaaagugua

SEQ ID NO: 3705010 - RNA, 16 nt, Human
uguacguuuguaugug

SEQ ID NO: 3705011 - RNA, 20 nt, Human
uguacguuuguaugugugua

SEQ ID NO: 3705012 - RNA, 14 nt, Human
uguacuaaacagua

SEQ ID NO: 3705013 - RNA, 20 nt, Human
uguacuaaacaguaagauau

SEQ ID NO: 3705014 - RNA, 16 nt, Human
uguacuaauucuuaca

SEQ ID NO: 3705015 - RNA, 14 nt, Human
uguacuaccugugu

SEQ ID NO: 3705016 - RNA, 18 nt, Human
uguacuaguacuguguac

SEQ ID NO: 3705017 - RNA, 19 nt, Human
uguacuauggaaaaucagc

SEQ ID NO: 3705018 - RNA, 21 nt, Human
uguacuauggaaaaucagcug

SEQ ID NO: 3705019 - RNA, 15 nt, Human
uguacuauuuaacug

SEQ ID NO: 3705020 - RNA, 18 nt, Human
uguacucaggaggcugag

SEQ ID NO: 3705021 - RNA, 12 nt, Human
uguacuccuccc

SEQ ID NO: 3705022 - RNA, 23 nt, Human
uguacucgcuugugcagaaaaca

SEQ ID NO: 3705023 - RNA, 15 nt, Human
uguacucuaacuuaa

SEQ ID NO: 3705024 - RNA, 14 nt, Human
uguacucuggccuc

SEQ ID NO: 3705025 - RNA, 20 nt, Human
uguacugaaaaaugguaauu

SEQ ID NO: 3705026 - RNA, 20 nt, Human
uguacugaauuuuuuuguaa

SEQ ID NO: 3705027 - RNA, 23 nt, Human
uguacugaauuuuuuuguaauaa

SEQ ID NO: 3705028 - RNA, 17 nt, Human
uguacugagccuuguaa

SEQ ID NO: 3705029 - RNA, 22 nt, Human
uguacugagccuuguaauucua

SEQ ID NO: 3705030 - RNA, 22 nt, Human
uguacugauuuuuguaagacaa

SEQ ID NO: 3705031 - RNA, 12 nt, Human
uguacugccugc

SEQ ID NO: 3705032 - RNA, 14 nt, Human
uguacugccugcuu

SEQ ID NO: 3705033 - RNA, 16 nt, Human
uguacugcucaggcug

SEQ ID NO: 3705034 - RNA, 17 nt, Human
uguacugcucaggcugc

SEQ ID NO: 3705035 - RNA, 15 nt, Human
uguacugggccaugu

SEQ ID NO: 3705036 - RNA, 16 nt, Human
uguacuguaaagaauu

SEQ ID NO: 3705037 - RNA, 16 nt, Human
uguacuguacuaauuc

SEQ ID NO: 3705038 - RNA, 12 nt, Human
uguacuguaguu

SEQ ID NO: 3705039 - RNA, 17 nt, Human
uguacuguauagacagu

SEQ ID NO: 3705040 - RNA, 19 nt, Human
uguacuguauagacaguuu

SEQ ID NO: 3705041 - RNA, 21 nt, Human
uguacuguauagacaguuugu

SEQ ID NO: 3705042 - RNA, 15 nt, Human
uguacuguuacuggg

SEQ ID NO: 3705043 - RNA, 18 nt, Human
uguacuguuacugggccc

SEQ ID NO: 3705044 - RNA, 19 nt, Human
uguacuguucugugucuuu

SEQ ID NO: 3705045 - RNA, 24 nt, Human
uguacuguuuaauguucugugaua

SEQ ID NO: 3705046 - RNA, 15 nt, Human
uguacuuaaauggua

SEQ ID NO: 3705047 - RNA, 20 nt, Human
uguacuuaauaaauucagau

SEQ ID NO: 3705048 - RNA, 21 nt, Human
uguacuuaauaaauucagaua

SEQ ID NO: 3705049 - RNA, 22 nt, Human
uguacuuaauaaauucagauau

SEQ ID NO: 3705050 - RNA, 14 nt, Human
uguacuucacuguc

SEQ ID NO: 3705051 - RNA, 21 nt, Human
uguacuucacugucaggaaga

SEQ ID NO: 3705052 - RNA, 18 nt, Human
uguacuucccgggccagg

SEQ ID NO: 3705053 - RNA, 21 nt, Human
uguacuucccgggccagggcu

SEQ ID NO: 3705054 - RNA, 15 nt, Human
guugaagaggaaggg

SEQ ID NO: 3705055 - RNA, 14 nt, Human
guugaagcucuggu

SEQ ID NO: 3705056 - RNA, 19 nt, Human
guugaauguugcaauguga

SEQ ID NO: 3705057 - RNA, 13 nt, Human
guugaauuuuaca

SEQ ID NO: 3705058 - RNA, 20 nt, Human
guugaauuuuguucucuggg

SEQ ID NO: 3705059 - RNA, 15 nt, Human
guugacaaaauuuuc

SEQ ID NO: 3705060 - RNA, 14 nt, Human
guugacaacuguga

SEQ ID NO: 3705061 - RNA, 15 nt, Human
guugacaacugugac

SEQ ID NO: 3705062 - RNA, 15 nt, Human
guugacacaggucuu

SEQ ID NO: 3705063 - RNA, 20 nt, Human
guugacaccucgccccugcu

SEQ ID NO: 3705064 - RNA, 12 nt, Human
guugacagcagg

SEQ ID NO: 3705065 - RNA, 17 nt, Human
guugacaguucugaaga

SEQ ID NO: 3705066 - RNA, 14 nt, Human
guugacauauuuaa

SEQ ID NO: 3705067 - RNA, 18 nt, Human
guugacauauuuaauguu

SEQ ID NO: 3705068 - RNA, 14 nt, Human
guugacaugggaca

SEQ ID NO: 3705069 - RNA, 13 nt, Human
guugacauucuga

SEQ ID NO: 3705070 - RNA, 17 nt, Human
guugacauucugaaugc

SEQ ID NO: 3705071 - RNA, 22 nt, Human
guugaccaugucuaugauucgu

SEQ ID NO: 3705072 - RNA, 15 nt, Human
guugaccccagagga

SEQ ID NO: 3705073 - RNA, 20 nt, Human
guugacuuauuuucucugug

SEQ ID NO: 3705074 - RNA, 19 nt, Human
guugacuugacagaacacu

SEQ ID NO: 3705075 - RNA, 18 nt, Human
guugacuuuagggacuca

SEQ ID NO: 3705076 - RNA, 14 nt, Human
guugacuuucaggu

SEQ ID NO: 3705077 - RNA, 18 nt, Human
guugagaggacacucccg

SEQ ID NO: 3705078 - RNA, 17 nt, Human
guugagauaguuuucau

SEQ ID NO: 3705079 - RNA, 14 nt, Human
guugagcaagcagu

SEQ ID NO: 3705080 - RNA, 19 nt, Human
guugagcagggauccuggu

SEQ ID NO: 3705081 - RNA, 15 nt, Human
guugagccagcagac

SEQ ID NO: 3705082 - RNA, 16 nt, Human
guugagccccaagucc

SEQ ID NO: 3705083 - RNA, 21 nt, Human
guugagcuucauauaccagca

SEQ ID NO: 3705084 - RNA, 20 nt, Human
guugaggaaagcacagaggc

SEQ ID NO: 3705085 - RNA, 21 nt, Human
guugaggccacuguguuccuu

SEQ ID NO: 3705086 - RNA, 17 nt, Human
guugagggaacagacag

SEQ ID NO: 3705087 - RNA, 23 nt, Human
guugagggaacagacaggagaaa

SEQ ID NO: 3705088 - RNA, 16 nt, Human
guugaggggcuccugg

SEQ ID NO: 3705089 - RNA, 17 nt, Human
guugaggggcuccugga

SEQ ID NO: 3705090 - RNA, 15 nt, Human
guugagucuguacua

SEQ ID NO: 3705091 - RNA, 14 nt, Human
guugauagcacaga

SEQ ID NO: 3705092 - RNA, 20 nt, Human
guugauauuucgaaagcugc

SEQ ID NO: 3705093 - RNA, 22 nt, Human
guugaucuggaacccagacuca

SEQ ID NO: 3705094 - RNA, 23 nt, Human
guugaugaucuuugcagacaggc

SEQ ID NO: 3705095 - RNA, 24 nt, Human
guugaugcaauccuuacaaaugau

SEQ ID NO: 3705096 - RNA, 21 nt, Human
guugauguaucugaguugcca

SEQ ID NO: 3705097 - RNA, 17 nt, Human
guugauguuggcuggga

SEQ ID NO: 3705098 - RNA, 13 nt, Human
guugauuaaggca

SEQ ID NO: 3705099 - RNA, 16 nt, Human
guugauuacagugcag

SEQ ID NO: 3705100 - RNA, 16 nt, Human
guugauugcuaaaugu

SEQ ID NO: 3705101 - RNA, 18 nt, Human
guugauuucuuuccagag

SEQ ID NO: 3705102 - RNA, 15 nt, Human
guugcaagaugugaa

SEQ ID NO: 3705103 - RNA, 23 nt, Human
guugcaaggccgcuguucaccca

SEQ ID NO: 3705104 - RNA, 11 nt, Human
guugcacagca

SEQ ID NO: 3705105 - RNA, 19 nt, Human
guugcacagcaucucagcu

SEQ ID NO: 3705106 - RNA, 13 nt, Human
guugcacccagcc

SEQ ID NO: 3705107 - RNA, 17 nt, Human
guugcacccagcccugg

SEQ ID NO: 3705108 - RNA, 17 nt, Human
guugcacguguguuuuu

SEQ ID NO: 3705109 - RNA, 14 nt, Human
guugcacugauauu

SEQ ID NO: 3705110 - RNA, 19 nt, Human
guugcacuuaugauuucau

SEQ ID NO: 3705111 - RNA, 19 nt, Human
guugcacuuggccucugga

SEQ ID NO: 3705112 - RNA, 14 nt, Human
guugcagacaggaa

SEQ ID NO: 3705113 - RNA, 20 nt, Human
guugcagacaggaaucuuaa

SEQ ID NO: 3705114 - RNA, 15 nt, Human
guugcaggaccucag

SEQ ID NO: 3705115 - RNA, 17 nt, Human
guugcagguucauggau

SEQ ID NO: 3705116 - RNA, 13 nt, Human
guugcagugagcu

SEQ ID NO: 3705117 - RNA, 15 nt, Human
guugcagugagcuga

SEQ ID NO: 3705118 - RNA, 20 nt, Human
guugcaugucgugaccaacu

SEQ ID NO: 3705119 - RNA, 23 nt, Human
guugcauuuuaacccuauuuuac

SEQ ID NO: 3705120 - RNA, 20 nt, Human
guugccaaaucuggcuccuu

SEQ ID NO: 3705121 - RNA, 17 nt, Human
guugccaagaacugaaa

SEQ ID NO: 3705122 - RNA, 22 nt, Human
guugccaagaacugaaaacaua

SEQ ID NO: 3705123 - RNA, 14 nt, Human
guugccaagacaaa

SEQ ID NO: 3705124 - RNA, 18 nt, Human
guugccaagcuccaagcc

SEQ ID NO: 3705125 - RNA, 11 nt, Human
guugccagaga

SEQ ID NO: 3705126 - RNA, 15 nt, Human
guugccagagaugga

SEQ ID NO: 3705127 - RNA, 17 nt, Human
guugccagagauggagg

SEQ ID NO: 3705128 - RNA, 13 nt, Human
guugccagucacc

SEQ ID NO: 3705129 - RNA, 16 nt, Human
guugccagucaccccg

SEQ ID NO: 3705130 - RNA, 18 nt, Human
guugccagucaccccggc

SEQ ID NO: 3705131 - RNA, 23 nt, Human
guugccauccuaccgucuuuucc

SEQ ID NO: 3705132 - RNA, 21 nt, Human
guugcccagccucuuucccuu

SEQ ID NO: 3705133 - RNA, 18 nt, Human
guugcccaggcaggucuu

SEQ ID NO: 3705134 - RNA, 19 nt, Human
guugcccaggcaggucuug

SEQ ID NO: 3705135 - RNA, 23 nt, Human
guugcccaggcaggucuugaacu

SEQ ID NO: 3705136 - RNA, 17 nt, Human
guugcccaggcuggcgu

SEQ ID NO: 3705137 - RNA, 16 nt, Human
guugcccagugugagg

SEQ ID NO: 3705138 - RNA, 17 nt, Human
guugccccgucucuguu

SEQ ID NO: 3705139 - RNA, 21 nt, Human
guugccuugaaccacuucccu

SEQ ID NO: 3705140 - RNA, 16 nt, Human
guugcgacggagagaa

SEQ ID NO: 3705141 - RNA, 17 nt, Human
guugcgacggagagaaa

SEQ ID NO: 3705142 - RNA, 20 nt, Human
guugcggauggauggaaggu

SEQ ID NO: 3705143 - RNA, 23 nt, Human
guugcgugacacucuccuugcag

SEQ ID NO: 3705144 - RNA, 13 nt, Human
guugcuaaacacu

SEQ ID NO: 3705145 - RNA, 14 nt, Human
guugcuaaacacug

SEQ ID NO: 3705146 - RNA, 15 nt, Human
guugcuaaacacugc

SEQ ID NO: 3705147 - RNA, 19 nt, Human
guugcuaaacacugcgcuu

SEQ ID NO: 3705148 - RNA, 14 nt, Human
guugcuaacagcaa

SEQ ID NO: 3705149 - RNA, 17 nt, Human
guugcuaacugaacuuu

SEQ ID NO: 3705150 - RNA, 22 nt, Human
guugcuaacugaacuuugaaga

SEQ ID NO: 3705151 - RNA, 18 nt, Human
guugcucaaaaaaugagc

SEQ ID NO: 3705152 - RNA, 19 nt, Human
guugcuccgccuggccugg

SEQ ID NO: 3705153 - RNA, 20 nt, Human
guugcucuaggaagacauuu

SEQ ID NO: 3705154 - RNA, 19 nt, Human
guugcugaaacuugcugag

SEQ ID NO: 3705155 - RNA, 16 nt, Human
guugcugcuucaauuu

SEQ ID NO: 3705156 - RNA, 22 nt, Human
guugcugcuucucccaggcaag

SEQ ID NO: 3705157 - RNA, 22 nt, Human
guugcuggcuuguuguaaagca

SEQ ID NO: 3705158 - RNA, 12 nt, Human
guugcugguaaa

SEQ ID NO: 3705159 - RNA, 16 nt, Human
guugcugguaaaauga

SEQ ID NO: 3705160 - RNA, 15 nt, Human
guugcugguugcugu

SEQ ID NO: 3705161 - RNA, 19 nt, Human
guugcuguuuuccucccuu

SEQ ID NO: 3705162 - RNA, 21 nt, Human
guugcuguuuuccucccuucu

SEQ ID NO: 3705163 - RNA, 14 nt, Human
guugcuuacaauuu

SEQ ID NO: 3705164 - RNA, 23 nt, Human
guugcuuccguucauggaagcgc

SEQ ID NO: 3705165 - RNA, 23 nt, Human
guugcuucuucuacuucagucuu

SEQ ID NO: 3705166 - RNA, 13 nt, Human
guugcuugucuuc

SEQ ID NO: 3705167 - RNA, 15 nt, Human
guugcuuucacucuc

SEQ ID NO: 3705168 - RNA, 15 nt, Human
guugcuuugcccugg

SEQ ID NO: 3705169 - RNA, 15 nt, Human
guuggaaaaaauuug

SEQ ID NO: 3705170 - RNA, 15 nt, Human
guuggaaaagaauac

SEQ ID NO: 3705171 - RNA, 17 nt, Human
guuggaaaauaucuuug

SEQ ID NO: 3705172 - RNA, 16 nt, Human
guuggaaacacuaaau

SEQ ID NO: 3705173 - RNA, 18 nt, Human
guuggaaacacuaaaugu

SEQ ID NO: 3705174 - RNA, 20 nt, Human
guuggaagcuuguuuuccag

SEQ ID NO: 3705175 - RNA, 15 nt, Human
guuggaauggauuuu

SEQ ID NO: 3705176 - RNA, 17 nt, Human
guuggaauggauuuuuc

SEQ ID NO: 3705177 - RNA, 15 nt, Human
guuggacaaauguga

SEQ ID NO: 3705178 - RNA, 16 nt, Human
guuggacccgcucugg

SEQ ID NO: 3705179 - RNA, 20 nt, Human
guuggacccgcucuggacca

SEQ ID NO: 3705180 - RNA, 15 nt, Human
guuggacuaaaugcc

SEQ ID NO: 3705181 - RNA, 18 nt, Human
guuggacuaaaugccuag

SEQ ID NO: 3705182 - RNA, 22 nt, Human
guuggagagcuagaaccuggag

SEQ ID NO: 3705183 - RNA, 18 nt, Human
guuggagccacucuguuc

SEQ ID NO: 3705184 - RNA, 12 nt, Human
guuggagccugc

SEQ ID NO: 3705185 - RNA, 16 nt, Human
guuggagccugcaggg

SEQ ID NO: 3705186 - RNA, 14 nt, Human
guuggaguucauuc

SEQ ID NO: 3705187 - RNA, 22 nt, Human
guuggauggauggguggauggc

SEQ ID NO: 3705188 - RNA, 23 nt, Human
guuggauggauggguggauggcc

SEQ ID NO: 3705189 - RNA, 18 nt, Human
guuggauuuauaaaugcu

SEQ ID NO: 3705190 - RNA, 14 nt, Human
guuggauuuuuguc

SEQ ID NO: 3705191 - RNA, 20 nt, Human
guuggauuuuugucuugugu

SEQ ID NO: 3705192 - RNA, 19 nt, Human
guuggcaaaauauuuuaaa

SEQ ID NO: 3705193 - RNA, 13 nt, Human
guuggcaccuucc

SEQ ID NO: 3705194 - RNA, 20 nt, Human
guuggcaggcuggccagucc

SEQ ID NO: 3705195 - RNA, 23 nt, Human
guuggcagugagugagccuggcu

SEQ ID NO: 3705196 - RNA, 19 nt, Human
guuggcauagcucuggggu

SEQ ID NO: 3705197 - RNA, 12 nt, Human
guuggcaugcau

SEQ ID NO: 3705198 - RNA, 17 nt, Human
guuggccaggcuggucu

SEQ ID NO: 3705199 - RNA, 18 nt, Human
guuggccaggcuggucua

SEQ ID NO: 3705200 - RNA, 19 nt, Human
guuggccaggcuggucuca

SEQ ID NO: 3705201 - RNA, 22 nt, Human
guuggccauauuuaccucagcc

SEQ ID NO: 3705202 - RNA, 14 nt, Human
guuggccccugccc

SEQ ID NO: 3705203 - RNA, 13 nt, Human
guuggccucugca

SEQ ID NO: 3705204 - RNA, 14 nt, Human
uggauuauuuaaua

SEQ ID NO: 3705205 - RNA, 13 nt, Human
uggauucagccuu

SEQ ID NO: 3705206 - RNA, 14 nt, Human
uggauucagccuuc

SEQ ID NO: 3705207 - RNA, 17 nt, Human
uggauucagccuucuuu

SEQ ID NO: 3705208 - RNA, 18 nt, Human
uggauucauuacagcuua

SEQ ID NO: 3705209 - RNA, 17 nt, Human
uggauucauucucauaa

SEQ ID NO: 3705210 - RNA, 17 nt, Human
uggauucauuuauaaga

SEQ ID NO: 3705211 - RNA, 17 nt, Human
uggauuccaaccccaac

SEQ ID NO: 3705212 - RNA, 18 nt, Human
uggauucccuuaaacaaa

SEQ ID NO: 3705213 - RNA, 14 nt, Human
uggauuccuguuuc

SEQ ID NO: 3705214 - RNA, 13 nt, Human
uggauucuaaaau

SEQ ID NO: 3705215 - RNA, 15 nt, Human
uggauucucagauau

SEQ ID NO: 3705216 - RNA, 17 nt, Human
uggauucuuauguagca

SEQ ID NO: 3705217 - RNA, 20 nt, Human
uggauugacaguaacuuggu

SEQ ID NO: 3705218 - RNA, 21 nt, Human
uggauugacaguaacuugguu

SEQ ID NO: 3705219 - RNA, 15 nt, Human
uggauuggacaaaau

SEQ ID NO: 3705220 - RNA, 23 nt, Human
uggauuggagaaguaauccuagg

SEQ ID NO: 3705221 - RNA, 21 nt, Human
uggauuguccccgacccuugc

SEQ ID NO: 3705222 - RNA, 20 nt, Human
uggauugugccuaauguguu

SEQ ID NO: 3705223 - RNA, 17 nt, Human
uggauuuaacagaaaug

SEQ ID NO: 3705224 - RNA, 16 nt, Human
uggauuuaguuucagu

SEQ ID NO: 3705225 - RNA, 15 nt, Human
uggauuuccuaauac

SEQ ID NO: 3705226 - RNA, 19 nt, Human
uggauuucugguucugaug

SEQ ID NO: 3705227 - RNA, 19 nt, Human
uggauuucuuugaaaaaaa

SEQ ID NO: 3705228 - RNA, 16 nt, Human
uggauuucuuuuguaa

SEQ ID NO: 3705229 - RNA, 13 nt, Human
uggauuugacauu

SEQ ID NO: 3705230 - RNA, 14 nt, Human
uggauuugacauug

SEQ ID NO: 3705231 - RNA, 13 nt, Human
uggauuugaugcu

SEQ ID NO: 3705232 - RNA, 17 nt, Human
uggauuuggagagaaau

SEQ ID NO: 3705233 - RNA, 20 nt, Human
uggauuuggagagaaauauu

SEQ ID NO: 3705234 - RNA, 18 nt, Human
uggauuuggcacuagcca

SEQ ID NO: 3705235 - RNA, 21 nt, Human
uggauuuggcacuagccaaag

SEQ ID NO: 3705236 - RNA, 17 nt, Human
uggauuuguuuaaaagg

SEQ ID NO: 3705237 - RNA, 19 nt, Human
uggauuuucuauuguuacu

SEQ ID NO: 3705238 - RNA, 13 nt, Human
uggauuuuuacca

SEQ ID NO: 3705239 - RNA, 19 nt, Human
uggauuuuugacucuggca

SEQ ID NO: 3705240 - RNA, 17 nt, Human
uggcaaaaauggcuaga

SEQ ID NO: 3705241 - RNA, 15 nt, Human
uggcaaaagccuugu

SEQ ID NO: 3705242 - RNA, 19 nt, Human
uggcaaacagggccucugc

SEQ ID NO: 3705243 - RNA, 13 nt, Human
uggcaaagcagaa

SEQ ID NO: 3705244 - RNA, 15 nt, Human
uggcaaagcagaaaa

SEQ ID NO: 3705245 - RNA, 21 nt, Human
uggcaaagggagcagaacuga

SEQ ID NO: 3705246 - RNA, 20 nt, Human
uggcaaauuaacuugaguuu

SEQ ID NO: 3705247 - RNA, 19 nt, Human
uggcaacaaacugcacaug

SEQ ID NO: 3705248 - RNA, 22 nt, Human
uggcaacagaucuggaaccuca

SEQ ID NO: 3705249 - RNA, 13 nt, Human
uggcaaccugcuu

SEQ ID NO: 3705250 - RNA, 22 nt, Human
uggcaaccuugucucuaugcca

SEQ ID NO: 3705251 - RNA, 19 nt, Human
uggcaagaaagcugguaaa

SEQ ID NO: 3705252 - RNA, 13 nt, Human
uggcaagagcccc

SEQ ID NO: 3705253 - RNA, 18 nt, Human
uggcaagagggugacagc

SEQ ID NO: 3705254 - RNA, 15 nt, Human
uggcaagccccugcc

SEQ ID NO: 3705255 - RNA, 21 nt, Human
uggcaagccccugcccaucug

SEQ ID NO: 3705256 - RNA, 13 nt, Human
uggcaagcuguga

SEQ ID NO: 3705257 - RNA, 19 nt, Human
uggcaaggacacagaugaa

SEQ ID NO: 3705258 - RNA, 17 nt, Human
uggcaaggacugcaggg

SEQ ID NO: 3705259 - RNA, 13 nt, Human
uggcaaggacuuu

SEQ ID NO: 3705260 - RNA, 12 nt, Human
uggcaaggcugu

SEQ ID NO: 3705261 - RNA, 14 nt, Human
uggcaaggcugugc

SEQ ID NO: 3705262 - RNA, 15 nt, Human
uggcaaggcugugcu

SEQ ID NO: 3705263 - RNA, 20 nt, Human
uggcaaggcugugcucccug

SEQ ID NO: 3705264 - RNA, 23 nt, Human
uggcaaggcugugcucccugguu

SEQ ID NO: 3705265 - RNA, 20 nt, Human
uggcaauaaauuuugaaaag

SEQ ID NO: 3705266 - RNA, 21 nt, Human
uggcaauaaauuuugaaaagu

SEQ ID NO: 3705267 - RNA, 15 nt, Human
uggcaauaguguguu

SEQ ID NO: 3705268 - RNA, 20 nt, Human
uggcaaugccacagcccugu

SEQ ID NO: 3705269 - RNA, 21 nt, Human
uggcaaugccacagcccuguc

SEQ ID NO: 3705270 - RNA, 23 nt, Human
uggcaaugccacagcccugucag

SEQ ID NO: 3705271 - RNA, 17 nt, Human
uggcaaugguaguuucu

SEQ ID NO: 3705272 - RNA, 18 nt, Human
uggcaaugguaguuucug

SEQ ID NO: 3705273 - RNA, 18 nt, Human
uggcaauguuuugcuuuu

SEQ ID NO: 3705274 - RNA, 23 nt, Human
uggcaauucuuugaccucaaccu

SEQ ID NO: 3705275 - RNA, 15 nt, Human
uggcaauuuuguaac

SEQ ID NO: 3705276 - RNA, 23 nt, Human
uggcacaauggcuaauucccaga

SEQ ID NO: 3705277 - RNA, 22 nt, Human
uggcacacaccuguagucccag

SEQ ID NO: 3705278 - RNA, 13 nt, Human
uggcacacagcag

SEQ ID NO: 3705279 - RNA, 22 nt, Human
uggcacagaaaccucuacuaaa

SEQ ID NO: 3705280 - RNA, 22 nt, Human
uggcacagccuggcuguggccu

SEQ ID NO: 3705281 - RNA, 14 nt, Human
uggcacaggacuga

SEQ ID NO: 3705282 - RNA, 15 nt, Human
uggcacaggacugau

SEQ ID NO: 3705283 - RNA, 16 nt, Human
uggcacagggcagugg

SEQ ID NO: 3705284 - RNA, 16 nt, Human
uggcacagugucuggg

SEQ ID NO: 3705285 - RNA, 18 nt, Human
uggcacaguuuucugaga

SEQ ID NO: 3705286 - RNA, 19 nt, Human
uggcacaguuuucugagaa

SEQ ID NO: 3705287 - RNA, 17 nt, Human
uggcaccaaagaugcag

SEQ ID NO: 3705288 - RNA, 19 nt, Human
uggcaccaaagaugcagcc

SEQ ID NO: 3705289 - RNA, 13 nt, Human
uggcaccacucuc

SEQ ID NO: 3705290 - RNA, 17 nt, Human
uggcaccagacacccag

SEQ ID NO: 3705291 - RNA, 23 nt, Human
uggcaccagaggcugcagaaggc

SEQ ID NO: 3705292 - RNA, 16 nt, Human
uggcaccagcagccug

SEQ ID NO: 3705293 - RNA, 14 nt, Human
uggcacccaagacc

SEQ ID NO: 3705294 - RNA, 23 nt, Human
uggcacccaagaccucagggcac

SEQ ID NO: 3705295 - RNA, 21 nt, Human
uggcacccaccguggaggagg

SEQ ID NO: 3705296 - RNA, 16 nt, Human
uggcacccggccccug

SEQ ID NO: 3705297 - RNA, 19 nt, Human
uggcacccggccccugcug

SEQ ID NO: 3705298 - RNA, 20 nt, Human
uggcacccggccccugcugg

SEQ ID NO: 3705299 - RNA, 21 nt, Human
uggcacccggccccugcuggu

SEQ ID NO: 3705300 - RNA, 16 nt, Human
uggcaccgaagcccag

SEQ ID NO: 3705301 - RNA, 17 nt, Human
uggcaccgaagcccaga

SEQ ID NO: 3705302 - RNA, 18 nt, Human
uggcaccgaagcccagag

SEQ ID NO: 3705303 - RNA, 21 nt, Human
uggcaccugucugcuccagcu

SEQ ID NO: 3705304 - RNA, 23 nt, Human
uggcaccugucugcuccagcucu

SEQ ID NO: 3705305 - RNA, 15 nt, Human
uggcacuaguauuuc

SEQ ID NO: 3705306 - RNA, 21 nt, Human
uggcacuauaauguaagcucu

SEQ ID NO: 3705307 - RNA, 22 nt, Human
uggcacucacagaccuggagcc

SEQ ID NO: 3705308 - RNA, 20 nt, Human
uggcacucccuccagcacaa

SEQ ID NO: 3705309 - RNA, 15 nt, Human
uggcacugagccccc

SEQ ID NO: 3705310 - RNA, 16 nt, Human
uggcacugagcccccc

SEQ ID NO: 3705311 - RNA, 17 nt, Human
uggcacugagccccccc

SEQ ID NO: 3705312 - RNA, 18 nt, Human
uggcacugagccccccca

SEQ ID NO: 3705313 - RNA, 16 nt, Human
uggcacugcuuccagu

SEQ ID NO: 3705314 - RNA, 22 nt, Human
uggcacuggcaaacagggccuc

SEQ ID NO: 3705315 - RNA, 22 nt, Human
uggcacugguagguugggacac

SEQ ID NO: 3705316 - RNA, 15 nt, Human
uggcacuuaucauua

SEQ ID NO: 3705317 - RNA, 14 nt, Human
uggcacuugcaucu

SEQ ID NO: 3705318 - RNA, 18 nt, Human
uggcacuugccuggguca

SEQ ID NO: 3705319 - RNA, 21 nt, Human
uggcacuuuuucauuugccua

SEQ ID NO: 3705320 - RNA, 12 nt, Human
uggcagaaaagu

SEQ ID NO: 3705321 - RNA, 20 nt, Human
uggcagaagacaccagagca

SEQ ID NO: 3705322 - RNA, 21 nt, Human
uggcagaagacaccagagcag

SEQ ID NO: 3705323 - RNA, 18 nt, Human
uggcagaagggagcagca

SEQ ID NO: 3705324 - RNA, 18 nt, Human
uggcagaaugcuagcucu

SEQ ID NO: 3705325 - RNA, 22 nt, Human
uggcagaauggggugcaugaag

SEQ ID NO: 3705326 - RNA, 13 nt, Human
uggcagagaugcc

SEQ ID NO: 3705327 - RNA, 15 nt, Human
uggcagaguccugga

SEQ ID NO: 3705328 - RNA, 17 nt, Human
uggcagaguuacaguuc

SEQ ID NO: 3705329 - RNA, 19 nt, Human
uggcagaguugaagacaga

SEQ ID NO: 3705330 - RNA, 22 nt, Human
uggcagaguugaagacagagcu

SEQ ID NO: 3705331 - RNA, 17 nt, Human
uggcagaguuugugugu

SEQ ID NO: 3705332 - RNA, 21 nt, Human
uggcagauaaucagccucuua

SEQ ID NO: 3705333 - RNA, 23 nt, Human
uggcagaugacaagaugguacaa

SEQ ID NO: 3705334 - RNA, 15 nt, Human
uggcagaugcagcuc

SEQ ID NO: 3705335 - RNA, 16 nt, Human
uggcagaugcagcucu

SEQ ID NO: 3705336 - RNA, 22 nt, Human
uggcagauguaaaguuauucuu

SEQ ID NO: 3705337 - RNA, 15 nt, Human
uggcagauguaggag

SEQ ID NO: 3705338 - RNA, 17 nt, Human
uggcagauuuuacaaaa

SEQ ID NO: 3705339 - RNA, 20 nt, Human
uggcagauuuuacaaaagau

SEQ ID NO: 3705340 - RNA, 23 nt, Human
uggcagcaccgccucuucccgcc

SEQ ID NO: 3705341 - RNA, 20 nt, Human
uggcagcagaguguggccuu

SEQ ID NO: 3705342 - RNA, 15 nt, Human
uggcagcaggugcug

SEQ ID NO: 3705343 - RNA, 16 nt, Human
uggcagcaggugcugc

SEQ ID NO: 3705344 - RNA, 21 nt, Human
uggcagcaggugcugcuaccc

SEQ ID NO: 3705345 - RNA, 18 nt, Human
uggcagccacacuucuca

SEQ ID NO: 3705346 - RNA, 19 nt, Human
uggcagccacacuucucag

SEQ ID NO: 3705347 - RNA, 12 nt, Human
uggcagcccagc

SEQ ID NO: 3705348 - RNA, 13 nt, Human
uggcagcccagcc

SEQ ID NO: 3705349 - RNA, 14 nt, Human
uggcagcccagcca

SEQ ID NO: 3705350 - RNA, 15 nt, Human
uggcagcccagccag

SEQ ID NO: 3705351 - RNA, 17 nt, Human
uggcagcccagccagcg

SEQ ID NO: 3705352 - RNA, 17 nt, Human
uggcagcccgcaucagc

SEQ ID NO: 3705353 - RNA, 12 nt, Human
uguacuuccuga

SEQ ID NO: 3705354 - RNA, 22 nt, Human
uguacuugcucuugaugccugg

SEQ ID NO: 3705355 - RNA, 22 nt, Human
uguacuuggaguauuggggucu

SEQ ID NO: 3705356 - RNA, 17 nt, Human
uguacuugguccaacug

SEQ ID NO: 3705357 - RNA, 20 nt, Human
uguacuugguccaacugcaa

SEQ ID NO: 3705358 - RNA, 20 nt, Human
uguacuuuaucaugaaugcu

SEQ ID NO: 3705359 - RNA, 17 nt, Human
uguacuuugauucacau

SEQ ID NO: 3705360 - RNA, 18 nt, Human
uguacuuugauucacaug

SEQ ID NO: 3705361 - RNA, 15 nt, Human
uguacuuugcuugcu

SEQ ID NO: 3705362 - RNA, 18 nt, Human
uguacuuuuaagacuuug

SEQ ID NO: 3705363 - RNA, 12 nt, Human
uguacuuuucau

SEQ ID NO: 3705364 - RNA, 22 nt, Human
uguacuuuucauucucuuuuaa

SEQ ID NO: 3705365 - RNA, 20 nt, Human
uguacuuuuuaguaauuucu

SEQ ID NO: 3705366 - RNA, 21 nt, Human
uguacuuuuuaguaauuucuu

SEQ ID NO: 3705367 - RNA, 12 nt, Human
uguacuuuuugg

SEQ ID NO: 3705368 - RNA, 17 nt, Human
uguacuuuuuggcauaa

SEQ ID NO: 3705369 - RNA, 11 nt, Human
uguagaaaaca

SEQ ID NO: 3705370 - RNA, 19 nt, Human
uguagaaaagggaacugaa

SEQ ID NO: 3705371 - RNA, 14 nt, Human
uguagaacacuaau

SEQ ID NO: 3705372 - RNA, 19 nt, Human
uguagaacacuaauucaua

SEQ ID NO: 3705373 - RNA, 20 nt, Human
uguagaacacuaauucauaa

SEQ ID NO: 3705374 - RNA, 16 nt, Human
uguagaagcauuccuu

SEQ ID NO: 3705375 - RNA, 17 nt, Human
uguagaagcauuccuuc

SEQ ID NO: 3705376 - RNA, 22 nt, Human
uguagaagcauuccuucuuuga

SEQ ID NO: 3705377 - RNA, 18 nt, Human
uguagaauagccuguggc

SEQ ID NO: 3705378 - RNA, 16 nt, Human
uguagaaugauuucau

SEQ ID NO: 3705379 - RNA, 17 nt, Human
uguagaaugauuucaug

SEQ ID NO: 3705380 - RNA, 14 nt, Human
uguagaauuguuau

SEQ ID NO: 3705381 - RNA, 16 nt, Human
uguagaauuguuauag

SEQ ID NO: 3705382 - RNA, 15 nt, Human
uguagacuauauaca

SEQ ID NO: 3705383 - RNA, 18 nt, Human
uguagacuauauacaugu

SEQ ID NO: 3705384 - RNA, 18 nt, Human
uguagaggagaaacugga

SEQ ID NO: 3705385 - RNA, 12 nt, Human
uguagaguuaag

SEQ ID NO: 3705386 - RNA, 14 nt, Human
uguagaguuaagaa

SEQ ID NO: 3705387 - RNA, 13 nt, Human
uguagaguugcug

SEQ ID NO: 3705388 - RNA, 14 nt, Human
uguagaguugcuga

SEQ ID NO: 3705389 - RNA, 15 nt, Human
uguagaguugcugag

SEQ ID NO: 3705390 - RNA, 20 nt, Human
uguagaguugcugagagggc

SEQ ID NO: 3705391 - RNA, 20 nt, Human
uguagaguuuugucauucag

SEQ ID NO: 3705392 - RNA, 17 nt, Human
uguagauaauacaguuc

SEQ ID NO: 3705393 - RNA, 18 nt, Human
uguagauauguauucuuu

SEQ ID NO: 3705394 - RNA, 21 nt, Human
uguagauauugugaaguacau

SEQ ID NO: 3705395 - RNA, 14 nt, Human
uguagauauuuggc

SEQ ID NO: 3705396 - RNA, 18 nt, Human
uguagaucagagcagcag

SEQ ID NO: 3705397 - RNA, 13 nt, Human
uguagaucccaag

SEQ ID NO: 3705398 - RNA, 22 nt, Human
uguagaugaaaaagcauguaca

SEQ ID NO: 3705399 - RNA, 19 nt, Human
uguagauggaaaaacuugu

SEQ ID NO: 3705400 - RNA, 16 nt, Human
uguagauucagguaau

SEQ ID NO: 3705401 - RNA, 16 nt, Human
uguagauuuauuucau

SEQ ID NO: 3705402 - RNA, 12 nt, Human
uguagauuugau

SEQ ID NO: 3705403 - RNA, 17 nt, Human
uguagauuuuauagugu

SEQ ID NO: 3705404 - RNA, 20 nt, Human
uguagcaaaacgcauggagu

SEQ ID NO: 3705405 - RNA, 23 nt, Human
uguagcaaacccugucaaacauu

SEQ ID NO: 3705406 - RNA, 16 nt, Human
uguagcacugacagau

SEQ ID NO: 3705407 - RNA, 11 nt, Human
uguagcaguga

SEQ ID NO: 3705408 - RNA, 17 nt, Human
uguagcauccuggaaua

SEQ ID NO: 3705409 - RNA, 10 nt, Human
uguagccaag

SEQ ID NO: 3705410 - RNA, 17 nt, Human
uguagccacaccaggau

SEQ ID NO: 3705411 - RNA, 18 nt, Human
uguagccacaccaggaua

SEQ ID NO: 3705412 - RNA, 20 nt, Human
uguagccacuaguaaguaau

SEQ ID NO: 3705413 - RNA, 15 nt, Human
uguagccagccgggg

SEQ ID NO: 3705414 - RNA, 17 nt, Human
uguagccagguauggcu

SEQ ID NO: 3705415 - RNA, 20 nt, Human
uguagccagguauggcucug

SEQ ID NO: 3705416 - RNA, 21 nt, Human
uguagccagguauggcucugc

SEQ ID NO: 3705417 - RNA, 18 nt, Human
uguagccaggucccccug

SEQ ID NO: 3705418 - RNA, 22 nt, Human
uguagccaugaccuuacauuuc

SEQ ID NO: 3705419 - RNA, 17 nt, Human
uguagcccacucugcuc

SEQ ID NO: 3705420 - RNA, 22 nt, Human
uguagcccacucugcucgccuu

SEQ ID NO: 3705421 - RNA, 23 nt, Human
uguagcccauccuucccuuugga

SEQ ID NO: 3705422 - RNA, 22 nt, Human
uguagccccaagaaggcugggg

SEQ ID NO: 3705423 - RNA, 17 nt, Human
uguagcccccuggccuc

SEQ ID NO: 3705424 - RNA, 19 nt, Human
uguagcccccuggccucug

SEQ ID NO: 3705425 - RNA, 20 nt, Human
uguagcccccuggccucugu

SEQ ID NO: 3705426 - RNA, 15 nt, Human
uguagcccucccacu

SEQ ID NO: 3705427 - RNA, 23 nt, Human
uguagccuggauauuauucuugu

SEQ ID NO: 3705428 - RNA, 15 nt, Human
uguagccugugcaug

SEQ ID NO: 3705429 - RNA, 22 nt, Human
uguagccugugcauguaugucu

SEQ ID NO: 3705430 - RNA, 16 nt, Human
uguagcgucuuucuuu

SEQ ID NO: 3705431 - RNA, 16 nt, Human
uguagcguguuuacau

SEQ ID NO: 3705432 - RNA, 13 nt, Human
uguagcuacagag

SEQ ID NO: 3705433 - RNA, 20 nt, Human
uguagcucugcaucuccugu

SEQ ID NO: 3705434 - RNA, 13 nt, Human
uguagcuguaaaa

SEQ ID NO: 3705435 - RNA, 11 nt, Human
uguagcuguga

SEQ ID NO: 3705436 - RNA, 14 nt, Human
uguagcugugaccu

SEQ ID NO: 3705437 - RNA, 17 nt, Human
uguagcugugaccugcu

SEQ ID NO: 3705438 - RNA, 18 nt, Human
uguagcugugaccugcug

SEQ ID NO: 3705439 - RNA, 19 nt, Human
uguagcugugaccugcuga

SEQ ID NO: 3705440 - RNA, 14 nt, Human
uguagcuuuaucaa

SEQ ID NO: 3705441 - RNA, 13 nt, Human
uguagcuuugcuc

SEQ ID NO: 3705442 - RNA, 15 nt, Human
uguagcuuugcucuu

SEQ ID NO: 3705443 - RNA, 13 nt, Human
uguagcuuuucac

SEQ ID NO: 3705444 - RNA, 21 nt, Human
uguaggaaccgugguaugucu

SEQ ID NO: 3705445 - RNA, 22 nt, Human
uguaggaaccgugguaugucug

SEQ ID NO: 3705446 - RNA, 19 nt, Human
uguaggaagaguagcauuu

SEQ ID NO: 3705447 - RNA, 19 nt, Human
uguaggaaggucucauucu

SEQ ID NO: 3705448 - RNA, 21 nt, Human
uguaggaaggucucauucuuc

SEQ ID NO: 3705449 - RNA, 22 nt, Human
uguaggagcugccuuggcucag

SEQ ID NO: 3705450 - RNA, 14 nt, Human
uguaggagggacug

SEQ ID NO: 3705451 - RNA, 18 nt, Human
uguaggcaucaugcaugu

SEQ ID NO: 3705452 - RNA, 22 nt, Human
uguaggccaguaguucucaaag

SEQ ID NO: 3705453 - RNA, 15 nt, Human
uguagggcuggaccu

SEQ ID NO: 3705454 - RNA, 21 nt, Human
uguaggggaggggcuccuuuc

SEQ ID NO: 3705455 - RNA, 21 nt, Human
uguaggguccaaccagaccug

SEQ ID NO: 3705456 - RNA, 16 nt, Human
uguaggguuauaauaa

SEQ ID NO: 3705457 - RNA, 15 nt, Human
uguagguaaaaugua

SEQ ID NO: 3705458 - RNA, 15 nt, Human
uguagguaagacugu

SEQ ID NO: 3705459 - RNA, 17 nt, Human
uguagguaugaauaagu

SEQ ID NO: 3705460 - RNA, 19 nt, Human
uguaggugucugcacccag

SEQ ID NO: 3705461 - RNA, 22 nt, Human
uguagguuauuaugauuagcuu

SEQ ID NO: 3705462 - RNA, 16 nt, Human
uguaguaaauaaugcu

SEQ ID NO: 3705463 - RNA, 17 nt, Human
uguaguaaauaaugcuu

SEQ ID NO: 3705464 - RNA, 21 nt, Human
uguaguaaauaaugcuuugaa

SEQ ID NO: 3705465 - RNA, 21 nt, Human
uguaguagcguuuuuuaaaug

SEQ ID NO: 3705466 - RNA, 22 nt, Human
uguaguagcguuuuuuaaaugu

SEQ ID NO: 3705467 - RNA, 14 nt, Human
uguaguaucaaaua

SEQ ID NO: 3705468 - RNA, 19 nt, Human
uguaguaucaaauauuaga

SEQ ID NO: 3705469 - RNA, 18 nt, Human
uguaguauggccuguguc

SEQ ID NO: 3705470 - RNA, 20 nt, Human
uguaguauuuuuuguauaau

SEQ ID NO: 3705471 - RNA, 22 nt, Human
uguagucagaauuagcugcuuc

SEQ ID NO: 3705472 - RNA, 15 nt, Human
uguagucccagccac

SEQ ID NO: 3705473 - RNA, 14 nt, Human
uguagucccagcua

SEQ ID NO: 3705474 - RNA, 22 nt, Human
uguagugaaucacguaaagcua

SEQ ID NO: 3705475 - RNA, 21 nt, Human
uguagugagauagcauuguga

SEQ ID NO: 3705476 - RNA, 15 nt, Human
uguagugagccgaga

SEQ ID NO: 3705477 - RNA, 14 nt, Human
uguagugauucaaa

SEQ ID NO: 3705478 - RNA, 21 nt, Human
uguaguguccauuuugugaag

SEQ ID NO: 3705479 - RNA, 16 nt, Human
uguaguguucagaaaa

SEQ ID NO: 3705480 - RNA, 16 nt, Human
uguaguguuggagaag

SEQ ID NO: 3705481 - RNA, 18 nt, Human
uguaguguuggagaagaa

SEQ ID NO: 3705482 - RNA, 18 nt, Human
uguaguuaauuuaucuaa

SEQ ID NO: 3705483 - RNA, 12 nt, Human
uguaguuaggaa

SEQ ID NO: 3705484 - RNA, 14 nt, Human
uguaguuaggaaau

SEQ ID NO: 3705485 - RNA, 23 nt, Human
uguaguuaggaaauaaaaccuuu

SEQ ID NO: 3705486 - RNA, 14 nt, Human
uguaguucauguaa

SEQ ID NO: 3705487 - RNA, 15 nt, Human
uguaguucuaagacu

SEQ ID NO: 3705488 - RNA, 12 nt, Human
uguaguucuuua

SEQ ID NO: 3705489 - RNA, 16 nt, Human
uguaguugauguaucc

SEQ ID NO: 3705490 - RNA, 17 nt, Human
uguaguugauguaucca

SEQ ID NO: 3705491 - RNA, 20 nt, Human
uguaguugcguggacucugc

SEQ ID NO: 3705492 - RNA, 22 nt, Human
uguaguuugaggaaauuugcag

SEQ ID NO: 3705493 - RNA, 20 nt, Human
uguaguuuuuauauguugua

SEQ ID NO: 3705494 - RNA, 13 nt, Human
uguauaaaauaau

SEQ ID NO: 3705495 - RNA, 19 nt, Human
uguauaaaauacauaguga

SEQ ID NO: 3705496 - RNA, 16 nt, Human
uguauaaaaucagcca

SEQ ID NO: 3705497 - RNA, 20 nt, Human
uguauaaacauuaaaugucu

SEQ ID NO: 3705498 - RNA, 19 nt, Human
uguauaaagcaacuguuau

SEQ ID NO: 3705499 - RNA, 23 nt, Human
uguauaaagcaacuguuaugaaa

SEQ ID NO: 3705500 - RNA, 12 nt, Human
uguauaaauaua

SEQ ID NO: 3705501 - RNA, 23 nt, Human
uguauaaaugaaguuuauacagu

SEQ ID NO: 3705502 - RNA, 19 nt, Human
guuggcguaggcuacagag

SEQ ID NO: 3705503 - RNA, 21 nt, Human
guuggcguaggcuacagagaa

SEQ ID NO: 3705504 - RNA, 22 nt, Human
guuggcguaggcuacagagaag

SEQ ID NO: 3705505 - RNA, 22 nt, Human
guuggcucugccaguccugucc

SEQ ID NO: 3705506 - RNA, 13 nt, Human
guuggcuggccuu

SEQ ID NO: 3705507 - RNA, 12 nt, Human
guuggcugggua

SEQ ID NO: 3705508 - RNA, 14 nt, Human
guuggcuuaccugg

SEQ ID NO: 3705509 - RNA, 13 nt, Human
guuggcuucuguu

SEQ ID NO: 3705510 - RNA, 23 nt, Human
guugggaaugaggaaaauucuua

SEQ ID NO: 3705511 - RNA, 19 nt, Human
guugggaaugaggcuugcu

SEQ ID NO: 3705512 - RNA, 21 nt, Human
guugggaaugaggcuugcuga

SEQ ID NO: 3705513 - RNA, 14 nt, Human
guugggagaauguc

SEQ ID NO: 3705514 - RNA, 14 nt, Human
guugggagcacugg

SEQ ID NO: 3705515 - RNA, 16 nt, Human
guugggagccugaaau

SEQ ID NO: 3705516 - RNA, 22 nt, Human
guugggaucagggguaggaaug

SEQ ID NO: 3705517 - RNA, 19 nt, Human
guugggauuccugacccag

SEQ ID NO: 3705518 - RNA, 22 nt, Human
guugggcagggugacccugaag

SEQ ID NO: 3705519 - RNA, 16 nt, Human
guugggcccagaucug

SEQ ID NO: 3705520 - RNA, 15 nt, Human
guugggcugguguca

SEQ ID NO: 3705521 - RNA, 21 nt, Human
guuggggacacauguauuugg

SEQ ID NO: 3705522 - RNA, 21 nt, Human
guugggggaggggagacuuug

SEQ ID NO: 3705523 - RNA, 14 nt, Human
guugggggucagug

SEQ ID NO: 3705524 - RNA, 16 nt, Human
guuggggucuggcagc

SEQ ID NO: 3705525 - RNA, 14 nt, Human
guuggggugacagu

SEQ ID NO: 3705526 - RNA, 19 nt, Human
guuggggugacagucauca

SEQ ID NO: 3705527 - RNA, 23 nt, Human
guugggguggguauaaaagaugg

SEQ ID NO: 3705528 - RNA, 21 nt, Human
guugggucaccagacggggcu

SEQ ID NO: 3705529 - RNA, 21 nt, Human
guugggugucuccuuaagcug

SEQ ID NO: 3705530 - RNA, 13 nt, Human
guugguaguuucu

SEQ ID NO: 3705531 - RNA, 15 nt, Human
guuggucaggcuggu

SEQ ID NO: 3705532 - RNA, 14 nt, Human
guugguccagagcg

SEQ ID NO: 3705533 - RNA, 16 nt, Human
guuggucuguacugau

SEQ ID NO: 3705534 - RNA, 17 nt, Human
guuggugcacagcacaa

SEQ ID NO: 3705535 - RNA, 13 nt, Human
guugguggugcug

SEQ ID NO: 3705536 - RNA, 15 nt, Human
guugguguguuuuug

SEQ ID NO: 3705537 - RNA, 15 nt, Human
guugguugugucuuu

SEQ ID NO: 3705538 - RNA, 18 nt, Human
guugguuuugacuucaga

SEQ ID NO: 3705539 - RNA, 14 nt, Human
guuguaaagcaaua

SEQ ID NO: 3705540 - RNA, 14 nt, Human
guuguaaauauaua

SEQ ID NO: 3705541 - RNA, 16 nt, Human
guuguaaauauauaaa

SEQ ID NO: 3705542 - RNA, 16 nt, Human
guuguaaauuggcaug

SEQ ID NO: 3705543 - RNA, 18 nt, Human
guuguaacuaggcucaga

SEQ ID NO: 3705544 - RNA, 15 nt, Human
guuguaacuuauauu

SEQ ID NO: 3705545 - RNA, 19 nt, Human
guuguaacuuauguagaua

SEQ ID NO: 3705546 - RNA, 16 nt, Human
guuguaagaauucuga

SEQ ID NO: 3705547 - RNA, 17 nt, Human
guuguaauauuucuuca

SEQ ID NO: 3705548 - RNA, 16 nt, Human
guuguacaugaaauuu

SEQ ID NO: 3705549 - RNA, 23 nt, Human
guuguacauuuaugauuuaauaa

SEQ ID NO: 3705550 - RNA, 15 nt, Human
guuguagacaaagua

SEQ ID NO: 3705551 - RNA, 16 nt, Human
guuguauaaauuuauu

SEQ ID NO: 3705552 - RNA, 14 nt, Human
guuguaugaucugu

SEQ ID NO: 3705553 - RNA, 23 nt, Human
guuguaugccuuuaaaucuguga

SEQ ID NO: 3705554 - RNA, 13 nt, Human
guuguauuaacaa

SEQ ID NO: 3705555 - RNA, 22 nt, Human
guugucaagaauagcauuguaa

SEQ ID NO: 3705556 - RNA, 22 nt, Human
guugucacugcuuuuggccugg

SEQ ID NO: 3705557 - RNA, 18 nt, Human
guugucagguuauuuauu

SEQ ID NO: 3705558 - RNA, 15 nt, Human
guugucauugcuuua

SEQ ID NO: 3705559 - RNA, 17 nt, Human
guugucccucugcuacg

SEQ ID NO: 3705560 - RNA, 15 nt, Human
guuguccuaugggag

SEQ ID NO: 3705561 - RNA, 19 nt, Human
guuguccuccccuugggcg

SEQ ID NO: 3705562 - RNA, 20 nt, Human
guuguccuccuuccggggaa

SEQ ID NO: 3705563 - RNA, 22 nt, Human
guuguccuccuuccggggaagg

SEQ ID NO: 3705564 - RNA, 14 nt, Human
guuguccuuuucau

SEQ ID NO: 3705565 - RNA, 14 nt, Human
guugucuaagaaau

SEQ ID NO: 3705566 - RNA, 21 nt, Human
guugucuaagaaauugaauac

SEQ ID NO: 3705567 - RNA, 15 nt, Human
guugucucccuggcc

SEQ ID NO: 3705568 - RNA, 17 nt, Human
guugucucccuggcccu

SEQ ID NO: 3705569 - RNA, 20 nt, Human
guugucucugaugcagcuua

SEQ ID NO: 3705570 - RNA, 13 nt, Human
guugucucuguuu

SEQ ID NO: 3705571 - RNA, 14 nt, Human
guugucuggcaagg

SEQ ID NO: 3705572 - RNA, 14 nt, Human
guugugaauguugu

SEQ ID NO: 3705573 - RNA, 13 nt, Human
guugugaccugaa

SEQ ID NO: 3705574 - RNA, 17 nt, Human
guugugaccuuaguguu

SEQ ID NO: 3705575 - RNA, 20 nt, Human
guugugaguuuaccuuguau

SEQ ID NO: 3705576 - RNA, 21 nt, Human
guugugaugucuuuucuuggc

SEQ ID NO: 3705577 - RNA, 17 nt, Human
guugugcaaauuaacag

SEQ ID NO: 3705578 - RNA, 22 nt, Human
guugugccacagaguguagcca

SEQ ID NO: 3705579 - RNA, 16 nt, Human
guugugccucccuggu

SEQ ID NO: 3705580 - RNA, 18 nt, Human
guugugccucccugguga

SEQ ID NO: 3705581 - RNA, 16 nt, Human
guuguggauuucaguu

SEQ ID NO: 3705582 - RNA, 24 nt, Human
guuguggccuuugcgcuccuggcc

SEQ ID NO: 3705583 - RNA, 15 nt, Human
guuguguaagagaau

SEQ ID NO: 3705584 - RNA, 14 nt, Human
guuguguauagaug

SEQ ID NO: 3705585 - RNA, 21 nt, Human
guugugugccucuagcugaau

SEQ ID NO: 3705586 - RNA, 13 nt, Human
guuguguguggga

SEQ ID NO: 3705587 - RNA, 22 nt, Human
guugugugugggaguguguaau

SEQ ID NO: 3705588 - RNA, 12 nt, Human
guuguguuguca

SEQ ID NO: 3705589 - RNA, 20 nt, Human
guuguguuuguugcuggcuu

SEQ ID NO: 3705590 - RNA, 16 nt, Human
guuguguuuuuuaaga

SEQ ID NO: 3705591 - RNA, 15 nt, Human
guuguuaauaaaagu

SEQ ID NO: 3705592 - RNA, 18 nt, Human
guuguuaaugaaaauguc

SEQ ID NO: 3705593 - RNA, 14 nt, Human
guuguuacauuuuu

SEQ ID NO: 3705594 - RNA, 20 nt, Human
guuguuacuaacuaaacucu

SEQ ID NO: 3705595 - RNA, 14 nt, Human
guuguuaugaugug

SEQ ID NO: 3705596 - RNA, 23 nt, Human
guuguuaugaugugcuuaacagg

SEQ ID NO: 3705597 - RNA, 15 nt, Human
guuguucaacuauuu

SEQ ID NO: 3705598 - RNA, 16 nt, Human
guuguucaacuauuuu

SEQ ID NO: 3705599 - RNA, 16 nt, Human
guuguucgggccaagg

SEQ ID NO: 3705600 - RNA, 12 nt, Human
guuguucuguua

SEQ ID NO: 3705601 - RNA, 15 nt, Human
guuguucuguuaacu

SEQ ID NO: 3705602 - RNA, 14 nt, Human
guuguugcauguuu

SEQ ID NO: 3705603 - RNA, 20 nt, Human
guuguugcuucuugugaagg

SEQ ID NO: 3705604 - RNA, 20 nt, Human
guuguuuacuuaaagauuua

SEQ ID NO: 3705605 - RNA, 13 nt, Human
guuguuucuucca

SEQ ID NO: 3705606 - RNA, 13 nt, Human
guuguuucuuucu

SEQ ID NO: 3705607 - RNA, 23 nt, Human
guuguuugauucagacagcugcc

SEQ ID NO: 3705608 - RNA, 13 nt, Human
guuguuuguaugu

SEQ ID NO: 3705609 - RNA, 15 nt, Human
guuguuuuguacaga

SEQ ID NO: 3705610 - RNA, 17 nt, Human
guuguuuuguacagaug

SEQ ID NO: 3705611 - RNA, 20 nt, Human
guuguuuuuuccuuugcucu

SEQ ID NO: 3705612 - RNA, 22 nt, Human
guuuaaaaaaguuuaaaaugua

SEQ ID NO: 3705613 - RNA, 23 nt, Human
guuuaaaaaaguuuaaaauguau

SEQ ID NO: 3705614 - RNA, 19 nt, Human
guuuaaaaaucaacuuuuu

SEQ ID NO: 3705615 - RNA, 13 nt, Human
guuuaaaacagua

SEQ ID NO: 3705616 - RNA, 17 nt, Human
guuuaaaacaguauuua

SEQ ID NO: 3705617 - RNA, 19 nt, Human
guuuaaaacaguauuuauu

SEQ ID NO: 3705618 - RNA, 14 nt, Human
guuuaaaagaaaaa

SEQ ID NO: 3705619 - RNA, 23 nt, Human
guuuaaaagacacacuuguccac

SEQ ID NO: 3705620 - RNA, 10 nt, Human
guuuaaaauc

SEQ ID NO: 3705621 - RNA, 16 nt, Human
guuuaaaaucauuucu

SEQ ID NO: 3705622 - RNA, 20 nt, Human
guuuaaaauguaauuuaaau

SEQ ID NO: 3705623 - RNA, 12 nt, Human
guuuaaacugau

SEQ ID NO: 3705624 - RNA, 18 nt, Human
guuuaaacuucucugaag

SEQ ID NO: 3705625 - RNA, 13 nt, Human
guuuaaagaaagu

SEQ ID NO: 3705626 - RNA, 18 nt, Human
guuuaaagaaaguguauu

SEQ ID NO: 3705627 - RNA, 21 nt, Human
guuuaaagaaaguguauuugg

SEQ ID NO: 3705628 - RNA, 16 nt, Human
guuuaaagagagguua

SEQ ID NO: 3705629 - RNA, 14 nt, Human
guuuaaagagucua

SEQ ID NO: 3705630 - RNA, 17 nt, Human
guuuaaagagucuagau

SEQ ID NO: 3705631 - RNA, 14 nt, Human
guuuaaagcaacug

SEQ ID NO: 3705632 - RNA, 16 nt, Human
guuuaaaguguauuau

SEQ ID NO: 3705633 - RNA, 23 nt, Human
guuuaaaguguauuauaacagug

SEQ ID NO: 3705634 - RNA, 15 nt, Human
guuuaaauaaaguau

SEQ ID NO: 3705635 - RNA, 19 nt, Human
guuuaaauauuucaagaca

SEQ ID NO: 3705636 - RNA, 12 nt, Human
guuuaacauaaa

SEQ ID NO: 3705637 - RNA, 21 nt, Human
guuuaacauuugccuugcaga

SEQ ID NO: 3705638 - RNA, 12 nt, Human
guuuaacucaga

SEQ ID NO: 3705639 - RNA, 16 nt, Human
guuuaacucagaucac

SEQ ID NO: 3705640 - RNA, 17 nt, Human
guuuaacucagaucacu

SEQ ID NO: 3705641 - RNA, 22 nt, Human
guuuaacucagaucacuacugc

SEQ ID NO: 3705642 - RNA, 23 nt, Human
guuuaagaaaaaauaacacacau

SEQ ID NO: 3705643 - RNA, 20 nt, Human
guuuaagaaaaguauuuuga

SEQ ID NO: 3705644 - RNA, 23 nt, Human
guuuaagaaaaguauuuugaagu

SEQ ID NO: 3705645 - RNA, 20 nt, Human
guuuaagacauuuuuggaag

SEQ ID NO: 3705646 - RNA, 23 nt, Human
guuuaagauuuaauuugccaaaa

SEQ ID NO: 3705647 - RNA, 12 nt, Human
guuuaagcagaa

SEQ ID NO: 3705648 - RNA, 19 nt, Human
guuuaagcagaauuggaaa

SEQ ID NO: 3705649 - RNA, 20 nt, Human
uggcguagaaguuuuuguac

SEQ ID NO: 3705650 - RNA, 20 nt, Human
uggcguagagggugcugccc

SEQ ID NO: 3705651 - RNA, 23 nt, Human
uggcguagagggugcugccccau

SEQ ID NO: 3705652 - RNA, 22 nt, Human
uggcgucugucuucaagggcuu

SEQ ID NO: 3705653 - RNA, 14 nt, Human
uggcgugaacccag

SEQ ID NO: 3705654 - RNA, 21 nt, Human
uggcgugacccgaccuggccg

SEQ ID NO: 3705655 - RNA, 22 nt, Human
uggcgugcaguggugcgaucug

SEQ ID NO: 3705656 - RNA, 15 nt, Human
uggcguggagcaggc

SEQ ID NO: 3705657 - RNA, 16 nt, Human
uggcguggauuaaacu

SEQ ID NO: 3705658 - RNA, 18 nt, Human
uggcgugucccucucgga

SEQ ID NO: 3705659 - RNA, 14 nt, Human
uggcguuguugcau

SEQ ID NO: 3705660 - RNA, 12 nt, Human
uggcuaaagaua

SEQ ID NO: 3705661 - RNA, 21 nt, Human
uggcuaacuauauuugcuuuu

SEQ ID NO: 3705662 - RNA, 15 nt, Human
uggcuacgccucuuc

SEQ ID NO: 3705663 - RNA, 14 nt, Human
uggcuacucugugc

SEQ ID NO: 3705664 - RNA, 19 nt, Human
uggcuacucugugccagag

SEQ ID NO: 3705665 - RNA, 20 nt, Human
uggcuacucugugccagagc

SEQ ID NO: 3705666 - RNA, 24 nt, Human
uggcuacucugugccagagccugg

SEQ ID NO: 3705667 - RNA, 22 nt, Human
uggcuacuuugguuucugucug

SEQ ID NO: 3705668 - RNA, 23 nt, Human
uggcuacuuugguuucugucugu

SEQ ID NO: 3705669 - RNA, 18 nt, Human
uggcuagaguccucacuc

SEQ ID NO: 3705670 - RNA, 17 nt, Human
uggcuagucaagcuccu

SEQ ID NO: 3705671 - RNA, 20 nt, Human
uggcuagucaagcuccuccu

SEQ ID NO: 3705672 - RNA, 21 nt, Human
uggcuagucaagcuccuccuc

SEQ ID NO: 3705673 - RNA, 17 nt, Human
uggcuagugucuaucag

SEQ ID NO: 3705674 - RNA, 19 nt, Human
uggcuauagaugucuuuuc

SEQ ID NO: 3705675 - RNA, 13 nt, Human
uggcuauguuuuu

SEQ ID NO: 3705676 - RNA, 17 nt, Human
uggcucaagucuggccc

SEQ ID NO: 3705677 - RNA, 16 nt, Human
uggcucaauccucuaa

SEQ ID NO: 3705678 - RNA, 16 nt, Human
uggcucacaccuguaa

SEQ ID NO: 3705679 - RNA, 17 nt, Human
uggcucacaccuguaau

SEQ ID NO: 3705680 - RNA, 17 nt, Human
uggcucacacucgacau

SEQ ID NO: 3705681 - RNA, 14 nt, Human
uggcucacagacug

SEQ ID NO: 3705682 - RNA, 18 nt, Human
uggcucacagacuggaga

SEQ ID NO: 3705683 - RNA, 19 nt, Human
uggcucacaugguuuacau

SEQ ID NO: 3705684 - RNA, 16 nt, Human
uggcucacgccuguaa

SEQ ID NO: 3705685 - RNA, 16 nt, Human
uggcucacguguguga

SEQ ID NO: 3705686 - RNA, 15 nt, Human
uggcucacugcagcc

SEQ ID NO: 3705687 - RNA, 14 nt, Human
uggcucagcucggg

SEQ ID NO: 3705688 - RNA, 16 nt, Human
uggcuccaaacccucg

SEQ ID NO: 3705689 - RNA, 20 nt, Human
uggcuccaaacccucgaggc

SEQ ID NO: 3705690 - RNA, 23 nt, Human
uggcuccacacacacaaaaaaag

SEQ ID NO: 3705691 - RNA, 15 nt, Human
uggcuccagccugga

SEQ ID NO: 3705692 - RNA, 14 nt, Human
uggcuccaggccaa

SEQ ID NO: 3705693 - RNA, 13 nt, Human
uguccagugccca

SEQ ID NO: 3705694 - RNA, 14 nt, Human
uguccagugcccau

SEQ ID NO: 3705695 - RNA, 16 nt, Human
uguccaucugcccgcc

SEQ ID NO: 3705696 - RNA, 19 nt, Human
uguccaucugcccgccugc

SEQ ID NO: 3705697 - RNA, 22 nt, Human
uguccaucugcccgccugccca

SEQ ID NO: 3705698 - RNA, 22 nt, Human
uguccaugcgcucagggccaug

SEQ ID NO: 3705699 - RNA, 16 nt, Human
uguccaugugugugca

SEQ ID NO: 3705700 - RNA, 14 nt, Human
uguccauugacaug

SEQ ID NO: 3705701 - RNA, 16 nt, Human
uguccauugacaugua

SEQ ID NO: 3705702 - RNA, 12 nt, Human
uguccauuuaua

SEQ ID NO: 3705703 - RNA, 13 nt, Human
uguccauuuguaa

SEQ ID NO: 3705704 - RNA, 21 nt, Human
uguccauuuugugaagcccug

SEQ ID NO: 3705705 - RNA, 14 nt, Human
ugucccaagugcca

SEQ ID NO: 3705706 - RNA, 13 nt, Human
ugucccacagcuu

SEQ ID NO: 3705707 - RNA, 14 nt, Human
ugucccacagcuug

SEQ ID NO: 3705708 - RNA, 18 nt, Human
ugucccaccauacgagca

SEQ ID NO: 3705709 - RNA, 23 nt, Human
ugucccaccauacgagcaccucc

SEQ ID NO: 3705710 - RNA, 17 nt, Human
ugucccacccccacccc

SEQ ID NO: 3705711 - RNA, 19 nt, Human
ugucccacccccuuccccc

SEQ ID NO: 3705712 - RNA, 21 nt, Human
ugucccaccucuucucuuccu

SEQ ID NO: 3705713 - RNA, 16 nt, Human
ugucccagaagaugac

SEQ ID NO: 3705714 - RNA, 16 nt, Human
ugucccaggcacugua

SEQ ID NO: 3705715 - RNA, 20 nt, Human
ugucccaucuggucauuugg

SEQ ID NO: 3705716 - RNA, 17 nt, Human
ugucccaugacccaccc

SEQ ID NO: 3705717 - RNA, 18 nt, Human
ugucccaugacccacccc

SEQ ID NO: 3705718 - RNA, 20 nt, Human
ugucccaugacccaccccug

SEQ ID NO: 3705719 - RNA, 17 nt, Human
ugucccauggacacucc

SEQ ID NO: 3705720 - RNA, 18 nt, Human
ugucccauggacacucca

SEQ ID NO: 3705721 - RNA, 20 nt, Human
ugucccaugugagcugcugc

SEQ ID NO: 3705722 - RNA, 16 nt, Human
ugucccauucccuggg

SEQ ID NO: 3705723 - RNA, 21 nt, Human
uguccccaaauccgaaccucc

SEQ ID NO: 3705724 - RNA, 16 nt, Human
uguccccacacuccua

SEQ ID NO: 3705725 - RNA, 12 nt, Human
uguccccaccau

SEQ ID NO: 3705726 - RNA, 17 nt, Human
uguccccacccuccacu

SEQ ID NO: 3705727 - RNA, 19 nt, Human
uguccccacccuccacuca

SEQ ID NO: 3705728 - RNA, 13 nt, Human
uguccccaccgca

SEQ ID NO: 3705729 - RNA, 18 nt, Human
uguccccaccgcagacag

SEQ ID NO: 3705730 - RNA, 19 nt, Human
uguccccaccgcagacagg

SEQ ID NO: 3705731 - RNA, 16 nt, Human
uguccccagcccacug

SEQ ID NO: 3705732 - RNA, 13 nt, Human
ugucccccagcuc

SEQ ID NO: 3705733 - RNA, 14 nt, Human
uguccccccacucc

SEQ ID NO: 3705734 - RNA, 18 nt, Human
ugucccccucuguccagg

SEQ ID NO: 3705735 - RNA, 12 nt, Human
uguccccuccca

SEQ ID NO: 3705736 - RNA, 17 nt, Human
uguccccucuugcccca

SEQ ID NO: 3705737 - RNA, 17 nt, Human
ugucccgauuguaacuc

SEQ ID NO: 3705738 - RNA, 20 nt, Human
ugucccuaccgagucucuuc

SEQ ID NO: 3705739 - RNA, 21 nt, Human
ugucccuaguaaaaauacaaa

SEQ ID NO: 3705740 - RNA, 19 nt, Human
ugucccucaaaugacccaa

SEQ ID NO: 3705741 - RNA, 12 nt, Human
ugucccuccugg

SEQ ID NO: 3705742 - RNA, 16 nt, Human
ugucccuccugguguc

SEQ ID NO: 3705743 - RNA, 13 nt, Human
ugucccucuaaag

SEQ ID NO: 3705744 - RNA, 15 nt, Human
ugucccucucucugg

SEQ ID NO: 3705745 - RNA, 16 nt, Human
ugucccucucucugga

SEQ ID NO: 3705746 - RNA, 14 nt, Human
ugucccucugcccc

SEQ ID NO: 3705747 - RNA, 20 nt, Human
ugucccugcacuugcagacu

SEQ ID NO: 3705748 - RNA, 15 nt, Human
ugucccuggccaucu

SEQ ID NO: 3705749 - RNA, 16 nt, Human
ugucccuggccaucuc

SEQ ID NO: 3705750 - RNA, 17 nt, Human
ugucccuggccaucucu

SEQ ID NO: 3705751 - RNA, 14 nt, Human
ugucccugggccag

SEQ ID NO: 3705752 - RNA, 13 nt, Human
ugucccugucacc

SEQ ID NO: 3705753 - RNA, 23 nt, Human
ugucccuuacgugaguccuggca

SEQ ID NO: 3705754 - RNA, 17 nt, Human
ugucccuugaugcacag

SEQ ID NO: 3705755 - RNA, 19 nt, Human
ugucccuugaugcacagag

SEQ ID NO: 3705756 - RNA, 20 nt, Human
ugucccuugaugcacagaga

SEQ ID NO: 3705757 - RNA, 21 nt, Human
ugucccuugccccccuggccu

SEQ ID NO: 3705758 - RNA, 14 nt, Human
ugucccuuggagcu

SEQ ID NO: 3705759 - RNA, 12 nt, Human
ugucccuuucuu

SEQ ID NO: 3705760 - RNA, 14 nt, Human
ugucccuuucuucu

SEQ ID NO: 3705761 - RNA, 15 nt, Human
ugucccuuucuucuc

SEQ ID NO: 3705762 - RNA, 16 nt, Human
ugucccuuucuucucc

SEQ ID NO: 3705763 - RNA, 17 nt, Human
ugucccuuucuucuccc

SEQ ID NO: 3705764 - RNA, 18 nt, Human
ugucccuuucuuggccag

SEQ ID NO: 3705765 - RNA, 15 nt, Human
uguccgacucuucug

SEQ ID NO: 3705766 - RNA, 22 nt, Human
uguccgagaacuaaagccaagg

SEQ ID NO: 3705767 - RNA, 12 nt, Human
uguccgcccucu

SEQ ID NO: 3705768 - RNA, 13 nt, Human
uguccgcccucuu

SEQ ID NO: 3705769 - RNA, 20 nt, Human
uguccgcugggugguacccu

SEQ ID NO: 3705770 - RNA, 17 nt, Human
uguccggaaugccaccc

SEQ ID NO: 3705771 - RNA, 18 nt, Human
uguccuaaggacacacua

SEQ ID NO: 3705772 - RNA, 20 nt, Human
uguccuaaggacacacuaau

SEQ ID NO: 3705773 - RNA, 22 nt, Human
uguccuaauaauaucccacugg

SEQ ID NO: 3705774 - RNA, 16 nt, Human
uguccuaauucuucug

SEQ ID NO: 3705775 - RNA, 18 nt, Human
uguccuaauucuucuguc

SEQ ID NO: 3705776 - RNA, 20 nt, Human
uguccuaauucuucuguccu

SEQ ID NO: 3705777 - RNA, 16 nt, Human
uguccuacagaaaaac

SEQ ID NO: 3705778 - RNA, 20 nt, Human
uguccuaggaguauccucau

SEQ ID NO: 3705779 - RNA, 16 nt, Human
uguccuaugcaauaaa

SEQ ID NO: 3705780 - RNA, 14 nt, Human
uguccuauguguga

SEQ ID NO: 3705781 - RNA, 16 nt, Human
uguccuauuaguguua

SEQ ID NO: 3705782 - RNA, 20 nt, Human
uguccucaccaugauggggc

SEQ ID NO: 3705783 - RNA, 15 nt, Human
uguccucacugcucc

SEQ ID NO: 3705784 - RNA, 22 nt, Human
uguccucacugcucccugaagc

SEQ ID NO: 3705785 - RNA, 13 nt, Human
uguccucagccuu

SEQ ID NO: 3705786 - RNA, 18 nt, Human
uguccucagguggccaug

SEQ ID NO: 3705787 - RNA, 17 nt, Human
uguccucauuucuccag

SEQ ID NO: 3705788 - RNA, 16 nt, Human
uguccuccagaagccu

SEQ ID NO: 3705789 - RNA, 15 nt, Human
uguccuccaggagcu

SEQ ID NO: 3705790 - RNA, 21 nt, Human
uguccuccaggagcuucuugu

SEQ ID NO: 3705791 - RNA, 21 nt, Human
uguccucccaccccugccccc

SEQ ID NO: 3705792 - RNA, 19 nt, Human
uguccucccauccccugga

SEQ ID NO: 3705793 - RNA, 23 nt, Human
uguccucccauccccuggacugg

SEQ ID NO: 3705794 - RNA, 14 nt, Human
uguccuccccuugg

SEQ ID NO: 3705795 - RNA, 21 nt, Human
uguccucccgagcuccucuuc

SEQ ID NO: 3705796 - RNA, 19 nt, Human
uguccucccuccaccuacc

SEQ ID NO: 3705797 - RNA, 11 nt, Human
uguccuccucg

SEQ ID NO: 3705798 - RNA, 12 nt, Human
uguccuccuggu

SEQ ID NO: 3705799 - RNA, 13 nt, Human
uguccucuccccu

SEQ ID NO: 3705800 - RNA, 13 nt, Human
uguccucuucccu

SEQ ID NO: 3705801 - RNA, 16 nt, Human
uguccucuucccucuc

SEQ ID NO: 3705802 - RNA, 15 nt, Human
uguccucuugcucaa

SEQ ID NO: 3705803 - RNA, 15 nt, Human
uguccugaccacccu

SEQ ID NO: 3705804 - RNA, 16 nt, Human
uguccugaccacccuc

SEQ ID NO: 3705805 - RNA, 19 nt, Human
uguccugaccacccucccc

SEQ ID NO: 3705806 - RNA, 17 nt, Human
uguccugaccugucuca

SEQ ID NO: 3705807 - RNA, 22 nt, Human
uguccugacuucaggggcugcc

SEQ ID NO: 3705808 - RNA, 10 nt, Human
uguccugccu

SEQ ID NO: 3705809 - RNA, 17 nt, Human
uguccugccuauuaucu

SEQ ID NO: 3705810 - RNA, 24 nt, Human
uguccugccuauuaucugucagcu

SEQ ID NO: 3705811 - RNA, 12 nt, Human
uguccugccugu

SEQ ID NO: 3705812 - RNA, 14 nt, Human
uguccugccugucu

SEQ ID NO: 3705813 - RNA, 16 nt, Human
uguccugcuccacagu

SEQ ID NO: 3705814 - RNA, 19 nt, Human
uguccugggagugagcugg

SEQ ID NO: 3705815 - RNA, 10 nt, Human
uguccugggc

SEQ ID NO: 3705816 - RNA, 17 nt, Human
uguccugggcgcccugg

SEQ ID NO: 3705817 - RNA, 17 nt, Human
uguccugggcugguggc

SEQ ID NO: 3705818 - RNA, 19 nt, Human
uguccuggugcucucugcc

SEQ ID NO: 3705819 - RNA, 17 nt, Human
uguccuggugguauuuu

SEQ ID NO: 3705820 - RNA, 20 nt, Human
uguccuguaaacacucagcu

SEQ ID NO: 3705821 - RNA, 15 nt, Human
uguccuguaaagguu

SEQ ID NO: 3705822 - RNA, 22 nt, Human
uguccuguaaagguuacaagcc

SEQ ID NO: 3705823 - RNA, 16 nt, Human
uguccuguacauugug

SEQ ID NO: 3705824 - RNA, 17 nt, Human
uguccugugucaguuua

SEQ ID NO: 3705825 - RNA, 21 nt, Human
uguccugugucaguuuauguu

SEQ ID NO: 3705826 - RNA, 15 nt, Human
uguccuuagccugga

SEQ ID NO: 3705827 - RNA, 14 nt, Human
uguccuucccugca

SEQ ID NO: 3705828 - RNA, 19 nt, Human
uguccuucucucaccuccu

SEQ ID NO: 3705829 - RNA, 21 nt, Human
uguccuucucucaccuccuaa

SEQ ID NO: 3705830 - RNA, 14 nt, Human
uguccuugugcaug

SEQ ID NO: 3705831 - RNA, 15 nt, Human
uguccuuguguguuu

SEQ ID NO: 3705832 - RNA, 14 nt, Human
uguccuuucccuuc

SEQ ID NO: 3705833 - RNA, 13 nt, Human
uguccuuucuaga

SEQ ID NO: 3705834 - RNA, 18 nt, Human
uguccuuucuagagcacu

SEQ ID NO: 3705835 - RNA, 15 nt, Human
uguccuuuuuccucu

SEQ ID NO: 3705836 - RNA, 16 nt, Human
uguccuuuuuccucuc

SEQ ID NO: 3705837 - RNA, 16 nt, Human
uguccuuuuuguuauu

SEQ ID NO: 3705838 - RNA, 22 nt, Human
ugucgaaaagagucuuccaauu

SEQ ID NO: 3705839 - RNA, 14 nt, Human
ugucgauuagacug

SEQ ID NO: 3705840 - RNA, 16 nt, Human
ugucgcccaggcugga

SEQ ID NO: 3705841 - RNA, 20 nt, Human
ugucgcgccuucuccccccc

SEQ ID NO: 3705842 - RNA, 14 nt, Human
ugucgcucaugugu

SEQ ID NO: 3705843 - RNA, 15 nt, Human
ugucgggcaccagcc

SEQ ID NO: 3705844 - RNA, 19 nt, Human
ugucgggcaccagccagcg

SEQ ID NO: 3705845 - RNA, 15 nt, Human
ugucgggcaugacac

SEQ ID NO: 3705846 - RNA, 22 nt, Human
ugucgggcccuucuugcugccc

SEQ ID NO: 3705847 - RNA, 20 nt, Human
ugucgggcuuugugugaagg

SEQ ID NO: 3705848 - RNA, 23 nt, Human
ugucguagccaaggugggcugag

SEQ ID NO: 3705849 - RNA, 22 nt, Human
ugucguauuuggcacacagcag

SEQ ID NO: 3705850 - RNA, 18 nt, Human
ugucuaaaaaacaaaaca

SEQ ID NO: 3705851 - RNA, 13 nt, Human
ugucuaaaaacac

SEQ ID NO: 3705852 - RNA, 15 nt, Human
ugucuaaaacaauaa

SEQ ID NO: 3705853 - RNA, 22 nt, Human
ugucuaaaaugccucaguguau

SEQ ID NO: 3705854 - RNA, 21 nt, Human
ugucuaaacaaugcugauuug

SEQ ID NO: 3705855 - RNA, 13 nt, Human
ugucuaaacugca

SEQ ID NO: 3705856 - RNA, 12 nt, Human
ugucuaaagugu

SEQ ID NO: 3705857 - RNA, 20 nt, Human
ugucuaacucagaauuauuu

SEQ ID NO: 3705858 - RNA, 22 nt, Human
ugucuaacuuuagaagugcauu

SEQ ID NO: 3705859 - RNA, 18 nt, Human
ugucuaagaaauugaaua

SEQ ID NO: 3705860 - RNA, 15 nt, Human
ugucuaagauaguaa

SEQ ID NO: 3705861 - RNA, 21 nt, Human
ugucuaagauuaauagcauuc

SEQ ID NO: 3705862 - RNA, 16 nt, Human
ugucuaagauucuaga

SEQ ID NO: 3705863 - RNA, 22 nt, Human
ugucuacacuaagagagaauga

SEQ ID NO: 3705864 - RNA, 12 nt, Human
ugucuacagaga

SEQ ID NO: 3705865 - RNA, 14 nt, Human
ugucuaccaucucc

SEQ ID NO: 3705866 - RNA, 16 nt, Human
ugucuaccaucucccu

SEQ ID NO: 3705867 - RNA, 19 nt, Human
ugucuaggauuuuggaugu

SEQ ID NO: 3705868 - RNA, 15 nt, Human
ugucuaguuguuuga

SEQ ID NO: 3705869 - RNA, 22 nt, Human
ugucuauaaucccagcacuuug

SEQ ID NO: 3705870 - RNA, 17 nt, Human
ugucuauaguugucagu

SEQ ID NO: 3705871 - RNA, 19 nt, Human
ugucuauucaaaauaucaa

SEQ ID NO: 3705872 - RNA, 14 nt, Human
ugucuauucuccag

SEQ ID NO: 3705873 - RNA, 18 nt, Human
ugucuauuucugcugaau

SEQ ID NO: 3705874 - RNA, 15 nt, Human
ugucuauuuuaaaau

SEQ ID NO: 3705875 - RNA, 22 nt, Human
ugucuauuuuaaaauaaauuag

SEQ ID NO: 3705876 - RNA, 15 nt, Human
ugucucaaugcucau

SEQ ID NO: 3705877 - RNA, 17 nt, Human
ugucucaaugcucauaa

SEQ ID NO: 3705878 - RNA, 14 nt, Human
ugucucagacuuuu

SEQ ID NO: 3705879 - RNA, 15 nt, Human
ugucucagacuuuug

SEQ ID NO: 3705880 - RNA, 20 nt, Human
ugucucaggcugccugaguc

SEQ ID NO: 3705881 - RNA, 21 nt, Human
ugucucaguccaugaagaugu

SEQ ID NO: 3705882 - RNA, 11 nt, Human
ugucucauccc

SEQ ID NO: 3705883 - RNA, 12 nt, Human
ugucucauccca

SEQ ID NO: 3705884 - RNA, 15 nt, Human
ugucucauccuccug

SEQ ID NO: 3705885 - RNA, 13 nt, Human
ugucucaugccag

SEQ ID NO: 3705886 - RNA, 16 nt, Human
ugucuccaacccccca

SEQ ID NO: 3705887 - RNA, 13 nt, Human
ugucuccacugug

SEQ ID NO: 3705888 - RNA, 12 nt, Human
ugucuccagacc

SEQ ID NO: 3705889 - RNA, 20 nt, Human
ugucuccagacccccacccc

SEQ ID NO: 3705890 - RNA, 22 nt, Human
ugucuccagacccccaccccuu

SEQ ID NO: 3705891 - RNA, 23 nt, Human
ugucuccagacccccaccccuuc

SEQ ID NO: 3705892 - RNA, 15 nt, Human
ugucuccauggcccu

SEQ ID NO: 3705893 - RNA, 20 nt, Human
ugucucccuauaaugcugga

SEQ ID NO: 3705894 - RNA, 21 nt, Human
ugucuccuaagcaccuguaau

SEQ ID NO: 3705895 - RNA, 16 nt, Human
ugucuccuacuccuga

SEQ ID NO: 3705896 - RNA, 18 nt, Human
ugucuccuauauauuucu

SEQ ID NO: 3705897 - RNA, 21 nt, Human
ugucuccuuaagcugcagaga

SEQ ID NO: 3705898 - RNA, 17 nt, Human
ugucuccuugguuauau

SEQ ID NO: 3705899 - RNA, 17 nt, Human
ugucuccuuuaagagcu

SEQ ID NO: 3705900 - RNA, 21 nt, Human
ugucuccuuucaccccagggc

SEQ ID NO: 3705901 - RNA, 22 nt, Human
ugucuccuuucaccccagggcc

SEQ ID NO: 3705902 - RNA, 15 nt, Human
ugucucgaacuauuu

SEQ ID NO: 3705903 - RNA, 17 nt, Human
ugucucgagcgcccugc

SEQ ID NO: 3705904 - RNA, 20 nt, Human
ugucucgagcgcccugcaga

SEQ ID NO: 3705905 - RNA, 14 nt, Human
ugucucguuuguga

SEQ ID NO: 3705906 - RNA, 15 nt, Human
ugucucuaacuuauu

SEQ ID NO: 3705907 - RNA, 17 nt, Human
ugucucuacuaaaaaua

SEQ ID NO: 3705908 - RNA, 13 nt, Human
ugucucuccuuuu

SEQ ID NO: 3705909 - RNA, 20 nt, Human
ugucucucuucucagagugg

SEQ ID NO: 3705910 - RNA, 13 nt, Human
ugucucugaugca

SEQ ID NO: 3705911 - RNA, 14 nt, Human
ugucucugaugcag

SEQ ID NO: 3705912 - RNA, 19 nt, Human
ugucucugaugcagcuuau

SEQ ID NO: 3705913 - RNA, 20 nt, Human
ugucucugaugcagcuuaua

SEQ ID NO: 3705914 - RNA, 18 nt, Human
ugucucugcaaacugccu

SEQ ID NO: 3705915 - RNA, 13 nt, Human
ugucucugccucc

SEQ ID NO: 3705916 - RNA, 11 nt, Human
ugucucugcuc

SEQ ID NO: 3705917 - RNA, 22 nt, Human
ugucucuggauuauauuaugaa

SEQ ID NO: 3705918 - RNA, 18 nt, Human
ugucucuggcgugugggu

SEQ ID NO: 3705919 - RNA, 19 nt, Human
ugucucuggcgugugggua

SEQ ID NO: 3705920 - RNA, 16 nt, Human
ugucucugggccacuu

SEQ ID NO: 3705921 - RNA, 13 nt, Human
ugucucugugaga

SEQ ID NO: 3705922 - RNA, 20 nt, Human
ugucucuuaaaaaaauaaaa

SEQ ID NO: 3705923 - RNA, 22 nt, Human
ugucucuuauggauguccccag

SEQ ID NO: 3705924 - RNA, 21 nt, Human
ugucucuuccauaugaccuca

SEQ ID NO: 3705925 - RNA, 17 nt, Human
ugucucuucuuuagaac

SEQ ID NO: 3705926 - RNA, 20 nt, Human
ugucucuugguccugcugca

SEQ ID NO: 3705927 - RNA, 21 nt, Human
ugucucuugguccugcugcag

SEQ ID NO: 3705928 - RNA, 17 nt, Human
ugucucuuuaagggcau

SEQ ID NO: 3705929 - RNA, 21 nt, Human
ugucucuuuaaugucacaggc

SEQ ID NO: 3705930 - RNA, 16 nt, Human
ugucucuuuuuuaagu

SEQ ID NO: 3705931 - RNA, 19 nt, Human
ugucugaaacauuucauaa

SEQ ID NO: 3705932 - RNA, 16 nt, Human
ugucugaacuugcauu

SEQ ID NO: 3705933 - RNA, 17 nt, Human
ugucugaacuuugggaa

SEQ ID NO: 3705934 - RNA, 18 nt, Human
ugucugaaggacacuucc

SEQ ID NO: 3705935 - RNA, 16 nt, Human
ugucugaagucacugc

SEQ ID NO: 3705936 - RNA, 17 nt, Human
ugucugaagucacugca

SEQ ID NO: 3705937 - RNA, 23 nt, Human
ugucugaaucgagugagacaaaa

SEQ ID NO: 3705938 - RNA, 17 nt, Human
ugucugagcccucaaag

SEQ ID NO: 3705939 - RNA, 17 nt, Human
ugucugagugaaccugu

SEQ ID NO: 3705940 - RNA, 16 nt, Human
ugucugaguggcuuca

SEQ ID NO: 3705941 - RNA, 21 nt, Human
ugucugaucguucaaagcaug

SEQ ID NO: 3705942 - RNA, 16 nt, Human
ugucugaucugugcuu

SEQ ID NO: 3705943 - RNA, 23 nt, Human
ugucugaucugugcuuuccagcu

SEQ ID NO: 3705944 - RNA, 14 nt, Human
ugucugcacccagg

SEQ ID NO: 3705945 - RNA, 13 nt, Human
ugucugcagccuu

SEQ ID NO: 3705946 - RNA, 16 nt, Human
ugucugccacauuaac

SEQ ID NO: 3705947 - RNA, 19 nt, Human
ugucugccagccagcagcc

SEQ ID NO: 3705948 - RNA, 13 nt, Human
ugucugccagggc

SEQ ID NO: 3705949 - RNA, 18 nt, Human
ugucugccauguugcccc

SEQ ID NO: 3705950 - RNA, 19 nt, Human
ugucugcccaaugaauaau

SEQ ID NO: 3705951 - RNA, 22 nt, Human
ugucugccccaaguuuugugaa

SEQ ID NO: 3705952 - RNA, 18 nt, Human
ugucugcuggucacuucu

SEQ ID NO: 3705953 - RNA, 22 nt, Human
ugucugcuggucacuucuucug

SEQ ID NO: 3705954 - RNA, 15 nt, Human
ugucuggaagauggg

SEQ ID NO: 3705955 - RNA, 14 nt, Human
ugucuggagaauaa

SEQ ID NO: 3705956 - RNA, 18 nt, Human
ugucuggagaccaccagg

SEQ ID NO: 3705957 - RNA, 22 nt, Human
ugucuggaggggagcucugucu

SEQ ID NO: 3705958 - RNA, 15 nt, Human
ugucuggaucaguaa

SEQ ID NO: 3705959 - RNA, 15 nt, Human
ugucuggauucccag

SEQ ID NO: 3705960 - RNA, 19 nt, Human
ugucuggauucccaggaug

SEQ ID NO: 3705961 - RNA, 18 nt, Human
ugucuggcaaaagaaaaa

SEQ ID NO: 3705962 - RNA, 16 nt, Human
ugucuggcaaugccac

SEQ ID NO: 3705963 - RNA, 15 nt, Human
ugucuggccaggccu

SEQ ID NO: 3705964 - RNA, 17 nt, Human
ugucuggcugcagagca

SEQ ID NO: 3705965 - RNA, 12 nt, Human
ugucugggcuga

SEQ ID NO: 3705966 - RNA, 16 nt, Human
ugucugggugcuacug

SEQ ID NO: 3705967 - RNA, 17 nt, Human
ugucuggguuugagaaa

SEQ ID NO: 3705968 - RNA, 13 nt, Human
ugucugguggccc

SEQ ID NO: 3705969 - RNA, 21 nt, Human
ugucuggugguggcaccaucu

SEQ ID NO: 3705970 - RNA, 14 nt, Human
ugucugguucucaa

SEQ ID NO: 3705971 - RNA, 22 nt, Human
ugucugguuuuaacaauuuccu

SEQ ID NO: 3705972 - RNA, 17 nt, Human
ugucuguaaauauguuu

SEQ ID NO: 3705973 - RNA, 15 nt, Human
ugucuguacacgugu

SEQ ID NO: 3705974 - RNA, 21 nt, Human
ugucuguagagggcccuggug

SEQ ID NO: 3705975 - RNA, 17 nt, Human
ugucuguagcuccucaa

SEQ ID NO: 3705976 - RNA, 22 nt, Human
ugucuguauuucauguggcugu

SEQ ID NO: 3705977 - RNA, 13 nt, Human
ugucugucauugu

SEQ ID NO: 3705978 - RNA, 14 nt, Human
ugucugucuguccc

SEQ ID NO: 3705979 - RNA, 14 nt, Human
ugucugugaacaga

SEQ ID NO: 3705980 - RNA, 19 nt, Human
ugucugugaagugagaccu

SEQ ID NO: 3705981 - RNA, 20 nt, Human
ugucuguggauggucauugc

SEQ ID NO: 3705982 - RNA, 21 nt, Human
ugucuguggauggucauugca

SEQ ID NO: 3705983 - RNA, 15 nt, Human
ugucuguggauuuuu

SEQ ID NO: 3705984 - RNA, 17 nt, Human
ugucuguuuaagaaaag

SEQ ID NO: 3705985 - RNA, 20 nt, Human
ugucuguuuguuucaagaac

SEQ ID NO: 3705986 - RNA, 20 nt, Human
ugucuuaaacuaaaugugca

SEQ ID NO: 3705987 - RNA, 19 nt, Human
ugucuuaaauaaaagaaau

SEQ ID NO: 3705988 - RNA, 14 nt, Human
ugucuuaaugaagu

SEQ ID NO: 3705989 - RNA, 18 nt, Human
ugucuuaaugaaguuuga

SEQ ID NO: 3705990 - RNA, 21 nt, Human
ugucuuaaugaaguuugaaug

SEQ ID NO: 3705991 - RNA, 13 nt, Human
ugucuuauauaua

SEQ ID NO: 3705992 - RNA, 19 nt, Human
ugucuuauggauucauuua

SEQ ID NO: 3705993 - RNA, 14 nt, Human
ugucuuauugacag

SEQ ID NO: 3705994 - RNA, 17 nt, Human
guuugugacagggcggg

SEQ ID NO: 3705995 - RNA, 23 nt, Human
guuugugauucuuccagauguga

SEQ ID NO: 3705996 - RNA, 13 nt, Human
guuuguggccuca

SEQ ID NO: 3705997 - RNA, 15 nt, Human
guuuguggccucaga

SEQ ID NO: 3705998 - RNA, 23 nt, Human
guuuguggggugacgggacucag

SEQ ID NO: 3705999 - RNA, 21 nt, Human
guuuguguguugucuugaaag

SEQ ID NO: 3706000 - RNA, 20 nt, Human
guuuguguucuguuuguuaa

SEQ ID NO: 3706001 - RNA, 17 nt, Human
guuuguuaaaacuggca

SEQ ID NO: 3706002 - RNA, 14 nt, Human
guuuguucaucugu

SEQ ID NO: 3706003 - RNA, 13 nt, Human
guuuguucccugu

SEQ ID NO: 3706004 - RNA, 18 nt, Human
guuuguucuuguuuuuaa

SEQ ID NO: 3706005 - RNA, 16 nt, Human
guuuguugugaggauu

SEQ ID NO: 3706006 - RNA, 18 nt, Human
guuuguuuacaaaaucag

SEQ ID NO: 3706007 - RNA, 12 nt, Human
guuuguuuaguc

SEQ ID NO: 3706008 - RNA, 19 nt, Human
guuuguuucucccccuggg

SEQ ID NO: 3706009 - RNA, 20 nt, Human
guuuguuucucccccugggc

SEQ ID NO: 3706010 - RNA, 12 nt, Human
guuuguuucuuu

SEQ ID NO: 3706011 - RNA, 14 nt, Human
guuuguuuguauuu

SEQ ID NO: 3706012 - RNA, 15 nt, Human
guuuguuugucuguu

SEQ ID NO: 3706013 - RNA, 17 nt, Human
guuuguuuguuugucug

SEQ ID NO: 3706014 - RNA, 15 nt, Human
guuuguuuguuuugu

SEQ ID NO: 3706015 - RNA, 13 nt, Human
guuuguuuuccuu

SEQ ID NO: 3706016 - RNA, 15 nt, Human
guuuguuuugugaau

SEQ ID NO: 3706017 - RNA, 16 nt, Human
guuuguuuuugcuugu

SEQ ID NO: 3706018 - RNA, 17 nt, Human
guuuguuuuuuugccac

SEQ ID NO: 3706019 - RNA, 20 nt, Human
guuuuaaaaaaauaaaacau

SEQ ID NO: 3706020 - RNA, 17 nt, Human
guuuuaaaaaccuguuc

SEQ ID NO: 3706021 - RNA, 21 nt, Human
guuuuaaaacuggaccuguau

SEQ ID NO: 3706022 - RNA, 16 nt, Human
guuuuaaaauacugua

SEQ ID NO: 3706023 - RNA, 14 nt, Human
guuuuaaaauuaaa

SEQ ID NO: 3706024 - RNA, 19 nt, Human
guuuuaaacauagaaaguu

SEQ ID NO: 3706025 - RNA, 23 nt, Human
guuuuaaacauuaauagcagccu

SEQ ID NO: 3706026 - RNA, 14 nt, Human
guuuuaaacucauu

SEQ ID NO: 3706027 - RNA, 15 nt, Human
guuuuaaagugauua

SEQ ID NO: 3706028 - RNA, 20 nt, Human
guuuuaaaguucauugcaau

SEQ ID NO: 3706029 - RNA, 14 nt, Human
guuuuaaauguaca

SEQ ID NO: 3706030 - RNA, 13 nt, Human
guuuuaaauucug

SEQ ID NO: 3706031 - RNA, 21 nt, Human
guuuuaacaaaugcuauuaaa

SEQ ID NO: 3706032 - RNA, 22 nt, Human
guuuuaacuguggauauuguua

SEQ ID NO: 3706033 - RNA, 18 nt, Human
guuuuaaggacugacuga

SEQ ID NO: 3706034 - RNA, 22 nt, Human
guuuuaaggaugcuuguacaua

SEQ ID NO: 3706035 - RNA, 16 nt, Human
guuuuaaguacuacac

SEQ ID NO: 3706036 - RNA, 17 nt, Human
guuuuaaguuguuugca

SEQ ID NO: 3706037 - RNA, 19 nt, Human
guuuuaaucugaaauucua

SEQ ID NO: 3706038 - RNA, 20 nt, Human
guuuuaaucugaaauucuaa

SEQ ID NO: 3706039 - RNA, 12 nt, Human
guuuuaauguau

SEQ ID NO: 3706040 - RNA, 13 nt, Human
guuuuaauuccau

SEQ ID NO: 3706041 - RNA, 22 nt, Human
guuuuaauuuauacuggcaugc

SEQ ID NO: 3706042 - RNA, 20 nt, Human
guuuuacaaguuggagucac

SEQ ID NO: 3706043 - RNA, 23 nt, Human
guuuuacaauaaaaucuugaaaa

SEQ ID NO: 3706044 - RNA, 20 nt, Human
guuuuacaauaguucugugg

SEQ ID NO: 3706045 - RNA, 14 nt, Human
guuuuacaguguuu

SEQ ID NO: 3706046 - RNA, 14 nt, Human
guuuuacuaaagaa

SEQ ID NO: 3706047 - RNA, 14 nt, Human
guuuuacugugaaa

SEQ ID NO: 3706048 - RNA, 17 nt, Human
guuuuagacaaauacuc

SEQ ID NO: 3706049 - RNA, 20 nt, Human
guuuuagccauuguuggcuu

SEQ ID NO: 3706050 - RNA, 16 nt, Human
guuuuagguagaaaaa

SEQ ID NO: 3706051 - RNA, 17 nt, Human
guuuuagguucuaaagu

SEQ ID NO: 3706052 - RNA, 20 nt, Human
guuuuauaagcaucauuauu

SEQ ID NO: 3706053 - RNA, 22 nt, Human
guuuuauaagcaucauuauuua

SEQ ID NO: 3706054 - RNA, 21 nt, Human
guuuuauaaggucugacauca

SEQ ID NO: 3706055 - RNA, 16 nt, Human
guuuuauaaugaaccc

SEQ ID NO: 3706056 - RNA, 15 nt, Human
guuuuauacugaagg

SEQ ID NO: 3706057 - RNA, 18 nt, Human
guuuuauagccuggacug

SEQ ID NO: 3706058 - RNA, 11 nt, Human
guuuuaucaag

SEQ ID NO: 3706059 - RNA, 22 nt, Human
guuuuaucaugacauguuauau

SEQ ID NO: 3706060 - RNA, 17 nt, Human
guuuuaucucugucuac

SEQ ID NO: 3706061 - RNA, 18 nt, Human
guuuuaugacuucauuaa

SEQ ID NO: 3706062 - RNA, 14 nt, Human
guuuuauuuauauu

SEQ ID NO: 3706063 - RNA, 12 nt, Human
guuuuauuucau

SEQ ID NO: 3706064 - RNA, 20 nt, Human
guuuuauuuucuaaaguacu

SEQ ID NO: 3706065 - RNA, 20 nt, Human
guuuucaaaauuguuacaaa

SEQ ID NO: 3706066 - RNA, 17 nt, Human
guuuucaaauuggacuu

SEQ ID NO: 3706067 - RNA, 15 nt, Human
guuuucaagucaaau

SEQ ID NO: 3706068 - RNA, 17 nt, Human
guuuucaagucaaauua

SEQ ID NO: 3706069 - RNA, 18 nt, Human
guuuucaagucaaauuaa

SEQ ID NO: 3706070 - RNA, 21 nt, Human
guuuucagaaccucuucccca

SEQ ID NO: 3706071 - RNA, 17 nt, Human
guuuucagacucagacu

SEQ ID NO: 3706072 - RNA, 19 nt, Human
guuuucagcauugauauuu

SEQ ID NO: 3706073 - RNA, 18 nt, Human
guuuucaggcuagaugua

SEQ ID NO: 3706074 - RNA, 17 nt, Human
guuuucaguguacaugg

SEQ ID NO: 3706075 - RNA, 22 nt, Human
guuuucauaauaaaacuuuaaa

SEQ ID NO: 3706076 - RNA, 17 nt, Human
guuuucauuugguucau

SEQ ID NO: 3706077 - RNA, 11 nt, Human
guuuuccaaac

SEQ ID NO: 3706078 - RNA, 23 nt, Human
guuuuccacccauaauccuuucu

SEQ ID NO: 3706079 - RNA, 20 nt, Human
guuuuccagguuuaagcugu

SEQ ID NO: 3706080 - RNA, 13 nt, Human
guuuuccaugaaa

SEQ ID NO: 3706081 - RNA, 20 nt, Human
guuuuccaugaguccccugu

SEQ ID NO: 3706082 - RNA, 15 nt, Human
guuuuccccaugaca

SEQ ID NO: 3706083 - RNA, 22 nt, Human
guuuucccgagcaaagucuaaa

SEQ ID NO: 3706084 - RNA, 15 nt, Human
guuuucccugaaguu

SEQ ID NO: 3706085 - RNA, 16 nt, Human
guuuucccugaaguua

SEQ ID NO: 3706086 - RNA, 21 nt, Human
guuuucccugaccucccucua

SEQ ID NO: 3706087 - RNA, 21 nt, Human
guuuuccuaugcuuugaaaca

SEQ ID NO: 3706088 - RNA, 13 nt, Human
guuuuccucccuu

SEQ ID NO: 3706089 - RNA, 18 nt, Human
guuuuccucccuucugcu

SEQ ID NO: 3706090 - RNA, 20 nt, Human
guuuuccucuauacaucucu

SEQ ID NO: 3706091 - RNA, 16 nt, Human
guuuuccuuucucacc

SEQ ID NO: 3706092 - RNA, 20 nt, Human
guuuuccuuuuauuucuuca

SEQ ID NO: 3706093 - RNA, 16 nt, Human
guuuucgaaaaucaaa

SEQ ID NO: 3706094 - RNA, 18 nt, Human
guuuucgaagcucagccc

SEQ ID NO: 3706095 - RNA, 22 nt, Human
guuuucggugccaucagugccc

SEQ ID NO: 3706096 - RNA, 18 nt, Human
guuuucuccaagagcuac

SEQ ID NO: 3706097 - RNA, 13 nt, Human
guuuucucucuau

SEQ ID NO: 3706098 - RNA, 17 nt, Human
guuuucucuuugugggg

SEQ ID NO: 3706099 - RNA, 15 nt, Human
guuuucugagaaaga

SEQ ID NO: 3706100 - RNA, 22 nt, Human
guuuucugagaaagacuauuca

SEQ ID NO: 3706101 - RNA, 23 nt, Human
guuuucugagaaagacuauucaa

SEQ ID NO: 3706102 - RNA, 15 nt, Human
guuuucugagcccgg

SEQ ID NO: 3706103 - RNA, 17 nt, Human
guuuucuggcuggagcc

SEQ ID NO: 3706104 - RNA, 18 nt, Human
guuuucuggcuggagccu

SEQ ID NO: 3706105 - RNA, 17 nt, Human
guuuucuggguguccaa

SEQ ID NO: 3706106 - RNA, 18 nt, Human
guuuucuguagucauuua

SEQ ID NO: 3706107 - RNA, 12 nt, Human
guuuucuguucu

SEQ ID NO: 3706108 - RNA, 12 nt, Human
guuuucuuccuu

SEQ ID NO: 3706109 - RNA, 19 nt, Human
guuuucuuccuuguaaauu

SEQ ID NO: 3706110 - RNA, 21 nt, Human
guuuucuugauaauuuuccuu

SEQ ID NO: 3706111 - RNA, 18 nt, Human
guuuucuuguugcuuugu

SEQ ID NO: 3706112 - RNA, 20 nt, Human
guuuucuuguugcuuuguug

SEQ ID NO: 3706113 - RNA, 22 nt, Human
guuuucuuguugcuuuguugca

SEQ ID NO: 3706114 - RNA, 15 nt, Human
guuuucuuuccuccu

SEQ ID NO: 3706115 - RNA, 16 nt, Human
guuuucuuuccuccuu

SEQ ID NO: 3706116 - RNA, 14 nt, Human
guuuucuuuuaaga

SEQ ID NO: 3706117 - RNA, 16 nt, Human
guuuucuuuuaauuuu

SEQ ID NO: 3706118 - RNA, 17 nt, Human
guuuucuuuugccauga

SEQ ID NO: 3706119 - RNA, 14 nt, Human
guuuugaaaagcua

SEQ ID NO: 3706120 - RNA, 13 nt, Human
guuuugaaaugcu

SEQ ID NO: 3706121 - RNA, 17 nt, Human
guuuugaacuaauaaaa

SEQ ID NO: 3706122 - RNA, 23 nt, Human
guuuugaacuaauaaaagcauaa

SEQ ID NO: 3706123 - RNA, 18 nt, Human
guuuugaagcuacugugu

SEQ ID NO: 3706124 - RNA, 19 nt, Human
guuuugaagcuacugugug

SEQ ID NO: 3706125 - RNA, 15 nt, Human
guuuugaaggcaaaa

SEQ ID NO: 3706126 - RNA, 21 nt, Human
guuuugaaggcaaaauugcaa

SEQ ID NO: 3706127 - RNA, 14 nt, Human
guuuugacauuuuu

SEQ ID NO: 3706128 - RNA, 16 nt, Human
guuuugagaguaaugc

SEQ ID NO: 3706129 - RNA, 21 nt, Human
guuuugagcuacuggauucuu

SEQ ID NO: 3706130 - RNA, 12 nt, Human
guuuugagcuuu

SEQ ID NO: 3706131 - RNA, 23 nt, Human
guuuugagguuuccuucagacag

SEQ ID NO: 3706132 - RNA, 21 nt, Human
guuuugauguuuguggccuca

SEQ ID NO: 3706133 - RNA, 15 nt, Human
guuuugcacagccaa

SEQ ID NO: 3706134 - RNA, 22 nt, Human
guuuugcacagccaaauuuaaa

SEQ ID NO: 3706135 - RNA, 14 nt, Human
guuuugccaacauu

SEQ ID NO: 3706136 - RNA, 16 nt, Human
guuuugccaacauugc

SEQ ID NO: 3706137 - RNA, 19 nt, Human
guuuugcuauuagacugua

SEQ ID NO: 3706138 - RNA, 16 nt, Human
guuuugcuguuuccuu

SEQ ID NO: 3706139 - RNA, 18 nt, Human
guuuugcuuuuucugacu

SEQ ID NO: 3706140 - RNA, 17 nt, Human
guuuuggacaguuuacc

SEQ ID NO: 3706141 - RNA, 18 nt, Human
guuuuggaucuugaaugu

SEQ ID NO: 3706142 - RNA, 17 nt, Human
guuuugguagauuaaau

SEQ ID NO: 3706143 - RNA, 21 nt, Human
guuuugguaucuguucuuuaa

SEQ ID NO: 3706144 - RNA, 15 nt, Human
uggcuccaggccaaa

SEQ ID NO: 3706145 - RNA, 23 nt, Human
uggcuccagucugcugcccucca

SEQ ID NO: 3706146 - RNA, 17 nt, Human
uggcucccacaggcagc

SEQ ID NO: 3706147 - RNA, 14 nt, Human
uggcucccaggaca

SEQ ID NO: 3706148 - RNA, 17 nt, Human
uggcucccagggccaug

SEQ ID NO: 3706149 - RNA, 17 nt, Human
uggcucccccuccaccu

SEQ ID NO: 3706150 - RNA, 12 nt, Human
uggcuccccugc

SEQ ID NO: 3706151 - RNA, 14 nt, Human
uggcuccccugcag

SEQ ID NO: 3706152 - RNA, 15 nt, Human
uggcuccccugcagc

SEQ ID NO: 3706153 - RNA, 17 nt, Human
uggcuccccugcagccc

SEQ ID NO: 3706154 - RNA, 18 nt, Human
uggcuccccugcagcccu

SEQ ID NO: 3706155 - RNA, 19 nt, Human
uggcuccccugcagcccug

SEQ ID NO: 3706156 - RNA, 22 nt, Human
uggcuccccugcagcccuggcc

SEQ ID NO: 3706157 - RNA, 14 nt, Human
uggcuccccugggg

SEQ ID NO: 3706158 - RNA, 20 nt, Human
uggcucccggagggcccuga

SEQ ID NO: 3706159 - RNA, 16 nt, Human
uggcucccucacucuc

SEQ ID NO: 3706160 - RNA, 17 nt, Human
uggcucccucacucuca

SEQ ID NO: 3706161 - RNA, 19 nt, Human
uggcucccucacucucagg

SEQ ID NO: 3706162 - RNA, 17 nt, Human
uggcucccuccuccagg

SEQ ID NO: 3706163 - RNA, 16 nt, Human
uggcucccuuacuuua

SEQ ID NO: 3706164 - RNA, 19 nt, Human
uggcuccucccggugccca

SEQ ID NO: 3706165 - RNA, 12 nt, Human
uggcuccucuca

SEQ ID NO: 3706166 - RNA, 20 nt, Human
uggcuccugaggggcaucug

SEQ ID NO: 3706167 - RNA, 12 nt, Human
uggcuccugauc

SEQ ID NO: 3706168 - RNA, 13 nt, Human
uggcuccugccca

SEQ ID NO: 3706169 - RNA, 17 nt, Human
uggcuccuucccaucgc

SEQ ID NO: 3706170 - RNA, 19 nt, Human
uggcuccuucccaucgcug

SEQ ID NO: 3706171 - RNA, 14 nt, Human
uggcuccuuuacaa

SEQ ID NO: 3706172 - RNA, 16 nt, Human
uggcuccuuuacaaaa

SEQ ID NO: 3706173 - RNA, 18 nt, Human
uggcucgaaucucugugc

SEQ ID NO: 3706174 - RNA, 12 nt, Human
uggcucuacaca

SEQ ID NO: 3706175 - RNA, 14 nt, Human
uggcucuacuuccc

SEQ ID NO: 3706176 - RNA, 15 nt, Human
uggcucucaccucua

SEQ ID NO: 3706177 - RNA, 17 nt, Human
uggcucuccuggcccug

SEQ ID NO: 3706178 - RNA, 12 nt, Human
uggcucugccag

SEQ ID NO: 3706179 - RNA, 13 nt, Human
uggcucuggagac

SEQ ID NO: 3706180 - RNA, 14 nt, Human
uggcucuggagaca

SEQ ID NO: 3706181 - RNA, 18 nt, Human
uggcucugggauccuggg

SEQ ID NO: 3706182 - RNA, 13 nt, Human
uggcucuuccagg

SEQ ID NO: 3706183 - RNA, 16 nt, Human
uggcucuuccaggcug

SEQ ID NO: 3706184 - RNA, 21 nt, Human
uggcucuuccaggcugggaga

SEQ ID NO: 3706185 - RNA, 19 nt, Human
uggcucuuuggagaucaag

SEQ ID NO: 3706186 - RNA, 22 nt, Human
uggcucuuuuacccaauaagau

SEQ ID NO: 3706187 - RNA, 16 nt, Human
uggcugaaaggaagcu

SEQ ID NO: 3706188 - RNA, 21 nt, Human
uggcugaaauucuccuggagg

SEQ ID NO: 3706189 - RNA, 23 nt, Human
uggcugaacccugugcugguguc

SEQ ID NO: 3706190 - RNA, 20 nt, Human
uggcugaagacuuuuguuau

SEQ ID NO: 3706191 - RNA, 14 nt, Human
uggcugaaggacug

SEQ ID NO: 3706192 - RNA, 18 nt, Human
uggcugacaugaagcugu

SEQ ID NO: 3706193 - RNA, 20 nt, Human
uggcugaccccaaagagccu

SEQ ID NO: 3706194 - RNA, 16 nt, Human
uggcugagccuggcug

SEQ ID NO: 3706195 - RNA, 19 nt, Human
uggcugagccuggcuggca

SEQ ID NO: 3706196 - RNA, 17 nt, Human
uggcugaggccacccag

SEQ ID NO: 3706197 - RNA, 14 nt, Human
uggcugagggcagc

SEQ ID NO: 3706198 - RNA, 14 nt, Human
uggcugagggcagu

SEQ ID NO: 3706199 - RNA, 13 nt, Human
uggcugauaaaag

SEQ ID NO: 3706200 - RNA, 18 nt, Human
uggcugcagagcaguggg

SEQ ID NO: 3706201 - RNA, 12 nt, Human
uggcugcagcag

SEQ ID NO: 3706202 - RNA, 23 nt, Human
uggcugcagcagcgguggccucu

SEQ ID NO: 3706203 - RNA, 12 nt, Human
uggcugcagccu

SEQ ID NO: 3706204 - RNA, 23 nt, Human
uggcugcagccucaggacuggga

SEQ ID NO: 3706205 - RNA, 15 nt, Human
uggcugcagggaguc

SEQ ID NO: 3706206 - RNA, 13 nt, Human
uggcugcccacac

SEQ ID NO: 3706207 - RNA, 17 nt, Human
uggcugccccaaccugc

SEQ ID NO: 3706208 - RNA, 22 nt, Human
uggcugccccauuuauccaccu

SEQ ID NO: 3706209 - RNA, 15 nt, Human
uggcugcccuggccc

SEQ ID NO: 3706210 - RNA, 17 nt, Human
uggcugcccuggcccug

SEQ ID NO: 3706211 - RNA, 17 nt, Human
uggcugccucauuuaga

SEQ ID NO: 3706212 - RNA, 20 nt, Human
uggcugccuccacucccacu

SEQ ID NO: 3706213 - RNA, 15 nt, Human
uggcugccuggagcc

SEQ ID NO: 3706214 - RNA, 16 nt, Human
uggcugccuggagccc

SEQ ID NO: 3706215 - RNA, 22 nt, Human
uggcugccuugugaaggaauua

SEQ ID NO: 3706216 - RNA, 15 nt, Human
uggcugcuagcacuu

SEQ ID NO: 3706217 - RNA, 15 nt, Human
uggcugcugaagcug

SEQ ID NO: 3706218 - RNA, 14 nt, Human
uggcugcuguggga

SEQ ID NO: 3706219 - RNA, 15 nt, Human
uggcugcuucaagga

SEQ ID NO: 3706220 - RNA, 15 nt, Human
uggcugcuuggccuu

SEQ ID NO: 3706221 - RNA, 20 nt, Human
uggcuggaagauccugcggg

SEQ ID NO: 3706222 - RNA, 18 nt, Human
uggcuggaagggguccag

SEQ ID NO: 3706223 - RNA, 14 nt, Human
uggcuggacaaacu

SEQ ID NO: 3706224 - RNA, 13 nt, Human
uggcuggacccag

SEQ ID NO: 3706225 - RNA, 15 nt, Human
uggcuggacccagcc

SEQ ID NO: 3706226 - RNA, 21 nt, Human
uggcuggacccagccaggccc

SEQ ID NO: 3706227 - RNA, 22 nt, Human
uggcuggacccagccaggccca

SEQ ID NO: 3706228 - RNA, 23 nt, Human
uggcuggacccagccaggcccag

SEQ ID NO: 3706229 - RNA, 19 nt, Human
uggcuggaugaaauuuucu

SEQ ID NO: 3706230 - RNA, 22 nt, Human
uggcuggaugaaauuuucuaga

SEQ ID NO: 3706231 - RNA, 15 nt, Human
uggcuggccacugca

SEQ ID NO: 3706232 - RNA, 15 nt, Human
uggcuggccucaccc

SEQ ID NO: 3706233 - RNA, 21 nt, Human
uggcuggccuuccacuuggcu

SEQ ID NO: 3706234 - RNA, 12 nt, Human
uggcuggcugag

SEQ ID NO: 3706235 - RNA, 15 nt, Human
uggcuggcugagggc

SEQ ID NO: 3706236 - RNA, 13 nt, Human
uggcuggcugcag

SEQ ID NO: 3706237 - RNA, 17 nt, Human
uggcugggaacugcaga

SEQ ID NO: 3706238 - RNA, 23 nt, Human
uggcugggacguggcucagccag

SEQ ID NO: 3706239 - RNA, 18 nt, Human
uggcugggacugggaaca

SEQ ID NO: 3706240 - RNA, 17 nt, Human
uggcugggggcaggagg

SEQ ID NO: 3706241 - RNA, 17 nt, Human
uggcugggggccucagu

SEQ ID NO: 3706242 - RNA, 16 nt, Human
uggcugggguggccug

SEQ ID NO: 3706243 - RNA, 22 nt, Human
uggcugggguggccuguguggc

SEQ ID NO: 3706244 - RNA, 22 nt, Human
uggcuggucaacuugagcaugu

SEQ ID NO: 3706245 - RNA, 11 nt, Human
uggcuggugug

SEQ ID NO: 3706246 - RNA, 13 nt, Human
uggcugguguggu

SEQ ID NO: 3706247 - RNA, 20 nt, Human
uggcuggugugguacagaga

SEQ ID NO: 3706248 - RNA, 12 nt, Human
uggcugguguua

SEQ ID NO: 3706249 - RNA, 16 nt, Human
uggcugguguuaacag

SEQ ID NO: 3706250 - RNA, 18 nt, Human
uggcugguguuaacagaa

SEQ ID NO: 3706251 - RNA, 20 nt, Human
uggcugguguuaacagaagg

SEQ ID NO: 3706252 - RNA, 19 nt, Human
uggcuguaaggcucuagau

SEQ ID NO: 3706253 - RNA, 22 nt, Human
uggcuguaaucauuuguuuaca

SEQ ID NO: 3706254 - RNA, 18 nt, Human
uggcuguagaucccaaga

SEQ ID NO: 3706255 - RNA, 17 nt, Human
uggcugucagcaggaag

SEQ ID NO: 3706256 - RNA, 18 nt, Human
uggcuguccagugcccau

SEQ ID NO: 3706257 - RNA, 18 nt, Human
uggcugucuggaaagccc

SEQ ID NO: 3706258 - RNA, 14 nt, Human
uggcugugccucug

SEQ ID NO: 3706259 - RNA, 15 nt, Human
uggcugugccucugc

SEQ ID NO: 3706260 - RNA, 18 nt, Human
uggcugugccucugccug

SEQ ID NO: 3706261 - RNA, 22 nt, Human
uggcuguggagacaaugucugc

SEQ ID NO: 3706262 - RNA, 16 nt, Human
uggcuguggagugugg

SEQ ID NO: 3706263 - RNA, 17 nt, Human
uggcuguggcauccaga

SEQ ID NO: 3706264 - RNA, 15 nt, Human
uggcugugggcuccc

SEQ ID NO: 3706265 - RNA, 15 nt, Human
uggcugugucuaaac

SEQ ID NO: 3706266 - RNA, 17 nt, Human
uggcugugucuaaacug

SEQ ID NO: 3706267 - RNA, 20 nt, Human
uggcugugucuaaacugcau

SEQ ID NO: 3706268 - RNA, 21 nt, Human
uggcuguguuugcagccugcu

SEQ ID NO: 3706269 - RNA, 21 nt, Human
uggcuguuaaucuuucaaagu

SEQ ID NO: 3706270 - RNA, 14 nt, Human
uggcuguucuggaa

SEQ ID NO: 3706271 - RNA, 20 nt, Human
uggcuguugacgcaccugug

SEQ ID NO: 3706272 - RNA, 16 nt, Human
uggcuguuggcugggg

SEQ ID NO: 3706273 - RNA, 23 nt, Human
uggcuguuggcugggggccucag

SEQ ID NO: 3706274 - RNA, 16 nt, Human
uggcuguuuggacuuu

SEQ ID NO: 3706275 - RNA, 17 nt, Human
uggcuuaaaacaacacu

SEQ ID NO: 3706276 - RNA, 13 nt, Human
uggcuuaaauaua

SEQ ID NO: 3706277 - RNA, 15 nt, Human
uggcuuaaugcuucu

SEQ ID NO: 3706278 - RNA, 14 nt, Human
uggcuuaauguuua

SEQ ID NO: 3706279 - RNA, 13 nt, Human
uggcuuacacugg

SEQ ID NO: 3706280 - RNA, 19 nt, Human
uggcuuaccugaccucuug

SEQ ID NO: 3706281 - RNA, 14 nt, Human
uggcuuaccuggcc

SEQ ID NO: 3706282 - RNA, 18 nt, Human
uggcuuauaauucuuuca

SEQ ID NO: 3706283 - RNA, 19 nt, Human
uggcuuauuuaauaugcuu

SEQ ID NO: 3706284 - RNA, 18 nt, Human
uggcuuauuuuaauguga

SEQ ID NO: 3706285 - RNA, 21 nt, Human
uggcuuauuuuaaugugauga

SEQ ID NO: 3706286 - RNA, 14 nt, Human
uggcuucacggaag

SEQ ID NO: 3706287 - RNA, 13 nt, Human
uggcuucagcucc

SEQ ID NO: 3706288 - RNA, 17 nt, Human
uggcuucagcuccagcc

SEQ ID NO: 3706289 - RNA, 20 nt, Human
uggcuucagcuccagccccu

SEQ ID NO: 3706290 - RNA, 22 nt, Human
uggcuuccagguaucuccagga

SEQ ID NO: 3706291 - RNA, 23 nt, Human
uggcuuccagguaucuccaggau

SEQ ID NO: 3706292 - RNA, 23 nt, Human
uggcuucccaaaugugugcccag

SEQ ID NO: 3706293 - RNA, 18 nt, Human
uggcuucccauccccagc

SEQ ID NO: 3706294 - RNA, 18 nt, Human
uggcuucccgcucagccc

SEQ ID NO: 3706295 - RNA, 16 nt, Human
ugucuucaaacuguga

SEQ ID NO: 3706296 - RNA, 20 nt, Human
ugucuucaauuuguauaaaa

SEQ ID NO: 3706297 - RNA, 14 nt, Human
ugucuucacaacag

SEQ ID NO: 3706298 - RNA, 17 nt, Human
ugucuucauaaaguacu

SEQ ID NO: 3706299 - RNA, 19 nt, Human
ugucuucauccuuagcaac

SEQ ID NO: 3706300 - RNA, 16 nt, Human
ugucuucauuucauug

SEQ ID NO: 3706301 - RNA, 19 nt, Human
ugucuucauuucauuguau

SEQ ID NO: 3706302 - RNA, 23 nt, Human
ugucuucauuucauuguaugaug

SEQ ID NO: 3706303 - RNA, 22 nt, Human
ugucuuccuaucaaaaagauau

SEQ ID NO: 3706304 - RNA, 17 nt, Human
ugucuuccuauuucaga

SEQ ID NO: 3706305 - RNA, 20 nt, Human
ugucuuccuauuucagaagu

SEQ ID NO: 3706306 - RNA, 17 nt, Human
ugucuuccugcauucac

SEQ ID NO: 3706307 - RNA, 16 nt, Human
ugucuucggaaaccuu

SEQ ID NO: 3706308 - RNA, 21 nt, Human
ugucuucggaaaccuuggugu

SEQ ID NO: 3706309 - RNA, 16 nt, Human
ugucuucguacaguuc

SEQ ID NO: 3706310 - RNA, 17 nt, Human
ugucuucguacaguucu

SEQ ID NO: 3706311 - RNA, 18 nt, Human
ugucuucguacaguucuu

SEQ ID NO: 3706312 - RNA, 16 nt, Human
ugucuucucaggcucu

SEQ ID NO: 3706313 - RNA, 23 nt, Human
ugucuucucaggcucugcccugc

SEQ ID NO: 3706314 - RNA, 14 nt, Human
ugucuucuccccag

SEQ ID NO: 3706315 - RNA, 12 nt, Human
ugucuucugccu

SEQ ID NO: 3706316 - RNA, 14 nt, Human
ugucuucugccugu

SEQ ID NO: 3706317 - RNA, 18 nt, Human
ugucuucugccuguuaua

SEQ ID NO: 3706318 - RNA, 22 nt, Human
ugucuucuguauauaaauggga

SEQ ID NO: 3706319 - RNA, 17 nt, Human
ugucuugaaugucuuuu

SEQ ID NO: 3706320 - RNA, 20 nt, Human
ugucuugaaugucuuuugaa

SEQ ID NO: 3706321 - RNA, 14 nt, Human
ugucuugagcucua

SEQ ID NO: 3706322 - RNA, 21 nt, Human
ugucuugccuuuuucauuauu

SEQ ID NO: 3706323 - RNA, 23 nt, Human
ugucuugcuauggggagaaaaga

SEQ ID NO: 3706324 - RNA, 14 nt, Human
ugucuugcugucau

SEQ ID NO: 3706325 - RNA, 19 nt, Human
ugucuugcuguugacauau

SEQ ID NO: 3706326 - RNA, 19 nt, Human
ugucuuggacacuguacaa

SEQ ID NO: 3706327 - RNA, 13 nt, Human
ugucuugggcaga

SEQ ID NO: 3706328 - RNA, 16 nt, Human
ugucuugggcagagcu

SEQ ID NO: 3706329 - RNA, 22 nt, Human
ugucuugggcagagcuggcucu

SEQ ID NO: 3706330 - RNA, 19 nt, Human
ugucuuguaauauuuugua

SEQ ID NO: 3706331 - RNA, 16 nt, Human
ugucuuguacaugugu

SEQ ID NO: 3706332 - RNA, 22 nt, Human
ugucuuguacauguguagccug

SEQ ID NO: 3706333 - RNA, 18 nt, Human
ugucuuguguuucuuuag

SEQ ID NO: 3706334 - RNA, 21 nt, Human
ugucuuguguuuuugucuuau

SEQ ID NO: 3706335 - RNA, 17 nt, Human
ugucuuguuaauauucu

SEQ ID NO: 3706336 - RNA, 18 nt, Human
ugucuuguucugucacuc

SEQ ID NO: 3706337 - RNA, 19 nt, Human
ugucuuguucugucacuca

SEQ ID NO: 3706338 - RNA, 15 nt, Human
ugucuuuaaaagaga

SEQ ID NO: 3706339 - RNA, 14 nt, Human
ugucuuuaaauaga

SEQ ID NO: 3706340 - RNA, 19 nt, Human
ugucuuuaaauagauacaa

SEQ ID NO: 3706341 - RNA, 17 nt, Human
ugucuuuaaaugcugcu

SEQ ID NO: 3706342 - RNA, 15 nt, Human
ugucuuuaaugcaau

SEQ ID NO: 3706343 - RNA, 12 nt, Human
ugucuuuacucc

SEQ ID NO: 3706344 - RNA, 15 nt, Human
ugucuuuagauagcc

SEQ ID NO: 3706345 - RNA, 19 nt, Human
ugucuuuaggcagcagcuu

SEQ ID NO: 3706346 - RNA, 20 nt, Human
ugucuuucaaacuccaaggu

SEQ ID NO: 3706347 - RNA, 15 nt, Human
ugucuuucagauaca

SEQ ID NO: 3706348 - RNA, 21 nt, Human
ugucuuuccacuccuccuagc

SEQ ID NO: 3706349 - RNA, 15 nt, Human
ugucuuucuaagaaa

SEQ ID NO: 3706350 - RNA, 17 nt, Human
ugucuuucuccaaaguu

SEQ ID NO: 3706351 - RNA, 15 nt, Human
ugucuuucugagcac

SEQ ID NO: 3706352 - RNA, 13 nt, Human
ugucuuucuuugg

SEQ ID NO: 3706353 - RNA, 22 nt, Human
ugucuuucuuuggugccuuucc

SEQ ID NO: 3706354 - RNA, 14 nt, Human
ugucuuuggacccu

SEQ ID NO: 3706355 - RNA, 18 nt, Human
ugucuuuggacccugagg

SEQ ID NO: 3706356 - RNA, 10 nt, Human
ugucuuuggu

SEQ ID NO: 3706357 - RNA, 15 nt, Human
ugucuuugguccucu

SEQ ID NO: 3706358 - RNA, 11 nt, Human
ugucuuuguaa

SEQ ID NO: 3706359 - RNA, 13 nt, Human
ugucuuuguaagu

SEQ ID NO: 3706360 - RNA, 19 nt, Human
ugucuuuguuggaaaagaa

SEQ ID NO: 3706361 - RNA, 16 nt, Human
ugucuuuuaaaaugca

SEQ ID NO: 3706362 - RNA, 20 nt, Human
ugucuuuuaaaaugcaaugu

SEQ ID NO: 3706363 - RNA, 14 nt, Human
ugucuuuuaaacuc

SEQ ID NO: 3706364 - RNA, 18 nt, Human
ugucuuuuaaugcuucau

SEQ ID NO: 3706365 - RNA, 20 nt, Human
ugucuuuuauaguggaaaaa

SEQ ID NO: 3706366 - RNA, 18 nt, Human
ugucuuuuauauuuguau

SEQ ID NO: 3706367 - RNA, 19 nt, Human
ugucuuuucccauuuaucu

SEQ ID NO: 3706368 - RNA, 20 nt, Human
ugucuuuucuuugccaucuc

SEQ ID NO: 3706369 - RNA, 13 nt, Human
ugucuuuugaaua

SEQ ID NO: 3706370 - RNA, 14 nt, Human
ugucuuuugaauau

SEQ ID NO: 3706371 - RNA, 13 nt, Human
ugucuuuugucau

SEQ ID NO: 3706372 - RNA, 16 nt, Human
ugucuuuuuucacuac

SEQ ID NO: 3706373 - RNA, 20 nt, Human
ugugaaaaaaaaaaugcuga

SEQ ID NO: 3706374 - RNA, 12 nt, Human
ugugaaaaaauu

SEQ ID NO: 3706375 - RNA, 23 nt, Human
ugugaaaaaauuuacuuuaaacu

SEQ ID NO: 3706376 - RNA, 22 nt, Human
ugugaaaaagaugccaauuauu

SEQ ID NO: 3706377 - RNA, 18 nt, Human
ugugaaaauaucugcuca

SEQ ID NO: 3706378 - RNA, 16 nt, Human
ugugaaaaugugugug

SEQ ID NO: 3706379 - RNA, 20 nt, Human
ugugaaaccuuuuuuaagau

SEQ ID NO: 3706380 - RNA, 22 nt, Human
ugugaaaccuuuuuuaagauuu

SEQ ID NO: 3706381 - RNA, 14 nt, Human
ugugaaacuuucau

SEQ ID NO: 3706382 - RNA, 15 nt, Human
ugugaaaggaaagag

SEQ ID NO: 3706383 - RNA, 21 nt, Human
ugugaaagucagaugcccaga

SEQ ID NO: 3706384 - RNA, 20 nt, Human
ugugaaauaaaacuggcuuu

SEQ ID NO: 3706385 - RNA, 18 nt, Human
ugugaaauugcauacuuu

SEQ ID NO: 3706386 - RNA, 12 nt, Human
ugugaacauuua

SEQ ID NO: 3706387 - RNA, 16 nt, Human
ugugaaccaagaucua

SEQ ID NO: 3706388 - RNA, 20 nt, Human
ugugaaccaccacacccagc

SEQ ID NO: 3706389 - RNA, 16 nt, Human
ugugaacccaggacaa

SEQ ID NO: 3706390 - RNA, 21 nt, Human
ugugaacccaggacaagcaug

SEQ ID NO: 3706391 - RNA, 23 nt, Human
ugugaacccuggggccugacugc

SEQ ID NO: 3706392 - RNA, 21 nt, Human
ugugaacgauuuagaaagaag

SEQ ID NO: 3706393 - RNA, 14 nt, Human
ugugaacuaaacuu

SEQ ID NO: 3706394 - RNA, 19 nt, Human
ugugaacuaaacuuucaca

SEQ ID NO: 3706395 - RNA, 19 nt, Human
ugugaacucagccaagcac

SEQ ID NO: 3706396 - RNA, 18 nt, Human
ugugaacugaaauuaaaa

SEQ ID NO: 3706397 - RNA, 14 nt, Human
ugugaacugaacuc

SEQ ID NO: 3706398 - RNA, 18 nt, Human
ugugaacuuggaagcaca

SEQ ID NO: 3706399 - RNA, 12 nt, Human
ugugaacuugua

SEQ ID NO: 3706400 - RNA, 16 nt, Human
ugugaagaaaaaugua

SEQ ID NO: 3706401 - RNA, 14 nt, Human
ugugaagauguuug

SEQ ID NO: 3706402 - RNA, 14 nt, Human
ugugaagcaaaauu

SEQ ID NO: 3706403 - RNA, 22 nt, Human
ugugaagcacagaccccuucca

SEQ ID NO: 3706404 - RNA, 14 nt, Human
ugugaaggacccuu

SEQ ID NO: 3706405 - RNA, 19 nt, Human
ugugaaggcagagaaaggg

SEQ ID NO: 3706406 - RNA, 14 nt, Human
ugugaaggccauga

SEQ ID NO: 3706407 - RNA, 15 nt, Human
ugugaaguuagaauu

SEQ ID NO: 3706408 - RNA, 20 nt, Human
ugugaaguuagaauuccuuc

SEQ ID NO: 3706409 - RNA, 14 nt, Human
ugugaauaauuaca

SEQ ID NO: 3706410 - RNA, 14 nt, Human
ugugaauacugcuu

SEQ ID NO: 3706411 - RNA, 15 nt, Human
ugugaauauaaaugu

SEQ ID NO: 3706412 - RNA, 17 nt, Human
ugugaaucaagggucag

SEQ ID NO: 3706413 - RNA, 16 nt, Human
ugugaaucauuuuacc

SEQ ID NO: 3706414 - RNA, 17 nt, Human
ugugaaugaacacucuu

SEQ ID NO: 3706415 - RNA, 23 nt, Human
ugugaaugaacacucuuuugcuu

SEQ ID NO: 3706416 - RNA, 19 nt, Human
ugugaaugauucauguuau

SEQ ID NO: 3706417 - RNA, 20 nt, Human
ugugaaugauucauguuaua

SEQ ID NO: 3706418 - RNA, 14 nt, Human
ugugaaugcuucuc

SEQ ID NO: 3706419 - RNA, 13 nt, Human
ugugaauggauug

SEQ ID NO: 3706420 - RNA, 12 nt, Human
ugugaauguggg

SEQ ID NO: 3706421 - RNA, 16 nt, Human
ugugaauuaagcccaa

SEQ ID NO: 3706422 - RNA, 17 nt, Human
ugugaauuacuaacuuc

SEQ ID NO: 3706423 - RNA, 19 nt, Human
ugugaauuacuaacuucua

SEQ ID NO: 3706424 - RNA, 20 nt, Human
ugugaauuacuaacuucuaa

SEQ ID NO: 3706425 - RNA, 20 nt, Human
ugugaauuagcucacuuggu

SEQ ID NO: 3706426 - RNA, 24 nt, Human
ugugaauuaggcuguaacuacuuu

SEQ ID NO: 3706427 - RNA, 18 nt, Human
ugugaauugagcugcaga

SEQ ID NO: 3706428 - RNA, 15 nt, Human
ugugaauuuuuaagc

SEQ ID NO: 3706429 - RNA, 16 nt, Human
ugugaauuuuuaagcu

SEQ ID NO: 3706430 - RNA, 20 nt, Human
ugugaauuuuuauuguugua

SEQ ID NO: 3706431 - RNA, 19 nt, Human
ugugacaauucuguuuuua

SEQ ID NO: 3706432 - RNA, 18 nt, Human
ugugacagauuauacaga

SEQ ID NO: 3706433 - RNA, 16 nt, Human
ugugacaggcagcaga

SEQ ID NO: 3706434 - RNA, 15 nt, Human
ugugacagggccagu

SEQ ID NO: 3706435 - RNA, 22 nt, Human
ugugacagggccaguggggccu

SEQ ID NO: 3706436 - RNA, 23 nt, Human
ugugacagggccaguggggccug

SEQ ID NO: 3706437 - RNA, 12 nt, Human
ugugacagggcg

SEQ ID NO: 3706438 - RNA, 18 nt, Human
ugugacauauuaugucuu

SEQ ID NO: 3706439 - RNA, 20 nt, Human
ugugacaucucuauucccca

SEQ ID NO: 3706440 - RNA, 12 nt, Human
ugugacauguaa

SEQ ID NO: 3706441 - RNA, 14 nt, Human
ugugacauguaaca

SEQ ID NO: 3706442 - RNA, 11 nt, Human
ugugacauucc

SEQ ID NO: 3706443 - RNA, 15 nt, Human
ugugacauuugucau

SEQ ID NO: 3706444 - RNA, 17 nt, Human
ugugacauuuuacauua

SEQ ID NO: 3706445 - RNA, 21 nt, Human
uggcuucccgcucagcccucc

SEQ ID NO: 3706446 - RNA, 16 nt, Human
uggcuuccuggcaaua

SEQ ID NO: 3706447 - RNA, 20 nt, Human
uggcuucggacaaaauaucu

SEQ ID NO: 3706448 - RNA, 13 nt, Human
uggcuucucauac

SEQ ID NO: 3706449 - RNA, 18 nt, Human
uggcuucucugaggaagc

SEQ ID NO: 3706450 - RNA, 17 nt, Human
uggcuucugaugaaucu

SEQ ID NO: 3706451 - RNA, 14 nt, Human
uggcuucuggagcc

SEQ ID NO: 3706452 - RNA, 13 nt, Human
uggcuucuggcca

SEQ ID NO: 3706453 - RNA, 17 nt, Human
uggcuucuggccaggaa

SEQ ID NO: 3706454 - RNA, 13 nt, Human
uggcuucugugau

SEQ ID NO: 3706455 - RNA, 14 nt, Human
uggcuucugugaug

SEQ ID NO: 3706456 - RNA, 17 nt, Human
uggcuucugugaugagc

SEQ ID NO: 3706457 - RNA, 21 nt, Human
uggcuucugugaugagcugau

SEQ ID NO: 3706458 - RNA, 14 nt, Human
uggcuucugugggg

SEQ ID NO: 3706459 - RNA, 15 nt, Human
uggcuucuguuucua

SEQ ID NO: 3706460 - RNA, 20 nt, Human
uggcuugccauuuuucaaaa

SEQ ID NO: 3706461 - RNA, 19 nt, Human
uggcuuggccacagccagg

SEQ ID NO: 3706462 - RNA, 22 nt, Human
uggcuuggccacagccagggga

SEQ ID NO: 3706463 - RNA, 23 nt, Human
uggcuuggccacagccaggggag

SEQ ID NO: 3706464 - RNA, 16 nt, Human
uggcuuggcccuggca

SEQ ID NO: 3706465 - RNA, 22 nt, Human
uggcuuggccuaucuccuaggg

SEQ ID NO: 3706466 - RNA, 17 nt, Human
uggcuugggcagggucu

SEQ ID NO: 3706467 - RNA, 22 nt, Human
uggcuuggggucaagaaacagc

SEQ ID NO: 3706468 - RNA, 12 nt, Human
uggcuuguagaa

SEQ ID NO: 3706469 - RNA, 18 nt, Human
uggcuuguagaauuguua

SEQ ID NO: 3706470 - RNA, 18 nt, Human
uggcuugugaucugggaa

SEQ ID NO: 3706471 - RNA, 19 nt, Human
uggcuuguguguuucacuu

SEQ ID NO: 3706472 - RNA, 20 nt, Human
uggcuuguguguuucacuuu

SEQ ID NO: 3706473 - RNA, 22 nt, Human
uggcuuguucaucauccagaug

SEQ ID NO: 3706474 - RNA, 14 nt, Human
uggcuuuaaugaau

SEQ ID NO: 3706475 - RNA, 16 nt, Human
uggcuuuaugcacauu

SEQ ID NO: 3706476 - RNA, 17 nt, Human
uggcuuuauuuguuuuu

SEQ ID NO: 3706477 - RNA, 16 nt, Human
uggcuuuccagucaua

SEQ ID NO: 3706478 - RNA, 21 nt, Human
uggcuuucccggacugcaagc

SEQ ID NO: 3706479 - RNA, 23 nt, Human
uggcuuucuccgacugcuaggga

SEQ ID NO: 3706480 - RNA, 14 nt, Human
uggcuuuggucucu

SEQ ID NO: 3706481 - RNA, 21 nt, Human
uggcuuuggucucuugcuugu

SEQ ID NO: 3706482 - RNA, 22 nt, Human
uggcuuugucccacagcuuggg

SEQ ID NO: 3706483 - RNA, 13 nt, Human
uggcuuuucugau

SEQ ID NO: 3706484 - RNA, 14 nt, Human
uggcuuuucugauc

SEQ ID NO: 3706485 - RNA, 16 nt, Human
ugggaaaacacugcca

SEQ ID NO: 3706486 - RNA, 17 nt, Human
ugggaaaccauguagca

SEQ ID NO: 3706487 - RNA, 23 nt, Human
ugggaaagacauccauaaagaag

SEQ ID NO: 3706488 - RNA, 14 nt, Human
ugggaaagcauugu

SEQ ID NO: 3706489 - RNA, 16 nt, Human
ugggaaagcauuguaa

SEQ ID NO: 3706490 - RNA, 16 nt, Human
ugggaaagccaccucu

SEQ ID NO: 3706491 - RNA, 22 nt, Human
ugggaaagccaccucucccuca

SEQ ID NO: 3706492 - RNA, 16 nt, Human
ugggaaaggggaaguu

SEQ ID NO: 3706493 - RNA, 20 nt, Human
ugggaaauauuuagcaaaua

SEQ ID NO: 3706494 - RNA, 15 nt, Human
ugggaaaugagcagg

SEQ ID NO: 3706495 - RNA, 17 nt, Human
ugggaacacuggcagac

SEQ ID NO: 3706496 - RNA, 14 nt, Human
ugggaacauuuauu

SEQ ID NO: 3706497 - RNA, 18 nt, Human
ugggaacauuuauuuuau

SEQ ID NO: 3706498 - RNA, 23 nt, Human
ugggaacauuuauuuuaugagaa

SEQ ID NO: 3706499 - RNA, 21 nt, Human
ugggaaccccccucccaccca

SEQ ID NO: 3706500 - RNA, 22 nt, Human
ugggaaccccuucauccucuga

SEQ ID NO: 3706501 - RNA, 22 nt, Human
ugggaaccucccagagguccag

SEQ ID NO: 3706502 - RNA, 18 nt, Human
ugggaacgugacugcccc

SEQ ID NO: 3706503 - RNA, 17 nt, Human
ugggaacucccaagaac

SEQ ID NO: 3706504 - RNA, 18 nt, Human
ugggaacugcagaccugu

SEQ ID NO: 3706505 - RNA, 22 nt, Human
ugggaacuuauuaaauggaaac

SEQ ID NO: 3706506 - RNA, 18 nt, Human
ugggaagacgccugagcu

SEQ ID NO: 3706507 - RNA, 20 nt, Human
ugggaagacuccuagcuguc

SEQ ID NO: 3706508 - RNA, 22 nt, Human
ugggaagauaggcucugcacag

SEQ ID NO: 3706509 - RNA, 19 nt, Human
ugggaagcccauccugacc

SEQ ID NO: 3706510 - RNA, 21 nt, Human
ugggaagccuuuacugacccu

SEQ ID NO: 3706511 - RNA, 13 nt, Human
ugggaaggacuug

SEQ ID NO: 3706512 - RNA, 22 nt, Human
ugggaaggacuuggcgcgcccu

SEQ ID NO: 3706513 - RNA, 16 nt, Human
ugggaaggccagcugc

SEQ ID NO: 3706514 - RNA, 17 nt, Human
ugggaaggcuugggauu

SEQ ID NO: 3706515 - RNA, 15 nt, Human
ugggaaguuaaaggg

SEQ ID NO: 3706516 - RNA, 15 nt, Human
ugggaauaauugcuu

SEQ ID NO: 3706517 - RNA, 16 nt, Human
ugggaauaauugcuuu

SEQ ID NO: 3706518 - RNA, 16 nt, Human
ugggaauauuugaauc

SEQ ID NO: 3706519 - RNA, 19 nt, Human
ugggaauauuugaaucuug

SEQ ID NO: 3706520 - RNA, 14 nt, Human
ugggaaucaagauu

SEQ ID NO: 3706521 - RNA, 20 nt, Human
ugggaaugaagcuuguguau

SEQ ID NO: 3706522 - RNA, 22 nt, Human
ugggaaugcggcaagaaggaau

SEQ ID NO: 3706523 - RNA, 19 nt, Human
ugggaauggaggggcagag

SEQ ID NO: 3706524 - RNA, 14 nt, Human
ugggaauguauagu

SEQ ID NO: 3706525 - RNA, 14 nt, Human
ugggaauuguguga

SEQ ID NO: 3706526 - RNA, 19 nt, Human
ugggacaaaucaagcuuca

SEQ ID NO: 3706527 - RNA, 20 nt, Human
ugggacacaaaacuccgccc

SEQ ID NO: 3706528 - RNA, 21 nt, Human
ugggacaccccgacuuuuguu

SEQ ID NO: 3706529 - RNA, 15 nt, Human
ugggacacccuguga

SEQ ID NO: 3706530 - RNA, 14 nt, Human
ugggacagcccaga

SEQ ID NO: 3706531 - RNA, 19 nt, Human
ugggacagggagcagcccc

SEQ ID NO: 3706532 - RNA, 20 nt, Human
ugggacagucaccucaugga

SEQ ID NO: 3706533 - RNA, 21 nt, Human
ugggacagucaccucauggaa

SEQ ID NO: 3706534 - RNA, 23 nt, Human
ugggacaguuuaucaugaagccu

SEQ ID NO: 3706535 - RNA, 19 nt, Human
ugggacauccugucaucug

SEQ ID NO: 3706536 - RNA, 17 nt, Human
ugggacauuccaaagaa

SEQ ID NO: 3706537 - RNA, 19 nt, Human
ugggaccacgugagaucau

SEQ ID NO: 3706538 - RNA, 13 nt, Human
ugggaccaggcac

SEQ ID NO: 3706539 - RNA, 17 nt, Human
ugggacccaguggcagg

SEQ ID NO: 3706540 - RNA, 22 nt, Human
ugggacccaguggcagggcaca

SEQ ID NO: 3706541 - RNA, 13 nt, Human
ugggaccccaggc

SEQ ID NO: 3706542 - RNA, 17 nt, Human
ugggacccccguggggc

SEQ ID NO: 3706543 - RNA, 19 nt, Human
ugggacccugcuuuagagc

SEQ ID NO: 3706544 - RNA, 14 nt, Human
ugggacccuuuccu

SEQ ID NO: 3706545 - RNA, 17 nt, Human
ugggacccuuuccuucc

SEQ ID NO: 3706546 - RNA, 16 nt, Human
ugggaccuagggaggc

SEQ ID NO: 3706547 - RNA, 23 nt, Human
ugggaccuauaacugcccagcgg

SEQ ID NO: 3706548 - RNA, 23 nt, Human
ugggaccugccaggcaggggugg

SEQ ID NO: 3706549 - RNA, 18 nt, Human
ugggaccuguggcugucg

SEQ ID NO: 3706550 - RNA, 15 nt, Human
ugggacgcucugcug

SEQ ID NO: 3706551 - RNA, 18 nt, Human
ugggacuaaaugcccugc

SEQ ID NO: 3706552 - RNA, 16 nt, Human
ugggacuacaggugug

SEQ ID NO: 3706553 - RNA, 17 nt, Human
ugggacuagccuggcuu

SEQ ID NO: 3706554 - RNA, 23 nt, Human
ugggacucagccuucagacagag

SEQ ID NO: 3706555 - RNA, 18 nt, Human
ugggacucguggcuguca

SEQ ID NO: 3706556 - RNA, 16 nt, Human
ugggacugagccaguc

SEQ ID NO: 3706557 - RNA, 20 nt, Human
ugggacugagccagucccag

SEQ ID NO: 3706558 - RNA, 20 nt, Human
ugggacugagccuggcccau

SEQ ID NO: 3706559 - RNA, 18 nt, Human
ugggacugggagggccca

SEQ ID NO: 3706560 - RNA, 14 nt, Human
ugggacuguacaca

SEQ ID NO: 3706561 - RNA, 18 nt, Human
ugggacuguacacacuuu

SEQ ID NO: 3706562 - RNA, 21 nt, Human
ugggacuguacacacuuuauu

SEQ ID NO: 3706563 - RNA, 17 nt, Human
ugggacuuccuugcucu

SEQ ID NO: 3706564 - RNA, 20 nt, Human
ugggacuucuuuucacauuc

SEQ ID NO: 3706565 - RNA, 21 nt, Human
ugggacuucuuuucacauucu

SEQ ID NO: 3706566 - RNA, 17 nt, Human
ugggagaagggcagagu

SEQ ID NO: 3706567 - RNA, 19 nt, Human
ugggagacacccaaagggu

SEQ ID NO: 3706568 - RNA, 12 nt, Human
ugggagacagac

SEQ ID NO: 3706569 - RNA, 13 nt, Human
ugggagacagacc

SEQ ID NO: 3706570 - RNA, 14 nt, Human
ugggagacauguga

SEQ ID NO: 3706571 - RNA, 15 nt, Human
ugggagagacuuguu

SEQ ID NO: 3706572 - RNA, 21 nt, Human
ugggagagacuuguuuuggau

SEQ ID NO: 3706573 - RNA, 14 nt, Human
ugggagagccccug

SEQ ID NO: 3706574 - RNA, 15 nt, Human
ugggagagccccugg

SEQ ID NO: 3706575 - RNA, 18 nt, Human
ugggagagccccuggggc

SEQ ID NO: 3706576 - RNA, 19 nt, Human
ugggagagccccuggggcc

SEQ ID NO: 3706577 - RNA, 14 nt, Human
ugggagaggcagcc

SEQ ID NO: 3706578 - RNA, 22 nt, Human
ugggagaggugccagcaacuga

SEQ ID NO: 3706579 - RNA, 18 nt, Human
ugggagagugucaaccag

SEQ ID NO: 3706580 - RNA, 18 nt, Human
ugggagcaaacugcaugc

SEQ ID NO: 3706581 - RNA, 12 nt, Human
ugggagcacugg

SEQ ID NO: 3706582 - RNA, 21 nt, Human
ugggagcagcgguuuggggag

SEQ ID NO: 3706583 - RNA, 13 nt, Human
ugggagcaggaga

SEQ ID NO: 3706584 - RNA, 14 nt, Human
ugggagcaggagau

SEQ ID NO: 3706585 - RNA, 12 nt, Human
ugggagccaggg

SEQ ID NO: 3706586 - RNA, 20 nt, Human
ugggagcccccagccuguca

SEQ ID NO: 3706587 - RNA, 23 nt, Human
ugggagccgggcaaacuggccgc

SEQ ID NO: 3706588 - RNA, 15 nt, Human
ugggagccucugggg

SEQ ID NO: 3706589 - RNA, 20 nt, Human
ugggagccugcaaacucacu

SEQ ID NO: 3706590 - RNA, 13 nt, Human
ugggagcuccucu

SEQ ID NO: 3706591 - RNA, 14 nt, Human
ugggagcuccucuc

SEQ ID NO: 3706592 - RNA, 17 nt, Human
ugggagcuccucuccug

SEQ ID NO: 3706593 - RNA, 18 nt, Human
ugggagcuccucuccugg

SEQ ID NO: 3706594 - RNA, 17 nt, Human
guuuuggugguuuuagu

SEQ ID NO: 3706595 - RNA, 20 nt, Human
guuuugguuaaguuggcuuc

SEQ ID NO: 3706596 - RNA, 16 nt, Human
guuuugguugcuuuaa

SEQ ID NO: 3706597 - RNA, 19 nt, Human
guuuuguaccagugaauuu

SEQ ID NO: 3706598 - RNA, 21 nt, Human
guuuuguauacaaauauauug

SEQ ID NO: 3706599 - RNA, 19 nt, Human
guuuuguaucuuaaauuug

SEQ ID NO: 3706600 - RNA, 20 nt, Human
guuuugucauucagagucag

SEQ ID NO: 3706601 - RNA, 14 nt, Human
guuuugugaaauuu

SEQ ID NO: 3706602 - RNA, 18 nt, Human
guuuugugaaauuuuuca

SEQ ID NO: 3706603 - RNA, 20 nt, Human
guuuugugaaauuuuucaua

SEQ ID NO: 3706604 - RNA, 16 nt, Human
guuuuguguacuuuua

SEQ ID NO: 3706605 - RNA, 17 nt, Human
guuuuguguacuuuuaa

SEQ ID NO: 3706606 - RNA, 15 nt, Human
guuuuguguuguuug

SEQ ID NO: 3706607 - RNA, 14 nt, Human
guuuuguuccccuc

SEQ ID NO: 3706608 - RNA, 15 nt, Human
guuuuguuccccucc

SEQ ID NO: 3706609 - RNA, 15 nt, Human
guuuuguucuuuaaa

SEQ ID NO: 3706610 - RNA, 16 nt, Human
guuuuguugacauucu

SEQ ID NO: 3706611 - RNA, 21 nt, Human
guuuuguugacauucugaaug

SEQ ID NO: 3706612 - RNA, 19 nt, Human
guuuuguugcacugaaguu

SEQ ID NO: 3706613 - RNA, 13 nt, Human
guuuuguuuacag

SEQ ID NO: 3706614 - RNA, 17 nt, Human
guuuuguuuauuaaaua

SEQ ID NO: 3706615 - RNA, 18 nt, Human
guuuuguuugcuaucuua

SEQ ID NO: 3706616 - RNA, 13 nt, Human
guuuuguuugucu

SEQ ID NO: 3706617 - RNA, 22 nt, Human
guuuuguuugucucuccuuuuc

SEQ ID NO: 3706618 - RNA, 15 nt, Human
guuuuguuuuuacaa

SEQ ID NO: 3706619 - RNA, 13 nt, Human
guuuuuaaaaucu

SEQ ID NO: 3706620 - RNA, 22 nt, Human
guuuuuaaacuguacagugucu

SEQ ID NO: 3706621 - RNA, 15 nt, Human
guuuuuaaauauauu

SEQ ID NO: 3706622 - RNA, 15 nt, Human
guuuuuaaauuuugu

SEQ ID NO: 3706623 - RNA, 15 nt, Human
guuuuuaacucaaua

SEQ ID NO: 3706624 - RNA, 14 nt, Human
guuuuuaacucuac

SEQ ID NO: 3706625 - RNA, 13 nt, Human
guuuuuaauguau

SEQ ID NO: 3706626 - RNA, 18 nt, Human
guuuuuaauguauaguaa

SEQ ID NO: 3706627 - RNA, 16 nt, Human
guuuuuacccauaucc

SEQ ID NO: 3706628 - RNA, 18 nt, Human
guuuuuacccauaucccc

SEQ ID NO: 3706629 - RNA, 17 nt, Human
guuuuuaccucugucuu

SEQ ID NO: 3706630 - RNA, 14 nt, Human
guuuuuacuccagu

SEQ ID NO: 3706631 - RNA, 18 nt, Human
guuuuuacugcucugaga

SEQ ID NO: 3706632 - RNA, 17 nt, Human
guuuuuaguaaucugua

SEQ ID NO: 3706633 - RNA, 17 nt, Human
guuuuuauauuaaugua

SEQ ID NO: 3706634 - RNA, 21 nt, Human
guuuuuaucugaaaucaauua

SEQ ID NO: 3706635 - RNA, 15 nt, Human
guuuuuaugagaaac

SEQ ID NO: 3706636 - RNA, 22 nt, Human
guuuuuauggcuuuugugcauu

SEQ ID NO: 3706637 - RNA, 14 nt, Human
guuuuuauuaguac

SEQ ID NO: 3706638 - RNA, 16 nt, Human
guuuuuauuccuugug

SEQ ID NO: 3706639 - RNA, 19 nt, Human
guuuuuauuuccuaugaug

SEQ ID NO: 3706640 - RNA, 16 nt, Human
guuuuuauuucuccuu

SEQ ID NO: 3706641 - RNA, 13 nt, Human
guuuuucaauuaa

SEQ ID NO: 3706642 - RNA, 14 nt, Human
guuuuucaauuaaa

SEQ ID NO: 3706643 - RNA, 19 nt, Human
guuuuucaauuaaacggau

SEQ ID NO: 3706644 - RNA, 23 nt, Human
guuuuucaauuaaacggauuauu

SEQ ID NO: 3706645 - RNA, 16 nt, Human
guuuuucacauuuucc

SEQ ID NO: 3706646 - RNA, 20 nt, Human
guuuuucaccacuucacuga

SEQ ID NO: 3706647 - RNA, 20 nt, Human
guuuuuccuaucauguuaac

SEQ ID NO: 3706648 - RNA, 18 nt, Human
guuuuuccuccauaaauu

SEQ ID NO: 3706649 - RNA, 19 nt, Human
guuuuuccuguucuuaaga

SEQ ID NO: 3706650 - RNA, 22 nt, Human
guuuuuccuuccaaugucugga

SEQ ID NO: 3706651 - RNA, 19 nt, Human
guuuuuccuuguauuuaaa

SEQ ID NO: 3706652 - RNA, 15 nt, Human
guuuuuccuuuaaaa

SEQ ID NO: 3706653 - RNA, 16 nt, Human
guuuuucggacaguuu

SEQ ID NO: 3706654 - RNA, 13 nt, Human
guuuuucuauuaa

SEQ ID NO: 3706655 - RNA, 11 nt, Human
guuuuucucac

SEQ ID NO: 3706656 - RNA, 15 nt, Human
guuuuucugauaugu

SEQ ID NO: 3706657 - RNA, 17 nt, Human
guuuuucugccagggag

SEQ ID NO: 3706658 - RNA, 16 nt, Human
guuuuucugcuuuaga

SEQ ID NO: 3706659 - RNA, 20 nt, Human
guuuuucugugugucaguuu

SEQ ID NO: 3706660 - RNA, 21 nt, Human
guuuuucuuaaauaauaaaga

SEQ ID NO: 3706661 - RNA, 22 nt, Human
guuuuucuucaacaucaauguu

SEQ ID NO: 3706662 - RNA, 17 nt, Human
guuuuucuuuucuugga

SEQ ID NO: 3706663 - RNA, 20 nt, Human
guuuuucuuuucuuggacac

SEQ ID NO: 3706664 - RNA, 20 nt, Human
guuuuugaaggcagaaagca

SEQ ID NO: 3706665 - RNA, 23 nt, Human
guuuuugaucaaaaacuauuugg

SEQ ID NO: 3706666 - RNA, 13 nt, Human
guuuuugggaugu

SEQ ID NO: 3706667 - RNA, 20 nt, Human
guuuuuggucuuuuauaauu

SEQ ID NO: 3706668 - RNA, 20 nt, Human
guuuuuguaaagaaaaauau

SEQ ID NO: 3706669 - RNA, 15 nt, Human
guuuuuguaaagugu

SEQ ID NO: 3706670 - RNA, 14 nt, Human
guuuuuguauauug

SEQ ID NO: 3706671 - RNA, 15 nt, Human
guuuuuguuaacuuu

SEQ ID NO: 3706672 - RNA, 19 nt, Human
guuuuuguuaacuuugggu

SEQ ID NO: 3706673 - RNA, 15 nt, Human
guuuuuguucaaagc

SEQ ID NO: 3706674 - RNA, 14 nt, Human
guuuuuguuuuguu

SEQ ID NO: 3706675 - RNA, 21 nt, Human
guuuuuuaaaauauuuaucug

SEQ ID NO: 3706676 - RNA, 18 nt, Human
guuuuuuaagauagugua

SEQ ID NO: 3706677 - RNA, 19 nt, Human
guuuuuuaucuuuucuaca

SEQ ID NO: 3706678 - RNA, 16 nt, Human
guuuuuuauuauugug

SEQ ID NO: 3706679 - RNA, 14 nt, Human
guuuuuucaaaaua

SEQ ID NO: 3706680 - RNA, 15 nt, Human
guuuuuucaaaauag

SEQ ID NO: 3706681 - RNA, 14 nt, Human
guuuuuugccacag

SEQ ID NO: 3706682 - RNA, 9 nt, Human
guuuuuugg

SEQ ID NO: 3706683 - RNA, 10 nt, Human
guuuuuuggu

SEQ ID NO: 3706684 - RNA, 19 nt, Human
guuuuuuucuucuguauuu

SEQ ID NO: 3706685 - RNA, 11 nt, Human
guuuuuuugcc

SEQ ID NO: 3706686 - RNA, 20 nt, Human
guuuuuuugucaacauugug

SEQ ID NO: 3706687 - RNA, 12 nt, Human
guuuuuuuuagu

SEQ ID NO: 3706688 - RNA, 15 nt, Human
guuuuuuuucaguug

SEQ ID NO: 3706689 - RNA, 17 nt, Human
guuuuuuuucuaaaacu

SEQ ID NO: 3706690 - RNA, 14 nt, Human
guuuuuuuucuucu

SEQ ID NO: 3706691 - RNA, 17 nt, Human
guuuuuuuuuaaagacu

SEQ ID NO: 3706692 - RNA, 23 nt, Human
guuuuuuuuuuuuuuaugugauc

SEQ ID NO: 3706693 - RNA, 19 nt, Human
uaaaaaaaaaaaaaagcuu

SEQ ID NO: 3706694 - RNA, 22 nt, Human
uaaaaaaaaaaaaaggaaaaaa

SEQ ID NO: 3706695 - RNA, 19 nt, Human
uaaaaaaaaaaaaguuaua

SEQ ID NO: 3706696 - RNA, 17 nt, Human
uaaaaaaaaaaguuaca

SEQ ID NO: 3706697 - RNA, 21 nt, Human
uaaaaaaaaaccugagcccca

SEQ ID NO: 3706698 - RNA, 22 nt, Human
uaaaaaaaaaggcauauugcuu

SEQ ID NO: 3706699 - RNA, 19 nt, Human
uaaaaaaaaagucagagac

SEQ ID NO: 3706700 - RNA, 16 nt, Human
uaaaaaaaaaugccuu

SEQ ID NO: 3706701 - RNA, 17 nt, Human
uaaaaaaaaaugccuuu

SEQ ID NO: 3706702 - RNA, 15 nt, Human
uaaaaaaaaauugua

SEQ ID NO: 3706703 - RNA, 19 nt, Human
uaaaaaaaacaaaaagaac

SEQ ID NO: 3706704 - RNA, 21 nt, Human
uaaaaaaaacaaaaagaacaa

SEQ ID NO: 3706705 - RNA, 20 nt, Human
uaaaaaaaacucuuuaacuu

SEQ ID NO: 3706706 - RNA, 14 nt, Human
uaaaaaaaagaaaa

SEQ ID NO: 3706707 - RNA, 16 nt, Human
uaaaaaaaagaaauga

SEQ ID NO: 3706708 - RNA, 17 nt, Human
uaaaaaaaauaauaaau

SEQ ID NO: 3706709 - RNA, 13 nt, Human
uaaaaaaaaugaa

SEQ ID NO: 3706710 - RNA, 21 nt, Human
uaaaaaaacaaucauuugcuu

SEQ ID NO: 3706711 - RNA, 14 nt, Human
uaaaaaaacagcuu

SEQ ID NO: 3706712 - RNA, 12 nt, Human
uaaaaaaaccac

SEQ ID NO: 3706713 - RNA, 11 nt, Human
uaaaaaaagaa

SEQ ID NO: 3706714 - RNA, 18 nt, Human
uaaaaaaaggcauuguuu

SEQ ID NO: 3706715 - RNA, 15 nt, Human
uaaaaaaauaagaag

SEQ ID NO: 3706716 - RNA, 13 nt, Human
uaaaaaaaugaca

SEQ ID NO: 3706717 - RNA, 14 nt, Human
uaaaaaaauggcag

SEQ ID NO: 3706718 - RNA, 13 nt, Human
uaaaaaaauuggu

SEQ ID NO: 3706719 - RNA, 16 nt, Human
uaaaaaaauuuaagug

SEQ ID NO: 3706720 - RNA, 17 nt, Human
uaaaaaaauuuaagugc

SEQ ID NO: 3706721 - RNA, 23 nt, Human
uaaaaaacaugugguuacacagu

SEQ ID NO: 3706722 - RNA, 15 nt, Human
uaaaaaaccacaugg

SEQ ID NO: 3706723 - RNA, 20 nt, Human
uaaaaaacugcugacuguuu

SEQ ID NO: 3706724 - RNA, 17 nt, Human
uaaaaaagauaaacaca

SEQ ID NO: 3706725 - RNA, 14 nt, Human
uaaaaaagccuucc

SEQ ID NO: 3706726 - RNA, 15 nt, Human
uaaaaaagccuuccu

SEQ ID NO: 3706727 - RNA, 15 nt, Human
uaaaaaagcugugug

SEQ ID NO: 3706728 - RNA, 13 nt, Human
uaaaaaagucucu

SEQ ID NO: 3706729 - RNA, 14 nt, Human
uaaaaaagucucua

SEQ ID NO: 3706730 - RNA, 20 nt, Human
uaaaaaagucucuauuuaaa

SEQ ID NO: 3706731 - RNA, 22 nt, Human
uaaaaaagucucuauuuaaauu

SEQ ID NO: 3706732 - RNA, 13 nt, Human
uaaaaaauauuuu

SEQ ID NO: 3706733 - RNA, 15 nt, Human
uaaaaaaugaaaaua

SEQ ID NO: 3706734 - RNA, 14 nt, Human
uaaaaaaugacaaa

SEQ ID NO: 3706735 - RNA, 15 nt, Human
uaaaaaauggugccu

SEQ ID NO: 3706736 - RNA, 13 nt, Human
uaaaaaaugucca

SEQ ID NO: 3706737 - RNA, 20 nt, Human
uaaaaaauguguguauucuu

SEQ ID NO: 3706738 - RNA, 18 nt, Human
uaaaaaauuaugacaaug

SEQ ID NO: 3706739 - RNA, 22 nt, Human
uaaaaacaaaaacaucccaaga

SEQ ID NO: 3706740 - RNA, 21 nt, Human
uaaaaacaaagaaauuaugug

SEQ ID NO: 3706741 - RNA, 18 nt, Human
uaaaaacaacuuuauacc

SEQ ID NO: 3706742 - RNA, 16 nt, Human
uaaaaacagcauugcu

SEQ ID NO: 3706743 - RNA, 22 nt, Human
uaaaaacagcauugcuuucuga

SEQ ID NO: 3706744 - RNA, 14 nt, Human
uaaaaaccaagaag

SEQ ID NO: 3706745 - RNA, 14 nt, Human
ugugaccaacugug

SEQ ID NO: 3706746 - RNA, 14 nt, Human
ugugaccagcacug

SEQ ID NO: 3706747 - RNA, 15 nt, Human
ugugaccagggguga

SEQ ID NO: 3706748 - RNA, 21 nt, Human
ugugacccagauccucacaac

SEQ ID NO: 3706749 - RNA, 15 nt, Human
ugugaccccuccugg

SEQ ID NO: 3706750 - RNA, 19 nt, Human
ugugaccccuccuggggcc

SEQ ID NO: 3706751 - RNA, 11 nt, Human
ugugacccucc

SEQ ID NO: 3706752 - RNA, 13 nt, Human
ugugacccuccaa

SEQ ID NO: 3706753 - RNA, 15 nt, Human
ugugacccuccaaau

SEQ ID NO: 3706754 - RNA, 16 nt, Human
ugugacccucugaaug

SEQ ID NO: 3706755 - RNA, 20 nt, Human
ugugaccucaggcacuagcc

SEQ ID NO: 3706756 - RNA, 14 nt, Human
ugugaccugcugag

SEQ ID NO: 3706757 - RNA, 15 nt, Human
ugugaccuuaguguu

SEQ ID NO: 3706758 - RNA, 13 nt, Human
ugugaccuucucu

SEQ ID NO: 3706759 - RNA, 22 nt, Human
ugugacuaauuguauaacaggu

SEQ ID NO: 3706760 - RNA, 15 nt, Human
ugugacuagugcuga

SEQ ID NO: 3706761 - RNA, 17 nt, Human
ugugacuagugcugaag

SEQ ID NO: 3706762 - RNA, 22 nt, Human
ugugacuagugcugaagcuuau

SEQ ID NO: 3706763 - RNA, 18 nt, Human
ugugacuauauagagaug

SEQ ID NO: 3706764 - RNA, 12 nt, Human
ugugacucuuuc

SEQ ID NO: 3706765 - RNA, 15 nt, Human
ugugacugaauuucu

SEQ ID NO: 3706766 - RNA, 16 nt, Human
ugugacugaauuucuu

SEQ ID NO: 3706767 - RNA, 20 nt, Human
ugugacugauguuaggcugg

SEQ ID NO: 3706768 - RNA, 23 nt, Human
ugugacugauguuaggcugggcc

SEQ ID NO: 3706769 - RNA, 17 nt, Human
ugugacuggcuaaagcu

SEQ ID NO: 3706770 - RNA, 17 nt, Human
ugugacuuaagaagccu

SEQ ID NO: 3706771 - RNA, 15 nt, Human
ugugacuuaaugcca

SEQ ID NO: 3706772 - RNA, 23 nt, Human
ugugacuucuauuuuaaagacaa

SEQ ID NO: 3706773 - RNA, 23 nt, Human
ugugacuugcaucguggagacag

SEQ ID NO: 3706774 - RNA, 22 nt, Human
ugugagaaaaccccuucccauu

SEQ ID NO: 3706775 - RNA, 21 nt, Human
ugugagaagccagccagaggc

SEQ ID NO: 3706776 - RNA, 18 nt, Human
ugugagaagguuuauugu

SEQ ID NO: 3706777 - RNA, 22 nt, Human
ugugagaagugaaugcugggac

SEQ ID NO: 3706778 - RNA, 14 nt, Human
ugugagacccccac

SEQ ID NO: 3706779 - RNA, 15 nt, Human
ugugagacccccaca

SEQ ID NO: 3706780 - RNA, 19 nt, Human
ugugagacccccacaccuc

SEQ ID NO: 3706781 - RNA, 17 nt, Human
ugugagagcgaggcuga

SEQ ID NO: 3706782 - RNA, 15 nt, Human
ugugagagguuugac

SEQ ID NO: 3706783 - RNA, 15 nt, Human
ugugagaugcuagaa

SEQ ID NO: 3706784 - RNA, 22 nt, Human
ugugagaugcuagaacucccuu

SEQ ID NO: 3706785 - RNA, 13 nt, Human
ugugagaugugua

SEQ ID NO: 3706786 - RNA, 22 nt, Human
ugugagauuuuuuauugcuagu

SEQ ID NO: 3706787 - RNA, 15 nt, Human
ugugagcagcaccca

SEQ ID NO: 3706788 - RNA, 18 nt, Human
ugugagcaucacaguuuu

SEQ ID NO: 3706789 - RNA, 12 nt, Human
ugugagccccug

SEQ ID NO: 3706790 - RNA, 17 nt, Human
ugugagccccugguccu

SEQ ID NO: 3706791 - RNA, 21 nt, Human
ugugagccccugguccugagg

SEQ ID NO: 3706792 - RNA, 19 nt, Human
ugugagcucccaggugcag

SEQ ID NO: 3706793 - RNA, 23 nt, Human
ugugaggaaagucauuggcuuua

SEQ ID NO: 3706794 - RNA, 13 nt, Human
ugugaggccaggg

SEQ ID NO: 3706795 - RNA, 15 nt, Human
ugugaggccagggca

SEQ ID NO: 3706796 - RNA, 22 nt, Human
ugugaggccagggcagagugag

SEQ ID NO: 3706797 - RNA, 22 nt, Human
ugugaggccccuggacaagcag

SEQ ID NO: 3706798 - RNA, 14 nt, Human
ugugaggcuguccu

SEQ ID NO: 3706799 - RNA, 21 nt, Human
ugugagguuucccaauggugu

SEQ ID NO: 3706800 - RNA, 19 nt, Human
ugugaguacuacaguccuc

SEQ ID NO: 3706801 - RNA, 20 nt, Human
ugugaguacuacaguccucc

SEQ ID NO: 3706802 - RNA, 13 nt, Human
ugugaguauucuc

SEQ ID NO: 3706803 - RNA, 15 nt, Human
ugugagucaccaagc

SEQ ID NO: 3706804 - RNA, 17 nt, Human
ugugagucaccaagccc

SEQ ID NO: 3706805 - RNA, 21 nt, Human
ugugagucaccaagcccaguu

SEQ ID NO: 3706806 - RNA, 18 nt, Human
ugugagucuuugguucua

SEQ ID NO: 3706807 - RNA, 20 nt, Human
ugugagucuuugguucuaag

SEQ ID NO: 3706808 - RNA, 16 nt, Human
ugugagugccuuuugc

SEQ ID NO: 3706809 - RNA, 12 nt, Human
uguguuuccaca

SEQ ID NO: 3706810 - RNA, 11 nt, Human
uguguuuccuu

SEQ ID NO: 3706811 - RNA, 14 nt, Human
uguguuugcuuucu

SEQ ID NO: 3706812 - RNA, 17 nt, Human
uguguuuggaagacuau

SEQ ID NO: 3706813 - RNA, 15 nt, Human
uguguuuggcuuuca

SEQ ID NO: 3706814 - RNA, 18 nt, Human
uguguuugguucuggggc

SEQ ID NO: 3706815 - RNA, 11 nt, Human
uguguuugugu

SEQ ID NO: 3706816 - RNA, 13 nt, Human
uguguuuguguga

SEQ ID NO: 3706817 - RNA, 20 nt, Human
uguguuuguucuuuuuauug

SEQ ID NO: 3706818 - RNA, 14 nt, Human
uguguuuuagagua

SEQ ID NO: 3706819 - RNA, 17 nt, Human
uguguuuucucuggaau

SEQ ID NO: 3706820 - RNA, 14 nt, Human
uguguuuucugaau

SEQ ID NO: 3706821 - RNA, 13 nt, Human
uguguuuugcaag

SEQ ID NO: 3706822 - RNA, 19 nt, Human
uguguuuugcuaaaggaaa

SEQ ID NO: 3706823 - RNA, 18 nt, Human
uguguuuuucauaaagca

SEQ ID NO: 3706824 - RNA, 16 nt, Human
uguguuuuucuauuaa

SEQ ID NO: 3706825 - RNA, 17 nt, Human
uguguuuuucuauuaaa

SEQ ID NO: 3706826 - RNA, 21 nt, Human
uguguuuuucuauuaaaagac

SEQ ID NO: 3706827 - RNA, 20 nt, Human
uguguuuuucuccagugcug

SEQ ID NO: 3706828 - RNA, 18 nt, Human
uguguuuuugggaugucu

SEQ ID NO: 3706829 - RNA, 15 nt, Human
uguguuuuuuaagau

SEQ ID NO: 3706830 - RNA, 22 nt, Human
uguguuuuuuuuucguuuguuu

SEQ ID NO: 3706831 - RNA, 19 nt, Human
uguuaaaaaaauaagaaga

SEQ ID NO: 3706832 - RNA, 14 nt, Human
uguuaaaaauguca

SEQ ID NO: 3706833 - RNA, 19 nt, Human
uguuaaaacuggcaucuga

SEQ ID NO: 3706834 - RNA, 15 nt, Human
uguuaaaaguuuuau

SEQ ID NO: 3706835 - RNA, 14 nt, Human
uguuaaaauaacua

SEQ ID NO: 3706836 - RNA, 22 nt, Human
uguuaaaauuauaccuguugcu

SEQ ID NO: 3706837 - RNA, 23 nt, Human
uguuaaaauuaucaauaucuaau

SEQ ID NO: 3706838 - RNA, 16 nt, Human
uguuaaaccaugggau

SEQ ID NO: 3706839 - RNA, 11 nt, Human
uguuaaacugu

SEQ ID NO: 3706840 - RNA, 14 nt, Human
uguuaaacuguuag

SEQ ID NO: 3706841 - RNA, 22 nt, Human
uguuaaacuguuagcacuguug

SEQ ID NO: 3706842 - RNA, 14 nt, Human
uguuaaagauguag

SEQ ID NO: 3706843 - RNA, 20 nt, Human
uguuaaauaaauuguauauu

SEQ ID NO: 3706844 - RNA, 22 nt, Human
uguuaaauaucaguagaaacuc

SEQ ID NO: 3706845 - RNA, 24 nt, Human
uguuaaaucccauucauaacuuuc

SEQ ID NO: 3706846 - RNA, 18 nt, Human
uguuaaaugaaauuguaa

SEQ ID NO: 3706847 - RNA, 15 nt, Human
uguuaaauuuguaag

SEQ ID NO: 3706848 - RNA, 16 nt, Human
uguuaaauuuguaagu

SEQ ID NO: 3706849 - RNA, 17 nt, Human
uguuaaauuuguaaguu

SEQ ID NO: 3706850 - RNA, 18 nt, Human
uguuaacacauuuuguau

SEQ ID NO: 3706851 - RNA, 21 nt, Human
uguuaacagaagggagggcag

SEQ ID NO: 3706852 - RNA, 22 nt, Human
uguuaacagaagggagggcaga

SEQ ID NO: 3706853 - RNA, 21 nt, Human
uguuaacauggacaugaucuu

SEQ ID NO: 3706854 - RNA, 15 nt, Human
uguuaaccucagugu

SEQ ID NO: 3706855 - RNA, 17 nt, Human
uguuaaccucaguguca

SEQ ID NO: 3706856 - RNA, 19 nt, Human
uguuaacucuugucuauuu

SEQ ID NO: 3706857 - RNA, 12 nt, Human
uguuaacugaau

SEQ ID NO: 3706858 - RNA, 15 nt, Human
uguuaacugaauacc

SEQ ID NO: 3706859 - RNA, 18 nt, Human
uguuaacugaauaccacu

SEQ ID NO: 3706860 - RNA, 22 nt, Human
uguuaacugaauaccacucugu

SEQ ID NO: 3706861 - RNA, 14 nt, Human
uguuaacuuagcuu

SEQ ID NO: 3706862 - RNA, 15 nt, Human
uguuaacuuauucaa

SEQ ID NO: 3706863 - RNA, 15 nt, Human
uguuaagaauugacc

SEQ ID NO: 3706864 - RNA, 15 nt, Human
uguuaagacuugaca

SEQ ID NO: 3706865 - RNA, 20 nt, Human
uguuaagacuugacagugga

SEQ ID NO: 3706866 - RNA, 23 nt, Human
uguuaagcagauggaaugcugug

SEQ ID NO: 3706867 - RNA, 18 nt, Human
uguuaagcagcuaaauuu

SEQ ID NO: 3706868 - RNA, 14 nt, Human
uguuaaggaaacuc

SEQ ID NO: 3706869 - RNA, 17 nt, Human
uguuaagggaccaggga

SEQ ID NO: 3706870 - RNA, 22 nt, Human
uguuaagguccugaaaguaacu

SEQ ID NO: 3706871 - RNA, 15 nt, Human
uguuaagguucaaga

SEQ ID NO: 3706872 - RNA, 22 nt, Human
uguuaaguugauggugaugaaa

SEQ ID NO: 3706873 - RNA, 18 nt, Human
uguuaauaaaaguacaug

SEQ ID NO: 3706874 - RNA, 22 nt, Human
uguuaauacaagguauaauaaa

SEQ ID NO: 3706875 - RNA, 12 nt, Human
uguuaauaucac

SEQ ID NO: 3706876 - RNA, 17 nt, Human
uguuaauaucacucauu

SEQ ID NO: 3706877 - RNA, 21 nt, Human
uguuaauaucacucauuaauu

SEQ ID NO: 3706878 - RNA, 22 nt, Human
uguuaauaucacucauuaauua

SEQ ID NO: 3706879 - RNA, 14 nt, Human
uguuaaucaauuua

SEQ ID NO: 3706880 - RNA, 20 nt, Human
uguuaaucaauuuaaaccca

SEQ ID NO: 3706881 - RNA, 22 nt, Human
uguuaaucaauuuaaacccauu

SEQ ID NO: 3706882 - RNA, 19 nt, Human
uguuaaucucuguuaugua

SEQ ID NO: 3706883 - RNA, 19 nt, Human
uguuaaugaaaaugucaga

SEQ ID NO: 3706884 - RNA, 23 nt, Human
uguuaauggauuucagaagccua

SEQ ID NO: 3706885 - RNA, 20 nt, Human
uguuaauggugcaaauccua

SEQ ID NO: 3706886 - RNA, 12 nt, Human
uguuaauguauu

SEQ ID NO: 3706887 - RNA, 19 nt, Human
uguuaauguauuuguucau

SEQ ID NO: 3706888 - RNA, 15 nt, Human
uguuaauuacaccau

SEQ ID NO: 3706889 - RNA, 15 nt, Human
uguuaauucagcacu

SEQ ID NO: 3706890 - RNA, 22 nt, Human
uguuaauucagcacugauuuca

SEQ ID NO: 3706891 - RNA, 20 nt, Human
uguuaauuuagaaaacuuua

SEQ ID NO: 3706892 - RNA, 22 nt, Human
uguuaauuuagaaaacuuuaaa

SEQ ID NO: 3706893 - RNA, 15 nt, Human
uguuaauuuggacca

SEQ ID NO: 3706894 - RNA, 22 nt, Human
uguuaauuuggaccauuuuccu

SEQ ID NO: 3706895 - RNA, 19 nt, Human
uguuaauuuuuugguacaa

SEQ ID NO: 3706896 - RNA, 21 nt, Human
uguuaauuuuuugguacaaaa

SEQ ID NO: 3706897 - RNA, 14 nt, Human
uguuacaaauugua

SEQ ID NO: 3706898 - RNA, 18 nt, Human
uguuacaaauuguagaag

SEQ ID NO: 3706899 - RNA, 18 nt, Human
uguuacacuuuuuggaag

SEQ ID NO: 3706900 - RNA, 23 nt, Human
uguuacaggcaccgagaauguug

SEQ ID NO: 3706901 - RNA, 17 nt, Human
uguuacauaacaagaaa

SEQ ID NO: 3706902 - RNA, 22 nt, Human
uguuacauaacaagaaaaucaa

SEQ ID NO: 3706903 - RNA, 19 nt, Human
uguuacauaagauaaaugu

SEQ ID NO: 3706904 - RNA, 19 nt, Human
uguuaccaaaaauaaauau

SEQ ID NO: 3706905 - RNA, 23 nt, Human
uguuaccaaaaauaaauauaucu

SEQ ID NO: 3706906 - RNA, 15 nt, Human
uguuacccaugaaaa

SEQ ID NO: 3706907 - RNA, 23 nt, Human
uguuaccccaagcgcccuggccc

SEQ ID NO: 3706908 - RNA, 15 nt, Human
uguuaccgccugucu

SEQ ID NO: 3706909 - RNA, 16 nt, Human
uguuaccuacuuugac

SEQ ID NO: 3706910 - RNA, 19 nt, Human
uguuaccuccaacagaacu

SEQ ID NO: 3706911 - RNA, 23 nt, Human
uguuaccugaaaacacugugcac

SEQ ID NO: 3706912 - RNA, 21 nt, Human
uguuaccugaucaaugacaga

SEQ ID NO: 3706913 - RNA, 14 nt, Human
uguuaccuguagau

SEQ ID NO: 3706914 - RNA, 20 nt, Human
uguuacuaaaaaaaagauga

SEQ ID NO: 3706915 - RNA, 15 nt, Human
uguuacuaucugcuu

SEQ ID NO: 3706916 - RNA, 14 nt, Human
uguuacuauuuucu

SEQ ID NO: 3706917 - RNA, 18 nt, Human
uguuacuauuuucuacaa

SEQ ID NO: 3706918 - RNA, 22 nt, Human
uguuacuauuuucuacaauuaa

SEQ ID NO: 3706919 - RNA, 15 nt, Human
uguuacucugguucu

SEQ ID NO: 3706920 - RNA, 20 nt, Human
uguuacucugguucuuuguu

SEQ ID NO: 3706921 - RNA, 14 nt, Human
uguuacucuuacga

SEQ ID NO: 3706922 - RNA, 14 nt, Human
uguuacucuuggga

SEQ ID NO: 3706923 - RNA, 17 nt, Human
uguuacucuugggacau

SEQ ID NO: 3706924 - RNA, 15 nt, Human
uguuacuguaauucc

SEQ ID NO: 3706925 - RNA, 15 nt, Human
uguuacuguucuugc

SEQ ID NO: 3706926 - RNA, 19 nt, Human
uguuacuguucuugcugcu

SEQ ID NO: 3706927 - RNA, 24 nt, Human
uguuacuguucuugcugcuagaac

SEQ ID NO: 3706928 - RNA, 14 nt, Human
uguuacuuaccuaa

SEQ ID NO: 3706929 - RNA, 14 nt, Human
uguuacuucucuaa

SEQ ID NO: 3706930 - RNA, 20 nt, Human
uguuagaacacuauuuucag

SEQ ID NO: 3706931 - RNA, 19 nt, Human
uguuagaauguaagguaua

SEQ ID NO: 3706932 - RNA, 21 nt, Human
uguuagagacuuuuuucuagu

SEQ ID NO: 3706933 - RNA, 11 nt, Human
uguuagagcac

SEQ ID NO: 3706934 - RNA, 19 nt, Human
uguuagauauuuuucauaa

SEQ ID NO: 3706935 - RNA, 18 nt, Human
uggggacaucucuuugaa

SEQ ID NO: 3706936 - RNA, 20 nt, Human
uggggacaucucuuugaauu

SEQ ID NO: 3706937 - RNA, 14 nt, Human
uggggaccagagcu

SEQ ID NO: 3706938 - RNA, 15 nt, Human
uggggaccagagcug

SEQ ID NO: 3706939 - RNA, 22 nt, Human
uggggaccagcagccccacacc

SEQ ID NO: 3706940 - RNA, 11 nt, Human
uggggacccac

SEQ ID NO: 3706941 - RNA, 13 nt, Human
uggggacccaggc

SEQ ID NO: 3706942 - RNA, 14 nt, Human
uggggaccucaggc

SEQ ID NO: 3706943 - RNA, 15 nt, Human
uggggaccucaggcc

SEQ ID NO: 3706944 - RNA, 19 nt, Human
uggggacuuggccucucuc

SEQ ID NO: 3706945 - RNA, 18 nt, Human
uggggagacaccucagag

SEQ ID NO: 3706946 - RNA, 20 nt, Human
uggggagacaccucagagcc

SEQ ID NO: 3706947 - RNA, 21 nt, Human
uggggagacugggcugaggga

SEQ ID NO: 3706948 - RNA, 15 nt, Human
uggggagaggaaaga

SEQ ID NO: 3706949 - RNA, 20 nt, Human
uggggagaggaacuccuugg

SEQ ID NO: 3706950 - RNA, 17 nt, Human
uggggagcaggcagcca

SEQ ID NO: 3706951 - RNA, 16 nt, Human
uggggagccaacagaa

SEQ ID NO: 3706952 - RNA, 22 nt, Human
uggggagccaacagaagcuucc

SEQ ID NO: 3706953 - RNA, 17 nt, Human
uggggagcgggucugcu

SEQ ID NO: 3706954 - RNA, 22 nt, Human
uggggaggcggacguuccagcc

SEQ ID NO: 3706955 - RNA, 14 nt, Human
uggggagggauuug

SEQ ID NO: 3706956 - RNA, 19 nt, Human
uggggaggggcgcuggccc

SEQ ID NO: 3706957 - RNA, 20 nt, Human
uggggaggggcgcuggccca

SEQ ID NO: 3706958 - RNA, 19 nt, Human
uggggaggggcggcaggag

SEQ ID NO: 3706959 - RNA, 15 nt, Human
uggggaggggcugug

SEQ ID NO: 3706960 - RNA, 19 nt, Human
uggggagugggacagaguc

SEQ ID NO: 3706961 - RNA, 18 nt, Human
uggggaguuuaggguggg

SEQ ID NO: 3706962 - RNA, 18 nt, Human
uggggauagaugugugga

SEQ ID NO: 3706963 - RNA, 18 nt, Human
uggggauccccgccuggc

SEQ ID NO: 3706964 - RNA, 22 nt, Human
uggggauccccgccuggccagg

SEQ ID NO: 3706965 - RNA, 12 nt, Human
uggggauucuua

SEQ ID NO: 3706966 - RNA, 23 nt, Human
uggggauugggugggcaggaaaa

SEQ ID NO: 3706967 - RNA, 18 nt, Human
uggggcaagauuuuccuu

SEQ ID NO: 3706968 - RNA, 18 nt, Human
uggggcacagggagaggc

SEQ ID NO: 3706969 - RNA, 18 nt, Human
uggggcagaaaucugagg

SEQ ID NO: 3706970 - RNA, 16 nt, Human
uggggcagcuccucug

SEQ ID NO: 3706971 - RNA, 13 nt, Human
uggggcaggagua

SEQ ID NO: 3706972 - RNA, 15 nt, Human
uggggcaggaguagc

SEQ ID NO: 3706973 - RNA, 19 nt, Human
uggggcaggaguagcugag

SEQ ID NO: 3706974 - RNA, 21 nt, Human
uggggcaggaguagcugagcu

SEQ ID NO: 3706975 - RNA, 14 nt, Human
uggggcaggcuggg

SEQ ID NO: 3706976 - RNA, 17 nt, Human
uggggcaguagaagguc

SEQ ID NO: 3706977 - RNA, 20 nt, Human
uggggcagugcuuggcccag

SEQ ID NO: 3706978 - RNA, 16 nt, Human
uggggcauccaugggg

SEQ ID NO: 3706979 - RNA, 20 nt, Human
uggggccaccaaagcugccc

SEQ ID NO: 3706980 - RNA, 22 nt, Human
uggggccaggccgggccuguac

SEQ ID NO: 3706981 - RNA, 21 nt, Human
uggggccaggcugggucgccc

SEQ ID NO: 3706982 - RNA, 21 nt, Human
uggggccaguuggucccccuu

SEQ ID NO: 3706983 - RNA, 19 nt, Human
uggggccaugccuccucag

SEQ ID NO: 3706984 - RNA, 21 nt, Human
uggggccaugccuccucagga

SEQ ID NO: 3706985 - RNA, 13 nt, Human
uggggcccaaaug

SEQ ID NO: 3706986 - RNA, 13 nt, Human
uggggcccagugc

SEQ ID NO: 3706987 - RNA, 12 nt, Human
uggggcccuaau

SEQ ID NO: 3706988 - RNA, 19 nt, Human
uggggccgccgccucuuuc

SEQ ID NO: 3706989 - RNA, 20 nt, Human
uggggccuaauaaaacugau

SEQ ID NO: 3706990 - RNA, 23 nt, Human
uggggccuaauaaaacugaugug

SEQ ID NO: 3706991 - RNA, 18 nt, Human
uggggccuagauccacac

SEQ ID NO: 3706992 - RNA, 13 nt, Human
uggggccucagac

SEQ ID NO: 3706993 - RNA, 14 nt, Human
uggggccucagacg

SEQ ID NO: 3706994 - RNA, 18 nt, Human
uggggccugacugcucag

SEQ ID NO: 3706995 - RNA, 11 nt, Human
uggggccugag

SEQ ID NO: 3706996 - RNA, 16 nt, Human
uggggccugagagaau

SEQ ID NO: 3706997 - RNA, 17 nt, Human
uggggccugaggucauc

SEQ ID NO: 3706998 - RNA, 16 nt, Human
uggggccuggaccugc

SEQ ID NO: 3706999 - RNA, 15 nt, Human
uggggccuggagcag

SEQ ID NO: 3707000 - RNA, 13 nt, Human
uggggccugggac

SEQ ID NO: 3707001 - RNA, 13 nt, Human
uggggccugugga

SEQ ID NO: 3707002 - RNA, 16 nt, Human
uggggccuguggaaug

SEQ ID NO: 3707003 - RNA, 14 nt, Human
uggggccuuggccu

SEQ ID NO: 3707004 - RNA, 17 nt, Human
uggggcgaggcagagga

SEQ ID NO: 3707005 - RNA, 19 nt, Human
uggggcguggggagggccg

SEQ ID NO: 3707006 - RNA, 23 nt, Human
uggggcuaggaaauccagggugg

SEQ ID NO: 3707007 - RNA, 13 nt, Human
uggggcucagagc

SEQ ID NO: 3707008 - RNA, 15 nt, Human
uggggcucagagugg

SEQ ID NO: 3707009 - RNA, 18 nt, Human
uggggcucccagccaggc

SEQ ID NO: 3707010 - RNA, 19 nt, Human
uggggcucccagccaggcc

SEQ ID NO: 3707011 - RNA, 21 nt, Human
uggggcucccagccaggcccu

SEQ ID NO: 3707012 - RNA, 14 nt, Human
uggggcucccgccc

SEQ ID NO: 3707013 - RNA, 23 nt, Human
uggggcuccuccaggguggcagc

SEQ ID NO: 3707014 - RNA, 11 nt, Human
uggggcuccuu

SEQ ID NO: 3707015 - RNA, 17 nt, Human
uggggcucuaacgccug

SEQ ID NO: 3707016 - RNA, 18 nt, Human
uggggcucuaacgccuga

SEQ ID NO: 3707017 - RNA, 19 nt, Human
uggggcucuaacgccugag

SEQ ID NO: 3707018 - RNA, 21 nt, Human
uggggcucuaacgccugagcc

SEQ ID NO: 3707019 - RNA, 22 nt, Human
uggggcucuaacgccugagccc

SEQ ID NO: 3707020 - RNA, 13 nt, Human
uggggcucucagu

SEQ ID NO: 3707021 - RNA, 15 nt, Human
uggggcucugugcag

SEQ ID NO: 3707022 - RNA, 18 nt, Human
uggggcugaucucaggga

SEQ ID NO: 3707023 - RNA, 19 nt, Human
uggggcugaucucagggaa

SEQ ID NO: 3707024 - RNA, 21 nt, Human
uggggcugaucucagggaagc

SEQ ID NO: 3707025 - RNA, 20 nt, Human
uggggcugcaccggcuggcc

SEQ ID NO: 3707026 - RNA, 23 nt, Human
uggggcugcaccggcuggccugg

SEQ ID NO: 3707027 - RNA, 15 nt, Human
uggggcugcuccucc

SEQ ID NO: 3707028 - RNA, 16 nt, Human
uggggcugcuccucca

SEQ ID NO: 3707029 - RNA, 19 nt, Human
uggggcugcuccuccaggg

SEQ ID NO: 3707030 - RNA, 12 nt, Human
uggggcugcugg

SEQ ID NO: 3707031 - RNA, 13 nt, Human
uggggcugcuggc

SEQ ID NO: 3707032 - RNA, 14 nt, Human
uggggcugcuguga

SEQ ID NO: 3707033 - RNA, 17 nt, Human
uggggcuggagaggaca

SEQ ID NO: 3707034 - RNA, 13 nt, Human
uggggcugggccc

SEQ ID NO: 3707035 - RNA, 18 nt, Human
uggggcugggcccaccca

SEQ ID NO: 3707036 - RNA, 11 nt, Human
uggggcugggg

SEQ ID NO: 3707037 - RNA, 22 nt, Human
uggggcugggggaugggccuga

SEQ ID NO: 3707038 - RNA, 16 nt, Human
uggggcugguucugua

SEQ ID NO: 3707039 - RNA, 12 nt, Human
uggggcuguguu

SEQ ID NO: 3707040 - RNA, 18 nt, Human
uggggcuucuccugaccc

SEQ ID NO: 3707041 - RNA, 12 nt, Human
uggggcuuggcg

SEQ ID NO: 3707042 - RNA, 23 nt, Human
uggggcuuucguccacagcuucc

SEQ ID NO: 3707043 - RNA, 18 nt, Human
ugggggaagagcacagcc

SEQ ID NO: 3707044 - RNA, 19 nt, Human
ugggggaagagcacagccc

SEQ ID NO: 3707045 - RNA, 21 nt, Human
ugggggaagagcacagcccuc

SEQ ID NO: 3707046 - RNA, 23 nt, Human
ugggggaagagcacagcccuccc

SEQ ID NO: 3707047 - RNA, 15 nt, Human
ugggggaagcccugg

SEQ ID NO: 3707048 - RNA, 14 nt, Human
ugggggacuuacau

SEQ ID NO: 3707049 - RNA, 14 nt, Human
ugggggagagccgu

SEQ ID NO: 3707050 - RNA, 11 nt, Human
ugggggagggc

SEQ ID NO: 3707051 - RNA, 15 nt, Human
ugggggaguggaaua

SEQ ID NO: 3707052 - RNA, 16 nt, Human
ugggggaguggccaca

SEQ ID NO: 3707053 - RNA, 18 nt, Human
ugggggcagcacaggagg

SEQ ID NO: 3707054 - RNA, 17 nt, Human
ugggggcagggcaugac

SEQ ID NO: 3707055 - RNA, 14 nt, Human
ugggggcagggcug

SEQ ID NO: 3707056 - RNA, 15 nt, Human
ugggggccuggcugg

SEQ ID NO: 3707057 - RNA, 18 nt, Human
ugggggcucagcaaggcc

SEQ ID NO: 3707058 - RNA, 23 nt, Human
ugggggcucagcaaggccaccuc

SEQ ID NO: 3707059 - RNA, 21 nt, Human
ugggggcugcagcauguugcu

SEQ ID NO: 3707060 - RNA, 20 nt, Human
uggggggaacgcccacuucc

SEQ ID NO: 3707061 - RNA, 21 nt, Human
uggggggccaacaccagggau

SEQ ID NO: 3707062 - RNA, 17 nt, Human
uggggggcuucauacac

SEQ ID NO: 3707063 - RNA, 20 nt, Human
ugggggggccaaaaggaaaa

SEQ ID NO: 3707064 - RNA, 14 nt, Human
uggggggguggccg

SEQ ID NO: 3707065 - RNA, 15 nt, Human
uggggguagcagcug

SEQ ID NO: 3707066 - RNA, 18 nt, Human
uggggguagcagcuggac

SEQ ID NO: 3707067 - RNA, 19 nt, Human
ugggggucaggcagccagu

SEQ ID NO: 3707068 - RNA, 21 nt, Human
uggggguccuccuccagggac

SEQ ID NO: 3707069 - RNA, 15 nt, Human
ugggggugagggucc

SEQ ID NO: 3707070 - RNA, 11 nt, Human
ugggggugggu

SEQ ID NO: 3707071 - RNA, 15 nt, Human
uggggguuggcuggg

SEQ ID NO: 3707072 - RNA, 16 nt, Human
uggggguuggcugggu

SEQ ID NO: 3707073 - RNA, 14 nt, Human
ugggguacccacug

SEQ ID NO: 3707074 - RNA, 20 nt, Human
ugggguacccacugcucugg

SEQ ID NO: 3707075 - RNA, 18 nt, Human
ugggguagcuagaggaac

SEQ ID NO: 3707076 - RNA, 21 nt, Human
ugggguaggaggaugggcucg

SEQ ID NO: 3707077 - RNA, 20 nt, Human
ugggguauuuaccacagcag

SEQ ID NO: 3707078 - RNA, 24 nt, Human
ugggguauuuaccacagcagcuga

SEQ ID NO: 3707079 - RNA, 21 nt, Human
ugggguauuuggggcuuauuu

SEQ ID NO: 3707080 - RNA, 12 nt, Human
ugggguauuuuu

SEQ ID NO: 3707081 - RNA, 17 nt, Human
uggggucacucuggcag

SEQ ID NO: 3707082 - RNA, 18 nt, Human
uggggucacucuggcagc

SEQ ID NO: 3707083 - RNA, 22 nt, Human
uggggucacucuggcagcucag

SEQ ID NO: 3707084 - RNA, 15 nt, Human
uggggucagccaggg

SEQ ID NO: 3707085 - RNA, 16 nt, Human
uaaaaugcuagguucu

SEQ ID NO: 3707086 - RNA, 18 nt, Human
uaaaauggaugccuugaa

SEQ ID NO: 3707087 - RNA, 20 nt, Human
uaaaauggcaacaaacugca

SEQ ID NO: 3707088 - RNA, 19 nt, Human
uaaaauggcaaguuuucca

SEQ ID NO: 3707089 - RNA, 15 nt, Human
uaaaauguaaacugu

SEQ ID NO: 3707090 - RNA, 18 nt, Human
uaaaauguaaagccaugc

SEQ ID NO: 3707091 - RNA, 15 nt, Human
uaaaauguaauuuaa

SEQ ID NO: 3707092 - RNA, 16 nt, Human
uaaaauguaauuuaaa

SEQ ID NO: 3707093 - RNA, 21 nt, Human
uaaaauguaauuuaaaugaaa

SEQ ID NO: 3707094 - RNA, 15 nt, Human
uaaaauguacaugua

SEQ ID NO: 3707095 - RNA, 16 nt, Human
uaaaauguaucuucca

SEQ ID NO: 3707096 - RNA, 20 nt, Human
uaaaauguauuauguccugu

SEQ ID NO: 3707097 - RNA, 14 nt, Human
uaaaaugucuucaa

SEQ ID NO: 3707098 - RNA, 21 nt, Human
uaaaaugugauguucuaaggc

SEQ ID NO: 3707099 - RNA, 19 nt, Human
uaaaaugugauuuuucuga

SEQ ID NO: 3707100 - RNA, 13 nt, Human
uaaaaugugcagu

SEQ ID NO: 3707101 - RNA, 15 nt, Human
uaaaauguugaaaag

SEQ ID NO: 3707102 - RNA, 14 nt, Human
uaaaauguugaaua

SEQ ID NO: 3707103 - RNA, 12 nt, Human
uaaaauguuuuc

SEQ ID NO: 3707104 - RNA, 21 nt, Human
uaaaauguuuucagcuaggaa

SEQ ID NO: 3707105 - RNA, 23 nt, Human
uaaaauguuuucagcuaggaaca

SEQ ID NO: 3707106 - RNA, 14 nt, Human
uaaaauuaaagcua

SEQ ID NO: 3707107 - RNA, 10 nt, Human
uaaaauuaag

SEQ ID NO: 3707108 - RNA, 15 nt, Human
uaaaauuacaacuaa

SEQ ID NO: 3707109 - RNA, 11 nt, Human
uaaaauuagau

SEQ ID NO: 3707110 - RNA, 14 nt, Human
uaaaauuauacugu

SEQ ID NO: 3707111 - RNA, 15 nt, Human
uaaaauuauagcucu

SEQ ID NO: 3707112 - RNA, 20 nt, Human
uaaaauuauagcucuaaugu

SEQ ID NO: 3707113 - RNA, 21 nt, Human
uaaaauuauagcucuaauguu

SEQ ID NO: 3707114 - RNA, 21 nt, Human
uaaaauuaucaccuuugucag

SEQ ID NO: 3707115 - RNA, 15 nt, Human
uaaaauuaugagauu

SEQ ID NO: 3707116 - RNA, 22 nt, Human
uaaaauuaugagauugguuuuc

SEQ ID NO: 3707117 - RNA, 16 nt, Human
uaaaauuauggaaaca

SEQ ID NO: 3707118 - RNA, 14 nt, Human
uaaaauuauuccuu

SEQ ID NO: 3707119 - RNA, 15 nt, Human
uaaaauuauuucaug

SEQ ID NO: 3707120 - RNA, 12 nt, Human
uaaaauucuaaa

SEQ ID NO: 3707121 - RNA, 14 nt, Human
uaaaauucuaaaua

SEQ ID NO: 3707122 - RNA, 12 nt, Human
uaaaauugccau

SEQ ID NO: 3707123 - RNA, 14 nt, Human
uaaaauugccauau

SEQ ID NO: 3707124 - RNA, 14 nt, Human
uaaaauuguaaaau

SEQ ID NO: 3707125 - RNA, 22 nt, Human
uaaaauuguaaaauuguauaga

SEQ ID NO: 3707126 - RNA, 16 nt, Human
uaaaauugugaugugu

SEQ ID NO: 3707127 - RNA, 15 nt, Human
uaaaauuguuaucaa

SEQ ID NO: 3707128 - RNA, 17 nt, Human
uaaaauuuauauuguaa

SEQ ID NO: 3707129 - RNA, 23 nt, Human
uaaaauuuauugcuugauacuuu

SEQ ID NO: 3707130 - RNA, 21 nt, Human
uaaaauuuccccuaaucuuuu

SEQ ID NO: 3707131 - RNA, 18 nt, Human
uaaaauuucuuagaaaac

SEQ ID NO: 3707132 - RNA, 9 nt, Human
uaaaauuug

SEQ ID NO: 3707133 - RNA, 21 nt, Human
uaaaauuugaaacauugcuuu

SEQ ID NO: 3707134 - RNA, 14 nt, Human
uaaaauuuguugca

SEQ ID NO: 3707135 - RNA, 15 nt, Human
uaaaauuuguugcau

SEQ ID NO: 3707136 - RNA, 18 nt, Human
uaaaauuuuaagcuagga

SEQ ID NO: 3707137 - RNA, 19 nt, Human
uaaaauuuuaagcuaggaa

SEQ ID NO: 3707138 - RNA, 17 nt, Human
uaaaauuuuaggcaagu

SEQ ID NO: 3707139 - RNA, 17 nt, Human
uaaaauuuuaucucuua

SEQ ID NO: 3707140 - RNA, 19 nt, Human
uaaaauuuugccuaauaca

SEQ ID NO: 3707141 - RNA, 19 nt, Human
uaaaauuuuuaaucuuuaa

SEQ ID NO: 3707142 - RNA, 17 nt, Human
uaaaauuuuuuuagaaa

SEQ ID NO: 3707143 - RNA, 19 nt, Human
uaaaauuuuuuuagaaagc

SEQ ID NO: 3707144 - RNA, 22 nt, Human
uaaaauuuuuuuggucuuuuug

SEQ ID NO: 3707145 - RNA, 17 nt, Human
uaaaauuuuuuuucaug

SEQ ID NO: 3707146 - RNA, 20 nt, Human
uaaaauuuuuuuucauguuu

SEQ ID NO: 3707147 - RNA, 18 nt, Human
uaaacaaaauagaaaguu

SEQ ID NO: 3707148 - RNA, 15 nt, Human
uaaacaaacauugug

SEQ ID NO: 3707149 - RNA, 14 nt, Human
uaaacaaaccagaa

SEQ ID NO: 3707150 - RNA, 22 nt, Human
uaaacaaacuguguaacugccc

SEQ ID NO: 3707151 - RNA, 16 nt, Human
uaaacaaagauucaug

SEQ ID NO: 3707152 - RNA, 18 nt, Human
uaaacaaagauucaugau

SEQ ID NO: 3707153 - RNA, 14 nt, Human
uaaacaaaguuacu

SEQ ID NO: 3707154 - RNA, 15 nt, Human
uaaacaaaguuacua

SEQ ID NO: 3707155 - RNA, 18 nt, Human
uaaacaaaguuucagagu

SEQ ID NO: 3707156 - RNA, 13 nt, Human
uaaacaaaucuuu

SEQ ID NO: 3707157 - RNA, 17 nt, Human
uaaacaagaaaaauaaa

SEQ ID NO: 3707158 - RNA, 18 nt, Human
uaaacaagaaaaauaaag

SEQ ID NO: 3707159 - RNA, 20 nt, Human
uaaacaagaaaaauaaagaa

SEQ ID NO: 3707160 - RNA, 20 nt, Human
uaaacaagaaucagucuauc

SEQ ID NO: 3707161 - RNA, 22 nt, Human
uaaacaaguauuuguuaauuua

SEQ ID NO: 3707162 - RNA, 18 nt, Human
uaaacaauuuauuuuauu

SEQ ID NO: 3707163 - RNA, 22 nt, Human
uaaacacaagauugguguuuuu

SEQ ID NO: 3707164 - RNA, 12 nt, Human
uaaacacacaga

SEQ ID NO: 3707165 - RNA, 18 nt, Human
uaaacacacagauacaca

SEQ ID NO: 3707166 - RNA, 22 nt, Human
uaaacacacagauacacacaca

SEQ ID NO: 3707167 - RNA, 14 nt, Human
uaaacacagacagg

SEQ ID NO: 3707168 - RNA, 18 nt, Human
uaaacacagucaaaauaa

SEQ ID NO: 3707169 - RNA, 22 nt, Human
uaaacacccaugaaucaaagac

SEQ ID NO: 3707170 - RNA, 18 nt, Human
uaaacacccuucacauac

SEQ ID NO: 3707171 - RNA, 14 nt, Human
uaaacacucaccuu

SEQ ID NO: 3707172 - RNA, 12 nt, Human
uaaacacucagc

SEQ ID NO: 3707173 - RNA, 16 nt, Human
uaaacacucagcuguu

SEQ ID NO: 3707174 - RNA, 15 nt, Human
uaaacacucuugaaa

SEQ ID NO: 3707175 - RNA, 17 nt, Human
uaaacacucuugaaaaa

SEQ ID NO: 3707176 - RNA, 18 nt, Human
uaaacacucuugaaaaau

SEQ ID NO: 3707177 - RNA, 14 nt, Human
uaaacacugcgcuu

SEQ ID NO: 3707178 - RNA, 16 nt, Human
uaaacacuugcaaccu

SEQ ID NO: 3707179 - RNA, 12 nt, Human
uaaacagaaaug

SEQ ID NO: 3707180 - RNA, 14 nt, Human
uaaacagaaaugga

SEQ ID NO: 3707181 - RNA, 17 nt, Human
uaaacagaugaugagaa

SEQ ID NO: 3707182 - RNA, 18 nt, Human
uaaacagaugaugagaau

SEQ ID NO: 3707183 - RNA, 19 nt, Human
uaaacagaugaugagaauu

SEQ ID NO: 3707184 - RNA, 21 nt, Human
uaaacagauguccaucagaug

SEQ ID NO: 3707185 - RNA, 15 nt, Human
uaaacagauuuuuac

SEQ ID NO: 3707186 - RNA, 22 nt, Human
uaaacagcaguguuccccaucu

SEQ ID NO: 3707187 - RNA, 18 nt, Human
uaaacagcuucaugccuu

SEQ ID NO: 3707188 - RNA, 12 nt, Human
uaaacaggccca

SEQ ID NO: 3707189 - RNA, 19 nt, Human
uaaacagggcaucuccagg

SEQ ID NO: 3707190 - RNA, 18 nt, Human
uaaacagugccugcugaa

SEQ ID NO: 3707191 - RNA, 13 nt, Human
uaaacaguucuug

SEQ ID NO: 3707192 - RNA, 16 nt, Human
uaaacaguugcacagc

SEQ ID NO: 3707193 - RNA, 17 nt, Human
uaaacaguugcacagca

SEQ ID NO: 3707194 - RNA, 17 nt, Human
uaaacauaaauaaauau

SEQ ID NO: 3707195 - RNA, 23 nt, Human
uaaacauaaguguacgauucuua

SEQ ID NO: 3707196 - RNA, 20 nt, Human
uaaacauaauucuuguauau

SEQ ID NO: 3707197 - RNA, 19 nt, Human
uaaacauauccaaguuuga

SEQ ID NO: 3707198 - RNA, 15 nt, Human
uaaacaucacacaca

SEQ ID NO: 3707199 - RNA, 19 nt, Human
uaaacaugcuguacauacu

SEQ ID NO: 3707200 - RNA, 20 nt, Human
uaaacaugcuguacauacuu

SEQ ID NO: 3707201 - RNA, 21 nt, Human
uaaacauuaaaugucuuauau

SEQ ID NO: 3707202 - RNA, 22 nt, Human
uaaacauuaauagcagccuuuc

SEQ ID NO: 3707203 - RNA, 18 nt, Human
uaaacauuaguucuauuu

SEQ ID NO: 3707204 - RNA, 23 nt, Human
uaaacauuaguucuauuucuauc

SEQ ID NO: 3707205 - RNA, 19 nt, Human
uaaacauuauuaaguaacu

SEQ ID NO: 3707206 - RNA, 20 nt, Human
uaaacauugacgauuccuuc

SEQ ID NO: 3707207 - RNA, 16 nt, Human
uaaaccaaaaacugaa

SEQ ID NO: 3707208 - RNA, 21 nt, Human
uaaaccaaaggacauuaugug

SEQ ID NO: 3707209 - RNA, 15 nt, Human
uaaaccaaggacuga

SEQ ID NO: 3707210 - RNA, 21 nt, Human
uaaaccacaaggcuguugcau

SEQ ID NO: 3707211 - RNA, 22 nt, Human
uaaaccaccagugcccaaaguc

SEQ ID NO: 3707212 - RNA, 19 nt, Human
uaaaccaguuuagauuuca

SEQ ID NO: 3707213 - RNA, 22 nt, Human
uaaaccaucucccuggugcuua

SEQ ID NO: 3707214 - RNA, 14 nt, Human
uaaaccauugugca

SEQ ID NO: 3707215 - RNA, 19 nt, Human
uaaaccauuuuuguuacuc

SEQ ID NO: 3707216 - RNA, 19 nt, Human
uaaacccaguaguggugac

SEQ ID NO: 3707217 - RNA, 17 nt, Human
uaaaccgcuaaaagaaa

SEQ ID NO: 3707218 - RNA, 15 nt, Human
uaaaccucaguuauu

SEQ ID NO: 3707219 - RNA, 15 nt, Human
uaaaccuccgccaau

SEQ ID NO: 3707220 - RNA, 18 nt, Human
uaaaccucuaauuuauuu

SEQ ID NO: 3707221 - RNA, 20 nt, Human
uaaaccugucuccacugugc

SEQ ID NO: 3707222 - RNA, 14 nt, Human
uaaaccuuaauauu

SEQ ID NO: 3707223 - RNA, 22 nt, Human
uaaacgaaacaaagacaauuua

SEQ ID NO: 3707224 - RNA, 18 nt, Human
uaaacgauuuuuaaaaug

SEQ ID NO: 3707225 - RNA, 14 nt, Human
uaaacggauuauuu

SEQ ID NO: 3707226 - RNA, 21 nt, Human
uaaacggauuauuuuuucaga

SEQ ID NO: 3707227 - RNA, 17 nt, Human
uaaacguaagcacuguu

SEQ ID NO: 3707228 - RNA, 23 nt, Human
uaaacguggagaaucacaggcug

SEQ ID NO: 3707229 - RNA, 18 nt, Human
uaaacguguauguuuuuc

SEQ ID NO: 3707230 - RNA, 17 nt, Human
uaaacuaaagaaaaauu

SEQ ID NO: 3707231 - RNA, 14 nt, Human
uaaacuaaaugugc

SEQ ID NO: 3707232 - RNA, 14 nt, Human
uaaacuacucuuug

SEQ ID NO: 3707233 - RNA, 17 nt, Human
uaaacuagaugaccuca

SEQ ID NO: 3707234 - RNA, 14 nt, Human
uaaacuaggaaaau

SEQ ID NO: 3707235 - RNA, 17 nt, Human
uguuagauguuuguuga

SEQ ID NO: 3707236 - RNA, 20 nt, Human
uguuagauuaagaaauagac

SEQ ID NO: 3707237 - RNA, 12 nt, Human
uguuagcacugu

SEQ ID NO: 3707238 - RNA, 21 nt, Human
uguuagcccaagguuaaaaag

SEQ ID NO: 3707239 - RNA, 18 nt, Human
uguuagcuccaaagcauu

SEQ ID NO: 3707240 - RNA, 16 nt, Human
uguuaggaaaauuuca

SEQ ID NO: 3707241 - RNA, 13 nt, Human
uguuaguaacaug

SEQ ID NO: 3707242 - RNA, 15 nt, Human
uguuaguaauaccuc

SEQ ID NO: 3707243 - RNA, 16 nt, Human
uguuaguaauaccucu

SEQ ID NO: 3707244 - RNA, 22 nt, Human
uguuaguacuauaucuguuuua

SEQ ID NO: 3707245 - RNA, 20 nt, Human
uguuaguagaaauuuuacaa

SEQ ID NO: 3707246 - RNA, 15 nt, Human
uguuagucauuugcu

SEQ ID NO: 3707247 - RNA, 14 nt, Human
uguuaguggcaccg

SEQ ID NO: 3707248 - RNA, 22 nt, Human
uguuaguguuuuaagaaaugua

SEQ ID NO: 3707249 - RNA, 23 nt, Human
uguuaguuaccuuauaguuacug

SEQ ID NO: 3707250 - RNA, 12 nt, Human
uguuaguuccca

SEQ ID NO: 3707251 - RNA, 22 nt, Human
uguuaguuccuguaugaaagau

SEQ ID NO: 3707252 - RNA, 14 nt, Human
uguuauaacucugc

SEQ ID NO: 3707253 - RNA, 18 nt, Human
uguuauaacucugcacua

SEQ ID NO: 3707254 - RNA, 23 nt, Human
uguuauaacucugcacuacuccu

SEQ ID NO: 3707255 - RNA, 15 nt, Human
uguuauauaauuuag

SEQ ID NO: 3707256 - RNA, 15 nt, Human
uguuauauauaaaua

SEQ ID NO: 3707257 - RNA, 17 nt, Human
uguuauauauaaauaua

SEQ ID NO: 3707258 - RNA, 18 nt, Human
uguuauauauaaauauau

SEQ ID NO: 3707259 - RNA, 19 nt, Human
uguuauauccccugcuacc

SEQ ID NO: 3707260 - RNA, 13 nt, Human
uguuauaugaaca

SEQ ID NO: 3707261 - RNA, 19 nt, Human
uguuauauguuguucuuac

SEQ ID NO: 3707262 - RNA, 16 nt, Human
uguuauauuaagcaga

SEQ ID NO: 3707263 - RNA, 20 nt, Human
uguuaucaaaacuuucuuuu

SEQ ID NO: 3707264 - RNA, 19 nt, Human
uguuaucaccgugggcucc

SEQ ID NO: 3707265 - RNA, 18 nt, Human
uguuaucauuuuuuccug

SEQ ID NO: 3707266 - RNA, 13 nt, Human
uguuauccuauuu

SEQ ID NO: 3707267 - RNA, 14 nt, Human
uguuaucuguuuga

SEQ ID NO: 3707268 - RNA, 18 nt, Human
uguuaucuguuugagaaa

SEQ ID NO: 3707269 - RNA, 19 nt, Human
uguuaucuuauacuguaca

SEQ ID NO: 3707270 - RNA, 21 nt, Human
uguuaucuuauacuguacaau

SEQ ID NO: 3707271 - RNA, 12 nt, Human
uguuaugauaaa

SEQ ID NO: 3707272 - RNA, 14 nt, Human
uguuaugaugugcu

SEQ ID NO: 3707273 - RNA, 17 nt, Human
uguuaugaugugcuuaa

SEQ ID NO: 3707274 - RNA, 19 nt, Human
uguuaugaugugcuuaaca

SEQ ID NO: 3707275 - RNA, 14 nt, Human
uguuauggaaacug

SEQ ID NO: 3707276 - RNA, 18 nt, Human
uguuauggcuuaaugaca

SEQ ID NO: 3707277 - RNA, 15 nt, Human
uguuaugguagaaaa

SEQ ID NO: 3707278 - RNA, 16 nt, Human
uguuaugguagaaaaa

SEQ ID NO: 3707279 - RNA, 16 nt, Human
uguuauguacuguacu

SEQ ID NO: 3707280 - RNA, 13 nt, Human
uguuauguauuuc

SEQ ID NO: 3707281 - RNA, 21 nt, Human
uguuaugucuguuuaagaaaa

SEQ ID NO: 3707282 - RNA, 20 nt, Human
uguuauuaaacguaugcaug

SEQ ID NO: 3707283 - RNA, 21 nt, Human
uguuauuaaacguaugcaugu

SEQ ID NO: 3707284 - RNA, 14 nt, Human
uguuauugaaaaaa

SEQ ID NO: 3707285 - RNA, 20 nt, Human
uguuauugagagagaugugu

SEQ ID NO: 3707286 - RNA, 12 nt, Human
uguuauugugaa

SEQ ID NO: 3707287 - RNA, 19 nt, Human
uguuauuuaacccauuugu

SEQ ID NO: 3707288 - RNA, 18 nt, Human
uguuauuuauugaaauga

SEQ ID NO: 3707289 - RNA, 14 nt, Human
uguuauuucugcaa

SEQ ID NO: 3707290 - RNA, 15 nt, Human
uguuauuucugcaaa

SEQ ID NO: 3707291 - RNA, 16 nt, Human
uguuauuuguacaguu

SEQ ID NO: 3707292 - RNA, 19 nt, Human
uguuauuuuaaucucagaa

SEQ ID NO: 3707293 - RNA, 18 nt, Human
uguuauuuucaaguagcu

SEQ ID NO: 3707294 - RNA, 15 nt, Human
uguuauuuucagcau

SEQ ID NO: 3707295 - RNA, 19 nt, Human
uguuauuuucuuugaaauu

SEQ ID NO: 3707296 - RNA, 17 nt, Human
uguuauuuuucaaggaa

SEQ ID NO: 3707297 - RNA, 19 nt, Human
uguuauuuuucaaggaagg

SEQ ID NO: 3707298 - RNA, 21 nt, Human
uguuauuuuuguuucuuccaa

SEQ ID NO: 3707299 - RNA, 22 nt, Human
uguucaaacaauaucauaucau

SEQ ID NO: 3707300 - RNA, 22 nt, Human
uguucaaagccagcguccuccu

SEQ ID NO: 3707301 - RNA, 15 nt, Human
uguucaauauuuucu

SEQ ID NO: 3707302 - RNA, 16 nt, Human
uguucaauguuuaaug

SEQ ID NO: 3707303 - RNA, 16 nt, Human
uguucacaauauauuu

SEQ ID NO: 3707304 - RNA, 16 nt, Human
uguucacacucucaca

SEQ ID NO: 3707305 - RNA, 16 nt, Human
uguucacagccagacu

SEQ ID NO: 3707306 - RNA, 16 nt, Human
uguucaccaucggcag

SEQ ID NO: 3707307 - RNA, 18 nt, Human
uguucacuggacacuuca

SEQ ID NO: 3707308 - RNA, 13 nt, Human
uguucacuguccc

SEQ ID NO: 3707309 - RNA, 16 nt, Human
uguucacuuuuccucc

SEQ ID NO: 3707310 - RNA, 15 nt, Human
uguucagaagaaauu

SEQ ID NO: 3707311 - RNA, 18 nt, Human
uguucagaagguugcucu

SEQ ID NO: 3707312 - RNA, 18 nt, Human
uguucagcacugucccuu

SEQ ID NO: 3707313 - RNA, 14 nt, Human
uguucagcuccagc

SEQ ID NO: 3707314 - RNA, 20 nt, Human
uguucagcuccagcucacca

SEQ ID NO: 3707315 - RNA, 11 nt, Human
uguucagcugg

SEQ ID NO: 3707316 - RNA, 21 nt, Human
uguucagcuguccucccucca

SEQ ID NO: 3707317 - RNA, 17 nt, Human
uguucagugucccgggc

SEQ ID NO: 3707318 - RNA, 18 nt, Human
uguucaguuacagaaagu

SEQ ID NO: 3707319 - RNA, 14 nt, Human
uguucauacauauu

SEQ ID NO: 3707320 - RNA, 14 nt, Human
uguucauagcccag

SEQ ID NO: 3707321 - RNA, 15 nt, Human
uguucauagcccagu

SEQ ID NO: 3707322 - RNA, 19 nt, Human
uguucauagcccaguagac

SEQ ID NO: 3707323 - RNA, 22 nt, Human
uguucaucaacagugagagacu

SEQ ID NO: 3707324 - RNA, 15 nt, Human
uguucaucauccaga

SEQ ID NO: 3707325 - RNA, 16 nt, Human
uguucaucauccagau

SEQ ID NO: 3707326 - RNA, 14 nt, Human
uguucaucuguaac

SEQ ID NO: 3707327 - RNA, 13 nt, Human
uguucauggcaga

SEQ ID NO: 3707328 - RNA, 19 nt, Human
uguucauuguaauguuacu

SEQ ID NO: 3707329 - RNA, 20 nt, Human
uguucauuguaauguuacug

SEQ ID NO: 3707330 - RNA, 14 nt, Human
uguucauuuccuca

SEQ ID NO: 3707331 - RNA, 18 nt, Human
uguucauuuugagcugaa

SEQ ID NO: 3707332 - RNA, 10 nt, Human
uguuccaaau

SEQ ID NO: 3707333 - RNA, 17 nt, Human
uguuccaaaugaauguu

SEQ ID NO: 3707334 - RNA, 14 nt, Human
uguuccaacugccc

SEQ ID NO: 3707335 - RNA, 18 nt, Human
uguuccaagacauuguca

SEQ ID NO: 3707336 - RNA, 21 nt, Human
uguuccaagacauugucaaua

SEQ ID NO: 3707337 - RNA, 18 nt, Human
uguuccaaugucaaugug

SEQ ID NO: 3707338 - RNA, 19 nt, Human
uguuccacaaguuaaauaa

SEQ ID NO: 3707339 - RNA, 20 nt, Human
uguuccacaaguuaaauaaa

SEQ ID NO: 3707340 - RNA, 22 nt, Human
uguucccaagagcaucaugccu

SEQ ID NO: 3707341 - RNA, 19 nt, Human
uguucccauccucuucuuu

SEQ ID NO: 3707342 - RNA, 17 nt, Human
uguuccccacuggagca

SEQ ID NO: 3707343 - RNA, 16 nt, Human
uguucccccgccgcuu

SEQ ID NO: 3707344 - RNA, 21 nt, Human
uguucccccgccgcuuuucuc

SEQ ID NO: 3707345 - RNA, 12 nt, Human
uguuccccuccu

SEQ ID NO: 3707346 - RNA, 23 nt, Human
uguuccccuccuccacucucccc

SEQ ID NO: 3707347 - RNA, 14 nt, Human
uguuccccucuccc

SEQ ID NO: 3707348 - RNA, 17 nt, Human
uguuccccucucccuuc

SEQ ID NO: 3707349 - RNA, 21 nt, Human
uguuccccucucccuucccuc

SEQ ID NO: 3707350 - RNA, 15 nt, Human
uguuccccucuuguc

SEQ ID NO: 3707351 - RNA, 18 nt, Human
uguuccccucuugucucc

SEQ ID NO: 3707352 - RNA, 14 nt, Human
uguuccccuuccac

SEQ ID NO: 3707353 - RNA, 21 nt, Human
uguuccccuuccacugagggc

SEQ ID NO: 3707354 - RNA, 22 nt, Human
uguuccccuuugcuucauucaa

SEQ ID NO: 3707355 - RNA, 16 nt, Human
uguucccuauccaauc

SEQ ID NO: 3707356 - RNA, 22 nt, Human
uguucccuauuuuucucuccug

SEQ ID NO: 3707357 - RNA, 16 nt, Human
uguucccucugcuccu

SEQ ID NO: 3707358 - RNA, 21 nt, Human
uguuccuauauuccagguuua

SEQ ID NO: 3707359 - RNA, 12 nt, Human
uguuccugcugc

SEQ ID NO: 3707360 - RNA, 13 nt, Human
uguuccugcugcu

SEQ ID NO: 3707361 - RNA, 23 nt, Human
uguuccuggaggucagcauuuga

SEQ ID NO: 3707362 - RNA, 22 nt, Human
uguuccuuccagugucauuucu

SEQ ID NO: 3707363 - RNA, 15 nt, Human
uguucgcgugugugg

SEQ ID NO: 3707364 - RNA, 19 nt, Human
uguucgcuuggcuccaugc

SEQ ID NO: 3707365 - RNA, 19 nt, Human
uguucguucuuguucuguu

SEQ ID NO: 3707366 - RNA, 16 nt, Human
uguucuaaagcucuga

SEQ ID NO: 3707367 - RNA, 22 nt, Human
uguucuaaauaucccuuggaca

SEQ ID NO: 3707368 - RNA, 13 nt, Human
uguucuaagaugu

SEQ ID NO: 3707369 - RNA, 15 nt, Human
uguucuaaggcucug

SEQ ID NO: 3707370 - RNA, 23 nt, Human
uguucuaaggcucugagagucua

SEQ ID NO: 3707371 - RNA, 16 nt, Human
uguucuaaguuucuaa

SEQ ID NO: 3707372 - RNA, 17 nt, Human
uguucuaaguuucuaag

SEQ ID NO: 3707373 - RNA, 19 nt, Human
uguucuaaguuucuaagau

SEQ ID NO: 3707374 - RNA, 22 nt, Human
uguucuaaguuucuaagauucu

SEQ ID NO: 3707375 - RNA, 13 nt, Human
uguucuauccaaa

SEQ ID NO: 3707376 - RNA, 16 nt, Human
uguucuauucaucuca

SEQ ID NO: 3707377 - RNA, 21 nt, Human
uguucuauuucagugccaaua

SEQ ID NO: 3707378 - RNA, 17 nt, Human
uguucucacacuggucu

SEQ ID NO: 3707379 - RNA, 17 nt, Human
uguucucagcucccccu

SEQ ID NO: 3707380 - RNA, 20 nt, Human
uguucucagcucccccuguc

SEQ ID NO: 3707381 - RNA, 17 nt, Human
uguucucccuucggugg

SEQ ID NO: 3707382 - RNA, 11 nt, Human
uguucuccugc

SEQ ID NO: 3707383 - RNA, 22 nt, Human
uguucuccugcugcucccucag

SEQ ID NO: 3707384 - RNA, 15 nt, Human
uguucucuaucauuu

SEQ ID NO: 3707385 - RNA, 19 nt, Human
uggggucaggccgggcaga

SEQ ID NO: 3707386 - RNA, 14 nt, Human
uggggucccagcag

SEQ ID NO: 3707387 - RNA, 15 nt, Human
uggggucccagcagc

SEQ ID NO: 3707388 - RNA, 20 nt, Human
ugggguccuggagcagacca

SEQ ID NO: 3707389 - RNA, 15 nt, Human
ugggguccuggccau

SEQ ID NO: 3707390 - RNA, 16 nt, Human
ugggguccuggccauc

SEQ ID NO: 3707391 - RNA, 19 nt, Human
ugggguccuggccauccca

SEQ ID NO: 3707392 - RNA, 22 nt, Human
ugggguccuguggggcccccac

SEQ ID NO: 3707393 - RNA, 23 nt, Human
ugggguccuguggggcccccaca

SEQ ID NO: 3707394 - RNA, 23 nt, Human
uggggucucacaguguugcccag

SEQ ID NO: 3707395 - RNA, 13 nt, Human
uggggucucccuc

SEQ ID NO: 3707396 - RNA, 17 nt, Human
uggggucucucacagac

SEQ ID NO: 3707397 - RNA, 21 nt, Human
uggggucucucacagacagga

SEQ ID NO: 3707398 - RNA, 17 nt, Human
uggggucuggcagccuc

SEQ ID NO: 3707399 - RNA, 18 nt, Human
uggggucuggcagccucc

SEQ ID NO: 3707400 - RNA, 14 nt, Human
uggggugacaguca

SEQ ID NO: 3707401 - RNA, 23 nt, Human
uggggugacagucaucaucaggg

SEQ ID NO: 3707402 - RNA, 22 nt, Human
uggggugacccggcacccccug

SEQ ID NO: 3707403 - RNA, 23 nt, Human
uggggugacccggcacccccugc

SEQ ID NO: 3707404 - RNA, 14 nt, Human
uggggugaggacca

SEQ ID NO: 3707405 - RNA, 17 nt, Human
uggggugaggaccacuc

SEQ ID NO: 3707406 - RNA, 15 nt, Human
uggggugcagggaug

SEQ ID NO: 3707407 - RNA, 18 nt, Human
uggggugcagggaugugg

SEQ ID NO: 3707408 - RNA, 19 nt, Human
uggggugcagggauguggg

SEQ ID NO: 3707409 - RNA, 13 nt, Human
uggggugcuggga

SEQ ID NO: 3707410 - RNA, 12 nt, Human
ugggguggcugc

SEQ ID NO: 3707411 - RNA, 15 nt, Human
uggggugggagaggu

SEQ ID NO: 3707412 - RNA, 17 nt, Human
ugggguggggaccucag

SEQ ID NO: 3707413 - RNA, 19 nt, Human
ugggguggggggggugcug

SEQ ID NO: 3707414 - RNA, 14 nt, Human
uggggugguugagg

SEQ ID NO: 3707415 - RNA, 15 nt, Human
uggggugugggaggc

SEQ ID NO: 3707416 - RNA, 23 nt, Human
ugggguuaucugaagucagaucu

SEQ ID NO: 3707417 - RNA, 15 nt, Human
ugggguucagccccu

SEQ ID NO: 3707418 - RNA, 17 nt, Human
ugggguucagccccucc

SEQ ID NO: 3707419 - RNA, 14 nt, Human
ugggguucguggaa

SEQ ID NO: 3707420 - RNA, 18 nt, Human
ugggguuggcugggccca

SEQ ID NO: 3707421 - RNA, 19 nt, Human
ugggguugggauugggggc

SEQ ID NO: 3707422 - RNA, 14 nt, Human
ugggguuuccuggc

SEQ ID NO: 3707423 - RNA, 23 nt, Human
uggguaaaauacuuuuacucugc

SEQ ID NO: 3707424 - RNA, 14 nt, Human
uggguaaaauuaga

SEQ ID NO: 3707425 - RNA, 15 nt, Human
uggguaaaauuagau

SEQ ID NO: 3707426 - RNA, 18 nt, Human
uggguaaucgauggggga

SEQ ID NO: 3707427 - RNA, 16 nt, Human
uggguacuucuugaag

SEQ ID NO: 3707428 - RNA, 17 nt, Human
uggguagacacacauga

SEQ ID NO: 3707429 - RNA, 12 nt, Human
uggguauaaaag

SEQ ID NO: 3707430 - RNA, 15 nt, Human
uggguauaaaagaug

SEQ ID NO: 3707431 - RNA, 17 nt, Human
uggguauaaaagauggg

SEQ ID NO: 3707432 - RNA, 20 nt, Human
uggguauaguucaugucugc

SEQ ID NO: 3707433 - RNA, 20 nt, Human
uggguaucaaacagcucagg

SEQ ID NO: 3707434 - RNA, 18 nt, Human
uggguaucaagacauagc

SEQ ID NO: 3707435 - RNA, 19 nt, Human
uggguauccugcccagugu

SEQ ID NO: 3707436 - RNA, 20 nt, Human
uggguauccugcccaguguu

SEQ ID NO: 3707437 - RNA, 17 nt, Human
uggguauguguaggcag

SEQ ID NO: 3707438 - RNA, 19 nt, Human
ugggucagaacccugccau

SEQ ID NO: 3707439 - RNA, 13 nt, Human
ugggucaggcagg

SEQ ID NO: 3707440 - RNA, 14 nt, Human
ugggucaggccacc

SEQ ID NO: 3707441 - RNA, 22 nt, Human
uggguccaaauaaaaacuaaau

SEQ ID NO: 3707442 - RNA, 14 nt, Human
uggguccaggagga

SEQ ID NO: 3707443 - RNA, 21 nt, Human
uggguccaggccuacuccugu

SEQ ID NO: 3707444 - RNA, 15 nt, Human
uggguccaggggaug

SEQ ID NO: 3707445 - RNA, 20 nt, Human
uggguccaggggaugggagg

SEQ ID NO: 3707446 - RNA, 18 nt, Human
uggguccaggggccccuc

SEQ ID NO: 3707447 - RNA, 14 nt, Human
uggguccaugggca

SEQ ID NO: 3707448 - RNA, 19 nt, Human
ugggucccacuuccccucc

SEQ ID NO: 3707449 - RNA, 18 nt, Human
ugggucccccucagcaag

SEQ ID NO: 3707450 - RNA, 14 nt, Human
uggguccugaagaa

SEQ ID NO: 3707451 - RNA, 15 nt, Human
uggguccuuccugaa

SEQ ID NO: 3707452 - RNA, 18 nt, Human
ugggucgcccuggacugu

SEQ ID NO: 3707453 - RNA, 22 nt, Human
ugggucuaggacacaguuccug

SEQ ID NO: 3707454 - RNA, 15 nt, Human
ugggucuauuccagc

SEQ ID NO: 3707455 - RNA, 18 nt, Human
ugggucuauuccagcuca

SEQ ID NO: 3707456 - RNA, 19 nt, Human
ugggucuauuccagcucau

SEQ ID NO: 3707457 - RNA, 20 nt, Human
ugggucuauuccagcucauu

SEQ ID NO: 3707458 - RNA, 23 nt, Human
ugggucucaccggcucucaccug

SEQ ID NO: 3707459 - RNA, 15 nt, Human
ugggucugggaguca

SEQ ID NO: 3707460 - RNA, 14 nt, Human
ugggucugugucuc

SEQ ID NO: 3707461 - RNA, 19 nt, Human
ugggucuguuuuccuuucu

SEQ ID NO: 3707462 - RNA, 22 nt, Human
ugggucuucagggggccaggug

SEQ ID NO: 3707463 - RNA, 20 nt, Human
ugggugaaagaaaucauguu

SEQ ID NO: 3707464 - RNA, 19 nt, Human
ugggugaaggcuggcauga

SEQ ID NO: 3707465 - RNA, 23 nt, Human
ugggugaccaguugcacuuggcc

SEQ ID NO: 3707466 - RNA, 16 nt, Human
ugggugagguaauaaa

SEQ ID NO: 3707467 - RNA, 18 nt, Human
ugggugcccaagcucaga

SEQ ID NO: 3707468 - RNA, 16 nt, Human
ugggugcccacagccc

SEQ ID NO: 3707469 - RNA, 19 nt, Human
ugggugcgaccccaucugc

SEQ ID NO: 3707470 - RNA, 21 nt, Human
ugggugcgaccccaucugccc

SEQ ID NO: 3707471 - RNA, 23 nt, Human
ugggugcgaccccaucugcccag

SEQ ID NO: 3707472 - RNA, 22 nt, Human
ugggugcucagaauaaggcagg

SEQ ID NO: 3707473 - RNA, 18 nt, Human
ugggugcugauccuugca

SEQ ID NO: 3707474 - RNA, 21 nt, Human
ugggugcugcuaauucuuugc

SEQ ID NO: 3707475 - RNA, 14 nt, Human
uggguggagaagcc

SEQ ID NO: 3707476 - RNA, 16 nt, Human
uggguggagaagccau

SEQ ID NO: 3707477 - RNA, 22 nt, Human
uggguggagaagccauugucuu

SEQ ID NO: 3707478 - RNA, 15 nt, Human
ugggugggcucugug

SEQ ID NO: 3707479 - RNA, 16 nt, Human
ugggugggcucugugc

SEQ ID NO: 3707480 - RNA, 13 nt, Human
uggguggggcugc

SEQ ID NO: 3707481 - RNA, 21 nt, Human
uggguggggcugcuccuccag

SEQ ID NO: 3707482 - RNA, 16 nt, Human
uggguggggggcuuca

SEQ ID NO: 3707483 - RNA, 15 nt, Human
ugggugggugguggg

SEQ ID NO: 3707484 - RNA, 14 nt, Human
ugggugguacccuc

SEQ ID NO: 3707485 - RNA, 15 nt, Human
uggguguaaacacau

SEQ ID NO: 3707486 - RNA, 22 nt, Human
uggguguaacaggucuccucuu

SEQ ID NO: 3707487 - RNA, 12 nt, Human
uggguguccugc

SEQ ID NO: 3707488 - RNA, 17 nt, Human
uggguguccugccuguc

SEQ ID NO: 3707489 - RNA, 19 nt, Human
uggguguccugccugucug

SEQ ID NO: 3707490 - RNA, 14 nt, Human
uggguguggcgcag

SEQ ID NO: 3707491 - RNA, 18 nt, Human
uggguguguguagccaag

SEQ ID NO: 3707492 - RNA, 14 nt, Human
uggguguuaauuuu

SEQ ID NO: 3707493 - RNA, 15 nt, Human
uggguguuccuggca

SEQ ID NO: 3707494 - RNA, 16 nt, Human
uggguuagacugccag

SEQ ID NO: 3707495 - RNA, 20 nt, Human
uggguuagacugccagcucu

SEQ ID NO: 3707496 - RNA, 16 nt, Human
uggguuagggaaaaca

SEQ ID NO: 3707497 - RNA, 14 nt, Human
uggguuaguggaug

SEQ ID NO: 3707498 - RNA, 16 nt, Human
uggguuauucuggagu

SEQ ID NO: 3707499 - RNA, 22 nt, Human
uggguucagaaaugcugccugc

SEQ ID NO: 3707500 - RNA, 17 nt, Human
uggguucaugaugcagu

SEQ ID NO: 3707501 - RNA, 11 nt, Human
uggguucauua

SEQ ID NO: 3707502 - RNA, 18 nt, Human
uggguucauuauuggaau

SEQ ID NO: 3707503 - RNA, 20 nt, Human
uggguucauuauuggaauua

SEQ ID NO: 3707504 - RNA, 18 nt, Human
uggguuccaauccuggcu

SEQ ID NO: 3707505 - RNA, 14 nt, Human
uggguuccacagac

SEQ ID NO: 3707506 - RNA, 13 nt, Human
uggguuccucuuc

SEQ ID NO: 3707507 - RNA, 22 nt, Human
uggguucuacccaggugcuagg

SEQ ID NO: 3707508 - RNA, 16 nt, Human
uggguucuauguuuac

SEQ ID NO: 3707509 - RNA, 17 nt, Human
uggguucugauauugcc

SEQ ID NO: 3707510 - RNA, 14 nt, Human
uggguucugggugg

SEQ ID NO: 3707511 - RNA, 23 nt, Human
uggguucuuuggaaggagugaga

SEQ ID NO: 3707512 - RNA, 21 nt, Human
uggguugcagacaggaaucuu

SEQ ID NO: 3707513 - RNA, 15 nt, Human
uggguugcuaacuga

SEQ ID NO: 3707514 - RNA, 15 nt, Human
uggguuggcgcaccc

SEQ ID NO: 3707515 - RNA, 22 nt, Human
uggguuggcgcacccuccccuc

SEQ ID NO: 3707516 - RNA, 19 nt, Human
uggguuggugcacagugau

SEQ ID NO: 3707517 - RNA, 16 nt, Human
uggguuggugcuucua

SEQ ID NO: 3707518 - RNA, 13 nt, Human
uggguuuauuugg

SEQ ID NO: 3707519 - RNA, 22 nt, Human
uggguuucacaagugaaaaaca

SEQ ID NO: 3707520 - RNA, 16 nt, Human
uggguuucuagcccau

SEQ ID NO: 3707521 - RNA, 14 nt, Human
uggguuugagaaau

SEQ ID NO: 3707522 - RNA, 24 nt, Human
uggguuuucuucccaucacuggag

SEQ ID NO: 3707523 - RNA, 22 nt, Human
uggguuuuuguuaccuuuaugg

SEQ ID NO: 3707524 - RNA, 14 nt, Human
ugguaaaacacuug

SEQ ID NO: 3707525 - RNA, 14 nt, Human
ugguaaaauugcau

SEQ ID NO: 3707526 - RNA, 13 nt, Human
ugguaaacuauuu

SEQ ID NO: 3707527 - RNA, 22 nt, Human
ugguaaagauauuauucaccau

SEQ ID NO: 3707528 - RNA, 13 nt, Human
ugguaaaugccac

SEQ ID NO: 3707529 - RNA, 21 nt, Human
ugguaaauuaguauuuauuua

SEQ ID NO: 3707530 - RNA, 18 nt, Human
ugguaacaguucauguuu

SEQ ID NO: 3707531 - RNA, 10 nt, Human
ugguaacauu

SEQ ID NO: 3707532 - RNA, 16 nt, Human
ugguaacuuuugugaa

SEQ ID NO: 3707533 - RNA, 23 nt, Human
ugguaagaaaaagcaaaaggcau

SEQ ID NO: 3707534 - RNA, 14 nt, Human
ugguaagagaaaag

SEQ ID NO: 3707535 - RNA, 18 nt, Human
uaaacuaguuuuuccuau

SEQ ID NO: 3707536 - RNA, 14 nt, Human
uaaacuauaaaaca

SEQ ID NO: 3707537 - RNA, 13 nt, Human
uaaacuaucaguu

SEQ ID NO: 3707538 - RNA, 14 nt, Human
uaaacuaucuuuuu

SEQ ID NO: 3707539 - RNA, 14 nt, Human
uaaacucaaaauau

SEQ ID NO: 3707540 - RNA, 16 nt, Human
uaaacucaaaauauuu

SEQ ID NO: 3707541 - RNA, 23 nt, Human
uaaacucaaaauauuuguacaua

SEQ ID NO: 3707542 - RNA, 11 nt, Human
uaaacucaggg

SEQ ID NO: 3707543 - RNA, 12 nt, Human
uaaacucauuuc

SEQ ID NO: 3707544 - RNA, 15 nt, Human
uaaacuccuguccuu

SEQ ID NO: 3707545 - RNA, 16 nt, Human
uaaacuccuuccuggc

SEQ ID NO: 3707546 - RNA, 21 nt, Human
uaaacucucuuugggaauguu

SEQ ID NO: 3707547 - RNA, 14 nt, Human
uaaacucugaauaa

SEQ ID NO: 3707548 - RNA, 22 nt, Human
uaaacucugaauaagcacuuuu

SEQ ID NO: 3707549 - RNA, 18 nt, Human
uaaacucugaauuuaucu

SEQ ID NO: 3707550 - RNA, 20 nt, Human
uaaacucuucacaaaaucug

SEQ ID NO: 3707551 - RNA, 15 nt, Human
uaaacugacuuuauc

SEQ ID NO: 3707552 - RNA, 10 nt, Human
uaaacugcau

SEQ ID NO: 3707553 - RNA, 13 nt, Human
uaaacugccauau

SEQ ID NO: 3707554 - RNA, 15 nt, Human
uaaacugcccugucu

SEQ ID NO: 3707555 - RNA, 16 nt, Human
uaaacugcccugucua

SEQ ID NO: 3707556 - RNA, 12 nt, Human
uaaacuggagac

SEQ ID NO: 3707557 - RNA, 14 nt, Human
uaaacuggagacug

SEQ ID NO: 3707558 - RNA, 20 nt, Human
uaaacuguacagugucuuuu

SEQ ID NO: 3707559 - RNA, 20 nt, Human
uaaacuguacuagucugugu

SEQ ID NO: 3707560 - RNA, 17 nt, Human
uaaacugucgugucaua

SEQ ID NO: 3707561 - RNA, 12 nt, Human
uaaacugugcac

SEQ ID NO: 3707562 - RNA, 16 nt, Human
uaaacuguuagcacug

SEQ ID NO: 3707563 - RNA, 23 nt, Human
uaaacuguuagcacuguugaugu

SEQ ID NO: 3707564 - RNA, 18 nt, Human
uaaacuguuucagauuuu

SEQ ID NO: 3707565 - RNA, 22 nt, Human
uaaacuuagugcggacaaguuu

SEQ ID NO: 3707566 - RNA, 16 nt, Human
uaaacuuauaaaucau

SEQ ID NO: 3707567 - RNA, 12 nt, Human
uaaacuuaugaa

SEQ ID NO: 3707568 - RNA, 18 nt, Human
uaaacuuaugaauguuuc

SEQ ID NO: 3707569 - RNA, 19 nt, Human
uaaacuuaugaauguuucc

SEQ ID NO: 3707570 - RNA, 18 nt, Human
uaaacuucauauguaauc

SEQ ID NO: 3707571 - RNA, 17 nt, Human
uaaacuuccaaagaaag

SEQ ID NO: 3707572 - RNA, 21 nt, Human
uaaacuuccaaagaaaguucu

SEQ ID NO: 3707573 - RNA, 21 nt, Human
uaaacuucucugaagggaggu

SEQ ID NO: 3707574 - RNA, 22 nt, Human
uaaacuugguuuuuaaaaaacu

SEQ ID NO: 3707575 - RNA, 13 nt, Human
uaaacuugugaau

SEQ ID NO: 3707576 - RNA, 20 nt, Human
uaaacuuguuugcugugaac

SEQ ID NO: 3707577 - RNA, 20 nt, Human
uaaacuuuacccaaaaacua

SEQ ID NO: 3707578 - RNA, 18 nt, Human
uaaacuuucuuaauauuu

SEQ ID NO: 3707579 - RNA, 13 nt, Human
uaaacuuugaaau

SEQ ID NO: 3707580 - RNA, 14 nt, Human
uaaacuuugaaaua

SEQ ID NO: 3707581 - RNA, 15 nt, Human
uaaacuuugaaauau

SEQ ID NO: 3707582 - RNA, 16 nt, Human
uaaacuuugaaauaua

SEQ ID NO: 3707583 - RNA, 14 nt, Human
uaaacuuuuaccac

SEQ ID NO: 3707584 - RNA, 17 nt, Human
uaaacuuuuuguucugg

SEQ ID NO: 3707585 - RNA, 16 nt, Human
uaaacuuuuuuucaau

SEQ ID NO: 3707586 - RNA, 17 nt, Human
uaaacuuuuuuucaaug

SEQ ID NO: 3707587 - RNA, 18 nt, Human
uaaacuuuuuuucaaugu

SEQ ID NO: 3707588 - RNA, 19 nt, Human
uaaacuuuuuuucaaugug

SEQ ID NO: 3707589 - RNA, 16 nt, Human
uaaacuuuuuuucugu

SEQ ID NO: 3707590 - RNA, 20 nt, Human
uaaacuuuuuuucuguacca

SEQ ID NO: 3707591 - RNA, 23 nt, Human
uaaagaaaaaaauguauuuuaug

SEQ ID NO: 3707592 - RNA, 23 nt, Human
uaaagaaaaaaauugaaauguaa

SEQ ID NO: 3707593 - RNA, 20 nt, Human
uaaagaaaaauaucuuggcc

SEQ ID NO: 3707594 - RNA, 22 nt, Human
uaaagaaaaauauuuaauguug

SEQ ID NO: 3707595 - RNA, 10 nt, Human
uaaagaaaag

SEQ ID NO: 3707596 - RNA, 16 nt, Human
uaaagaaaaguuuugu

SEQ ID NO: 3707597 - RNA, 22 nt, Human
uaaagaaaaguuuuguaaauuu

SEQ ID NO: 3707598 - RNA, 20 nt, Human
uaaagaaacagcuuucaagu

SEQ ID NO: 3707599 - RNA, 17 nt, Human
uaaagaaagagagaaaa

SEQ ID NO: 3707600 - RNA, 16 nt, Human
uaaagaaaggaaaaga

SEQ ID NO: 3707601 - RNA, 17 nt, Human
uaaagaaaggaaaagaa

SEQ ID NO: 3707602 - RNA, 21 nt, Human
uaaagaaagucgaauuaauag

SEQ ID NO: 3707603 - RNA, 13 nt, Human
uaaagaaagugua

SEQ ID NO: 3707604 - RNA, 17 nt, Human
uaaagaaaguguauuug

SEQ ID NO: 3707605 - RNA, 14 nt, Human
uaaagaaauaauuu

SEQ ID NO: 3707606 - RNA, 17 nt, Human
uaaagaaauagaacaag

SEQ ID NO: 3707607 - RNA, 15 nt, Human
uaaagaaaugucuua

SEQ ID NO: 3707608 - RNA, 17 nt, Human
uaaagaaauugcaauaa

SEQ ID NO: 3707609 - RNA, 18 nt, Human
uaaagaaauuuacuauau

SEQ ID NO: 3707610 - RNA, 15 nt, Human
uaaagaacauaaaua

SEQ ID NO: 3707611 - RNA, 23 nt, Human
uaaagaacugcacaugaagaaau

SEQ ID NO: 3707612 - RNA, 13 nt, Human
uaaagaagaaaaa

SEQ ID NO: 3707613 - RNA, 23 nt, Human
uaaagaagaaaaaaaaaaauuca

SEQ ID NO: 3707614 - RNA, 11 nt, Human
uaaagaagacc

SEQ ID NO: 3707615 - RNA, 16 nt, Human
uaaagaagaccugaga

SEQ ID NO: 3707616 - RNA, 21 nt, Human
uaaagaagcaauaaagaagag

SEQ ID NO: 3707617 - RNA, 14 nt, Human
uaaagaaguauuuu

SEQ ID NO: 3707618 - RNA, 14 nt, Human
uaaagaauacuuga

SEQ ID NO: 3707619 - RNA, 15 nt, Human
uaaagaauacuugaa

SEQ ID NO: 3707620 - RNA, 17 nt, Human
uaaagaauacuugaacu

SEQ ID NO: 3707621 - RNA, 20 nt, Human
uaaagaauacuugaacuugu

SEQ ID NO: 3707622 - RNA, 19 nt, Human
uaaagaauaggacuuguuu

SEQ ID NO: 3707623 - RNA, 17 nt, Human
uaaagaauaugaaacau

SEQ ID NO: 3707624 - RNA, 16 nt, Human
uaaagaauaugacuuu

SEQ ID NO: 3707625 - RNA, 19 nt, Human
uaaagaauaugacuuuuua

SEQ ID NO: 3707626 - RNA, 14 nt, Human
uaaagaauuuguca

SEQ ID NO: 3707627 - RNA, 11 nt, Human
uaaagacaaag

SEQ ID NO: 3707628 - RNA, 22 nt, Human
uaaagacaaagacaaauucugu

SEQ ID NO: 3707629 - RNA, 20 nt, Human
uaaagacaaccauauuuagc

SEQ ID NO: 3707630 - RNA, 9 nt, Human
uaaagacag

SEQ ID NO: 3707631 - RNA, 10 nt, Human
uaaagacaga

SEQ ID NO: 3707632 - RNA, 13 nt, Human
uaaagacaugaag

SEQ ID NO: 3707633 - RNA, 16 nt, Human
uaaagacaugaagcca

SEQ ID NO: 3707634 - RNA, 14 nt, Human
uaaagaccaaacuu

SEQ ID NO: 3707635 - RNA, 16 nt, Human
uaaagaccagaaauuc

SEQ ID NO: 3707636 - RNA, 21 nt, Human
uaaagacccagggggagaaug

SEQ ID NO: 3707637 - RNA, 23 nt, Human
uaaagacccuccuauucuauaaa

SEQ ID NO: 3707638 - RNA, 21 nt, Human
uaaagacguuuuauaagcauc

SEQ ID NO: 3707639 - RNA, 14 nt, Human
uaaagacuggcuuu

SEQ ID NO: 3707640 - RNA, 15 nt, Human
uaaagacuggcuuuu

SEQ ID NO: 3707641 - RNA, 19 nt, Human
uaaagacugguuuucugcc

SEQ ID NO: 3707642 - RNA, 22 nt, Human
uaaagacuuguauagcaugaaa

SEQ ID NO: 3707643 - RNA, 15 nt, Human
uaaagagaaaauuga

SEQ ID NO: 3707644 - RNA, 16 nt, Human
uaaagagaaaauugaa

SEQ ID NO: 3707645 - RNA, 20 nt, Human
uaaagagaaaauugaauuua

SEQ ID NO: 3707646 - RNA, 20 nt, Human
uaaagagaaacuuugugcua

SEQ ID NO: 3707647 - RNA, 12 nt, Human
uaaagagaagac

SEQ ID NO: 3707648 - RNA, 19 nt, Human
uaaagagaccuaccucagg

SEQ ID NO: 3707649 - RNA, 20 nt, Human
uaaagagaccuaccucaggu

SEQ ID NO: 3707650 - RNA, 17 nt, Human
uaaagagcccuugccuc

SEQ ID NO: 3707651 - RNA, 14 nt, Human
uaaagauaauugcu

SEQ ID NO: 3707652 - RNA, 17 nt, Human
uaaagauauggagaauu

SEQ ID NO: 3707653 - RNA, 20 nt, Human
uaaagauauggagaauugcu

SEQ ID NO: 3707654 - RNA, 14 nt, Human
uaaagauauuauuc

SEQ ID NO: 3707655 - RNA, 21 nt, Human
uaaagauauuuuuaucuuuau

SEQ ID NO: 3707656 - RNA, 22 nt, Human
uaaagauauuuuuaucuuuaua

SEQ ID NO: 3707657 - RNA, 18 nt, Human
uaaagauggaguuucuaa

SEQ ID NO: 3707658 - RNA, 22 nt, Human
uaaagauggaguuucuaagguc

SEQ ID NO: 3707659 - RNA, 12 nt, Human
uaaagauuucug

SEQ ID NO: 3707660 - RNA, 14 nt, Human
uaaagauuucuuga

SEQ ID NO: 3707661 - RNA, 15 nt, Human
uaaagauuuuuguuu

SEQ ID NO: 3707662 - RNA, 16 nt, Human
uaaagcaacugucuau

SEQ ID NO: 3707663 - RNA, 21 nt, Human
uaaagcaacugucuauuucug

SEQ ID NO: 3707664 - RNA, 23 nt, Human
uaaagcaacugucuauuucugcu

SEQ ID NO: 3707665 - RNA, 16 nt, Human
uaaagcaauaaaauuu

SEQ ID NO: 3707666 - RNA, 14 nt, Human
uaaagcaauagaaa

SEQ ID NO: 3707667 - RNA, 17 nt, Human
uaaagcaauaugcauuu

SEQ ID NO: 3707668 - RNA, 11 nt, Human
uaaagcaauuu

SEQ ID NO: 3707669 - RNA, 15 nt, Human
uaaagcaauuuuccu

SEQ ID NO: 3707670 - RNA, 22 nt, Human
uaaagcaauuuuccuugaagcc

SEQ ID NO: 3707671 - RNA, 17 nt, Human
uaaagcagcguuucuau

SEQ ID NO: 3707672 - RNA, 19 nt, Human
uaaagcaggccuuuugaua

SEQ ID NO: 3707673 - RNA, 19 nt, Human
uaaagcaguggacaccagg

SEQ ID NO: 3707674 - RNA, 17 nt, Human
uaaagcauaaguauaca

SEQ ID NO: 3707675 - RNA, 23 nt, Human
uaaagcauauccauucagaauga

SEQ ID NO: 3707676 - RNA, 14 nt, Human
uaaagcaucuaaac

SEQ ID NO: 3707677 - RNA, 16 nt, Human
uaaagcaucuaaacuu

SEQ ID NO: 3707678 - RNA, 14 nt, Human
uaaagcaugaaaug

SEQ ID NO: 3707679 - RNA, 15 nt, Human
uaaagcauugcuguu

SEQ ID NO: 3707680 - RNA, 21 nt, Human
uaaagcauugcuguuaugucu

SEQ ID NO: 3707681 - RNA, 21 nt, Human
uaaagcauugcuuuuauuuug

SEQ ID NO: 3707682 - RNA, 13 nt, Human
uaaagcauuuaga

SEQ ID NO: 3707683 - RNA, 19 nt, Human
uaaagcauuuagaaaacuu

SEQ ID NO: 3707684 - RNA, 13 nt, Human
uaaagccauguuu

SEQ ID NO: 3707685 - RNA, 20 nt, Human
uaaagccauguuuauuacag

SEQ ID NO: 3707686 - RNA, 15 nt, Human
uguucucucccaggg

SEQ ID NO: 3707687 - RNA, 16 nt, Human
uguucucugaggacac

SEQ ID NO: 3707688 - RNA, 12 nt, Human
uguucucugccc

SEQ ID NO: 3707689 - RNA, 15 nt, Human
uguucucugcccucc

SEQ ID NO: 3707690 - RNA, 16 nt, Human
uguucucugcccucca

SEQ ID NO: 3707691 - RNA, 19 nt, Human
uguucucugcccuccaaga

SEQ ID NO: 3707692 - RNA, 15 nt, Human
uguucucugggagaa

SEQ ID NO: 3707693 - RNA, 23 nt, Human
uguucucuugggaacugaacuca

SEQ ID NO: 3707694 - RNA, 13 nt, Human
uguucugacauua

SEQ ID NO: 3707695 - RNA, 22 nt, Human
uguucugacauuaacaguuuuc

SEQ ID NO: 3707696 - RNA, 22 nt, Human
uguucugauuagaaaugaccaa

SEQ ID NO: 3707697 - RNA, 23 nt, Human
uguucugcaaaaauauuuauaaa

SEQ ID NO: 3707698 - RNA, 17 nt, Human
uguucugcacacagcac

SEQ ID NO: 3707699 - RNA, 15 nt, Human
uguucuggcccucac

SEQ ID NO: 3707700 - RNA, 13 nt, Human
uguucuggcucuu

SEQ ID NO: 3707701 - RNA, 20 nt, Human
uguucuggcucuuccaggcu

SEQ ID NO: 3707702 - RNA, 21 nt, Human
uguucuggcucuuccaggcug

SEQ ID NO: 3707703 - RNA, 13 nt, Human
uguucugggacac

SEQ ID NO: 3707704 - RNA, 15 nt, Human
uguucugggcucuuu

SEQ ID NO: 3707705 - RNA, 22 nt, Human
uguucuggggggacccagugca

SEQ ID NO: 3707706 - RNA, 23 nt, Human
uguucuggggggacccagugcag

SEQ ID NO: 3707707 - RNA, 13 nt, Human
uguucugucacca

SEQ ID NO: 3707708 - RNA, 18 nt, Human
uguucugucccuugcccc

SEQ ID NO: 3707709 - RNA, 23 nt, Human
uguucugugaugaggggaggggg

SEQ ID NO: 3707710 - RNA, 19 nt, Human
uguucuguggaaaguguaa

SEQ ID NO: 3707711 - RNA, 21 nt, Human
uguucuguggaaaguguaaag

SEQ ID NO: 3707712 - RNA, 23 nt, Human
uguucugugguuccucugcucac

SEQ ID NO: 3707713 - RNA, 16 nt, Human
uguucuguuaacugaa

SEQ ID NO: 3707714 - RNA, 17 nt, Human
uguucuguuaacugaau

SEQ ID NO: 3707715 - RNA, 18 nt, Human
uguucuguuaacugaaua

SEQ ID NO: 3707716 - RNA, 22 nt, Human
uguucuguuaacugaauaccac

SEQ ID NO: 3707717 - RNA, 23 nt, Human
uguucuguuaacugaauaccacu

SEQ ID NO: 3707718 - RNA, 14 nt, Human
uguucuguuacaaa

SEQ ID NO: 3707719 - RNA, 19 nt, Human
uguucuguuacaaaaugua

SEQ ID NO: 3707720 - RNA, 22 nt, Human
uguucuguuacaaaauguaacu

SEQ ID NO: 3707721 - RNA, 23 nt, Human
uguucuguuacaaaauguaacug

SEQ ID NO: 3707722 - RNA, 16 nt, Human
uguucuuaagacguga

SEQ ID NO: 3707723 - RNA, 22 nt, Human
uguucuuacacauacaguuuua

SEQ ID NO: 3707724 - RNA, 17 nt, Human
uguucuuaccuguaugu

SEQ ID NO: 3707725 - RNA, 20 nt, Human
uguucuuagcucaaugagca

SEQ ID NO: 3707726 - RNA, 20 nt, Human
uguucuuaugcaaaauggaa

SEQ ID NO: 3707727 - RNA, 13 nt, Human
uguucuucagaga

SEQ ID NO: 3707728 - RNA, 21 nt, Human
uguucuuccaguuacuuucca

SEQ ID NO: 3707729 - RNA, 22 nt, Human
uguucuuccaguuacuuuccaa

SEQ ID NO: 3707730 - RNA, 15 nt, Human
uguucuuccucagcc

SEQ ID NO: 3707731 - RNA, 17 nt, Human
uguucuuccucagccag

SEQ ID NO: 3707732 - RNA, 21 nt, Human
uguucuuccucagccagccuc

SEQ ID NO: 3707733 - RNA, 13 nt, Human
uguucuugaagca

SEQ ID NO: 3707734 - RNA, 12 nt, Human
uguucuugcugc

SEQ ID NO: 3707735 - RNA, 22 nt, Human
uguucuugcugcuagaacuuuu

SEQ ID NO: 3707736 - RNA, 19 nt, Human
uguucuugguuuguaaauu

SEQ ID NO: 3707737 - RNA, 10 nt, Human
uguucuugua

SEQ ID NO: 3707738 - RNA, 15 nt, Human
uguucuuuaggagau

SEQ ID NO: 3707739 - RNA, 11 nt, Human
uguucuuuaua

SEQ ID NO: 3707740 - RNA, 14 nt, Human
uguucuuucagaaa

SEQ ID NO: 3707741 - RNA, 14 nt, Human
uguucuuuccaaag

SEQ ID NO: 3707742 - RNA, 18 nt, Human
uguucuuuccaaaguaca

SEQ ID NO: 3707743 - RNA, 14 nt, Human
uguucuuucuggcu

SEQ ID NO: 3707744 - RNA, 23 nt, Human
uguucuuucuggcuaugcauuug

SEQ ID NO: 3707745 - RNA, 22 nt, Human
uguucuuuggaaaguacacucu

SEQ ID NO: 3707746 - RNA, 20 nt, Human
uguucuuuuaaaugauugaa

SEQ ID NO: 3707747 - RNA, 12 nt, Human
uguucuuuucaa

SEQ ID NO: 3707748 - RNA, 16 nt, Human
uguucuuuugucccag

SEQ ID NO: 3707749 - RNA, 23 nt, Human
uguugaaaaaaaaguuucagaga

SEQ ID NO: 3707750 - RNA, 12 nt, Human
uguugaaaaaau

SEQ ID NO: 3707751 - RNA, 15 nt, Human
uguugaaaaccaaaa

SEQ ID NO: 3707752 - RNA, 22 nt, Human
uguugaaaagccauguuuaaga

SEQ ID NO: 3707753 - RNA, 14 nt, Human
uguugaaaauguuc

SEQ ID NO: 3707754 - RNA, 17 nt, Human
uguugaaaauguucaga

SEQ ID NO: 3707755 - RNA, 22 nt, Human
uguugaaaauuauuuuaaacaa

SEQ ID NO: 3707756 - RNA, 20 nt, Human
uguugaaacggaugauuucu

SEQ ID NO: 3707757 - RNA, 11 nt, Human
uguugaaagau

SEQ ID NO: 3707758 - RNA, 17 nt, Human
uguugaaagcaaaaaug

SEQ ID NO: 3707759 - RNA, 24 nt, Human
uguugaaagguaauuugagagaaa

SEQ ID NO: 3707760 - RNA, 22 nt, Human
uguugaaauuauguauguuuac

SEQ ID NO: 3707761 - RNA, 18 nt, Human
uguugaaauuuugcaaau

SEQ ID NO: 3707762 - RNA, 14 nt, Human
uguugaacuguuag

SEQ ID NO: 3707763 - RNA, 22 nt, Human
uguugaagaaauuauaaagaua

SEQ ID NO: 3707764 - RNA, 17 nt, Human
uguugaagggagguggc

SEQ ID NO: 3707765 - RNA, 17 nt, Human
uguugaagucucaggag

SEQ ID NO: 3707766 - RNA, 16 nt, Human
uguugacacaggucuu

SEQ ID NO: 3707767 - RNA, 18 nt, Human
uguugacauaccuuuuau

SEQ ID NO: 3707768 - RNA, 21 nt, Human
uguugacauauuuaauguuuu

SEQ ID NO: 3707769 - RNA, 22 nt, Human
uguugacauuaagaauguuggu

SEQ ID NO: 3707770 - RNA, 15 nt, Human
uguugacauucugaa

SEQ ID NO: 3707771 - RNA, 17 nt, Human
uguugacauucugaaug

SEQ ID NO: 3707772 - RNA, 18 nt, Human
uguugacauucugaaugc

SEQ ID NO: 3707773 - RNA, 21 nt, Human
uguugaccaggcaccuccccu

SEQ ID NO: 3707774 - RNA, 16 nt, Human
uguugacgaagucucu

SEQ ID NO: 3707775 - RNA, 18 nt, Human
uguugacgaagucucuuu

SEQ ID NO: 3707776 - RNA, 19 nt, Human
uguugacucuaguacugug

SEQ ID NO: 3707777 - RNA, 13 nt, Human
uguugacuuauuu

SEQ ID NO: 3707778 - RNA, 21 nt, Human
uguugacuuauuuucucugug

SEQ ID NO: 3707779 - RNA, 20 nt, Human
uguugagcaucacagaaugu

SEQ ID NO: 3707780 - RNA, 18 nt, Human
uguugagccuuuucccuc

SEQ ID NO: 3707781 - RNA, 21 nt, Human
uguugagguggucugaauguu

SEQ ID NO: 3707782 - RNA, 22 nt, Human
uguugaguuaguuaaguugggu

SEQ ID NO: 3707783 - RNA, 15 nt, Human
uguugauaauucuua

SEQ ID NO: 3707784 - RNA, 15 nt, Human
uguugauacuguugc

SEQ ID NO: 3707785 - RNA, 19 nt, Human
uguugauguaucugaguug

SEQ ID NO: 3707786 - RNA, 15 nt, Human
uguugauuaaagaug

SEQ ID NO: 3707787 - RNA, 20 nt, Human
uguugauuaauuucugccau

SEQ ID NO: 3707788 - RNA, 14 nt, Human
uguugauucucucc

SEQ ID NO: 3707789 - RNA, 12 nt, Human
uguugauugcua

SEQ ID NO: 3707790 - RNA, 15 nt, Human
uguugauugcuaaau

SEQ ID NO: 3707791 - RNA, 18 nt, Human
uguugauugcuaaaugua

SEQ ID NO: 3707792 - RNA, 14 nt, Human
uguugauuucuagu

SEQ ID NO: 3707793 - RNA, 15 nt, Human
uguugauuucuaguu

SEQ ID NO: 3707794 - RNA, 18 nt, Human
uguugauuucuaguuauu

SEQ ID NO: 3707795 - RNA, 20 nt, Human
uguugauuucuuuccagagg

SEQ ID NO: 3707796 - RNA, 14 nt, Human
uguugauuuucugu

SEQ ID NO: 3707797 - RNA, 18 nt, Human
uguugauuuuuacugugu

SEQ ID NO: 3707798 - RNA, 17 nt, Human
uguugcaagaugugaau

SEQ ID NO: 3707799 - RNA, 18 nt, Human
uguugcaagaugugaauu

SEQ ID NO: 3707800 - RNA, 16 nt, Human
uguugcaagccccucu

SEQ ID NO: 3707801 - RNA, 17 nt, Human
uguugcaaguacugcug

SEQ ID NO: 3707802 - RNA, 19 nt, Human
uguugcaaguacugcugua

SEQ ID NO: 3707803 - RNA, 21 nt, Human
uguugcaaugugaaaaaucug

SEQ ID NO: 3707804 - RNA, 20 nt, Human
uguugcacacccacucagcu

SEQ ID NO: 3707805 - RNA, 16 nt, Human
uguugcacccagcccu

SEQ ID NO: 3707806 - RNA, 21 nt, Human
uguugcacguguguuuuucua

SEQ ID NO: 3707807 - RNA, 15 nt, Human
uguugcacugaaguu

SEQ ID NO: 3707808 - RNA, 19 nt, Human
uguugcacugaaguuugau

SEQ ID NO: 3707809 - RNA, 22 nt, Human
uguugcacugaaguuugauaaa

SEQ ID NO: 3707810 - RNA, 23 nt, Human
uguugcacugaaguuugauaaau

SEQ ID NO: 3707811 - RNA, 17 nt, Human
uguugcagguucaugga

SEQ ID NO: 3707812 - RNA, 17 nt, Human
uguugcaugauguauuu

SEQ ID NO: 3707813 - RNA, 20 nt, Human
uguugcaugggcuaaugaag

SEQ ID NO: 3707814 - RNA, 21 nt, Human
uguugccaaaaugguggccug

SEQ ID NO: 3707815 - RNA, 19 nt, Human
uguugccaaauauguccug

SEQ ID NO: 3707816 - RNA, 14 nt, Human
uguugccaagcugg

SEQ ID NO: 3707817 - RNA, 16 nt, Human
uguugccacaggacac

SEQ ID NO: 3707818 - RNA, 18 nt, Human
uguugccacuuuccaagu

SEQ ID NO: 3707819 - RNA, 12 nt, Human
uguugccagaga

SEQ ID NO: 3707820 - RNA, 17 nt, Human
uguugccaguuguccuc

SEQ ID NO: 3707821 - RNA, 18 nt, Human
uguugccaguuguccucc

SEQ ID NO: 3707822 - RNA, 19 nt, Human
uguugccaugugcaccuug

SEQ ID NO: 3707823 - RNA, 14 nt, Human
uguugccauguguu

SEQ ID NO: 3707824 - RNA, 22 nt, Human
uguugcccacagcuguaugauu

SEQ ID NO: 3707825 - RNA, 16 nt, Human
uguugcccaggcaggu

SEQ ID NO: 3707826 - RNA, 13 nt, Human
uguugcccaggcu

SEQ ID NO: 3707827 - RNA, 15 nt, Human
uguugcccaggcugg

SEQ ID NO: 3707828 - RNA, 20 nt, Human
uguugcccaggcuggagugc

SEQ ID NO: 3707829 - RNA, 21 nt, Human
uguugcccaggcuggagugca

SEQ ID NO: 3707830 - RNA, 16 nt, Human
uguugccccuuucucu

SEQ ID NO: 3707831 - RNA, 13 nt, Human
uguugcccugagu

SEQ ID NO: 3707832 - RNA, 12 nt, Human
uguugccuaagu

SEQ ID NO: 3707833 - RNA, 17 nt, Human
uguugccuauaagccaa

SEQ ID NO: 3707834 - RNA, 22 nt, Human
uguugccuauaagccaaaauua

SEQ ID NO: 3707835 - RNA, 16 nt, Human
ugguaagagaauguua

SEQ ID NO: 3707836 - RNA, 22 nt, Human
ugguaagagacagaauguaucu

SEQ ID NO: 3707837 - RNA, 17 nt, Human
ugguaagcuauguccca

SEQ ID NO: 3707838 - RNA, 16 nt, Human
ugguaagggccaaguc

SEQ ID NO: 3707839 - RNA, 16 nt, Human
ugguaauaagggaaaa

SEQ ID NO: 3707840 - RNA, 21 nt, Human
ugguaauaagggaaaaaucaa

SEQ ID NO: 3707841 - RNA, 15 nt, Human
ugguaaucuugcucu

SEQ ID NO: 3707842 - RNA, 21 nt, Human
ugguaauuaucauuuuagaag

SEQ ID NO: 3707843 - RNA, 22 nt, Human
ugguaauuauuuugguacuuuu

SEQ ID NO: 3707844 - RNA, 22 nt, Human
ugguaauuuaagauuccagaga

SEQ ID NO: 3707845 - RNA, 19 nt, Human
ugguaauuuguaucugaag

SEQ ID NO: 3707846 - RNA, 21 nt, Human
ugguaauuuguaucugaagga

SEQ ID NO: 3707847 - RNA, 14 nt, Human
ugguacagagaagc

SEQ ID NO: 3707848 - RNA, 22 nt, Human
ugguacaguauggggguuguaa

SEQ ID NO: 3707849 - RNA, 13 nt, Human
ugguacaugucuu

SEQ ID NO: 3707850 - RNA, 15 nt, Human
ugguaccagauaaaa

SEQ ID NO: 3707851 - RNA, 18 nt, Human
ugguaccagauaaaauua

SEQ ID NO: 3707852 - RNA, 14 nt, Human
ugguaccagauaac

SEQ ID NO: 3707853 - RNA, 13 nt, Human
ugguaccagaugc

SEQ ID NO: 3707854 - RNA, 13 nt, Human
ugguaccagcccu

SEQ ID NO: 3707855 - RNA, 15 nt, Human
ugguaccaggucucc

SEQ ID NO: 3707856 - RNA, 18 nt, Human
ugguaccaggucuccucc

SEQ ID NO: 3707857 - RNA, 14 nt, Human
ugguacccagccau

SEQ ID NO: 3707858 - RNA, 17 nt, Human
ugguacccagccaucug

SEQ ID NO: 3707859 - RNA, 18 nt, Human
ugguacccagccaucugc

SEQ ID NO: 3707860 - RNA, 15 nt, Human
ugguacccuccuggc

SEQ ID NO: 3707861 - RNA, 21 nt, Human
ugguacccuccuggcucuuga

SEQ ID NO: 3707862 - RNA, 15 nt, Human
ugguaccuauuugac

SEQ ID NO: 3707863 - RNA, 18 nt, Human
ugguacggagauguuuca

SEQ ID NO: 3707864 - RNA, 13 nt, Human
ugguacucuccua

SEQ ID NO: 3707865 - RNA, 19 nt, Human
ugguacuguacagcuggcu

SEQ ID NO: 3707866 - RNA, 17 nt, Human
ugguacuuauuacugcu

SEQ ID NO: 3707867 - RNA, 19 nt, Human
ugguacuuauuacugcuaa

SEQ ID NO: 3707868 - RNA, 18 nt, Human
ugguacuugcugcuauuu

SEQ ID NO: 3707869 - RNA, 19 nt, Human
ugguacuuuuaugauguau

SEQ ID NO: 3707870 - RNA, 22 nt, Human
ugguagagaccgagccucuguc

SEQ ID NO: 3707871 - RNA, 20 nt, Human
ugguagauuaaauauagauu

SEQ ID NO: 3707872 - RNA, 18 nt, Human
ugguagcauuuuaaacaa

SEQ ID NO: 3707873 - RNA, 20 nt, Human
ugguaggaacugcugggcuu

SEQ ID NO: 3707874 - RNA, 22 nt, Human
ugguaggaccaagcaucuuggg

SEQ ID NO: 3707875 - RNA, 17 nt, Human
ugguaggacuguagaaa

SEQ ID NO: 3707876 - RNA, 18 nt, Human
ugguaggacuguagaaaa

SEQ ID NO: 3707877 - RNA, 21 nt, Human
ugguaggccuuuuaacauuuu

SEQ ID NO: 3707878 - RNA, 18 nt, Human
ugguagggggaaaaugug

SEQ ID NO: 3707879 - RNA, 19 nt, Human
ugguagggugggagugguu

SEQ ID NO: 3707880 - RNA, 20 nt, Human
ugguagguacuuuuugugaa

SEQ ID NO: 3707881 - RNA, 14 nt, Human
ugguagguugggac

SEQ ID NO: 3707882 - RNA, 14 nt, Human
ugguaguaaaacac

SEQ ID NO: 3707883 - RNA, 17 nt, Human
ugguaguuucugugguu

SEQ ID NO: 3707884 - RNA, 15 nt, Human
ugguauaaguaacuu

SEQ ID NO: 3707885 - RNA, 14 nt, Human
ugguauagaaaugc

SEQ ID NO: 3707886 - RNA, 19 nt, Human
ugguauauccaaaagcuuu

SEQ ID NO: 3707887 - RNA, 22 nt, Human
ugguauccugugacauguaaca

SEQ ID NO: 3707888 - RNA, 21 nt, Human
ugguaucuaauucuuuaauga

SEQ ID NO: 3707889 - RNA, 22 nt, Human
ugguaucucagaaagugccuga

SEQ ID NO: 3707890 - RNA, 14 nt, Human
ugguaucuguucuu

SEQ ID NO: 3707891 - RNA, 13 nt, Human
ugguaugucugcc

SEQ ID NO: 3707892 - RNA, 19 nt, Human
ugguaugugacaccaaagc

SEQ ID NO: 3707893 - RNA, 17 nt, Human
ugguauguguguguaug

SEQ ID NO: 3707894 - RNA, 16 nt, Human
ugguauuccugccucc

SEQ ID NO: 3707895 - RNA, 19 nt, Human
ugguauucgcuugagaaaa

SEQ ID NO: 3707896 - RNA, 21 nt, Human
ugguauucuguucuggaggaa

SEQ ID NO: 3707897 - RNA, 23 nt, Human
ugguauuggcuagagguucaaag

SEQ ID NO: 3707898 - RNA, 12 nt, Human
ugguauuguauu

SEQ ID NO: 3707899 - RNA, 13 nt, Human
ugguauuguauuu

SEQ ID NO: 3707900 - RNA, 18 nt, Human
ugguauuguauuuauuca

SEQ ID NO: 3707901 - RNA, 20 nt, Human
ugguauuuaucuauuguaag

SEQ ID NO: 3707902 - RNA, 19 nt, Human
ugguauuugagacauucca

SEQ ID NO: 3707903 - RNA, 18 nt, Human
ugguauuuggauaucugu

SEQ ID NO: 3707904 - RNA, 20 nt, Human
ugguauuuucaauagccacu

SEQ ID NO: 3707905 - RNA, 20 nt, Human
uggucaaaccgcacucaccc

SEQ ID NO: 3707906 - RNA, 18 nt, Human
uggucaaccuccuggaca

SEQ ID NO: 3707907 - RNA, 15 nt, Human
uggucaagauuuuga

SEQ ID NO: 3707908 - RNA, 14 nt, Human
uggucacacacuga

SEQ ID NO: 3707909 - RNA, 15 nt, Human
uggucacagccaggc

SEQ ID NO: 3707910 - RNA, 17 nt, Human
uggucacagccaggcgc

SEQ ID NO: 3707911 - RNA, 13 nt, Human
uggucacagccuc

SEQ ID NO: 3707912 - RNA, 21 nt, Human
uggucacagcggaggugugga

SEQ ID NO: 3707913 - RNA, 14 nt, Human
uggucacagcugua

SEQ ID NO: 3707914 - RNA, 23 nt, Human
uggucacaggacucugccuccuc

SEQ ID NO: 3707915 - RNA, 20 nt, Human
uggucaccaaaucagcugcu

SEQ ID NO: 3707916 - RNA, 21 nt, Human
uggucaccaaaucagcugcua

SEQ ID NO: 3707917 - RNA, 15 nt, Human
uggucaccagcuccu

SEQ ID NO: 3707918 - RNA, 16 nt, Human
uggucaccaugaaacu

SEQ ID NO: 3707919 - RNA, 21 nt, Human
uggucaccuaggaagccucag

SEQ ID NO: 3707920 - RNA, 14 nt, Human
uggucacugccaug

SEQ ID NO: 3707921 - RNA, 22 nt, Human
uggucacugccauggaggcaca

SEQ ID NO: 3707922 - RNA, 13 nt, Human
uggucacugcugu

SEQ ID NO: 3707923 - RNA, 22 nt, Human
uggucagacacaaacaaacaag

SEQ ID NO: 3707924 - RNA, 21 nt, Human
uggucagaguaagcugcuuuu

SEQ ID NO: 3707925 - RNA, 16 nt, Human
uggucagcccaaacca

SEQ ID NO: 3707926 - RNA, 22 nt, Human
uggucagcccuaggguggagag

SEQ ID NO: 3707927 - RNA, 16 nt, Human
uggucagcguugcaug

SEQ ID NO: 3707928 - RNA, 17 nt, Human
uggucagcguugcaugu

SEQ ID NO: 3707929 - RNA, 13 nt, Human
uggucagcucccu

SEQ ID NO: 3707930 - RNA, 21 nt, Human
uggucagguauuucaguucuu

SEQ ID NO: 3707931 - RNA, 21 nt, Human
uggucagguuauacuccuccu

SEQ ID NO: 3707932 - RNA, 22 nt, Human
uggucaugugggucuuccaggg

SEQ ID NO: 3707933 - RNA, 11 nt, Human
ugguccaaaua

SEQ ID NO: 3707934 - RNA, 15 nt, Human
ugguccaaauaggca

SEQ ID NO: 3707935 - RNA, 15 nt, Human
ugguccaagauuccg

SEQ ID NO: 3707936 - RNA, 18 nt, Human
ugguccaauuaguuuccu

SEQ ID NO: 3707937 - RNA, 21 nt, Human
ugguccaauuaguuuccuuuu

SEQ ID NO: 3707938 - RNA, 23 nt, Human
ugguccaauuaguuuccuuuuua

SEQ ID NO: 3707939 - RNA, 13 nt, Human
ugguccacagggc

SEQ ID NO: 3707940 - RNA, 15 nt, Human
ugguccacuuuucca

SEQ ID NO: 3707941 - RNA, 12 nt, Human
ugguccagagcg

SEQ ID NO: 3707942 - RNA, 14 nt, Human
ugguccagccuggu

SEQ ID NO: 3707943 - RNA, 15 nt, Human
ugguccauagagagc

SEQ ID NO: 3707944 - RNA, 20 nt, Human
ugguccaucugguuuucucu

SEQ ID NO: 3707945 - RNA, 15 nt, Human
uggucccacaucccu

SEQ ID NO: 3707946 - RNA, 16 nt, Human
uggucccacaucccug

SEQ ID NO: 3707947 - RNA, 19 nt, Human
uggucccacaucccugggc

SEQ ID NO: 3707948 - RNA, 16 nt, Human
uggucccagccagcag

SEQ ID NO: 3707949 - RNA, 17 nt, Human
uggucccauccaggcag

SEQ ID NO: 3707950 - RNA, 18 nt, Human
uggucccauccaggcagu

SEQ ID NO: 3707951 - RNA, 19 nt, Human
ugguccccaacaaugugag

SEQ ID NO: 3707952 - RNA, 14 nt, Human
ugguccccaagacc

SEQ ID NO: 3707953 - RNA, 18 nt, Human
uggucccccuuccaugga

SEQ ID NO: 3707954 - RNA, 17 nt, Human
ugguccccguuccaccc

SEQ ID NO: 3707955 - RNA, 22 nt, Human
uggucccuccagaaccaccccg

SEQ ID NO: 3707956 - RNA, 12 nt, Human
uggucccugggg

SEQ ID NO: 3707957 - RNA, 23 nt, Human
uggucccuuguauccccugcagg

SEQ ID NO: 3707958 - RNA, 15 nt, Human
ugguccgguguccuu

SEQ ID NO: 3707959 - RNA, 18 nt, Human
ugguccgugcuaaggacu

SEQ ID NO: 3707960 - RNA, 20 nt, Human
ugguccgugcuaaggacuug

SEQ ID NO: 3707961 - RNA, 17 nt, Human
ugguccuaaaagcaaaa

SEQ ID NO: 3707962 - RNA, 21 nt, Human
ugguccuaaaagcaaaauaaa

SEQ ID NO: 3707963 - RNA, 18 nt, Human
ugguccuaagucccugcc

SEQ ID NO: 3707964 - RNA, 20 nt, Human
ugguccuaagucccugcccc

SEQ ID NO: 3707965 - RNA, 12 nt, Human
ugguccuaccca

SEQ ID NO: 3707966 - RNA, 18 nt, Human
uguuuuugaaggcagaaa

SEQ ID NO: 3707967 - RNA, 16 nt, Human
uguuuuugcacauguu

SEQ ID NO: 3707968 - RNA, 23 nt, Human
uguuuuugcgugggagugugugc

SEQ ID NO: 3707969 - RNA, 20 nt, Human
uguuuuugcuuguuauauua

SEQ ID NO: 3707970 - RNA, 10 nt, Human
uguuuuuggg

SEQ ID NO: 3707971 - RNA, 13 nt, Human
uguuuuuguaaag

SEQ ID NO: 3707972 - RNA, 14 nt, Human
uguuuuuguaaaga

SEQ ID NO: 3707973 - RNA, 13 nt, Human
uguuuuuguugug

SEQ ID NO: 3707974 - RNA, 20 nt, Human
uguuuuuuaaacuaggaaaa

SEQ ID NO: 3707975 - RNA, 16 nt, Human
uguuuuuuaagauagu

SEQ ID NO: 3707976 - RNA, 17 nt, Human
uguuuuuuagaucaaau

SEQ ID NO: 3707977 - RNA, 13 nt, Human
uguuuuuuccuuu

SEQ ID NO: 3707978 - RNA, 12 nt, Human
uguuuuuucuaa

SEQ ID NO: 3707979 - RNA, 13 nt, Human
uguuuuuugaagu

SEQ ID NO: 3707980 - RNA, 15 nt, Human
uguuuuuugaagugu

SEQ ID NO: 3707981 - RNA, 16 nt, Human
uguuuuuugaaguguu

SEQ ID NO: 3707982 - RNA, 21 nt, Human
uguuuuuuuaggguuucugau

SEQ ID NO: 3707983 - RNA, 19 nt, Human
uguuuuuuuuuuccacuua

SEQ ID NO: 3707984 - RNA, 19 nt, Human
uuaaaaaaaaaaaaaagcu

SEQ ID NO: 3707985 - RNA, 20 nt, Human
uuaaaaaaaaaaaaaagcuu

SEQ ID NO: 3707986 - RNA, 21 nt, Human
uuaaaaaaaaaaaaaggaaaa

SEQ ID NO: 3707987 - RNA, 15 nt, Human
uuaaaaaaaaaaguc

SEQ ID NO: 3707988 - RNA, 22 nt, Human
uuaaaaaaaacaaaaagaacaa

SEQ ID NO: 3707989 - RNA, 14 nt, Human
uuaaaaaaaacuca

SEQ ID NO: 3707990 - RNA, 21 nt, Human
uuaaaaaaaacucuuuaacuu

SEQ ID NO: 3707991 - RNA, 13 nt, Human
uuaaaaaaaauaa

SEQ ID NO: 3707992 - RNA, 14 nt, Human
uuaaaaaaaauaau

SEQ ID NO: 3707993 - RNA, 17 nt, Human
uuaaaaaaaauaauaaa

SEQ ID NO: 3707994 - RNA, 21 nt, Human
uuaaaaaaaaucaucauuauu

SEQ ID NO: 3707995 - RNA, 19 nt, Human
uuaaaaaaaauccuucuaa

SEQ ID NO: 3707996 - RNA, 12 nt, Human
uuaaaaaaagaa

SEQ ID NO: 3707997 - RNA, 18 nt, Human
uuaaaaaaagaagagaaa

SEQ ID NO: 3707998 - RNA, 23 nt, Human
uuaaaaaaauaaaacauuuuaaa

SEQ ID NO: 3707999 - RNA, 17 nt, Human
uuaaaaaaaucacaaaa

SEQ ID NO: 3708000 - RNA, 16 nt, Human
uuaaaaaaauggcagu

SEQ ID NO: 3708001 - RNA, 20 nt, Human
uuaaaaaaauugguuggaga

SEQ ID NO: 3708002 - RNA, 13 nt, Human
uuaaaaaacuugu

SEQ ID NO: 3708003 - RNA, 22 nt, Human
uuaaaaaacuuucuacucauuu

SEQ ID NO: 3708004 - RNA, 13 nt, Human
uuaaaaaagagac

SEQ ID NO: 3708005 - RNA, 12 nt, Human
uuaaaaaagcuu

SEQ ID NO: 3708006 - RNA, 12 nt, Human
uuaaaaaaguuu

SEQ ID NO: 3708007 - RNA, 18 nt, Human
uuaaaaaaguuuaaaaug

SEQ ID NO: 3708008 - RNA, 20 nt, Human
uuaaaaaaguuuaaaaugua

SEQ ID NO: 3708009 - RNA, 19 nt, Human
uuaaaaaauauuuauuaaa

SEQ ID NO: 3708010 - RNA, 16 nt, Human
uuaaaaaauguccaug

SEQ ID NO: 3708011 - RNA, 17 nt, Human
uuaaaaacaaaaggcaa

SEQ ID NO: 3708012 - RNA, 19 nt, Human
uuaaaaacauaacauaaau

SEQ ID NO: 3708013 - RNA, 13 nt, Human
uuaaaaacuagua

SEQ ID NO: 3708014 - RNA, 18 nt, Human
uuaaaaacuaguaguucu

SEQ ID NO: 3708015 - RNA, 13 nt, Human
uuaaaaacuggaa

SEQ ID NO: 3708016 - RNA, 14 nt, Human
uuaaaaagcccaac

SEQ ID NO: 3708017 - RNA, 16 nt, Human
uuaaaaagguuuacag

SEQ ID NO: 3708018 - RNA, 20 nt, Human
uuaaaaaguauugccaaaca

SEQ ID NO: 3708019 - RNA, 17 nt, Human
uuaaaaagucuuuuaaa

SEQ ID NO: 3708020 - RNA, 16 nt, Human
uuaaaaauaaauccca

SEQ ID NO: 3708021 - RNA, 22 nt, Human
uuaaaaauaagucaacaguaaa

SEQ ID NO: 3708022 - RNA, 12 nt, Human
uuaaaaauacau

SEQ ID NO: 3708023 - RNA, 20 nt, Human
uuaaaaauauggaacuucua

SEQ ID NO: 3708024 - RNA, 21 nt, Human
uuaaaaaucuaccuucuguag

SEQ ID NO: 3708025 - RNA, 17 nt, Human
uaaauuauauuugugcu

SEQ ID NO: 3708026 - RNA, 21 nt, Human
uaaauuauauuugugcuauag

SEQ ID NO: 3708027 - RNA, 19 nt, Human
uaaauuauguaaugcaaaa

SEQ ID NO: 3708028 - RNA, 19 nt, Human
uaaauuauguuuauauaaa

SEQ ID NO: 3708029 - RNA, 12 nt, Human
uaaauuauucag

SEQ ID NO: 3708030 - RNA, 17 nt, Human
uaaauuauugaugaaaa

SEQ ID NO: 3708031 - RNA, 20 nt, Human
uaaauuauuugauuauuuaa

SEQ ID NO: 3708032 - RNA, 23 nt, Human
uaaauuauuugauuauuuaagac

SEQ ID NO: 3708033 - RNA, 11 nt, Human
uaaauuauuuu

SEQ ID NO: 3708034 - RNA, 16 nt, Human
uaaauuauuuuaaauu

SEQ ID NO: 3708035 - RNA, 15 nt, Human
uaaauucaacuuugu

SEQ ID NO: 3708036 - RNA, 23 nt, Human
uaaauucagauauauuuuucaca

SEQ ID NO: 3708037 - RNA, 18 nt, Human
uaaauucaguccuaagaa

SEQ ID NO: 3708038 - RNA, 20 nt, Human
uaaauucauuuuaauuuugu

SEQ ID NO: 3708039 - RNA, 18 nt, Human
uaaauucccguuuuguca

SEQ ID NO: 3708040 - RNA, 20 nt, Human
uaaauuccucuuugcuuugc

SEQ ID NO: 3708041 - RNA, 22 nt, Human
uaaauucugagacaugugucaa

SEQ ID NO: 3708042 - RNA, 14 nt, Human
uaaauucugauuuc

SEQ ID NO: 3708043 - RNA, 15 nt, Human
uaaauucugauuucu

SEQ ID NO: 3708044 - RNA, 20 nt, Human
uaaauucugauuucuuuuca

SEQ ID NO: 3708045 - RNA, 18 nt, Human
uaaauucuugcaaaguau

SEQ ID NO: 3708046 - RNA, 21 nt, Human
uaaauucuuuauuucugucau

SEQ ID NO: 3708047 - RNA, 19 nt, Human
uaaauucuuuuuuaaauuu

SEQ ID NO: 3708048 - RNA, 22 nt, Human
uaaauucuuuuuuaaauuuucu

SEQ ID NO: 3708049 - RNA, 16 nt, Human
uaaauugaauaauggu

SEQ ID NO: 3708050 - RNA, 19 nt, Human
uaaauugaaucaguauaaa

SEQ ID NO: 3708051 - RNA, 22 nt, Human
uaaauugaaucaguauaaacaa

SEQ ID NO: 3708052 - RNA, 20 nt, Human
uaaauugacacuuaaaaaug

SEQ ID NO: 3708053 - RNA, 23 nt, Human
uaaauugacacuuaaaaaugguu

SEQ ID NO: 3708054 - RNA, 18 nt, Human
uaaauugauguugaugca

SEQ ID NO: 3708055 - RNA, 19 nt, Human
uaaauugauguugaugcaa

SEQ ID NO: 3708056 - RNA, 16 nt, Human
uaaauugauguugcug

SEQ ID NO: 3708057 - RNA, 13 nt, Human
uaaauugauuuuu

SEQ ID NO: 3708058 - RNA, 22 nt, Human
uaaauugauuuuuauaaauacu

SEQ ID NO: 3708059 - RNA, 13 nt, Human
uaaauugcaagaa

SEQ ID NO: 3708060 - RNA, 16 nt, Human
uaaauugcaucacugu

SEQ ID NO: 3708061 - RNA, 18 nt, Human
uaaauugcaugcugcuuu

SEQ ID NO: 3708062 - RNA, 24 nt, Human
uaaauugcucacaguuauuacaua

SEQ ID NO: 3708063 - RNA, 15 nt, Human
uaaauugcuguguau

SEQ ID NO: 3708064 - RNA, 20 nt, Human
uaaauuggcauggaaauuua

SEQ ID NO: 3708065 - RNA, 13 nt, Human
uaaauuguauauu

SEQ ID NO: 3708066 - RNA, 23 nt, Human
uaaauuguuuggcuuccuccuga

SEQ ID NO: 3708067 - RNA, 15 nt, Human
uaaauuuaaagauau

SEQ ID NO: 3708068 - RNA, 22 nt, Human
uaaauuuaagcuuaagccauaa

SEQ ID NO: 3708069 - RNA, 23 nt, Human
uaaauuuaaguaaguuuuauaag

SEQ ID NO: 3708070 - RNA, 15 nt, Human
uaaauuuaaugcugc

SEQ ID NO: 3708071 - RNA, 17 nt, Human
uaaauuuacuuuacaca

SEQ ID NO: 3708072 - RNA, 14 nt, Human
uaaauuuaguauuu

SEQ ID NO: 3708073 - RNA, 18 nt, Human
uaaauuuauuuacugcua

SEQ ID NO: 3708074 - RNA, 17 nt, Human
uaaauuuccccaacagu

SEQ ID NO: 3708075 - RNA, 20 nt, Human
uaaauuucgcuucuuagaac

SEQ ID NO: 3708076 - RNA, 22 nt, Human
uaaauuucuuaugugacauuaa

SEQ ID NO: 3708077 - RNA, 14 nt, Human
uaaauuugaauguu

SEQ ID NO: 3708078 - RNA, 22 nt, Human
uaaauuugaauguuaagcagau

SEQ ID NO: 3708079 - RNA, 19 nt, Human
uaaauuugacuuuucugua

SEQ ID NO: 3708080 - RNA, 13 nt, Human
uaaauuugauuua

SEQ ID NO: 3708081 - RNA, 14 nt, Human
uaaauuugcuagca

SEQ ID NO: 3708082 - RNA, 17 nt, Human
uaaauuuggcuucuguu

SEQ ID NO: 3708083 - RNA, 17 nt, Human
uaaauuuguaaguuuca

SEQ ID NO: 3708084 - RNA, 20 nt, Human
uaaauuuguaaguuucaggu

SEQ ID NO: 3708085 - RNA, 19 nt, Human
uaaauuuguacuauuuaac

SEQ ID NO: 3708086 - RNA, 20 nt, Human
uaaauuuguacuauuuaacu

SEQ ID NO: 3708087 - RNA, 16 nt, Human
uaaauuuguguaauau

SEQ ID NO: 3708088 - RNA, 13 nt, Human
uaaauuuuaaagc

SEQ ID NO: 3708089 - RNA, 18 nt, Human
uaaauuuuccuguccucu

SEQ ID NO: 3708090 - RNA, 22 nt, Human
uaaauuuugaaaaguaauauuu

SEQ ID NO: 3708091 - RNA, 15 nt, Human
uaaauuuugugucuc

SEQ ID NO: 3708092 - RNA, 16 nt, Human
uaaauuuuuuuccuua

SEQ ID NO: 3708093 - RNA, 16 nt, Human
uaaauuuuuuuguaug

SEQ ID NO: 3708094 - RNA, 21 nt, Human
uaaauuuuuuuguaugaaaac

SEQ ID NO: 3708095 - RNA, 22 nt, Human
uaaauuuuuuuguaugaaaaca

SEQ ID NO: 3708096 - RNA, 15 nt, Human
uaacaaaaaagcuaa

SEQ ID NO: 3708097 - RNA, 12 nt, Human
uaacaaaagaug

SEQ ID NO: 3708098 - RNA, 15 nt, Human
uaacaaaauggacau

SEQ ID NO: 3708099 - RNA, 16 nt, Human
uaacaaaauguauguc

SEQ ID NO: 3708100 - RNA, 21 nt, Human
uaacaaacccucguuucugau

SEQ ID NO: 3708101 - RNA, 17 nt, Human
uaacaaaggauacuuau

SEQ ID NO: 3708102 - RNA, 18 nt, Human
uaacaaaggauacuuauu

SEQ ID NO: 3708103 - RNA, 19 nt, Human
uaacaaaugcuauuaaagu

SEQ ID NO: 3708104 - RNA, 12 nt, Human
uaacaaauuaug

SEQ ID NO: 3708105 - RNA, 18 nt, Human
uaacaacaccuucagagg

SEQ ID NO: 3708106 - RNA, 13 nt, Human
uaacaacuaggga

SEQ ID NO: 3708107 - RNA, 17 nt, Human
uaacaagaaaggagagu

SEQ ID NO: 3708108 - RNA, 13 nt, Human
uaacaagaagaug

SEQ ID NO: 3708109 - RNA, 14 nt, Human
uaacaagaagauga

SEQ ID NO: 3708110 - RNA, 19 nt, Human
uaacaagaagaugaauggc

SEQ ID NO: 3708111 - RNA, 19 nt, Human
uaacaagagugauucuugc

SEQ ID NO: 3708112 - RNA, 16 nt, Human
uaacaagaucuuucag

SEQ ID NO: 3708113 - RNA, 17 nt, Human
uaacaagaucuuucagg

SEQ ID NO: 3708114 - RNA, 18 nt, Human
uaacaagaucuuucagga

SEQ ID NO: 3708115 - RNA, 20 nt, Human
uaacaagucgaugaacuauu

SEQ ID NO: 3708116 - RNA, 17 nt, Human
uaacaauaacuacugug

SEQ ID NO: 3708117 - RNA, 21 nt, Human
uaacaauaacuacuguguucc

SEQ ID NO: 3708118 - RNA, 13 nt, Human
uaacaauacaaau

SEQ ID NO: 3708119 - RNA, 17 nt, Human
uaacaauacaaauggau

SEQ ID NO: 3708120 - RNA, 19 nt, Human
uaacaaugauauauggaua

SEQ ID NO: 3708121 - RNA, 18 nt, Human
uaacaaugccuauuguaa

SEQ ID NO: 3708122 - RNA, 24 nt, Human
uaacaauggaagauuugcccauuu

SEQ ID NO: 3708123 - RNA, 12 nt, Human
uaacaauguuaa

SEQ ID NO: 3708124 - RNA, 13 nt, Human
uaacaauguuaag

SEQ ID NO: 3708125 - RNA, 14 nt, Human
uaacaauuaauugu

SEQ ID NO: 3708126 - RNA, 14 nt, Human
uaacaauuccucua

SEQ ID NO: 3708127 - RNA, 19 nt, Human
uaacaauuguguagccuuu

SEQ ID NO: 3708128 - RNA, 23 nt, Human
uaacaauuguguagccuuuuugu

SEQ ID NO: 3708129 - RNA, 16 nt, Human
uaacacaagccacaga

SEQ ID NO: 3708130 - RNA, 17 nt, Human
uaacacaagccacagaa

SEQ ID NO: 3708131 - RNA, 18 nt, Human
uaacacaaguccugugaa

SEQ ID NO: 3708132 - RNA, 23 nt, Human
uaacacaaguccugugaauuucu

SEQ ID NO: 3708133 - RNA, 12 nt, Human
uaacacacagcu

SEQ ID NO: 3708134 - RNA, 21 nt, Human
uaacacacuaccgaauguguc

SEQ ID NO: 3708135 - RNA, 23 nt, Human
uaacacacuaccgaaugugucuu

SEQ ID NO: 3708136 - RNA, 18 nt, Human
uaacacacuuuuuauuag

SEQ ID NO: 3708137 - RNA, 19 nt, Human
uaacacagugccuucaaua

SEQ ID NO: 3708138 - RNA, 11 nt, Human
uaacacauuau

SEQ ID NO: 3708139 - RNA, 14 nt, Human
uaacacauuuugua

SEQ ID NO: 3708140 - RNA, 21 nt, Human
uaacaccagguuuauggaaaa

SEQ ID NO: 3708141 - RNA, 13 nt, Human
uaacacccuuccu

SEQ ID NO: 3708142 - RNA, 23 nt, Human
uaacacccuuccuucuguaaaua

SEQ ID NO: 3708143 - RNA, 14 nt, Human
uaacaccugaugug

SEQ ID NO: 3708144 - RNA, 18 nt, Human
uaacacuaaaauuuuagg

SEQ ID NO: 3708145 - RNA, 20 nt, Human
uaacacuaauauauuuaaaa

SEQ ID NO: 3708146 - RNA, 15 nt, Human
uaacacuauuuuaug

SEQ ID NO: 3708147 - RNA, 18 nt, Human
uaacacucagaagccugg

SEQ ID NO: 3708148 - RNA, 14 nt, Human
uaacacuccucugc

SEQ ID NO: 3708149 - RNA, 13 nt, Human
uaacacuguuuau

SEQ ID NO: 3708150 - RNA, 21 nt, Human
uaacagaaagggcaacaauaa

SEQ ID NO: 3708151 - RNA, 17 nt, Human
uaacagaacagcuucag

SEQ ID NO: 3708152 - RNA, 18 nt, Human
uaacagaacagcuucagg

SEQ ID NO: 3708153 - RNA, 22 nt, Human
uaacagaacagcuucagguuau

SEQ ID NO: 3708154 - RNA, 19 nt, Human
uaacagaagaaaauagaau

SEQ ID NO: 3708155 - RNA, 18 nt, Human
uaacagacauuguuuugc

SEQ ID NO: 3708156 - RNA, 18 nt, Human
uaacagauaagcaagaga

SEQ ID NO: 3708157 - RNA, 13 nt, Human
uaacagauacauu

SEQ ID NO: 3708158 - RNA, 20 nt, Human
uaacagcaacacaaagcuuu

SEQ ID NO: 3708159 - RNA, 19 nt, Human
uaacagcaguuucagguag

SEQ ID NO: 3708160 - RNA, 22 nt, Human
uaacagcauucuugucacaaua

SEQ ID NO: 3708161 - RNA, 18 nt, Human
uaacagccgcuccagagu

SEQ ID NO: 3708162 - RNA, 15 nt, Human
uaacagcuccuuggg

SEQ ID NO: 3708163 - RNA, 20 nt, Human
uaacagcuccuugggaggaa

SEQ ID NO: 3708164 - RNA, 22 nt, Human
uaacagcuccuugggaggaagc

SEQ ID NO: 3708165 - RNA, 15 nt, Human
uaacagcugaauuau

SEQ ID NO: 3708166 - RNA, 12 nt, Human
uaacagcugagg

SEQ ID NO: 3708167 - RNA, 21 nt, Human
uaacaggaagaucuuaaauuu

SEQ ID NO: 3708168 - RNA, 15 nt, Human
uaacaggcaaacauu

SEQ ID NO: 3708169 - RNA, 21 nt, Human
uaacaggcucaaacaaugaca

SEQ ID NO: 3708170 - RNA, 14 nt, Human
uaacaggcuuagug

SEQ ID NO: 3708171 - RNA, 14 nt, Human
uaacagggaaggca

SEQ ID NO: 3708172 - RNA, 17 nt, Human
uaacagggaaggcaggc

SEQ ID NO: 3708173 - RNA, 22 nt, Human
uaacagggaaggcaggcagggc

SEQ ID NO: 3708174 - RNA, 20 nt, Human
uguaauaaacucauuucuag

SEQ ID NO: 3708175 - RNA, 13 nt, Human
uguaauaaacuuu

SEQ ID NO: 3708176 - RNA, 20 nt, Human
uguaauaaaguguuuucaga

SEQ ID NO: 3708177 - RNA, 15 nt, Human
uguaauaagacauaa

SEQ ID NO: 3708178 - RNA, 18 nt, Human
uguaauaagacauaacgu

SEQ ID NO: 3708179 - RNA, 13 nt, Human
uguaauaagcaau

SEQ ID NO: 3708180 - RNA, 14 nt, Human
uguaauaauaccuc

SEQ ID NO: 3708181 - RNA, 14 nt, Human
uguaauaauagacu

SEQ ID NO: 3708182 - RNA, 14 nt, Human
uguaauaauugcuc

SEQ ID NO: 3708183 - RNA, 11 nt, Human
uguaauacaau

SEQ ID NO: 3708184 - RNA, 18 nt, Human
uguaauacuucuugugug

SEQ ID NO: 3708185 - RNA, 18 nt, Human
uguaauagaaaacugaaa

SEQ ID NO: 3708186 - RNA, 23 nt, Human
uguaauauagaaaaaaacauucu

SEQ ID NO: 3708187 - RNA, 19 nt, Human
uguaauauuuacaauguau

SEQ ID NO: 3708188 - RNA, 23 nt, Human
uguaauauuuuguauuauugcug

SEQ ID NO: 3708189 - RNA, 22 nt, Human
uguaauauuuuuauauacagag

SEQ ID NO: 3708190 - RNA, 14 nt, Human
uguaaucaacaugg

SEQ ID NO: 3708191 - RNA, 16 nt, Human
uguaaucaauaaacga

SEQ ID NO: 3708192 - RNA, 20 nt, Human
uguaaucaauguuucuucua

SEQ ID NO: 3708193 - RNA, 17 nt, Human
uguaaucauauaauaaa

SEQ ID NO: 3708194 - RNA, 21 nt, Human
uguaaucauuucuugggcccu

SEQ ID NO: 3708195 - RNA, 15 nt, Human
uguaaucccagcacu

SEQ ID NO: 3708196 - RNA, 20 nt, Human
uguaaucccagcuacucagg

SEQ ID NO: 3708197 - RNA, 23 nt, Human
uguaaucccagcuacucaggagg

SEQ ID NO: 3708198 - RNA, 20 nt, Human
uguaaucccagcuacucggg

SEQ ID NO: 3708199 - RNA, 17 nt, Human
uguaaucccagcuacuu

SEQ ID NO: 3708200 - RNA, 22 nt, Human
uguaaucccagcuacuugggag

SEQ ID NO: 3708201 - RNA, 13 nt, Human
uguaaucccccag

SEQ ID NO: 3708202 - RNA, 21 nt, Human
uguaaucguuauguguguaua

SEQ ID NO: 3708203 - RNA, 16 nt, Human
uguaaucuauguauau

SEQ ID NO: 3708204 - RNA, 20 nt, Human
uguaaucuuauuuaggaagu

SEQ ID NO: 3708205 - RNA, 15 nt, Human
uguaaucuugaauug

SEQ ID NO: 3708206 - RNA, 12 nt, Human
uguaaugaaaac

SEQ ID NO: 3708207 - RNA, 17 nt, Human
uguaaugaaaaccacau

SEQ ID NO: 3708208 - RNA, 15 nt, Human
uguaaugaaaaugaa

SEQ ID NO: 3708209 - RNA, 16 nt, Human
uguaaugaaacaccuu

SEQ ID NO: 3708210 - RNA, 14 nt, Human
uguaaugaauaccu

SEQ ID NO: 3708211 - RNA, 20 nt, Human
uguaaugaaucuaagcagca

SEQ ID NO: 3708212 - RNA, 21 nt, Human
uguaaugaaucuaagcagcau

SEQ ID NO: 3708213 - RNA, 13 nt, Human
uguaaugaucaua

SEQ ID NO: 3708214 - RNA, 18 nt, Human
uguaaugcugcacuuccu

SEQ ID NO: 3708215 - RNA, 19 nt, Human
uguaaugcugcacuuccug

SEQ ID NO: 3708216 - RNA, 20 nt, Human
uguaaugcugcacuuccugu

SEQ ID NO: 3708217 - RNA, 20 nt, Human
uguaauggagcaucaagcca

SEQ ID NO: 3708218 - RNA, 14 nt, Human
uguaauguaacugc

SEQ ID NO: 3708219 - RNA, 18 nt, Human
uguaauguaacugcucuu

SEQ ID NO: 3708220 - RNA, 23 nt, Human
uguaauguaucaaauacauuuaa

SEQ ID NO: 3708221 - RNA, 13 nt, Human
uguaaugucacca

SEQ ID NO: 3708222 - RNA, 16 nt, Human
uguaaugucaccaccu

SEQ ID NO: 3708223 - RNA, 20 nt, Human
uguaaugucaccaccuuccc

SEQ ID NO: 3708224 - RNA, 20 nt, Human
uguaaugucuugagcucuau

SEQ ID NO: 3708225 - RNA, 23 nt, Human
uguaaugugugaaaaagaugcca

SEQ ID NO: 3708226 - RNA, 17 nt, Human
uguaauguuacugauca

SEQ ID NO: 3708227 - RNA, 14 nt, Human
uguaauguugugaa

SEQ ID NO: 3708228 - RNA, 15 nt, Human
uguaauguugugaau

SEQ ID NO: 3708229 - RNA, 19 nt, Human
uguaauguuuucuuugcaa

SEQ ID NO: 3708230 - RNA, 20 nt, Human
uguaauuaaaagcaaaucau

SEQ ID NO: 3708231 - RNA, 19 nt, Human
uguaauuaaguacuaugua

SEQ ID NO: 3708232 - RNA, 21 nt, Human
uguaauuagugccacuuaaug

SEQ ID NO: 3708233 - RNA, 13 nt, Human
uguaauuauaucu

SEQ ID NO: 3708234 - RNA, 15 nt, Human
uguaauuaugauuug

SEQ ID NO: 3708235 - RNA, 14 nt, Human
uguaauuauuguga

SEQ ID NO: 3708236 - RNA, 19 nt, Human
uguaauucagguuuuuccu

SEQ ID NO: 3708237 - RNA, 14 nt, Human
uguaauucuaaaug

SEQ ID NO: 3708238 - RNA, 15 nt, Human
uguaauucuaaauga

SEQ ID NO: 3708239 - RNA, 18 nt, Human
uguaauugcuuacauuuu

SEQ ID NO: 3708240 - RNA, 23 nt, Human
uguaauugcuuacauuuuuacaa

SEQ ID NO: 3708241 - RNA, 16 nt, Human
uguaauugcuuuuuua

SEQ ID NO: 3708242 - RNA, 16 nt, Human
uguaauuguuccuuuu

SEQ ID NO: 3708243 - RNA, 16 nt, Human
uguaauuguuguuugu

SEQ ID NO: 3708244 - RNA, 17 nt, Human
uguaauuguuguuugua

SEQ ID NO: 3708245 - RNA, 20 nt, Human
uguaauuguuguuuguaugu

SEQ ID NO: 3708246 - RNA, 16 nt, Human
uguaauuuaaacaggc

SEQ ID NO: 3708247 - RNA, 20 nt, Human
uguaauuuaaacaggcccag

SEQ ID NO: 3708248 - RNA, 16 nt, Human
uguaauuuaaaugaaa

SEQ ID NO: 3708249 - RNA, 23 nt, Human
uguaauuuaggguacuaaauuua

SEQ ID NO: 3708250 - RNA, 16 nt, Human
uguaauuuauaaaauu

SEQ ID NO: 3708251 - RNA, 14 nt, Human
uguaauuuucuuga

SEQ ID NO: 3708252 - RNA, 16 nt, Human
uguaauuuuguguaag

SEQ ID NO: 3708253 - RNA, 23 nt, Human
uguaauuuuguucuaguuuucag

SEQ ID NO: 3708254 - RNA, 22 nt, Human
uguaauuuuucagcucucugua

SEQ ID NO: 3708255 - RNA, 16 nt, Human
uguaauuuuucuguau

SEQ ID NO: 3708256 - RNA, 20 nt, Human
uguaauuuuuuuaucgucac

SEQ ID NO: 3708257 - RNA, 21 nt, Human
uguacaaaaaaaucuuccaau

SEQ ID NO: 3708258 - RNA, 11 nt, Human
uguacaaaagc

SEQ ID NO: 3708259 - RNA, 13 nt, Human
uguacaaaagcaa

SEQ ID NO: 3708260 - RNA, 15 nt, Human
uguacaaaagcaaug

SEQ ID NO: 3708261 - RNA, 17 nt, Human
uguacaaaauaaacaaa

SEQ ID NO: 3708262 - RNA, 15 nt, Human
uguacaaaguauuaa

SEQ ID NO: 3708263 - RNA, 15 nt, Human
uguacaaauauaaga

SEQ ID NO: 3708264 - RNA, 15 nt, Human
uguacaacuuaaguu

SEQ ID NO: 3708265 - RNA, 16 nt, Human
uguacaagaugaagga

SEQ ID NO: 3708266 - RNA, 16 nt, Human
uguacaaggacagccc

SEQ ID NO: 3708267 - RNA, 20 nt, Human
uguacaaggacagccccucc

SEQ ID NO: 3708268 - RNA, 23 nt, Human
uguacaaggacagccccuccucc

SEQ ID NO: 3708269 - RNA, 17 nt, Human
uguacaauauuuaaaau

SEQ ID NO: 3708270 - RNA, 18 nt, Human
uguacaauauuuuaagca

SEQ ID NO: 3708271 - RNA, 19 nt, Human
uguacaauauuuuaagcau

SEQ ID NO: 3708272 - RNA, 15 nt, Human
uguacacaacucacu

SEQ ID NO: 3708273 - RNA, 22 nt, Human
uguacacacugguacuuagagu

SEQ ID NO: 3708274 - RNA, 22 nt, Human
uguacacaugggaguuuagugu

SEQ ID NO: 3708275 - RNA, 13 nt, Human
uguacacgggacu

SEQ ID NO: 3708276 - RNA, 14 nt, Human
uguacacgggacug

SEQ ID NO: 3708277 - RNA, 15 nt, Human
uguacacgggacuga

SEQ ID NO: 3708278 - RNA, 20 nt, Human
uguacacgggacugacgcaa

SEQ ID NO: 3708279 - RNA, 16 nt, Human
uguacacguguccugu

SEQ ID NO: 3708280 - RNA, 20 nt, Human
uguacacugaauauuuauau

SEQ ID NO: 3708281 - RNA, 23 nt, Human
uguacagaauauuucuauugaau

SEQ ID NO: 3708282 - RNA, 15 nt, Human
uguacagacagagaa

SEQ ID NO: 3708283 - RNA, 22 nt, Human
uguacagagaacuaacacuauu

SEQ ID NO: 3708284 - RNA, 22 nt, Human
uguacagagccguaaaaacuga

SEQ ID NO: 3708285 - RNA, 21 nt, Human
uguacagaguggaauaagaca

SEQ ID NO: 3708286 - RNA, 14 nt, Human
uguacagauucuuu

SEQ ID NO: 3708287 - RNA, 23 nt, Human
uguacagcaaggagauuuacaac

SEQ ID NO: 3708288 - RNA, 17 nt, Human
uguacagcguuuuaaaa

SEQ ID NO: 3708289 - RNA, 14 nt, Human
uguacaguagauuu

SEQ ID NO: 3708290 - RNA, 17 nt, Human
uguacaguagauuuucc

SEQ ID NO: 3708291 - RNA, 12 nt, Human
uguacagucugu

SEQ ID NO: 3708292 - RNA, 15 nt, Human
uguacagucugucau

SEQ ID NO: 3708293 - RNA, 16 nt, Human
uguacagucugucaug

SEQ ID NO: 3708294 - RNA, 14 nt, Human
uguacagucuugua

SEQ ID NO: 3708295 - RNA, 15 nt, Human
uguacagucuuguau

SEQ ID NO: 3708296 - RNA, 17 nt, Human
uguacagucuuguauua

SEQ ID NO: 3708297 - RNA, 19 nt, Human
uguacaguguguaaagugu

SEQ ID NO: 3708298 - RNA, 22 nt, Human
uguacaguuaucuaaguuaauu

SEQ ID NO: 3708299 - RNA, 14 nt, Human
uguacaguuuguuu

SEQ ID NO: 3708300 - RNA, 12 nt, Human
uguacaguuuuu

SEQ ID NO: 3708301 - RNA, 13 nt, Human
uguacauaaaaga

SEQ ID NO: 3708302 - RNA, 16 nt, Human
uguacauaaaagaauu

SEQ ID NO: 3708303 - RNA, 14 nt, Human
uguacauaaacaau

SEQ ID NO: 3708304 - RNA, 23 nt, Human
uguacauaaauugcauaaagcau

SEQ ID NO: 3708305 - RNA, 14 nt, Human
uguacauaacugaa

SEQ ID NO: 3708306 - RNA, 18 nt, Human
uguacauaacugaaaaug

SEQ ID NO: 3708307 - RNA, 19 nt, Human
uguacauaacugaaaaugu

SEQ ID NO: 3708308 - RNA, 22 nt, Human
uguacauaaugcuuaauuucua

SEQ ID NO: 3708309 - RNA, 18 nt, Human
uguacauacgauuuaagg

SEQ ID NO: 3708310 - RNA, 15 nt, Human
uguacauacuuuuug

SEQ ID NO: 3708311 - RNA, 16 nt, Human
uguacauagccuauau

SEQ ID NO: 3708312 - RNA, 23 nt, Human
uguacauagccuauauuuacagu

SEQ ID NO: 3708313 - RNA, 18 nt, Human
uguacauaguuauuuauu

SEQ ID NO: 3708314 - RNA, 14 nt, Human
uguacauauaagug

SEQ ID NO: 3708315 - RNA, 15 nt, Human
uguacauauguaaaa

SEQ ID NO: 3708316 - RNA, 17 nt, Human
uguacauaugugcugga

SEQ ID NO: 3708317 - RNA, 20 nt, Human
uguacauauuugagacuagu

SEQ ID NO: 3708318 - RNA, 18 nt, Human
uguacauauuuguggaau

SEQ ID NO: 3708319 - RNA, 20 nt, Human
uguacaucccauguaacaga

SEQ ID NO: 3708320 - RNA, 22 nt, Human
uguacaucccauguaacagaaa

SEQ ID NO: 3708321 - RNA, 14 nt, Human
uguacaucuauuuu

SEQ ID NO: 3708322 - RNA, 18 nt, Human
uguacaucuauuuuggau

SEQ ID NO: 3708323 - RNA, 21 nt, Human
uguacaucuauuuuggauugu

SEQ ID NO: 3708324 - RNA, 12 nt, Human
uuaaaaauggaa

SEQ ID NO: 3708325 - RNA, 17 nt, Human
uuaaaaaugguaucaaa

SEQ ID NO: 3708326 - RNA, 22 nt, Human
uuaaaaaugguaucaaaauuac

SEQ ID NO: 3708327 - RNA, 23 nt, Human
uuaaaaaugguaucaaaauuaca

SEQ ID NO: 3708328 - RNA, 22 nt, Human
uuaaaaaugguggcuucagcuc

SEQ ID NO: 3708329 - RNA, 16 nt, Human
uuaaaaauguaaauau

SEQ ID NO: 3708330 - RNA, 17 nt, Human
uuaaaaauguaaauauu

SEQ ID NO: 3708331 - RNA, 19 nt, Human
uuaaaaauguaaauauucu

SEQ ID NO: 3708332 - RNA, 20 nt, Human
uuaaaaauguuuuuucaugu

SEQ ID NO: 3708333 - RNA, 24 nt, Human
uuaaaaauguuuuuucauguguuu

SEQ ID NO: 3708334 - RNA, 20 nt, Human
uuaaaaauucuugaaagaau

SEQ ID NO: 3708335 - RNA, 22 nt, Human
uuaaaaauuggcuaguugaauc

SEQ ID NO: 3708336 - RNA, 14 nt, Human
uuaaaaauuguuau

SEQ ID NO: 3708337 - RNA, 21 nt, Human
uuaaaacacguuuuaaggacu

SEQ ID NO: 3708338 - RNA, 17 nt, Human
uuaaaacacuucugucc

SEQ ID NO: 3708339 - RNA, 18 nt, Human
uuaaaacacuuucaaaac

SEQ ID NO: 3708340 - RNA, 23 nt, Human
uuaaaacaguauuuauuuuguaa

SEQ ID NO: 3708341 - RNA, 13 nt, Human
uuaaaacauguaa

SEQ ID NO: 3708342 - RNA, 14 nt, Human
uuaaaacauguaau

SEQ ID NO: 3708343 - RNA, 16 nt, Human
uuaaaacuaaauuuca

SEQ ID NO: 3708344 - RNA, 20 nt, Human
uuaaaacuaggcauuuguaa

SEQ ID NO: 3708345 - RNA, 12 nt, Human
uuaaaacuccug

SEQ ID NO: 3708346 - RNA, 16 nt, Human
uuaaaacugaagucug

SEQ ID NO: 3708347 - RNA, 17 nt, Human
uuaaaacugaagucuga

SEQ ID NO: 3708348 - RNA, 19 nt, Human
uuaaaacugaagucugaaa

SEQ ID NO: 3708349 - RNA, 12 nt, Human
uuaaaacugcuu

SEQ ID NO: 3708350 - RNA, 15 nt, Human
uuaaaacuucuuaaa

SEQ ID NO: 3708351 - RNA, 19 nt, Human
uuaaaacuucuuaaauauc

SEQ ID NO: 3708352 - RNA, 15 nt, Human
uuaaaacuuguaauu

SEQ ID NO: 3708353 - RNA, 15 nt, Human
uuaaaacuuugaagu

SEQ ID NO: 3708354 - RNA, 12 nt, Human
uuaaaagaauau

SEQ ID NO: 3708355 - RNA, 23 nt, Human
uuaaaagaauaucuggcaaauua

SEQ ID NO: 3708356 - RNA, 21 nt, Human
uuaaaagaauauuuuaacuuc

SEQ ID NO: 3708357 - RNA, 22 nt, Human
uuaaaagaauauuuuaacuucc

SEQ ID NO: 3708358 - RNA, 12 nt, Human
uuaaaagaauga

SEQ ID NO: 3708359 - RNA, 14 nt, Human
uuaaaagaaugacu

SEQ ID NO: 3708360 - RNA, 15 nt, Human
uuaaaagaaugacua

SEQ ID NO: 3708361 - RNA, 19 nt, Human
uuaaaagaaugauuaugaa

SEQ ID NO: 3708362 - RNA, 13 nt, Human
uuaaaagaauggg

SEQ ID NO: 3708363 - RNA, 17 nt, Human
uuaaaagauucauuuuu

SEQ ID NO: 3708364 - RNA, 21 nt, Human
uuaaaagauucauuuuuaauc

SEQ ID NO: 3708365 - RNA, 19 nt, Human
uuaaaagccaucauguaaa

SEQ ID NO: 3708366 - RNA, 21 nt, Human
uuaaaagccaucauguaaauu

SEQ ID NO: 3708367 - RNA, 16 nt, Human
uuaaaagcuaucuuca

SEQ ID NO: 3708368 - RNA, 19 nt, Human
uuaaaagcuaucuucaugu

SEQ ID NO: 3708369 - RNA, 15 nt, Human
uuaaaaggauaguau

SEQ ID NO: 3708370 - RNA, 22 nt, Human
uuaaaaggauuuuuaucuuucg

SEQ ID NO: 3708371 - RNA, 15 nt, Human
uuaaaaguaaaaugu

SEQ ID NO: 3708372 - RNA, 20 nt, Human
uuaaaagucacaauguucuu

SEQ ID NO: 3708373 - RNA, 17 nt, Human
uuaaaaguuucaaugug

SEQ ID NO: 3708374 - RNA, 16 nt, Human
uuaaaauaaacuuucu

SEQ ID NO: 3708375 - RNA, 15 nt, Human
uuaaaauaagucuga

SEQ ID NO: 3708376 - RNA, 18 nt, Human
uuaaaauacacacucaaa

SEQ ID NO: 3708377 - RNA, 11 nt, Human
uuaaaauacug

SEQ ID NO: 3708378 - RNA, 13 nt, Human
uuaaaauacugua

SEQ ID NO: 3708379 - RNA, 17 nt, Human
uuaaaauagaaauuuug

SEQ ID NO: 3708380 - RNA, 21 nt, Human
uuaaaauagaaauuuuguaag

SEQ ID NO: 3708381 - RNA, 12 nt, Human
uuaaaauauauu

SEQ ID NO: 3708382 - RNA, 16 nt, Human
uuaaaauaugcacuaa

SEQ ID NO: 3708383 - RNA, 19 nt, Human
uuaaaauaugcacuaaguc

SEQ ID NO: 3708384 - RNA, 16 nt, Human
uuaaaauauuccugca

SEQ ID NO: 3708385 - RNA, 18 nt, Human
uuaaaaucuauucugugu

SEQ ID NO: 3708386 - RNA, 18 nt, Human
uuaaaaucugagggaaau

SEQ ID NO: 3708387 - RNA, 11 nt, Human
uuaaaaucuua

SEQ ID NO: 3708388 - RNA, 14 nt, Human
uuaaaaucuuaaac

SEQ ID NO: 3708389 - RNA, 15 nt, Human
uuaaaaucuuauuaa

SEQ ID NO: 3708390 - RNA, 16 nt, Human
uuaaaaucuuauuaaa

SEQ ID NO: 3708391 - RNA, 20 nt, Human
uuaaaaucuuauuaaaguuu

SEQ ID NO: 3708392 - RNA, 19 nt, Human
uuaaaaugauugaaaauaa

SEQ ID NO: 3708393 - RNA, 11 nt, Human
uuaaaauggaa

SEQ ID NO: 3708394 - RNA, 21 nt, Human
uuaaaauggugcuuaaguucc

SEQ ID NO: 3708395 - RNA, 19 nt, Human
uuaaaaugguuuguccuga

SEQ ID NO: 3708396 - RNA, 21 nt, Human
uuaaaaugguuuguccugaug

SEQ ID NO: 3708397 - RNA, 17 nt, Human
uuaaaauguaagauuau

SEQ ID NO: 3708398 - RNA, 13 nt, Human
uuaaaauguaauu

SEQ ID NO: 3708399 - RNA, 19 nt, Human
uuaaaauguacauguauua

SEQ ID NO: 3708400 - RNA, 21 nt, Human
uuaaaauguacauguauuaaa

SEQ ID NO: 3708401 - RNA, 19 nt, Human
uuaaaauguaugcauguug

SEQ ID NO: 3708402 - RNA, 20 nt, Human
uuaaaauuaugaaucugauu

SEQ ID NO: 3708403 - RNA, 13 nt, Human
uuaaaauucaugu

SEQ ID NO: 3708404 - RNA, 14 nt, Human
uuaaaauucugaau

SEQ ID NO: 3708405 - RNA, 15 nt, Human
uuaaaauucugaauu

SEQ ID NO: 3708406 - RNA, 18 nt, Human
uuaaaauucugaauuuug

SEQ ID NO: 3708407 - RNA, 15 nt, Human
uuaaaauuuauugcu

SEQ ID NO: 3708408 - RNA, 13 nt, Human
uuaaaauuucuua

SEQ ID NO: 3708409 - RNA, 22 nt, Human
uuaaaauuucuuagaaaacaau

SEQ ID NO: 3708410 - RNA, 14 nt, Human
uuaaaauuugaaac

SEQ ID NO: 3708411 - RNA, 12 nt, Human
uuaaaauuuguu

SEQ ID NO: 3708412 - RNA, 18 nt, Human
uuaaaauuuuuuuagaaa

SEQ ID NO: 3708413 - RNA, 16 nt, Human
uuaaacaauuuauuuu

SEQ ID NO: 3708414 - RNA, 22 nt, Human
uuaaacacacagauacacacac

SEQ ID NO: 3708415 - RNA, 14 nt, Human
uuaaacacauuaaa

SEQ ID NO: 3708416 - RNA, 14 nt, Human
uuaaacaccccuca

SEQ ID NO: 3708417 - RNA, 13 nt, Human
uuaaacaccuccu

SEQ ID NO: 3708418 - RNA, 11 nt, Human
uuaaacagaug

SEQ ID NO: 3708419 - RNA, 14 nt, Human
uuaaacagcagugu

SEQ ID NO: 3708420 - RNA, 19 nt, Human
uuaaacagccuauuccuga

SEQ ID NO: 3708421 - RNA, 17 nt, Human
uuaaacaguugcacagc

SEQ ID NO: 3708422 - RNA, 18 nt, Human
uuaaacaguugcacagca

SEQ ID NO: 3708423 - RNA, 19 nt, Human
uuaaacaguugcacagcau

SEQ ID NO: 3708424 - RNA, 22 nt, Human
uuaaacauauccaaguuugaau

SEQ ID NO: 3708425 - RNA, 19 nt, Human
uuaaacaucaaucuuuaaa

SEQ ID NO: 3708426 - RNA, 10 nt, Human
uuaaacauua

SEQ ID NO: 3708427 - RNA, 19 nt, Human
uuaaacauuaauagcagcc

SEQ ID NO: 3708428 - RNA, 18 nt, Human
uuaaaccaucucccuggu

SEQ ID NO: 3708429 - RNA, 21 nt, Human
uuaaaccaucucccuggugcu

SEQ ID NO: 3708430 - RNA, 17 nt, Human
uuaaaccaugggauaaa

SEQ ID NO: 3708431 - RNA, 13 nt, Human
uuaaaccuuuuau

SEQ ID NO: 3708432 - RNA, 14 nt, Human
uuaaaccuuuuauu

SEQ ID NO: 3708433 - RNA, 19 nt, Human
uuaaacgaagaguucccuu

SEQ ID NO: 3708434 - RNA, 13 nt, Human
uuaaacggauuau

SEQ ID NO: 3708435 - RNA, 23 nt, Human
uuaaacggauuauuuuuucagac

SEQ ID NO: 3708436 - RNA, 14 nt, Human
uuaaacuaaaugug

SEQ ID NO: 3708437 - RNA, 14 nt, Human
uuaaacuagaugac

SEQ ID NO: 3708438 - RNA, 18 nt, Human
uuaaacuagaugaccuca

SEQ ID NO: 3708439 - RNA, 21 nt, Human
uuaaacuagcauaucugccuu

SEQ ID NO: 3708440 - RNA, 22 nt, Human
uuaaacuaggagaaccaaaucu

SEQ ID NO: 3708441 - RNA, 14 nt, Human
uuaaacuaucuugu

SEQ ID NO: 3708442 - RNA, 14 nt, Human
uuaaacucaagaca

SEQ ID NO: 3708443 - RNA, 16 nt, Human
uuaaacucaagacaau

SEQ ID NO: 3708444 - RNA, 22 nt, Human
uuaaacucgagauacagcuuuu

SEQ ID NO: 3708445 - RNA, 13 nt, Human
uuaaacucugaau

SEQ ID NO: 3708446 - RNA, 13 nt, Human
uuaaacugguauu

SEQ ID NO: 3708447 - RNA, 15 nt, Human
uuaaacuguacagug

SEQ ID NO: 3708448 - RNA, 16 nt, Human
uuaaacuguacagugu

SEQ ID NO: 3708449 - RNA, 21 nt, Human
uuaaacuguguggacugugau

SEQ ID NO: 3708450 - RNA, 18 nt, Human
uuaaacuguuagcacugu

SEQ ID NO: 3708451 - RNA, 21 nt, Human
uuaaacuguuagcacuguuga

SEQ ID NO: 3708452 - RNA, 16 nt, Human
uuaaacuuaaucuaaa

SEQ ID NO: 3708453 - RNA, 18 nt, Human
uuaaacuuaaucuaaaug

SEQ ID NO: 3708454 - RNA, 20 nt, Human
uuaaacuuaaucuaaaugga

SEQ ID NO: 3708455 - RNA, 23 nt, Human
uuaaacuuauaaaucauauugau

SEQ ID NO: 3708456 - RNA, 16 nt, Human
uuaaacuuaugaaugu

SEQ ID NO: 3708457 - RNA, 14 nt, Human
uuaaacuucucuga

SEQ ID NO: 3708458 - RNA, 14 nt, Human
uuaaacuugugaau

SEQ ID NO: 3708459 - RNA, 15 nt, Human
uuaaacuuuuuuaac

SEQ ID NO: 3708460 - RNA, 16 nt, Human
uuaaagaaaaaaaugu

SEQ ID NO: 3708461 - RNA, 20 nt, Human
uuaaagaaaaaaauugaaau

SEQ ID NO: 3708462 - RNA, 22 nt, Human
uuaaagaaaaaaauugaaaugu

SEQ ID NO: 3708463 - RNA, 17 nt, Human
uuaaagaaaagaugaaa

SEQ ID NO: 3708464 - RNA, 23 nt, Human
uuaaagaaaauaaaauuaagaau

SEQ ID NO: 3708465 - RNA, 14 nt, Human
uuaaagaaacagcu

SEQ ID NO: 3708466 - RNA, 17 nt, Human
uuaaagaaacaugguuu

SEQ ID NO: 3708467 - RNA, 18 nt, Human
uuaaagaauaugaaacau

SEQ ID NO: 3708468 - RNA, 20 nt, Human
uuaaagaauaugacuuuuua

SEQ ID NO: 3708469 - RNA, 17 nt, Human
uuaaagaauucaaauuu

SEQ ID NO: 3708470 - RNA, 20 nt, Human
uuaaagacccuccuauucua

SEQ ID NO: 3708471 - RNA, 14 nt, Human
uuaaagagaaugag

SEQ ID NO: 3708472 - RNA, 14 nt, Human
uuaaagagagguua

SEQ ID NO: 3708473 - RNA, 20 nt, Human
uuaaagagagguuauagagu

SEQ ID NO: 3708474 - RNA, 16 nt, Human
uguacaugaaaacaca

SEQ ID NO: 3708475 - RNA, 17 nt, Human
uguacaugaaaacacau

SEQ ID NO: 3708476 - RNA, 19 nt, Human
uguacaugaaaacacauuu

SEQ ID NO: 3708477 - RNA, 16 nt, Human
uguacaugagaaggaa

SEQ ID NO: 3708478 - RNA, 14 nt, Human
uguacaugcauuca

SEQ ID NO: 3708479 - RNA, 20 nt, Human
uguacauggaauaacaugua

SEQ ID NO: 3708480 - RNA, 19 nt, Human
uguacauggcagaguuugu

SEQ ID NO: 3708481 - RNA, 13 nt, Human
uguacauguauua

SEQ ID NO: 3708482 - RNA, 21 nt, Human
uguacauguauuaaauuacau

SEQ ID NO: 3708483 - RNA, 11 nt, Human
uguacaugugu

SEQ ID NO: 3708484 - RNA, 20 nt, Human
uguacauguguagccugugc

SEQ ID NO: 3708485 - RNA, 21 nt, Human
uguacauguguagccugugca

SEQ ID NO: 3708486 - RNA, 21 nt, Human
uguacauguucgggugugggu

SEQ ID NO: 3708487 - RNA, 15 nt, Human
uguacauuuaaaauu

SEQ ID NO: 3708488 - RNA, 21 nt, Human
uguacauuucuauaaauagau

SEQ ID NO: 3708489 - RNA, 22 nt, Human
uguacauuuuguuguaaaaaga

SEQ ID NO: 3708490 - RNA, 23 nt, Human
uguaccaaaauucaucugucuau

SEQ ID NO: 3708491 - RNA, 16 nt, Human
uguaccaagugaaauu

SEQ ID NO: 3708492 - RNA, 16 nt, Human
uguaccacuuuugcaa

SEQ ID NO: 3708493 - RNA, 20 nt, Human
uguaccagcccagauguuuu

SEQ ID NO: 3708494 - RNA, 21 nt, Human
uguaccaggaaaggauuuuau

SEQ ID NO: 3708495 - RNA, 15 nt, Human
uguaccaguuaauuu

SEQ ID NO: 3708496 - RNA, 22 nt, Human
uguaccaguuaauuuuuccaac

SEQ ID NO: 3708497 - RNA, 17 nt, Human
uguaccauauagcaaaa

SEQ ID NO: 3708498 - RNA, 21 nt, Human
uguaccaugaaacaaagcugc

SEQ ID NO: 3708499 - RNA, 12 nt, Human
uguaccauguac

SEQ ID NO: 3708500 - RNA, 14 nt, Human
uguaccauuaaaau

SEQ ID NO: 3708501 - RNA, 14 nt, Human
uguaccauuugccu

SEQ ID NO: 3708502 - RNA, 14 nt, Human
uguaccccccaacc

SEQ ID NO: 3708503 - RNA, 17 nt, Human
uguacccccgcccaggc

SEQ ID NO: 3708504 - RNA, 19 nt, Human
uguacccccgcccaggcug

SEQ ID NO: 3708505 - RNA, 18 nt, Human
uguaccgcgucuacccug

SEQ ID NO: 3708506 - RNA, 20 nt, Human
uguaccgcgucuacccuggg

SEQ ID NO: 3708507 - RNA, 21 nt, Human
uguaccgggcuggccugugcc

SEQ ID NO: 3708508 - RNA, 22 nt, Human
uguaccguaggcuuuguauuca

SEQ ID NO: 3708509 - RNA, 17 nt, Human
uguaccuccccugccuu

SEQ ID NO: 3708510 - RNA, 20 nt, Human
uguaccuccucucaguguuu

SEQ ID NO: 3708511 - RNA, 21 nt, Human
uguaccucuuuuagucauuuu

SEQ ID NO: 3708512 - RNA, 18 nt, Human
uguaccugcccccaaucc

SEQ ID NO: 3708513 - RNA, 17 nt, Human
uguaccuggugaccccu

SEQ ID NO: 3708514 - RNA, 22 nt, Human
uguacgacgucagauguuuaaa

SEQ ID NO: 3708515 - RNA, 17 nt, Human
uguacguccagccugcc

SEQ ID NO: 3708516 - RNA, 15 nt, Human
uguacgucugacagg

SEQ ID NO: 3708517 - RNA, 12 nt, Human
uguacguggaga

SEQ ID NO: 3708518 - RNA, 14 nt, Human
uguacguggagagg

SEQ ID NO: 3708519 - RNA, 23 nt, Human
uguacguggccauguaugaagcc

SEQ ID NO: 3708520 - RNA, 19 nt, Human
uguacguuuguaugugugu

SEQ ID NO: 3708521 - RNA, 18 nt, Human
uguacuaggauacugcug

SEQ ID NO: 3708522 - RNA, 16 nt, Human
uguacuaguacugugu

SEQ ID NO: 3708523 - RNA, 17 nt, Human
uguacuaguacugugua

SEQ ID NO: 3708524 - RNA, 15 nt, Human
uguacuagucugugu

SEQ ID NO: 3708525 - RNA, 19 nt, Human
uguacuagucuguguggga

SEQ ID NO: 3708526 - RNA, 13 nt, Human
uguacuaguuuua

SEQ ID NO: 3708527 - RNA, 18 nt, Human
uguacuauuuaacugacu

SEQ ID NO: 3708528 - RNA, 13 nt, Human
uguacucaauuuu

SEQ ID NO: 3708529 - RNA, 13 nt, Human
uguacuccuccca

SEQ ID NO: 3708530 - RNA, 20 nt, Human
uguacucgcuugugcagaaa

SEQ ID NO: 3708531 - RNA, 13 nt, Human
uguacucuuccga

SEQ ID NO: 3708532 - RNA, 15 nt, Human
uguacugauucaauu

SEQ ID NO: 3708533 - RNA, 19 nt, Human
uguacugcauaugaaagga

SEQ ID NO: 3708534 - RNA, 13 nt, Human
uguacugccugcu

SEQ ID NO: 3708535 - RNA, 15 nt, Human
uguacugcucaggcu

SEQ ID NO: 3708536 - RNA, 12 nt, Human
uguacugggggu

SEQ ID NO: 3708537 - RNA, 15 nt, Human
uguacuguacuaauu

SEQ ID NO: 3708538 - RNA, 16 nt, Human
uguacuguaguuuuuc

SEQ ID NO: 3708539 - RNA, 23 nt, Human
uguacuguauagacaguuuguaa

SEQ ID NO: 3708540 - RNA, 17 nt, Human
uguacuguaugugauga

SEQ ID NO: 3708541 - RNA, 15 nt, Human
uguacuguucugugu

SEQ ID NO: 3708542 - RNA, 16 nt, Human
uguacuguucuguguc

SEQ ID NO: 3708543 - RNA, 19 nt, Human
uguacuguuuaauguucug

SEQ ID NO: 3708544 - RNA, 15 nt, Human
uguacuuaacuauuc

SEQ ID NO: 3708545 - RNA, 14 nt, Human
uguacuucaaguua

SEQ ID NO: 3708546 - RNA, 13 nt, Human
uguacuucacugu

SEQ ID NO: 3708547 - RNA, 23 nt, Human
uguacuugcccugaccaugcauu

SEQ ID NO: 3708548 - RNA, 15 nt, Human
uguacuugcucuuga

SEQ ID NO: 3708549 - RNA, 21 nt, Human
uguacuuuaucaugaaugcuu

SEQ ID NO: 3708550 - RNA, 12 nt, Human
uguacuuucugu

SEQ ID NO: 3708551 - RNA, 19 nt, Human
uguacuuucuguuaaaaug

SEQ ID NO: 3708552 - RNA, 20 nt, Human
uguacuuugauucacauguu

SEQ ID NO: 3708553 - RNA, 18 nt, Human
uguacuuugcuugcucau

SEQ ID NO: 3708554 - RNA, 23 nt, Human
uguacuuuuauuuuacacagaaa

SEQ ID NO: 3708555 - RNA, 13 nt, Human
uguacuuuucauu

SEQ ID NO: 3708556 - RNA, 23 nt, Human
uguagaaaauuuguuauuuugca

SEQ ID NO: 3708557 - RNA, 21 nt, Human
uguagaaaugguuguauuaga

SEQ ID NO: 3708558 - RNA, 18 nt, Human
uguagaacacuaauucau

SEQ ID NO: 3708559 - RNA, 17 nt, Human
uguagaaccuaauucaa

SEQ ID NO: 3708560 - RNA, 19 nt, Human
uguagaacucacucugggc

SEQ ID NO: 3708561 - RNA, 17 nt, Human
uguagaaggagacagag

SEQ ID NO: 3708562 - RNA, 21 nt, Human
uguagaaggagacagagcugg

SEQ ID NO: 3708563 - RNA, 18 nt, Human
uguagaaugauuucaugc

SEQ ID NO: 3708564 - RNA, 16 nt, Human
uguagacaaaguacau

SEQ ID NO: 3708565 - RNA, 19 nt, Human
uguagacaaaguacauucu

SEQ ID NO: 3708566 - RNA, 17 nt, Human
uguagacaguuggguuu

SEQ ID NO: 3708567 - RNA, 21 nt, Human
uguagaccuagggaggaccuu

SEQ ID NO: 3708568 - RNA, 19 nt, Human
uguagacuauauacaugug

SEQ ID NO: 3708569 - RNA, 21 nt, Human
uguagacuauauacaugugug

SEQ ID NO: 3708570 - RNA, 23 nt, Human
uguagagaacacgcguauuuaca

SEQ ID NO: 3708571 - RNA, 14 nt, Human
uguagagcuucugg

SEQ ID NO: 3708572 - RNA, 14 nt, Human
uguagagggcccug

SEQ ID NO: 3708573 - RNA, 14 nt, Human
uguagagugggagc

SEQ ID NO: 3708574 - RNA, 13 nt, Human
uguagaguuaaga

SEQ ID NO: 3708575 - RNA, 19 nt, Human
uguagaguuaagaagcugu

SEQ ID NO: 3708576 - RNA, 13 nt, Human
uguagauaagugu

SEQ ID NO: 3708577 - RNA, 19 nt, Human
uguagauacaaucagcugc

SEQ ID NO: 3708578 - RNA, 20 nt, Human
uguagaugaaaaagcaugua

SEQ ID NO: 3708579 - RNA, 23 nt, Human
uguagauggaaaaacuugugcua

SEQ ID NO: 3708580 - RNA, 21 nt, Human
uguagauuaaggugaugugau

SEQ ID NO: 3708581 - RNA, 22 nt, Human
uguagauugauuguauuguuga

SEQ ID NO: 3708582 - RNA, 15 nt, Human
uguagauuuauuuca

SEQ ID NO: 3708583 - RNA, 22 nt, Human
uguagcaaaauucuuaaguaug

SEQ ID NO: 3708584 - RNA, 15 nt, Human
uguagcaaacccugu

SEQ ID NO: 3708585 - RNA, 22 nt, Human
uguagcaaacccugucaaacau

SEQ ID NO: 3708586 - RNA, 17 nt, Human
uguagcacugacagauu

SEQ ID NO: 3708587 - RNA, 15 nt, Human
uguagcacuuacugg

SEQ ID NO: 3708588 - RNA, 19 nt, Human
uguagcacuuacugguagg

SEQ ID NO: 3708589 - RNA, 17 nt, Human
uguagcauuucuugaug

SEQ ID NO: 3708590 - RNA, 16 nt, Human
uguagccacaccagga

SEQ ID NO: 3708591 - RNA, 22 nt, Human
uguagccagguauggcucugca

SEQ ID NO: 3708592 - RNA, 14 nt, Human
uguagccagguccc

SEQ ID NO: 3708593 - RNA, 11 nt, Human
uguagccaugg

SEQ ID NO: 3708594 - RNA, 16 nt, Human
uguagccaugggacca

SEQ ID NO: 3708595 - RNA, 14 nt, Human
uguagcccacacuu

SEQ ID NO: 3708596 - RNA, 16 nt, Human
uguagcccacucugcu

SEQ ID NO: 3708597 - RNA, 16 nt, Human
uguagccccagugaca

SEQ ID NO: 3708598 - RNA, 13 nt, Human
uguagccugugca

SEQ ID NO: 3708599 - RNA, 15 nt, Human
uguagccuuccucca

SEQ ID NO: 3708600 - RNA, 12 nt, Human
uguagccuuuuu

SEQ ID NO: 3708601 - RNA, 20 nt, Human
uguagcguguuuacaugugu

SEQ ID NO: 3708602 - RNA, 15 nt, Human
uguagcuacagagaa

SEQ ID NO: 3708603 - RNA, 19 nt, Human
uguagcuacagagaaacca

SEQ ID NO: 3708604 - RNA, 23 nt, Human
uguagcuacagagaaaccagcuu

SEQ ID NO: 3708605 - RNA, 11 nt, Human
uguagcuccuc

SEQ ID NO: 3708606 - RNA, 18 nt, Human
uguagcuccuccccugga

SEQ ID NO: 3708607 - RNA, 17 nt, Human
uguagcucuaaaaucug

SEQ ID NO: 3708608 - RNA, 20 nt, Human
uguagcucuuugucagggag

SEQ ID NO: 3708609 - RNA, 15 nt, Human
uguagcugaggaggc

SEQ ID NO: 3708610 - RNA, 14 nt, Human
uguagcugguuucc

SEQ ID NO: 3708611 - RNA, 15 nt, Human
uguagcugugaccug

SEQ ID NO: 3708612 - RNA, 21 nt, Human
uguagcugugaccugcugagc

SEQ ID NO: 3708613 - RNA, 22 nt, Human
uguagcugugaccugcugagcu

SEQ ID NO: 3708614 - RNA, 19 nt, Human
uguagcuucagucauuaaa

SEQ ID NO: 3708615 - RNA, 15 nt, Human
uguagcuuuaucaaa

SEQ ID NO: 3708616 - RNA, 23 nt, Human
uguagcuuuggaaguuuagcucu

SEQ ID NO: 3708617 - RNA, 16 nt, Human
uguagcuuuucaccuu

SEQ ID NO: 3708618 - RNA, 22 nt, Human
uguaggaagguacuguaugauc

SEQ ID NO: 3708619 - RNA, 20 nt, Human
uguaggaagguuaauguuca

SEQ ID NO: 3708620 - RNA, 21 nt, Human
uguaggaauucuuuuggggaa

SEQ ID NO: 3708621 - RNA, 13 nt, Human
uguaggagaaacu

SEQ ID NO: 3708622 - RNA, 18 nt, Human
uguaggagaaacucccau

SEQ ID NO: 3708623 - RNA, 14 nt, Human
uaacaggggcuggu

SEQ ID NO: 3708624 - RNA, 16 nt, Human
uaacaggucuccucuu

SEQ ID NO: 3708625 - RNA, 21 nt, Human
uaacaguaugugggauauuga

SEQ ID NO: 3708626 - RNA, 19 nt, Human
uaacagucuuacugcaggc

SEQ ID NO: 3708627 - RNA, 14 nt, Human
uaacagugccauug

SEQ ID NO: 3708628 - RNA, 19 nt, Human
uaacagugccauugucuuu

SEQ ID NO: 3708629 - RNA, 22 nt, Human
uaacagugccauugucuuuaua

SEQ ID NO: 3708630 - RNA, 14 nt, Human
uaacaguucauguu

SEQ ID NO: 3708631 - RNA, 16 nt, Human
uaacaguuuuccauga

SEQ ID NO: 3708632 - RNA, 20 nt, Human
uaacaguuuuccaugaaaac

SEQ ID NO: 3708633 - RNA, 21 nt, Human
uaacaguuuuccaugaaaacg

SEQ ID NO: 3708634 - RNA, 19 nt, Human
uaacaguuuuguguaacuc

SEQ ID NO: 3708635 - RNA, 16 nt, Human
uaacauaaaucuguga

SEQ ID NO: 3708636 - RNA, 15 nt, Human
uaacauaagcuauuu

SEQ ID NO: 3708637 - RNA, 23 nt, Human
uaacauagaauugcaaucuauaa

SEQ ID NO: 3708638 - RNA, 13 nt, Human
uaacauauaauau

SEQ ID NO: 3708639 - RNA, 20 nt, Human
uaacauauaauauauguuuu

SEQ ID NO: 3708640 - RNA, 17 nt, Human
uaacauauguacauaaa

SEQ ID NO: 3708641 - RNA, 23 nt, Human
uaacauauuuacuaagccacaag

SEQ ID NO: 3708642 - RNA, 14 nt, Human
uaacaucuaaaaau

SEQ ID NO: 3708643 - RNA, 16 nt, Human
uaacaucuucaacaug

SEQ ID NO: 3708644 - RNA, 23 nt, Human
uaacaucuugaauacucugcccu

SEQ ID NO: 3708645 - RNA, 15 nt, Human
uaacaugaaaugaua

SEQ ID NO: 3708646 - RNA, 15 nt, Human
uaacaugaagaccuu

SEQ ID NO: 3708647 - RNA, 19 nt, Human
uaacaugaauauuuagugu

SEQ ID NO: 3708648 - RNA, 22 nt, Human
uaacaugcuggugaauauuuuc

SEQ ID NO: 3708649 - RNA, 21 nt, Human
uaacaugcuguguaagcugug

SEQ ID NO: 3708650 - RNA, 23 nt, Human
uaacauggacaugaucuucuuua

SEQ ID NO: 3708651 - RNA, 18 nt, Human
uaacaugggcucuucacu

SEQ ID NO: 3708652 - RNA, 18 nt, Human
uaacaugguuuaaaagaa

SEQ ID NO: 3708653 - RNA, 22 nt, Human
uaacauguccugccuauuaucu

SEQ ID NO: 3708654 - RNA, 15 nt, Human
uaacauguuaaacca

SEQ ID NO: 3708655 - RNA, 13 nt, Human
uaacauuauauug

SEQ ID NO: 3708656 - RNA, 16 nt, Human
uaacauuauauugcaa

SEQ ID NO: 3708657 - RNA, 12 nt, Human
uaacauuauuua

SEQ ID NO: 3708658 - RNA, 15 nt, Human
uaacauuauuuauau

SEQ ID NO: 3708659 - RNA, 12 nt, Human
uaacauuccaag

SEQ ID NO: 3708660 - RNA, 16 nt, Human
uaacauuccuaaaaug

SEQ ID NO: 3708661 - RNA, 11 nt, Human
uaacauuccuc

SEQ ID NO: 3708662 - RNA, 20 nt, Human
uaacauuccucaugaaugua

SEQ ID NO: 3708663 - RNA, 16 nt, Human
uaacauugaccaagaa

SEQ ID NO: 3708664 - RNA, 20 nt, Human
uaacauugaccaagaacugc

SEQ ID NO: 3708665 - RNA, 20 nt, Human
uaacauugggaaaucuuaua

SEQ ID NO: 3708666 - RNA, 20 nt, Human
uaacauuggguccugggucu

SEQ ID NO: 3708667 - RNA, 12 nt, Human
uaacauuugccu

SEQ ID NO: 3708668 - RNA, 16 nt, Human
uaacauuugccuugca

SEQ ID NO: 3708669 - RNA, 22 nt, Human
uaacauuugcuguuuuaaacau

SEQ ID NO: 3708670 - RNA, 12 nt, Human
uaacauuuuguu

SEQ ID NO: 3708671 - RNA, 14 nt, Human
uaacauuuuguucu

SEQ ID NO: 3708672 - RNA, 15 nt, Human
uaacauuuuguucuu

SEQ ID NO: 3708673 - RNA, 16 nt, Human
uaacauuuuguucuua

SEQ ID NO: 3708674 - RNA, 22 nt, Human
uaacauuuuguucuuacacaua

SEQ ID NO: 3708675 - RNA, 13 nt, Human
uaaccaaaugcau

SEQ ID NO: 3708676 - RNA, 21 nt, Human
uaaccaagagauaacuguaaa

SEQ ID NO: 3708677 - RNA, 20 nt, Human
uaaccaagcugaguuuccua

SEQ ID NO: 3708678 - RNA, 15 nt, Human
uaaccaaggaaauau

SEQ ID NO: 3708679 - RNA, 14 nt, Human
uaaccaaucuacaa

SEQ ID NO: 3708680 - RNA, 23 nt, Human
uaaccacaaagcacaguuugaac

SEQ ID NO: 3708681 - RNA, 14 nt, Human
uaaccacagcuccu

SEQ ID NO: 3708682 - RNA, 11 nt, Human
uaaccacccca

SEQ ID NO: 3708683 - RNA, 19 nt, Human
uaaccacgucugucuucac

SEQ ID NO: 3708684 - RNA, 20 nt, Human
uaaccacgucugucuucaca

SEQ ID NO: 3708685 - RNA, 17 nt, Human
uaaccacugcaaguccu

SEQ ID NO: 3708686 - RNA, 18 nt, Human
uaaccacugcaaguccuu

SEQ ID NO: 3708687 - RNA, 20 nt, Human
uaaccacuuaaaaaaugucc

SEQ ID NO: 3708688 - RNA, 21 nt, Human
uaaccagggcaccaagcccac

SEQ ID NO: 3708689 - RNA, 22 nt, Human
uaaccaguuguggugugaguau

SEQ ID NO: 3708690 - RNA, 19 nt, Human
uaaccauguguuauguuuu

SEQ ID NO: 3708691 - RNA, 15 nt, Human
uaaccauuaaaacug

SEQ ID NO: 3708692 - RNA, 14 nt, Human
uaacccaacucucc

SEQ ID NO: 3708693 - RNA, 16 nt, Human
uaacccagaaaaucug

SEQ ID NO: 3708694 - RNA, 19 nt, Human
uaaccccaaaaugaagauu

SEQ ID NO: 3708695 - RNA, 13 nt, Human
uaaccccagcucc

SEQ ID NO: 3708696 - RNA, 15 nt, Human
uaaccccaggccccg

SEQ ID NO: 3708697 - RNA, 18 nt, Human
uaacccccacuggacuga

SEQ ID NO: 3708698 - RNA, 16 nt, Human
uaaccccccuguacac

SEQ ID NO: 3708699 - RNA, 15 nt, Human
uaaccccgggcgggu

SEQ ID NO: 3708700 - RNA, 18 nt, Human
uaaccccgucaacaaauc

SEQ ID NO: 3708701 - RNA, 16 nt, Human
uaaccccuuuccugcg

SEQ ID NO: 3708702 - RNA, 17 nt, Human
uaacccuguuacaaagc

SEQ ID NO: 3708703 - RNA, 20 nt, Human
uaacccuucaucuuccugug

SEQ ID NO: 3708704 - RNA, 21 nt, Human
uaacccuucaucuuccugugu

SEQ ID NO: 3708705 - RNA, 20 nt, Human
uaacccuuugguuuuuuucu

SEQ ID NO: 3708706 - RNA, 17 nt, Human
uaaccgaugcuuuacca

SEQ ID NO: 3708707 - RNA, 13 nt, Human
uaaccgcuccagg

SEQ ID NO: 3708708 - RNA, 21 nt, Human
uaaccggcauguuuccagcag

SEQ ID NO: 3708709 - RNA, 20 nt, Human
uaaccguccucgagcaacug

SEQ ID NO: 3708710 - RNA, 13 nt, Human
uaaccuaguuaaa

SEQ ID NO: 3708711 - RNA, 11 nt, Human
uaaccuccuuu

SEQ ID NO: 3708712 - RNA, 14 nt, Human
uaaccucgcccucu

SEQ ID NO: 3708713 - RNA, 17 nt, Human
uaaccucuuuucugcau

SEQ ID NO: 3708714 - RNA, 22 nt, Human
uaaccugagauggcccucuggu

SEQ ID NO: 3708715 - RNA, 11 nt, Human
uaaccuggagg

SEQ ID NO: 3708716 - RNA, 18 nt, Human
uaaccuggugcuggauau

SEQ ID NO: 3708717 - RNA, 19 nt, Human
uaaccuggugcuggauauu

SEQ ID NO: 3708718 - RNA, 22 nt, Human
uaaccuggugcuggauauuuuc

SEQ ID NO: 3708719 - RNA, 19 nt, Human
uaaccuguacuucaaguua

SEQ ID NO: 3708720 - RNA, 12 nt, Human
uaaccugugucu

SEQ ID NO: 3708721 - RNA, 14 nt, Human
uaaccugugucugc

SEQ ID NO: 3708722 - RNA, 19 nt, Human
uaaccuuacuaauuauacu

SEQ ID NO: 3708723 - RNA, 21 nt, Human
uaaccuuauccugcauuguua

SEQ ID NO: 3708724 - RNA, 18 nt, Human
uaaccuugaaugcugcca

SEQ ID NO: 3708725 - RNA, 22 nt, Human
uaaccuugaaugcugccagugu

SEQ ID NO: 3708726 - RNA, 19 nt, Human
uaaccuugccugguacagu

SEQ ID NO: 3708727 - RNA, 13 nt, Human
uaaccuuguauaa

SEQ ID NO: 3708728 - RNA, 16 nt, Human
uaacgaaguugggcaa

SEQ ID NO: 3708729 - RNA, 14 nt, Human
uaacgacuucaggg

SEQ ID NO: 3708730 - RNA, 20 nt, Human
uaacgauaaaagacagugaa

SEQ ID NO: 3708731 - RNA, 14 nt, Human
uaacgcaaccaagu

SEQ ID NO: 3708732 - RNA, 17 nt, Human
uaacgcaaguucccagu

SEQ ID NO: 3708733 - RNA, 23 nt, Human
uaacgcaccgacuagacacacaa

SEQ ID NO: 3708734 - RNA, 22 nt, Human
uaacgcguaucuaggcuuuggu

SEQ ID NO: 3708735 - RNA, 13 nt, Human
uaacggcuccagg

SEQ ID NO: 3708736 - RNA, 23 nt, Human
uaacggucuguucuguuucaagg

SEQ ID NO: 3708737 - RNA, 22 nt, Human
uaacguuagaccacaaauagug

SEQ ID NO: 3708738 - RNA, 16 nt, Human
uaacguugcuguggga

SEQ ID NO: 3708739 - RNA, 18 nt, Human
uaacguugcugugggaac

SEQ ID NO: 3708740 - RNA, 20 nt, Human
uaacguuuuuccuuuaaaaa

SEQ ID NO: 3708741 - RNA, 15 nt, Human
uaacuaaaagguaug

SEQ ID NO: 3708742 - RNA, 18 nt, Human
uaacuaaaauaauuuugu

SEQ ID NO: 3708743 - RNA, 19 nt, Human
uaacuaaaauaauuuugua

SEQ ID NO: 3708744 - RNA, 20 nt, Human
uaacuaaaauaauuuuguaa

SEQ ID NO: 3708745 - RNA, 18 nt, Human
uaacuaaauuugauacuu

SEQ ID NO: 3708746 - RNA, 23 nt, Human
uaacuaauaugggcauuguaguu

SEQ ID NO: 3708747 - RNA, 19 nt, Human
uaacuaaucuauuggguuc

SEQ ID NO: 3708748 - RNA, 23 nt, Human
uaacuaaucuauuggguucauua

SEQ ID NO: 3708749 - RNA, 12 nt, Human
uaacuacauuua

SEQ ID NO: 3708750 - RNA, 21 nt, Human
uaacuaccuuuggcuuaauuc

SEQ ID NO: 3708751 - RNA, 22 nt, Human
uaacuaccuuuggcuuaauucc

SEQ ID NO: 3708752 - RNA, 12 nt, Human
uaacuacugugu

SEQ ID NO: 3708753 - RNA, 13 nt, Human
uaacuacuuuaua

SEQ ID NO: 3708754 - RNA, 12 nt, Human
uaacuagaacug

SEQ ID NO: 3708755 - RNA, 17 nt, Human
uaacuagacaccaaagu

SEQ ID NO: 3708756 - RNA, 18 nt, Human
uaacuagauggugcugag

SEQ ID NO: 3708757 - RNA, 16 nt, Human
uaacuaggcucagaga

SEQ ID NO: 3708758 - RNA, 16 nt, Human
uaacuagggaagaaag

SEQ ID NO: 3708759 - RNA, 21 nt, Human
uaacuaucacugguuugguuc

SEQ ID NO: 3708760 - RNA, 18 nt, Human
uaacuauguacaauauuu

SEQ ID NO: 3708761 - RNA, 12 nt, Human
uaacuauucagu

SEQ ID NO: 3708762 - RNA, 22 nt, Human
uaacuauucaguuguguuuguu

SEQ ID NO: 3708763 - RNA, 16 nt, Human
uaacuauugcauuuau

SEQ ID NO: 3708764 - RNA, 17 nt, Human
uaacuauugcccagguu

SEQ ID NO: 3708765 - RNA, 15 nt, Human
uaacucaaauacaca

SEQ ID NO: 3708766 - RNA, 18 nt, Human
uaacucaaauacacauuu

SEQ ID NO: 3708767 - RNA, 22 nt, Human
uaacucaaggauaccuucuuau

SEQ ID NO: 3708768 - RNA, 14 nt, Human
uaacucaauauuuu

SEQ ID NO: 3708769 - RNA, 15 nt, Human
uaacucaccagcccc

SEQ ID NO: 3708770 - RNA, 16 nt, Human
uaacucaccagcccca

SEQ ID NO: 3708771 - RNA, 18 nt, Human
uaacucaccuggcaucuu

SEQ ID NO: 3708772 - RNA, 22 nt, Human
uaacucagaaacaucaguuacu

SEQ ID NO: 3708773 - RNA, 16 nt, Human
uuaaagagucuagauu

SEQ ID NO: 3708774 - RNA, 18 nt, Human
uuaaagagucuagauuca

SEQ ID NO: 3708775 - RNA, 11 nt, Human
uuaaagaugua

SEQ ID NO: 3708776 - RNA, 13 nt, Human
uuaaagauguucc

SEQ ID NO: 3708777 - RNA, 17 nt, Human
uuaaagauuuaucaaau

SEQ ID NO: 3708778 - RNA, 21 nt, Human
uuaaagcauugcuguuauguc

SEQ ID NO: 3708779 - RNA, 20 nt, Human
uuaaagcauuuacuuugaau

SEQ ID NO: 3708780 - RNA, 20 nt, Human
uuaaagccauguuuauuaca

SEQ ID NO: 3708781 - RNA, 14 nt, Human
uuaaagcugccugu

SEQ ID NO: 3708782 - RNA, 15 nt, Human
uuaaagcugccugua

SEQ ID NO: 3708783 - RNA, 17 nt, Human
uuaaagcugccuguagu

SEQ ID NO: 3708784 - RNA, 18 nt, Human
uuaaagcugccuguaguu

SEQ ID NO: 3708785 - RNA, 14 nt, Human
uuaaagcuguuauu

SEQ ID NO: 3708786 - RNA, 20 nt, Human
uuaaaggcccagccccuaga

SEQ ID NO: 3708787 - RNA, 15 nt, Human
uuaaaggcuguggua

SEQ ID NO: 3708788 - RNA, 19 nt, Human
uuaaaggcuucucucucac

SEQ ID NO: 3708789 - RNA, 16 nt, Human
uuaaagggaagaaaac

SEQ ID NO: 3708790 - RNA, 23 nt, Human
uuaaagggaagaaaacacuguua

SEQ ID NO: 3708791 - RNA, 20 nt, Human
uuaaagggagaugguaagaa

SEQ ID NO: 3708792 - RNA, 23 nt, Human
uuaaaggggagaccucagaagua

SEQ ID NO: 3708793 - RNA, 19 nt, Human
uuaaaggguguacuuauau

SEQ ID NO: 3708794 - RNA, 16 nt, Human
uuaaaguauauauuua

SEQ ID NO: 3708795 - RNA, 15 nt, Human
uuaaaguaugaaucu

SEQ ID NO: 3708796 - RNA, 19 nt, Human
uuaaagucgagcuuuucua

SEQ ID NO: 3708797 - RNA, 20 nt, Human
uuaaagugaggccacugaag

SEQ ID NO: 3708798 - RNA, 12 nt, Human
uuaaagugauua

SEQ ID NO: 3708799 - RNA, 13 nt, Human
uuaaagugccagu

SEQ ID NO: 3708800 - RNA, 19 nt, Human
uuaaagugcuaagguucua

SEQ ID NO: 3708801 - RNA, 17 nt, Human
uuaaaguguaauaauau

SEQ ID NO: 3708802 - RNA, 18 nt, Human
uuaaaguguauuauaaca

SEQ ID NO: 3708803 - RNA, 19 nt, Human
uuaaaguguauuauaacag

SEQ ID NO: 3708804 - RNA, 19 nt, Human
uuaaaguguccauugacau

SEQ ID NO: 3708805 - RNA, 20 nt, Human
uuaaaguuaguaucuuuuga

SEQ ID NO: 3708806 - RNA, 14 nt, Human
uuaaaguucauugc

SEQ ID NO: 3708807 - RNA, 15 nt, Human
uuaaaguucuguaaa

SEQ ID NO: 3708808 - RNA, 18 nt, Human
uuaaaguucuguguauuu

SEQ ID NO: 3708809 - RNA, 19 nt, Human
uuaaaguucuguguauuua

SEQ ID NO: 3708810 - RNA, 17 nt, Human
uuaaaguugaauuuauu

SEQ ID NO: 3708811 - RNA, 14 nt, Human
uuaaaguuggaauu

SEQ ID NO: 3708812 - RNA, 18 nt, Human
uuaaaguuucaaaaaucu

SEQ ID NO: 3708813 - RNA, 20 nt, Human
uuaaauaaaagaaaugcaca

SEQ ID NO: 3708814 - RNA, 13 nt, Human
uuaaauaaaagcu

SEQ ID NO: 3708815 - RNA, 15 nt, Human
uuaaauaaaaucaau

SEQ ID NO: 3708816 - RNA, 19 nt, Human
uuaaauaaacuuuuuuuca

SEQ ID NO: 3708817 - RNA, 17 nt, Human
uuaaauaaaguaucaug

SEQ ID NO: 3708818 - RNA, 13 nt, Human
uuaaauaaauuug

SEQ ID NO: 3708819 - RNA, 22 nt, Human
uuaaauaaauuugacuuuucug

SEQ ID NO: 3708820 - RNA, 14 nt, Human
uuaaauaagauucu

SEQ ID NO: 3708821 - RNA, 16 nt, Human
uuaaauaauaaagauc

SEQ ID NO: 3708822 - RNA, 20 nt, Human
uuaaauaaugcuucagauau

SEQ ID NO: 3708823 - RNA, 20 nt, Human
uuaaauaaugugaaacugga

SEQ ID NO: 3708824 - RNA, 14 nt, Human
uuaaauaauuuaac

SEQ ID NO: 3708825 - RNA, 16 nt, Human
uuaaauaauuuaacua

SEQ ID NO: 3708826 - RNA, 18 nt, Human
uuaaauacaaaacuucca

SEQ ID NO: 3708827 - RNA, 16 nt, Human
uuaaauacagacacua

SEQ ID NO: 3708828 - RNA, 20 nt, Human
uuaaauacagacacuaaguu

SEQ ID NO: 3708829 - RNA, 13 nt, Human
uuaaauacagucu

SEQ ID NO: 3708830 - RNA, 18 nt, Human
uuaaauacauauggaugu

SEQ ID NO: 3708831 - RNA, 19 nt, Human
uuaaauacauauggauguu

SEQ ID NO: 3708832 - RNA, 19 nt, Human
uuaaauacgcacuacaugu

SEQ ID NO: 3708833 - RNA, 14 nt, Human
uuaaauauaauucu

SEQ ID NO: 3708834 - RNA, 16 nt, Human
uuaaauauaauucugu

SEQ ID NO: 3708835 - RNA, 23 nt, Human
uuaaauauaguuccuaagaagcu

SEQ ID NO: 3708836 - RNA, 12 nt, Human
uuaaauaucaau

SEQ ID NO: 3708837 - RNA, 21 nt, Human
uuaaauaucugaacauuuacu

SEQ ID NO: 3708838 - RNA, 21 nt, Human
uuaaauaucuuuuauguuuga

SEQ ID NO: 3708839 - RNA, 22 nt, Human
uuaaauaucuuuuauguuugaa

SEQ ID NO: 3708840 - RNA, 21 nt, Human
uuaaauauguuagcaaagagu

SEQ ID NO: 3708841 - RNA, 20 nt, Human
uuaaauauuaguuaauggau

SEQ ID NO: 3708842 - RNA, 15 nt, Human
uuaaauauuucaaga

SEQ ID NO: 3708843 - RNA, 22 nt, Human
uuaaauauuucaagacauuaaa

SEQ ID NO: 3708844 - RNA, 13 nt, Human
uuaaauauuuucu

SEQ ID NO: 3708845 - RNA, 22 nt, Human
uuaaauauuuucuauuuuaaga

SEQ ID NO: 3708846 - RNA, 20 nt, Human
uuaaauauuuugacuuguug

SEQ ID NO: 3708847 - RNA, 18 nt, Human
uuaaauccuguugaaaag

SEQ ID NO: 3708848 - RNA, 16 nt, Human
uuaaaucugucccuga

SEQ ID NO: 3708849 - RNA, 14 nt, Human
uuaaaucugugaug

SEQ ID NO: 3708850 - RNA, 14 nt, Human
uuaaaucuuaaugu

SEQ ID NO: 3708851 - RNA, 15 nt, Human
uuaaaucuuaauguu

SEQ ID NO: 3708852 - RNA, 16 nt, Human
uuaaaugaaagaaaau

SEQ ID NO: 3708853 - RNA, 17 nt, Human
uuaaaugaacaagagaa

SEQ ID NO: 3708854 - RNA, 20 nt, Human
uuaaaugaacaagagaagca

SEQ ID NO: 3708855 - RNA, 22 nt, Human
uuaaaugacacucauauaauua

SEQ ID NO: 3708856 - RNA, 12 nt, Human
uuaaaugagaag

SEQ ID NO: 3708857 - RNA, 23 nt, Human
uuaaaugagaaggaauuugaguu

SEQ ID NO: 3708858 - RNA, 11 nt, Human
uuaaaugcacc

SEQ ID NO: 3708859 - RNA, 16 nt, Human
uuaaaugcaccuggaa

SEQ ID NO: 3708860 - RNA, 20 nt, Human
uuaaaugcaguuacaaauua

SEQ ID NO: 3708861 - RNA, 14 nt, Human
uuaaaugcccagcc

SEQ ID NO: 3708862 - RNA, 19 nt, Human
uuaaauggaaacugaaacu

SEQ ID NO: 3708863 - RNA, 21 nt, Human
uuaaaugggaauauuuauaaa

SEQ ID NO: 3708864 - RNA, 13 nt, Human
uuaaauguaaaga

SEQ ID NO: 3708865 - RNA, 17 nt, Human
uuaaauguaaagauauu

SEQ ID NO: 3708866 - RNA, 16 nt, Human
uuaaauguaaauaauc

SEQ ID NO: 3708867 - RNA, 12 nt, Human
uuaaauguauac

SEQ ID NO: 3708868 - RNA, 19 nt, Human
uuaaauguauacuauagua

SEQ ID NO: 3708869 - RNA, 14 nt, Human
uuaaaugucuaaug

SEQ ID NO: 3708870 - RNA, 18 nt, Human
uuaaaugucuaauguauu

SEQ ID NO: 3708871 - RNA, 19 nt, Human
uuaaaugucuaauguauuu

SEQ ID NO: 3708872 - RNA, 18 nt, Human
uuaaaugucuucuguauu

SEQ ID NO: 3708873 - RNA, 11 nt, Human
uuaaaugugaa

SEQ ID NO: 3708874 - RNA, 21 nt, Human
uuaaaugugaauuacuaacuu

SEQ ID NO: 3708875 - RNA, 22 nt, Human
uuaaaugugaauuacuaacuuc

SEQ ID NO: 3708876 - RNA, 17 nt, Human
uuaaauguguacaaugu

SEQ ID NO: 3708877 - RNA, 11 nt, Human
uuaaauguguu

SEQ ID NO: 3708878 - RNA, 17 nt, Human
uuaaauguuaccucuga

SEQ ID NO: 3708879 - RNA, 13 nt, Human
uuaaauguuaugu

SEQ ID NO: 3708880 - RNA, 13 nt, Human
uuaaauguuauua

SEQ ID NO: 3708881 - RNA, 22 nt, Human
uuaaauguuuuauaaguucaca

SEQ ID NO: 3708882 - RNA, 14 nt, Human
uuaaauguuuugua

SEQ ID NO: 3708883 - RNA, 23 nt, Human
uuaaauguuuuguaaacuuugaa

SEQ ID NO: 3708884 - RNA, 14 nt, Human
uuaaauuaaacaau

SEQ ID NO: 3708885 - RNA, 19 nt, Human
uuaaauuaaacaauuuauu

SEQ ID NO: 3708886 - RNA, 16 nt, Human
uuaaauuaauaucuuu

SEQ ID NO: 3708887 - RNA, 15 nt, Human
uuaaauuacaauuuu

SEQ ID NO: 3708888 - RNA, 17 nt, Human
uuaaauuacaauuuuau

SEQ ID NO: 3708889 - RNA, 15 nt, Human
uuaaauuagaaaaua

SEQ ID NO: 3708890 - RNA, 13 nt, Human
uuaaauuagauaa

SEQ ID NO: 3708891 - RNA, 21 nt, Human
uuaaauucaguccuaagaaag

SEQ ID NO: 3708892 - RNA, 23 nt, Human
uuaaauucucucucuugcaggaa

SEQ ID NO: 3708893 - RNA, 12 nt, Human
uuaaauucugag

SEQ ID NO: 3708894 - RNA, 13 nt, Human
uuaaauucuugca

SEQ ID NO: 3708895 - RNA, 17 nt, Human
uuaaauuggaaagcagg

SEQ ID NO: 3708896 - RNA, 15 nt, Human
uuaaauuuaauacca

SEQ ID NO: 3708897 - RNA, 17 nt, Human
uuaaauuucuuauguga

SEQ ID NO: 3708898 - RNA, 22 nt, Human
uuaaauuucuuaugugacauua

SEQ ID NO: 3708899 - RNA, 16 nt, Human
uuaaauuuuaagguag

SEQ ID NO: 3708900 - RNA, 17 nt, Human
uuaaauuuuaagguaga

SEQ ID NO: 3708901 - RNA, 15 nt, Human
uuaaauuuugaguuc

SEQ ID NO: 3708902 - RNA, 16 nt, Human
uuaaauuuugugucuc

SEQ ID NO: 3708903 - RNA, 14 nt, Human
uuaaauuuuuuggc

SEQ ID NO: 3708904 - RNA, 16 nt, Human
uuaaauuuuuuguuga

SEQ ID NO: 3708905 - RNA, 17 nt, Human
uuaaauuuuuuuguaug

SEQ ID NO: 3708906 - RNA, 21 nt, Human
uuaaauuuuuuuguaugaaaa

SEQ ID NO: 3708907 - RNA, 23 nt, Human
uuaaauuuuuuuguaugaaaaca

SEQ ID NO: 3708908 - RNA, 19 nt, Human
uuaacaaaaagugcuucau

SEQ ID NO: 3708909 - RNA, 16 nt, Human
uuaacaaaaguucccu

SEQ ID NO: 3708910 - RNA, 23 nt, Human
uuaacaaacccucguuucugauu

SEQ ID NO: 3708911 - RNA, 17 nt, Human
uuaacaaauaacaacuu

SEQ ID NO: 3708912 - RNA, 22 nt, Human
uuaacaacauguuuccagcauu

SEQ ID NO: 3708913 - RNA, 14 nt, Human
uuaacaacuugucu

SEQ ID NO: 3708914 - RNA, 17 nt, Human
uuaacaagaagaugaau

SEQ ID NO: 3708915 - RNA, 20 nt, Human
uuaacaagaagaugaauggc

SEQ ID NO: 3708916 - RNA, 12 nt, Human
uuaacaagaagc

SEQ ID NO: 3708917 - RNA, 20 nt, Human
uuaacaauaacuacuguguu

SEQ ID NO: 3708918 - RNA, 17 nt, Human
uuaacaaugauauaugg

SEQ ID NO: 3708919 - RNA, 15 nt, Human
uuaacaaugccuauu

SEQ ID NO: 3708920 - RNA, 19 nt, Human
uuaacaaugccuauuguaa

SEQ ID NO: 3708921 - RNA, 21 nt, Human
uuaacaaugccuauuguaaua

SEQ ID NO: 3708922 - RNA, 18 nt, Human
uuaacacacauaaaggau

SEQ ID NO: 3708923 - RNA, 18 nt, Human
uguaggagacuugccaga

SEQ ID NO: 3708924 - RNA, 20 nt, Human
uguaggagcuacccuuuucc

SEQ ID NO: 3708925 - RNA, 15 nt, Human
uguaggagcugccuu

SEQ ID NO: 3708926 - RNA, 14 nt, Human
uguaggcagacaca

SEQ ID NO: 3708927 - RNA, 20 nt, Human
uguaggccaaauuuguagug

SEQ ID NO: 3708928 - RNA, 22 nt, Human
uguagggagggcggcaggggcc

SEQ ID NO: 3708929 - RNA, 16 nt, Human
uguagggcuggaccua

SEQ ID NO: 3708930 - RNA, 22 nt, Human
uguaggggaggggcuccuuucc

SEQ ID NO: 3708931 - RNA, 17 nt, Human
uguaggguuauaauaau

SEQ ID NO: 3708932 - RNA, 16 nt, Human
uguaggugguauguga

SEQ ID NO: 3708933 - RNA, 23 nt, Human
uguagguggucuggagcuguccg

SEQ ID NO: 3708934 - RNA, 15 nt, Human
uguagguugcacacu

SEQ ID NO: 3708935 - RNA, 17 nt, Human
uguaguaacacuaauau

SEQ ID NO: 3708936 - RNA, 19 nt, Human
uguaguaaucugcauuauu

SEQ ID NO: 3708937 - RNA, 14 nt, Human
uguaguaauugaca

SEQ ID NO: 3708938 - RNA, 13 nt, Human
uguaguagucuca

SEQ ID NO: 3708939 - RNA, 18 nt, Human
uguaguaucaaauauuag

SEQ ID NO: 3708940 - RNA, 21 nt, Human
uguaguaucaaauauuagaug

SEQ ID NO: 3708941 - RNA, 14 nt, Human
uguagucauuuacu

SEQ ID NO: 3708942 - RNA, 24 nt, Human
uguagucauuuacuaaacauauga

SEQ ID NO: 3708943 - RNA, 20 nt, Human
uguaguccgugcugacagcu

SEQ ID NO: 3708944 - RNA, 21 nt, Human
uguagugauuuuuaugccacc

SEQ ID NO: 3708945 - RNA, 15 nt, Human
uguaguguuggagaa

SEQ ID NO: 3708946 - RNA, 19 nt, Human
uguaguguuggagaagaac

SEQ ID NO: 3708947 - RNA, 21 nt, Human
uguaguguuggagaagaacug

SEQ ID NO: 3708948 - RNA, 14 nt, Human
uguaguuaauuuau

SEQ ID NO: 3708949 - RNA, 15 nt, Human
uguaguuaggaaaua

SEQ ID NO: 3708950 - RNA, 22 nt, Human
uguaguuccacuuauagccucu

SEQ ID NO: 3708951 - RNA, 20 nt, Human
uguaguucugcuccagacag

SEQ ID NO: 3708952 - RNA, 19 nt, Human
uguaguucuugucugauug

SEQ ID NO: 3708953 - RNA, 15 nt, Human
uguaguugcguggac

SEQ ID NO: 3708954 - RNA, 21 nt, Human
uguaguugcguggacucugca

SEQ ID NO: 3708955 - RNA, 16 nt, Human
uguaguuuacagaaaa

SEQ ID NO: 3708956 - RNA, 22 nt, Human
uguaguuuuaucacauguaugu

SEQ ID NO: 3708957 - RNA, 17 nt, Human
uguaguuuuauuuuaug

SEQ ID NO: 3708958 - RNA, 18 nt, Human
uguauaaaagugugaaau

SEQ ID NO: 3708959 - RNA, 21 nt, Human
uguauaaaagugugaaauaaa

SEQ ID NO: 3708960 - RNA, 14 nt, Human
uguauaaaauacau

SEQ ID NO: 3708961 - RNA, 16 nt, Human
uguauaaaauacauag

SEQ ID NO: 3708962 - RNA, 13 nt, Human
uguauaaaauaga

SEQ ID NO: 3708963 - RNA, 15 nt, Human
uguauaaaauagaca

SEQ ID NO: 3708964 - RNA, 14 nt, Human
uguauaaaaucagc

SEQ ID NO: 3708965 - RNA, 16 nt, Human
uguauaaacaagaaaa

SEQ ID NO: 3708966 - RNA, 14 nt, Human
uguauaaauaugua

SEQ ID NO: 3708967 - RNA, 21 nt, Human
uguauaaaucuuucuuuugau

SEQ ID NO: 3708968 - RNA, 11 nt, Human
uguauaaaugu

SEQ ID NO: 3708969 - RNA, 15 nt, Human
uguauaaauguauau

SEQ ID NO: 3708970 - RNA, 16 nt, Human
uguauaaauguauaua

SEQ ID NO: 3708971 - RNA, 20 nt, Human
uguauaaauguauauacaca

SEQ ID NO: 3708972 - RNA, 21 nt, Human
uguauaaauguauauacacau

SEQ ID NO: 3708973 - RNA, 14 nt, Human
uguauaaaugugau

SEQ ID NO: 3708974 - RNA, 15 nt, Human
uguauaaauugucuu

SEQ ID NO: 3708975 - RNA, 14 nt, Human
uguauaaauuuauu

SEQ ID NO: 3708976 - RNA, 21 nt, Human
uguauaacagguuauuuuagu

SEQ ID NO: 3708977 - RNA, 18 nt, Human
uguauaacuucuuaaaag

SEQ ID NO: 3708978 - RNA, 17 nt, Human
uguauaagauccuagau

SEQ ID NO: 3708979 - RNA, 21 nt, Human
uguauaagugcacacagaaau

SEQ ID NO: 3708980 - RNA, 19 nt, Human
uguauaaguggaggcacuu

SEQ ID NO: 3708981 - RNA, 20 nt, Human
uguauaaguggaggcacuuu

SEQ ID NO: 3708982 - RNA, 23 nt, Human
uguauaaguggaggcacuuuagg

SEQ ID NO: 3708983 - RNA, 16 nt, Human
uguauaaguugaggca

SEQ ID NO: 3708984 - RNA, 19 nt, Human
uguauaaguugaggcauuu

SEQ ID NO: 3708985 - RNA, 14 nt, Human
uguauaauaagaaa

SEQ ID NO: 3708986 - RNA, 17 nt, Human
uguauaauacuuuguau

SEQ ID NO: 3708987 - RNA, 20 nt, Human
uguauaauacuuuguauaca

SEQ ID NO: 3708988 - RNA, 20 nt, Human
uguauaauucaaagcaccaa

SEQ ID NO: 3708989 - RNA, 13 nt, Human
uguauaauuguau

SEQ ID NO: 3708990 - RNA, 12 nt, Human
uguauacaaaua

SEQ ID NO: 3708991 - RNA, 15 nt, Human
uguauacaaauauau

SEQ ID NO: 3708992 - RNA, 16 nt, Human
uguauacaacccuggc

SEQ ID NO: 3708993 - RNA, 19 nt, Human
uguauacaaguacugguaa

SEQ ID NO: 3708994 - RNA, 13 nt, Human
uguauacagugca

SEQ ID NO: 3708995 - RNA, 23 nt, Human
uguauacagugcagagccuucuc

SEQ ID NO: 3708996 - RNA, 13 nt, Human
uguauacaugcca

SEQ ID NO: 3708997 - RNA, 15 nt, Human
uguauacaugccagu

SEQ ID NO: 3708998 - RNA, 23 nt, Human
uguauaccccgugaagcauccag

SEQ ID NO: 3708999 - RNA, 13 nt, Human
uguauaccuguaa

SEQ ID NO: 3709000 - RNA, 15 nt, Human
uguauaccuguaacu

SEQ ID NO: 3709001 - RNA, 14 nt, Human
uguauacuauagua

SEQ ID NO: 3709002 - RNA, 17 nt, Human
uguauacuauaguacca

SEQ ID NO: 3709003 - RNA, 19 nt, Human
uguauacuauaguaccagu

SEQ ID NO: 3709004 - RNA, 14 nt, Human
uguauacuuuaaau

SEQ ID NO: 3709005 - RNA, 16 nt, Human
uguauacuuuaaauaa

SEQ ID NO: 3709006 - RNA, 21 nt, Human
uguauacuuuaaauaauuuaa

SEQ ID NO: 3709007 - RNA, 21 nt, Human
uguauagacaguuuguaaaug

SEQ ID NO: 3709008 - RNA, 21 nt, Human
uguauagauuagaauucugua

SEQ ID NO: 3709009 - RNA, 19 nt, Human
uguauagcaugaaauaaaa

SEQ ID NO: 3709010 - RNA, 15 nt, Human
uguauagcugcuucc

SEQ ID NO: 3709011 - RNA, 15 nt, Human
uguauaguguaaaau

SEQ ID NO: 3709012 - RNA, 24 nt, Human
uguauaguguaaaauaagaaugau

SEQ ID NO: 3709013 - RNA, 15 nt, Human
uguauaguuaacaca

SEQ ID NO: 3709014 - RNA, 20 nt, Human
uguauaguuaggauagcauu

SEQ ID NO: 3709015 - RNA, 16 nt, Human
uguauaguuauguaaa

SEQ ID NO: 3709016 - RNA, 14 nt, Human
uguauaguugcuug

SEQ ID NO: 3709017 - RNA, 16 nt, Human
uguauaguugcuugcc

SEQ ID NO: 3709018 - RNA, 17 nt, Human
uguauauacaauaacau

SEQ ID NO: 3709019 - RNA, 18 nt, Human
uguauauacaauaacaua

SEQ ID NO: 3709020 - RNA, 16 nt, Human
uguauauacacauaua

SEQ ID NO: 3709021 - RNA, 20 nt, Human
uguauauacacauauaccua

SEQ ID NO: 3709022 - RNA, 22 nt, Human
uguauauacauuuaugaauuaa

SEQ ID NO: 3709023 - RNA, 17 nt, Human
uguauauacgcaucuau

SEQ ID NO: 3709024 - RNA, 13 nt, Human
uguauauauacau

SEQ ID NO: 3709025 - RNA, 17 nt, Human
uguauauauacauaaca

SEQ ID NO: 3709026 - RNA, 19 nt, Human
uguauauauacauacacuu

SEQ ID NO: 3709027 - RNA, 17 nt, Human
uguauauauauuaagag

SEQ ID NO: 3709028 - RNA, 15 nt, Human
uguauauauguguau

SEQ ID NO: 3709029 - RNA, 21 nt, Human
uguauauauguguauauauac

SEQ ID NO: 3709030 - RNA, 23 nt, Human
uguauauauguguauauauacau

SEQ ID NO: 3709031 - RNA, 15 nt, Human
uguauauaugugugu

SEQ ID NO: 3709032 - RNA, 14 nt, Human
uguauauauuauua

SEQ ID NO: 3709033 - RNA, 20 nt, Human
uguauauauuauuauaaucu

SEQ ID NO: 3709034 - RNA, 16 nt, Human
uguauauauuuagugc

SEQ ID NO: 3709035 - RNA, 18 nt, Human
uguauauauuuagugcug

SEQ ID NO: 3709036 - RNA, 14 nt, Human
uguauauuacaaug

SEQ ID NO: 3709037 - RNA, 21 nt, Human
uguauauuauuuggcaguuug

SEQ ID NO: 3709038 - RNA, 22 nt, Human
uguauauuauuuggcaguuugg

SEQ ID NO: 3709039 - RNA, 24 nt, Human
uguauauuauuuggcaguuuggua

SEQ ID NO: 3709040 - RNA, 14 nt, Human
uguauauucacuuu

SEQ ID NO: 3709041 - RNA, 14 nt, Human
uguauauugguuuu

SEQ ID NO: 3709042 - RNA, 19 nt, Human
uguauauugucagauauuu

SEQ ID NO: 3709043 - RNA, 20 nt, Human
uguauauuguguuuguguau

SEQ ID NO: 3709044 - RNA, 12 nt, Human
uguauauuugau

SEQ ID NO: 3709045 - RNA, 22 nt, Human
uguauauuugauuuauuaacuu

SEQ ID NO: 3709046 - RNA, 12 nt, Human
uguauauuugua

SEQ ID NO: 3709047 - RNA, 16 nt, Human
uguauauuuguaugau

SEQ ID NO: 3709048 - RNA, 22 nt, Human
uguauauuuuaagaaauaacag

SEQ ID NO: 3709049 - RNA, 17 nt, Human
uguauauuuuauauaaa

SEQ ID NO: 3709050 - RNA, 17 nt, Human
uguaucaaacccacgau

SEQ ID NO: 3709051 - RNA, 21 nt, Human
uguaucaggaaauauauaugu

SEQ ID NO: 3709052 - RNA, 23 nt, Human
uguaucaguguuuaugugcuauu

SEQ ID NO: 3709053 - RNA, 17 nt, Human
uguaucauagaaaugua

SEQ ID NO: 3709054 - RNA, 21 nt, Human
uguaucaucuggauaggagcc

SEQ ID NO: 3709055 - RNA, 22 nt, Human
uguaucaugugcuagauuggag

SEQ ID NO: 3709056 - RNA, 15 nt, Human
uguauccaggccugg

SEQ ID NO: 3709057 - RNA, 14 nt, Human
uguauccauuauca

SEQ ID NO: 3709058 - RNA, 17 nt, Human
uguauccauuaucaugu

SEQ ID NO: 3709059 - RNA, 21 nt, Human
uguauccccccccuguauagu

SEQ ID NO: 3709060 - RNA, 19 nt, Human
uguauccuggaacaauauu

SEQ ID NO: 3709061 - RNA, 15 nt, Human
uguaucggagacagu

SEQ ID NO: 3709062 - RNA, 18 nt, Human
uguaucggagacagugau

SEQ ID NO: 3709063 - RNA, 15 nt, Human
uguaucguauagcug

SEQ ID NO: 3709064 - RNA, 17 nt, Human
uguaucguauagcugua

SEQ ID NO: 3709065 - RNA, 18 nt, Human
uguaucguauagcuguau

SEQ ID NO: 3709066 - RNA, 21 nt, Human
uguaucuagugcagcugauuu

SEQ ID NO: 3709067 - RNA, 18 nt, Human
uguaucucugaagcaugu

SEQ ID NO: 3709068 - RNA, 19 nt, Human
uguaucucugaagcauguu

SEQ ID NO: 3709069 - RNA, 22 nt, Human
uguaucucugaagcauguuuca

SEQ ID NO: 3709070 - RNA, 18 nt, Human
uguaucugaaggagauuu

SEQ ID NO: 3709071 - RNA, 22 nt, Human
uguaucugaaggagauuuuccu

SEQ ID NO: 3709072 - RNA, 11 nt, Human
uuaacacauuu

SEQ ID NO: 3709073 - RNA, 15 nt, Human
uuaacacuacucaaa

SEQ ID NO: 3709074 - RNA, 17 nt, Human
uuaacacuacucaaagc

SEQ ID NO: 3709075 - RNA, 13 nt, Human
uuaacacugagcu

SEQ ID NO: 3709076 - RNA, 19 nt, Human
uuaacacugcuuguguuuu

SEQ ID NO: 3709077 - RNA, 14 nt, Human
uuaacagaaaaaca

SEQ ID NO: 3709078 - RNA, 15 nt, Human
uuaacagaaauugua

SEQ ID NO: 3709079 - RNA, 19 nt, Human
uuaacagaaauuguauauu

SEQ ID NO: 3709080 - RNA, 14 nt, Human
uuaacagaagggag

SEQ ID NO: 3709081 - RNA, 13 nt, Human
uuaacagggaggg

SEQ ID NO: 3709082 - RNA, 16 nt, Human
uuaacagucauuuaaa

SEQ ID NO: 3709083 - RNA, 18 nt, Human
uuaacaguuccuuucaaa

SEQ ID NO: 3709084 - RNA, 22 nt, Human
uuaacaguuccuuucaaaggag

SEQ ID NO: 3709085 - RNA, 16 nt, Human
uuaacaguuuuccaug

SEQ ID NO: 3709086 - RNA, 11 nt, Human
uuaacauaaag

SEQ ID NO: 3709087 - RNA, 21 nt, Human
uuaacauaaagguuauuuucu

SEQ ID NO: 3709088 - RNA, 12 nt, Human
uuaacauaccua

SEQ ID NO: 3709089 - RNA, 17 nt, Human
uuaacauaccuaagaag

SEQ ID NO: 3709090 - RNA, 13 nt, Human
uuaacauauaaua

SEQ ID NO: 3709091 - RNA, 22 nt, Human
uuaacaugaacacccuuagaaa

SEQ ID NO: 3709092 - RNA, 14 nt, Human
uuaacaugcugugu

SEQ ID NO: 3709093 - RNA, 19 nt, Human
uuaacaugcuuaugacaau

SEQ ID NO: 3709094 - RNA, 13 nt, Human
uuaacauuccaag

SEQ ID NO: 3709095 - RNA, 14 nt, Human
uuaacauucuguaa

SEQ ID NO: 3709096 - RNA, 20 nt, Human
uuaacauugaccaagaacug

SEQ ID NO: 3709097 - RNA, 12 nt, Human
uuaacauuugcc

SEQ ID NO: 3709098 - RNA, 16 nt, Human
uuaacauuuuguucuu

SEQ ID NO: 3709099 - RNA, 22 nt, Human
uuaacauuuuguucuuacacau

SEQ ID NO: 3709100 - RNA, 12 nt, Human
uuaaccaaaggu

SEQ ID NO: 3709101 - RNA, 18 nt, Human
uuaaccaaaggugaagga

SEQ ID NO: 3709102 - RNA, 17 nt, Human
uuaaccauuaaaacuga

SEQ ID NO: 3709103 - RNA, 18 nt, Human
uuaaccauuaaaacugaa

SEQ ID NO: 3709104 - RNA, 14 nt, Human
uuaaccauuuaagu

SEQ ID NO: 3709105 - RNA, 18 nt, Human
uuaacccaaggagcacag

SEQ ID NO: 3709106 - RNA, 18 nt, Human
uuaaccccccuguacaca

SEQ ID NO: 3709107 - RNA, 20 nt, Human
uuaaccuaugauauuuucug

SEQ ID NO: 3709108 - RNA, 21 nt, Human
uuaaccuaugauauuuucugu

SEQ ID NO: 3709109 - RNA, 14 nt, Human
uuaaccugcauaaa

SEQ ID NO: 3709110 - RNA, 13 nt, Human
uuaaccuggugcu

SEQ ID NO: 3709111 - RNA, 17 nt, Human
uuaaccuggugcuggau

SEQ ID NO: 3709112 - RNA, 21 nt, Human
uuaaccuuguauaaauuauuc

SEQ ID NO: 3709113 - RNA, 14 nt, Human
uuaacgauguccaa

SEQ ID NO: 3709114 - RNA, 18 nt, Human
uuaacuaaauuuuaaagc

SEQ ID NO: 3709115 - RNA, 23 nt, Human
uuaacuaauaugggcauuguagu

SEQ ID NO: 3709116 - RNA, 20 nt, Human
uuaacuacccuuaauuacuu

SEQ ID NO: 3709117 - RNA, 19 nt, Human
uuaacuacuauauugauug

SEQ ID NO: 3709118 - RNA, 14 nt, Human
uuaacuagaauuua

SEQ ID NO: 3709119 - RNA, 21 nt, Human
uuaacuauugcauuuauaugu

SEQ ID NO: 3709120 - RNA, 22 nt, Human
uuaacuauugcauuuauaugua

SEQ ID NO: 3709121 - RNA, 19 nt, Human
uuaacuauuuuauuuucua

SEQ ID NO: 3709122 - RNA, 22 nt, Human
uuaacucagaucacuacugcag

SEQ ID NO: 3709123 - RNA, 14 nt, Human
ugcacaguaaaaau

SEQ ID NO: 3709124 - RNA, 16 nt, Human
ugcacaguauuuguaa

SEQ ID NO: 3709125 - RNA, 15 nt, Human
ugcacagugacuucu

SEQ ID NO: 3709126 - RNA, 16 nt, Human
ugcacagugacuucug

SEQ ID NO: 3709127 - RNA, 15 nt, Human
ugcacagugcaucuc

SEQ ID NO: 3709128 - RNA, 16 nt, Human
ugcacagugcaucuca

SEQ ID NO: 3709129 - RNA, 22 nt, Human
ugcacauaagcuuccauuuuaa

SEQ ID NO: 3709130 - RNA, 22 nt, Human
ugcacauagcuaucaagugugc

SEQ ID NO: 3709131 - RNA, 15 nt, Human
ugcacauauggacuc

SEQ ID NO: 3709132 - RNA, 17 nt, Human
ugcacauauggacucug

SEQ ID NO: 3709133 - RNA, 18 nt, Human
ugcacauccauucccaag

SEQ ID NO: 3709134 - RNA, 18 nt, Human
ugcacaucugugucuugu

SEQ ID NO: 3709135 - RNA, 13 nt, Human
ugcacaucuguuu

SEQ ID NO: 3709136 - RNA, 24 nt, Human
ugcacaucuuggcuauguaauucu

SEQ ID NO: 3709137 - RNA, 17 nt, Human
ugcacaugaacuuagau

SEQ ID NO: 3709138 - RNA, 16 nt, Human
ugcacaugaagaaaua

SEQ ID NO: 3709139 - RNA, 23 nt, Human
ugcacaugaaucccacccacaug

SEQ ID NO: 3709140 - RNA, 22 nt, Human
ugcacaugauuucacaaauauu

SEQ ID NO: 3709141 - RNA, 21 nt, Human
ugcacaugcacgugugugcac

SEQ ID NO: 3709142 - RNA, 16 nt, Human
ugcacaugucuuaaug

SEQ ID NO: 3709143 - RNA, 22 nt, Human
ugcacaugucuuguacaugugu

SEQ ID NO: 3709144 - RNA, 17 nt, Human
ugcacauguuuccucua

SEQ ID NO: 3709145 - RNA, 17 nt, Human
ugcacauuguuguuuuu

SEQ ID NO: 3709146 - RNA, 22 nt, Human
ugcacauuuauuuccucccucu

SEQ ID NO: 3709147 - RNA, 15 nt, Human
ugcacauuuugauuu

SEQ ID NO: 3709148 - RNA, 21 nt, Human
ugcaccacugcacuccagccu

SEQ ID NO: 3709149 - RNA, 23 nt, Human
ugcaccagagcaaccucucacuc

SEQ ID NO: 3709150 - RNA, 12 nt, Human
ugcaccaggaga

SEQ ID NO: 3709151 - RNA, 15 nt, Human
ugcaccaggagacag

SEQ ID NO: 3709152 - RNA, 21 nt, Human
ugcaccagguagaacgccagg

SEQ ID NO: 3709153 - RNA, 21 nt, Human
ugcaccaucccuuuuugaagu

SEQ ID NO: 3709154 - RNA, 23 nt, Human
ugcaccaucccuuuuugaagugu

SEQ ID NO: 3709155 - RNA, 19 nt, Human
ugcaccauuuaaaaacagg

SEQ ID NO: 3709156 - RNA, 18 nt, Human
ugcacccacccaggagug

SEQ ID NO: 3709157 - RNA, 20 nt, Human
ugcacccacuaaugugucau

SEQ ID NO: 3709158 - RNA, 16 nt, Human
ugcacccagcccuggu

SEQ ID NO: 3709159 - RNA, 22 nt, Human
ugcacccaggaggggaacacug

SEQ ID NO: 3709160 - RNA, 15 nt, Human
ugcacccaggggugg

SEQ ID NO: 3709161 - RNA, 20 nt, Human
ugcacccaugggcucugaca

SEQ ID NO: 3709162 - RNA, 22 nt, Human
ugcacccaugggcucugacaga

SEQ ID NO: 3709163 - RNA, 14 nt, Human
ugcaccccaugcug

SEQ ID NO: 3709164 - RNA, 16 nt, Human
ugcaccccaugcuguu

SEQ ID NO: 3709165 - RNA, 15 nt, Human
ugcaccccccugggc

SEQ ID NO: 3709166 - RNA, 14 nt, Human
ugcaccccucccau

SEQ ID NO: 3709167 - RNA, 15 nt, Human
ugcaccccucccauu

SEQ ID NO: 3709168 - RNA, 16 nt, Human
ugcaccccuuccuggg

SEQ ID NO: 3709169 - RNA, 17 nt, Human
ugcaccccuuccugggc

SEQ ID NO: 3709170 - RNA, 17 nt, Human
ugcacccucaggcaggu

SEQ ID NO: 3709171 - RNA, 16 nt, Human
ugcacccuccacccug

SEQ ID NO: 3709172 - RNA, 22 nt, Human
ugcacccuggggccuggaccug

SEQ ID NO: 3709173 - RNA, 14 nt, Human
ugcaccggcuggcc

SEQ ID NO: 3709174 - RNA, 16 nt, Human
ugcaccggcuggccug

SEQ ID NO: 3709175 - RNA, 14 nt, Human
ugcaccgggccaca

SEQ ID NO: 3709176 - RNA, 15 nt, Human
ugcaccgggccacag

SEQ ID NO: 3709177 - RNA, 22 nt, Human
ugcaccgggccacagagaaagu

SEQ ID NO: 3709178 - RNA, 16 nt, Human
ugcaccuaaagaaaaa

SEQ ID NO: 3709179 - RNA, 23 nt, Human
ugcaccuacccauacacccccuc

SEQ ID NO: 3709180 - RNA, 17 nt, Human
ugcaccuagcugugcaa

SEQ ID NO: 3709181 - RNA, 20 nt, Human
ugcaccuagcugugcaagac

SEQ ID NO: 3709182 - RNA, 16 nt, Human
ugcaccuccccccacu

SEQ ID NO: 3709183 - RNA, 14 nt, Human
ugcaccuugugucu

SEQ ID NO: 3709184 - RNA, 15 nt, Human
ugcaccuugugucug

SEQ ID NO: 3709185 - RNA, 18 nt, Human
ugcacgaccgccccaguu

SEQ ID NO: 3709186 - RNA, 15 nt, Human
ugcacgacgcccucu

SEQ ID NO: 3709187 - RNA, 13 nt, Human
ugcacgcagauua

SEQ ID NO: 3709188 - RNA, 15 nt, Human
ugcacgcccaugugu

SEQ ID NO: 3709189 - RNA, 22 nt, Human
ugcacgcccaugugugagugug

SEQ ID NO: 3709190 - RNA, 19 nt, Human
ugcacgcgcccuuucuacc

SEQ ID NO: 3709191 - RNA, 14 nt, Human
ugcacgcuggggaa

SEQ ID NO: 3709192 - RNA, 13 nt, Human
ugcacggcugcug

SEQ ID NO: 3709193 - RNA, 15 nt, Human
ugcacggcugcugag

SEQ ID NO: 3709194 - RNA, 23 nt, Human
ugcacggugaauggcuuuguaua

SEQ ID NO: 3709195 - RNA, 21 nt, Human
ugcacggugggccuugcuggg

SEQ ID NO: 3709196 - RNA, 23 nt, Human
ugcacggugggccuugcugggga

SEQ ID NO: 3709197 - RNA, 19 nt, Human
ugcacguaguagggucagg

SEQ ID NO: 3709198 - RNA, 12 nt, Human
ugcacguggaga

SEQ ID NO: 3709199 - RNA, 14 nt, Human
ugcacguggccucu

SEQ ID NO: 3709200 - RNA, 19 nt, Human
ugcacguggccucuugagc

SEQ ID NO: 3709201 - RNA, 16 nt, Human
ugcacguggcuucuga

SEQ ID NO: 3709202 - RNA, 18 nt, Human
ugcacguggcuucugaug

SEQ ID NO: 3709203 - RNA, 14 nt, Human
ugcacgugugugca

SEQ ID NO: 3709204 - RNA, 15 nt, Human
ugcacguuauggugu

SEQ ID NO: 3709205 - RNA, 18 nt, Human
ugcacuaaaucagagaca

SEQ ID NO: 3709206 - RNA, 23 nt, Human
ugcacuauagccuaggugacaga

SEQ ID NO: 3709207 - RNA, 14 nt, Human
guccuaucugggcu

SEQ ID NO: 3709208 - RNA, 19 nt, Human
guccuaucugggcuuccug

SEQ ID NO: 3709209 - RNA, 19 nt, Human
guccuaugaaugcuuugca

SEQ ID NO: 3709210 - RNA, 20 nt, Human
guccuaugaaugcuuugcau

SEQ ID NO: 3709211 - RNA, 14 nt, Human
guccuauggccuca

SEQ ID NO: 3709212 - RNA, 16 nt, Human
guccuauggccucaug

SEQ ID NO: 3709213 - RNA, 13 nt, Human
guccuauguguga

SEQ ID NO: 3709214 - RNA, 20 nt, Human
guccucaccccuguccucac

SEQ ID NO: 3709215 - RNA, 21 nt, Human
guccucaccccuguccucacu

SEQ ID NO: 3709216 - RNA, 17 nt, Human
guccucacucccagucc

SEQ ID NO: 3709217 - RNA, 21 nt, Human
guccucacugcucccugaagc

SEQ ID NO: 3709218 - RNA, 12 nt, Human
guccucagcccc

SEQ ID NO: 3709219 - RNA, 12 nt, Human
guccucagccuu

SEQ ID NO: 3709220 - RNA, 17 nt, Human
guccucagcuucuuaau

SEQ ID NO: 3709221 - RNA, 16 nt, Human
guccucagggagcagg

SEQ ID NO: 3709222 - RNA, 18 nt, Human
guccuccacacaagggaa

SEQ ID NO: 3709223 - RNA, 12 nt, Human
guccuccagaac

SEQ ID NO: 3709224 - RNA, 13 nt, Human
guccuccagaagc

SEQ ID NO: 3709225 - RNA, 19 nt, Human
guccuccagaagccucugg

SEQ ID NO: 3709226 - RNA, 23 nt, Human
guccuccaucccaacagccaugc

SEQ ID NO: 3709227 - RNA, 21 nt, Human
guccucccauccccuggacug

SEQ ID NO: 3709228 - RNA, 14 nt, Human
guccucccaucuca

SEQ ID NO: 3709229 - RNA, 21 nt, Human
guccucccccugccagugccu

SEQ ID NO: 3709230 - RNA, 15 nt, Human
guccuccccucaagg

SEQ ID NO: 3709231 - RNA, 16 nt, Human
guccuccccucaagga

SEQ ID NO: 3709232 - RNA, 15 nt, Human
guccuccccucacag

SEQ ID NO: 3709233 - RNA, 20 nt, Human
guccuccccucacagccucu

SEQ ID NO: 3709234 - RNA, 22 nt, Human
guccuccccucacagccucuga

SEQ ID NO: 3709235 - RNA, 19 nt, Human
guccuccccuugggcggcu

SEQ ID NO: 3709236 - RNA, 22 nt, Human
guccucccgagcuccucuucca

SEQ ID NO: 3709237 - RNA, 16 nt, Human
guccucccgggcccuc

SEQ ID NO: 3709238 - RNA, 22 nt, Human
guccuccuaccgaaaccuugcc

SEQ ID NO: 3709239 - RNA, 21 nt, Human
guccuccucaccucaugccca

SEQ ID NO: 3709240 - RNA, 12 nt, Human
guccuccucugu

SEQ ID NO: 3709241 - RNA, 17 nt, Human
guccucguagccaucuc

SEQ ID NO: 3709242 - RNA, 13 nt, Human
guccucuccaccu

SEQ ID NO: 3709243 - RNA, 14 nt, Human
guccucuccaccua

SEQ ID NO: 3709244 - RNA, 19 nt, Human
guccucucccaaguccaca

SEQ ID NO: 3709245 - RNA, 17 nt, Human
guccucuccccuccagc

SEQ ID NO: 3709246 - RNA, 19 nt, Human
guccucuccccuccagccu

SEQ ID NO: 3709247 - RNA, 18 nt, Human
guccucugucagucacag

SEQ ID NO: 3709248 - RNA, 19 nt, Human
guccucugucagucacagc

SEQ ID NO: 3709249 - RNA, 20 nt, Human
guccucugucagucacagcc

SEQ ID NO: 3709250 - RNA, 23 nt, Human
guccucugucagucacagccacc

SEQ ID NO: 3709251 - RNA, 18 nt, Human
guccucuuaacuguggug

SEQ ID NO: 3709252 - RNA, 18 nt, Human
guccucuuccaccacaga

SEQ ID NO: 3709253 - RNA, 18 nt, Human
guccucuucccucucugc

SEQ ID NO: 3709254 - RNA, 20 nt, Human
guccucuucccucucugcag

SEQ ID NO: 3709255 - RNA, 13 nt, Human
guccucuucuggg

SEQ ID NO: 3709256 - RNA, 18 nt, Human
guccucuugccuccugga

SEQ ID NO: 3709257 - RNA, 20 nt, Human
guccucuuuacaugaaacua

SEQ ID NO: 3709258 - RNA, 17 nt, Human
guccucuuucagaaaac

SEQ ID NO: 3709259 - RNA, 18 nt, Human
guccucuuucagaaaaca

SEQ ID NO: 3709260 - RNA, 15 nt, Human
guccucuuucagcuc

SEQ ID NO: 3709261 - RNA, 16 nt, Human
guccucuuucagcucc

SEQ ID NO: 3709262 - RNA, 20 nt, Human
guccugaagaggcgggccag

SEQ ID NO: 3709263 - RNA, 23 nt, Human
guccugaagaggcgggccagcca

SEQ ID NO: 3709264 - RNA, 12 nt, Human
guccugaccacc

SEQ ID NO: 3709265 - RNA, 15 nt, Human
guccugaccugucuc

SEQ ID NO: 3709266 - RNA, 16 nt, Human
guccugaccugucuca

SEQ ID NO: 3709267 - RNA, 21 nt, Human
guccugacggcgcccccagug

SEQ ID NO: 3709268 - RNA, 16 nt, Human
guccugagaaagcuca

SEQ ID NO: 3709269 - RNA, 20 nt, Human
guccugagauggaaaagugu

SEQ ID NO: 3709270 - RNA, 13 nt, Human
guccugagcacug

SEQ ID NO: 3709271 - RNA, 14 nt, Human
guccugagcacugc

SEQ ID NO: 3709272 - RNA, 16 nt, Human
guccugagcacugcca

SEQ ID NO: 3709273 - RNA, 17 nt, Human
guccugagcacugccag

SEQ ID NO: 3709274 - RNA, 20 nt, Human
guccugagcacugccaggag

SEQ ID NO: 3709275 - RNA, 23 nt, Human
guccugagcacugccaggaggga

SEQ ID NO: 3709276 - RNA, 16 nt, Human
guccugagcucagcgu

SEQ ID NO: 3709277 - RNA, 19 nt, Human
guccugagcucagcgugga

SEQ ID NO: 3709278 - RNA, 15 nt, Human
guccugaucagagcc

SEQ ID NO: 3709279 - RNA, 15 nt, Human
guccugauggucagc

SEQ ID NO: 3709280 - RNA, 18 nt, Human
guccugauggucagcucc

SEQ ID NO: 3709281 - RNA, 15 nt, Human
guccugcaccggggc

SEQ ID NO: 3709282 - RNA, 17 nt, Human
guccugccucagccucc

SEQ ID NO: 3709283 - RNA, 14 nt, Human
guccugccuggcca

SEQ ID NO: 3709284 - RNA, 18 nt, Human
guccugccugucugcccc

SEQ ID NO: 3709285 - RNA, 16 nt, Human
guccugcuccacagug

SEQ ID NO: 3709286 - RNA, 17 nt, Human
guccugcuccacagugu

SEQ ID NO: 3709287 - RNA, 22 nt, Human
guccugcuccagaauuuggaaa

SEQ ID NO: 3709288 - RNA, 22 nt, Human
guccugcucucuacccagccca

SEQ ID NO: 3709289 - RNA, 13 nt, Human
guccugcugcagu

SEQ ID NO: 3709290 - RNA, 12 nt, Human
guccugcuucug

SEQ ID NO: 3709291 - RNA, 13 nt, Human
guccugcuucuga

SEQ ID NO: 3709292 - RNA, 21 nt, Human
guccuggaagcgcgagggccu

SEQ ID NO: 3709293 - RNA, 20 nt, Human
guccuggacaccgggccagu

SEQ ID NO: 3709294 - RNA, 19 nt, Human
guccuggagcagaccaccc

SEQ ID NO: 3709295 - RNA, 13 nt, Human
guccuggaggggc

SEQ ID NO: 3709296 - RNA, 19 nt, Human
guccuggaugauacuaaua

SEQ ID NO: 3709297 - RNA, 15 nt, Human
guccuggccauccca

SEQ ID NO: 3709298 - RNA, 17 nt, Human
guccuggccaucccaca

SEQ ID NO: 3709299 - RNA, 17 nt, Human
guccuggccuggcuucu

SEQ ID NO: 3709300 - RNA, 22 nt, Human
guccuggcgccuggcaguccgu

SEQ ID NO: 3709301 - RNA, 14 nt, Human
guccuggcuccuga

SEQ ID NO: 3709302 - RNA, 21 nt, Human
guccugggagaaccucaggcu

SEQ ID NO: 3709303 - RNA, 17 nt, Human
guccugggagacccaug

SEQ ID NO: 3709304 - RNA, 14 nt, Human
guccugggcgcccu

SEQ ID NO: 3709305 - RNA, 20 nt, Human
guccugggcgcccuggaagc

SEQ ID NO: 3709306 - RNA, 19 nt, Human
guccuggggaaccugaccc

SEQ ID NO: 3709307 - RNA, 20 nt, Human
guccuggggaaccugacccc

SEQ ID NO: 3709308 - RNA, 14 nt, Human
guccuggggccucg

SEQ ID NO: 3709309 - RNA, 22 nt, Human
guccuggggccucggagccuca

SEQ ID NO: 3709310 - RNA, 15 nt, Human
guccuggggcucugu

SEQ ID NO: 3709311 - RNA, 18 nt, Human
guccugggggccugaccu

SEQ ID NO: 3709312 - RNA, 20 nt, Human
guccuggugcccuggaugcc

SEQ ID NO: 3709313 - RNA, 16 nt, Human
guccugguggggcagc

SEQ ID NO: 3709314 - RNA, 20 nt, Human
guccugguggggcagcuccu

SEQ ID NO: 3709315 - RNA, 20 nt, Human
guccuggugguauuuucaau

SEQ ID NO: 3709316 - RNA, 23 nt, Human
guccuguaguugcguggacucug

SEQ ID NO: 3709317 - RNA, 16 nt, Human
guccugucaucaucau

SEQ ID NO: 3709318 - RNA, 19 nt, Human
guccuguccacacccagcu

SEQ ID NO: 3709319 - RNA, 14 nt, Human
guccuguccugcuc

SEQ ID NO: 3709320 - RNA, 18 nt, Human
guccugucggagcccugu

SEQ ID NO: 3709321 - RNA, 20 nt, Human
guccugucggagcccugucu

SEQ ID NO: 3709322 - RNA, 21 nt, Human
guccugucggagcccugucuc

SEQ ID NO: 3709323 - RNA, 18 nt, Human
guccugugaaugccacug

SEQ ID NO: 3709324 - RNA, 15 nt, Human
guccuguggcaggca

SEQ ID NO: 3709325 - RNA, 21 nt, Human
guccuguggcaggcagcgcca

SEQ ID NO: 3709326 - RNA, 16 nt, Human
guccugugucaguuua

SEQ ID NO: 3709327 - RNA, 21 nt, Human
guccuguguuuuuucugccac

SEQ ID NO: 3709328 - RNA, 14 nt, Human
guccuuagccugga

SEQ ID NO: 3709329 - RNA, 16 nt, Human
guccuuagccuggacc

SEQ ID NO: 3709330 - RNA, 17 nt, Human
guccuuaggccucugag

SEQ ID NO: 3709331 - RNA, 18 nt, Human
guccuuaucuagcugcau

SEQ ID NO: 3709332 - RNA, 15 nt, Human
guccuuauguuaagc

SEQ ID NO: 3709333 - RNA, 21 nt, Human
guccuucaccucacugaaaac

SEQ ID NO: 3709334 - RNA, 15 nt, Human
guccuucagauggaa

SEQ ID NO: 3709335 - RNA, 14 nt, Human
guccuuccaggccc

SEQ ID NO: 3709336 - RNA, 15 nt, Human
guccuucucauucau

SEQ ID NO: 3709337 - RNA, 17 nt, Human
guccuucucucaccucc

SEQ ID NO: 3709338 - RNA, 16 nt, Human
guccuugauuucaaag

SEQ ID NO: 3709339 - RNA, 18 nt, Human
guccuugcaccccucacu

SEQ ID NO: 3709340 - RNA, 14 nt, Human
guccuugcaccugc

SEQ ID NO: 3709341 - RNA, 18 nt, Human
guccuugcaccugcaucc

SEQ ID NO: 3709342 - RNA, 14 nt, Human
guccuuggccugcu

SEQ ID NO: 3709343 - RNA, 14 nt, Human
guccuuggugugac

SEQ ID NO: 3709344 - RNA, 21 nt, Human
guccuugucucugggccacuu

SEQ ID NO: 3709345 - RNA, 21 nt, Human
guccuuuacacucaggcuuuc

SEQ ID NO: 3709346 - RNA, 13 nt, Human
guccuuuaugugg

SEQ ID NO: 3709347 - RNA, 20 nt, Human
guccuuuauguggaaaacag

SEQ ID NO: 3709348 - RNA, 21 nt, Human
guccuuuauguggaaaacaga

SEQ ID NO: 3709349 - RNA, 22 nt, Human
guccuuuauguggaaaacagaa

SEQ ID NO: 3709350 - RNA, 20 nt, Human
guccuuuccaaggcuucucc

SEQ ID NO: 3709351 - RNA, 15 nt, Human
guccuuuccaguggc

SEQ ID NO: 3709352 - RNA, 23 nt, Human
guccuuuccaguggccuggcucc

SEQ ID NO: 3709353 - RNA, 15 nt, Human
guccuuucccuccac

SEQ ID NO: 3709354 - RNA, 18 nt, Human
guccuuugcgccugugac

SEQ ID NO: 3709355 - RNA, 15 nt, Human
guccuuuucacuaca

SEQ ID NO: 3709356 - RNA, 15 nt, Human
ugcucuuuucuccuc

SEQ ID NO: 3709357 - RNA, 22 nt, Human
ugcugaaaaccaucuggccugg

SEQ ID NO: 3709358 - RNA, 15 nt, Human
ugcugaaacaggaga

SEQ ID NO: 3709359 - RNA, 17 nt, Human
ugcugaaacaggagaga

SEQ ID NO: 3709360 - RNA, 20 nt, Human
ugcugaaacgcaucuaguuc

SEQ ID NO: 3709361 - RNA, 14 nt, Human
ugcugaacagugga

SEQ ID NO: 3709362 - RNA, 19 nt, Human
ugcugaacauugcauauaa

SEQ ID NO: 3709363 - RNA, 22 nt, Human
ugcugaacauuggagaaucuca

SEQ ID NO: 3709364 - RNA, 13 nt, Human
ugcugaagcuuau

SEQ ID NO: 3709365 - RNA, 19 nt, Human
ugcugaagcuuauuaaugc

SEQ ID NO: 3709366 - RNA, 21 nt, Human
ugcugaagcuuauuaaugcua

SEQ ID NO: 3709367 - RNA, 13 nt, Human
ugcugaaggcucg

SEQ ID NO: 3709368 - RNA, 21 nt, Human
ugcugaaggcucgagcaugcc

SEQ ID NO: 3709369 - RNA, 13 nt, Human
ugcugaagggacc

SEQ ID NO: 3709370 - RNA, 16 nt, Human
ugcugaaguccggaac

SEQ ID NO: 3709371 - RNA, 18 nt, Human
ugcugaauaggcgaucac

SEQ ID NO: 3709372 - RNA, 16 nt, Human
ugcugaauuuucacau

SEQ ID NO: 3709373 - RNA, 17 nt, Human
ugcugacagcugcuccu

SEQ ID NO: 3709374 - RNA, 20 nt, Human
ugcugacauggcucuggacu

SEQ ID NO: 3709375 - RNA, 18 nt, Human
ugcugacauucaccugcc

SEQ ID NO: 3709376 - RNA, 18 nt, Human
ugcugaccaauugugcug

SEQ ID NO: 3709377 - RNA, 20 nt, Human
ugcugaccaauugugcugcc

SEQ ID NO: 3709378 - RNA, 22 nt, Human
ugcugaccaauugugcugccau

SEQ ID NO: 3709379 - RNA, 15 nt, Human
ugcugacccaugggc

SEQ ID NO: 3709380 - RNA, 17 nt, Human
ugcugacccuccccaaa

SEQ ID NO: 3709381 - RNA, 15 nt, Human
ugcugacccuccugu

SEQ ID NO: 3709382 - RNA, 15 nt, Human
ugcugaccuccacag

SEQ ID NO: 3709383 - RNA, 14 nt, Human
ugcugaccugugca

SEQ ID NO: 3709384 - RNA, 15 nt, Human
ugcugacggccaggg

SEQ ID NO: 3709385 - RNA, 20 nt, Human
ugcugacgggacccacaugc

SEQ ID NO: 3709386 - RNA, 14 nt, Human
ugcugacuguacuc

SEQ ID NO: 3709387 - RNA, 22 nt, Human
ugcugacuguacuccucccagg

SEQ ID NO: 3709388 - RNA, 16 nt, Human
ugcugacuguuuucuc

SEQ ID NO: 3709389 - RNA, 21 nt, Human
ugcugacuguuuucucuugag

SEQ ID NO: 3709390 - RNA, 13 nt, Human
ugcugacuuagaa

SEQ ID NO: 3709391 - RNA, 10 nt, Human
ugcugagacu

SEQ ID NO: 3709392 - RNA, 15 nt, Human
ugcugagagacccaa

SEQ ID NO: 3709393 - RNA, 14 nt, Human
ugcugagauccugg

SEQ ID NO: 3709394 - RNA, 18 nt, Human
ugcugagauccuggacug

SEQ ID NO: 3709395 - RNA, 18 nt, Human
ugcugagccucacagcag

SEQ ID NO: 3709396 - RNA, 21 nt, Human
ugcugagccucacagcaguga

SEQ ID NO: 3709397 - RNA, 16 nt, Human
ugcugagccucugcuc

SEQ ID NO: 3709398 - RNA, 15 nt, Human
ugcugagcucugaga

SEQ ID NO: 3709399 - RNA, 17 nt, Human
ugcugagcucugagagg

SEQ ID NO: 3709400 - RNA, 12 nt, Human
ugcugagggucc

SEQ ID NO: 3709401 - RNA, 13 nt, Human
ugcugagggucca

SEQ ID NO: 3709402 - RNA, 21 nt, Human
ugcugaguauguuaagcucuu

SEQ ID NO: 3709403 - RNA, 18 nt, Human
ugcugagucccaggcuga

SEQ ID NO: 3709404 - RNA, 15 nt, Human
ugcugagucucccaa

SEQ ID NO: 3709405 - RNA, 14 nt, Human
ugcugagucugaag

SEQ ID NO: 3709406 - RNA, 16 nt, Human
ugcugagucugaaggc

SEQ ID NO: 3709407 - RNA, 18 nt, Human
ugcugagucugaaggcug

SEQ ID NO: 3709408 - RNA, 22 nt, Human
ugcugagucugaaggcuggguu

SEQ ID NO: 3709409 - RNA, 15 nt, Human
ugcugaguugguguu

SEQ ID NO: 3709410 - RNA, 21 nt, Human
ugcugauauuuucucuaggaa

SEQ ID NO: 3709411 - RNA, 18 nt, Human
ugcugaucgccuucccca

SEQ ID NO: 3709412 - RNA, 21 nt, Human
ugcugaugaacucuuaaucaa

SEQ ID NO: 3709413 - RNA, 20 nt, Human
ugcugaugaaucacuguuuu

SEQ ID NO: 3709414 - RNA, 22 nt, Human
ugcugaugacccccccagcuuc

SEQ ID NO: 3709415 - RNA, 22 nt, Human
ugcugaugcucaugguccccau

SEQ ID NO: 3709416 - RNA, 15 nt, Human
ugcugauggagccuu

SEQ ID NO: 3709417 - RNA, 17 nt, Human
ugcugauggugcaauga

SEQ ID NO: 3709418 - RNA, 18 nt, Human
ugcugauggugcaaugac

SEQ ID NO: 3709419 - RNA, 23 nt, Human
ugcugauggugcaaugaccuuuc

SEQ ID NO: 3709420 - RNA, 17 nt, Human
ugcugauguucagugua

SEQ ID NO: 3709421 - RNA, 17 nt, Human
ugcugauucucccguuc

SEQ ID NO: 3709422 - RNA, 19 nt, Human
ugcugauuuccccucuucc

SEQ ID NO: 3709423 - RNA, 18 nt, Human
ugcugauuuggugaccaa

SEQ ID NO: 3709424 - RNA, 16 nt, Human
ugcugauuuuauucuu

SEQ ID NO: 3709425 - RNA, 17 nt, Human
ugcugauuuuauucuug

SEQ ID NO: 3709426 - RNA, 14 nt, Human
ugcugcaaaccuga

SEQ ID NO: 3709427 - RNA, 22 nt, Human
ugcugcagagaaacuuaagcaa

SEQ ID NO: 3709428 - RNA, 23 nt, Human
ugcugcagaggggcaggcccugc

SEQ ID NO: 3709429 - RNA, 23 nt, Human
ugcugcagcaccgaggggccuuu

SEQ ID NO: 3709430 - RNA, 15 nt, Human
ugcugcagcucccug

SEQ ID NO: 3709431 - RNA, 19 nt, Human
ugcugcagcucccuggcuu

SEQ ID NO: 3709432 - RNA, 21 nt, Human
ugcugcagcucccuggcuucu

SEQ ID NO: 3709433 - RNA, 21 nt, Human
ugcugcaggacuugagaagac

SEQ ID NO: 3709434 - RNA, 15 nt, Human
ugcugcaguugccag

SEQ ID NO: 3709435 - RNA, 14 nt, Human
ugcugcauacauuc

SEQ ID NO: 3709436 - RNA, 15 nt, Human
ugcugcaugcccucu

SEQ ID NO: 3709437 - RNA, 19 nt, Human
ugcugcaugcccucucagg

SEQ ID NO: 3709438 - RNA, 15 nt, Human
ugcugcaugccuggu

SEQ ID NO: 3709439 - RNA, 23 nt, Human
ugcugcauuuaaaagauacaguu

SEQ ID NO: 3709440 - RNA, 21 nt, Human
ugcugccaaccauaccuuccu

SEQ ID NO: 3709441 - RNA, 15 nt, Human
ugcugccaauauccu

SEQ ID NO: 3709442 - RNA, 17 nt, Human
ugcugccaauauccuaa

SEQ ID NO: 3709443 - RNA, 18 nt, Human
ugcugccaauauccuaau

SEQ ID NO: 3709444 - RNA, 19 nt, Human
ugcugccaauauccuaaua

SEQ ID NO: 3709445 - RNA, 21 nt, Human
ugcugccaauauccuaauaaa

SEQ ID NO: 3709446 - RNA, 19 nt, Human
ugcugccacacuucaggcu

SEQ ID NO: 3709447 - RNA, 14 nt, Human
ugcugccacugagg

SEQ ID NO: 3709448 - RNA, 14 nt, Human
ugcugccacuuuuu

SEQ ID NO: 3709449 - RNA, 14 nt, Human
ugcugccauccagg

SEQ ID NO: 3709450 - RNA, 15 nt, Human
ugcugccauccaggu

SEQ ID NO: 3709451 - RNA, 19 nt, Human
ugcugccauuacagaggua

SEQ ID NO: 3709452 - RNA, 14 nt, Human
ugcugcccagccuc

SEQ ID NO: 3709453 - RNA, 16 nt, Human
ugcugcccaugccacc

SEQ ID NO: 3709454 - RNA, 19 nt, Human
ugcugccccaucagugcuc

SEQ ID NO: 3709455 - RNA, 17 nt, Human
ugcugccccaugaagcc

SEQ ID NO: 3709456 - RNA, 14 nt, Human
ugcugcccuaggcu

SEQ ID NO: 3709457 - RNA, 17 nt, Human
ugcugcccugcccaccu

SEQ ID NO: 3709458 - RNA, 18 nt, Human
ugcugcccugcccaccug

SEQ ID NO: 3709459 - RNA, 15 nt, Human
ugcugcccugcccca

SEQ ID NO: 3709460 - RNA, 13 nt, Human
ugcugcccugcgg

SEQ ID NO: 3709461 - RNA, 16 nt, Human
ugcugccgccucccag

SEQ ID NO: 3709462 - RNA, 14 nt, Human
ugcugccuccagaa

SEQ ID NO: 3709463 - RNA, 19 nt, Human
ugcugccuccccaacccug

SEQ ID NO: 3709464 - RNA, 20 nt, Human
ugcugccuccccaacccugc

SEQ ID NO: 3709465 - RNA, 16 nt, Human
ugcugccucccucugc

SEQ ID NO: 3709466 - RNA, 19 nt, Human
ugcugccucggauccccuu

SEQ ID NO: 3709467 - RNA, 14 nt, Human
ugcugccugaaucc

SEQ ID NO: 3709468 - RNA, 16 nt, Human
ugcugccugccugucu

SEQ ID NO: 3709469 - RNA, 15 nt, Human
ugcugccugcuuuuu

SEQ ID NO: 3709470 - RNA, 17 nt, Human
ugcugccugcuuuuuau

SEQ ID NO: 3709471 - RNA, 13 nt, Human
ugcugccuggcca

SEQ ID NO: 3709472 - RNA, 14 nt, Human
ugcugccugucccc

SEQ ID NO: 3709473 - RNA, 21 nt, Human
ugcugccuucugacggcccug

SEQ ID NO: 3709474 - RNA, 13 nt, Human
ugcugccuucugg

SEQ ID NO: 3709475 - RNA, 16 nt, Human
ugcugcgcccuuaccu

SEQ ID NO: 3709476 - RNA, 18 nt, Human
ugcugcuaauucuuugca

SEQ ID NO: 3709477 - RNA, 15 nt, Human
ugcugcuacccuccc

SEQ ID NO: 3709478 - RNA, 19 nt, Human
ugcugcuacccucccugcu

SEQ ID NO: 3709479 - RNA, 21 nt, Human
ugcugcuacccucccugcugu

SEQ ID NO: 3709480 - RNA, 22 nt, Human
ugcugcuacccucccugcuguc

SEQ ID NO: 3709481 - RNA, 23 nt, Human
ugcugcuacccucccugcugucc

SEQ ID NO: 3709482 - RNA, 15 nt, Human
ugcugcuacuuaauu

SEQ ID NO: 3709483 - RNA, 15 nt, Human
ugcugcuagaacuuu

SEQ ID NO: 3709484 - RNA, 19 nt, Human
ugcugcuagaacuuuuuua

SEQ ID NO: 3709485 - RNA, 21 nt, Human
ugcugcuauuuuacugucuua

SEQ ID NO: 3709486 - RNA, 14 nt, Human
ugcugcucccucag

SEQ ID NO: 3709487 - RNA, 17 nt, Human
ugcugcucccucagacu

SEQ ID NO: 3709488 - RNA, 20 nt, Human
ugcugcuccuuagcugccaa

SEQ ID NO: 3709489 - RNA, 12 nt, Human
ugcugcucuuca

SEQ ID NO: 3709490 - RNA, 21 nt, Human
ugcugcucuuggcuggaccca

SEQ ID NO: 3709491 - RNA, 13 nt, Human
ugcugcugccugc

SEQ ID NO: 3709492 - RNA, 14 nt, Human
ugcugcugccugcc

SEQ ID NO: 3709493 - RNA, 15 nt, Human
ugcugcugcgcccuu

SEQ ID NO: 3709494 - RNA, 16 nt, Human
ugcugcugcugcgccc

SEQ ID NO: 3709495 - RNA, 23 nt, Human
ugcugcuggacaguaucacuguc

SEQ ID NO: 3709496 - RNA, 11 nt, Human
ugcugcuggcc

SEQ ID NO: 3709497 - RNA, 21 nt, Human
ugcugcuggccaaauagcaaa

SEQ ID NO: 3709498 - RNA, 17 nt, Human
ugcugcugggcucagug

SEQ ID NO: 3709499 - RNA, 14 nt, Human
ugcugcuggggaag

SEQ ID NO: 3709500 - RNA, 15 nt, Human
ugcugcuggggaaga

SEQ ID NO: 3709501 - RNA, 21 nt, Human
ugcugcuggggaagacagugg

SEQ ID NO: 3709502 - RNA, 23 nt, Human
ugcugcuggggaagacaguggcc

SEQ ID NO: 3709503 - RNA, 13 nt, Human
ugcugcugucacc

SEQ ID NO: 3709504 - RNA, 17 nt, Human
ugcugcugucugggugc

SEQ ID NO: 3709505 - RNA, 12 nt, Human
ugcugcugucuu

SEQ ID NO: 3709506 - RNA, 13 nt, Human
ugcugcuucaauu

SEQ ID NO: 3709507 - RNA, 15 nt, Human
ugcugcuucccucug

SEQ ID NO: 3709508 - RNA, 16 nt, Human
ugcugcuucccucugc

SEQ ID NO: 3709509 - RNA, 20 nt, Human
ugcugcuucucccaggcaag

SEQ ID NO: 3709510 - RNA, 23 nt, Human
ugcugcuucucccaggcaaggcu

SEQ ID NO: 3709511 - RNA, 16 nt, Human
ugcugcuuuccccugu

SEQ ID NO: 3709512 - RNA, 17 nt, Human
ugcugcuuuccccugug

SEQ ID NO: 3709513 - RNA, 18 nt, Human
ugcugcuuuccccugugg

SEQ ID NO: 3709514 - RNA, 19 nt, Human
ugcugcuuuuauaucugua

SEQ ID NO: 3709515 - RNA, 17 nt, Human
ugcugcuuuuccuuggg

SEQ ID NO: 3709516 - RNA, 12 nt, Human
ugcuggaaagag

SEQ ID NO: 3709517 - RNA, 17 nt, Human
ugcuggaaccugcaaaa

SEQ ID NO: 3709518 - RNA, 14 nt, Human
ugcuggaagcccag

SEQ ID NO: 3709519 - RNA, 16 nt, Human
ugcuggaauucuaaca

SEQ ID NO: 3709520 - RNA, 17 nt, Human
ugcuggaauucuaacaa

SEQ ID NO: 3709521 - RNA, 19 nt, Human
ugcuggacggcauuccugc

SEQ ID NO: 3709522 - RNA, 20 nt, Human
ugcuggacggggacugggga

SEQ ID NO: 3709523 - RNA, 21 nt, Human
ugcuggacggggacuggggau

SEQ ID NO: 3709524 - RNA, 22 nt, Human
ugcuggagaggccccagccgcu

SEQ ID NO: 3709525 - RNA, 16 nt, Human
ugcuggagcacugggc

SEQ ID NO: 3709526 - RNA, 20 nt, Human
ugcuggagccacuaacuaga

SEQ ID NO: 3709527 - RNA, 11 nt, Human
ugcuggagccu

SEQ ID NO: 3709528 - RNA, 12 nt, Human
ugcuggagccug

SEQ ID NO: 3709529 - RNA, 16 nt, Human
ugcuggaggccucagg

SEQ ID NO: 3709530 - RNA, 20 nt, Human
ugcuggaggccucaggugcu

SEQ ID NO: 3709531 - RNA, 21 nt, Human
ugcuggaggccucaggugcug

SEQ ID NO: 3709532 - RNA, 16 nt, Human
ugcuggaggugggagc

SEQ ID NO: 3709533 - RNA, 17 nt, Human
ugcuggaggugggagca

SEQ ID NO: 3709534 - RNA, 23 nt, Human
ugcuggaggugggagcaggagau

SEQ ID NO: 3709535 - RNA, 15 nt, Human
ugcuggauaaaauga

SEQ ID NO: 3709536 - RNA, 22 nt, Human
ugcuggauauuuucaaauugua

SEQ ID NO: 3709537 - RNA, 19 nt, Human
ugcuggaucucccagggcu

SEQ ID NO: 3709538 - RNA, 13 nt, Human
ugcuggccaaaua

SEQ ID NO: 3709539 - RNA, 19 nt, Human
ugcuggccaaauagcaaag

SEQ ID NO: 3709540 - RNA, 20 nt, Human
ugcuggccaaauagcaaaga

SEQ ID NO: 3709541 - RNA, 15 nt, Human
ugcuggccagccugg

SEQ ID NO: 3709542 - RNA, 22 nt, Human
ugcuggccagccuggggccugg

SEQ ID NO: 3709543 - RNA, 23 nt, Human
ugcuggccagccuggggccuggc

SEQ ID NO: 3709544 - RNA, 18 nt, Human
ugcuggcccagggcccag

SEQ ID NO: 3709545 - RNA, 13 nt, Human
ugcuggccccagc

SEQ ID NO: 3709546 - RNA, 14 nt, Human
ugcuggccccagcc

SEQ ID NO: 3709547 - RNA, 13 nt, Human
ugcuggccccuca

SEQ ID NO: 3709548 - RNA, 15 nt, Human
ugcuggccccucacc

SEQ ID NO: 3709549 - RNA, 20 nt, Human
ugcuggccccucaccugggc

SEQ ID NO: 3709550 - RNA, 14 nt, Human
ugcuggccuggauc

SEQ ID NO: 3709551 - RNA, 16 nt, Human
ugcuggccuggaucuc

SEQ ID NO: 3709552 - RNA, 18 nt, Human
ugcuggccuggaucuccc

SEQ ID NO: 3709553 - RNA, 16 nt, Human
ugcuggcgccucugca

SEQ ID NO: 3709554 - RNA, 19 nt, Human
ugcuggcucacaguacagc

SEQ ID NO: 3709555 - RNA, 15 nt, Human
ugcuggcucccaggg

SEQ ID NO: 3709556 - RNA, 16 nt, Human
ugcuggcucccagggc

SEQ ID NO: 3709557 - RNA, 18 nt, Human
ugcuggcucccagggcca

SEQ ID NO: 3709558 - RNA, 21 nt, Human
ugcuggcugcccagaccccuc

SEQ ID NO: 3709559 - RNA, 14 nt, Human
ugcuggcugccuua

SEQ ID NO: 3709560 - RNA, 21 nt, Human
ugcuggcuguuggcugggggc

SEQ ID NO: 3709561 - RNA, 21 nt, Human
ugcugggaaccucaggguauu

SEQ ID NO: 3709562 - RNA, 17 nt, Human
ugcugggacuggccagg

SEQ ID NO: 3709563 - RNA, 23 nt, Human
ugcugggagcuccacucugcuuc

SEQ ID NO: 3709564 - RNA, 21 nt, Human
ugcugggagcugaaaaaucac

SEQ ID NO: 3709565 - RNA, 18 nt, Human
ugcugggaggagggagag

SEQ ID NO: 3709566 - RNA, 13 nt, Human
ugcugggcagccc

SEQ ID NO: 3709567 - RNA, 14 nt, Human
ugcugggcagcccg

SEQ ID NO: 3709568 - RNA, 17 nt, Human
ugcugggccccugccuc

SEQ ID NO: 3709569 - RNA, 21 nt, Human
ugcugggccccugccucucug

SEQ ID NO: 3709570 - RNA, 14 nt, Human
ugcugggcggcugu

SEQ ID NO: 3709571 - RNA, 16 nt, Human
ugcugggcggcugugc

SEQ ID NO: 3709572 - RNA, 13 nt, Human
ugcugggcucagu

SEQ ID NO: 3709573 - RNA, 15 nt, Human
ugcugggcucaguga

SEQ ID NO: 3709574 - RNA, 17 nt, Human
ugcugggcucagugaag

SEQ ID NO: 3709575 - RNA, 17 nt, Human
ugcugggcucuccaccu

SEQ ID NO: 3709576 - RNA, 22 nt, Human
ugcugggcucuccaccucagcc

SEQ ID NO: 3709577 - RNA, 21 nt, Human
ugcugggcugacggugcaguc

SEQ ID NO: 3709578 - RNA, 17 nt, Human
ugcugggcuggggccug

SEQ ID NO: 3709579 - RNA, 17 nt, Human
ugcuggggaagacagug

SEQ ID NO: 3709580 - RNA, 20 nt, Human
ugcuggggacggggggcccc

SEQ ID NO: 3709581 - RNA, 18 nt, Human
ugcuggggccugguuccc

SEQ ID NO: 3709582 - RNA, 14 nt, Human
ugcugggggaauga

SEQ ID NO: 3709583 - RNA, 20 nt, Human
ugcugggggaaugagcccag

SEQ ID NO: 3709584 - RNA, 19 nt, Human
ugcuggggucaaggcagua

SEQ ID NO: 3709585 - RNA, 17 nt, Human
ugcugggguuaucugaa

SEQ ID NO: 3709586 - RNA, 20 nt, Human
ugcugggguuaucugaaguc

SEQ ID NO: 3709587 - RNA, 16 nt, Human
ugcuggguaaacugug

SEQ ID NO: 3709588 - RNA, 17 nt, Human
ugcuggguuggugcaca

SEQ ID NO: 3709589 - RNA, 19 nt, Human
ugcuggguuggugcacagu

SEQ ID NO: 3709590 - RNA, 23 nt, Human
ugcuggguuggugcacagugauu

SEQ ID NO: 3709591 - RNA, 22 nt, Human
ugcugguaauuuguaucugaag

SEQ ID NO: 3709592 - RNA, 16 nt, Human
ugcuggucacugccau

SEQ ID NO: 3709593 - RNA, 19 nt, Human
ugcuggucccggggccagc

SEQ ID NO: 3709594 - RNA, 13 nt, Human
ugcugguccgugg

SEQ ID NO: 3709595 - RNA, 16 nt, Human
ugcugguccgugggac

SEQ ID NO: 3709596 - RNA, 16 nt, Human
ugcugguugcugugug

SEQ ID NO: 3709597 - RNA, 13 nt, Human
ugcugguuuguag

SEQ ID NO: 3709598 - RNA, 22 nt, Human
ugcugguuuguaguugaauauu

SEQ ID NO: 3709599 - RNA, 13 nt, Human
ugcugguuuuagu

SEQ ID NO: 3709600 - RNA, 14 nt, Human
ugcugguuuuccua

SEQ ID NO: 3709601 - RNA, 16 nt, Human
ugcugguuuuucaguu

SEQ ID NO: 3709602 - RNA, 15 nt, Human
ugcuguaaaagcaag

SEQ ID NO: 3709603 - RNA, 11 nt, Human
ugcuguacaua

SEQ ID NO: 3709604 - RNA, 15 nt, Human
ugcuguacaucuauu

SEQ ID NO: 3709605 - RNA, 17 nt, Human
ugcuguacaucuauuuu

SEQ ID NO: 3709606 - RNA, 21 nt, Human
ugcuguacaucuauuuuggau

SEQ ID NO: 3709607 - RNA, 21 nt, Human
ugcuguacuagagaucugguu

SEQ ID NO: 3709608 - RNA, 21 nt, Human
ugcuguacugaaguaaaacaa

SEQ ID NO: 3709609 - RNA, 18 nt, Human
ugcuguaggaucuaaggc

SEQ ID NO: 3709610 - RNA, 15 nt, Human
ugcuguauaaaauca

SEQ ID NO: 3709611 - RNA, 17 nt, Human
ugcuguauaaaaucagc

SEQ ID NO: 3709612 - RNA, 18 nt, Human
ugcuguauaaaaucagcc

SEQ ID NO: 3709613 - RNA, 16 nt, Human
ugcuguauaaguuauu

SEQ ID NO: 3709614 - RNA, 15 nt, Human
ugcuguauucccaua

SEQ ID NO: 3709615 - RNA, 23 nt, Human
ugcuguauuuuaaaagaaugauu

SEQ ID NO: 3709616 - RNA, 15 nt, Human
ugcugucaccucucc

SEQ ID NO: 3709617 - RNA, 13 nt, Human
ugcugucauugcu

SEQ ID NO: 3709618 - RNA, 21 nt, Human
ugcuguccagacagccuguau

SEQ ID NO: 3709619 - RNA, 17 nt, Human
ugcuguccaugcuucuc

SEQ ID NO: 3709620 - RNA, 21 nt, Human
ugcugucccauagucccugcc

SEQ ID NO: 3709621 - RNA, 20 nt, Human
ugcuguccccucuugcccca

SEQ ID NO: 3709622 - RNA, 21 nt, Human
ugcuguccccucuugccccaa

SEQ ID NO: 3709623 - RNA, 17 nt, Human
ugcugucccucccccuu

SEQ ID NO: 3709624 - RNA, 14 nt, Human
ugcuguccuaggcc

SEQ ID NO: 3709625 - RNA, 16 nt, Human
ugcuguccuaggccac

SEQ ID NO: 3709626 - RNA, 18 nt, Human
ugcuguccucagguggcc

SEQ ID NO: 3709627 - RNA, 21 nt, Human
ugcuguccucagguggccaug

SEQ ID NO: 3709628 - RNA, 19 nt, Human
ugcuguccuugaaugccau

SEQ ID NO: 3709629 - RNA, 14 nt, Human
ugcugucuaugugg

SEQ ID NO: 3709630 - RNA, 16 nt, Human
ugcugucucugcucgc

SEQ ID NO: 3709631 - RNA, 15 nt, Human
ugcugucugcagccu

SEQ ID NO: 3709632 - RNA, 21 nt, Human
ugcugucuuaaacuaaaugug

SEQ ID NO: 3709633 - RNA, 15 nt, Human
ugcugucuucuggac

SEQ ID NO: 3709634 - RNA, 13 nt, Human
ugcugucuuucuu

SEQ ID NO: 3709635 - RNA, 22 nt, Human
ugcugugaaaaaaaaaaugcug

SEQ ID NO: 3709636 - RNA, 17 nt, Human
ugcugugaaauucccaa

SEQ ID NO: 3709637 - RNA, 18 nt, Human
ugcugugaagcuggaacu

SEQ ID NO: 3709638 - RNA, 13 nt, Human
ugcugugaggcug

SEQ ID NO: 3709639 - RNA, 19 nt, Human
ugcugugaggcuguccugu

SEQ ID NO: 3709640 - RNA, 17 nt, Human
ugcugugagggagggga

SEQ ID NO: 3709641 - RNA, 18 nt, Human
ugcugugagggaggggaa

SEQ ID NO: 3709642 - RNA, 23 nt, Human
ugcugugagucuuugguucuaag

SEQ ID NO: 3709643 - RNA, 16 nt, Human
ugcugugcgcccaggg

SEQ ID NO: 3709644 - RNA, 22 nt, Human
ugcuguggaacuacauuacugu

SEQ ID NO: 3709645 - RNA, 13 nt, Human
ugcuguggccagg

SEQ ID NO: 3709646 - RNA, 17 nt, Human
ugcuguggccaggaggu

SEQ ID NO: 3709647 - RNA, 19 nt, Human
ugcugugggaacgagaggg

SEQ ID NO: 3709648 - RNA, 15 nt, Human
ugcuguggugugucc

SEQ ID NO: 3709649 - RNA, 17 nt, Human
ugcuguggugugucccc

SEQ ID NO: 3709650 - RNA, 15 nt, Human
ugcuguguaucugau

SEQ ID NO: 3709651 - RNA, 14 nt, Human
ugcugugugguuug

SEQ ID NO: 3709652 - RNA, 18 nt, Human
ugcuguguguggcuucug

SEQ ID NO: 3709653 - RNA, 13 nt, Human
ugcuguguuugcu

SEQ ID NO: 3709654 - RNA, 16 nt, Human
ugcuguucaugaaaga

SEQ ID NO: 3709655 - RNA, 13 nt, Human
ugcuguugaaagc

SEQ ID NO: 3709656 - RNA, 16 nt, Human
guccuuuucuugcuua

SEQ ID NO: 3709657 - RNA, 20 nt, Human
guccuuuuuccucuccacac

SEQ ID NO: 3709658 - RNA, 16 nt, Human
guccuuuuuuuccauc

SEQ ID NO: 3709659 - RNA, 19 nt, Human
guccuuuuuuuccaucuuu

SEQ ID NO: 3709660 - RNA, 13 nt, Human
gucgaaaguuagu

SEQ ID NO: 3709661 - RNA, 12 nt, Human
gucgagacacuu

SEQ ID NO: 3709662 - RNA, 21 nt, Human
gucgagccugggggcuggagc

SEQ ID NO: 3709663 - RNA, 23 nt, Human
gucgagcuggaugucccaccucu

SEQ ID NO: 3709664 - RNA, 16 nt, Human
gucgaggacagggagg

SEQ ID NO: 3709665 - RNA, 14 nt, Human
gucgauaaucagag

SEQ ID NO: 3709666 - RNA, 14 nt, Human
gucgaugaacuauu

SEQ ID NO: 3709667 - RNA, 13 nt, Human
gucgcccaggaga

SEQ ID NO: 3709668 - RNA, 14 nt, Human
gucgcccaggcugg

SEQ ID NO: 3709669 - RNA, 20 nt, Human
gucgcccaggcuggagugca

SEQ ID NO: 3709670 - RNA, 13 nt, Human
gucgcccagucug

SEQ ID NO: 3709671 - RNA, 14 nt, Human
gucgcccagucugg

SEQ ID NO: 3709672 - RNA, 21 nt, Human
gucgccuuucagcaggcagcc

SEQ ID NO: 3709673 - RNA, 18 nt, Human
gucgcgcaccgaaaaacu

SEQ ID NO: 3709674 - RNA, 13 nt, Human
gucgcgcucagca

SEQ ID NO: 3709675 - RNA, 12 nt, Human
gucgcgcugccu

SEQ ID NO: 3709676 - RNA, 16 nt, Human
gucgcgcugccugugu

SEQ ID NO: 3709677 - RNA, 18 nt, Human
gucgcgcugccugugugg

SEQ ID NO: 3709678 - RNA, 11 nt, Human
gucgcuccugc

SEQ ID NO: 3709679 - RNA, 15 nt, Human
gucgcuccugcccac

SEQ ID NO: 3709680 - RNA, 15 nt, Human
gucggaacagcagau

SEQ ID NO: 3709681 - RNA, 12 nt, Human
gucggagcccug

SEQ ID NO: 3709682 - RNA, 14 nt, Human
gucggaggcuuggg

SEQ ID NO: 3709683 - RNA, 17 nt, Human
gucggccccaccagugc

SEQ ID NO: 3709684 - RNA, 20 nt, Human
gucggccucuaaccccaggc

SEQ ID NO: 3709685 - RNA, 21 nt, Human
gucggccucuaaccccaggcc

SEQ ID NO: 3709686 - RNA, 12 nt, Human
gucggcuccagu

SEQ ID NO: 3709687 - RNA, 22 nt, Human
gucggcuccaguccccagaacu

SEQ ID NO: 3709688 - RNA, 14 nt, Human
gucggcugaccaug

SEQ ID NO: 3709689 - RNA, 18 nt, Human
gucggcugaccaugcuca

SEQ ID NO: 3709690 - RNA, 22 nt, Human
gucgggaugucauguccuccag

SEQ ID NO: 3709691 - RNA, 21 nt, Human
gucgggcccuucuugcugccc

SEQ ID NO: 3709692 - RNA, 22 nt, Human
gucgggcccuucuugcugcccu

SEQ ID NO: 3709693 - RNA, 21 nt, Human
gucgggcucagcucuggcuca

SEQ ID NO: 3709694 - RNA, 18 nt, Human
gucggggcaucuggccug

SEQ ID NO: 3709695 - RNA, 14 nt, Human
gucgggggcugagg

SEQ ID NO: 3709696 - RNA, 17 nt, Human
gucggggggacagcucc

SEQ ID NO: 3709697 - RNA, 12 nt, Human
gucguaaagauu

SEQ ID NO: 3709698 - RNA, 14 nt, Human
gucguaaagauuug

SEQ ID NO: 3709699 - RNA, 19 nt, Human
gucgucacuaauacacagu

SEQ ID NO: 3709700 - RNA, 17 nt, Human
gucgucaucagaugcuu

SEQ ID NO: 3709701 - RNA, 17 nt, Human
gucgucgcacagucucu

SEQ ID NO: 3709702 - RNA, 19 nt, Human
gucgucgcacagucucucu

SEQ ID NO: 3709703 - RNA, 13 nt, Human
gucgugccugugu

SEQ ID NO: 3709704 - RNA, 18 nt, Human
gucgugccuguguccaug

SEQ ID NO: 3709705 - RNA, 19 nt, Human
gucguggagagcuaggagc

SEQ ID NO: 3709706 - RNA, 21 nt, Human
gucguggagagcuaggagcaa

SEQ ID NO: 3709707 - RNA, 15 nt, Human
gucguggcagauaau

SEQ ID NO: 3709708 - RNA, 15 nt, Human
gucguuuuaaaaaca

SEQ ID NO: 3709709 - RNA, 16 nt, Human
gucguuuuuuuuuugu

SEQ ID NO: 3709710 - RNA, 21 nt, Human
gucguuuuuuuuuuguuuguu

SEQ ID NO: 3709711 - RNA, 15 nt, Human
gucuaaaaauucaga

SEQ ID NO: 3709712 - RNA, 20 nt, Human
gucuaaaauuuuuaaggacu

SEQ ID NO: 3709713 - RNA, 16 nt, Human
gucuaaacaaugcuga

SEQ ID NO: 3709714 - RNA, 21 nt, Human
gucuaaacaaugcugauuugg

SEQ ID NO: 3709715 - RNA, 21 nt, Human
gucuaaagauggaguuucuaa

SEQ ID NO: 3709716 - RNA, 15 nt, Human
gucuaaaugcugaaa

SEQ ID NO: 3709717 - RNA, 18 nt, Human
gucuaacuuuugugugaa

SEQ ID NO: 3709718 - RNA, 14 nt, Human
gucuaagauucuag

SEQ ID NO: 3709719 - RNA, 15 nt, Human
gucuaagauucuaga

SEQ ID NO: 3709720 - RNA, 20 nt, Human
gucuaaggaugcuaaaccuu

SEQ ID NO: 3709721 - RNA, 21 nt, Human
gucuaaucuagauaucgacuu

SEQ ID NO: 3709722 - RNA, 22 nt, Human
gucuaauugcaucucaaaauua

SEQ ID NO: 3709723 - RNA, 23 nt, Human
gucuacacuaagagagaaugaga

SEQ ID NO: 3709724 - RNA, 15 nt, Human
gucuaccaauuauaa

SEQ ID NO: 3709725 - RNA, 13 nt, Human
gucuaccaucucc

SEQ ID NO: 3709726 - RNA, 20 nt, Human
gucuaccugaggggccucuu

SEQ ID NO: 3709727 - RNA, 21 nt, Human
gucuagagagggaggcaagcc

SEQ ID NO: 3709728 - RNA, 20 nt, Human
gucuagauggcuccucucag

SEQ ID NO: 3709729 - RNA, 11 nt, Human
gucuagauuca

SEQ ID NO: 3709730 - RNA, 19 nt, Human
gucuagauucaaagguucu

SEQ ID NO: 3709731 - RNA, 19 nt, Human
gucuagcagagcaggggca

SEQ ID NO: 3709732 - RNA, 22 nt, Human
gucuagcuaugcuguaucugug

SEQ ID NO: 3709733 - RNA, 23 nt, Human
gucuaggcaggaccuguggccaa

SEQ ID NO: 3709734 - RNA, 12 nt, Human
gucuagggagag

SEQ ID NO: 3709735 - RNA, 14 nt, Human
gucuagggagagac

SEQ ID NO: 3709736 - RNA, 23 nt, Human
gucuaguugccaaaucuggcucc

SEQ ID NO: 3709737 - RNA, 13 nt, Human
gucuauaaagcau

SEQ ID NO: 3709738 - RNA, 17 nt, Human
gucuauaugaaaaacaa

SEQ ID NO: 3709739 - RNA, 14 nt, Human
gucuauauguuugu

SEQ ID NO: 3709740 - RNA, 21 nt, Human
gucuaucaaccccagacacug

SEQ ID NO: 3709741 - RNA, 23 nt, Human
gucuaucaaccccagacacuggu

SEQ ID NO: 3709742 - RNA, 20 nt, Human
gucuaucugguauuaaaugc

SEQ ID NO: 3709743 - RNA, 15 nt, Human
gucuaugggacucaa

SEQ ID NO: 3709744 - RNA, 12 nt, Human
gucuauucauua

SEQ ID NO: 3709745 - RNA, 12 nt, Human
gucuauuccagc

SEQ ID NO: 3709746 - RNA, 16 nt, Human
gucuauuccagcucau

SEQ ID NO: 3709747 - RNA, 10 nt, Human
gucuauuuaa

SEQ ID NO: 3709748 - RNA, 22 nt, Human
gucuauuucaucagaacagcug

SEQ ID NO: 3709749 - RNA, 19 nt, Human
gucucaaaaaaagaaaaag

SEQ ID NO: 3709750 - RNA, 17 nt, Human
gucucaaaaauacaaaa

SEQ ID NO: 3709751 - RNA, 16 nt, Human
gucucaaacuccuggg

SEQ ID NO: 3709752 - RNA, 14 nt, Human
gucucaaaggccag

SEQ ID NO: 3709753 - RNA, 15 nt, Human
gucucaagagggcac

SEQ ID NO: 3709754 - RNA, 23 nt, Human
gucucacaguguugcccaggcug

SEQ ID NO: 3709755 - RNA, 23 nt, Human
gucucacaugauuccagccauca

SEQ ID NO: 3709756 - RNA, 21 nt, Human
gucucaccauuuccccagggc

SEQ ID NO: 3709757 - RNA, 15 nt, Human
gucucacccuggagg

SEQ ID NO: 3709758 - RNA, 20 nt, Human
gucucaccggcucucaccug

SEQ ID NO: 3709759 - RNA, 23 nt, Human
gucucacuauguugcccaggcag

SEQ ID NO: 3709760 - RNA, 15 nt, Human
gucucacucugucgc

SEQ ID NO: 3709761 - RNA, 18 nt, Human
gucucacucugucgccca

SEQ ID NO: 3709762 - RNA, 18 nt, Human
gucucacuguugcccagg

SEQ ID NO: 3709763 - RNA, 22 nt, Human
gucucacuguugcccaggcugg

SEQ ID NO: 3709764 - RNA, 16 nt, Human
gucucagaaucuuucc

SEQ ID NO: 3709765 - RNA, 18 nt, Human
gucucagacuuuuguaca

SEQ ID NO: 3709766 - RNA, 20 nt, Human
gucucagacuuuuguacauc

SEQ ID NO: 3709767 - RNA, 13 nt, Human
gucucagauuuua

SEQ ID NO: 3709768 - RNA, 14 nt, Human
gucucagauuuuau

SEQ ID NO: 3709769 - RNA, 15 nt, Human
gucucagauuuuauu

SEQ ID NO: 3709770 - RNA, 16 nt, Human
gucucagauuuuauua

SEQ ID NO: 3709771 - RNA, 12 nt, Human
gucucaggagca

SEQ ID NO: 3709772 - RNA, 16 nt, Human
gucucaggagucucug

SEQ ID NO: 3709773 - RNA, 18 nt, Human
gucucagggugcagaggu

SEQ ID NO: 3709774 - RNA, 20 nt, Human
gucucagguuuguuuuguga

SEQ ID NO: 3709775 - RNA, 23 nt, Human
gucucaguccaugaagauguaga

SEQ ID NO: 3709776 - RNA, 16 nt, Human
gucucagugaagacua

SEQ ID NO: 3709777 - RNA, 15 nt, Human
gucucaguuggaaau

SEQ ID NO: 3709778 - RNA, 19 nt, Human
gucucaguuugugugucuu

SEQ ID NO: 3709779 - RNA, 22 nt, Human
gucucauaguuggacuuucuag

SEQ ID NO: 3709780 - RNA, 16 nt, Human
gucucauccaucauca

SEQ ID NO: 3709781 - RNA, 12 nt, Human
gucucaucccau

SEQ ID NO: 3709782 - RNA, 13 nt, Human
gucucauccccag

SEQ ID NO: 3709783 - RNA, 16 nt, Human
gucucauccccagggg

SEQ ID NO: 3709784 - RNA, 22 nt, Human
gucucaugccaguaacaggcuc

SEQ ID NO: 3709785 - RNA, 16 nt, Human
gucucauuuuaaugua

SEQ ID NO: 3709786 - RNA, 23 nt, Human
gucuccaaaaaaaaaaaaaauac

SEQ ID NO: 3709787 - RNA, 20 nt, Human
gucuccacacacagcugggc

SEQ ID NO: 3709788 - RNA, 23 nt, Human
gucuccacacacagcugggcugu

SEQ ID NO: 3709789 - RNA, 12 nt, Human
gucuccacugug

SEQ ID NO: 3709790 - RNA, 19 nt, Human
gucuccacugugccuuugc

SEQ ID NO: 3709791 - RNA, 23 nt, Human
gucuccagaaagccccacccagg

SEQ ID NO: 3709792 - RNA, 15 nt, Human
gucuccagaccccca

SEQ ID NO: 3709793 - RNA, 17 nt, Human
gucuccagacccccacc

SEQ ID NO: 3709794 - RNA, 11 nt, Human
gucuccagccc

SEQ ID NO: 3709795 - RNA, 19 nt, Human
gucuccaggggcugcuucc

SEQ ID NO: 3709796 - RNA, 21 nt, Human
gucuccaguauccacuuugca

SEQ ID NO: 3709797 - RNA, 18 nt, Human
gucuccagugguugcugu

SEQ ID NO: 3709798 - RNA, 19 nt, Human
gucuccauguuugauguau

SEQ ID NO: 3709799 - RNA, 22 nt, Human
gucucccccacccuuguuccag

SEQ ID NO: 3709800 - RNA, 17 nt, Human
gucuccccuguuccccu

SEQ ID NO: 3709801 - RNA, 20 nt, Human
gucucccgauucccaacuga

SEQ ID NO: 3709802 - RNA, 16 nt, Human
gucucccuccucugcc

SEQ ID NO: 3709803 - RNA, 19 nt, Human
gucucccuccucugcccgg

SEQ ID NO: 3709804 - RNA, 16 nt, Human
gucucccucuccugcc

SEQ ID NO: 3709805 - RNA, 17 nt, Human
gucucccucuccugccu

SEQ ID NO: 3709806 - RNA, 14 nt, Human
ugcacuauauacau

SEQ ID NO: 3709807 - RNA, 16 nt, Human
ugcacuaucuuucagc

SEQ ID NO: 3709808 - RNA, 22 nt, Human
ugcacucaaaucuuaagaaaua

SEQ ID NO: 3709809 - RNA, 18 nt, Human
ugcacuccagccugggcg

SEQ ID NO: 3709810 - RNA, 19 nt, Human
ugcacuccagccugggcga

SEQ ID NO: 3709811 - RNA, 15 nt, Human
ugcacucccaccuga

SEQ ID NO: 3709812 - RNA, 16 nt, Human
ugcacuccccugcugg

SEQ ID NO: 3709813 - RNA, 12 nt, Human
ugcacuccucag

SEQ ID NO: 3709814 - RNA, 15 nt, Human
ugcacucuagccgga

SEQ ID NO: 3709815 - RNA, 15 nt, Human
ugcacucugugccca

SEQ ID NO: 3709816 - RNA, 10 nt, Human
ugcacugaag

SEQ ID NO: 3709817 - RNA, 15 nt, Human
ugcacugacccuucc

SEQ ID NO: 3709818 - RNA, 12 nt, Human
ugcacugacucu

SEQ ID NO: 3709819 - RNA, 17 nt, Human
ugcacugacucuggaaa

SEQ ID NO: 3709820 - RNA, 17 nt, Human
ugcacugagcagagucu

SEQ ID NO: 3709821 - RNA, 12 nt, Human
ugcacugagggc

SEQ ID NO: 3709822 - RNA, 16 nt, Human
ugcacugagggccaca

SEQ ID NO: 3709823 - RNA, 19 nt, Human
ugcacugagggccacacua

SEQ ID NO: 3709824 - RNA, 22 nt, Human
ugcacugauauaucaugaguga

SEQ ID NO: 3709825 - RNA, 17 nt, Human
ugcacugaugcugcccc

SEQ ID NO: 3709826 - RNA, 21 nt, Human
ugcacugaugcugccccucau

SEQ ID NO: 3709827 - RNA, 22 nt, Human
ugcacugaugcugccccucauc

SEQ ID NO: 3709828 - RNA, 14 nt, Human
ugcacugauguugu

SEQ ID NO: 3709829 - RNA, 15 nt, Human
ugcacugauguugug

SEQ ID NO: 3709830 - RNA, 21 nt, Human
ugcacugauguuguguuuuua

SEQ ID NO: 3709831 - RNA, 15 nt, Human
ugcacuggccccacc

SEQ ID NO: 3709832 - RNA, 17 nt, Human
ugcacuggccuucugau

SEQ ID NO: 3709833 - RNA, 20 nt, Human
ugcacuggggagcccgucuc

SEQ ID NO: 3709834 - RNA, 17 nt, Human
ugcacuguaaaaugugg

SEQ ID NO: 3709835 - RNA, 15 nt, Human
ugcacugucacuuug

SEQ ID NO: 3709836 - RNA, 19 nt, Human
ugcacugucacuuugcucu

SEQ ID NO: 3709837 - RNA, 23 nt, Human
ugcacugucacuuugcucugggu

SEQ ID NO: 3709838 - RNA, 14 nt, Human
ugcacuguccugcu

SEQ ID NO: 3709839 - RNA, 15 nt, Human
ugcacuguccugcuc

SEQ ID NO: 3709840 - RNA, 18 nt, Human
ugcacuguccugcuccac

SEQ ID NO: 3709841 - RNA, 20 nt, Human
ugcacuguccugcuccacag

SEQ ID NO: 3709842 - RNA, 21 nt, Human
ugcacuguccugcuccacagu

SEQ ID NO: 3709843 - RNA, 19 nt, Human
ugcacugucgauaaucaga

SEQ ID NO: 3709844 - RNA, 15 nt, Human
ugcacugugaaggac

SEQ ID NO: 3709845 - RNA, 13 nt, Human
ugcacuguucccc

SEQ ID NO: 3709846 - RNA, 17 nt, Human
ugcacuuaaauaucaau

SEQ ID NO: 3709847 - RNA, 18 nt, Human
ugcacuuaacaagcuccc

SEQ ID NO: 3709848 - RNA, 16 nt, Human
ugcacuuaaggcacuc

SEQ ID NO: 3709849 - RNA, 15 nt, Human
ugcacuuacuugcuu

SEQ ID NO: 3709850 - RNA, 16 nt, Human
ugcacuuacuugcuua

SEQ ID NO: 3709851 - RNA, 23 nt, Human
ugcacuuauugaccauuuuuuaa

SEQ ID NO: 3709852 - RNA, 22 nt, Human
ugcacuuauuuaugaaccugcc

SEQ ID NO: 3709853 - RNA, 15 nt, Human
ugcacuucaaauuca

SEQ ID NO: 3709854 - RNA, 16 nt, Human
ugcacuugcagacucu

SEQ ID NO: 3709855 - RNA, 22 nt, Human
ugcacuugcgguuccggcaugg

SEQ ID NO: 3709856 - RNA, 21 nt, Human
ugcacuugggggcucagcaag

SEQ ID NO: 3709857 - RNA, 14 nt, Human
ugcacuuucagacu

SEQ ID NO: 3709858 - RNA, 19 nt, Human
ugcacuuugaugucaugug

SEQ ID NO: 3709859 - RNA, 16 nt, Human
ugcacuuugcuuuaau

SEQ ID NO: 3709860 - RNA, 12 nt, Human
ugcacuuuguaa

SEQ ID NO: 3709861 - RNA, 17 nt, Human
ugcacuuuguaaauucc

SEQ ID NO: 3709862 - RNA, 15 nt, Human
ugcacuuuguagugu

SEQ ID NO: 3709863 - RNA, 12 nt, Human
ugcacuuuguuc

SEQ ID NO: 3709864 - RNA, 21 nt, Human
ugcacuuuucuaaacuaggcu

SEQ ID NO: 3709865 - RNA, 18 nt, Human
ugcacuuuuuuucuauau

SEQ ID NO: 3709866 - RNA, 16 nt, Human
ugcagaaaagcaccug

SEQ ID NO: 3709867 - RNA, 20 nt, Human
ugcagaaaagcaccugccga

SEQ ID NO: 3709868 - RNA, 19 nt, Human
ugcagaaauagacaaaaag

SEQ ID NO: 3709869 - RNA, 14 nt, Human
ugcagaacaaauga

SEQ ID NO: 3709870 - RNA, 18 nt, Human
ugcagaacaaaugaagac

SEQ ID NO: 3709871 - RNA, 21 nt, Human
ugcagaacacauuucaaauga

SEQ ID NO: 3709872 - RNA, 20 nt, Human
ugcagaaccggagagccagc

SEQ ID NO: 3709873 - RNA, 15 nt, Human
ugcagaacucccaag

SEQ ID NO: 3709874 - RNA, 21 nt, Human
ugcagaacuugaagccugcuc

SEQ ID NO: 3709875 - RNA, 15 nt, Human
ugcagaaggaaaaau

SEQ ID NO: 3709876 - RNA, 20 nt, Human
ugcagaaguucuuaguguug

SEQ ID NO: 3709877 - RNA, 18 nt, Human
ugcagaauggcauuugca

SEQ ID NO: 3709878 - RNA, 11 nt, Human
ugcagaaugua

SEQ ID NO: 3709879 - RNA, 21 nt, Human
ugcagacacgccuuccccuca

SEQ ID NO: 3709880 - RNA, 13 nt, Human
ugcagacaggaau

SEQ ID NO: 3709881 - RNA, 18 nt, Human
ugcagacaggaaucuuaa

SEQ ID NO: 3709882 - RNA, 20 nt, Human
ugcagacaggaaucuuaagg

SEQ ID NO: 3709883 - RNA, 13 nt, Human
ugcagacaggcaa

SEQ ID NO: 3709884 - RNA, 22 nt, Human
ugcagacagggggccagaacac

SEQ ID NO: 3709885 - RNA, 23 nt, Human
ugcagaccacgcccguccugccu

SEQ ID NO: 3709886 - RNA, 19 nt, Human
ugcagaccuguccuccugg

SEQ ID NO: 3709887 - RNA, 20 nt, Human
ugcagaccuguccuccuggu

SEQ ID NO: 3709888 - RNA, 23 nt, Human
ugcagaccuguccuccugguggg

SEQ ID NO: 3709889 - RNA, 19 nt, Human
ugcagacuagaauucuagu

SEQ ID NO: 3709890 - RNA, 16 nt, Human
ugcagacucaauaaaa

SEQ ID NO: 3709891 - RNA, 14 nt, Human
ugcagacucacugu

SEQ ID NO: 3709892 - RNA, 17 nt, Human
ugcagacucuacagagg

SEQ ID NO: 3709893 - RNA, 18 nt, Human
ugcagacucuacagaggc

SEQ ID NO: 3709894 - RNA, 20 nt, Human
ugcagacucuacagaggcca

SEQ ID NO: 3709895 - RNA, 22 nt, Human
ugcagacucuacagaggccaug

SEQ ID NO: 3709896 - RNA, 16 nt, Human
ugcagacuucccagcu

SEQ ID NO: 3709897 - RNA, 21 nt, Human
ugcagagaaacuuaagcaaag

SEQ ID NO: 3709898 - RNA, 14 nt, Human
ugcagagagaagcc

SEQ ID NO: 3709899 - RNA, 17 nt, Human
ugcagagagccauuuug

SEQ ID NO: 3709900 - RNA, 13 nt, Human
ugcagagauuucu

SEQ ID NO: 3709901 - RNA, 17 nt, Human
ugcagagcaguaaggga

SEQ ID NO: 3709902 - RNA, 15 nt, Human
ugcagagccuucuca

SEQ ID NO: 3709903 - RNA, 20 nt, Human
ugcagagccuucucagaagc

SEQ ID NO: 3709904 - RNA, 15 nt, Human
ugcagagcugaagau

SEQ ID NO: 3709905 - RNA, 11 nt, Human
ugcagagcugc

SEQ ID NO: 3709906 - RNA, 11 nt, Human
ugcagaggcug

SEQ ID NO: 3709907 - RNA, 14 nt, Human
ugcagaggcugugg

SEQ ID NO: 3709908 - RNA, 15 nt, Human
ugcagaggcuguggc

SEQ ID NO: 3709909 - RNA, 22 nt, Human
ugcagaggcuguggcuggugag

SEQ ID NO: 3709910 - RNA, 13 nt, Human
ugcagaggggaaa

SEQ ID NO: 3709911 - RNA, 18 nt, Human
ugcagaggggcaggcccu

SEQ ID NO: 3709912 - RNA, 21 nt, Human
ugcagaggggcuuucuggaga

SEQ ID NO: 3709913 - RNA, 18 nt, Human
ugcagagguacccugggu

SEQ ID NO: 3709914 - RNA, 19 nt, Human
ugcagagguccacaacaca

SEQ ID NO: 3709915 - RNA, 16 nt, Human
ugcagaggucugugcu

SEQ ID NO: 3709916 - RNA, 21 nt, Human
ugcagaggucugugcugaggc

SEQ ID NO: 3709917 - RNA, 22 nt, Human
ugcagaguaggggucugucuuu

SEQ ID NO: 3709918 - RNA, 19 nt, Human
ugcagaguauuucuaaagu

SEQ ID NO: 3709919 - RNA, 14 nt, Human
ugcagagucagcag

SEQ ID NO: 3709920 - RNA, 15 nt, Human
ugcagaugacaaaaa

SEQ ID NO: 3709921 - RNA, 11 nt, Human
ugcagaugcca

SEQ ID NO: 3709922 - RNA, 17 nt, Human
ugcagaugccacccuag

SEQ ID NO: 3709923 - RNA, 18 nt, Human
ugcagauggugagagaua

SEQ ID NO: 3709924 - RNA, 22 nt, Human
ugcagauugagaccuacaggcu

SEQ ID NO: 3709925 - RNA, 19 nt, Human
ugcagcaaacacuccaccc

SEQ ID NO: 3709926 - RNA, 22 nt, Human
ugcagcaaacacuccacccucc

SEQ ID NO: 3709927 - RNA, 19 nt, Human
ugcagcaaccagagcacug

SEQ ID NO: 3709928 - RNA, 16 nt, Human
ugcagcaauaaagcag

SEQ ID NO: 3709929 - RNA, 18 nt, Human
ugcagcaauuaaaaauug

SEQ ID NO: 3709930 - RNA, 17 nt, Human
ugcagcaccgaggggcc

SEQ ID NO: 3709931 - RNA, 20 nt, Human
ugcagcaccgaggggccuuu

SEQ ID NO: 3709932 - RNA, 15 nt, Human
ugcagcaccuccagg

SEQ ID NO: 3709933 - RNA, 16 nt, Human
ugcagcaccuccaggc

SEQ ID NO: 3709934 - RNA, 18 nt, Human
ugcagcaccuccaggccu

SEQ ID NO: 3709935 - RNA, 19 nt, Human
ugcagcaccuccaggccug

SEQ ID NO: 3709936 - RNA, 20 nt, Human
ugcagcacggacaauaaacc

SEQ ID NO: 3709937 - RNA, 17 nt, Human
ugcagcacucacacagg

SEQ ID NO: 3709938 - RNA, 16 nt, Human
ugcagcagauuggaag

SEQ ID NO: 3709939 - RNA, 22 nt, Human
ugcagcagauuggaaggagaca

SEQ ID NO: 3709940 - RNA, 20 nt, Human
ugcagcagcaacacaauguu

SEQ ID NO: 3709941 - RNA, 22 nt, Human
ugcagcagcaacacaauguuau

SEQ ID NO: 3709942 - RNA, 16 nt, Human
ugcagcagcuugcugc

SEQ ID NO: 3709943 - RNA, 23 nt, Human
ugcagcaggaauauaugugugcc

SEQ ID NO: 3709944 - RNA, 21 nt, Human
ugcagcaggaucuagaggggg

SEQ ID NO: 3709945 - RNA, 14 nt, Human
ugcagcagggaugc

SEQ ID NO: 3709946 - RNA, 18 nt, Human
ugcagcagggaugcccug

SEQ ID NO: 3709947 - RNA, 19 nt, Human
ugcagcagggaugcccugg

SEQ ID NO: 3709948 - RNA, 22 nt, Human
ugcagcagggaugcccuggagg

SEQ ID NO: 3709949 - RNA, 22 nt, Human
ugcagcagugagucucuucaga

SEQ ID NO: 3709950 - RNA, 22 nt, Human
ugcagcaguucaccuauuucaa

SEQ ID NO: 3709951 - RNA, 15 nt, Human
ugcagcauaugagga

SEQ ID NO: 3709952 - RNA, 20 nt, Human
ugcagcauaugaggaugcag

SEQ ID NO: 3709953 - RNA, 13 nt, Human
ugcagcaugaccu

SEQ ID NO: 3709954 - RNA, 19 nt, Human
ugcagcaugaccugugacc

SEQ ID NO: 3709955 - RNA, 16 nt, Human
ugcuguugaaagcaaa

SEQ ID NO: 3709956 - RNA, 17 nt, Human
ugcuguugaaagcaaaa

SEQ ID NO: 3709957 - RNA, 22 nt, Human
ugcuguugaaagcaaaaaugcu

SEQ ID NO: 3709958 - RNA, 18 nt, Human
ugcuguugauugcuaaau

SEQ ID NO: 3709959 - RNA, 19 nt, Human
ugcuguugauugcuaaaug

SEQ ID NO: 3709960 - RNA, 14 nt, Human
ugcuguugccucau

SEQ ID NO: 3709961 - RNA, 17 nt, Human
ugcuguugcugauuuua

SEQ ID NO: 3709962 - RNA, 23 nt, Human
ugcuguugucauugcuuuacugg

SEQ ID NO: 3709963 - RNA, 23 nt, Human
ugcuguuguccaacuauuuauug

SEQ ID NO: 3709964 - RNA, 12 nt, Human
ugcuguuguccc

SEQ ID NO: 3709965 - RNA, 15 nt, Human
ugcuguuguuaugau

SEQ ID NO: 3709966 - RNA, 16 nt, Human
ugcuguuguuaugaug

SEQ ID NO: 3709967 - RNA, 17 nt, Human
ugcuguuguuaugaugu

SEQ ID NO: 3709968 - RNA, 22 nt, Human
ugcuguuuaucccuuaagaaug

SEQ ID NO: 3709969 - RNA, 18 nt, Human
ugcuguuucacaauaccu

SEQ ID NO: 3709970 - RNA, 11 nt, Human
ugcuguuuccu

SEQ ID NO: 3709971 - RNA, 12 nt, Human
ugcuguuuccuu

SEQ ID NO: 3709972 - RNA, 14 nt, Human
ugcuguuuccuuuu

SEQ ID NO: 3709973 - RNA, 16 nt, Human
ugcuguuuguagugaa

SEQ ID NO: 3709974 - RNA, 21 nt, Human
ugcuguuuguagugaaauaau

SEQ ID NO: 3709975 - RNA, 23 nt, Human
ugcuguuuuaaacauuaauagca

SEQ ID NO: 3709976 - RNA, 14 nt, Human
ugcuguuuuccucc

SEQ ID NO: 3709977 - RNA, 16 nt, Human
ugcuguuuuccucccu

SEQ ID NO: 3709978 - RNA, 16 nt, Human
ugcuguuuugccagcc

SEQ ID NO: 3709979 - RNA, 19 nt, Human
ugcuguuuuguuauauaau

SEQ ID NO: 3709980 - RNA, 17 nt, Human
ugcuuaaaaaucauuga

SEQ ID NO: 3709981 - RNA, 18 nt, Human
ugcuuaaaaaucauugau

SEQ ID NO: 3709982 - RNA, 19 nt, Human
ugcuuaaaaaucauugauu

SEQ ID NO: 3709983 - RNA, 18 nt, Human
ugcuuaaaagguugcaua

SEQ ID NO: 3709984 - RNA, 19 nt, Human
ugcuuaaaauaagcaggug

SEQ ID NO: 3709985 - RNA, 21 nt, Human
ugcuuaaaccacuuaaacgaa

SEQ ID NO: 3709986 - RNA, 16 nt, Human
ugcuuaaauuucuuau

SEQ ID NO: 3709987 - RNA, 22 nt, Human
ugcuuaaauuucuuaugugaca

SEQ ID NO: 3709988 - RNA, 17 nt, Human
ugcuuaacuucacauau

SEQ ID NO: 3709989 - RNA, 19 nt, Human
ugcuuaacuucacauauug

SEQ ID NO: 3709990 - RNA, 19 nt, Human
ugcuuaagggaguuuaaua

SEQ ID NO: 3709991 - RNA, 15 nt, Human
ugcuuaaguuccagc

SEQ ID NO: 3709992 - RNA, 21 nt, Human
ugcuuaaucuucaaagccuuc

SEQ ID NO: 3709993 - RNA, 14 nt, Human
ugcuuaaugaaaag

SEQ ID NO: 3709994 - RNA, 20 nt, Human
ugcuuaauucaaauaauaau

SEQ ID NO: 3709995 - RNA, 14 nt, Human
ugcuuaauuucuaa

SEQ ID NO: 3709996 - RNA, 22 nt, Human
ugcuuacaauuuuuuuaauuuu

SEQ ID NO: 3709997 - RNA, 15 nt, Human
ugcuuacacaucuca

SEQ ID NO: 3709998 - RNA, 12 nt, Human
ugcuuacauuuu

SEQ ID NO: 3709999 - RNA, 19 nt, Human
ugcuuaccuacuuucuuca

SEQ ID NO: 3710000 - RNA, 23 nt, Human
ugcuuaccuugacuguugaugua

SEQ ID NO: 3710001 - RNA, 14 nt, Human
ugcuuacuuaugcc

SEQ ID NO: 3710002 - RNA, 17 nt, Human
ugcuuagacauaacaaa

SEQ ID NO: 3710003 - RNA, 13 nt, Human
ugcuuagcaaaaa

SEQ ID NO: 3710004 - RNA, 15 nt, Human
ugcuuagccuccuga

SEQ ID NO: 3710005 - RNA, 18 nt, Human
ugcuuagcucaucuuaga

SEQ ID NO: 3710006 - RNA, 18 nt, Human
ugcuuagucacugccugc

SEQ ID NO: 3710007 - RNA, 16 nt, Human
ugcuuauauuguucac

SEQ ID NO: 3710008 - RNA, 17 nt, Human
ugcuuauauuguuuuca

SEQ ID NO: 3710009 - RNA, 18 nt, Human
ugcuuaugaauauuuaua

SEQ ID NO: 3710010 - RNA, 19 nt, Human
ugcuuaugaauauuuauaa

SEQ ID NO: 3710011 - RNA, 12 nt, Human
ugcuuauguugu

SEQ ID NO: 3710012 - RNA, 19 nt, Human
ugcuuauguuguuuuguac

SEQ ID NO: 3710013 - RNA, 17 nt, Human
ugcuuauuauguaggua

SEQ ID NO: 3710014 - RNA, 19 nt, Human
ugcuuauuccaugacugcu

SEQ ID NO: 3710015 - RNA, 13 nt, Human
ugcuuauugauau

SEQ ID NO: 3710016 - RNA, 14 nt, Human
ugcuuauuguucca

SEQ ID NO: 3710017 - RNA, 13 nt, Human
ugcuucaaaaaca

SEQ ID NO: 3710018 - RNA, 19 nt, Human
ugcuucaaauccauccaga

SEQ ID NO: 3710019 - RNA, 16 nt, Human
ugcuucaagagaaaau

SEQ ID NO: 3710020 - RNA, 12 nt, Human
ugcuucaaggau

SEQ ID NO: 3710021 - RNA, 18 nt, Human
ugcuucaaggauccugag

SEQ ID NO: 3710022 - RNA, 23 nt, Human
ugcuucaaggauccugagccaga

SEQ ID NO: 3710023 - RNA, 16 nt, Human
ugcuucaaggcuucca

SEQ ID NO: 3710024 - RNA, 23 nt, Human
ugcuucaauacccaaauccucuc

SEQ ID NO: 3710025 - RNA, 23 nt, Human
ugcuucaauuaauaaaaaaugga

SEQ ID NO: 3710026 - RNA, 15 nt, Human
ugcuucacaacccau

SEQ ID NO: 3710027 - RNA, 20 nt, Human
ugcuucacaguagagccagc

SEQ ID NO: 3710028 - RNA, 21 nt, Human
ugcuucacaguagagccagcu

SEQ ID NO: 3710029 - RNA, 16 nt, Human
ugcuucacuucuccca

SEQ ID NO: 3710030 - RNA, 22 nt, Human
ugcuucagauguggagccaggc

SEQ ID NO: 3710031 - RNA, 14 nt, Human
ugcuucagccuccc

SEQ ID NO: 3710032 - RNA, 23 nt, Human
ugcuucagccugaggcugagacu

SEQ ID NO: 3710033 - RNA, 16 nt, Human
ugcuucaguggagaau

SEQ ID NO: 3710034 - RNA, 20 nt, Human
ugcuucauaaaugaagcagc

SEQ ID NO: 3710035 - RNA, 15 nt, Human
ugcuucauacaggga

SEQ ID NO: 3710036 - RNA, 18 nt, Human
ugcuucaucuucccaggu

SEQ ID NO: 3710037 - RNA, 19 nt, Human
ugcuucaucuucccaggua

SEQ ID NO: 3710038 - RNA, 17 nt, Human
ugcuucaugaaaauccu

SEQ ID NO: 3710039 - RNA, 18 nt, Human
ugcuucaugaaaauccua

SEQ ID NO: 3710040 - RNA, 20 nt, Human
ugcuucaugaaaauccuacc

SEQ ID NO: 3710041 - RNA, 15 nt, Human
ugcuucauguguccc

SEQ ID NO: 3710042 - RNA, 19 nt, Human
ugcuucaugugucccagaa

SEQ ID NO: 3710043 - RNA, 15 nt, Human
ugcuuccaauuuucu

SEQ ID NO: 3710044 - RNA, 16 nt, Human
ugcuuccaccucaccc

SEQ ID NO: 3710045 - RNA, 19 nt, Human
ugcuuccaccucaccccac

SEQ ID NO: 3710046 - RNA, 13 nt, Human
ugcuuccagaaac

SEQ ID NO: 3710047 - RNA, 14 nt, Human
ugcuuccagaaaca

SEQ ID NO: 3710048 - RNA, 19 nt, Human
ugcuuccagugaggcucug

SEQ ID NO: 3710049 - RNA, 21 nt, Human
ugcuucccaccucccugccca

SEQ ID NO: 3710050 - RNA, 23 nt, Human
ugcuucccaccucccugcccagg

SEQ ID NO: 3710051 - RNA, 14 nt, Human
ugcuucccagguuc

SEQ ID NO: 3710052 - RNA, 15 nt, Human
ugcuucccauccuac

SEQ ID NO: 3710053 - RNA, 23 nt, Human
ugcuucccauccuacccucgggc

SEQ ID NO: 3710054 - RNA, 15 nt, Human
ugcuuccccuuuugc

SEQ ID NO: 3710055 - RNA, 15 nt, Human
ugcuucccuaaucua

SEQ ID NO: 3710056 - RNA, 20 nt, Human
ugcuucccucugccuguccc

SEQ ID NO: 3710057 - RNA, 15 nt, Human
ugcuucccuuacuuu

SEQ ID NO: 3710058 - RNA, 16 nt, Human
ugcuucccuuuccuga

SEQ ID NO: 3710059 - RNA, 21 nt, Human
ugcuuccuagaaguuacugaa

SEQ ID NO: 3710060 - RNA, 13 nt, Human
ugcuuccuccugg

SEQ ID NO: 3710061 - RNA, 22 nt, Human
ugcuuccugucuuauccuccac

SEQ ID NO: 3710062 - RNA, 16 nt, Human
ugcuucuaaguaaaua

SEQ ID NO: 3710063 - RNA, 17 nt, Human
ugcuucuaaguaaauac

SEQ ID NO: 3710064 - RNA, 19 nt, Human
ugcuucuaaguaaauacaa

SEQ ID NO: 3710065 - RNA, 22 nt, Human
ugcuucuaauauuuauugcuuu

SEQ ID NO: 3710066 - RNA, 18 nt, Human
ugcuucuaguucugccag

SEQ ID NO: 3710067 - RNA, 19 nt, Human
ugcuucucauagccccggu

SEQ ID NO: 3710068 - RNA, 19 nt, Human
ugcuucucaucuugugaaa

SEQ ID NO: 3710069 - RNA, 13 nt, Human
ugcuucucccagg

SEQ ID NO: 3710070 - RNA, 17 nt, Human
ugcuucucccaggcaag

SEQ ID NO: 3710071 - RNA, 14 nt, Human
ugcuucuccccaga

SEQ ID NO: 3710072 - RNA, 16 nt, Human
ugcuucuccccagaau

SEQ ID NO: 3710073 - RNA, 22 nt, Human
ugcuucucuagcucucuaggcc

SEQ ID NO: 3710074 - RNA, 23 nt, Human
ugcuucucuagcucucuaggccu

SEQ ID NO: 3710075 - RNA, 19 nt, Human
ugcuucucugacuucugcc

SEQ ID NO: 3710076 - RNA, 20 nt, Human
ugcuucucugacuucugccu

SEQ ID NO: 3710077 - RNA, 21 nt, Human
ugcuucucugacuucugccug

SEQ ID NO: 3710078 - RNA, 23 nt, Human
ugcuucucugacuucugccugga

SEQ ID NO: 3710079 - RNA, 16 nt, Human
ugcuucugaauacaaa

SEQ ID NO: 3710080 - RNA, 13 nt, Human
ugcuucugccacc

SEQ ID NO: 3710081 - RNA, 12 nt, Human
ugcuucugggaa

SEQ ID NO: 3710082 - RNA, 13 nt, Human
ugcuucugggaga

SEQ ID NO: 3710083 - RNA, 17 nt, Human
ugcuucuguuuuauaau

SEQ ID NO: 3710084 - RNA, 15 nt, Human
ugcuucuuacugaua

SEQ ID NO: 3710085 - RNA, 21 nt, Human
ugcuucuucccuuaaaauuua

SEQ ID NO: 3710086 - RNA, 22 nt, Human
ugcuucuucccuuaaaauuuau

SEQ ID NO: 3710087 - RNA, 19 nt, Human
ugcuucuuucuuugggaau

SEQ ID NO: 3710088 - RNA, 17 nt, Human
ugcuugaaaaaugugca

SEQ ID NO: 3710089 - RNA, 22 nt, Human
ugcuugaaaaaugugcaaaaca

SEQ ID NO: 3710090 - RNA, 21 nt, Human
ugcuugaaagaaaauaugcau

SEQ ID NO: 3710091 - RNA, 12 nt, Human
ugcuugaacaca

SEQ ID NO: 3710092 - RNA, 13 nt, Human
ugcuugaacacag

SEQ ID NO: 3710093 - RNA, 17 nt, Human
ugcuugaacccaggaga

SEQ ID NO: 3710094 - RNA, 20 nt, Human
ugcuugaauaaacaccacug

SEQ ID NO: 3710095 - RNA, 13 nt, Human
ugcuugaggaaaa

SEQ ID NO: 3710096 - RNA, 16 nt, Human
ugcuugaggaaaacaa

SEQ ID NO: 3710097 - RNA, 14 nt, Human
ugcuugagucaggu

SEQ ID NO: 3710098 - RNA, 23 nt, Human
ugcuugagucagguuugaguaga

SEQ ID NO: 3710099 - RNA, 13 nt, Human
ugcuugauacagg

SEQ ID NO: 3710100 - RNA, 21 nt, Human
ugcuugauaggaauucaucuu

SEQ ID NO: 3710101 - RNA, 20 nt, Human
ugcuugaugggauucuggac

SEQ ID NO: 3710102 - RNA, 15 nt, Human
ugcuugaugguuuau

SEQ ID NO: 3710103 - RNA, 22 nt, Human
ugcuugccaaggcagaggccug

SEQ ID NO: 3710104 - RNA, 17 nt, Human
ugcuugccacagagcgg

SEQ ID NO: 3710105 - RNA, 16 nt, Human
ugcuugccaucccucc

SEQ ID NO: 3710106 - RNA, 21 nt, Human
ugcuugcccuaagcagaaagu

SEQ ID NO: 3710107 - RNA, 15 nt, Human
ugcuugccucucugu

SEQ ID NO: 3710108 - RNA, 15 nt, Human
ugcuugccugcaggg

SEQ ID NO: 3710109 - RNA, 17 nt, Human
ugcuugcggcaaaagga

SEQ ID NO: 3710110 - RNA, 21 nt, Human
ugcuugcggcaaaaggaaagc

SEQ ID NO: 3710111 - RNA, 19 nt, Human
ugcuugcugccuucuggau

SEQ ID NO: 3710112 - RNA, 19 nt, Human
ugcuuggaccucgugcuuu

SEQ ID NO: 3710113 - RNA, 21 nt, Human
ugcuuggaccucgugcuuuaa

SEQ ID NO: 3710114 - RNA, 16 nt, Human
ugcuuggaggaaggaa

SEQ ID NO: 3710115 - RNA, 16 nt, Human
ugcuuggcccaggagu

SEQ ID NO: 3710116 - RNA, 14 nt, Human
ugcuuggcccaggg

SEQ ID NO: 3710117 - RNA, 16 nt, Human
ugcuugggcuucaucc

SEQ ID NO: 3710118 - RNA, 16 nt, Human
ugcuuggguggagaag

SEQ ID NO: 3710119 - RNA, 21 nt, Human
ugcuuggguggagaagccauu

SEQ ID NO: 3710120 - RNA, 13 nt, Human
ugcuuggucuguu

SEQ ID NO: 3710121 - RNA, 20 nt, Human
ugcuuguaacaagaaaacau

SEQ ID NO: 3710122 - RNA, 21 nt, Human
ugcuuguaacaagaaaacaua

SEQ ID NO: 3710123 - RNA, 15 nt, Human
ugcuuguaacuaaaa

SEQ ID NO: 3710124 - RNA, 16 nt, Human
ugcuuguacacucauu

SEQ ID NO: 3710125 - RNA, 16 nt, Human
ugcuuguacauaaugc

SEQ ID NO: 3710126 - RNA, 15 nt, Human
ugcuuguauagguuu

SEQ ID NO: 3710127 - RNA, 17 nt, Human
ugcuugucccugcccag

SEQ ID NO: 3710128 - RNA, 15 nt, Human
ugcuugucuucuggu

SEQ ID NO: 3710129 - RNA, 12 nt, Human
ugcuuguuacau

SEQ ID NO: 3710130 - RNA, 19 nt, Human
ugcuuguugggauuccuga

SEQ ID NO: 3710131 - RNA, 14 nt, Human
ugcuuguuuacagc

SEQ ID NO: 3710132 - RNA, 13 nt, Human
ugcuuguuucuug

SEQ ID NO: 3710133 - RNA, 12 nt, Human
ugcuuguuuuau

SEQ ID NO: 3710134 - RNA, 13 nt, Human
ugcuuuaaaaacu

SEQ ID NO: 3710135 - RNA, 19 nt, Human
ugcuuuaaagggccugccu

SEQ ID NO: 3710136 - RNA, 20 nt, Human
ugcuuuaaagggccugccug

SEQ ID NO: 3710137 - RNA, 21 nt, Human
ugcuuuaaagggccugccugg

SEQ ID NO: 3710138 - RNA, 15 nt, Human
ugcuuuaaaguguaa

SEQ ID NO: 3710139 - RNA, 14 nt, Human
ugcuuuaauauaaa

SEQ ID NO: 3710140 - RNA, 21 nt, Human
ugcuuuaauauaaaugcaaau

SEQ ID NO: 3710141 - RNA, 22 nt, Human
ugcuuuaauauaaaugcaaaua

SEQ ID NO: 3710142 - RNA, 13 nt, Human
ugcuuuaauauca

SEQ ID NO: 3710143 - RNA, 22 nt, Human
ugcuuuaccaaacagcaaacca

SEQ ID NO: 3710144 - RNA, 18 nt, Human
ugcuuuaccuuuucaggg

SEQ ID NO: 3710145 - RNA, 11 nt, Human
ugcuuuacugg

SEQ ID NO: 3710146 - RNA, 14 nt, Human
ugcuuuagacuuga

SEQ ID NO: 3710147 - RNA, 18 nt, Human
ugcuuuagacuugaaaag

SEQ ID NO: 3710148 - RNA, 13 nt, Human
ugcuuuagcuuga

SEQ ID NO: 3710149 - RNA, 14 nt, Human
ugcuuuaugcugaa

SEQ ID NO: 3710150 - RNA, 15 nt, Human
ugcuuuaugcugaaa

SEQ ID NO: 3710151 - RNA, 17 nt, Human
ugcuuuaugcugaaaca

SEQ ID NO: 3710152 - RNA, 18 nt, Human
ugcuuuauuaauguuuuc

SEQ ID NO: 3710153 - RNA, 23 nt, Human
ugcuuuauuaauguuuucaaaag

SEQ ID NO: 3710154 - RNA, 15 nt, Human
ugcuuuauuccagaa

SEQ ID NO: 3710155 - RNA, 23 nt, Human
ugcuuucaagaucuaaaucauau

SEQ ID NO: 3710156 - RNA, 23 nt, Human
ugcuuucagaagugcccuuccug

SEQ ID NO: 3710157 - RNA, 16 nt, Human
ugcuuucagauacugg

SEQ ID NO: 3710158 - RNA, 20 nt, Human
ugcuuucagauacuggauug

SEQ ID NO: 3710159 - RNA, 20 nt, Human
ugcuuuccacaccuggcacu

SEQ ID NO: 3710160 - RNA, 13 nt, Human
ugcuuuccagcuc

SEQ ID NO: 3710161 - RNA, 14 nt, Human
ugcuuuccccugug

SEQ ID NO: 3710162 - RNA, 16 nt, Human
ugcuuucccugaacug

SEQ ID NO: 3710163 - RNA, 17 nt, Human
ugcuuuccguggcacug

SEQ ID NO: 3710164 - RNA, 20 nt, Human
ugcuuuccguggcacugcau

SEQ ID NO: 3710165 - RNA, 19 nt, Human
ugcuuucuaugcuguuugu

SEQ ID NO: 3710166 - RNA, 12 nt, Human
ugcuuucuauug

SEQ ID NO: 3710167 - RNA, 12 nt, Human
ugcuuucucccc

SEQ ID NO: 3710168 - RNA, 15 nt, Human
ugcuuucuccuuuaa

SEQ ID NO: 3710169 - RNA, 12 nt, Human
ugcuuucugaaa

SEQ ID NO: 3710170 - RNA, 20 nt, Human
ugcuuucugaacucgcuucu

SEQ ID NO: 3710171 - RNA, 21 nt, Human
ugcuuucugaagcuuuaccag

SEQ ID NO: 3710172 - RNA, 12 nt, Human
ugcuuucugcuc

SEQ ID NO: 3710173 - RNA, 14 nt, Human
ugcuuucuguucca

SEQ ID NO: 3710174 - RNA, 16 nt, Human
ugcuuucuguuccaaa

SEQ ID NO: 3710175 - RNA, 17 nt, Human
ugcuuucuguuccaaau

SEQ ID NO: 3710176 - RNA, 22 nt, Human
ugcuuucuuucguuuguuuguu

SEQ ID NO: 3710177 - RNA, 16 nt, Human
ugcuuugaaacagaaa

SEQ ID NO: 3710178 - RNA, 21 nt, Human
ugcuuugaaacagaaaaauau

SEQ ID NO: 3710179 - RNA, 20 nt, Human
ugcuuugaaacuagacuuga

SEQ ID NO: 3710180 - RNA, 23 nt, Human
ugcuuugaaagccccagaaauca

SEQ ID NO: 3710181 - RNA, 14 nt, Human
ugcuuugaagcagu

SEQ ID NO: 3710182 - RNA, 19 nt, Human
ugcuuugaagcaguugugu

SEQ ID NO: 3710183 - RNA, 18 nt, Human
ugcuuugacucaccuguu

SEQ ID NO: 3710184 - RNA, 20 nt, Human
ugcuuugacugagcagacug

SEQ ID NO: 3710185 - RNA, 22 nt, Human
ugcuuugacugagcagacuggu

SEQ ID NO: 3710186 - RNA, 22 nt, Human
ugcuuugaggcucaccagaauu

SEQ ID NO: 3710187 - RNA, 13 nt, Human
ugcuuugauauau

SEQ ID NO: 3710188 - RNA, 18 nt, Human
ugcuuugauuuacagcaa

SEQ ID NO: 3710189 - RNA, 13 nt, Human
ugcuuugcccagc

SEQ ID NO: 3710190 - RNA, 14 nt, Human
ugcuuugcccagca

SEQ ID NO: 3710191 - RNA, 22 nt, Human
ugcuuugcgugcccggggcagc

SEQ ID NO: 3710192 - RNA, 23 nt, Human
ugcuuuggaccuaaauggccuca

SEQ ID NO: 3710193 - RNA, 16 nt, Human
ugcuuugggcugcccu

SEQ ID NO: 3710194 - RNA, 17 nt, Human
ugcuuugggcugcccug

SEQ ID NO: 3710195 - RNA, 19 nt, Human
ugcuuugggcugcccuggu

SEQ ID NO: 3710196 - RNA, 20 nt, Human
ugcuuugggcugcccuggug

SEQ ID NO: 3710197 - RNA, 17 nt, Human
ugcuuugggcuugggcc

SEQ ID NO: 3710198 - RNA, 21 nt, Human
ugcuuugucuggaagaaagau

SEQ ID NO: 3710199 - RNA, 18 nt, Human
ugcuuuguugugugccuc

SEQ ID NO: 3710200 - RNA, 23 nt, Human
ugcuuuguugugugccucuagcu

SEQ ID NO: 3710201 - RNA, 17 nt, Human
ugcuuuuaaaauuuuaa

SEQ ID NO: 3710202 - RNA, 16 nt, Human
ugcuuuuaacucuaga

SEQ ID NO: 3710203 - RNA, 17 nt, Human
ugcuuuuaacucuagaa

SEQ ID NO: 3710204 - RNA, 13 nt, Human
ugcuuuuaauuaa

SEQ ID NO: 3710205 - RNA, 13 nt, Human
ugcuuuuagaaaa

SEQ ID NO: 3710206 - RNA, 24 nt, Human
ugcuuuuaguauuuuagugaacuu

SEQ ID NO: 3710207 - RNA, 15 nt, Human
ugcuuuuauaucugu

SEQ ID NO: 3710208 - RNA, 15 nt, Human
ugcuuuuauuuugaa

SEQ ID NO: 3710209 - RNA, 16 nt, Human
ugcuuuucacugcugc

SEQ ID NO: 3710210 - RNA, 13 nt, Human
ugcuuuucugucu

SEQ ID NO: 3710211 - RNA, 20 nt, Human
ugcuuuugaaggaauacaau

SEQ ID NO: 3710212 - RNA, 14 nt, Human
ugcuuuugcccauu

SEQ ID NO: 3710213 - RNA, 18 nt, Human
ugcuuuugcccauuuuga

SEQ ID NO: 3710214 - RNA, 19 nt, Human
ugcuuuuggcaaaacucua

SEQ ID NO: 3710215 - RNA, 13 nt, Human
ugcuuuuggccug

SEQ ID NO: 3710216 - RNA, 17 nt, Human
ugcuuuuggcggggagg

SEQ ID NO: 3710217 - RNA, 21 nt, Human
ugcuuuuggggggcauauauu

SEQ ID NO: 3710218 - RNA, 14 nt, Human
ugcuuuuggucugu

SEQ ID NO: 3710219 - RNA, 20 nt, Human
ugcuuuugucuaugggacuc

SEQ ID NO: 3710220 - RNA, 15 nt, Human
ugcuuuuuauuucug

SEQ ID NO: 3710221 - RNA, 12 nt, Human
ugcuuuuucuga

SEQ ID NO: 3710222 - RNA, 17 nt, Human
ugcuuuuugaaaugaaa

SEQ ID NO: 3710223 - RNA, 13 nt, Human
ugcuuuuuggaaa

SEQ ID NO: 3710224 - RNA, 14 nt, Human
ugcuuuuuuaaaua

SEQ ID NO: 3710225 - RNA, 23 nt, Human
ugcuuuuuuauggcgauucccau

SEQ ID NO: 3710226 - RNA, 19 nt, Human
ugcuuuuuuccaaaacaaa

SEQ ID NO: 3710227 - RNA, 13 nt, Human
ugcuuuuuuguau

SEQ ID NO: 3710228 - RNA, 17 nt, Human
ugcuuuuuuugugugua

SEQ ID NO: 3710229 - RNA, 14 nt, Human
ugcuuuuuuuuccu

SEQ ID NO: 3710230 - RNA, 17 nt, Human
ugcuuuuuuuuccuucu

SEQ ID NO: 3710231 - RNA, 20 nt, Human
uggaaaaaaaaaaaagagga

SEQ ID NO: 3710232 - RNA, 21 nt, Human
uggaaaaaaaaaaaagaggaa

SEQ ID NO: 3710233 - RNA, 12 nt, Human
uggaaaaaguga

SEQ ID NO: 3710234 - RNA, 16 nt, Human
uggaaaaauaaacacu

SEQ ID NO: 3710235 - RNA, 17 nt, Human
uggaaaaauagccugcc

SEQ ID NO: 3710236 - RNA, 12 nt, Human
uggaaaaauauu

SEQ ID NO: 3710237 - RNA, 23 nt, Human
uggaaaaaucacaauuuuuaaug

SEQ ID NO: 3710238 - RNA, 18 nt, Human
uggaaaaauccagaaaga

SEQ ID NO: 3710239 - RNA, 15 nt, Human
uggaaaaauguuugu

SEQ ID NO: 3710240 - RNA, 17 nt, Human
uggaaaacaaggaaguc

SEQ ID NO: 3710241 - RNA, 17 nt, Human
uggaaaacagaacacuu

SEQ ID NO: 3710242 - RNA, 14 nt, Human
uggaaaagaauaca

SEQ ID NO: 3710243 - RNA, 19 nt, Human
uggaaaagaauacagaaag

SEQ ID NO: 3710244 - RNA, 12 nt, Human
uggaaaagacag

SEQ ID NO: 3710245 - RNA, 16 nt, Human
uggaaaagccaagagg

SEQ ID NO: 3710246 - RNA, 19 nt, Human
uggaaaagccaagaggcug

SEQ ID NO: 3710247 - RNA, 22 nt, Human
uggaaaaggaagacuagaggcu

SEQ ID NO: 3710248 - RNA, 14 nt, Human
uggaaaaggcauau

SEQ ID NO: 3710249 - RNA, 16 nt, Human
uggaaaaguguccuuc

SEQ ID NO: 3710250 - RNA, 15 nt, Human
uggaaaauaaaucaa

SEQ ID NO: 3710251 - RNA, 18 nt, Human
uggaaaaugccaugaauu

SEQ ID NO: 3710252 - RNA, 21 nt, Human
uggaaacaaaguggaaggaaa

SEQ ID NO: 3710253 - RNA, 19 nt, Human
uggaaacacuaaauguuaa

SEQ ID NO: 3710254 - RNA, 20 nt, Human
uggaaacacuaaauguuaaa

SEQ ID NO: 3710255 - RNA, 18 nt, Human
ugcagcauguugcugagg

SEQ ID NO: 3710256 - RNA, 20 nt, Human
ugcagcauguugcugaggag

SEQ ID NO: 3710257 - RNA, 14 nt, Human
ugcagcauuucacu

SEQ ID NO: 3710258 - RNA, 15 nt, Human
ugcagcauuucacuu

SEQ ID NO: 3710259 - RNA, 18 nt, Human
ugcagcauuugauaauga

SEQ ID NO: 3710260 - RNA, 16 nt, Human
ugcagccacuuaggac

SEQ ID NO: 3710261 - RNA, 13 nt, Human
ugcagccagaccu

SEQ ID NO: 3710262 - RNA, 14 nt, Human
ugcagccagaccua

SEQ ID NO: 3710263 - RNA, 11 nt, Human
ugcagccagag

SEQ ID NO: 3710264 - RNA, 13 nt, Human
ugcagccagaggc

SEQ ID NO: 3710265 - RNA, 14 nt, Human
ugcagccagaggca

SEQ ID NO: 3710266 - RNA, 13 nt, Human
ugcagccagccca

SEQ ID NO: 3710267 - RNA, 16 nt, Human
ugcagccagcccagcc

SEQ ID NO: 3710268 - RNA, 22 nt, Human
ugcagccagcccagcccagcug

SEQ ID NO: 3710269 - RNA, 14 nt, Human
ugcagcccaugccc

SEQ ID NO: 3710270 - RNA, 19 nt, Human
ugcagcccaugcccaccug

SEQ ID NO: 3710271 - RNA, 21 nt, Human
ugcagcccaugcccaccugcc

SEQ ID NO: 3710272 - RNA, 23 nt, Human
ugcagcccccacugccuuugacc

SEQ ID NO: 3710273 - RNA, 20 nt, Human
ugcagccccgccuccaggcc

SEQ ID NO: 3710274 - RNA, 20 nt, Human
ugcagcccggcgccaccauc

SEQ ID NO: 3710275 - RNA, 21 nt, Human
ugcagcccguguggccccuuc

SEQ ID NO: 3710276 - RNA, 16 nt, Human
ugcagcccugagaaag

SEQ ID NO: 3710277 - RNA, 22 nt, Human
ugcagcccugagaaagcccugu

SEQ ID NO: 3710278 - RNA, 14 nt, Human
ugcagccgcugagc

SEQ ID NO: 3710279 - RNA, 18 nt, Human
ugcagccggcacaggguc

SEQ ID NO: 3710280 - RNA, 14 nt, Human
uggagaugcagagg

SEQ ID NO: 3710281 - RNA, 16 nt, Human
uggagaugggaugcuu

SEQ ID NO: 3710282 - RNA, 18 nt, Human
uggagaugggaugcuugc

SEQ ID NO: 3710283 - RNA, 17 nt, Human
uggagauggggagaaac

SEQ ID NO: 3710284 - RNA, 19 nt, Human
uggagauuauaauaaauau

SEQ ID NO: 3710285 - RNA, 15 nt, Human
uggagauugaccugg

SEQ ID NO: 3710286 - RNA, 17 nt, Human
uggagcaaagugguagg

SEQ ID NO: 3710287 - RNA, 18 nt, Human
uggagcacaaaagccucu

SEQ ID NO: 3710288 - RNA, 19 nt, Human
uggagcacaaagacccugg

SEQ ID NO: 3710289 - RNA, 17 nt, Human
uggagcaccaggcacga

SEQ ID NO: 3710290 - RNA, 17 nt, Human
uggagcacugggcuccc

SEQ ID NO: 3710291 - RNA, 21 nt, Human
uggagcacugggcucccgggc

SEQ ID NO: 3710292 - RNA, 17 nt, Human
uggagcagaccaccccg

SEQ ID NO: 3710293 - RNA, 12 nt, Human
uggagcagagca

SEQ ID NO: 3710294 - RNA, 17 nt, Human
gucuuguuagaaaacaa

SEQ ID NO: 3710295 - RNA, 16 nt, Human
gucuuuaaauagauac

SEQ ID NO: 3710296 - RNA, 14 nt, Human
gucuuuaacuguca

SEQ ID NO: 3710297 - RNA, 21 nt, Human
gucuuuagauagcccuguccu

SEQ ID NO: 3710298 - RNA, 13 nt, Human
gucuuuagcuauu

SEQ ID NO: 3710299 - RNA, 17 nt, Human
gucuuuaggcagcagcu

SEQ ID NO: 3710300 - RNA, 18 nt, Human
gucuuuaggucuuuguaa

SEQ ID NO: 3710301 - RNA, 22 nt, Human
gucuuuaggucuuuguaagaac

SEQ ID NO: 3710302 - RNA, 15 nt, Human
gucuuucaagaauga

SEQ ID NO: 3710303 - RNA, 15 nt, Human
gucuuucacagcucc

SEQ ID NO: 3710304 - RNA, 19 nt, Human
gucuuucacaguaccaucu

SEQ ID NO: 3710305 - RNA, 23 nt, Human
gucuuucagcaagauaaacauua

SEQ ID NO: 3710306 - RNA, 22 nt, Human
gucuuucaguacuuuuuuaaau

SEQ ID NO: 3710307 - RNA, 16 nt, Human
gucuuucauggcugcu

SEQ ID NO: 3710308 - RNA, 18 nt, Human
gucuuuccacggagccac

SEQ ID NO: 3710309 - RNA, 10 nt, Human
gucuuuccca

SEQ ID NO: 3710310 - RNA, 20 nt, Human
gucuuucccauggggaggga

SEQ ID NO: 3710311 - RNA, 19 nt, Human
gucuuucuaagaaaucaag

SEQ ID NO: 3710312 - RNA, 14 nt, Human
gucuuucucucuca

SEQ ID NO: 3710313 - RNA, 14 nt, Human
gucuuucucuuucc

SEQ ID NO: 3710314 - RNA, 16 nt, Human
gucuuucucuuucccu

SEQ ID NO: 3710315 - RNA, 15 nt, Human
gucuuucuucuucaa

SEQ ID NO: 3710316 - RNA, 15 nt, Human
gucuuucuuuggugc

SEQ ID NO: 3710317 - RNA, 16 nt, Human
gucuuugagcucccac

SEQ ID NO: 3710318 - RNA, 20 nt, Human
gucuuuggaaaaauguuugu

SEQ ID NO: 3710319 - RNA, 15 nt, Human
gucuuuggacccuga

SEQ ID NO: 3710320 - RNA, 18 nt, Human
gucuuuggagaaaugcuu

SEQ ID NO: 3710321 - RNA, 17 nt, Human
gucuuugguucuaagga

SEQ ID NO: 3710322 - RNA, 13 nt, Human
gucuuuguaagag

SEQ ID NO: 3710323 - RNA, 14 nt, Human
gucuuuguaagagu

SEQ ID NO: 3710324 - RNA, 22 nt, Human
gucuuuguaagaguguagaagc

SEQ ID NO: 3710325 - RNA, 16 nt, Human
gucuuuguaaugucac

SEQ ID NO: 3710326 - RNA, 20 nt, Human
gucuuuguaaugucaccacc

SEQ ID NO: 3710327 - RNA, 22 nt, Human
gucuuuguaaugucaccaccuu

SEQ ID NO: 3710328 - RNA, 17 nt, Human
gucuuuguaucuuccau

SEQ ID NO: 3710329 - RNA, 15 nt, Human
gucuuuuaaaaagua

SEQ ID NO: 3710330 - RNA, 17 nt, Human
gucuuuuaaaaaguauu

SEQ ID NO: 3710331 - RNA, 23 nt, Human
gucuuuuauaguggaaaaacaca

SEQ ID NO: 3710332 - RNA, 14 nt, Human
gucuuuucuugcau

SEQ ID NO: 3710333 - RNA, 24 nt, Human
gucuuuucuugcaugaggcuagug

SEQ ID NO: 3710334 - RNA, 14 nt, Human
gucuuuugaauauu

SEQ ID NO: 3710335 - RNA, 19 nt, Human
gucuuuugaauauucccaa

SEQ ID NO: 3710336 - RNA, 16 nt, Human
gucuuuugacaugugg

SEQ ID NO: 3710337 - RNA, 13 nt, Human
gucuuuugcauga

SEQ ID NO: 3710338 - RNA, 12 nt, Human
gucuuuugcuuu

SEQ ID NO: 3710339 - RNA, 16 nt, Human
gucuuuugcuuuuggc

SEQ ID NO: 3710340 - RNA, 15 nt, Human
gucuuuuuaaaaaua

SEQ ID NO: 3710341 - RNA, 20 nt, Human
gucuuuuuaagcuuauuuaa

SEQ ID NO: 3710342 - RNA, 16 nt, Human
gucuuuuuaugcauuu

SEQ ID NO: 3710343 - RNA, 22 nt, Human
gucuuuuucuguuguaacuuau

SEQ ID NO: 3710344 - RNA, 14 nt, Human
gucuuuuuguaagu

SEQ ID NO: 3710345 - RNA, 13 nt, Human
gucuuuuuuugua

SEQ ID NO: 3710346 - RNA, 22 nt, Human
gucuuuuuuuguauaguuaaca

SEQ ID NO: 3710347 - RNA, 17 nt, Human
gucuuuuuuuuaaugug

SEQ ID NO: 3710348 - RNA, 21 nt, Human
gucuuuuuuuuuuaagugaaa

SEQ ID NO: 3710349 - RNA, 18 nt, Human
gugaaaaaaaaaaugcug

SEQ ID NO: 3710350 - RNA, 20 nt, Human
gugaaaaaagcuuuuaugag

SEQ ID NO: 3710351 - RNA, 19 nt, Human
gugaaaacacauuugcuuu

SEQ ID NO: 3710352 - RNA, 15 nt, Human
gugaaaacggagcug

SEQ ID NO: 3710353 - RNA, 14 nt, Human
gugaaaagaaaaau

SEQ ID NO: 3710354 - RNA, 14 nt, Human
gugaaaagcuccau

SEQ ID NO: 3710355 - RNA, 12 nt, Human
gugaaaaucuug

SEQ ID NO: 3710356 - RNA, 14 nt, Human
gugaaaauguacug

SEQ ID NO: 3710357 - RNA, 18 nt, Human
gugaaacacaccaggcug

SEQ ID NO: 3710358 - RNA, 20 nt, Human
gugaaacacaccaggcugug

SEQ ID NO: 3710359 - RNA, 13 nt, Human
gugaaacacagcu

SEQ ID NO: 3710360 - RNA, 17 nt, Human
gugaaaccuuuuuuaag

SEQ ID NO: 3710361 - RNA, 19 nt, Human
gugaaaccuuuuuuaagau

SEQ ID NO: 3710362 - RNA, 19 nt, Human
gugaaacuaacagauaagc

SEQ ID NO: 3710363 - RNA, 20 nt, Human
gugaaacugcuuguuuccua

SEQ ID NO: 3710364 - RNA, 22 nt, Human
gugaaacuuuucuagaauuauu

SEQ ID NO: 3710365 - RNA, 19 nt, Human
gugaaagaaaauaacaaua

SEQ ID NO: 3710366 - RNA, 20 nt, Human
gugaaagcaucacuugggau

SEQ ID NO: 3710367 - RNA, 20 nt, Human
gugaaagcugagaacuccug

SEQ ID NO: 3710368 - RNA, 19 nt, Human
gugaaaggaaagagggagg

SEQ ID NO: 3710369 - RNA, 15 nt, Human
gugaaagugaggaaa

SEQ ID NO: 3710370 - RNA, 21 nt, Human
gugaaauaguucaaagccaag

SEQ ID NO: 3710371 - RNA, 17 nt, Human
gugaaaucaaaggugcu

SEQ ID NO: 3710372 - RNA, 14 nt, Human
gugaaauuauuuug

SEQ ID NO: 3710373 - RNA, 21 nt, Human
gugaaauuuauuaguuaauau

SEQ ID NO: 3710374 - RNA, 18 nt, Human
gugaaauuucuagccugc

SEQ ID NO: 3710375 - RNA, 22 nt, Human
gugaaauuucuagccugcacuu

SEQ ID NO: 3710376 - RNA, 22 nt, Human
gugaaauuuucuugauuugagu

SEQ ID NO: 3710377 - RNA, 21 nt, Human
gugaacaaauuuacagagaca

SEQ ID NO: 3710378 - RNA, 19 nt, Human
gugaacaagugaacacauu

SEQ ID NO: 3710379 - RNA, 19 nt, Human
gugaacaggcugggcugcu

SEQ ID NO: 3710380 - RNA, 24 nt, Human
gugaacauuuaucaaucaguauaa

SEQ ID NO: 3710381 - RNA, 18 nt, Human
gugaaccacuucauucug

SEQ ID NO: 3710382 - RNA, 17 nt, Human
gugaacccaggacaagc

SEQ ID NO: 3710383 - RNA, 21 nt, Human
gugaacccuggggccugacug

SEQ ID NO: 3710384 - RNA, 16 nt, Human
gugaaccuaccuucau

SEQ ID NO: 3710385 - RNA, 14 nt, Human
gugaaccuguauaa

SEQ ID NO: 3710386 - RNA, 15 nt, Human
gugaacguggacucc

SEQ ID NO: 3710387 - RNA, 17 nt, Human
gugaacuagggaagcuc

SEQ ID NO: 3710388 - RNA, 16 nt, Human
gugaacucagccaagc

SEQ ID NO: 3710389 - RNA, 23 nt, Human
gugaacuggacccuguugcuaag

SEQ ID NO: 3710390 - RNA, 19 nt, Human
gugaacuugggccacugug

SEQ ID NO: 3710391 - RNA, 23 nt, Human
gugaagaaaagugaaugcucaag

SEQ ID NO: 3710392 - RNA, 23 nt, Human
gugaagaauccuuuuguagaaug

SEQ ID NO: 3710393 - RNA, 14 nt, Human
gugaagacagaagu

SEQ ID NO: 3710394 - RNA, 16 nt, Human
gugaagacuccagaaa

SEQ ID NO: 3710395 - RNA, 12 nt, Human
gugaagaggggc

SEQ ID NO: 3710396 - RNA, 16 nt, Human
gugaagaggggcagcc

SEQ ID NO: 3710397 - RNA, 17 nt, Human
gugaagaggggcagccc

SEQ ID NO: 3710398 - RNA, 19 nt, Human
gugaagaggggcagcccuu

SEQ ID NO: 3710399 - RNA, 19 nt, Human
gugaagaucucacucugcc

SEQ ID NO: 3710400 - RNA, 17 nt, Human
gugaagcaccaagcuca

SEQ ID NO: 3710401 - RNA, 15 nt, Human
gugaagcauccaggc

SEQ ID NO: 3710402 - RNA, 17 nt, Human
gugaagcauccaggcac

SEQ ID NO: 3710403 - RNA, 22 nt, Human
gugaagccaauucagacaggca

SEQ ID NO: 3710404 - RNA, 11 nt, Human
gugaagccuuc

SEQ ID NO: 3710405 - RNA, 17 nt, Human
gugaaggaggcuccagg

SEQ ID NO: 3710406 - RNA, 20 nt, Human
gugaaggccgagaagcaaga

SEQ ID NO: 3710407 - RNA, 22 nt, Human
gugaaggcuucucucuguggga

SEQ ID NO: 3710408 - RNA, 18 nt, Human
gugaagggaagagacagc

SEQ ID NO: 3710409 - RNA, 17 nt, Human
gugaagguccugcuauu

SEQ ID NO: 3710410 - RNA, 16 nt, Human
gugaaggugacagcag

SEQ ID NO: 3710411 - RNA, 19 nt, Human
gugaaguauacuguauuuu

SEQ ID NO: 3710412 - RNA, 14 nt, Human
gugaaguuagaauu

SEQ ID NO: 3710413 - RNA, 20 nt, Human
gugaaguuagguucuuaaaa

SEQ ID NO: 3710414 - RNA, 16 nt, Human
gugaauaaaugucuug

SEQ ID NO: 3710415 - RNA, 14 nt, Human
gugaauaaugauuu

SEQ ID NO: 3710416 - RNA, 14 nt, Human
gugaauaauuacag

SEQ ID NO: 3710417 - RNA, 15 nt, Human
gugaauaccugcuca

SEQ ID NO: 3710418 - RNA, 19 nt, Human
gugaauagccauauuugua

SEQ ID NO: 3710419 - RNA, 22 nt, Human
gugaauaugccuguaauucagu

SEQ ID NO: 3710420 - RNA, 15 nt, Human
gugaaucaaggguca

SEQ ID NO: 3710421 - RNA, 17 nt, Human
gugaaucaagggucagg

SEQ ID NO: 3710422 - RNA, 21 nt, Human
gugaaucaagggucaggccuu

SEQ ID NO: 3710423 - RNA, 16 nt, Human
gugaaucacguaaagc

SEQ ID NO: 3710424 - RNA, 14 nt, Human
gugaaucagagcac

SEQ ID NO: 3710425 - RNA, 19 nt, Human
gugaaugaaagauuaaaca

SEQ ID NO: 3710426 - RNA, 22 nt, Human
gugaaugaaagucuugugacua

SEQ ID NO: 3710427 - RNA, 23 nt, Human
gugaaugauucauguuauauuua

SEQ ID NO: 3710428 - RNA, 13 nt, Human
gugaaugcuggga

SEQ ID NO: 3710429 - RNA, 15 nt, Human
gugaaugcugggacu

SEQ ID NO: 3710430 - RNA, 14 nt, Human
gugaaugcuucuca

SEQ ID NO: 3710431 - RNA, 15 nt, Human
gugaauggauuggau

SEQ ID NO: 3710432 - RNA, 13 nt, Human
gugaauggcuuug

SEQ ID NO: 3710433 - RNA, 23 nt, Human
gugaauguaggcuggcuuucaga

SEQ ID NO: 3710434 - RNA, 21 nt, Human
gugaauuaggcuguaacuacu

SEQ ID NO: 3710435 - RNA, 22 nt, Human
gugaauuaggcuguaacuacuu

SEQ ID NO: 3710436 - RNA, 14 nt, Human
gugaauuauugaca

SEQ ID NO: 3710437 - RNA, 16 nt, Human
gugaauuauugacacu

SEQ ID NO: 3710438 - RNA, 18 nt, Human
gugaauuauugacacuga

SEQ ID NO: 3710439 - RNA, 13 nt, Human
gugaauucccuca

SEQ ID NO: 3710440 - RNA, 22 nt, Human
gugaauucuugaaggaaaauga

SEQ ID NO: 3710441 - RNA, 13 nt, Human
gugaauugacuac

SEQ ID NO: 3710442 - RNA, 13 nt, Human
gugaauugauaau

SEQ ID NO: 3710443 - RNA, 22 nt, Human
gugaauugccugcagagagaag

SEQ ID NO: 3710444 - RNA, 21 nt, Human
ugccaauuauuguuacacauu

SEQ ID NO: 3710445 - RNA, 15 nt, Human
ugccaauuugcacau

SEQ ID NO: 3710446 - RNA, 18 nt, Human
ugccacaaugcaguucug

SEQ ID NO: 3710447 - RNA, 13 nt, Human
ugccacacagagu

SEQ ID NO: 3710448 - RNA, 23 nt, Human
ugccacacagaguggucuuucug

SEQ ID NO: 3710449 - RNA, 19 nt, Human
ugccacaccaagcugugcc

SEQ ID NO: 3710450 - RNA, 20 nt, Human
ugccacaccaagcugugcca

SEQ ID NO: 3710451 - RNA, 23 nt, Human
ugccacaccccccaccccuagga

SEQ ID NO: 3710452 - RNA, 14 nt, Human
ugccacacccuccc

SEQ ID NO: 3710453 - RNA, 18 nt, Human
ugccacacucuccaucac

SEQ ID NO: 3710454 - RNA, 23 nt, Human
ugccacacuucaggcucuucucc

SEQ ID NO: 3710455 - RNA, 15 nt, Human
ugccacagagcgggg

SEQ ID NO: 3710456 - RNA, 17 nt, Human
ugccacagcccugucag

SEQ ID NO: 3710457 - RNA, 22 nt, Human
ugccacagcccugucagcauga

SEQ ID NO: 3710458 - RNA, 13 nt, Human
ugccacagccucc

SEQ ID NO: 3710459 - RNA, 22 nt, Human
ugccacagcuggagcucucaaa

SEQ ID NO: 3710460 - RNA, 17 nt, Human
ugccacagcuuuugcaa

SEQ ID NO: 3710461 - RNA, 12 nt, Human
ugccacaggaca

SEQ ID NO: 3710462 - RNA, 13 nt, Human
ugccacaggccuc

SEQ ID NO: 3710463 - RNA, 17 nt, Human
ugccacaggcuuaggga

SEQ ID NO: 3710464 - RNA, 21 nt, Human
ugccacaggcuuagggacagg

SEQ ID NO: 3710465 - RNA, 22 nt, Human
ugccacaucaaaccuuugagua

SEQ ID NO: 3710466 - RNA, 18 nt, Human
ugccaccaaaggccaggg

SEQ ID NO: 3710467 - RNA, 18 nt, Human
ugccaccaacuggcccuc

SEQ ID NO: 3710468 - RNA, 19 nt, Human
ugccaccagagaccguccu

SEQ ID NO: 3710469 - RNA, 12 nt, Human
ugccaccaggag

SEQ ID NO: 3710470 - RNA, 13 nt, Human
ugccaccaggcca

SEQ ID NO: 3710471 - RNA, 16 nt, Human
ugccaccagucacugu

SEQ ID NO: 3710472 - RNA, 13 nt, Human
ugccacccaccuc

SEQ ID NO: 3710473 - RNA, 17 nt, Human
ugccacccaccucccug

SEQ ID NO: 3710474 - RNA, 16 nt, Human
ugccaccccacccucc

SEQ ID NO: 3710475 - RNA, 17 nt, Human
ugccaccccacccuccc

SEQ ID NO: 3710476 - RNA, 20 nt, Human
ugccaccccacccucccugg

SEQ ID NO: 3710477 - RNA, 13 nt, Human
ugccaccccuaaa

SEQ ID NO: 3710478 - RNA, 21 nt, Human
ugccaccccuaaacuccaggg

SEQ ID NO: 3710479 - RNA, 12 nt, Human
ugccacccuacc

SEQ ID NO: 3710480 - RNA, 13 nt, Human
ugccacccugggc

SEQ ID NO: 3710481 - RNA, 15 nt, Human
ugccacccugggcuc

SEQ ID NO: 3710482 - RNA, 20 nt, Human
ugccacccugggcucugugg

SEQ ID NO: 3710483 - RNA, 21 nt, Human
ugccacccugggcucuguggg

SEQ ID NO: 3710484 - RNA, 18 nt, Human
ugccaccuccccuaucca

SEQ ID NO: 3710485 - RNA, 17 nt, Human
ugccaccuccccuugcc

SEQ ID NO: 3710486 - RNA, 14 nt, Human
ugccaccucccuga

SEQ ID NO: 3710487 - RNA, 19 nt, Human
ugccaccuggaccccugca

SEQ ID NO: 3710488 - RNA, 19 nt, Human
ugccaccuggggcagucac

SEQ ID NO: 3710489 - RNA, 10 nt, Human
ugccaccugu

SEQ ID NO: 3710490 - RNA, 11 nt, Human
ugccaccuguc

SEQ ID NO: 3710491 - RNA, 14 nt, Human
ugccaccugucugu

SEQ ID NO: 3710492 - RNA, 16 nt, Human
ugccacgaauuucugu

SEQ ID NO: 3710493 - RNA, 14 nt, Human
ugccacguuccaca

SEQ ID NO: 3710494 - RNA, 19 nt, Human
ugccacguuccacaguugc

SEQ ID NO: 3710495 - RNA, 22 nt, Human
ugccacguuggagaagcccgug

SEQ ID NO: 3710496 - RNA, 20 nt, Human
ugccacuaaauugacacuua

SEQ ID NO: 3710497 - RNA, 19 nt, Human
ugccacuaaccuuccaaaa

SEQ ID NO: 3710498 - RNA, 20 nt, Human
ugccacuaccccuugauuuu

SEQ ID NO: 3710499 - RNA, 16 nt, Human
ugccacuaggcugggu

SEQ ID NO: 3710500 - RNA, 18 nt, Human
ugccacucacuaggcccc

SEQ ID NO: 3710501 - RNA, 22 nt, Human
ugccacugaggggggauccagu

SEQ ID NO: 3710502 - RNA, 17 nt, Human
ugccacugcccgagcug

SEQ ID NO: 3710503 - RNA, 13 nt, Human
ugccacugccucu

SEQ ID NO: 3710504 - RNA, 19 nt, Human
ugccacugccucuuccucc

SEQ ID NO: 3710505 - RNA, 19 nt, Human
ugccacugccuucgcuucu

SEQ ID NO: 3710506 - RNA, 13 nt, Human
ugccacuggagug

SEQ ID NO: 3710507 - RNA, 20 nt, Human
ugccacuggcaaauguaacu

SEQ ID NO: 3710508 - RNA, 16 nt, Human
ugccacuucccaggua

SEQ ID NO: 3710509 - RNA, 23 nt, Human
ugccacuucuaagaaaagccuaa

SEQ ID NO: 3710510 - RNA, 19 nt, Human
ugccacuugaacaaaaucu

SEQ ID NO: 3710511 - RNA, 12 nt, Human
ugccacuuugca

SEQ ID NO: 3710512 - RNA, 13 nt, Human
ugccacuuugcac

SEQ ID NO: 3710513 - RNA, 19 nt, Human
ugccacuuugcacauuuug

SEQ ID NO: 3710514 - RNA, 19 nt, Human
ugccagaacaguuuguaca

SEQ ID NO: 3710515 - RNA, 17 nt, Human
ugccagaauuuuaggaa

SEQ ID NO: 3710516 - RNA, 13 nt, Human
ugccagacaugug

SEQ ID NO: 3710517 - RNA, 13 nt, Human
ugccagagaaccc

SEQ ID NO: 3710518 - RNA, 21 nt, Human
ugccagagacggaagccuuuu

SEQ ID NO: 3710519 - RNA, 15 nt, Human
ugccagagauggagg

SEQ ID NO: 3710520 - RNA, 21 nt, Human
ugccagagauggagguucucu

SEQ ID NO: 3710521 - RNA, 12 nt, Human
ugccagagccgg

SEQ ID NO: 3710522 - RNA, 11 nt, Human
ugccagagccu

SEQ ID NO: 3710523 - RNA, 13 nt, Human
ugccagagccugg

SEQ ID NO: 3710524 - RNA, 19 nt, Human
ugccagagccuggggcucu

SEQ ID NO: 3710525 - RNA, 20 nt, Human
ugccagaggugggcaggugg

SEQ ID NO: 3710526 - RNA, 21 nt, Human
ugccagaugccuuuauggcug

SEQ ID NO: 3710527 - RNA, 17 nt, Human
ugccagaugcugauguu

SEQ ID NO: 3710528 - RNA, 21 nt, Human
ugccagauguccuaaugguga

SEQ ID NO: 3710529 - RNA, 13 nt, Human
ugccagcaaagcc

SEQ ID NO: 3710530 - RNA, 24 nt, Human
ugccagcaaagccccaugcuggag

SEQ ID NO: 3710531 - RNA, 13 nt, Human
ugccagcaacuga

SEQ ID NO: 3710532 - RNA, 17 nt, Human
ugccagcaacugaauaa

SEQ ID NO: 3710533 - RNA, 18 nt, Human
ugccagcaacugaauaaa

SEQ ID NO: 3710534 - RNA, 22 nt, Human
ugccagcaaugacaucucaggg

SEQ ID NO: 3710535 - RNA, 16 nt, Human
ugccagcacccccacg

SEQ ID NO: 3710536 - RNA, 16 nt, Human
ugccagcagcagcagg

SEQ ID NO: 3710537 - RNA, 16 nt, Human
ugccagccagcagcca

SEQ ID NO: 3710538 - RNA, 23 nt, Human
ugccagccagcagccagcucuca

SEQ ID NO: 3710539 - RNA, 15 nt, Human
ugccagcccagaggc

SEQ ID NO: 3710540 - RNA, 15 nt, Human
ugccagcccauuugg

SEQ ID NO: 3710541 - RNA, 17 nt, Human
ugccagccccacacagc

SEQ ID NO: 3710542 - RNA, 23 nt, Human
ugccagcccccuaaaagcacucc

SEQ ID NO: 3710543 - RNA, 19 nt, Human
ugccagccccugccauugu

SEQ ID NO: 3710544 - RNA, 22 nt, Human
ugccagccugaggcagccacuu

SEQ ID NO: 3710545 - RNA, 14 nt, Human
ugccagccuuccuc

SEQ ID NO: 3710546 - RNA, 19 nt, Human
ugccagccuugagcccugg

SEQ ID NO: 3710547 - RNA, 23 nt, Human
ugccagccuugagcccuggcugu

SEQ ID NO: 3710548 - RNA, 23 nt, Human
ugccagcucuuccuagcuggaga

SEQ ID NO: 3710549 - RNA, 15 nt, Human
ugccagcugacaucu

SEQ ID NO: 3710550 - RNA, 16 nt, Human
ugccagcugcugagcc

SEQ ID NO: 3710551 - RNA, 15 nt, Human
ugccagcuggccuuu

SEQ ID NO: 3710552 - RNA, 14 nt, Human
ugccaggaaccugu

SEQ ID NO: 3710553 - RNA, 21 nt, Human
ugccaggacuccccaggccag

SEQ ID NO: 3710554 - RNA, 15 nt, Human
ugccaggagcacggc

SEQ ID NO: 3710555 - RNA, 20 nt, Human
ugccaggagcacggcucugu

SEQ ID NO: 3710556 - RNA, 21 nt, Human
ugccaggaggacccagggcuc

SEQ ID NO: 3710557 - RNA, 15 nt, Human
ugccaggcacaggca

SEQ ID NO: 3710558 - RNA, 21 nt, Human
ugccaggcacaggcagggcag

SEQ ID NO: 3710559 - RNA, 22 nt, Human
ugccaggcacaggcagggcagg

SEQ ID NO: 3710560 - RNA, 12 nt, Human
ugccaggcaggg

SEQ ID NO: 3710561 - RNA, 15 nt, Human
ugccaggcaggggug

SEQ ID NO: 3710562 - RNA, 18 nt, Human
ugccaggcaggggugggg

SEQ ID NO: 3710563 - RNA, 16 nt, Human
ugccaggccagccucc

SEQ ID NO: 3710564 - RNA, 11 nt, Human
ugccaggcccc

SEQ ID NO: 3710565 - RNA, 20 nt, Human
ugccaggcccccaccacaca

SEQ ID NO: 3710566 - RNA, 20 nt, Human
ugccaggcuagagugcagug

SEQ ID NO: 3710567 - RNA, 12 nt, Human
ugccaggcucuc

SEQ ID NO: 3710568 - RNA, 19 nt, Human
ugccaggcuggagugcagu

SEQ ID NO: 3710569 - RNA, 22 nt, Human
ugccagggacagaggggguggc

SEQ ID NO: 3710570 - RNA, 18 nt, Human
ugccagggagacagagcu

SEQ ID NO: 3710571 - RNA, 12 nt, Human
ugccagggagcu

SEQ ID NO: 3710572 - RNA, 11 nt, Human
ugccagggcag

SEQ ID NO: 3710573 - RNA, 16 nt, Human
ugccagggcagggccc

SEQ ID NO: 3710574 - RNA, 19 nt, Human
ugccagggcagugcuagug

SEQ ID NO: 3710575 - RNA, 21 nt, Human
ugccagggccccucuccccag

SEQ ID NO: 3710576 - RNA, 16 nt, Human
ugccagggccgaccag

SEQ ID NO: 3710577 - RNA, 23 nt, Human
ugccaggguuucgagaagcugcu

SEQ ID NO: 3710578 - RNA, 20 nt, Human
ugccagguucuauuuggaau

SEQ ID NO: 3710579 - RNA, 22 nt, Human
ugccagguuuuuggucugaccc

SEQ ID NO: 3710580 - RNA, 22 nt, Human
ugccaguaacgcgucuuccuga

SEQ ID NO: 3710581 - RNA, 23 nt, Human
ugccaguaacgcgucuuccugag

SEQ ID NO: 3710582 - RNA, 22 nt, Human
ugccaguaccagccccacccug

SEQ ID NO: 3710583 - RNA, 17 nt, Human
ugccaguauuuuaaaau

SEQ ID NO: 3710584 - RNA, 21 nt, Human
ugccaguauuuuaaaauagcg

SEQ ID NO: 3710585 - RNA, 17 nt, Human
ugccagucaagaagaaa

SEQ ID NO: 3710586 - RNA, 23 nt, Human
ugccagucaccccggccaccugc

SEQ ID NO: 3710587 - RNA, 17 nt, Human
ugccagucccccugccc

SEQ ID NO: 3710588 - RNA, 20 nt, Human
ugccagucccccugccccag

SEQ ID NO: 3710589 - RNA, 14 nt, Human
ugccaguccugucc

SEQ ID NO: 3710590 - RNA, 23 nt, Human
ugccagucgcgcugccugugugg

SEQ ID NO: 3710591 - RNA, 23 nt, Human
ugccagucucacugugggaaggc

SEQ ID NO: 3710592 - RNA, 11 nt, Human
ugccagugccu

SEQ ID NO: 3710593 - RNA, 22 nt, Human
uggagcagagcaagucugcagg

SEQ ID NO: 3710594 - RNA, 13 nt, Human
uggagcagagggg

SEQ ID NO: 3710595 - RNA, 19 nt, Human
uggagcagggacagaucau

SEQ ID NO: 3710596 - RNA, 11 nt, Human
uggagcaucug

SEQ ID NO: 3710597 - RNA, 17 nt, Human
uggagccaacugcugcu

SEQ ID NO: 3710598 - RNA, 16 nt, Human
uggagccaaguccaga

SEQ ID NO: 3710599 - RNA, 17 nt, Human
uggagccaauggagacu

SEQ ID NO: 3710600 - RNA, 16 nt, Human
uggagccacucuguuc

SEQ ID NO: 3710601 - RNA, 12 nt, Human
uggagccaggcg

SEQ ID NO: 3710602 - RNA, 14 nt, Human
uggagccagggagc

SEQ ID NO: 3710603 - RNA, 23 nt, Human
uggagccagggagcggccgccug

SEQ ID NO: 3710604 - RNA, 19 nt, Human
uggagcccagaggagggca

SEQ ID NO: 3710605 - RNA, 13 nt, Human
uggagcccaggcg

SEQ ID NO: 3710606 - RNA, 16 nt, Human
uggagcccaggcggga

SEQ ID NO: 3710607 - RNA, 22 nt, Human
uggagcccaggcgggagcggug

SEQ ID NO: 3710608 - RNA, 13 nt, Human
uggagccccagcc

SEQ ID NO: 3710609 - RNA, 13 nt, Human
uggagccccuggg

SEQ ID NO: 3710610 - RNA, 18 nt, Human
uggagcccgcacccccac

SEQ ID NO: 3710611 - RNA, 15 nt, Human
uggagcccuccgccu

SEQ ID NO: 3710612 - RNA, 17 nt, Human
uggagccgaggccuacc

SEQ ID NO: 3710613 - RNA, 20 nt, Human
uggagccggacuuucggagu

SEQ ID NO: 3710614 - RNA, 22 nt, Human
uggagccggacuuucggaguug

SEQ ID NO: 3710615 - RNA, 17 nt, Human
uggagccugacagccag

SEQ ID NO: 3710616 - RNA, 18 nt, Human
uggagccugacagccaga

SEQ ID NO: 3710617 - RNA, 13 nt, Human
uggagccugcagg

SEQ ID NO: 3710618 - RNA, 15 nt, Human
uggagccugcagggu

SEQ ID NO: 3710619 - RNA, 23 nt, Human
uggagccugcaggguggugcugg

SEQ ID NO: 3710620 - RNA, 18 nt, Human
uggagccuggcacaggac

SEQ ID NO: 3710621 - RNA, 22 nt, Human
uggagccuguguaacagcuccu

SEQ ID NO: 3710622 - RNA, 20 nt, Human
uggagccuuuuaacugugca

SEQ ID NO: 3710623 - RNA, 14 nt, Human
uggagcgcaccugc

SEQ ID NO: 3710624 - RNA, 23 nt, Human
uggagcggaauuuaccugauuuc

SEQ ID NO: 3710625 - RNA, 18 nt, Human
uggagcucagagagggca

SEQ ID NO: 3710626 - RNA, 12 nt, Human
uggagcucagcc

SEQ ID NO: 3710627 - RNA, 13 nt, Human
uggagcucagccc

SEQ ID NO: 3710628 - RNA, 14 nt, Human
uggagcuccagccu

SEQ ID NO: 3710629 - RNA, 17 nt, Human
uggagcuccagccugac

SEQ ID NO: 3710630 - RNA, 14 nt, Human
uggagcuccuggga

SEQ ID NO: 3710631 - RNA, 17 nt, Human
uggagcucguggaacag

SEQ ID NO: 3710632 - RNA, 21 nt, Human
uggagcucguggaacaguuac

SEQ ID NO: 3710633 - RNA, 21 nt, Human
uggagcucgugggacagucac

SEQ ID NO: 3710634 - RNA, 13 nt, Human
uggagcugagccu

SEQ ID NO: 3710635 - RNA, 16 nt, Human
uggagcuuuuuucuuu

SEQ ID NO: 3710636 - RNA, 23 nt, Human
uggaggaaaaccaagccguggcu

SEQ ID NO: 3710637 - RNA, 13 nt, Human
uggaggaaagcaa

SEQ ID NO: 3710638 - RNA, 16 nt, Human
uggaggaaagggagga

SEQ ID NO: 3710639 - RNA, 17 nt, Human
uggaggaagaacugaaa

SEQ ID NO: 3710640 - RNA, 20 nt, Human
uggaggaagaacugaaaggc

SEQ ID NO: 3710641 - RNA, 18 nt, Human
uggaggaagagggacaga

SEQ ID NO: 3710642 - RNA, 19 nt, Human
uggaggaaggauuguaaaa

SEQ ID NO: 3710643 - RNA, 16 nt, Human
uggaggaaugcucccc

SEQ ID NO: 3710644 - RNA, 22 nt, Human
uggaggaaugcucccccauccu

SEQ ID NO: 3710645 - RNA, 14 nt, Human
uggaggaccugagc

SEQ ID NO: 3710646 - RNA, 18 nt, Human
uggaggaccugagccugc

SEQ ID NO: 3710647 - RNA, 20 nt, Human
uggaggaccugagccugccg

SEQ ID NO: 3710648 - RNA, 21 nt, Human
uggaggacuagaaccuggagg

SEQ ID NO: 3710649 - RNA, 11 nt, Human
uggaggagagc

SEQ ID NO: 3710650 - RNA, 16 nt, Human
uggaggagcaaaggcu

SEQ ID NO: 3710651 - RNA, 20 nt, Human
uggaggagcagugcaggcac

SEQ ID NO: 3710652 - RNA, 21 nt, Human
uggaggagcagugcaggcaca

SEQ ID NO: 3710653 - RNA, 13 nt, Human
uggaggagcccag

SEQ ID NO: 3710654 - RNA, 23 nt, Human
uggaggagcccaggccaggacuc

SEQ ID NO: 3710655 - RNA, 19 nt, Human
uggaggagcucaggacacu

SEQ ID NO: 3710656 - RNA, 20 nt, Human
uggaggagcucaggacacua

SEQ ID NO: 3710657 - RNA, 14 nt, Human
uggaggaggaaggc

SEQ ID NO: 3710658 - RNA, 12 nt, Human
uggaggaggagg

SEQ ID NO: 3710659 - RNA, 16 nt, Human
uggaggaggaggcaau

SEQ ID NO: 3710660 - RNA, 17 nt, Human
uggaggagguugggagg

SEQ ID NO: 3710661 - RNA, 17 nt, Human
uggaggaugugggcagc

SEQ ID NO: 3710662 - RNA, 13 nt, Human
uggaggcacuuua

SEQ ID NO: 3710663 - RNA, 17 nt, Human
uggaggcagccagggcu

SEQ ID NO: 3710664 - RNA, 14 nt, Human
uggaggcaggggcu

SEQ ID NO: 3710665 - RNA, 22 nt, Human
uggaggcaugugaugagaggaa

SEQ ID NO: 3710666 - RNA, 23 nt, Human
uggaggcccaggcugggaacuca

SEQ ID NO: 3710667 - RNA, 20 nt, Human
uggaggccccuggagccaga

SEQ ID NO: 3710668 - RNA, 19 nt, Human
uggaggccgggugcucagg

SEQ ID NO: 3710669 - RNA, 20 nt, Human
uggaggccucaggugcuguc

SEQ ID NO: 3710670 - RNA, 24 nt, Human
uggaggccucaggugcuguccaug

SEQ ID NO: 3710671 - RNA, 14 nt, Human
uggaggccucuggg

SEQ ID NO: 3710672 - RNA, 22 nt, Human
uggaggccucugggccuccucu

SEQ ID NO: 3710673 - RNA, 20 nt, Human
uggaggccuuccagcugcug

SEQ ID NO: 3710674 - RNA, 17 nt, Human
uggaggcugccucccaa

SEQ ID NO: 3710675 - RNA, 20 nt, Human
uggaggcugccucccaacag

SEQ ID NO: 3710676 - RNA, 12 nt, Human
uggaggcugcuc

SEQ ID NO: 3710677 - RNA, 16 nt, Human
uggaggcuuccugcgu

SEQ ID NO: 3710678 - RNA, 20 nt, Human
uggaggcuuccugcguccuc

SEQ ID NO: 3710679 - RNA, 14 nt, Human
uggagggaggcccc

SEQ ID NO: 3710680 - RNA, 16 nt, Human
uggagggaggccccag

SEQ ID NO: 3710681 - RNA, 13 nt, Human
uggagggagggaa

SEQ ID NO: 3710682 - RNA, 17 nt, Human
uggagggagggaagggu

SEQ ID NO: 3710683 - RNA, 15 nt, Human
uggagggccugggcc

SEQ ID NO: 3710684 - RNA, 17 nt, Human
uggagggccugggccug

SEQ ID NO: 3710685 - RNA, 22 nt, Human
uggagggccugggccuggcucc

SEQ ID NO: 3710686 - RNA, 22 nt, Human
uggagggcuagaaccuggagaa

SEQ ID NO: 3710687 - RNA, 21 nt, Human
uggagggcuagaacuggagag

SEQ ID NO: 3710688 - RNA, 22 nt, Human
uggagggcuagaaucuggagag

SEQ ID NO: 3710689 - RNA, 12 nt, Human
uggagggcugga

SEQ ID NO: 3710690 - RNA, 16 nt, Human
uggaggggaguguugg

SEQ ID NO: 3710691 - RNA, 23 nt, Human
uggaggggcagagccaggaagau

SEQ ID NO: 3710692 - RNA, 16 nt, Human
uggaggggcuggggac

SEQ ID NO: 3710693 - RNA, 21 nt, Human
uggagggguaggggcugggaa

SEQ ID NO: 3710694 - RNA, 22 nt, Human
uggagggguaggggcugggaac

SEQ ID NO: 3710695 - RNA, 13 nt, Human
uggaggggugugg

SEQ ID NO: 3710696 - RNA, 18 nt, Human
uggagggguguggcagug

SEQ ID NO: 3710697 - RNA, 18 nt, Human
uggagggucccaagcugg

SEQ ID NO: 3710698 - RNA, 20 nt, Human
uggagguacgaaaagagggg

SEQ ID NO: 3710699 - RNA, 17 nt, Human
uggaggugccagcaaag

SEQ ID NO: 3710700 - RNA, 20 nt, Human
uggaggugggagcaggagau

SEQ ID NO: 3710701 - RNA, 22 nt, Human
uggagguggggcgaggcaggcc

SEQ ID NO: 3710702 - RNA, 21 nt, Human
uggaggugucaggcugcuggc

SEQ ID NO: 3710703 - RNA, 22 nt, Human
uggaggugucaggcugcuggcg

SEQ ID NO: 3710704 - RNA, 16 nt, Human
uggagguuaaggcaua

SEQ ID NO: 3710705 - RNA, 19 nt, Human
uggagguuaaggcugagga

SEQ ID NO: 3710706 - RNA, 24 nt, Human
uggagguuaaggcugaggaaaggc

SEQ ID NO: 3710707 - RNA, 16 nt, Human
uggagguucuaaggcc

SEQ ID NO: 3710708 - RNA, 22 nt, Human
uggagguugaagccaagugggg

SEQ ID NO: 3710709 - RNA, 20 nt, Human
uggagguugauaacuuugcu

SEQ ID NO: 3710710 - RNA, 20 nt, Human
uggagguugcagugagcuga

SEQ ID NO: 3710711 - RNA, 15 nt, Human
uggaguacuuagcua

SEQ ID NO: 3710712 - RNA, 18 nt, Human
uggaguagaccccuggcu

SEQ ID NO: 3710713 - RNA, 20 nt, Human
uggaguagaccccuggcugg

SEQ ID NO: 3710714 - RNA, 16 nt, Human
uggaguauaauauuca

SEQ ID NO: 3710715 - RNA, 14 nt, Human
uggaguauauguca

SEQ ID NO: 3710716 - RNA, 15 nt, Human
uggaguccagucucu

SEQ ID NO: 3710717 - RNA, 20 nt, Human
uggaguccccucaccuccuc

SEQ ID NO: 3710718 - RNA, 21 nt, Human
uggaguccccucaccuccucu

SEQ ID NO: 3710719 - RNA, 13 nt, Human
uggagucuccagu

SEQ ID NO: 3710720 - RNA, 15 nt, Human
uggagucugccaccc

SEQ ID NO: 3710721 - RNA, 17 nt, Human
uggagucugccacccag

SEQ ID NO: 3710722 - RNA, 18 nt, Human
uggagucugccacccagg

SEQ ID NO: 3710723 - RNA, 19 nt, Human
uggagucuggagugggcag

SEQ ID NO: 3710724 - RNA, 16 nt, Human
uggagugcaaaaggcu

SEQ ID NO: 3710725 - RNA, 17 nt, Human
uggagugcaaugacaca

SEQ ID NO: 3710726 - RNA, 18 nt, Human
uggagugcaccaaagaga

SEQ ID NO: 3710727 - RNA, 18 nt, Human
uggagugcccacccuggg

SEQ ID NO: 3710728 - RNA, 13 nt, Human
uggaguggaugcc

SEQ ID NO: 3710729 - RNA, 17 nt, Human
uggaguggaugccucag

SEQ ID NO: 3710730 - RNA, 16 nt, Human
uggaguggcagcccag

SEQ ID NO: 3710731 - RNA, 19 nt, Human
uggaguggcagcccagcca

SEQ ID NO: 3710732 - RNA, 14 nt, Human
uggagugggcagag

SEQ ID NO: 3710733 - RNA, 13 nt, Human
uggaguggggcag

SEQ ID NO: 3710734 - RNA, 17 nt, Human
uggaguggggcaguaga

SEQ ID NO: 3710735 - RNA, 14 nt, Human
uggaguguaugacu

SEQ ID NO: 3710736 - RNA, 15 nt, Human
uggaguguguauugu

SEQ ID NO: 3710737 - RNA, 20 nt, Human
uggaguguguauuguuccca

SEQ ID NO: 3710738 - RNA, 20 nt, Human
uggaguguuucuaauaaacu

SEQ ID NO: 3710739 - RNA, 20 nt, Human
uggaguuacauuaauguuaa

SEQ ID NO: 3710740 - RNA, 22 nt, Human
uggaguuauugaagcagagugg

SEQ ID NO: 3710741 - RNA, 17 nt, Human
uggaguucaucuugaau

SEQ ID NO: 3710742 - RNA, 18 nt, Human
gugaauuguuaguuucug

SEQ ID NO: 3710743 - RNA, 14 nt, Human
gugaauuugaaucu

SEQ ID NO: 3710744 - RNA, 17 nt, Human
gugaauuuuuaagcugc

SEQ ID NO: 3710745 - RNA, 15 nt, Human
gugaauuuuuauugu

SEQ ID NO: 3710746 - RNA, 16 nt, Human
gugaauuuuucucuaa

SEQ ID NO: 3710747 - RNA, 15 nt, Human
gugaauuuuugcaau

SEQ ID NO: 3710748 - RNA, 21 nt, Human
gugaauuuuugcaauaaugca

SEQ ID NO: 3710749 - RNA, 16 nt, Human
gugacaacacuugugu

SEQ ID NO: 3710750 - RNA, 23 nt, Human
gugacaagcuccuggucuugaga

SEQ ID NO: 3710751 - RNA, 21 nt, Human
gugacaauaauauuguuguau

SEQ ID NO: 3710752 - RNA, 19 nt, Human
gugacaauucuguuuuuaa

SEQ ID NO: 3710753 - RNA, 16 nt, Human
gugacaauuuuguaca

SEQ ID NO: 3710754 - RNA, 14 nt, Human
gugacacaaacaca

SEQ ID NO: 3710755 - RNA, 19 nt, Human
gugacacagacucauccug

SEQ ID NO: 3710756 - RNA, 20 nt, Human
gugacacuucagagagcugg

SEQ ID NO: 3710757 - RNA, 17 nt, Human
gugacagacaggcucuu

SEQ ID NO: 3710758 - RNA, 19 nt, Human
gugacagacuccugaggac

SEQ ID NO: 3710759 - RNA, 22 nt, Human
gugacagagcaagacucugucu

SEQ ID NO: 3710760 - RNA, 16 nt, Human
gugacagaggcagccc

SEQ ID NO: 3710761 - RNA, 19 nt, Human
gugacagaggcagccccau

SEQ ID NO: 3710762 - RNA, 23 nt, Human
gugacagaggcagccccauucug

SEQ ID NO: 3710763 - RNA, 18 nt, Human
gugacagaguucacuaua

SEQ ID NO: 3710764 - RNA, 16 nt, Human
gugacagauuauacag

SEQ ID NO: 3710765 - RNA, 22 nt, Human
gugacagcucuuuuugugaagu

SEQ ID NO: 3710766 - RNA, 14 nt, Human
gugacaggcagcag

SEQ ID NO: 3710767 - RNA, 16 nt, Human
gugacagggaagcuac

SEQ ID NO: 3710768 - RNA, 17 nt, Human
gugacagggaagcuaca

SEQ ID NO: 3710769 - RNA, 20 nt, Human
gugacagggaagcuacaggu

SEQ ID NO: 3710770 - RNA, 12 nt, Human
gugacagggcca

SEQ ID NO: 3710771 - RNA, 13 nt, Human
gugacagggccag

SEQ ID NO: 3710772 - RNA, 19 nt, Human
gugacagggccaguggggc

SEQ ID NO: 3710773 - RNA, 20 nt, Human
gugacagggccaguggggcc

SEQ ID NO: 3710774 - RNA, 21 nt, Human
gugacagggccaguggggccu

SEQ ID NO: 3710775 - RNA, 19 nt, Human
gugacaguauuuugguucu

SEQ ID NO: 3710776 - RNA, 22 nt, Human
gugacagucaucaucagggccu

SEQ ID NO: 3710777 - RNA, 14 nt, Human
gugacaucaguggc

SEQ ID NO: 3710778 - RNA, 16 nt, Human
gugacaucggaaaaau

SEQ ID NO: 3710779 - RNA, 19 nt, Human
gugacaucggaaaaauaau

SEQ ID NO: 3710780 - RNA, 14 nt, Human
gugacaucucuuac

SEQ ID NO: 3710781 - RNA, 16 nt, Human
gugacaugcgggcugg

SEQ ID NO: 3710782 - RNA, 22 nt, Human
gugacauggugccugagaggca

SEQ ID NO: 3710783 - RNA, 14 nt, Human
gugacaugucuuuu

SEQ ID NO: 3710784 - RNA, 19 nt, Human
gugacaugucuuuucuugc

SEQ ID NO: 3710785 - RNA, 15 nt, Human
gugacaugugaaacc

SEQ ID NO: 3710786 - RNA, 19 nt, Human
gugacaugugaaaccuuuu

SEQ ID NO: 3710787 - RNA, 19 nt, Human
gugacauuugucauuuuca

SEQ ID NO: 3710788 - RNA, 20 nt, Human
gugacauuugucauuuucau

SEQ ID NO: 3710789 - RNA, 23 nt, Human
gugacauuugucauuuucauuag

SEQ ID NO: 3710790 - RNA, 19 nt, Human
gugacauuuuacauuaaau

SEQ ID NO: 3710791 - RNA, 20 nt, Human
gugacauuuuacauuaaauu

SEQ ID NO: 3710792 - RNA, 17 nt, Human
gugaccaaaaguuacau

SEQ ID NO: 3710793 - RNA, 16 nt, Human
gugaccaaaauccccu

SEQ ID NO: 3710794 - RNA, 22 nt, Human
gugaccaacuagacauucuguc

SEQ ID NO: 3710795 - RNA, 19 nt, Human
gugaccaacuguguuguau

SEQ ID NO: 3710796 - RNA, 14 nt, Human
gugaccaaggagga

SEQ ID NO: 3710797 - RNA, 19 nt, Human
gugaccaaguuauaaauca

SEQ ID NO: 3710798 - RNA, 17 nt, Human
gugaccaggcauccucc

SEQ ID NO: 3710799 - RNA, 15 nt, Human
gugaccauuuauaau

SEQ ID NO: 3710800 - RNA, 16 nt, Human
gugacccacaugccau

SEQ ID NO: 3710801 - RNA, 15 nt, Human
gugacccagucagag

SEQ ID NO: 3710802 - RNA, 21 nt, Human
gugaccccagggcacaggagc

SEQ ID NO: 3710803 - RNA, 17 nt, Human
gugacccccagcuccgg

SEQ ID NO: 3710804 - RNA, 13 nt, Human
gugaccccuccug

SEQ ID NO: 3710805 - RNA, 21 nt, Human
gugaccccuccuggggccagg

SEQ ID NO: 3710806 - RNA, 23 nt, Human
gugaccccuccuggggccaggcc

SEQ ID NO: 3710807 - RNA, 17 nt, Human
gugacccggcacccccu

SEQ ID NO: 3710808 - RNA, 12 nt, Human
gugacccuccaa

SEQ ID NO: 3710809 - RNA, 21 nt, Human
gugacccucugcugaagacuu

SEQ ID NO: 3710810 - RNA, 23 nt, Human
gugacccuucccaaucagcacug

SEQ ID NO: 3710811 - RNA, 20 nt, Human
gugaccuaucaguuauuaau

SEQ ID NO: 3710812 - RNA, 16 nt, Human
gugaccucagcuuuga

SEQ ID NO: 3710813 - RNA, 19 nt, Human
gugaccucaggcacuagcc

SEQ ID NO: 3710814 - RNA, 20 nt, Human
gugaccucuagcccugcccg

SEQ ID NO: 3710815 - RNA, 16 nt, Human
gugaccucucucucug

SEQ ID NO: 3710816 - RNA, 12 nt, Human
gugaccucugcc

SEQ ID NO: 3710817 - RNA, 15 nt, Human
gugaccucugccuga

SEQ ID NO: 3710818 - RNA, 13 nt, Human
gugaccugcuagg

SEQ ID NO: 3710819 - RNA, 16 nt, Human
gugaccugcugagcuc

SEQ ID NO: 3710820 - RNA, 18 nt, Human
gugaccugcugagcucug

SEQ ID NO: 3710821 - RNA, 19 nt, Human
gugaccugcugagcucuga

SEQ ID NO: 3710822 - RNA, 20 nt, Human
gugaccugcugagcucugag

SEQ ID NO: 3710823 - RNA, 21 nt, Human
gugaccugcugagcucugaga

SEQ ID NO: 3710824 - RNA, 23 nt, Human
gugaccuuaguguuucugugcau

SEQ ID NO: 3710825 - RNA, 14 nt, Human
gugacggcccucau

SEQ ID NO: 3710826 - RNA, 15 nt, Human
gugacggucccacac

SEQ ID NO: 3710827 - RNA, 23 nt, Human
gugacuaacuagacaccaaaguu

SEQ ID NO: 3710828 - RNA, 17 nt, Human
gugacuaauggcaugag

SEQ ID NO: 3710829 - RNA, 17 nt, Human
gugacuaauuguauaac

SEQ ID NO: 3710830 - RNA, 18 nt, Human
gugacuaauuguauaaca

SEQ ID NO: 3710831 - RNA, 23 nt, Human
gugacuaauuguauaacagguua

SEQ ID NO: 3710832 - RNA, 19 nt, Human
gugacuaguacaaauuaua

SEQ ID NO: 3710833 - RNA, 15 nt, Human
gugacuagugcugaa

SEQ ID NO: 3710834 - RNA, 12 nt, Human
gugacuccagga

SEQ ID NO: 3710835 - RNA, 17 nt, Human
gugacucgggcuccugu

SEQ ID NO: 3710836 - RNA, 19 nt, Human
gugacucgggcuccugugc

SEQ ID NO: 3710837 - RNA, 16 nt, Human
gugacucuuuuuaggg

SEQ ID NO: 3710838 - RNA, 19 nt, Human
gugacugauguuaggcugg

SEQ ID NO: 3710839 - RNA, 15 nt, Human
gugacuguauauaaa

SEQ ID NO: 3710840 - RNA, 15 nt, Human
gugacuguaucugug

SEQ ID NO: 3710841 - RNA, 19 nt, Human
gugacuguaucuguguaga

SEQ ID NO: 3710842 - RNA, 15 nt, Human
gugacugucugggga

SEQ ID NO: 3710843 - RNA, 21 nt, Human
gugacuuagcagaugcugguc

SEQ ID NO: 3710844 - RNA, 11 nt, Human
gugacuucuga

SEQ ID NO: 3710845 - RNA, 22 nt, Human
gugacuugcaucguggagacag

SEQ ID NO: 3710846 - RNA, 17 nt, Human
gugacuugugucccaug

SEQ ID NO: 3710847 - RNA, 15 nt, Human
gugacuuuggauaau

SEQ ID NO: 3710848 - RNA, 18 nt, Human
gugacuuuucaaguauuu

SEQ ID NO: 3710849 - RNA, 15 nt, Human
gugacuuuugcuuua

SEQ ID NO: 3710850 - RNA, 11 nt, Human
gugagaaaccu

SEQ ID NO: 3710851 - RNA, 15 nt, Human
gugagaaaccuguau

SEQ ID NO: 3710852 - RNA, 17 nt, Human
gugagaaaccuguaucu

SEQ ID NO: 3710853 - RNA, 20 nt, Human
gugagaaccuggguugcaga

SEQ ID NO: 3710854 - RNA, 22 nt, Human
gugagaaccuggguugcagaca

SEQ ID NO: 3710855 - RNA, 17 nt, Human
gugagaagguuuauugu

SEQ ID NO: 3710856 - RNA, 20 nt, Human
gugagaagugaaugcuggga

SEQ ID NO: 3710857 - RNA, 14 nt, Human
gugagaauaagaga

SEQ ID NO: 3710858 - RNA, 22 nt, Human
gugagaauaagagagucauaaa

SEQ ID NO: 3710859 - RNA, 17 nt, Human
gugagaauaggcagccc

SEQ ID NO: 3710860 - RNA, 12 nt, Human
gugagacagacu

SEQ ID NO: 3710861 - RNA, 13 nt, Human
gugagaccaccuc

SEQ ID NO: 3710862 - RNA, 14 nt, Human
gugagaccaccucu

SEQ ID NO: 3710863 - RNA, 16 nt, Human
gugagacccccacacc

SEQ ID NO: 3710864 - RNA, 16 nt, Human
gugagaccccugucuc

SEQ ID NO: 3710865 - RNA, 20 nt, Human
gugagacucgagaacuuuca

SEQ ID NO: 3710866 - RNA, 19 nt, Human
gugagagacauuaacucau

SEQ ID NO: 3710867 - RNA, 23 nt, Human
gugagagacauuaacucauuaga

SEQ ID NO: 3710868 - RNA, 17 nt, Human
gugagagagaugggagc

SEQ ID NO: 3710869 - RNA, 14 nt, Human
gugagagauucugu

SEQ ID NO: 3710870 - RNA, 22 nt, Human
gugagaguaaugaggcuugggg

SEQ ID NO: 3710871 - RNA, 22 nt, Human
gugagaugagggaugggccugg

SEQ ID NO: 3710872 - RNA, 16 nt, Human
gugagaugcagcugga

SEQ ID NO: 3710873 - RNA, 15 nt, Human
gugagauuuuuuauu

SEQ ID NO: 3710874 - RNA, 18 nt, Human
gugagauuuuuuauugcu

SEQ ID NO: 3710875 - RNA, 21 nt, Human
gugagcacuaaggugugcucu

SEQ ID NO: 3710876 - RNA, 16 nt, Human
gugagcacucccaagu

SEQ ID NO: 3710877 - RNA, 17 nt, Human
gugagcagccuggagcc

SEQ ID NO: 3710878 - RNA, 21 nt, Human
gugagcagugugucuccugca

SEQ ID NO: 3710879 - RNA, 19 nt, Human
gugagcauguuuggaaggg

SEQ ID NO: 3710880 - RNA, 16 nt, Human
gugagccaccacgccc

SEQ ID NO: 3710881 - RNA, 13 nt, Human
gugagccacugca

SEQ ID NO: 3710882 - RNA, 14 nt, Human
gugagccacugcac

SEQ ID NO: 3710883 - RNA, 15 nt, Human
gugagccacugcacc

SEQ ID NO: 3710884 - RNA, 15 nt, Human
gugagcccagcuggg

SEQ ID NO: 3710885 - RNA, 20 nt, Human
gugagcccagcugggucagg

SEQ ID NO: 3710886 - RNA, 12 nt, Human
gugagccccauc

SEQ ID NO: 3710887 - RNA, 18 nt, Human
gugagccgcaucuucucc

SEQ ID NO: 3710888 - RNA, 14 nt, Human
gugagccuggcucu

SEQ ID NO: 3710889 - RNA, 14 nt, Human
gugagcgcuugggc

SEQ ID NO: 3710890 - RNA, 22 nt, Human
gugagcucccaggugcagccag

SEQ ID NO: 3710891 - RNA, 14 nt, Human
uggaguugaaaauc

SEQ ID NO: 3710892 - RNA, 19 nt, Human
uggaguugaucuggaaccc

SEQ ID NO: 3710893 - RNA, 16 nt, Human
uggaguuggaguucau

SEQ ID NO: 3710894 - RNA, 19 nt, Human
uggaguuggggcagaggag

SEQ ID NO: 3710895 - RNA, 16 nt, Human
uggaguugguggugcu

SEQ ID NO: 3710896 - RNA, 17 nt, Human
uggaguuucuaaggucc

SEQ ID NO: 3710897 - RNA, 16 nt, Human
uggaguuuuguuuccu

SEQ ID NO: 3710898 - RNA, 23 nt, Human
uggaguuuuuguuuggagagcac

SEQ ID NO: 3710899 - RNA, 16 nt, Human
uggauaaagccacuga

SEQ ID NO: 3710900 - RNA, 14 nt, Human
uggauaacaaagau

SEQ ID NO: 3710901 - RNA, 15 nt, Human
uggauaacaccacca

SEQ ID NO: 3710902 - RNA, 21 nt, Human
uggauaacuuagguggcaagc

SEQ ID NO: 3710903 - RNA, 16 nt, Human
uggauaacuuccacag

SEQ ID NO: 3710904 - RNA, 20 nt, Human
uggauaauaaggaaaaguuu

SEQ ID NO: 3710905 - RNA, 18 nt, Human
uggauaaugcuguugccu

SEQ ID NO: 3710906 - RNA, 18 nt, Human
uggauacagcaguagaca

SEQ ID NO: 3710907 - RNA, 13 nt, Human
uggauacauaaag

SEQ ID NO: 3710908 - RNA, 16 nt, Human
uggauacauaaagacu

SEQ ID NO: 3710909 - RNA, 17 nt, Human
uggauacauaaagacua

SEQ ID NO: 3710910 - RNA, 13 nt, Human
uggauagcauguc

SEQ ID NO: 3710911 - RNA, 16 nt, Human
uggauaggagccugcu

SEQ ID NO: 3710912 - RNA, 16 nt, Human
uggauaggcacauaga

SEQ ID NO: 3710913 - RNA, 14 nt, Human
uggauauaaauaua

SEQ ID NO: 3710914 - RNA, 17 nt, Human
uggauauaguuuuacuu

SEQ ID NO: 3710915 - RNA, 19 nt, Human
uggauauauaggcuauuuu

SEQ ID NO: 3710916 - RNA, 13 nt, Human
uggauaucuguua

SEQ ID NO: 3710917 - RNA, 18 nt, Human
uggauaucuguuagaugc

SEQ ID NO: 3710918 - RNA, 21 nt, Human
uggauauguaaaacauuuauu

SEQ ID NO: 3710919 - RNA, 23 nt, Human
uggauauuuucaaauuguaucua

SEQ ID NO: 3710920 - RNA, 24 nt, Human
uggaucaaaaucuguagagcaggg

SEQ ID NO: 3710921 - RNA, 19 nt, Human
uggaucaaauccagccugc

SEQ ID NO: 3710922 - RNA, 23 nt, Human
uggaucacagaggcuucuucaga

SEQ ID NO: 3710923 - RNA, 15 nt, Human
uggaucacucaccau

SEQ ID NO: 3710924 - RNA, 17 nt, Human
uggaucacucaccauuc

SEQ ID NO: 3710925 - RNA, 18 nt, Human
uggaucagcguggccuug

SEQ ID NO: 3710926 - RNA, 12 nt, Human
uggaucaggaaa

SEQ ID NO: 3710927 - RNA, 19 nt, Human
uggaucaguccuuugauca

SEQ ID NO: 3710928 - RNA, 19 nt, Human
uggaucauaagacaaugga

SEQ ID NO: 3710929 - RNA, 20 nt, Human
uggauccccucugucuacaa

SEQ ID NO: 3710930 - RNA, 16 nt, Human
uggaucuaccuggagg

SEQ ID NO: 3710931 - RNA, 20 nt, Human
uggaucuauuucauguuuuu

SEQ ID NO: 3710932 - RNA, 18 nt, Human
uggaucuccaaggaccag

SEQ ID NO: 3710933 - RNA, 19 nt, Human
uggaucuguauguguucua

SEQ ID NO: 3710934 - RNA, 15 nt, Human
uggaucugugagggg

SEQ ID NO: 3710935 - RNA, 19 nt, Human
uggaucugugaggggcucu

SEQ ID NO: 3710936 - RNA, 18 nt, Human
uggaucuucaauggcuuu

SEQ ID NO: 3710937 - RNA, 16 nt, Human
uggaucuugaaugugg

SEQ ID NO: 3710938 - RNA, 16 nt, Human
uggaucuuuucauucu

SEQ ID NO: 3710939 - RNA, 15 nt, Human
uggaugaaauuuucu

SEQ ID NO: 3710940 - RNA, 22 nt, Human
uggaugaaguuaucuggcuuca

SEQ ID NO: 3710941 - RNA, 14 nt, Human
uggaugacauuaaa

SEQ ID NO: 3710942 - RNA, 22 nt, Human
uggaugauccccacgccacagc

SEQ ID NO: 3710943 - RNA, 12 nt, Human
uggaugauguuu

SEQ ID NO: 3710944 - RNA, 21 nt, Human
uggaugcagccucacaguccu

SEQ ID NO: 3710945 - RNA, 14 nt, Human
uggaugcagugcuc

SEQ ID NO: 3710946 - RNA, 15 nt, Human
uggaugcagugcucg

SEQ ID NO: 3710947 - RNA, 22 nt, Human
uggaugccgauuucuguaaacu

SEQ ID NO: 3710948 - RNA, 12 nt, Human
uggaugccuuga

SEQ ID NO: 3710949 - RNA, 18 nt, Human
uggaugcggccauucaag

SEQ ID NO: 3710950 - RNA, 20 nt, Human
uggauggaagguuggaugga

SEQ ID NO: 3710951 - RNA, 15 nt, Human
uggauggccccagca

SEQ ID NO: 3710952 - RNA, 17 nt, Human
uggauggccccagcaca

SEQ ID NO: 3710953 - RNA, 18 nt, Human
uggauggccguggaugcg

SEQ ID NO: 3710954 - RNA, 14 nt, Human
uggauggugugccu

SEQ ID NO: 3710955 - RNA, 12 nt, Human
uggauguaaaua

SEQ ID NO: 3710956 - RNA, 17 nt, Human
uggaugucugccaauuu

SEQ ID NO: 3710957 - RNA, 20 nt, Human
uggaugucugccaauuuuug

SEQ ID NO: 3710958 - RNA, 15 nt, Human
uggaugucuuccuug

SEQ ID NO: 3710959 - RNA, 12 nt, Human
uggauguucuga

SEQ ID NO: 3710960 - RNA, 18 nt, Human
uggauuaaacuuaugaau

SEQ ID NO: 3710961 - RNA, 20 nt, Human
uggauuaaacuuaugaaugu

SEQ ID NO: 3710962 - RNA, 14 nt, Human
uggauuaaauacau

SEQ ID NO: 3710963 - RNA, 21 nt, Human
uggauuaaauacauauggaug

SEQ ID NO: 3710964 - RNA, 21 nt, Human
uggauuaaauuaguuugugaa

SEQ ID NO: 3710965 - RNA, 13 nt, Human
uggauuauuuaau

SEQ ID NO: 3710966 - RNA, 16 nt, Human
uggauuauuuaauaac

SEQ ID NO: 3710967 - RNA, 17 nt, Human
uggauucauauuuaauu

SEQ ID NO: 3710968 - RNA, 13 nt, Human
uggauucaucagc

SEQ ID NO: 3710969 - RNA, 16 nt, Human
uggauucauugucucu

SEQ ID NO: 3710970 - RNA, 12 nt, Human
uggauuccagag

SEQ ID NO: 3710971 - RNA, 13 nt, Human
uggauuccaugcu

SEQ ID NO: 3710972 - RNA, 15 nt, Human
uggauuccaugcuaa

SEQ ID NO: 3710973 - RNA, 18 nt, Human
uggauuccgaguggugac

SEQ ID NO: 3710974 - RNA, 17 nt, Human
uggauucucuaaccuuu

SEQ ID NO: 3710975 - RNA, 17 nt, Human
uggauucugagagcugu

SEQ ID NO: 3710976 - RNA, 20 nt, Human
uggauucugaggcccugccc

SEQ ID NO: 3710977 - RNA, 17 nt, Human
uggauugacaguaacuu

SEQ ID NO: 3710978 - RNA, 19 nt, Human
uggauugcaauaucugaag

SEQ ID NO: 3710979 - RNA, 17 nt, Human
uggauugcacguggccu

SEQ ID NO: 3710980 - RNA, 21 nt, Human
uggauugcacguggccucuug

SEQ ID NO: 3710981 - RNA, 16 nt, Human
uggauugccucugaaa

SEQ ID NO: 3710982 - RNA, 20 nt, Human
uggauuggacaaaaugacuu

SEQ ID NO: 3710983 - RNA, 13 nt, Human
uggauuggauuug

SEQ ID NO: 3710984 - RNA, 17 nt, Human
uggauugguguaaaagg

SEQ ID NO: 3710985 - RNA, 21 nt, Human
uggauuguuaauuucaguccu

SEQ ID NO: 3710986 - RNA, 16 nt, Human
uggauuuaaaagccug

SEQ ID NO: 3710987 - RNA, 24 nt, Human
uggauuuaacagaaauguacagca

SEQ ID NO: 3710988 - RNA, 15 nt, Human
uggauuuaguuucag

SEQ ID NO: 3710989 - RNA, 22 nt, Human
uggauuuauguuguauagauua

SEQ ID NO: 3710990 - RNA, 14 nt, Human
uggauuucagaaag

SEQ ID NO: 3710991 - RNA, 13 nt, Human
uggauuucagaag

SEQ ID NO: 3710992 - RNA, 15 nt, Human
uggauuucuuugaaa

SEQ ID NO: 3710993 - RNA, 18 nt, Human
uggauuucuuugaaaaaa

SEQ ID NO: 3710994 - RNA, 14 nt, Human
uggauuucuuuugu

SEQ ID NO: 3710995 - RNA, 13 nt, Human
uggauuugaagca

SEQ ID NO: 3710996 - RNA, 19 nt, Human
uggauuuggagagaaauau

SEQ ID NO: 3710997 - RNA, 16 nt, Human
uggauuuguuuaaaag

SEQ ID NO: 3710998 - RNA, 13 nt, Human
uggauuuuauguu

SEQ ID NO: 3710999 - RNA, 15 nt, Human
uggauuuuauguuga

SEQ ID NO: 3711000 - RNA, 22 nt, Human
uggauuuuauguugacauuugu

SEQ ID NO: 3711001 - RNA, 22 nt, Human
uggauuuuuaccagucucacau

SEQ ID NO: 3711002 - RNA, 20 nt, Human
uggauuuuugacucuggcaa

SEQ ID NO: 3711003 - RNA, 17 nt, Human
uggauuuuugucuugug

SEQ ID NO: 3711004 - RNA, 23 nt, Human
uggauuuuuuccuucaaaguuua

SEQ ID NO: 3711005 - RNA, 16 nt, Human
uggcaaaaaggcagga

SEQ ID NO: 3711006 - RNA, 16 nt, Human
uggcaaaagccuugug

SEQ ID NO: 3711007 - RNA, 19 nt, Human
uggcaaaagccuuguguau

SEQ ID NO: 3711008 - RNA, 21 nt, Human
uggcaaaagccuuguguauau

SEQ ID NO: 3711009 - RNA, 21 nt, Human
uggcaaaaggaucuuuguggc

SEQ ID NO: 3711010 - RNA, 24 nt, Human
uggcaaacagggccucugcggagc

SEQ ID NO: 3711011 - RNA, 24 nt, Human
uggcaaacgcuaaagagcccuugc

SEQ ID NO: 3711012 - RNA, 19 nt, Human
uggcaaacucuccaccaca

SEQ ID NO: 3711013 - RNA, 18 nt, Human
uggcaaagcagaauguga

SEQ ID NO: 3711014 - RNA, 16 nt, Human
uggcaaagcuuuuaga

SEQ ID NO: 3711015 - RNA, 17 nt, Human
uggcaaaggaaggugga

SEQ ID NO: 3711016 - RNA, 22 nt, Human
uggcaaagggagcagaacugaa

SEQ ID NO: 3711017 - RNA, 14 nt, Human
uggcaaauauaaaa

SEQ ID NO: 3711018 - RNA, 15 nt, Human
uggcaacaaacugca

SEQ ID NO: 3711019 - RNA, 13 nt, Human
uggcaacacagag

SEQ ID NO: 3711020 - RNA, 14 nt, Human
uggcaacagaagug

SEQ ID NO: 3711021 - RNA, 20 nt, Human
uggcaacagaucuggaaccu

SEQ ID NO: 3711022 - RNA, 16 nt, Human
uggcaacauucauugc

SEQ ID NO: 3711023 - RNA, 16 nt, Human
uggcaacauuccaaga

SEQ ID NO: 3711024 - RNA, 16 nt, Human
uggcaaccagaccauu

SEQ ID NO: 3711025 - RNA, 19 nt, Human
uggcaagaauguguuuaaa

SEQ ID NO: 3711026 - RNA, 23 nt, Human
uggcaaggacgcuucacaggaca

SEQ ID NO: 3711027 - RNA, 20 nt, Human
uggcaaggacuuuguacauu

SEQ ID NO: 3711028 - RNA, 16 nt, Human
uggcaagucacaugcg

SEQ ID NO: 3711029 - RNA, 18 nt, Human
uggcaauaaauuuugaaa

SEQ ID NO: 3711030 - RNA, 12 nt, Human
uggcaauagacc

SEQ ID NO: 3711031 - RNA, 20 nt, Human
uggcaauagucaaauugugu

SEQ ID NO: 3711032 - RNA, 18 nt, Human
uggcaauaguguguucug

SEQ ID NO: 3711033 - RNA, 20 nt, Human
uggcaaucaaacauuuucug

SEQ ID NO: 3711034 - RNA, 13 nt, Human
uggcaaugccaca

SEQ ID NO: 3711035 - RNA, 14 nt, Human
uggcaaugccacag

SEQ ID NO: 3711036 - RNA, 19 nt, Human
uggcaaugguaguuucugu

SEQ ID NO: 3711037 - RNA, 17 nt, Human
uggcaauuccaauauuu

SEQ ID NO: 3711038 - RNA, 19 nt, Human
uggcaauuccaauauuucu

SEQ ID NO: 3711039 - RNA, 14 nt, Human
uggcaauucuuuga

SEQ ID NO: 3711040 - RNA, 18 nt, Human
uggcaauuuauuuuaaga

SEQ ID NO: 3711041 - RNA, 13 nt, Human
uggcaauuuugua

SEQ ID NO: 3711042 - RNA, 14 nt, Human
uggcaauuuuguaa

SEQ ID NO: 3711043 - RNA, 14 nt, Human
uggcacagaaacac

SEQ ID NO: 3711044 - RNA, 20 nt, Human
uggcacagcccaaagaagga

SEQ ID NO: 3711045 - RNA, 15 nt, Human
uggcacagggcagug

SEQ ID NO: 3711046 - RNA, 18 nt, Human
uggcacagggcaguggga

SEQ ID NO: 3711047 - RNA, 19 nt, Human
uggcacagggcaugaaaug

SEQ ID NO: 3711048 - RNA, 20 nt, Human
uggcacagggcaugaaauga

SEQ ID NO: 3711049 - RNA, 15 nt, Human
uggcacauccuaugc

SEQ ID NO: 3711050 - RNA, 18 nt, Human
uggcacauccuaugcaau

SEQ ID NO: 3711051 - RNA, 23 nt, Human
uggcacauccuaugcaauauauc

SEQ ID NO: 3711052 - RNA, 18 nt, Human
uggcacauuuaagagaca

SEQ ID NO: 3711053 - RNA, 21 nt, Human
uggcacauuuccccagaccug

SEQ ID NO: 3711054 - RNA, 11 nt, Human
uggcaccaaag

SEQ ID NO: 3711055 - RNA, 20 nt, Human
uggcaccaaagaugcagccg

SEQ ID NO: 3711056 - RNA, 18 nt, Human
uggcaccacugcacucca

SEQ ID NO: 3711057 - RNA, 19 nt, Human
uggcaccacugcacuccag

SEQ ID NO: 3711058 - RNA, 14 nt, Human
uggcaccagacacc

SEQ ID NO: 3711059 - RNA, 16 nt, Human
uggcaccagacaccca

SEQ ID NO: 3711060 - RNA, 21 nt, Human
uggcaccagacacccaggacu

SEQ ID NO: 3711061 - RNA, 19 nt, Human
uggcaccagaggcugcaga

SEQ ID NO: 3711062 - RNA, 20 nt, Human
uggcaccagaggcugcagaa

SEQ ID NO: 3711063 - RNA, 18 nt, Human
uggcaccagcagccugga

SEQ ID NO: 3711064 - RNA, 18 nt, Human
uggcacccggccccugcu

SEQ ID NO: 3711065 - RNA, 23 nt, Human
uggcaccgccuccccaccuccag

SEQ ID NO: 3711066 - RNA, 20 nt, Human
uggcaccuaauccaggcaga

SEQ ID NO: 3711067 - RNA, 22 nt, Human
uggcaccuccucggcuggcugu

SEQ ID NO: 3711068 - RNA, 13 nt, Human
uggcaccugucug

SEQ ID NO: 3711069 - RNA, 14 nt, Human
uggcacggugguac

SEQ ID NO: 3711070 - RNA, 22 nt, Human
uggcacuaacguugagccccug

SEQ ID NO: 3711071 - RNA, 15 nt, Human
uggcacuauaaugua

SEQ ID NO: 3711072 - RNA, 16 nt, Human
uggcacuauaauguaa

SEQ ID NO: 3711073 - RNA, 22 nt, Human
uggcacuauaauguaagcucua

SEQ ID NO: 3711074 - RNA, 15 nt, Human
uggcacucaacauga

SEQ ID NO: 3711075 - RNA, 15 nt, Human
uggcacucccuccag

SEQ ID NO: 3711076 - RNA, 19 nt, Human
uggcacugacugggcauag

SEQ ID NO: 3711077 - RNA, 14 nt, Human
uggcacugagcccc

SEQ ID NO: 3711078 - RNA, 19 nt, Human
uggcacugcauacaaucug

SEQ ID NO: 3711079 - RNA, 22 nt, Human
uggcacugcuuccagugaggcu

SEQ ID NO: 3711080 - RNA, 16 nt, Human
uggcacuggaccccag

SEQ ID NO: 3711081 - RNA, 13 nt, Human
uggcacuggcaaa

SEQ ID NO: 3711082 - RNA, 20 nt, Human
uggcacuggcauugucccug

SEQ ID NO: 3711083 - RNA, 21 nt, Human
uggcacugguagguugggaca

SEQ ID NO: 3711084 - RNA, 16 nt, Human
uggcacuugcaucugu

SEQ ID NO: 3711085 - RNA, 14 nt, Human
uggcacuugccugg

SEQ ID NO: 3711086 - RNA, 16 nt, Human
uggcacuugccugggu

SEQ ID NO: 3711087 - RNA, 17 nt, Human
uggcacuugccuggguc

SEQ ID NO: 3711088 - RNA, 11 nt, Human
uggcacuuuga

SEQ ID NO: 3711089 - RNA, 16 nt, Human
uggcacuuugaagggg

SEQ ID NO: 3711090 - RNA, 16 nt, Human
uggcacuuuuucauuu

SEQ ID NO: 3711091 - RNA, 20 nt, Human
uggcagaaaaaaugucugua

SEQ ID NO: 3711092 - RNA, 18 nt, Human
uggcagaagacaccagag

SEQ ID NO: 3711093 - RNA, 21 nt, Human
uggcagaagggagcagcacac

SEQ ID NO: 3711094 - RNA, 17 nt, Human
uggcagacuguguaaaa

SEQ ID NO: 3711095 - RNA, 13 nt, Human
uggcagagagaga

SEQ ID NO: 3711096 - RNA, 18 nt, Human
uggcagagaugccucccu

SEQ ID NO: 3711097 - RNA, 13 nt, Human
uggcagagcuucu

SEQ ID NO: 3711098 - RNA, 22 nt, Human
uggcagagcuuggacuggaugc

SEQ ID NO: 3711099 - RNA, 21 nt, Human
uggcagaguggauucuugaac

SEQ ID NO: 3711100 - RNA, 12 nt, Human
uggcagaguuac

SEQ ID NO: 3711101 - RNA, 19 nt, Human
uggcagaguuacaguucug

SEQ ID NO: 3711102 - RNA, 15 nt, Human
uggcagaguugaaga

SEQ ID NO: 3711103 - RNA, 19 nt, Human
uggcagaguuguaaauaua

SEQ ID NO: 3711104 - RNA, 21 nt, Human
uggcagaugcagcucuuccug

SEQ ID NO: 3711105 - RNA, 19 nt, Human
uggcagauguaggagggac

SEQ ID NO: 3711106 - RNA, 20 nt, Human
uggcagcaggccuguugcuu

SEQ ID NO: 3711107 - RNA, 17 nt, Human
uggcagcaggugcugcu

SEQ ID NO: 3711108 - RNA, 13 nt, Human
uggcagcauaaag

SEQ ID NO: 3711109 - RNA, 11 nt, Human
uggcagcccag

SEQ ID NO: 3711110 - RNA, 15 nt, Human
uggcagccccagcac

SEQ ID NO: 3711111 - RNA, 11 nt, Human
uggcagcccug

SEQ ID NO: 3711112 - RNA, 12 nt, Human
uggcagcccugu

SEQ ID NO: 3711113 - RNA, 17 nt, Human
uggcagcccuguaggga

SEQ ID NO: 3711114 - RNA, 17 nt, Human
uggcagccgugccuuca

SEQ ID NO: 3711115 - RNA, 22 nt, Human
uggcagccgugccuucagcucu

SEQ ID NO: 3711116 - RNA, 20 nt, Human
uggcagccucccauccaggg

SEQ ID NO: 3711117 - RNA, 12 nt, Human
uggcagccuugu

SEQ ID NO: 3711118 - RNA, 15 nt, Human
uggcagccuugugau

SEQ ID NO: 3711119 - RNA, 15 nt, Human
uggcagcucaccucu

SEQ ID NO: 3711120 - RNA, 19 nt, Human
uggcagcucaccucucccu

SEQ ID NO: 3711121 - RNA, 21 nt, Human
uggcagcugcgguccacccag

SEQ ID NO: 3711122 - RNA, 13 nt, Human
uggcagcugcuuu

SEQ ID NO: 3711123 - RNA, 11 nt, Human
uggcagcuuuu

SEQ ID NO: 3711124 - RNA, 18 nt, Human
uggcagcuuuuaaaagau

SEQ ID NO: 3711125 - RNA, 13 nt, Human
uggcaggacagga

SEQ ID NO: 3711126 - RNA, 11 nt, Human
uggcaggacca

SEQ ID NO: 3711127 - RNA, 22 nt, Human
uggcaggaugacccugcgaagg

SEQ ID NO: 3711128 - RNA, 19 nt, Human
uggcaggauggccuggcca

SEQ ID NO: 3711129 - RNA, 14 nt, Human
uggcaggcaccugu

SEQ ID NO: 3711130 - RNA, 18 nt, Human
uggcaggcagaggcccag

SEQ ID NO: 3711131 - RNA, 15 nt, Human
uggcaggcagcgcca

SEQ ID NO: 3711132 - RNA, 15 nt, Human
uggcaggccagcugu

SEQ ID NO: 3711133 - RNA, 20 nt, Human
uggcagggcacagggccugg

SEQ ID NO: 3711134 - RNA, 21 nt, Human
uggcagggcacagggccuggc

SEQ ID NO: 3711135 - RNA, 11 nt, Human
uggcagggcuc

SEQ ID NO: 3711136 - RNA, 23 nt, Human
uggcagggcuggccccagggcac

SEQ ID NO: 3711137 - RNA, 15 nt, Human
uggcaggggacagga

SEQ ID NO: 3711138 - RNA, 18 nt, Human
uggcagggggcugcugcu

SEQ ID NO: 3711139 - RNA, 24 nt, Human
uggcagggguggaggagagccugg

SEQ ID NO: 3711140 - RNA, 15 nt, Human
uggcagguccucccc

SEQ ID NO: 3711141 - RNA, 19 nt, Human
uggcaguaaagagaaacuu

SEQ ID NO: 3711142 - RNA, 22 nt, Human
uggcaguaaagagaaacuuugu

SEQ ID NO: 3711143 - RNA, 18 nt, Human
uggcaguccgugggacgg

SEQ ID NO: 3711144 - RNA, 13 nt, Human
uggcagucuauau

SEQ ID NO: 3711145 - RNA, 22 nt, Human
uggcagucugaauuuuuaaaac

SEQ ID NO: 3711146 - RNA, 14 nt, Human
uggcagugagugag

SEQ ID NO: 3711147 - RNA, 18 nt, Human
uggcagugagugagccug

SEQ ID NO: 3711148 - RNA, 19 nt, Human
uggcagugggaaaaaugua

SEQ ID NO: 3711149 - RNA, 15 nt, Human
uggcagugggagcug

SEQ ID NO: 3711150 - RNA, 16 nt, Human
uggcaguguuuugaga

SEQ ID NO: 3711151 - RNA, 21 nt, Human
uggcaguuuugacaucagcca

SEQ ID NO: 3711152 - RNA, 15 nt, Human
uggcauaaauugcau

SEQ ID NO: 3711153 - RNA, 22 nt, Human
uggcauacgccuguaguccuag

SEQ ID NO: 3711154 - RNA, 15 nt, Human
uggcauagagcagca

SEQ ID NO: 3711155 - RNA, 17 nt, Human
uggcauagcccagacac

SEQ ID NO: 3711156 - RNA, 19 nt, Human
uggcauagcccagacacag

SEQ ID NO: 3711157 - RNA, 23 nt, Human
uggcaucaagaggugggagggcc

SEQ ID NO: 3711158 - RNA, 15 nt, Human
uggcaucacagggca

SEQ ID NO: 3711159 - RNA, 15 nt, Human
uggcaucagcuggcg

SEQ ID NO: 3711160 - RNA, 15 nt, Human
uggcaucccugggcc

SEQ ID NO: 3711161 - RNA, 16 nt, Human
uggcaucccugggccu

SEQ ID NO: 3711162 - RNA, 20 nt, Human
uggcaucccugggccuuggg

SEQ ID NO: 3711163 - RNA, 17 nt, Human
uggcauccugugaaguc

SEQ ID NO: 3711164 - RNA, 23 nt, Human
uggcaucgcaccauucugacucg

SEQ ID NO: 3711165 - RNA, 20 nt, Human
uggcaucuuagaccuccaca

SEQ ID NO: 3711166 - RNA, 22 nt, Human
uggcaucuucgucuucacucuu

SEQ ID NO: 3711167 - RNA, 20 nt, Human
uggcaucuuugccuugggcu

SEQ ID NO: 3711168 - RNA, 23 nt, Human
uggcaucuuugccuugggcugcu

SEQ ID NO: 3711169 - RNA, 13 nt, Human
uggcaugagaaau

SEQ ID NO: 3711170 - RNA, 15 nt, Human
uggcaugccuuccag

SEQ ID NO: 3711171 - RNA, 16 nt, Human
uggcaugcuuaaauuu

SEQ ID NO: 3711172 - RNA, 19 nt, Human
uggcauggaaauuuaaagc

SEQ ID NO: 3711173 - RNA, 17 nt, Human
uggcaugggggccucag

SEQ ID NO: 3711174 - RNA, 19 nt, Human
uggcaugggggccucaggg

SEQ ID NO: 3711175 - RNA, 21 nt, Human
uggcaugguuuugugccaucu

SEQ ID NO: 3711176 - RNA, 15 nt, Human
uggcauguggccugu

SEQ ID NO: 3711177 - RNA, 12 nt, Human
uggcauguguuu

SEQ ID NO: 3711178 - RNA, 19 nt, Human
uggcauuacagcuggagaa

SEQ ID NO: 3711179 - RNA, 17 nt, Human
uggcauucuuguacagu

SEQ ID NO: 3711180 - RNA, 13 nt, Human
uggcauuggcagc

SEQ ID NO: 3711181 - RNA, 19 nt, Human
uggcauuggcagcaggugc

SEQ ID NO: 3711182 - RNA, 20 nt, Human
uggcauugucccugugccua

SEQ ID NO: 3711183 - RNA, 15 nt, Human
uggcauuugcaauaa

SEQ ID NO: 3711184 - RNA, 19 nt, Human
uggcauuugcagauuuuua

SEQ ID NO: 3711185 - RNA, 20 nt, Human
uggccaaauuauuuguguaa

SEQ ID NO: 3711186 - RNA, 13 nt, Human
uggccaagaagca

SEQ ID NO: 3711187 - RNA, 16 nt, Human
uggccaagaagcagug

SEQ ID NO: 3711188 - RNA, 21 nt, Human
uggccaagaagcaguggccuu

SEQ ID NO: 3711189 - RNA, 22 nt, Human
uggccaagaagcaguggccuua

SEQ ID NO: 3711190 - RNA, 20 nt, Human
uggccaagagaaacuuccua

SEQ ID NO: 3711191 - RNA, 20 nt, Human
ugccagugucuuucuuuggu

SEQ ID NO: 3711192 - RNA, 19 nt, Human
ugccagugugcugaugggc

SEQ ID NO: 3711193 - RNA, 18 nt, Human
ugccaguuacuugcuuua

SEQ ID NO: 3711194 - RNA, 13 nt, Human
ugccauaaaacau

SEQ ID NO: 3711195 - RNA, 14 nt, Human
ugccauaaaacauu

SEQ ID NO: 3711196 - RNA, 13 nt, Human
ugccauaauuacu

SEQ ID NO: 3711197 - RNA, 23 nt, Human
ugccauacaucaguuauucauuc

SEQ ID NO: 3711198 - RNA, 16 nt, Human
ugccauagucacaugg

SEQ ID NO: 3711199 - RNA, 18 nt, Human
ugccaucaaacuguaaaa

SEQ ID NO: 3711200 - RNA, 15 nt, Human
ugccaucaucuccug

SEQ ID NO: 3711201 - RNA, 15 nt, Human
ugccaucauugcugu

SEQ ID NO: 3711202 - RNA, 19 nt, Human
ugccaucccucccuccacc

SEQ ID NO: 3711203 - RNA, 22 nt, Human
ugccaucccucccuccaccucc

SEQ ID NO: 3711204 - RNA, 23 nt, Human
ugccauccucaaacacugcaggc

SEQ ID NO: 3711205 - RNA, 18 nt, Human
ugccauccuggcccaggg

SEQ ID NO: 3711206 - RNA, 20 nt, Human
ugccaucucaccuccugcug

SEQ ID NO: 3711207 - RNA, 22 nt, Human
ugccaucucaccuccugcuggg

SEQ ID NO: 3711208 - RNA, 23 nt, Human
ugccaucucaccuccugcugggc

SEQ ID NO: 3711209 - RNA, 16 nt, Human
ugccaugaacuggagg

SEQ ID NO: 3711210 - RNA, 18 nt, Human
ugccauggaacuguuucc

SEQ ID NO: 3711211 - RNA, 14 nt, Human
ugccauggaagagg

SEQ ID NO: 3711212 - RNA, 22 nt, Human
ugccauggaagaggcuacaggg

SEQ ID NO: 3711213 - RNA, 18 nt, Human
ugccauggacagaagaag

SEQ ID NO: 3711214 - RNA, 23 nt, Human
ugccauggacagaagaaggcagc

SEQ ID NO: 3711215 - RNA, 20 nt, Human
ugccaugggcuucacuguau

SEQ ID NO: 3711216 - RNA, 22 nt, Human
ugccaugggcuucacuguauaa

SEQ ID NO: 3711217 - RNA, 18 nt, Human
ugccauguacaguauguu

SEQ ID NO: 3711218 - RNA, 12 nt, Human
ugccauguaccu

SEQ ID NO: 3711219 - RNA, 17 nt, Human
ugccauguaccuccccu

SEQ ID NO: 3711220 - RNA, 23 nt, Human
ugccauguaccuccccugccuug

SEQ ID NO: 3711221 - RNA, 17 nt, Human
ugccaugucaaacaaau

SEQ ID NO: 3711222 - RNA, 18 nt, Human
ugccaugucaaacaaaua

SEQ ID NO: 3711223 - RNA, 18 nt, Human
ugccaugucagcgcucug

SEQ ID NO: 3711224 - RNA, 15 nt, Human
ugccaugugccaggu

SEQ ID NO: 3711225 - RNA, 20 nt, Human
ugccaugugcuucugccacc

SEQ ID NO: 3711226 - RNA, 21 nt, Human
ugccauguugccccuuucucu

SEQ ID NO: 3711227 - RNA, 15 nt, Human
ugccauguuggccag

SEQ ID NO: 3711228 - RNA, 17 nt, Human
ugccauguuggccaggc

SEQ ID NO: 3711229 - RNA, 18 nt, Human
ugccauguuggccaggcu

SEQ ID NO: 3711230 - RNA, 21 nt, Human
ugccauguuggccaggcuggu

SEQ ID NO: 3711231 - RNA, 21 nt, Human
ugccauguuuugccacccccu

SEQ ID NO: 3711232 - RNA, 14 nt, Human
ugccauuaaagaau

SEQ ID NO: 3711233 - RNA, 14 nt, Human
ugccauuaacaaau

SEQ ID NO: 3711234 - RNA, 22 nt, Human
ugccauuacagagguauuaaaa

SEQ ID NO: 3711235 - RNA, 23 nt, Human
ugccauuaucccugaaucccccu

SEQ ID NO: 3711236 - RNA, 20 nt, Human
ugccauuauuuucugucaga

SEQ ID NO: 3711237 - RNA, 16 nt, Human
ugccauucacuucaua

SEQ ID NO: 3711238 - RNA, 20 nt, Human
ugccauuccaaaauauuaug

SEQ ID NO: 3711239 - RNA, 13 nt, Human
ugccauugucuuu

SEQ ID NO: 3711240 - RNA, 14 nt, Human
ugccauugucuuua

SEQ ID NO: 3711241 - RNA, 18 nt, Human
ugccauugucuuuauaug

SEQ ID NO: 3711242 - RNA, 14 nt, Human
ugccauuuaaaaag

SEQ ID NO: 3711243 - RNA, 17 nt, Human
ugccauuuaaaaaguug

SEQ ID NO: 3711244 - RNA, 14 nt, Human
ugccauuuauuuau

SEQ ID NO: 3711245 - RNA, 15 nt, Human
ugccauuucaugucc

SEQ ID NO: 3711246 - RNA, 20 nt, Human
ugccauuugauaccccuggg

SEQ ID NO: 3711247 - RNA, 18 nt, Human
ugccauuugauuuuucua

SEQ ID NO: 3711248 - RNA, 15 nt, Human
ugcccaacaccagcc

SEQ ID NO: 3711249 - RNA, 19 nt, Human
ugcccaacaccagccccug

SEQ ID NO: 3711250 - RNA, 22 nt, Human
ugcccaacaccagccccugccc

SEQ ID NO: 3711251 - RNA, 19 nt, Human
ugcccaacccuucccucac

SEQ ID NO: 3711252 - RNA, 20 nt, Human
ugcccaacccuucccucacc

SEQ ID NO: 3711253 - RNA, 14 nt, Human
ugcccaaccucagc

SEQ ID NO: 3711254 - RNA, 15 nt, Human
ugcccaaccucagca

SEQ ID NO: 3711255 - RNA, 11 nt, Human
ugcccaagcca

SEQ ID NO: 3711256 - RNA, 15 nt, Human
ugcccaagccagagg

SEQ ID NO: 3711257 - RNA, 14 nt, Human
ugcccaagggaaag

SEQ ID NO: 3711258 - RNA, 20 nt, Human
ugcccaaugaauaauggaaa

SEQ ID NO: 3711259 - RNA, 21 nt, Human
ugcccaauuggaggaaagcaa

SEQ ID NO: 3711260 - RNA, 17 nt, Human
ugcccacaccuccuggg

SEQ ID NO: 3711261 - RNA, 12 nt, Human
ugcccacagccc

SEQ ID NO: 3711262 - RNA, 19 nt, Human
ugcccacaggaucagucug

SEQ ID NO: 3711263 - RNA, 21 nt, Human
ugcccacaggccgcccugcgg

SEQ ID NO: 3711264 - RNA, 18 nt, Human
ugcccacagugucaggca

SEQ ID NO: 3711265 - RNA, 24 nt, Human
ugcccacccccucaagccaauccc

SEQ ID NO: 3711266 - RNA, 18 nt, Human
ugcccacccccugcccug

SEQ ID NO: 3711267 - RNA, 17 nt, Human
ugcccacccuccacucu

SEQ ID NO: 3711268 - RNA, 22 nt, Human
ugcccacccugggagacagacc

SEQ ID NO: 3711269 - RNA, 11 nt, Human
ugcccaccugc

SEQ ID NO: 3711270 - RNA, 17 nt, Human
ugcccaccugcccauca

SEQ ID NO: 3711271 - RNA, 19 nt, Human
ugcccaccugcccaucaca

SEQ ID NO: 3711272 - RNA, 17 nt, Human
ugcccaccugccuggcc

SEQ ID NO: 3711273 - RNA, 17 nt, Human
ugcccaccuggccucug

SEQ ID NO: 3711274 - RNA, 20 nt, Human
ugcccaccuggccucugcac

SEQ ID NO: 3711275 - RNA, 11 nt, Human
ugcccaccugu

SEQ ID NO: 3711276 - RNA, 13 nt, Human
ugcccacucccug

SEQ ID NO: 3711277 - RNA, 18 nt, Human
ugcccacuccugcucugc

SEQ ID NO: 3711278 - RNA, 12 nt, Human
ugcccacuguuu

SEQ ID NO: 3711279 - RNA, 17 nt, Human
ugcccagaacuucccug

SEQ ID NO: 3711280 - RNA, 18 nt, Human
ugcccagaacuucccuga

SEQ ID NO: 3711281 - RNA, 18 nt, Human
ugcccagaauacugaugg

SEQ ID NO: 3711282 - RNA, 18 nt, Human
ugcccagaaugaggcugc

SEQ ID NO: 3711283 - RNA, 19 nt, Human
ugcccagaaugaggcugcu

SEQ ID NO: 3711284 - RNA, 21 nt, Human
ugcccagaauucccagcuguc

SEQ ID NO: 3711285 - RNA, 18 nt, Human
ugcccagaccccucuggc

SEQ ID NO: 3711286 - RNA, 17 nt, Human
ugcccagagacccagcg

SEQ ID NO: 3711287 - RNA, 20 nt, Human
ugcccagagacccagcggac

SEQ ID NO: 3711288 - RNA, 18 nt, Human
ugcccagagaugccucca

SEQ ID NO: 3711289 - RNA, 20 nt, Human
ugcccagagaugccuccacc

SEQ ID NO: 3711290 - RNA, 22 nt, Human
ugcccagagaugccuccaccgc

SEQ ID NO: 3711291 - RNA, 15 nt, Human
ugcccagagauggga

SEQ ID NO: 3711292 - RNA, 14 nt, Human
ugcccagagcuggg

SEQ ID NO: 3711293 - RNA, 17 nt, Human
ugcccagagcuggguga

SEQ ID NO: 3711294 - RNA, 16 nt, Human
ugcccagaucagccag

SEQ ID NO: 3711295 - RNA, 20 nt, Human
ugcccagaucagccagaagc

SEQ ID NO: 3711296 - RNA, 22 nt, Human
ugcccagcccccuggucuuuga

SEQ ID NO: 3711297 - RNA, 12 nt, Human
ugcccagccccu

SEQ ID NO: 3711298 - RNA, 20 nt, Human
ugcccagccccuucugaccc

SEQ ID NO: 3711299 - RNA, 17 nt, Human
ugcccagccucuuuccc

SEQ ID NO: 3711300 - RNA, 18 nt, Human
ugcccagccuggaugcca

SEQ ID NO: 3711301 - RNA, 21 nt, Human
ugcccagcuagcugcagagcc

SEQ ID NO: 3711302 - RNA, 21 nt, Human
ugcccagcuauaccugugccu

SEQ ID NO: 3711303 - RNA, 14 nt, Human
ugcccagcuugggc

SEQ ID NO: 3711304 - RNA, 18 nt, Human
ugcccagcuugggcccag

SEQ ID NO: 3711305 - RNA, 23 nt, Human
ugcccagcuugggcccagcuggg

SEQ ID NO: 3711306 - RNA, 21 nt, Human
ugcccaggacggggccggcca

SEQ ID NO: 3711307 - RNA, 16 nt, Human
ugcccaggagagccag

SEQ ID NO: 3711308 - RNA, 20 nt, Human
ugcccaggagagccagcccu

SEQ ID NO: 3711309 - RNA, 22 nt, Human
ugcccaggagagccagcccucc

SEQ ID NO: 3711310 - RNA, 13 nt, Human
ugcccaggcaggu

SEQ ID NO: 3711311 - RNA, 16 nt, Human
ugcccaggcaggucuu

SEQ ID NO: 3711312 - RNA, 17 nt, Human
ugcccaggcaggucuug

SEQ ID NO: 3711313 - RNA, 11 nt, Human
ugcccaggccc

SEQ ID NO: 3711314 - RNA, 14 nt, Human
ugcccaggccccug

SEQ ID NO: 3711315 - RNA, 17 nt, Human
ugcccaggccccugcca

SEQ ID NO: 3711316 - RNA, 18 nt, Human
ugcccaggccccugccac

SEQ ID NO: 3711317 - RNA, 15 nt, Human
ugcccaggccggcca

SEQ ID NO: 3711318 - RNA, 13 nt, Human
ugcccaggcugga

SEQ ID NO: 3711319 - RNA, 15 nt, Human
ugcccaggcuggagu

SEQ ID NO: 3711320 - RNA, 20 nt, Human
ugcccaggcuggagugcaau

SEQ ID NO: 3711321 - RNA, 19 nt, Human
ugcccaggcuggcgugcag

SEQ ID NO: 3711322 - RNA, 23 nt, Human
ugcccaggcuggcgugcaguggu

SEQ ID NO: 3711323 - RNA, 16 nt, Human
ugcccaggcuggucuu

SEQ ID NO: 3711324 - RNA, 19 nt, Human
ugcccagggccacucugcc

SEQ ID NO: 3711325 - RNA, 21 nt, Human
ugcccagggccacucugccuc

SEQ ID NO: 3711326 - RNA, 15 nt, Human
ugcccagggcucagc

SEQ ID NO: 3711327 - RNA, 17 nt, Human
ugcccagggcucagccu

SEQ ID NO: 3711328 - RNA, 14 nt, Human
ugcccaggggagcc

SEQ ID NO: 3711329 - RNA, 20 nt, Human
ugcccaggggcccacaggga

SEQ ID NO: 3711330 - RNA, 19 nt, Human
ugcccaggggugcccccuc

SEQ ID NO: 3711331 - RNA, 23 nt, Human
ugcccaggggugcccccuccucu

SEQ ID NO: 3711332 - RNA, 19 nt, Human
ugcccaguacauuuaaauu

SEQ ID NO: 3711333 - RNA, 22 nt, Human
ugcccagucccccaaccccagc

SEQ ID NO: 3711334 - RNA, 21 nt, Human
ugcccagucgauaucucacuu

SEQ ID NO: 3711335 - RNA, 14 nt, Human
ugcccagucuuuca

SEQ ID NO: 3711336 - RNA, 17 nt, Human
ugcccagucuuucaugu

SEQ ID NO: 3711337 - RNA, 19 nt, Human
ugcccaguguuguuuguaa

SEQ ID NO: 3711338 - RNA, 20 nt, Human
ugcccaguguuguuuguaaa

SEQ ID NO: 3711339 - RNA, 16 nt, Human
gugagcuccuaagcca

SEQ ID NO: 3711340 - RNA, 23 nt, Human
gugagcucuuccuaucccucucc

SEQ ID NO: 3711341 - RNA, 18 nt, Human
gugaggaaagcacacagu

SEQ ID NO: 3711342 - RNA, 18 nt, Human
gugaggaaaucaaagugc

SEQ ID NO: 3711343 - RNA, 22 nt, Human
gugaggaaaucaaagugcuauu

SEQ ID NO: 3711344 - RNA, 16 nt, Human
gugaggaagccgcugg

SEQ ID NO: 3711345 - RNA, 16 nt, Human
gugaggaagcuccagu

SEQ ID NO: 3711346 - RNA, 18 nt, Human
gugaggagcugcuggcuu

SEQ ID NO: 3711347 - RNA, 17 nt, Human
gugaggaugggaaggag

SEQ ID NO: 3711348 - RNA, 19 nt, Human
gugaggaugggaaggaggg

SEQ ID NO: 3711349 - RNA, 15 nt, Human
gugaggaugucuggg

SEQ ID NO: 3711350 - RNA, 23 nt, Human
gugaggauuaaauaauguaaaua

SEQ ID NO: 3711351 - RNA, 23 nt, Human
gugaggcaaugggagcugaggcc

SEQ ID NO: 3711352 - RNA, 12 nt, Human
gugaggcagggg

SEQ ID NO: 3711353 - RNA, 17 nt, Human
gugaggcaggggcggag

SEQ ID NO: 3711354 - RNA, 13 nt, Human
gugaggcaguggg

SEQ ID NO: 3711355 - RNA, 15 nt, Human
gugaggccacugaag

SEQ ID NO: 3711356 - RNA, 16 nt, Human
gugaggccacugaaga

SEQ ID NO: 3711357 - RNA, 21 nt, Human
gugaggccacugaagaggagg

SEQ ID NO: 3711358 - RNA, 22 nt, Human
gugaggccacugaagaggagga

SEQ ID NO: 3711359 - RNA, 17 nt, Human
gugaggccagagacaca

SEQ ID NO: 3711360 - RNA, 15 nt, Human
gugaggcccagggag

SEQ ID NO: 3711361 - RNA, 14 nt, Human
gugaggccugucug

SEQ ID NO: 3711362 - RNA, 14 nt, Human
gugaggcucugccc

SEQ ID NO: 3711363 - RNA, 19 nt, Human
gugagggguaaaagcugau

SEQ ID NO: 3711364 - RNA, 13 nt, Human
gugaggggucccu

SEQ ID NO: 3711365 - RNA, 19 nt, Human
gugaggugcagagugccca

SEQ ID NO: 3711366 - RNA, 14 nt, Human
gugaggugcccagc

SEQ ID NO: 3711367 - RNA, 16 nt, Human
gugagguucuuggguu

SEQ ID NO: 3711368 - RNA, 16 nt, Human
gugagguugggcagcu

SEQ ID NO: 3711369 - RNA, 22 nt, Human
gugagguuucccaaugguguuu

SEQ ID NO: 3711370 - RNA, 17 nt, Human
gugagucaccaagccca

SEQ ID NO: 3711371 - RNA, 19 nt, Human
gugagucaccaagcccagu

SEQ ID NO: 3711372 - RNA, 14 nt, Human
gugagucauuuaaa

SEQ ID NO: 3711373 - RNA, 19 nt, Human
gugaguccuagagcuacag

SEQ ID NO: 3711374 - RNA, 20 nt, Human
gugaguccuggcaugggaau

SEQ ID NO: 3711375 - RNA, 18 nt, Human
gugagucucucugggccu

SEQ ID NO: 3711376 - RNA, 16 nt, Human
gugagucuuggcggca

SEQ ID NO: 3711377 - RNA, 21 nt, Human
gugagucuuggcggcagcagc

SEQ ID NO: 3711378 - RNA, 22 nt, Human
gugagucuuggcggcagcagcc

SEQ ID NO: 3711379 - RNA, 19 nt, Human
gugagucuuugguucuaag

SEQ ID NO: 3711380 - RNA, 13 nt, Human
gugagugccuuuu

SEQ ID NO: 3711381 - RNA, 17 nt, Human
gugagugccuuuugcag

SEQ ID NO: 3711382 - RNA, 16 nt, Human
gugagugguugaauau

SEQ ID NO: 3711383 - RNA, 15 nt, Human
gugaguguggcuccc

SEQ ID NO: 3711384 - RNA, 14 nt, Human
gugaguucucaggg

SEQ ID NO: 3711385 - RNA, 13 nt, Human
gugaguucucccu

SEQ ID NO: 3711386 - RNA, 22 nt, Human
gugaguucucccuguacagugu

SEQ ID NO: 3711387 - RNA, 20 nt, Human
gugaguuggcuuaccuggcc

SEQ ID NO: 3711388 - RNA, 21 nt, Human
gugaguuugagcugccuuccc

SEQ ID NO: 3711389 - RNA, 12 nt, Human
gugauaaaauca

SEQ ID NO: 3711390 - RNA, 13 nt, Human
gugauaaacuuug

SEQ ID NO: 3711391 - RNA, 21 nt, Human
gugauaacuccuaagaggagc

SEQ ID NO: 3711392 - RNA, 19 nt, Human
gugauaagggaaaagauaa

SEQ ID NO: 3711393 - RNA, 20 nt, Human
gugauacccauagcuuccau

SEQ ID NO: 3711394 - RNA, 21 nt, Human
gugauauauaaguguacauau

SEQ ID NO: 3711395 - RNA, 13 nt, Human
gugauauggagca

SEQ ID NO: 3711396 - RNA, 16 nt, Human
gugauauggcagaaga

SEQ ID NO: 3711397 - RNA, 12 nt, Human
gugauauucccc

SEQ ID NO: 3711398 - RNA, 23 nt, Human
gugauauucuuuguuaauuugga

SEQ ID NO: 3711399 - RNA, 20 nt, Human
gugaucaauauuuuuauauc

SEQ ID NO: 3711400 - RNA, 16 nt, Human
gugaucauguguggaa

SEQ ID NO: 3711401 - RNA, 20 nt, Human
gugauccacccaccucagcc

SEQ ID NO: 3711402 - RNA, 24 nt, Human
gugauccacccgccucagccuccc

SEQ ID NO: 3711403 - RNA, 14 nt, Human
gugauccacucgcc

SEQ ID NO: 3711404 - RNA, 16 nt, Human
gugauccauguaacug

SEQ ID NO: 3711405 - RNA, 20 nt, Human
gugauccgcccgccucggcc

SEQ ID NO: 3711406 - RNA, 21 nt, Human
gugauccucucaccucagccu

SEQ ID NO: 3711407 - RNA, 14 nt, Human
gugauccuuuuaug

SEQ ID NO: 3711408 - RNA, 12 nt, Human
gugaucuccaua

SEQ ID NO: 3711409 - RNA, 13 nt, Human
gugaucuccauau

SEQ ID NO: 3711410 - RNA, 12 nt, Human
gugaucugggaa

SEQ ID NO: 3711411 - RNA, 22 nt, Human
gugaucuuggcuuacugcagcc

SEQ ID NO: 3711412 - RNA, 22 nt, Human
gugaugaagaaaagugggccag

SEQ ID NO: 3711413 - RNA, 12 nt, Human
gugaugagcuga

SEQ ID NO: 3711414 - RNA, 16 nt, Human
gugaugagggcagcag

SEQ ID NO: 3711415 - RNA, 18 nt, Human
gugaugagggcagcagcc

SEQ ID NO: 3711416 - RNA, 19 nt, Human
gugaugagggcagcagcca

SEQ ID NO: 3711417 - RNA, 22 nt, Human
gugaugagggcagcagccagcc

SEQ ID NO: 3711418 - RNA, 23 nt, Human
gugaugccagguucuauuuggaa

SEQ ID NO: 3711419 - RNA, 16 nt, Human
gugaugcccugcccuu

SEQ ID NO: 3711420 - RNA, 13 nt, Human
gugaugccucccu

SEQ ID NO: 3711421 - RNA, 12 nt, Human
gugaugcggcag

SEQ ID NO: 3711422 - RNA, 15 nt, Human
gugaugcugggcugg

SEQ ID NO: 3711423 - RNA, 23 nt, Human
gugauggagugcuguuuuguuau

SEQ ID NO: 3711424 - RNA, 16 nt, Human
gugaugguuccccugu

SEQ ID NO: 3711425 - RNA, 19 nt, Human
gugauguauauuccuuuga

SEQ ID NO: 3711426 - RNA, 19 nt, Human
gugauguauguguaauaaa

SEQ ID NO: 3711427 - RNA, 19 nt, Human
gugaugucauacagagaag

SEQ ID NO: 3711428 - RNA, 15 nt, Human
gugauguccuguaaa

SEQ ID NO: 3711429 - RNA, 21 nt, Human
gugauguccuguaaacacuca

SEQ ID NO: 3711430 - RNA, 15 nt, Human
gugaugugaagccaa

SEQ ID NO: 3711431 - RNA, 12 nt, Human
gugauguucuaa

SEQ ID NO: 3711432 - RNA, 18 nt, Human
gugauguucuaaggcucu

SEQ ID NO: 3711433 - RNA, 22 nt, Human
gugauguuuaacaggaagaucu

SEQ ID NO: 3711434 - RNA, 14 nt, Human
ugccucugugcugu

SEQ ID NO: 3711435 - RNA, 16 nt, Human
ugccucugugcugugu

SEQ ID NO: 3711436 - RNA, 17 nt, Human
ugccucugugcugugug

SEQ ID NO: 3711437 - RNA, 15 nt, Human
ugccucuuagacuuc

SEQ ID NO: 3711438 - RNA, 21 nt, Human
ugccucuuccagucuuccuga

SEQ ID NO: 3711439 - RNA, 13 nt, Human
ugccucuucuggg

SEQ ID NO: 3711440 - RNA, 16 nt, Human
ugccucuucugugggu

SEQ ID NO: 3711441 - RNA, 17 nt, Human
ugccugaacauccuucc

SEQ ID NO: 3711442 - RNA, 16 nt, Human
ugccugaaccuuccau

SEQ ID NO: 3711443 - RNA, 17 nt, Human
ugccugaagucacacag

SEQ ID NO: 3711444 - RNA, 15 nt, Human
ugccugaauauuugu

SEQ ID NO: 3711445 - RNA, 19 nt, Human
ugccugacagagggaugga

SEQ ID NO: 3711446 - RNA, 18 nt, Human
ugccugacauuuggagug

SEQ ID NO: 3711447 - RNA, 21 nt, Human
ugccugacugcccagcauuug

SEQ ID NO: 3711448 - RNA, 16 nt, Human
ugccugagaggcaggc

SEQ ID NO: 3711449 - RNA, 17 nt, Human
ugccugagaggcaggca

SEQ ID NO: 3711450 - RNA, 11 nt, Human
ugccugagcuu

SEQ ID NO: 3711451 - RNA, 16 nt, Human
ugccugagggccccuc

SEQ ID NO: 3711452 - RNA, 19 nt, Human
ugccugagggccccucugc

SEQ ID NO: 3711453 - RNA, 20 nt, Human
ugccugagggccccucugcc

SEQ ID NO: 3711454 - RNA, 22 nt, Human
ugccugagggccccucugccca

SEQ ID NO: 3711455 - RNA, 23 nt, Human
ugccugagggccccucugcccag

SEQ ID NO: 3711456 - RNA, 16 nt, Human
ugccugaggggcagcc

SEQ ID NO: 3711457 - RNA, 11 nt, Human
ugccugagggu

SEQ ID NO: 3711458 - RNA, 16 nt, Human
ugccugaggucuguac

SEQ ID NO: 3711459 - RNA, 24 nt, Human
ugccugagucgugaccugcuaggc

SEQ ID NO: 3711460 - RNA, 16 nt, Human
ugccugagugccuggc

SEQ ID NO: 3711461 - RNA, 15 nt, Human
ugccugauauaaaug

SEQ ID NO: 3711462 - RNA, 22 nt, Human
ugccugauauuucccuccccug

SEQ ID NO: 3711463 - RNA, 19 nt, Human
ugccugcacaaacucacca

SEQ ID NO: 3711464 - RNA, 17 nt, Human
ugccugcaccaggagac

SEQ ID NO: 3711465 - RNA, 18 nt, Human
ugccugcaccaggagaca

SEQ ID NO: 3711466 - RNA, 14 nt, Human
ugccugcagagaga

SEQ ID NO: 3711467 - RNA, 21 nt, Human
ugccugcagaggucugugcug

SEQ ID NO: 3711468 - RNA, 11 nt, Human
ugccugcagcc

SEQ ID NO: 3711469 - RNA, 23 nt, Human
ugccugcagggccauggcucagg

SEQ ID NO: 3711470 - RNA, 23 nt, Human
ugccugcauaggaguuuggagga

SEQ ID NO: 3711471 - RNA, 21 nt, Human
ugccugccauguaccuccccu

SEQ ID NO: 3711472 - RNA, 14 nt, Human
ugccugcccacccg

SEQ ID NO: 3711473 - RNA, 13 nt, Human
ugccugcccaggc

SEQ ID NO: 3711474 - RNA, 14 nt, Human
ugccugcccaggcc

SEQ ID NO: 3711475 - RNA, 17 nt, Human
ugccugcccaggccccu

SEQ ID NO: 3711476 - RNA, 22 nt, Human
ugccugcccaggccccugccac

SEQ ID NO: 3711477 - RNA, 24 nt, Human
ugccugcccaggccccugccaccc

SEQ ID NO: 3711478 - RNA, 19 nt, Human
ugccugcccgcacagcagc

SEQ ID NO: 3711479 - RNA, 15 nt, Human
ugccugcccuauucu

SEQ ID NO: 3711480 - RNA, 15 nt, Human
ugccugcccugguga

SEQ ID NO: 3711481 - RNA, 21 nt, Human
ugccugcccuuuguccuccug

SEQ ID NO: 3711482 - RNA, 13 nt, Human
ugccugccugcuc

SEQ ID NO: 3711483 - RNA, 14 nt, Human
ugccugccugucug

SEQ ID NO: 3711484 - RNA, 15 nt, Human
ugccugccugucugu

SEQ ID NO: 3711485 - RNA, 14 nt, Human
ugccugccuuucca

SEQ ID NO: 3711486 - RNA, 15 nt, Human
ugccugccuuuccau

SEQ ID NO: 3711487 - RNA, 22 nt, Human
ugccugccuuuccauccauggc

SEQ ID NO: 3711488 - RNA, 14 nt, Human
ugccugcgcccacc

SEQ ID NO: 3711489 - RNA, 19 nt, Human
ugccugcggaguugugcac

SEQ ID NO: 3711490 - RNA, 17 nt, Human
ugccugcggucaaggcc

SEQ ID NO: 3711491 - RNA, 19 nt, Human
ugccugcggucaaggccag

SEQ ID NO: 3711492 - RNA, 23 nt, Human
ugccugcucuuuggccugaugac

SEQ ID NO: 3711493 - RNA, 23 nt, Human
ugccugcuuuucacugcugcaag

SEQ ID NO: 3711494 - RNA, 15 nt, Human
ugccugcuuuuugga

SEQ ID NO: 3711495 - RNA, 17 nt, Human
ugccugcuuuuuggaaa

SEQ ID NO: 3711496 - RNA, 22 nt, Human
ugccugcuuuuuggaaagucag

SEQ ID NO: 3711497 - RNA, 15 nt, Human
ugccuggacaaaccc

SEQ ID NO: 3711498 - RNA, 20 nt, Human
ugccuggagacuuagggcac

SEQ ID NO: 3711499 - RNA, 11 nt, Human
ugccuggagga

SEQ ID NO: 3711500 - RNA, 19 nt, Human
ugccuggaggaccugagcc

SEQ ID NO: 3711501 - RNA, 22 nt, Human
ugccuggaggaccugagccugc

SEQ ID NO: 3711502 - RNA, 21 nt, Human
ugccuggagugcccacccugg

SEQ ID NO: 3711503 - RNA, 15 nt, Human
ugccuggauggggcu

SEQ ID NO: 3711504 - RNA, 17 nt, Human
ugccuggauggggcugc

SEQ ID NO: 3711505 - RNA, 15 nt, Human
ugccuggcaggcugu

SEQ ID NO: 3711506 - RNA, 23 nt, Human
ugccuggccacugcucccuaagc

SEQ ID NO: 3711507 - RNA, 11 nt, Human
ugccuggcccc

SEQ ID NO: 3711508 - RNA, 19 nt, Human
ugccuggcccccuguccuc

SEQ ID NO: 3711509 - RNA, 18 nt, Human
ugccuggccggccagcca

SEQ ID NO: 3711510 - RNA, 23 nt, Human
ugccuggccggccagccagccac

SEQ ID NO: 3711511 - RNA, 22 nt, Human
ugccuggccuuguccucagcca

SEQ ID NO: 3711512 - RNA, 15 nt, Human
ugccuggcucagagc

SEQ ID NO: 3711513 - RNA, 16 nt, Human
ugccuggcucagagcc

SEQ ID NO: 3711514 - RNA, 18 nt, Human
ugccugggaaccuuccug

SEQ ID NO: 3711515 - RNA, 14 nt, Human
ugccugggaaugua

SEQ ID NO: 3711516 - RNA, 15 nt, Human
ugccugggaauguau

SEQ ID NO: 3711517 - RNA, 16 nt, Human
ugccugggaauguauu

SEQ ID NO: 3711518 - RNA, 22 nt, Human
ugccugggaguuuuguauucau

SEQ ID NO: 3711519 - RNA, 21 nt, Human
ugccugggaucccucauccuc

SEQ ID NO: 3711520 - RNA, 18 nt, Human
ugccugggcagaaggaag

SEQ ID NO: 3711521 - RNA, 16 nt, Human
ugccugggcuguuggc

SEQ ID NO: 3711522 - RNA, 19 nt, Human
ugccugggguguuaguggc

SEQ ID NO: 3711523 - RNA, 16 nt, Human
ugccuggguggggcug

SEQ ID NO: 3711524 - RNA, 17 nt, Human
ugccuggguggggcugc

SEQ ID NO: 3711525 - RNA, 21 nt, Human
ugccuggguggggcugcuccu

SEQ ID NO: 3711526 - RNA, 22 nt, Human
ugccuggguggggcugcuccuc

SEQ ID NO: 3711527 - RNA, 24 nt, Human
ugccuggguggggcugcuccucca

SEQ ID NO: 3711528 - RNA, 22 nt, Human
ugccuggguuccaauccuggcu

SEQ ID NO: 3711529 - RNA, 14 nt, Human
ugccugguacagua

SEQ ID NO: 3711530 - RNA, 18 nt, Human
ugccuggucuccugcccc

SEQ ID NO: 3711531 - RNA, 21 nt, Human
ugccuggucuccugcccccac

SEQ ID NO: 3711532 - RNA, 18 nt, Human
ugccuggugaauggccuu

SEQ ID NO: 3711533 - RNA, 16 nt, Human
ugccugguggcagcug

SEQ ID NO: 3711534 - RNA, 14 nt, Human
ugccugguuuugau

SEQ ID NO: 3711535 - RNA, 22 nt, Human
ugccuguacucgcuugugcaga

SEQ ID NO: 3711536 - RNA, 15 nt, Human
ugccuguagcaguga

SEQ ID NO: 3711537 - RNA, 18 nt, Human
ugccuguagcccacucug

SEQ ID NO: 3711538 - RNA, 20 nt, Human
ugccuguagcccacucugcu

SEQ ID NO: 3711539 - RNA, 15 nt, Human
ugccuguaguuagga

SEQ ID NO: 3711540 - RNA, 18 nt, Human
ugccuguaguuaggaaau

SEQ ID NO: 3711541 - RNA, 19 nt, Human
ugccuguaguuaggaaaua

SEQ ID NO: 3711542 - RNA, 20 nt, Human
ugccuguaguuaggaaauaa

SEQ ID NO: 3711543 - RNA, 21 nt, Human
ugccuguaguuaggaaauaaa

SEQ ID NO: 3711544 - RNA, 22 nt, Human
ugccugucuccuuugcaggcuc

SEQ ID NO: 3711545 - RNA, 23 nt, Human
ugccugucuccuuugcaggcuca

SEQ ID NO: 3711546 - RNA, 14 nt, Human
ugccugucugaagc

SEQ ID NO: 3711547 - RNA, 15 nt, Human
ugccugucugcccca

SEQ ID NO: 3711548 - RNA, 18 nt, Human
ugccugucugucucucca

SEQ ID NO: 3711549 - RNA, 21 nt, Human
ugccugucugucucuccaucu

SEQ ID NO: 3711550 - RNA, 14 nt, Human
ugccugugaacuga

SEQ ID NO: 3711551 - RNA, 18 nt, Human
ugccugugaacugaacuc

SEQ ID NO: 3711552 - RNA, 14 nt, Human
ugccugugccaccc

SEQ ID NO: 3711553 - RNA, 16 nt, Human
ugccugugccacccac

SEQ ID NO: 3711554 - RNA, 12 nt, Human
ugccugugccug

SEQ ID NO: 3711555 - RNA, 22 nt, Human
ugccuguggaagagugugugug

SEQ ID NO: 3711556 - RNA, 18 nt, Human
ugccuguuauaacucugc

SEQ ID NO: 3711557 - RNA, 16 nt, Human
ugccuguucagcucca

SEQ ID NO: 3711558 - RNA, 17 nt, Human
ugccuguucagcuccag

SEQ ID NO: 3711559 - RNA, 12 nt, Human
ugccuguucagu

SEQ ID NO: 3711560 - RNA, 13 nt, Human
ugccuguucaguu

SEQ ID NO: 3711561 - RNA, 21 nt, Human
ugccuguucaguuacagaaag

SEQ ID NO: 3711562 - RNA, 14 nt, Human
ugccuguucccauu

SEQ ID NO: 3711563 - RNA, 17 nt, Human
ugccuguugggccagga

SEQ ID NO: 3711564 - RNA, 14 nt, Human
ugccuguuucccag

SEQ ID NO: 3711565 - RNA, 15 nt, Human
ugccuuaaaaccaaa

SEQ ID NO: 3711566 - RNA, 18 nt, Human
ugccuuaaaaccaaagag

SEQ ID NO: 3711567 - RNA, 15 nt, Human
ugccuuaccuccugc

SEQ ID NO: 3711568 - RNA, 19 nt, Human
ugccuuaccuccugcccag

SEQ ID NO: 3711569 - RNA, 15 nt, Human
ugccuuacucuucuu

SEQ ID NO: 3711570 - RNA, 17 nt, Human
ugccuuacuuuguauga

SEQ ID NO: 3711571 - RNA, 19 nt, Human
ugccuuacuuuguaugaua

SEQ ID NO: 3711572 - RNA, 18 nt, Human
ugccuuagagccaggcac

SEQ ID NO: 3711573 - RNA, 19 nt, Human
ugccuuagagccaggcaca

SEQ ID NO: 3711574 - RNA, 23 nt, Human
ugccuuagagccaggcacacacu

SEQ ID NO: 3711575 - RNA, 19 nt, Human
ugccuuagaggagcccacg

SEQ ID NO: 3711576 - RNA, 14 nt, Human
ugccuuagcuucag

SEQ ID NO: 3711577 - RNA, 20 nt, Human
ugccuuagucucaguuugug

SEQ ID NO: 3711578 - RNA, 21 nt, Human
ugccuuauggaacacucugag

SEQ ID NO: 3711579 - RNA, 17 nt, Human
ugccuuauguugaaaaa

SEQ ID NO: 3711580 - RNA, 18 nt, Human
ugccuuauucagggaagg

SEQ ID NO: 3711581 - RNA, 12 nt, Human
ugccuucaagaa

SEQ ID NO: 3711582 - RNA, 14 nt, Human
ugccuucaauaaau

SEQ ID NO: 3711583 - RNA, 15 nt, Human
ugccuuccagaaaac

SEQ ID NO: 3711584 - RNA, 18 nt, Human
ugccuuccagcacccugc

SEQ ID NO: 3711585 - RNA, 21 nt, Human
ugccuuccauaauuaugacag

SEQ ID NO: 3711586 - RNA, 20 nt, Human
ugccuuccaugucggccucu

SEQ ID NO: 3711587 - RNA, 15 nt, Human
ugccuuccccugggc

SEQ ID NO: 3711588 - RNA, 20 nt, Human
ugccuuccccugggcccuga

SEQ ID NO: 3711589 - RNA, 16 nt, Human
ugccuucccuagcuuu

SEQ ID NO: 3711590 - RNA, 17 nt, Human
ugccuucccuagcuuua

SEQ ID NO: 3711591 - RNA, 17 nt, Human
ugccuuccuccugggcc

SEQ ID NO: 3711592 - RNA, 20 nt, Human
ugccuuccuccugggcccuc

SEQ ID NO: 3711593 - RNA, 19 nt, Human
ugccuuccuguuuuucaca

SEQ ID NO: 3711594 - RNA, 16 nt, Human
ugccuucgcuucuugc

SEQ ID NO: 3711595 - RNA, 20 nt, Human
ugccuucgcuucuugccucu

SEQ ID NO: 3711596 - RNA, 21 nt, Human
ugccuucgcuucuugccucug

SEQ ID NO: 3711597 - RNA, 22 nt, Human
ugccuucgcuucuugccucugu

SEQ ID NO: 3711598 - RNA, 18 nt, Human
ugccuucgguacccacca

SEQ ID NO: 3711599 - RNA, 15 nt, Human
ugccuucucaacucc

SEQ ID NO: 3711600 - RNA, 22 nt, Human
ugccuucucaacuccaaacuga

SEQ ID NO: 3711601 - RNA, 16 nt, Human
ugccuucucaccagcu

SEQ ID NO: 3711602 - RNA, 18 nt, Human
ugccuucucaccagcugc

SEQ ID NO: 3711603 - RNA, 13 nt, Human
ugccuucucucuc

SEQ ID NO: 3711604 - RNA, 18 nt, Human
ugccuucugacggcccug

SEQ ID NO: 3711605 - RNA, 18 nt, Human
ugccuucuguccuggugu

SEQ ID NO: 3711606 - RNA, 20 nt, Human
ugccuucuguccugguguca

SEQ ID NO: 3711607 - RNA, 22 nt, Human
ugccuucuguggggacuccggc

SEQ ID NO: 3711608 - RNA, 17 nt, Human
ugccuucuucagggccu

SEQ ID NO: 3711609 - RNA, 19 nt, Human
ugccuucuucagggccugg

SEQ ID NO: 3711610 - RNA, 12 nt, Human
ugccuucuucuu

SEQ ID NO: 3711611 - RNA, 21 nt, Human
ugccuucuucuuuuugcuguu

SEQ ID NO: 3711612 - RNA, 14 nt, Human
ugccuucuuuugua

SEQ ID NO: 3711613 - RNA, 23 nt, Human
ugccuugaaccugugaguaaaua

SEQ ID NO: 3711614 - RNA, 14 nt, Human
ugccuugaagccac

SEQ ID NO: 3711615 - RNA, 15 nt, Human
ugccuugaagccacu

SEQ ID NO: 3711616 - RNA, 14 nt, Human
ugccuugacaaacu

SEQ ID NO: 3711617 - RNA, 14 nt, Human
ugccuugagguacu

SEQ ID NO: 3711618 - RNA, 20 nt, Human
ugccuugcauaauggucaga

SEQ ID NO: 3711619 - RNA, 19 nt, Human
ugccuugcccacuccugcu

SEQ ID NO: 3711620 - RNA, 13 nt, Human
ugccuugccuuua

SEQ ID NO: 3711621 - RNA, 13 nt, Human
ugccuuggcucag

SEQ ID NO: 3711622 - RNA, 16 nt, Human
ugccuugggcugcucc

SEQ ID NO: 3711623 - RNA, 18 nt, Human
ugccuuggggaauuuccu

SEQ ID NO: 3711624 - RNA, 16 nt, Human
ugccuuggugugcugu

SEQ ID NO: 3711625 - RNA, 17 nt, Human
ugccuugucacgccaga

SEQ ID NO: 3711626 - RNA, 19 nt, Human
ugccuugugaaggaauuau

SEQ ID NO: 3711627 - RNA, 15 nt, Human
ugccuuuaaaucugu

SEQ ID NO: 3711628 - RNA, 11 nt, Human
ugccuuuagaa

SEQ ID NO: 3711629 - RNA, 20 nt, Human
ugccuuuagccccucccaag

SEQ ID NO: 3711630 - RNA, 20 nt, Human
ugccuuuauuguguuuguca

SEQ ID NO: 3711631 - RNA, 20 nt, Human
ugccuuuccauccauggcca

SEQ ID NO: 3711632 - RNA, 22 nt, Human
ugccuuuccauccauggccagc

SEQ ID NO: 3711633 - RNA, 16 nt, Human
ugccuuucgaggccug

SEQ ID NO: 3711634 - RNA, 17 nt, Human
ugccuuucgaggccuga

SEQ ID NO: 3711635 - RNA, 13 nt, Human
ugccuuucuaguc

SEQ ID NO: 3711636 - RNA, 20 nt, Human
ugccuuucucgauuuuaucu

SEQ ID NO: 3711637 - RNA, 12 nt, Human
ugccuuugaaga

SEQ ID NO: 3711638 - RNA, 18 nt, Human
ugccuuugaagagugaaa

SEQ ID NO: 3711639 - RNA, 18 nt, Human
ugccuuugagacaguuuc

SEQ ID NO: 3711640 - RNA, 19 nt, Human
ugccuuugagacaguuucu

SEQ ID NO: 3711641 - RNA, 23 nt, Human
ugccuuugagacaguuucuuagc

SEQ ID NO: 3711642 - RNA, 18 nt, Human
ugccuuugaguuuccuca

SEQ ID NO: 3711643 - RNA, 19 nt, Human
ugccuuugcaccacgggac

SEQ ID NO: 3711644 - RNA, 18 nt, Human
ugccuuugcagaaacaga

SEQ ID NO: 3711645 - RNA, 18 nt, Human
ugccuuugcagcucagaa

SEQ ID NO: 3711646 - RNA, 12 nt, Human
ugccuuugggag

SEQ ID NO: 3711647 - RNA, 15 nt, Human
ugccuuuguuuugau

SEQ ID NO: 3711648 - RNA, 18 nt, Human
ugccuuuuaguuccugug

SEQ ID NO: 3711649 - RNA, 17 nt, Human
ugccuuuuauagcuauu

SEQ ID NO: 3711650 - RNA, 22 nt, Human
ugccuuuuauagcuauuacugu

SEQ ID NO: 3711651 - RNA, 15 nt, Human
ugccuuuucuagccc

SEQ ID NO: 3711652 - RNA, 14 nt, Human
ugccuuuugcaccc

SEQ ID NO: 3711653 - RNA, 18 nt, Human
ugccuuuugcaccccucc

SEQ ID NO: 3711654 - RNA, 19 nt, Human
ugccuuuugcaccccuccc

SEQ ID NO: 3711655 - RNA, 22 nt, Human
ugccuuuugcaccccucccauu

SEQ ID NO: 3711656 - RNA, 16 nt, Human
ugccuuuugcagaaga

SEQ ID NO: 3711657 - RNA, 19 nt, Human
ugccuuuugcagaagaggg

SEQ ID NO: 3711658 - RNA, 19 nt, Human
ugccuuuuuauuuauaugu

SEQ ID NO: 3711659 - RNA, 14 nt, Human
ugccuuuuucauua

SEQ ID NO: 3711660 - RNA, 19 nt, Human
ugccuuuuucauuuuccaa

SEQ ID NO: 3711661 - RNA, 13 nt, Human
ugccuuuuuccua

SEQ ID NO: 3711662 - RNA, 20 nt, Human
ugcgaagacccucuugccca

SEQ ID NO: 3711663 - RNA, 21 nt, Human
ugcgaaggggcccugguccuu

SEQ ID NO: 3711664 - RNA, 18 nt, Human
ugcgaccccaucugccca

SEQ ID NO: 3711665 - RNA, 14 nt, Human
ugcgacccuggggg

SEQ ID NO: 3711666 - RNA, 15 nt, Human
ugcgacgcuugcucu

SEQ ID NO: 3711667 - RNA, 16 nt, Human
ugcgacuuucugccug

SEQ ID NO: 3711668 - RNA, 21 nt, Human
ugcgacuuucugccuggagug

SEQ ID NO: 3711669 - RNA, 15 nt, Human
ugcgagagaugugug

SEQ ID NO: 3711670 - RNA, 16 nt, Human
ugcgagagaugugugu

SEQ ID NO: 3711671 - RNA, 23 nt, Human
ugcgagagauguguguugauacu

SEQ ID NO: 3711672 - RNA, 15 nt, Human
ugcgaguauguguuu

SEQ ID NO: 3711673 - RNA, 13 nt, Human
ugcgagugugugc

SEQ ID NO: 3711674 - RNA, 16 nt, Human
ugcgauagagucucac

SEQ ID NO: 3711675 - RNA, 14 nt, Human
ugcgaucuggguuc

SEQ ID NO: 3711676 - RNA, 22 nt, Human
ugcgauggcgugggcugcguga

SEQ ID NO: 3711677 - RNA, 12 nt, Human
ugcgauucugga

SEQ ID NO: 3711678 - RNA, 21 nt, Human
ugcgauucuggauaaagccac

SEQ ID NO: 3711679 - RNA, 17 nt, Human
uggcuaugcauuugaaa

SEQ ID NO: 3711680 - RNA, 19 nt, Human
uggcuaugcauuugaaaau

SEQ ID NO: 3711681 - RNA, 12 nt, Human
uggcuauuuuau

SEQ ID NO: 3711682 - RNA, 18 nt, Human
uggcucaaguccucuuuu

SEQ ID NO: 3711683 - RNA, 14 nt, Human
uggcucacacugag

SEQ ID NO: 3711684 - RNA, 15 nt, Human
uggcucacacugaga

SEQ ID NO: 3711685 - RNA, 16 nt, Human
uggcucacacugagaa

SEQ ID NO: 3711686 - RNA, 13 nt, Human
uggcucacccagu

SEQ ID NO: 3711687 - RNA, 19 nt, Human
uggcucacgccuguaaucc

SEQ ID NO: 3711688 - RNA, 13 nt, Human
uggcucacugcag

SEQ ID NO: 3711689 - RNA, 17 nt, Human
uggcucacugcagccuc

SEQ ID NO: 3711690 - RNA, 13 nt, Human
uggcucagagggg

SEQ ID NO: 3711691 - RNA, 12 nt, Human
uggcucagccag

SEQ ID NO: 3711692 - RNA, 22 nt, Human
uggcucagcucggggagccuua

SEQ ID NO: 3711693 - RNA, 22 nt, Human
uggcucagguggggucacucug

SEQ ID NO: 3711694 - RNA, 22 nt, Human
uggcucauauuccugcagccug

SEQ ID NO: 3711695 - RNA, 17 nt, Human
uggcuccacacacacaa

SEQ ID NO: 3711696 - RNA, 20 nt, Human
uggcuccagaugcagggcag

SEQ ID NO: 3711697 - RNA, 21 nt, Human
uggcuccagaugcagggcagu

SEQ ID NO: 3711698 - RNA, 23 nt, Human
uggcuccagaugcagggcaguca

SEQ ID NO: 3711699 - RNA, 13 nt, Human
uggcuccagcacc

SEQ ID NO: 3711700 - RNA, 21 nt, Human
uggcuccagcaccauccgcca

SEQ ID NO: 3711701 - RNA, 17 nt, Human
uggcuccagcuggccgg

SEQ ID NO: 3711702 - RNA, 15 nt, Human
uggcuccaggccagg

SEQ ID NO: 3711703 - RNA, 15 nt, Human
uggcuccaugcuccu

SEQ ID NO: 3711704 - RNA, 14 nt, Human
uggcucccacaggc

SEQ ID NO: 3711705 - RNA, 18 nt, Human
uggcucccacaggcagcu

SEQ ID NO: 3711706 - RNA, 19 nt, Human
uggcucccaggggcucccu

SEQ ID NO: 3711707 - RNA, 21 nt, Human
uggcucccaggggcucccucc

SEQ ID NO: 3711708 - RNA, 23 nt, Human
uggcucccaugaccauacugagg

SEQ ID NO: 3711709 - RNA, 17 nt, Human
uggcucccauucacucu

SEQ ID NO: 3711710 - RNA, 15 nt, Human
uggcuccccaaaggg

SEQ ID NO: 3711711 - RNA, 13 nt, Human
uggcuccccucua

SEQ ID NO: 3711712 - RNA, 14 nt, Human
uggcuccccucuau

SEQ ID NO: 3711713 - RNA, 21 nt, Human
uggcuccccucuauuuagcau

SEQ ID NO: 3711714 - RNA, 23 nt, Human
uggcuccccucuauuuagcauga

SEQ ID NO: 3711715 - RNA, 13 nt, Human
uggcuccccugca

SEQ ID NO: 3711716 - RNA, 12 nt, Human
uggcuccccugg

SEQ ID NO: 3711717 - RNA, 13 nt, Human
uggcuccccuggg

SEQ ID NO: 3711718 - RNA, 15 nt, Human
uggcucccuccucca

SEQ ID NO: 3711719 - RNA, 19 nt, Human
uggcucccuccuccaggcc

SEQ ID NO: 3711720 - RNA, 20 nt, Human
uggcucccuccuccaggccu

SEQ ID NO: 3711721 - RNA, 17 nt, Human
uggcucccucuucuuuc

SEQ ID NO: 3711722 - RNA, 19 nt, Human
uggcuccggccucugccuu

SEQ ID NO: 3711723 - RNA, 16 nt, Human
uggcuccuaucugugu

SEQ ID NO: 3711724 - RNA, 16 nt, Human
uggcuccucccggugc

SEQ ID NO: 3711725 - RNA, 22 nt, Human
uggcuccucuguggugucugcc

SEQ ID NO: 3711726 - RNA, 14 nt, Human
uggcuccugagggg

SEQ ID NO: 3711727 - RNA, 15 nt, Human
uggcuccuuuacaaa

SEQ ID NO: 3711728 - RNA, 20 nt, Human
uggcucgaaucucugugccu

SEQ ID NO: 3711729 - RNA, 19 nt, Human
uggcucuaauucacagugc

SEQ ID NO: 3711730 - RNA, 16 nt, Human
uggcucucagaaggua

SEQ ID NO: 3711731 - RNA, 21 nt, Human
uggcucucaguuaaaauguga

SEQ ID NO: 3711732 - RNA, 13 nt, Human
uggcucuccaagu

SEQ ID NO: 3711733 - RNA, 15 nt, Human
uggcucuccaagugc

SEQ ID NO: 3711734 - RNA, 20 nt, Human
uggcucuccaagugccagag

SEQ ID NO: 3711735 - RNA, 23 nt, Human
uggcucuccaagugccagaggug

SEQ ID NO: 3711736 - RNA, 19 nt, Human
uggcucugaccgaaacagc

SEQ ID NO: 3711737 - RNA, 14 nt, Human
uggcucugcaaugg

SEQ ID NO: 3711738 - RNA, 19 nt, Human
uggcucugccaguccuguc

SEQ ID NO: 3711739 - RNA, 12 nt, Human
uggcucugcugg

SEQ ID NO: 3711740 - RNA, 19 nt, Human
uggcucugcuguccccuug

SEQ ID NO: 3711741 - RNA, 17 nt, Human
uggcucuggaaugacau

SEQ ID NO: 3711742 - RNA, 15 nt, Human
uggcucuggacucua

SEQ ID NO: 3711743 - RNA, 22 nt, Human
uggcucuggagacagccccaga

SEQ ID NO: 3711744 - RNA, 15 nt, Human
uggcucugggauccu

SEQ ID NO: 3711745 - RNA, 15 nt, Human
uggcucuuccaggcu

SEQ ID NO: 3711746 - RNA, 20 nt, Human
uggcugaaauucuccuggag

SEQ ID NO: 3711747 - RNA, 13 nt, Human
uggcugaacucau

SEQ ID NO: 3711748 - RNA, 12 nt, Human
uggcugaaggac

SEQ ID NO: 3711749 - RNA, 13 nt, Human
uggcugaaggacu

SEQ ID NO: 3711750 - RNA, 15 nt, Human
uggcugaaggacugu

SEQ ID NO: 3711751 - RNA, 16 nt, Human
uggcugaaggacugug

SEQ ID NO: 3711752 - RNA, 16 nt, Human
uggcugacccaguccc

SEQ ID NO: 3711753 - RNA, 17 nt, Human
uggcugacccagucccu

SEQ ID NO: 3711754 - RNA, 19 nt, Human
uggcugacccagucccugg

SEQ ID NO: 3711755 - RNA, 21 nt, Human
uggcugacccagucccugggg

SEQ ID NO: 3711756 - RNA, 21 nt, Human
uggcugaccccaaagagccug

SEQ ID NO: 3711757 - RNA, 15 nt, Human
uggcugaccccccuc

SEQ ID NO: 3711758 - RNA, 16 nt, Human
uggcugaccccccuca

SEQ ID NO: 3711759 - RNA, 15 nt, Human
uggcugacuaaauuu

SEQ ID NO: 3711760 - RNA, 20 nt, Human
uggcugacuaaauuugggga

SEQ ID NO: 3711761 - RNA, 22 nt, Human
uggcugacuaaauuuggggaca

SEQ ID NO: 3711762 - RNA, 13 nt, Human
uggcugagccccu

SEQ ID NO: 3711763 - RNA, 17 nt, Human
uggcugagccccugucu

SEQ ID NO: 3711764 - RNA, 19 nt, Human
uggcugagcggaugcaucu

SEQ ID NO: 3711765 - RNA, 13 nt, Human
uggcugagggcag

SEQ ID NO: 3711766 - RNA, 15 nt, Human
uggcugagggcagcu

SEQ ID NO: 3711767 - RNA, 23 nt, Human
uggcugagggcagcugcgcgggc

SEQ ID NO: 3711768 - RNA, 23 nt, Human
uggcugagggcaguucgcagcca

SEQ ID NO: 3711769 - RNA, 18 nt, Human
uggcugagguuccucugc

SEQ ID NO: 3711770 - RNA, 20 nt, Human
uggcugagguuccucugccu

SEQ ID NO: 3711771 - RNA, 23 nt, Human
uggcugagguuccucugccugcc

SEQ ID NO: 3711772 - RNA, 12 nt, Human
uggcugcaaagg

SEQ ID NO: 3711773 - RNA, 22 nt, Human
uggcugcagagcagugggccug

SEQ ID NO: 3711774 - RNA, 14 nt, Human
uggcugcaggaauc

SEQ ID NO: 3711775 - RNA, 16 nt, Human
uggcugcaggaaucuu

SEQ ID NO: 3711776 - RNA, 19 nt, Human
uggcugcaggaaucuuuaa

SEQ ID NO: 3711777 - RNA, 20 nt, Human
uggcugcaucccccccaccu

SEQ ID NO: 3711778 - RNA, 12 nt, Human
uggcugcaugcg

SEQ ID NO: 3711779 - RNA, 20 nt, Human
uggcugccaaugggagcuca

SEQ ID NO: 3711780 - RNA, 14 nt, Human
uggcugccagcuau

SEQ ID NO: 3711781 - RNA, 20 nt, Human
uggcugcccagaccccucug

SEQ ID NO: 3711782 - RNA, 13 nt, Human
uggcugcccuggc

SEQ ID NO: 3711783 - RNA, 14 nt, Human
uggcugcccuggcc

SEQ ID NO: 3711784 - RNA, 16 nt, Human
uggcugcccuggcccu

SEQ ID NO: 3711785 - RNA, 14 nt, Human
uggcugccuggagc

SEQ ID NO: 3711786 - RNA, 16 nt, Human
uggcugcggcacccuu

SEQ ID NO: 3711787 - RNA, 17 nt, Human
uggcugcggcacccuug

SEQ ID NO: 3711788 - RNA, 13 nt, Human
uggcugcuagcac

SEQ ID NO: 3711789 - RNA, 14 nt, Human
uggcugcuagcacu

SEQ ID NO: 3711790 - RNA, 12 nt, Human
uggcugcugaag

SEQ ID NO: 3711791 - RNA, 21 nt, Human
uggcugcugaagcugccugcu

SEQ ID NO: 3711792 - RNA, 22 nt, Human
uggcugcugaagcugccugcuu

SEQ ID NO: 3711793 - RNA, 20 nt, Human
uggcugcugaucgccuuccc

SEQ ID NO: 3711794 - RNA, 11 nt, Human
uggcugcugcc

SEQ ID NO: 3711795 - RNA, 12 nt, Human
uggcugcugccc

SEQ ID NO: 3711796 - RNA, 15 nt, Human
uggcugcugccccca

SEQ ID NO: 3711797 - RNA, 20 nt, Human
uggcugcugcccccaccccg

SEQ ID NO: 3711798 - RNA, 19 nt, Human
uggcuggaagauccugcgg

SEQ ID NO: 3711799 - RNA, 13 nt, Human
uggcuggaagggg

SEQ ID NO: 3711800 - RNA, 14 nt, Human
uggcuggacccagc

SEQ ID NO: 3711801 - RNA, 23 nt, Human
uggcuggccuugugguccaaaua

SEQ ID NO: 3711802 - RNA, 17 nt, Human
uggcuggcugagggcag

SEQ ID NO: 3711803 - RNA, 18 nt, Human
uggcuggcugagggcagu

SEQ ID NO: 3711804 - RNA, 21 nt, Human
uggcugggaacugcagaccug

SEQ ID NO: 3711805 - RNA, 19 nt, Human
uggcugggacguggcucag

SEQ ID NO: 3711806 - RNA, 12 nt, Human
uggcugggcaug

SEQ ID NO: 3711807 - RNA, 12 nt, Human
uggcugggccca

SEQ ID NO: 3711808 - RNA, 14 nt, Human
uggcuggggcaugg

SEQ ID NO: 3711809 - RNA, 22 nt, Human
uggcuggggccuaucagugugc

SEQ ID NO: 3711810 - RNA, 12 nt, Human
uggcugggggcc

SEQ ID NO: 3711811 - RNA, 21 nt, Human
uggcugggggccucagugcca

SEQ ID NO: 3711812 - RNA, 18 nt, Human
uggcugggguggccugug

SEQ ID NO: 3711813 - RNA, 20 nt, Human
uggcugggguggccugugug

SEQ ID NO: 3711814 - RNA, 22 nt, Human
uggcugguaacaguucauguuu

SEQ ID NO: 3711815 - RNA, 14 nt, Human
uggcuggucaacuu

SEQ ID NO: 3711816 - RNA, 13 nt, Human
uggcugguccagg

SEQ ID NO: 3711817 - RNA, 22 nt, Human
uggcuggugugguacagagaag

SEQ ID NO: 3711818 - RNA, 23 nt, Human
uggcuggugugguacagagaagc

SEQ ID NO: 3711819 - RNA, 19 nt, Human
uggcugguguuaacagaag

SEQ ID NO: 3711820 - RNA, 20 nt, Human
uggcuguaaggcucuagauc

SEQ ID NO: 3711821 - RNA, 17 nt, Human
uggcuguaucuuguuuu

SEQ ID NO: 3711822 - RNA, 14 nt, Human
uggcugucagcagg

SEQ ID NO: 3711823 - RNA, 15 nt, Human
uggcuguccagugcc

SEQ ID NO: 3711824 - RNA, 23 nt, Human
uggcuguccagugcccauuccuc

SEQ ID NO: 3711825 - RNA, 14 nt, Human
uggcugugaacuga

SEQ ID NO: 3711826 - RNA, 16 nt, Human
uggcugugccucugcc

SEQ ID NO: 3711827 - RNA, 21 nt, Human
uggcuguggaauaggaacgcu

SEQ ID NO: 3711828 - RNA, 14 nt, Human
uggcugugucuccc

SEQ ID NO: 3711829 - RNA, 22 nt, Human
uggcuguguucuggugaggccu

SEQ ID NO: 3711830 - RNA, 18 nt, Human
gugcugagucugaaggcu

SEQ ID NO: 3711831 - RNA, 19 nt, Human
gugcugagucugaaggcug

SEQ ID NO: 3711832 - RNA, 15 nt, Human
gugcugauccuugca

SEQ ID NO: 3711833 - RNA, 22 nt, Human
gugcugcagggcuuuaaaauuc

SEQ ID NO: 3711834 - RNA, 12 nt, Human
gugcugccacac

SEQ ID NO: 3711835 - RNA, 19 nt, Human
gugcugccauccagguuca

SEQ ID NO: 3711836 - RNA, 21 nt, Human
gugcugccauuugauuuuucu

SEQ ID NO: 3711837 - RNA, 18 nt, Human
gugcugcccgucuucagc

SEQ ID NO: 3711838 - RNA, 11 nt, Human
gugcugcccug

SEQ ID NO: 3711839 - RNA, 21 nt, Human
gugcugcccugcccaccuggc

SEQ ID NO: 3711840 - RNA, 23 nt, Human
gugcugcccugcccaccuggccu

SEQ ID NO: 3711841 - RNA, 12 nt, Human
gugcugccucua

SEQ ID NO: 3711842 - RNA, 19 nt, Human
gugcugccucuaccugaca

SEQ ID NO: 3711843 - RNA, 17 nt, Human
gugcugcuaauucuuug

SEQ ID NO: 3711844 - RNA, 18 nt, Human
gugcugcuaauucuuugc

SEQ ID NO: 3711845 - RNA, 19 nt, Human
gugcugcuacccucccugc

SEQ ID NO: 3711846 - RNA, 22 nt, Human
gugcugcuacccucccugcugu

SEQ ID NO: 3711847 - RNA, 20 nt, Human
gugcugcugcugcuguggcg

SEQ ID NO: 3711848 - RNA, 13 nt, Human
gugcugcuucccu

SEQ ID NO: 3711849 - RNA, 16 nt, Human
gugcugcuucccucug

SEQ ID NO: 3711850 - RNA, 16 nt, Human
gugcuggagcacuggg

SEQ ID NO: 3711851 - RNA, 22 nt, Human
gugcuggagcacugggcucccg

SEQ ID NO: 3711852 - RNA, 12 nt, Human
gugcuggagcca

SEQ ID NO: 3711853 - RNA, 15 nt, Human
gugcuggagccacua

SEQ ID NO: 3711854 - RNA, 19 nt, Human
gugcuggagccacuaacua

SEQ ID NO: 3711855 - RNA, 14 nt, Human
gugcuggaggacug

SEQ ID NO: 3711856 - RNA, 21 nt, Human
gugcuggauauuuuacuacca

SEQ ID NO: 3711857 - RNA, 19 nt, Human
gugcuggauggagcccagg

SEQ ID NO: 3711858 - RNA, 18 nt, Human
gugcuggcaccaccaggc

SEQ ID NO: 3711859 - RNA, 18 nt, Human
gugcugggacugagccag

SEQ ID NO: 3711860 - RNA, 20 nt, Human
gugcugggacugagccaguc

SEQ ID NO: 3711861 - RNA, 23 nt, Human
gugcugggagcuccacucugcuu

SEQ ID NO: 3711862 - RNA, 17 nt, Human
gugcugggaggagggag

SEQ ID NO: 3711863 - RNA, 18 nt, Human
gugcugggaggagggaga

SEQ ID NO: 3711864 - RNA, 16 nt, Human
gugcugggccccugcc

SEQ ID NO: 3711865 - RNA, 21 nt, Human
gugcugggggaaugagcccag

SEQ ID NO: 3711866 - RNA, 20 nt, Human
gugcuggucccggggccagc

SEQ ID NO: 3711867 - RNA, 19 nt, Human
gugcugguguccugaccac

SEQ ID NO: 3711868 - RNA, 23 nt, Human
gugcugguguccugaccacccuc

SEQ ID NO: 3711869 - RNA, 12 nt, Human
gugcuguaauuu

SEQ ID NO: 3711870 - RNA, 21 nt, Human
gugcuguauaaaaucagccaa

SEQ ID NO: 3711871 - RNA, 15 nt, Human
gugcugugcccaagu

SEQ ID NO: 3711872 - RNA, 11 nt, Human
gugcuguggcc

SEQ ID NO: 3711873 - RNA, 17 nt, Human
gugcuguggccagggug

SEQ ID NO: 3711874 - RNA, 23 nt, Human
gugcuguggccagggugagagcu

SEQ ID NO: 3711875 - RNA, 13 nt, Human
gugcuguguaaag

SEQ ID NO: 3711876 - RNA, 14 nt, Human
gugcuguguaaagu

SEQ ID NO: 3711877 - RNA, 18 nt, Human
gugcuguguaaaguuagu

SEQ ID NO: 3711878 - RNA, 19 nt, Human
gugcuguguuugcuccccu

SEQ ID NO: 3711879 - RNA, 17 nt, Human
gugcuguuacaguuuuc

SEQ ID NO: 3711880 - RNA, 19 nt, Human
gugcuguugucauugcuuu

SEQ ID NO: 3711881 - RNA, 20 nt, Human
gugcuguugucauugcuuua

SEQ ID NO: 3711882 - RNA, 14 nt, Human
gugcuguuguuaug

SEQ ID NO: 3711883 - RNA, 19 nt, Human
gugcuguuguuaugaugug

SEQ ID NO: 3711884 - RNA, 20 nt, Human
gugcuguuguuaugaugugc

SEQ ID NO: 3711885 - RNA, 15 nt, Human
gugcuguuuauuaau

SEQ ID NO: 3711886 - RNA, 14 nt, Human
gugcuuaaguucca

SEQ ID NO: 3711887 - RNA, 15 nt, Human
gugcuucaauuaaua

SEQ ID NO: 3711888 - RNA, 13 nt, Human
gugcuucagccug

SEQ ID NO: 3711889 - RNA, 18 nt, Human
gugcuucagccugaggcu

SEQ ID NO: 3711890 - RNA, 14 nt, Human
gugcuucuuucuuu

SEQ ID NO: 3711891 - RNA, 13 nt, Human
gugcuugaaggcc

SEQ ID NO: 3711892 - RNA, 15 nt, Human
gugcuugaaggcccu

SEQ ID NO: 3711893 - RNA, 14 nt, Human
gugcuugagccagg

SEQ ID NO: 3711894 - RNA, 18 nt, Human
gugcuugauagaaaugcc

SEQ ID NO: 3711895 - RNA, 13 nt, Human
gugcuuggaggaa

SEQ ID NO: 3711896 - RNA, 14 nt, Human
gugcuuggaggaag

SEQ ID NO: 3711897 - RNA, 15 nt, Human
gugcuuggaggaagg

SEQ ID NO: 3711898 - RNA, 19 nt, Human
gugcuuggcccaggaguuu

SEQ ID NO: 3711899 - RNA, 14 nt, Human
gugcuugucccugu

SEQ ID NO: 3711900 - RNA, 13 nt, Human
gugcuuguguaau

SEQ ID NO: 3711901 - RNA, 14 nt, Human
gugcuuguguaauu

SEQ ID NO: 3711902 - RNA, 19 nt, Human
gugcuuguuuacagcacua

SEQ ID NO: 3711903 - RNA, 22 nt, Human
gugcuuguuugcucaccugggg

SEQ ID NO: 3711904 - RNA, 13 nt, Human
gugcuuuauauuu

SEQ ID NO: 3711905 - RNA, 14 nt, Human
gugcuuuaugcuga

SEQ ID NO: 3711906 - RNA, 14 nt, Human
gugcuuuccagcuc

SEQ ID NO: 3711907 - RNA, 18 nt, Human
gugcuuuccagcucaccc

SEQ ID NO: 3711908 - RNA, 15 nt, Human
gugcuuugagagaga

SEQ ID NO: 3711909 - RNA, 17 nt, Human
gugcuuugagagagaaa

SEQ ID NO: 3711910 - RNA, 18 nt, Human
gugcuuuuuauaaaaaga

SEQ ID NO: 3711911 - RNA, 14 nt, Human
guggaaaauaacuc

SEQ ID NO: 3711912 - RNA, 15 nt, Human
guggaaagccucugc

SEQ ID NO: 3711913 - RNA, 20 nt, Human
guggaaagggugcugcuucc

SEQ ID NO: 3711914 - RNA, 20 nt, Human
guggaaaguguaaagcauuc

SEQ ID NO: 3711915 - RNA, 18 nt, Human
guggaaaugcgcaugagu

SEQ ID NO: 3711916 - RNA, 21 nt, Human
guggaaauuaagaagaaacua

SEQ ID NO: 3711917 - RNA, 20 nt, Human
guggaacauaaaaaggacau

SEQ ID NO: 3711918 - RNA, 14 nt, Human
guggaaccucuguc

SEQ ID NO: 3711919 - RNA, 15 nt, Human
guggaaccucugucu

SEQ ID NO: 3711920 - RNA, 23 nt, Human
guggaacuacauuaguacacagc

SEQ ID NO: 3711921 - RNA, 18 nt, Human
guggaagaagggagaaga

SEQ ID NO: 3711922 - RNA, 20 nt, Human
guggaagaagggagaagaaa

SEQ ID NO: 3711923 - RNA, 17 nt, Human
guggaagcccuccuucc

SEQ ID NO: 3711924 - RNA, 12 nt, Human
guggaaggaaag

SEQ ID NO: 3711925 - RNA, 15 nt, Human
guggaaggcagacag

SEQ ID NO: 3711926 - RNA, 20 nt, Human
guggaaggcagacagcaggc

SEQ ID NO: 3711927 - RNA, 15 nt, Human
guggaaguguggguc

SEQ ID NO: 3711928 - RNA, 20 nt, Human
guggaagugugggucugugu

SEQ ID NO: 3711929 - RNA, 22 nt, Human
guggaagugugggucugugugu

SEQ ID NO: 3711930 - RNA, 21 nt, Human
guggaauaguauccuccaggu

SEQ ID NO: 3711931 - RNA, 23 nt, Human
guggaauaguauccuccagguuu

SEQ ID NO: 3711932 - RNA, 13 nt, Human
guggaauauaaag

SEQ ID NO: 3711933 - RNA, 14 nt, Human
guggaaugagugug

SEQ ID NO: 3711934 - RNA, 17 nt, Human
guggaauguuggauaag

SEQ ID NO: 3711935 - RNA, 18 nt, Human
guggaauuauuuuaaaag

SEQ ID NO: 3711936 - RNA, 20 nt, Human
guggaauuauuuuaaaagau

SEQ ID NO: 3711937 - RNA, 23 nt, Human
guggaauuucuuguuucuccaga

SEQ ID NO: 3711938 - RNA, 20 nt, Human
guggacaaacuggagucugg

SEQ ID NO: 3711939 - RNA, 16 nt, Human
guggacacacacagac

SEQ ID NO: 3711940 - RNA, 15 nt, Human
guggacacagcucuu

SEQ ID NO: 3711941 - RNA, 23 nt, Human
guggacacagcucuucuccaggc

SEQ ID NO: 3711942 - RNA, 12 nt, Human
guggacaccugc

SEQ ID NO: 3711943 - RNA, 18 nt, Human
guggacaccugcccugcc

SEQ ID NO: 3711944 - RNA, 15 nt, Human
guggacaguccuggg

SEQ ID NO: 3711945 - RNA, 20 nt, Human
guggaccaauuauugauaua

SEQ ID NO: 3711946 - RNA, 18 nt, Human
guggaccaggacaggacc

SEQ ID NO: 3711947 - RNA, 19 nt, Human
guggaccucuacuuuccag

SEQ ID NO: 3711948 - RNA, 14 nt, Human
guggacucagggca

SEQ ID NO: 3711949 - RNA, 15 nt, Human
guggacucagggcag

SEQ ID NO: 3711950 - RNA, 16 nt, Human
guggacucagggcagc

SEQ ID NO: 3711951 - RNA, 21 nt, Human
guggacucagggcagcgccag

SEQ ID NO: 3711952 - RNA, 14 nt, Human
guggacuccagacu

SEQ ID NO: 3711953 - RNA, 14 nt, Human
guggacucugcaca

SEQ ID NO: 3711954 - RNA, 12 nt, Human
guggacucuggu

SEQ ID NO: 3711955 - RNA, 17 nt, Human
guggacucuuugguggc

SEQ ID NO: 3711956 - RNA, 21 nt, Human
guggacuguggcacuugccug

SEQ ID NO: 3711957 - RNA, 18 nt, Human
guggacuuagaaagcagg

SEQ ID NO: 3711958 - RNA, 19 nt, Human
guggacuugaacuuuccug

SEQ ID NO: 3711959 - RNA, 17 nt, Human
guggacuuuccaccccc

SEQ ID NO: 3711960 - RNA, 20 nt, Human
guggacuuuccacccccucc

SEQ ID NO: 3711961 - RNA, 22 nt, Human
guggacuuuccacccccucccu

SEQ ID NO: 3711962 - RNA, 13 nt, Human
guggacuuuuauu

SEQ ID NO: 3711963 - RNA, 15 nt, Human
guggagaagcacacu

SEQ ID NO: 3711964 - RNA, 12 nt, Human
guggagaagcca

SEQ ID NO: 3711965 - RNA, 17 nt, Human
guggagaagccacaggc

SEQ ID NO: 3711966 - RNA, 20 nt, Human
guggagaagccacaggccug

SEQ ID NO: 3711967 - RNA, 18 nt, Human
guggagaagccauugucu

SEQ ID NO: 3711968 - RNA, 20 nt, Human
guggagaagccauugucuuc

SEQ ID NO: 3711969 - RNA, 20 nt, Human
guggagaagcggcuggcagc

SEQ ID NO: 3711970 - RNA, 18 nt, Human
guggagaaucacaggcug

SEQ ID NO: 3711971 - RNA, 18 nt, Human
guggagacaaugucugca

SEQ ID NO: 3711972 - RNA, 15 nt, Human
guggagacugcuccu

SEQ ID NO: 3711973 - RNA, 18 nt, Human
guggagaggcccggccuc

SEQ ID NO: 3711974 - RNA, 22 nt, Human
guggagagggaugaggugcugg

SEQ ID NO: 3711975 - RNA, 15 nt, Human
guggagaugucuucg

SEQ ID NO: 3711976 - RNA, 16 nt, Human
guggagaugucuucgu

SEQ ID NO: 3711977 - RNA, 16 nt, Human
guggagcaugggccug

SEQ ID NO: 3711978 - RNA, 11 nt, Human
guggagccagg

SEQ ID NO: 3711979 - RNA, 13 nt, Human
guggagccaggcg

SEQ ID NO: 3711980 - RNA, 13 nt, Human
uggcuguuggcug

SEQ ID NO: 3711981 - RNA, 11 nt, Human
uggcuguuugg

SEQ ID NO: 3711982 - RNA, 19 nt, Human
uggcuuaaaaaaaacucuu

SEQ ID NO: 3711983 - RNA, 15 nt, Human
uggcuuaaucauuuu

SEQ ID NO: 3711984 - RNA, 16 nt, Human
uggcuuaaugcuucuu

SEQ ID NO: 3711985 - RNA, 20 nt, Human
uggcuuaaugcuucuuucau

SEQ ID NO: 3711986 - RNA, 15 nt, Human
uggcuuaauguuuau

SEQ ID NO: 3711987 - RNA, 19 nt, Human
uggcuuauaauucuuucaa

SEQ ID NO: 3711988 - RNA, 19 nt, Human
uggcuuauuuuaaugugau

SEQ ID NO: 3711989 - RNA, 22 nt, Human
uggcuucacggaagagccuugc

SEQ ID NO: 3711990 - RNA, 23 nt, Human
uggcuucacuccugcuguaaauu

SEQ ID NO: 3711991 - RNA, 19 nt, Human
uggcuucagcuccagcccc

SEQ ID NO: 3711992 - RNA, 16 nt, Human
uggcuucaucugucaa

SEQ ID NO: 3711993 - RNA, 14 nt, Human
uggcuuccagguau

SEQ ID NO: 3711994 - RNA, 20 nt, Human
uggcuuccagguaucuccag

SEQ ID NO: 3711995 - RNA, 20 nt, Human
uggcuucccauccccagcga

SEQ ID NO: 3711996 - RNA, 15 nt, Human
uggcuucccgcucag

SEQ ID NO: 3711997 - RNA, 20 nt, Human
uggcuucccgcucagcccuc

SEQ ID NO: 3711998 - RNA, 22 nt, Human
uggcuucccgcucagcccuccc

SEQ ID NO: 3711999 - RNA, 22 nt, Human
uggcuuccuaaaauucagugga

SEQ ID NO: 3712000 - RNA, 13 nt, Human
uggcuuccuccug

SEQ ID NO: 3712001 - RNA, 14 nt, Human
uggcuuccuccuga

SEQ ID NO: 3712002 - RNA, 15 nt, Human
uggcuuccuccugcg

SEQ ID NO: 3712003 - RNA, 16 nt, Human
uggcuucggacaaaau

SEQ ID NO: 3712004 - RNA, 14 nt, Human
uggcuucuccaggg

SEQ ID NO: 3712005 - RNA, 12 nt, Human
uggcuucugaug

SEQ ID NO: 3712006 - RNA, 15 nt, Human
uggcuucugaugaau

SEQ ID NO: 3712007 - RNA, 20 nt, Human
uggcuucugaugaaucuugc

SEQ ID NO: 3712008 - RNA, 22 nt, Human
uggcuucuuuucuuuguaucau

SEQ ID NO: 3712009 - RNA, 18 nt, Human
uggcuugaauuaagaaga

SEQ ID NO: 3712010 - RNA, 23 nt, Human
uggcuuggauuaauauucauagu

SEQ ID NO: 3712011 - RNA, 18 nt, Human
uggcuuggccacagccag

SEQ ID NO: 3712012 - RNA, 19 nt, Human
uggcuuguagaauuguuau

SEQ ID NO: 3712013 - RNA, 14 nt, Human
uggcuuguguguuu

SEQ ID NO: 3712014 - RNA, 18 nt, Human
uggcuuguguguuucacu

SEQ ID NO: 3712015 - RNA, 12 nt, Human
uggcuuguucau

SEQ ID NO: 3712016 - RNA, 21 nt, Human
uggcuuguucaucauccagau

SEQ ID NO: 3712017 - RNA, 15 nt, Human
uggcuuuaagccuuc

SEQ ID NO: 3712018 - RNA, 23 nt, Human
uggcuuuaagccuucaaaacuau

SEQ ID NO: 3712019 - RNA, 17 nt, Human
uggcuuuaggagcagug

SEQ ID NO: 3712020 - RNA, 15 nt, Human
uggcuuucagagccu

SEQ ID NO: 3712021 - RNA, 17 nt, Human
uggcuuucagagccucc

SEQ ID NO: 3712022 - RNA, 12 nt, Human
uggcuuucccgg

SEQ ID NO: 3712023 - RNA, 20 nt, Human
uggcuuuccuuguggcagag

SEQ ID NO: 3712024 - RNA, 20 nt, Human
uggcuuucucccacugaguu

SEQ ID NO: 3712025 - RNA, 22 nt, Human
uggcuuucuccgacugcuaggg

SEQ ID NO: 3712026 - RNA, 22 nt, Human
uggcuuugcccaaccucagcaa

SEQ ID NO: 3712027 - RNA, 17 nt, Human
uggcuuuuacccuuuuu

SEQ ID NO: 3712028 - RNA, 15 nt, Human
uggcuuuuagacaga

SEQ ID NO: 3712029 - RNA, 17 nt, Human
uggcuuuuauuaaugca

SEQ ID NO: 3712030 - RNA, 20 nt, Human
uggcuuuuauuaaugcacuu

SEQ ID NO: 3712031 - RNA, 16 nt, Human
uggcuuuucacugcug

SEQ ID NO: 3712032 - RNA, 19 nt, Human
uggcuuuucacugcuggcu

SEQ ID NO: 3712033 - RNA, 17 nt, Human
uggcuuuucugauccag

SEQ ID NO: 3712034 - RNA, 16 nt, Human
uggcuuuucuguuucc

SEQ ID NO: 3712035 - RNA, 20 nt, Human
uggcuuuugcgguucaggaa

SEQ ID NO: 3712036 - RNA, 15 nt, Human
uggcuuuugugcauu

SEQ ID NO: 3712037 - RNA, 22 nt, Human
uggcuuuuuuaaaaaagcaaca

SEQ ID NO: 3712038 - RNA, 23 nt, Human
ugggaaaaaugcccuuaaaucau

SEQ ID NO: 3712039 - RNA, 18 nt, Human
ugggaaacaaaaggauaa

SEQ ID NO: 3712040 - RNA, 20 nt, Human
ugggaaacacuccuugcauc

SEQ ID NO: 3712041 - RNA, 21 nt, Human
ugggaaaccccuucucuguga

SEQ ID NO: 3712042 - RNA, 18 nt, Human
ugggaaacuuggcucgaa

SEQ ID NO: 3712043 - RNA, 22 nt, Human
ugggaaacuugucacuugcaug

SEQ ID NO: 3712044 - RNA, 21 nt, Human
ugggaaagcauuguaaaugug

SEQ ID NO: 3712045 - RNA, 20 nt, Human
ugggaaagccaccucucccu

SEQ ID NO: 3712046 - RNA, 22 nt, Human
ugggaaagccccugccccuccu

SEQ ID NO: 3712047 - RNA, 21 nt, Human
ugggaaaggaggcaugccucu

SEQ ID NO: 3712048 - RNA, 20 nt, Human
ugggaaaugagaaggcagcc

SEQ ID NO: 3712049 - RNA, 16 nt, Human
ugggaaaugagcaggg

SEQ ID NO: 3712050 - RNA, 22 nt, Human
ugggaacauuuauuuuaugaga

SEQ ID NO: 3712051 - RNA, 20 nt, Human
ugggaaccaagcuauuccuu

SEQ ID NO: 3712052 - RNA, 14 nt, Human
ugggaaccucccag

SEQ ID NO: 3712053 - RNA, 21 nt, Human
ugggaaccucccagaggucca

SEQ ID NO: 3712054 - RNA, 16 nt, Human
ugggaaccuuccuguc

SEQ ID NO: 3712055 - RNA, 16 nt, Human
ugggaacgagagggga

SEQ ID NO: 3712056 - RNA, 21 nt, Human
ugggaacgcagaugauccaug

SEQ ID NO: 3712057 - RNA, 24 nt, Human
ugggaacgcagaugauccaugagu

SEQ ID NO: 3712058 - RNA, 13 nt, Human
ugggaacuagacu

SEQ ID NO: 3712059 - RNA, 18 nt, Human
ugggaacucaccuggggc

SEQ ID NO: 3712060 - RNA, 22 nt, Human
ugggaacucccaagaacagcag

SEQ ID NO: 3712061 - RNA, 13 nt, Human
ugggaacucugac

SEQ ID NO: 3712062 - RNA, 16 nt, Human
ugggaacucugacaag

SEQ ID NO: 3712063 - RNA, 21 nt, Human
ugggaagacgccugagcucac

SEQ ID NO: 3712064 - RNA, 22 nt, Human
ugggaagacuccuagcuguccu

SEQ ID NO: 3712065 - RNA, 23 nt, Human
ugggaagacuccuagcuguccuu

SEQ ID NO: 3712066 - RNA, 22 nt, Human
ugggaagcccauccugaccagc

SEQ ID NO: 3712067 - RNA, 12 nt, Human
ugggaaggacuu

SEQ ID NO: 3712068 - RNA, 21 nt, Human
ugggaagggagagcggggcag

SEQ ID NO: 3712069 - RNA, 19 nt, Human
ugggaaggggacccccgcc

SEQ ID NO: 3712070 - RNA, 22 nt, Human
ugggaaggggacccccgccccc

SEQ ID NO: 3712071 - RNA, 18 nt, Human
ugggaaguccggccccag

SEQ ID NO: 3712072 - RNA, 23 nt, Human
ugggaagucguccuuacuccugu

SEQ ID NO: 3712073 - RNA, 23 nt, Human
ugggaaguuaaagggaagaaaac

SEQ ID NO: 3712074 - RNA, 13 nt, Human
ugggaauaaauau

SEQ ID NO: 3712075 - RNA, 23 nt, Human
ugggaauaagugccaggauggaa

SEQ ID NO: 3712076 - RNA, 13 nt, Human
ugggaauauuuga

SEQ ID NO: 3712077 - RNA, 15 nt, Human
ugggaauauuugaau

SEQ ID NO: 3712078 - RNA, 12 nt, Human
ugggaaugaagc

SEQ ID NO: 3712079 - RNA, 14 nt, Human
ugggaaugaagcaa

SEQ ID NO: 3712080 - RNA, 18 nt, Human
ugggaaugaagcuugugu

SEQ ID NO: 3712081 - RNA, 16 nt, Human
ugggaaugaaugucag

SEQ ID NO: 3712082 - RNA, 21 nt, Human
ugggaaugaaugucaguguga

SEQ ID NO: 3712083 - RNA, 22 nt, Human
ugggaaugaaugucagugugac

SEQ ID NO: 3712084 - RNA, 16 nt, Human
ugggaaugaggaaaau

SEQ ID NO: 3712085 - RNA, 17 nt, Human
ugggaaugaggcuugcu

SEQ ID NO: 3712086 - RNA, 14 nt, Human
ugggaaugaggugg

SEQ ID NO: 3712087 - RNA, 17 nt, Human
ugggaaugaggugggag

SEQ ID NO: 3712088 - RNA, 20 nt, Human
ugggaauguauaguauuuga

SEQ ID NO: 3712089 - RNA, 17 nt, Human
ugggaauugugugaugu

SEQ ID NO: 3712090 - RNA, 12 nt, Human
ugggacaauuag

SEQ ID NO: 3712091 - RNA, 22 nt, Human
ugggacaauuagauaaaugucc

SEQ ID NO: 3712092 - RNA, 16 nt, Human
ugggacaauuguuuua

SEQ ID NO: 3712093 - RNA, 20 nt, Human
ugggacagcccagagccugg

SEQ ID NO: 3712094 - RNA, 16 nt, Human
ugggacagggcauggc

SEQ ID NO: 3712095 - RNA, 20 nt, Human
ugggacauuugcucauggaa

SEQ ID NO: 3712096 - RNA, 17 nt, Human
ugggaccaaaccuagcc

SEQ ID NO: 3712097 - RNA, 18 nt, Human
ugggacccaguggcaggg

SEQ ID NO: 3712098 - RNA, 19 nt, Human
ugggacccaguggcagggc

SEQ ID NO: 3712099 - RNA, 21 nt, Human
ugggacccauagaucuucuga

SEQ ID NO: 3712100 - RNA, 15 nt, Human
ugggaccccaggccc

SEQ ID NO: 3712101 - RNA, 22 nt, Human
ugggaccccaggcccacucagg

SEQ ID NO: 3712102 - RNA, 20 nt, Human
ugggaccgcuacaccacucu

SEQ ID NO: 3712103 - RNA, 24 nt, Human
ugggaccuccaccguugguguuca

SEQ ID NO: 3712104 - RNA, 19 nt, Human
ugggaccugccaggcaggg

SEQ ID NO: 3712105 - RNA, 15 nt, Human
ugggaccuuuagugg

SEQ ID NO: 3712106 - RNA, 16 nt, Human
ugggacgcucugcugu

SEQ ID NO: 3712107 - RNA, 13 nt, Human
ugggacggcggca

SEQ ID NO: 3712108 - RNA, 15 nt, Human
ugggacguggcucag

SEQ ID NO: 3712109 - RNA, 16 nt, Human
ugggacguggcucagc

SEQ ID NO: 3712110 - RNA, 20 nt, Human
ugggacguggcucagccagc

SEQ ID NO: 3712111 - RNA, 15 nt, Human
ugggacuaaaugccc

SEQ ID NO: 3712112 - RNA, 14 nt, Human
ugggacuacaggca

SEQ ID NO: 3712113 - RNA, 15 nt, Human
ugggacuacaggcac

SEQ ID NO: 3712114 - RNA, 18 nt, Human
ugggacuagagcuuucuu

SEQ ID NO: 3712115 - RNA, 13 nt, Human
ugggacucagccu

SEQ ID NO: 3712116 - RNA, 18 nt, Human
ugggacugcugcuucuua

SEQ ID NO: 3712117 - RNA, 12 nt, Human
ugggacugggag

SEQ ID NO: 3712118 - RNA, 15 nt, Human
ugggacugggagggc

SEQ ID NO: 3712119 - RNA, 16 nt, Human
ugggacugggagggcc

SEQ ID NO: 3712120 - RNA, 15 nt, Human
ugggacuguacacac

SEQ ID NO: 3712121 - RNA, 17 nt, Human
ugggacuguacacacuu

SEQ ID NO: 3712122 - RNA, 18 nt, Human
ugggacuuccaugccuua

SEQ ID NO: 3712123 - RNA, 20 nt, Human
ugggacuuccuugcucuccc

SEQ ID NO: 3712124 - RNA, 22 nt, Human
ugggacuucuuuucacauucuu

SEQ ID NO: 3712125 - RNA, 18 nt, Human
ugggagaaauugacagau

SEQ ID NO: 3712126 - RNA, 15 nt, Human
ugggagaaccucagg

SEQ ID NO: 3712127 - RNA, 22 nt, Human
ugggagaagggggucaaagcaa

SEQ ID NO: 3712128 - RNA, 14 nt, Human
guggagccccacac

SEQ ID NO: 3712129 - RNA, 21 nt, Human
guggagccugacagccagaac

SEQ ID NO: 3712130 - RNA, 19 nt, Human
guggagcgggguaugaaga

SEQ ID NO: 3712131 - RNA, 16 nt, Human
guggagcguucaccag

SEQ ID NO: 3712132 - RNA, 13 nt, Human
guggagcugccug

SEQ ID NO: 3712133 - RNA, 14 nt, Human
guggaggaaggauu

SEQ ID NO: 3712134 - RNA, 16 nt, Human
guggaggagagccugg

SEQ ID NO: 3712135 - RNA, 17 nt, Human
guggaggagagccuggu

SEQ ID NO: 3712136 - RNA, 16 nt, Human
guggaggagcucagga

SEQ ID NO: 3712137 - RNA, 13 nt, Human
guggaggcagcca

SEQ ID NO: 3712138 - RNA, 14 nt, Human
guggaggcugcucg

SEQ ID NO: 3712139 - RNA, 12 nt, Human
guggagggccac

SEQ ID NO: 3712140 - RNA, 15 nt, Human
guggagggguguggc

SEQ ID NO: 3712141 - RNA, 13 nt, Human
guggaggugcugc

SEQ ID NO: 3712142 - RNA, 18 nt, Human
guggaggugggcugggcc

SEQ ID NO: 3712143 - RNA, 17 nt, Human
guggaggugucaggcug

SEQ ID NO: 3712144 - RNA, 22 nt, Human
guggaggugucaggcugcuggc

SEQ ID NO: 3712145 - RNA, 23 nt, Human
guggagguugcagugagccaaga

SEQ ID NO: 3712146 - RNA, 19 nt, Human
guggagguugcagugagcu

SEQ ID NO: 3712147 - RNA, 20 nt, Human
guggagguugcugguacaca

SEQ ID NO: 3712148 - RNA, 14 nt, Human
guggagugcagugg

SEQ ID NO: 3712149 - RNA, 19 nt, Human
guggaguuggcauugcauu

SEQ ID NO: 3712150 - RNA, 20 nt, Human
guggaguuugacauuguaug

SEQ ID NO: 3712151 - RNA, 18 nt, Human
guggauaacaaagauauc

SEQ ID NO: 3712152 - RNA, 17 nt, Human
guggauacgugucaaug

SEQ ID NO: 3712153 - RNA, 20 nt, Human
guggauagaugcccugcuag

SEQ ID NO: 3712154 - RNA, 17 nt, Human
guggauauaaaaugugc

SEQ ID NO: 3712155 - RNA, 15 nt, Human
guggaucacagaggc

SEQ ID NO: 3712156 - RNA, 21 nt, Human
guggaucagagaugcaccacc

SEQ ID NO: 3712157 - RNA, 19 nt, Human
guggauccaaacugaucca

SEQ ID NO: 3712158 - RNA, 19 nt, Human
guggauccaauguuagaga

SEQ ID NO: 3712159 - RNA, 19 nt, Human
guggaucuauuucauguuu

SEQ ID NO: 3712160 - RNA, 18 nt, Human
guggaucuccaaggacca

SEQ ID NO: 3712161 - RNA, 17 nt, Human
guggaucuguccaagga

SEQ ID NO: 3712162 - RNA, 12 nt, Human
guggaugaucaa

SEQ ID NO: 3712163 - RNA, 20 nt, Human
guggaugcugcugccccugc

SEQ ID NO: 3712164 - RNA, 13 nt, Human
guggauggcccca

SEQ ID NO: 3712165 - RNA, 16 nt, Human
guggauggccccagca

SEQ ID NO: 3712166 - RNA, 14 nt, Human
guggauuaaacuua

SEQ ID NO: 3712167 - RNA, 18 nt, Human
guggauucugaggcccug

SEQ ID NO: 3712168 - RNA, 21 nt, Human
guggauuuaacagaaauguac

SEQ ID NO: 3712169 - RNA, 22 nt, Human
guggcaaagcuguucuuccugg

SEQ ID NO: 3712170 - RNA, 16 nt, Human
guggcaaauauaaaac

SEQ ID NO: 3712171 - RNA, 18 nt, Human
guggcaccagcagccugg

SEQ ID NO: 3712172 - RNA, 15 nt, Human
guggcacugagcccc

SEQ ID NO: 3712173 - RNA, 14 nt, Human
guggcacuggggca

SEQ ID NO: 3712174 - RNA, 17 nt, Human
guggcacuggggcaggg

SEQ ID NO: 3712175 - RNA, 18 nt, Human
guggcacuggggcagggg

SEQ ID NO: 3712176 - RNA, 17 nt, Human
guggcacuugccugggu

SEQ ID NO: 3712177 - RNA, 23 nt, Human
guggcagagcuuggacuggaugc

SEQ ID NO: 3712178 - RNA, 20 nt, Human
guggcagauaaucagccucu

SEQ ID NO: 3712179 - RNA, 23 nt, Human
guggcagauaaucagccucuuaa

SEQ ID NO: 3712180 - RNA, 18 nt, Human
guggcagauuuuacaaaa

SEQ ID NO: 3712181 - RNA, 17 nt, Human
guggcagcccagccagc

SEQ ID NO: 3712182 - RNA, 12 nt, Human
guggcagcccug

SEQ ID NO: 3712183 - RNA, 13 nt, Human
guggcagcccugu

SEQ ID NO: 3712184 - RNA, 14 nt, Human
guggcagcccugua

SEQ ID NO: 3712185 - RNA, 17 nt, Human
guggcagcuauaggaaa

SEQ ID NO: 3712186 - RNA, 16 nt, Human
guggcagcucaccucu

SEQ ID NO: 3712187 - RNA, 14 nt, Human
guggcagcugcggu

SEQ ID NO: 3712188 - RNA, 17 nt, Human
guggcagcugcggucca

SEQ ID NO: 3712189 - RNA, 11 nt, Human
guggcagcugu

SEQ ID NO: 3712190 - RNA, 15 nt, Human
guggcaggaccagga

SEQ ID NO: 3712191 - RNA, 17 nt, Human
guggcaggaccaggacu

SEQ ID NO: 3712192 - RNA, 12 nt, Human
guggcaggcaga

SEQ ID NO: 3712193 - RNA, 13 nt, Human
guggcaggcagag

SEQ ID NO: 3712194 - RNA, 18 nt, Human
guggcagggcacagggcc

SEQ ID NO: 3712195 - RNA, 19 nt, Human
guggcagggcacagggccu

SEQ ID NO: 3712196 - RNA, 18 nt, Human
guggcaggggacaggagu

SEQ ID NO: 3712197 - RNA, 14 nt, Human
guggcaguaaagag

SEQ ID NO: 3712198 - RNA, 22 nt, Human
guggcagugcagcaaccagagc

SEQ ID NO: 3712199 - RNA, 15 nt, Human
guggcagugggagcu

SEQ ID NO: 3712200 - RNA, 19 nt, Human
guggcagugggagcugccu

SEQ ID NO: 3712201 - RNA, 21 nt, Human
guggcagugguuuuggcaaac

SEQ ID NO: 3712202 - RNA, 15 nt, Human
guggcauagcccaga

SEQ ID NO: 3712203 - RNA, 13 nt, Human
guggcauggccac

SEQ ID NO: 3712204 - RNA, 14 nt, Human
guggcauguggccu

SEQ ID NO: 3712205 - RNA, 17 nt, Human
guggcauguggccugug

SEQ ID NO: 3712206 - RNA, 22 nt, Human
guggcauguucaucguauaaca

SEQ ID NO: 3712207 - RNA, 14 nt, Human
guggcauugaaaug

SEQ ID NO: 3712208 - RNA, 15 nt, Human
guggcauugaaauga

SEQ ID NO: 3712209 - RNA, 19 nt, Human
guggccaaauuauuugugu

SEQ ID NO: 3712210 - RNA, 15 nt, Human
guggccaagaagcag

SEQ ID NO: 3712211 - RNA, 16 nt, Human
guggccaaggagcugc

SEQ ID NO: 3712212 - RNA, 22 nt, Human
guggccacaccucuaucccggc

SEQ ID NO: 3712213 - RNA, 23 nt, Human
guggccacaccucuaucccggcu

SEQ ID NO: 3712214 - RNA, 21 nt, Human
guggccacagcgccagccuca

SEQ ID NO: 3712215 - RNA, 21 nt, Human
guggccacuccagaccccugg

SEQ ID NO: 3712216 - RNA, 23 nt, Human
guggccagagcugggaggcaugg

SEQ ID NO: 3712217 - RNA, 19 nt, Human
guggccagaggugucaccc

SEQ ID NO: 3712218 - RNA, 21 nt, Human
guggccagcgagggcgugucu

SEQ ID NO: 3712219 - RNA, 10 nt, Human
guggccaggc

SEQ ID NO: 3712220 - RNA, 13 nt, Human
guggccaggguga

SEQ ID NO: 3712221 - RNA, 11 nt, Human
guggccccacc

SEQ ID NO: 3712222 - RNA, 23 nt, Human
guggccccacccugggcccuggg

SEQ ID NO: 3712223 - RNA, 22 nt, Human
guggccccaccuggcccucucu

SEQ ID NO: 3712224 - RNA, 12 nt, Human
guggccccagcc

SEQ ID NO: 3712225 - RNA, 16 nt, Human
guggccccagccuggc

SEQ ID NO: 3712226 - RNA, 16 nt, Human
guggcccgacagccug

SEQ ID NO: 3712227 - RNA, 14 nt, Human
guggcccucucccc

SEQ ID NO: 3712228 - RNA, 17 nt, Human
guggcccucuccccugc

SEQ ID NO: 3712229 - RNA, 22 nt, Human
guggcccugccaucuucccagc

SEQ ID NO: 3712230 - RNA, 17 nt, Human
guggcccugcccucucc

SEQ ID NO: 3712231 - RNA, 23 nt, Human
guggcccugcccucuccuuccuu

SEQ ID NO: 3712232 - RNA, 16 nt, Human
guggcccuggccugcu

SEQ ID NO: 3712233 - RNA, 17 nt, Human
guggcccugucccuccc

SEQ ID NO: 3712234 - RNA, 23 nt, Human
guggcccugucccucccaccucu

SEQ ID NO: 3712235 - RNA, 13 nt, Human
guggcccuuccug

SEQ ID NO: 3712236 - RNA, 18 nt, Human
guggccgaaccagaacca

SEQ ID NO: 3712237 - RNA, 9 nt, Human
guggccuca

SEQ ID NO: 3712238 - RNA, 20 nt, Human
guggccucaacccucccuca

SEQ ID NO: 3712239 - RNA, 11 nt, Human
guggccucaga

SEQ ID NO: 3712240 - RNA, 11 nt, Human
guggccucagc

SEQ ID NO: 3712241 - RNA, 18 nt, Human
guggccucagcugaaugc

SEQ ID NO: 3712242 - RNA, 22 nt, Human
guggccucccaacucaccccag

SEQ ID NO: 3712243 - RNA, 23 nt, Human
guggccucgaacuccuggcacua

SEQ ID NO: 3712244 - RNA, 21 nt, Human
guggccucuugagcaguggcu

SEQ ID NO: 3712245 - RNA, 16 nt, Human
guggccucuuugucua

SEQ ID NO: 3712246 - RNA, 19 nt, Human
guggccucuuugucuaaaa

SEQ ID NO: 3712247 - RNA, 13 nt, Human
guggccugccagu

SEQ ID NO: 3712248 - RNA, 13 nt, Human
guggccuggcucc

SEQ ID NO: 3712249 - RNA, 12 nt, Human
guggccugggca

SEQ ID NO: 3712250 - RNA, 14 nt, Human
guggccugggcaag

SEQ ID NO: 3712251 - RNA, 22 nt, Human
guggccuguagaauagccugug

SEQ ID NO: 3712252 - RNA, 13 nt, Human
guggccuguggcu

SEQ ID NO: 3712253 - RNA, 12 nt, Human
guggccugugug

SEQ ID NO: 3712254 - RNA, 19 nt, Human
guggccuuggccggcugug

SEQ ID NO: 3712255 - RNA, 17 nt, Human
guggccuuugcgcuccu

SEQ ID NO: 3712256 - RNA, 20 nt, Human
guggccuuugcgcuccuggc

SEQ ID NO: 3712257 - RNA, 20 nt, Human
guggcgacucuauagacucu

SEQ ID NO: 3712258 - RNA, 20 nt, Human
guggcgagccauuuguccca

SEQ ID NO: 3712259 - RNA, 23 nt, Human
guggcgagccauuugucccaagu

SEQ ID NO: 3712260 - RNA, 23 nt, Human
guggcgcagcauauucaggaagc

SEQ ID NO: 3712261 - RNA, 21 nt, Human
guggcgccgucuccaggggcu

SEQ ID NO: 3712262 - RNA, 19 nt, Human
guggcgcgaucucagcuca

SEQ ID NO: 3712263 - RNA, 19 nt, Human
guggcgugaucucagcuca

SEQ ID NO: 3712264 - RNA, 18 nt, Human
guggcgugggagccagcc

SEQ ID NO: 3712265 - RNA, 15 nt, Human
guggcuacucugugc

SEQ ID NO: 3712266 - RNA, 22 nt, Human
guggcuacucugugccagagcc

SEQ ID NO: 3712267 - RNA, 14 nt, Human
guggcuacugacau

SEQ ID NO: 3712268 - RNA, 12 nt, Human
guggcuaggcag

SEQ ID NO: 3712269 - RNA, 21 nt, Human
guggcuagucaagcuccuccu

SEQ ID NO: 3712270 - RNA, 17 nt, Human
guggcuauuaaaacucu

SEQ ID NO: 3712271 - RNA, 19 nt, Human
guggcuauuaaaacucuuu

SEQ ID NO: 3712272 - RNA, 21 nt, Human
guggcucaagucuggccccac

SEQ ID NO: 3712273 - RNA, 22 nt, Human
guggcucacucagcacuuggcc

SEQ ID NO: 3712274 - RNA, 15 nt, Human
guggcuccagcacca

SEQ ID NO: 3712275 - RNA, 23 nt, Human
guggcuccccucuauuuagcaug

SEQ ID NO: 3712276 - RNA, 20 nt, Human
guggcuccuaucuguguuuu

SEQ ID NO: 3712277 - RNA, 13 nt, Human
guggcuccucccg

SEQ ID NO: 3712278 - RNA, 15 nt, Human
ugcgauuuuauuacu

SEQ ID NO: 3712279 - RNA, 19 nt, Human
ugcgauuuugccugugucu

SEQ ID NO: 3712280 - RNA, 16 nt, Human
ugcgcacaacuuaaaa

SEQ ID NO: 3712281 - RNA, 13 nt, Human
ugcgcaggcuggc

SEQ ID NO: 3712282 - RNA, 17 nt, Human
ugcgcaggcuggcccug

SEQ ID NO: 3712283 - RNA, 19 nt, Human
ugcgcaggcuggcccugcc

SEQ ID NO: 3712284 - RNA, 13 nt, Human
ugcgcaguugcug

SEQ ID NO: 3712285 - RNA, 22 nt, Human
ugcgcaucuugccuccaggugc

SEQ ID NO: 3712286 - RNA, 20 nt, Human
ugcgcauucuaaccuggagg

SEQ ID NO: 3712287 - RNA, 17 nt, Human
ugcgcauucucauggag

SEQ ID NO: 3712288 - RNA, 19 nt, Human
ugcgcauucucauggagaa

SEQ ID NO: 3712289 - RNA, 14 nt, Human
ugcgccacugcucc

SEQ ID NO: 3712290 - RNA, 19 nt, Human
ugcgccacugcuccgugga

SEQ ID NO: 3712291 - RNA, 15 nt, Human
ugcgccaguccugcu

SEQ ID NO: 3712292 - RNA, 16 nt, Human
ugcgccaguccugcua

SEQ ID NO: 3712293 - RNA, 17 nt, Human
ugcgcccaccccgcucu

SEQ ID NO: 3712294 - RNA, 21 nt, Human
ugcgcccccuccgcccugcca

SEQ ID NO: 3712295 - RNA, 21 nt, Human
ugcgcccuuaacugcauccag

SEQ ID NO: 3712296 - RNA, 16 nt, Human
ugcgcccuuaccuucc

SEQ ID NO: 3712297 - RNA, 15 nt, Human
ugcgccgagucuguc

SEQ ID NO: 3712298 - RNA, 13 nt, Human
ugcgccuacagga

SEQ ID NO: 3712299 - RNA, 14 nt, Human
ugcgccuacaggag

SEQ ID NO: 3712300 - RNA, 16 nt, Human
ugcgccuacaggagug

SEQ ID NO: 3712301 - RNA, 11 nt, Human
ugcgccugcug

SEQ ID NO: 3712302 - RNA, 18 nt, Human
ugcgccugugaugcuggg

SEQ ID NO: 3712303 - RNA, 17 nt, Human
ugcgcgcacaauaguaa

SEQ ID NO: 3712304 - RNA, 18 nt, Human
ugcgcguucugaaauauu

SEQ ID NO: 3712305 - RNA, 19 nt, Human
ugcgcuaaacuuuucugau

SEQ ID NO: 3712306 - RNA, 15 nt, Human
ugcgcucagggccau

SEQ ID NO: 3712307 - RNA, 19 nt, Human
ugcgcucagggccaugcug

SEQ ID NO: 3712308 - RNA, 14 nt, Human
ugcgcuccuggccc

SEQ ID NO: 3712309 - RNA, 20 nt, Human
ugcgcuccuggcccagccuu

SEQ ID NO: 3712310 - RNA, 11 nt, Human
ugcgcuucacu

SEQ ID NO: 3712311 - RNA, 15 nt, Human
ugcgcuucacuuggg

SEQ ID NO: 3712312 - RNA, 14 nt, Human
ugcgcuugcuuuuc

SEQ ID NO: 3712313 - RNA, 16 nt, Human
ugcgcuuuauuuucuu

SEQ ID NO: 3712314 - RNA, 15 nt, Human
ugcggaaucagcuuc

SEQ ID NO: 3712315 - RNA, 22 nt, Human
ugcggaccccagcugugagccu

SEQ ID NO: 3712316 - RNA, 13 nt, Human
ugcggagaacaaa

SEQ ID NO: 3712317 - RNA, 19 nt, Human
ugcggagaaccuugugccu

SEQ ID NO: 3712318 - RNA, 13 nt, Human
ugcggagcacacu

SEQ ID NO: 3712319 - RNA, 13 nt, Human
ugcggauggccgg

SEQ ID NO: 3712320 - RNA, 15 nt, Human
ugcggcagggaagag

SEQ ID NO: 3712321 - RNA, 23 nt, Human
ugcggcagguucacaggcgaggc

SEQ ID NO: 3712322 - RNA, 17 nt, Human
ugcggcauuaaagccau

SEQ ID NO: 3712323 - RNA, 13 nt, Human
ugcggcccagccc

SEQ ID NO: 3712324 - RNA, 14 nt, Human
ugcggcccagcccg

SEQ ID NO: 3712325 - RNA, 18 nt, Human
ugcggcccagcccggcuc

SEQ ID NO: 3712326 - RNA, 13 nt, Human
ugcggccccuccc

SEQ ID NO: 3712327 - RNA, 19 nt, Human
ugcggccgcauucccugag

SEQ ID NO: 3712328 - RNA, 23 nt, Human
ugcggcuggccauggagaaagcu

SEQ ID NO: 3712329 - RNA, 13 nt, Human
ugcggcugugcag

SEQ ID NO: 3712330 - RNA, 17 nt, Human
ugcgggcugggcagcug

SEQ ID NO: 3712331 - RNA, 20 nt, Human
ugcgggcuuccuccuggugu

SEQ ID NO: 3712332 - RNA, 22 nt, Human
ugcggggguuccguguccaccc

SEQ ID NO: 3712333 - RNA, 16 nt, Human
ugcgggucacaggagg

SEQ ID NO: 3712334 - RNA, 18 nt, Human
ugcgggugaacaaagcag

SEQ ID NO: 3712335 - RNA, 22 nt, Human
ugcgggugaacaaagcagccac

SEQ ID NO: 3712336 - RNA, 18 nt, Human
ugcgguccacccaggagc

SEQ ID NO: 3712337 - RNA, 16 nt, Human
ugcgguuaauuuugaa

SEQ ID NO: 3712338 - RNA, 19 nt, Human
ugcgguuauaaaaaauggu

SEQ ID NO: 3712339 - RNA, 23 nt, Human
ugcguacguuuccugagaagugu

SEQ ID NO: 3712340 - RNA, 16 nt, Human
ugcguaugcaguguag

SEQ ID NO: 3712341 - RNA, 19 nt, Human
ugcguaugucuguuaccau

SEQ ID NO: 3712342 - RNA, 19 nt, Human
ugcguccacgagcuguuua

SEQ ID NO: 3712343 - RNA, 19 nt, Human
ugcguccuccucaccucau

SEQ ID NO: 3712344 - RNA, 22 nt, Human
ugcguccuccucaccucaugcc

SEQ ID NO: 3712345 - RNA, 16 nt, Human
ugcgucgguccuggug

SEQ ID NO: 3712346 - RNA, 16 nt, Human
ugcgucuauccugugu

SEQ ID NO: 3712347 - RNA, 23 nt, Human
ugcgucuggaggggccccugcuu

SEQ ID NO: 3712348 - RNA, 14 nt, Human
ugcgucuuccgccc

SEQ ID NO: 3712349 - RNA, 22 nt, Human
ugcgugaaacacaccaggcugu

SEQ ID NO: 3712350 - RNA, 19 nt, Human
ugcgugacacucuccuugc

SEQ ID NO: 3712351 - RNA, 20 nt, Human
ugcgugacacucuccuugca

SEQ ID NO: 3712352 - RNA, 21 nt, Human
ugcgugacacucuccuugcag

SEQ ID NO: 3712353 - RNA, 17 nt, Human
ugcgugccccugcugcu

SEQ ID NO: 3712354 - RNA, 18 nt, Human
ugcgugccgugugagugu

SEQ ID NO: 3712355 - RNA, 16 nt, Human
ugcguggacucugcac

SEQ ID NO: 3712356 - RNA, 17 nt, Human
ugcguggacucugcaca

SEQ ID NO: 3712357 - RNA, 19 nt, Human
ugcguggcauagcccagac

SEQ ID NO: 3712358 - RNA, 13 nt, Human
ugcgugggucaga

SEQ ID NO: 3712359 - RNA, 16 nt, Human
ugcgugggucagaaga

SEQ ID NO: 3712360 - RNA, 23 nt, Human
ugcgugggugugugcguguuugg

SEQ ID NO: 3712361 - RNA, 18 nt, Human
ugcgugguggucccuggg

SEQ ID NO: 3712362 - RNA, 18 nt, Human
ugcgugugcgugcaugug

SEQ ID NO: 3712363 - RNA, 20 nt, Human
ugcguguguagaguuaagaa

SEQ ID NO: 3712364 - RNA, 17 nt, Human
ugcguguguccaugugu

SEQ ID NO: 3712365 - RNA, 19 nt, Human
ugcguguguccaugugugu

SEQ ID NO: 3712366 - RNA, 14 nt, Human
ugcguguuugcacg

SEQ ID NO: 3712367 - RNA, 16 nt, Human
ugcguguuugcacguu

SEQ ID NO: 3712368 - RNA, 15 nt, Human
ugcuaaaaaugggac

SEQ ID NO: 3712369 - RNA, 14 nt, Human
ugcuaaaauaacag

SEQ ID NO: 3712370 - RNA, 22 nt, Human
ugcuaaacacugcgcuuuauuu

SEQ ID NO: 3712371 - RNA, 16 nt, Human
ugcuaaacguguaugu

SEQ ID NO: 3712372 - RNA, 17 nt, Human
ugcuaaacguguauguu

SEQ ID NO: 3712373 - RNA, 19 nt, Human
ugcuaaacguguauguuuu

SEQ ID NO: 3712374 - RNA, 12 nt, Human
ugcuaaagacau

SEQ ID NO: 3712375 - RNA, 17 nt, Human
ugcuaaauaaaauuugu

SEQ ID NO: 3712376 - RNA, 21 nt, Human
ugcuaaauaaaauuuguugca

SEQ ID NO: 3712377 - RNA, 12 nt, Human
ugcuaaaucucc

SEQ ID NO: 3712378 - RNA, 20 nt, Human
ugcuaaauggucgcccagga

SEQ ID NO: 3712379 - RNA, 14 nt, Human
ugcuaaauguaaca

SEQ ID NO: 3712380 - RNA, 16 nt, Human
ugcuaaauguaacagu

SEQ ID NO: 3712381 - RNA, 24 nt, Human
ugcuaaauguaagaaucauuguaa

SEQ ID NO: 3712382 - RNA, 18 nt, Human
ugcuaaauugauguugau

SEQ ID NO: 3712383 - RNA, 21 nt, Human
ugcuaaauugauguugaugca

SEQ ID NO: 3712384 - RNA, 23 nt, Human
ugcuaacaaagacaaaagucugu

SEQ ID NO: 3712385 - RNA, 21 nt, Human
ugcuaagaauauuugaaugua

SEQ ID NO: 3712386 - RNA, 22 nt, Human
ugcuaagacucaguggggaggg

SEQ ID NO: 3712387 - RNA, 13 nt, Human
ugcuaagagaagu

SEQ ID NO: 3712388 - RNA, 16 nt, Human
ugcuaagagaaguaga

SEQ ID NO: 3712389 - RNA, 22 nt, Human
ugcuaagagaaguagaaaucau

SEQ ID NO: 3712390 - RNA, 20 nt, Human
ugcuaagcaagcuaaccuua

SEQ ID NO: 3712391 - RNA, 15 nt, Human
ugcuaagcauuccaa

SEQ ID NO: 3712392 - RNA, 18 nt, Human
ugcuaagccccagcaagc

SEQ ID NO: 3712393 - RNA, 20 nt, Human
ugcuaagccccagcaagcaa

SEQ ID NO: 3712394 - RNA, 15 nt, Human
ugcuaaggucuugga

SEQ ID NO: 3712395 - RNA, 12 nt, Human
ugcuaagguucu

SEQ ID NO: 3712396 - RNA, 20 nt, Human
ugcuaaguaaaucucuucug

SEQ ID NO: 3712397 - RNA, 12 nt, Human
ugcuaaguauuu

SEQ ID NO: 3712398 - RNA, 16 nt, Human
ugcuaaguauuuccca

SEQ ID NO: 3712399 - RNA, 14 nt, Human
ugcuaagugugaac

SEQ ID NO: 3712400 - RNA, 16 nt, Human
ugcuaaucaaagccag

SEQ ID NO: 3712401 - RNA, 23 nt, Human
ugcuaaucagggaggucauuuug

SEQ ID NO: 3712402 - RNA, 14 nt, Human
ugcuaaucaguguc

SEQ ID NO: 3712403 - RNA, 20 nt, Human
ugcuaaucggguugucacuc

SEQ ID NO: 3712404 - RNA, 23 nt, Human
ugcuaaucuugugaaaauaauug

SEQ ID NO: 3712405 - RNA, 21 nt, Human
ugcuaaugucaaacuugaguc

SEQ ID NO: 3712406 - RNA, 17 nt, Human
ugcuaauuaaaaaguua

SEQ ID NO: 3712407 - RNA, 13 nt, Human
ugcuaauucuuug

SEQ ID NO: 3712408 - RNA, 16 nt, Human
ugcuaauucuuugcaa

SEQ ID NO: 3712409 - RNA, 17 nt, Human
ugcuaauucuuugcaaa

SEQ ID NO: 3712410 - RNA, 18 nt, Human
ugcuaauugcuguugaaa

SEQ ID NO: 3712411 - RNA, 21 nt, Human
ugcuaauugcuguugaaagca

SEQ ID NO: 3712412 - RNA, 22 nt, Human
ugcuaauugcuguugaaagcaa

SEQ ID NO: 3712413 - RNA, 15 nt, Human
ugcuaauuuucucaa

SEQ ID NO: 3712414 - RNA, 17 nt, Human
ugcuaauuuucucaaaa

SEQ ID NO: 3712415 - RNA, 20 nt, Human
ugcuaauuuugaaaaacugc

SEQ ID NO: 3712416 - RNA, 14 nt, Human
ugcuacaaaaacac

SEQ ID NO: 3712417 - RNA, 18 nt, Human
ugcuacaaaaacacagca

SEQ ID NO: 3712418 - RNA, 18 nt, Human
ugcuacaaagaagacaug

SEQ ID NO: 3712419 - RNA, 20 nt, Human
ugcuacaaagaagacauguu

SEQ ID NO: 3712420 - RNA, 21 nt, Human
ugcuacaaagaagacauguuu

SEQ ID NO: 3712421 - RNA, 11 nt, Human
ugcuacacacu

SEQ ID NO: 3712422 - RNA, 13 nt, Human
ugcuacaguaaua

SEQ ID NO: 3712423 - RNA, 14 nt, Human
ugcuaccaccagcu

SEQ ID NO: 3712424 - RNA, 15 nt, Human
ugcuaccaccagcug

SEQ ID NO: 3712425 - RNA, 17 nt, Human
ugcuaccaccagcugug

SEQ ID NO: 3712426 - RNA, 18 nt, Human
ugcuaccaccagcugugu

SEQ ID NO: 3712427 - RNA, 22 nt, Human
ugcuaccaccagcuguguccaa

SEQ ID NO: 3712428 - RNA, 23 nt, Human
ugggagaagggggucaaagcaag

SEQ ID NO: 3712429 - RNA, 23 nt, Human
ugggagaaucgcuccugcagccc

SEQ ID NO: 3712430 - RNA, 19 nt, Human
ugggagaaugucaguaugu

SEQ ID NO: 3712431 - RNA, 20 nt, Human
ugggagaaugucaguaugug

SEQ ID NO: 3712432 - RNA, 21 nt, Human
ugggagaauucuuacauguuu

SEQ ID NO: 3712433 - RNA, 16 nt, Human
ugggagacaugugaca

SEQ ID NO: 3712434 - RNA, 18 nt, Human
ugggagacugcugaguca

SEQ ID NO: 3712435 - RNA, 21 nt, Human
ugggagagaagagaaugcaca

SEQ ID NO: 3712436 - RNA, 14 nt, Human
ugggagagacuugu

SEQ ID NO: 3712437 - RNA, 16 nt, Human
ugggagagccauacau

SEQ ID NO: 3712438 - RNA, 23 nt, Human
ugggagagccccuggggccuaga

SEQ ID NO: 3712439 - RNA, 23 nt, Human
ugggagaggauuuuuuucugagc

SEQ ID NO: 3712440 - RNA, 15 nt, Human
ugggagaggcagccc

SEQ ID NO: 3712441 - RNA, 18 nt, Human
ugggagaggcagcccagg

SEQ ID NO: 3712442 - RNA, 14 nt, Human
ugggagagggcgca

SEQ ID NO: 3712443 - RNA, 22 nt, Human
ugggagagugucaaccagacag

SEQ ID NO: 3712444 - RNA, 14 nt, Human
ugggagauguggaa

SEQ ID NO: 3712445 - RNA, 14 nt, Human
ugggagauguuaga

SEQ ID NO: 3712446 - RNA, 23 nt, Human
ugggagauucaagggacccauga

SEQ ID NO: 3712447 - RNA, 13 nt, Human
ugggagcaaaaga

SEQ ID NO: 3712448 - RNA, 19 nt, Human
ugggagcaaacugcaugcc

SEQ ID NO: 3712449 - RNA, 23 nt, Human
ugggagcaggagauugagaagga

SEQ ID NO: 3712450 - RNA, 14 nt, Human
ugggagcaguccau

SEQ ID NO: 3712451 - RNA, 16 nt, Human
ugggagcccccagccu

SEQ ID NO: 3712452 - RNA, 18 nt, Human
ugggagccgggucugccu

SEQ ID NO: 3712453 - RNA, 16 nt, Human
ugggagcuccacucug

SEQ ID NO: 3712454 - RNA, 19 nt, Human
ugggagcuccacucugcuu

SEQ ID NO: 3712455 - RNA, 17 nt, Human
ugggagcugaaaaauca

SEQ ID NO: 3712456 - RNA, 16 nt, Human
ugggagcugaggccac

SEQ ID NO: 3712457 - RNA, 13 nt, Human
ugggagcugccug

SEQ ID NO: 3712458 - RNA, 17 nt, Human
ugggagcugccuguuca

SEQ ID NO: 3712459 - RNA, 23 nt, Human
ugggagcugccuguucagcucca

SEQ ID NO: 3712460 - RNA, 18 nt, Human
ugggagcugguuagaaau

SEQ ID NO: 3712461 - RNA, 19 nt, Human
ugggagcugguuagaaaug

SEQ ID NO: 3712462 - RNA, 16 nt, Human
ugggagcugucaagca

SEQ ID NO: 3712463 - RNA, 16 nt, Human
ugggagcuugggaaug

SEQ ID NO: 3712464 - RNA, 16 nt, Human
ugggagcuuuuguaga

SEQ ID NO: 3712465 - RNA, 16 nt, Human
ugggaggaaagagagc

SEQ ID NO: 3712466 - RNA, 15 nt, Human
ugggaggaaauuuga

SEQ ID NO: 3712467 - RNA, 11 nt, Human
ugggaggaagc

SEQ ID NO: 3712468 - RNA, 17 nt, Human
ugggaggaagcagaaua

SEQ ID NO: 3712469 - RNA, 22 nt, Human
ugggaggaagcagaauaaagca

SEQ ID NO: 3712470 - RNA, 23 nt, Human
ugggaggaagcagaauaaagcaa

SEQ ID NO: 3712471 - RNA, 18 nt, Human
ugggaggagcagauuuuu

SEQ ID NO: 3712472 - RNA, 13 nt, Human
ugggaggagggag

SEQ ID NO: 3712473 - RNA, 18 nt, Human
ugggaggagggagaggga

SEQ ID NO: 3712474 - RNA, 19 nt, Human
ugggaggagggagagggag

SEQ ID NO: 3712475 - RNA, 18 nt, Human
ugggaggaucucuugagc

SEQ ID NO: 3712476 - RNA, 22 nt, Human
ugggaggaucucuugagccugg

SEQ ID NO: 3712477 - RNA, 15 nt, Human
ugggaggaugugaau

SEQ ID NO: 3712478 - RNA, 23 nt, Human
ugggaggcaagagggguggagac

SEQ ID NO: 3712479 - RNA, 20 nt, Human
ugggaggcagagguugcagu

SEQ ID NO: 3712480 - RNA, 14 nt, Human
ugggaggccaagga

SEQ ID NO: 3712481 - RNA, 19 nt, Human
ugggaggccaaggugggag

SEQ ID NO: 3712482 - RNA, 20 nt, Human
ugggaggccaaggugggagg

SEQ ID NO: 3712483 - RNA, 18 nt, Human
ugggaggccccacugggg

SEQ ID NO: 3712484 - RNA, 12 nt, Human
ugggaggcgggc

SEQ ID NO: 3712485 - RNA, 20 nt, Human
ugggaggcucacccccuucu

SEQ ID NO: 3712486 - RNA, 14 nt, Human
ugggaggcuccugu

SEQ ID NO: 3712487 - RNA, 17 nt, Human
ugggaggcucuggagcc

SEQ ID NO: 3712488 - RNA, 19 nt, Human
ugggaggcugagaugggag

SEQ ID NO: 3712489 - RNA, 15 nt, Human
ugggaggcuggaguu

SEQ ID NO: 3712490 - RNA, 14 nt, Human
ugggaggcuucccc

SEQ ID NO: 3712491 - RNA, 14 nt, Human
ugggagggaaaagg

SEQ ID NO: 3712492 - RNA, 19 nt, Human
ugggagggagcugagaaga

SEQ ID NO: 3712493 - RNA, 18 nt, Human
ugggagggcagcagggcu

SEQ ID NO: 3712494 - RNA, 15 nt, Human
ugggaggggcaggcu

SEQ ID NO: 3712495 - RNA, 19 nt, Human
ugggaggggcgcccaccuc

SEQ ID NO: 3712496 - RNA, 20 nt, Human
ugggaggggguugggguggu

SEQ ID NO: 3712497 - RNA, 18 nt, Human
ugggaggucaaggcugca

SEQ ID NO: 3712498 - RNA, 19 nt, Human
ugggaggucaaggcugcag

SEQ ID NO: 3712499 - RNA, 16 nt, Human
ugggaggucaggaaac

SEQ ID NO: 3712500 - RNA, 17 nt, Human
ugggaggucaggaaacu

SEQ ID NO: 3712501 - RNA, 13 nt, Human
ugggaggucgagg

SEQ ID NO: 3712502 - RNA, 19 nt, Human
ugggaggugagaccaccuc

SEQ ID NO: 3712503 - RNA, 22 nt, Human
ugggagguggaagaagggagaa

SEQ ID NO: 3712504 - RNA, 19 nt, Human
ugggagguggagguugcau

SEQ ID NO: 3712505 - RNA, 20 nt, Human
ugggaguaguuggagcauug

SEQ ID NO: 3712506 - RNA, 23 nt, Human
ugggagucacacaguguuggagg

SEQ ID NO: 3712507 - RNA, 14 nt, Human
ugggaguccaggca

SEQ ID NO: 3712508 - RNA, 17 nt, Human
ugggaguccaggcacag

SEQ ID NO: 3712509 - RNA, 16 nt, Human
ugggagugggcccaau

SEQ ID NO: 3712510 - RNA, 11 nt, Human
ugggagugugu

SEQ ID NO: 3712511 - RNA, 20 nt, Human
ugggaguuuuguauucaucu

SEQ ID NO: 3712512 - RNA, 23 nt, Human
ugggauaaagaugcaaggaccag

SEQ ID NO: 3712513 - RNA, 13 nt, Human
ugggauaaaugcc

SEQ ID NO: 3712514 - RNA, 12 nt, Human
ugggauagagaa

SEQ ID NO: 3712515 - RNA, 20 nt, Human
ugggaucagggguaggaaug

SEQ ID NO: 3712516 - RNA, 20 nt, Human
ugggaucccucugggcacug

SEQ ID NO: 3712517 - RNA, 12 nt, Human
ugggauccucca

SEQ ID NO: 3712518 - RNA, 14 nt, Human
ugggauccuccagg

SEQ ID NO: 3712519 - RNA, 15 nt, Human
ugggaucuaggagag

SEQ ID NO: 3712520 - RNA, 16 nt, Human
ugggaugagccgcugu

SEQ ID NO: 3712521 - RNA, 14 nt, Human
ugggaugauugaag

SEQ ID NO: 3712522 - RNA, 16 nt, Human
ugggaugauugaagaa

SEQ ID NO: 3712523 - RNA, 23 nt, Human
ugggaugauugaagaaacagcua

SEQ ID NO: 3712524 - RNA, 12 nt, Human
ugggaugcuccu

SEQ ID NO: 3712525 - RNA, 19 nt, Human
ugggaugcuugccuagggc

SEQ ID NO: 3712526 - RNA, 14 nt, Human
ugggauggaggaga

SEQ ID NO: 3712527 - RNA, 16 nt, Human
ugggauggaggagaag

SEQ ID NO: 3712528 - RNA, 15 nt, Human
ugggauggaggggag

SEQ ID NO: 3712529 - RNA, 16 nt, Human
ugggaugguggagggc

SEQ ID NO: 3712530 - RNA, 20 nt, Human
ugggauggugggcuucaggg

SEQ ID NO: 3712531 - RNA, 21 nt, Human
ugggauguaugaauacagcag

SEQ ID NO: 3712532 - RNA, 23 nt, Human
ugggauguccacagaugccucca

SEQ ID NO: 3712533 - RNA, 15 nt, Human
ugggaugucuuauuu

SEQ ID NO: 3712534 - RNA, 16 nt, Human
ugggaugucuuauuuu

SEQ ID NO: 3712535 - RNA, 20 nt, Human
ugggaugugguuuucuuaag

SEQ ID NO: 3712536 - RNA, 16 nt, Human
ugggauguucagcacu

SEQ ID NO: 3712537 - RNA, 14 nt, Human
ugggauguuucugu

SEQ ID NO: 3712538 - RNA, 22 nt, Human
ugggauuacaagcgugagccac

SEQ ID NO: 3712539 - RNA, 17 nt, Human
ugggauuauauaucccu

SEQ ID NO: 3712540 - RNA, 18 nt, Human
ugggauuaugggucacag

SEQ ID NO: 3712541 - RNA, 20 nt, Human
ugggauuaugggucacagga

SEQ ID NO: 3712542 - RNA, 20 nt, Human
ugggauucaggaaaaggccu

SEQ ID NO: 3712543 - RNA, 22 nt, Human
ugggauucaggaaaaggccugg

SEQ ID NO: 3712544 - RNA, 24 nt, Human
ugggauuccugacccaggccgcag

SEQ ID NO: 3712545 - RNA, 23 nt, Human
ugggauugacagaagcuucugcc

SEQ ID NO: 3712546 - RNA, 14 nt, Human
ugggauugggggcu

SEQ ID NO: 3712547 - RNA, 21 nt, Human
ugggauugggggcuggugcca

SEQ ID NO: 3712548 - RNA, 14 nt, Human
ugggauuuaauuuc

SEQ ID NO: 3712549 - RNA, 17 nt, Human
ugggauuucuaugcagu

SEQ ID NO: 3712550 - RNA, 14 nt, Human
ugggauuugcugug

SEQ ID NO: 3712551 - RNA, 21 nt, Human
ugggauuuuaaacuagaugac

SEQ ID NO: 3712552 - RNA, 22 nt, Human
ugggcaaaacugaauuauaaga

SEQ ID NO: 3712553 - RNA, 16 nt, Human
ugggcaaacaggcagu

SEQ ID NO: 3712554 - RNA, 21 nt, Human
ugggcaaagccuagugaaggc

SEQ ID NO: 3712555 - RNA, 12 nt, Human
ugggcaacaaag

SEQ ID NO: 3712556 - RNA, 12 nt, Human
ugggcaacagag

SEQ ID NO: 3712557 - RNA, 16 nt, Human
ugggcaacagagcaag

SEQ ID NO: 3712558 - RNA, 19 nt, Human
ugggcaacagagcaagacu

SEQ ID NO: 3712559 - RNA, 16 nt, Human
ugggcaacauugcugg

SEQ ID NO: 3712560 - RNA, 16 nt, Human
ugggcaacccccagcc

SEQ ID NO: 3712561 - RNA, 20 nt, Human
ugggcaacccccagccugcu

SEQ ID NO: 3712562 - RNA, 14 nt, Human
ugggcaaggaaaaa

SEQ ID NO: 3712563 - RNA, 14 nt, Human
ugggcaaggaggcc

SEQ ID NO: 3712564 - RNA, 17 nt, Human
ugggcaauauaaccaau

SEQ ID NO: 3712565 - RNA, 16 nt, Human
ugggcaauauagcaag

SEQ ID NO: 3712566 - RNA, 13 nt, Human
ugggcaauauucu

SEQ ID NO: 3712567 - RNA, 17 nt, Human
ugggcaauauucucugu

SEQ ID NO: 3712568 - RNA, 21 nt, Human
ugggcacacgccucccacugg

SEQ ID NO: 3712569 - RNA, 15 nt, Human
ugggcacacgcugcu

SEQ ID NO: 3712570 - RNA, 23 nt, Human
ugggcacacgcugcucugcccca

SEQ ID NO: 3712571 - RNA, 16 nt, Human
ugggcacacucugcca

SEQ ID NO: 3712572 - RNA, 17 nt, Human
ugggcacccccagccug

SEQ ID NO: 3712573 - RNA, 20 nt, Human
ugggcacccccagccugggc

SEQ ID NO: 3712574 - RNA, 22 nt, Human
ugggcacccccagccugggccu

SEQ ID NO: 3712575 - RNA, 23 nt, Human
ugggcacccccagccugggccua

SEQ ID NO: 3712576 - RNA, 17 nt, Human
ugggcaccuauaauacc

SEQ ID NO: 3712577 - RNA, 19 nt, Human
ugggcaccuauaauaccag

SEQ ID NO: 3712578 - RNA, 21 nt, Human
ugggcacgcugugggcaggug

SEQ ID NO: 3712579 - RNA, 15 nt, Human
ugggcacuggcccag

SEQ ID NO: 3712580 - RNA, 16 nt, Human
ugggcacugggaugag

SEQ ID NO: 3712581 - RNA, 23 nt, Human
ugggcagaaggaagacuucaucc

SEQ ID NO: 3712582 - RNA, 17 nt, Human
ugggcagaagggagaag

SEQ ID NO: 3712583 - RNA, 11 nt, Human
ugggcagagca

SEQ ID NO: 3712584 - RNA, 14 nt, Human
ugggcagagcagag

SEQ ID NO: 3712585 - RNA, 15 nt, Human
ugggcagagcagaga

SEQ ID NO: 3712586 - RNA, 18 nt, Human
ugggcagagcagagacca

SEQ ID NO: 3712587 - RNA, 23 nt, Human
ugggcagagcagagaccaucccu

SEQ ID NO: 3712588 - RNA, 18 nt, Human
ugggcagagcccccagga

SEQ ID NO: 3712589 - RNA, 23 nt, Human
uggguccaggccuacuccugucu

SEQ ID NO: 3712590 - RNA, 21 nt, Human
uggguccaggggccccuccag

SEQ ID NO: 3712591 - RNA, 18 nt, Human
uggguccaugggcagagc

SEQ ID NO: 3712592 - RNA, 15 nt, Human
uggguccccagcccu

SEQ ID NO: 3712593 - RNA, 19 nt, Human
uggguccccagcccuuccu

SEQ ID NO: 3712594 - RNA, 17 nt, Human
ugggucccccacgugac

SEQ ID NO: 3712595 - RNA, 21 nt, Human
uggguccgauaauaucuuugu

SEQ ID NO: 3712596 - RNA, 18 nt, Human
uggguccucacaucuuuc

SEQ ID NO: 3712597 - RNA, 21 nt, Human
uggguccugggucuuucaugg

SEQ ID NO: 3712598 - RNA, 16 nt, Human
ugggucuauuccagcu

SEQ ID NO: 3712599 - RNA, 17 nt, Human
ugggucuauuccagcuc

SEQ ID NO: 3712600 - RNA, 18 nt, Human
ugggucucaccggcucuc

SEQ ID NO: 3712601 - RNA, 19 nt, Human
ugggucugagucauggccg

SEQ ID NO: 3712602 - RNA, 21 nt, Human
ugggucugggagucacacagu

SEQ ID NO: 3712603 - RNA, 14 nt, Human
ugggucugugcauu

SEQ ID NO: 3712604 - RNA, 15 nt, Human
ugggucugugugugu

SEQ ID NO: 3712605 - RNA, 14 nt, Human
ugggucuguuuucc

SEQ ID NO: 3712606 - RNA, 14 nt, Human
ugggugaaggcugg

SEQ ID NO: 3712607 - RNA, 15 nt, Human
ugggugaagggagag

SEQ ID NO: 3712608 - RNA, 12 nt, Human
ugggugacauuu

SEQ ID NO: 3712609 - RNA, 13 nt, Human
ugggugagaacaa

SEQ ID NO: 3712610 - RNA, 19 nt, Human
ugggugagaugcuggagaa

SEQ ID NO: 3712611 - RNA, 15 nt, Human
ugggugcccacagcc

SEQ ID NO: 3712612 - RNA, 23 nt, Human
ugggugcccacagcccgcaugca

SEQ ID NO: 3712613 - RNA, 17 nt, Human
ugggugccuaggccugg

SEQ ID NO: 3712614 - RNA, 13 nt, Human
ugggugcgacccc

SEQ ID NO: 3712615 - RNA, 22 nt, Human
ugggugcgaccccaucugccca

SEQ ID NO: 3712616 - RNA, 17 nt, Human
ugggugcuacuggggaa

SEQ ID NO: 3712617 - RNA, 15 nt, Human
ugggugcuuggagga

SEQ ID NO: 3712618 - RNA, 19 nt, Human
uggguggaaccaggaaccu

SEQ ID NO: 3712619 - RNA, 18 nt, Human
guguccaaaaccgccagc

SEQ ID NO: 3712620 - RNA, 20 nt, Human
guguccaaaaccgccagcuc

SEQ ID NO: 3712621 - RNA, 23 nt, Human
guguccaaaaccgccagcucugu

SEQ ID NO: 3712622 - RNA, 13 nt, Human
guguccaaagcag

SEQ ID NO: 3712623 - RNA, 16 nt, Human
guguccaacuccagua

SEQ ID NO: 3712624 - RNA, 11 nt, Human
guguccacccc

SEQ ID NO: 3712625 - RNA, 16 nt, Human
guguccaccugugggu

SEQ ID NO: 3712626 - RNA, 13 nt, Human
guguccaucccag

SEQ ID NO: 3712627 - RNA, 19 nt, Human
guguccaucccagcggcug

SEQ ID NO: 3712628 - RNA, 21 nt, Human
guguccaugcgcucagggcca

SEQ ID NO: 3712629 - RNA, 15 nt, Human
guguccaugugugug

SEQ ID NO: 3712630 - RNA, 16 nt, Human
guguccauugacaugu

SEQ ID NO: 3712631 - RNA, 11 nt, Human
guguccccacc

SEQ ID NO: 3712632 - RNA, 17 nt, Human
guguccccaccaucugc

SEQ ID NO: 3712633 - RNA, 18 nt, Human
guguccccaccaucugcu

SEQ ID NO: 3712634 - RNA, 20 nt, Human
guguccccaccaucugcugu

SEQ ID NO: 3712635 - RNA, 12 nt, Human
guguccccagcc

SEQ ID NO: 3712636 - RNA, 15 nt, Human
guguccccagcccac

SEQ ID NO: 3712637 - RNA, 14 nt, Human
gugucccccucugu

SEQ ID NO: 3712638 - RNA, 19 nt, Human
guguccccgcugcugugca

SEQ ID NO: 3712639 - RNA, 17 nt, Human
guguccccggggcccag

SEQ ID NO: 3712640 - RNA, 14 nt, Human
gugucccuaaugug

SEQ ID NO: 3712641 - RNA, 18 nt, Human
gugucccucucucuggaa

SEQ ID NO: 3712642 - RNA, 13 nt, Human
guguccuacagaa

SEQ ID NO: 3712643 - RNA, 21 nt, Human
guguccugaaacgcuccuuug

SEQ ID NO: 3712644 - RNA, 13 nt, Human
guguccugacacu

SEQ ID NO: 3712645 - RNA, 12 nt, Human
guguccuucccu

SEQ ID NO: 3712646 - RNA, 15 nt, Human
guguccuucccugca

SEQ ID NO: 3712647 - RNA, 19 nt, Human
guguccuugcaccugcauc

SEQ ID NO: 3712648 - RNA, 17 nt, Human
gugucgagucaaaaugu

SEQ ID NO: 3712649 - RNA, 13 nt, Human
gugucgggcccuu

SEQ ID NO: 3712650 - RNA, 17 nt, Human
gugucuaaaaacaccaa

SEQ ID NO: 3712651 - RNA, 15 nt, Human
gugucuaagauucua

SEQ ID NO: 3712652 - RNA, 18 nt, Human
gugucucacuaaagcaug

SEQ ID NO: 3712653 - RNA, 12 nt, Human
gugucucaggcu

SEQ ID NO: 3712654 - RNA, 14 nt, Human
gugucucaggcugc

SEQ ID NO: 3712655 - RNA, 19 nt, Human
gugucucaggcugccugag

SEQ ID NO: 3712656 - RNA, 18 nt, Human
gugucuccaaccccccag

SEQ ID NO: 3712657 - RNA, 14 nt, Human
gugucuccugcaug

SEQ ID NO: 3712658 - RNA, 18 nt, Human
gugucucuugguccugcu

SEQ ID NO: 3712659 - RNA, 22 nt, Human
gugucucuugguccugcugcag

SEQ ID NO: 3712660 - RNA, 16 nt, Human
gugucugagagauuca

SEQ ID NO: 3712661 - RNA, 13 nt, Human
gugucugcccccu

SEQ ID NO: 3712662 - RNA, 14 nt, Human
gugucugcccccuc

SEQ ID NO: 3712663 - RNA, 18 nt, Human
gugucuggaauuguggcu

SEQ ID NO: 3712664 - RNA, 16 nt, Human
gugucuggaucaguaa

SEQ ID NO: 3712665 - RNA, 20 nt, Human
gugucuggaucaguaaaauu

SEQ ID NO: 3712666 - RNA, 16 nt, Human
gugucuguacacgugu

SEQ ID NO: 3712667 - RNA, 21 nt, Human
gugucuguauuucauguggcu

SEQ ID NO: 3712668 - RNA, 15 nt, Human
gugucuuccucccaa

SEQ ID NO: 3712669 - RNA, 19 nt, Human
gugucuuccucccaagugg

SEQ ID NO: 3712670 - RNA, 12 nt, Human
gugucuuccugu

SEQ ID NO: 3712671 - RNA, 14 nt, Human
gugucuuccugugg

SEQ ID NO: 3712672 - RNA, 15 nt, Human
gugucuuguguuuuu

SEQ ID NO: 3712673 - RNA, 14 nt, Human
gugucuuguucugu

SEQ ID NO: 3712674 - RNA, 18 nt, Human
gugucuuuaaaugcugcu

SEQ ID NO: 3712675 - RNA, 17 nt, Human
gugucuuuagauagccc

SEQ ID NO: 3712676 - RNA, 15 nt, Human
gugucuuucuaagaa

SEQ ID NO: 3712677 - RNA, 15 nt, Human
gugucuuucucuuuu

SEQ ID NO: 3712678 - RNA, 21 nt, Human
gugucuuugugauuuugagua

SEQ ID NO: 3712679 - RNA, 16 nt, Human
gugucuuuuuuuguau

SEQ ID NO: 3712680 - RNA, 21 nt, Human
gugugaaaggaagcuccacug

SEQ ID NO: 3712681 - RNA, 15 nt, Human
gugugaacuuggaag

SEQ ID NO: 3712682 - RNA, 11 nt, Human
gugugaaguua

SEQ ID NO: 3712683 - RNA, 21 nt, Human
gugugaaguuagaauuccuuc

SEQ ID NO: 3712684 - RNA, 17 nt, Human
gugugaauaccccaaga

SEQ ID NO: 3712685 - RNA, 15 nt, Human
gugugaaugaacacu

SEQ ID NO: 3712686 - RNA, 18 nt, Human
gugugacagggccagugg

SEQ ID NO: 3712687 - RNA, 15 nt, Human
gugugacauuccagg

SEQ ID NO: 3712688 - RNA, 19 nt, Human
gugugacauuuggagaggg

SEQ ID NO: 3712689 - RNA, 21 nt, Human
gugugaccacugcagaagaca

SEQ ID NO: 3712690 - RNA, 14 nt, Human
gugugaccccuccu

SEQ ID NO: 3712691 - RNA, 23 nt, Human
gugugaccccuccuggggccagg

SEQ ID NO: 3712692 - RNA, 21 nt, Human
gugugagaagugaaugcuggg

SEQ ID NO: 3712693 - RNA, 12 nt, Human
gugugagacugg

SEQ ID NO: 3712694 - RNA, 13 nt, Human
gugugaggcagga

SEQ ID NO: 3712695 - RNA, 12 nt, Human
gugugaggccag

SEQ ID NO: 3712696 - RNA, 14 nt, Human
gugugaggccaggg

SEQ ID NO: 3712697 - RNA, 15 nt, Human
gugugaggccagggc

SEQ ID NO: 3712698 - RNA, 17 nt, Human
gugugaggguccugcag

SEQ ID NO: 3712699 - RNA, 17 nt, Human
gugugauauuucagaaa

SEQ ID NO: 3712700 - RNA, 19 nt, Human
gugugaucccaagugccag

SEQ ID NO: 3712701 - RNA, 22 nt, Human
gugugaugaacuuucucuucau

SEQ ID NO: 3712702 - RNA, 16 nt, Human
gugugauugaaucuga

SEQ ID NO: 3712703 - RNA, 16 nt, Human
gugugcaaguauguga

SEQ ID NO: 3712704 - RNA, 22 nt, Human
gugugcacacacaccacacaua

SEQ ID NO: 3712705 - RNA, 23 nt, Human
gugugcacauccgcgugugccug

SEQ ID NO: 3712706 - RNA, 22 nt, Human
gugugcaccuuaccaacuuucu

SEQ ID NO: 3712707 - RNA, 13 nt, Human
gugugcaggagcg

SEQ ID NO: 3712708 - RNA, 12 nt, Human
gugugcauaaua

SEQ ID NO: 3712709 - RNA, 18 nt, Human
gugugcauauuguacacu

SEQ ID NO: 3712710 - RNA, 21 nt, Human
gugugcauauuguacacuuuu

SEQ ID NO: 3712711 - RNA, 22 nt, Human
gugugcauauuguacacuuuuu

SEQ ID NO: 3712712 - RNA, 18 nt, Human
gugugcccagcuuauaaa

SEQ ID NO: 3712713 - RNA, 22 nt, Human
gugugccccccauccuggccca

SEQ ID NO: 3712714 - RNA, 13 nt, Human
gugugcccucugg

SEQ ID NO: 3712715 - RNA, 17 nt, Human
gugugcccucugggcuc

SEQ ID NO: 3712716 - RNA, 21 nt, Human
gugugcccucugggcucugag

SEQ ID NO: 3712717 - RNA, 22 nt, Human
gugugcccucugggcucugagu

SEQ ID NO: 3712718 - RNA, 19 nt, Human
gugugccugacugcccagc

SEQ ID NO: 3712719 - RNA, 20 nt, Human
gugugccugacugcccagca

SEQ ID NO: 3712720 - RNA, 14 nt, Human
gugugccugcagcc

SEQ ID NO: 3712721 - RNA, 13 nt, Human
gugugccugucug

SEQ ID NO: 3712722 - RNA, 14 nt, Human
gugugcguccuguc

SEQ ID NO: 3712723 - RNA, 22 nt, Human
gugugcuaaacguguauguuuu

SEQ ID NO: 3712724 - RNA, 16 nt, Human
gugugcucaggagccc

SEQ ID NO: 3712725 - RNA, 19 nt, Human
gugugcucaggagcccugg

SEQ ID NO: 3712726 - RNA, 16 nt, Human
gugugcucuccauucu

SEQ ID NO: 3712727 - RNA, 15 nt, Human
gugugcucugaucau

SEQ ID NO: 3712728 - RNA, 13 nt, Human
gugugcucuucuu

SEQ ID NO: 3712729 - RNA, 17 nt, Human
gugugcugaugggcgua

SEQ ID NO: 3712730 - RNA, 22 nt, Human
gugugcuuuaugcugaaacaga

SEQ ID NO: 3712731 - RNA, 16 nt, Human
gugugcuuuuuuugug

SEQ ID NO: 3712732 - RNA, 19 nt, Human
guguggaaauuaagaagaa

SEQ ID NO: 3712733 - RNA, 14 nt, Human
guguggacaggacu

SEQ ID NO: 3712734 - RNA, 15 nt, Human
guguggacugugaug

SEQ ID NO: 3712735 - RNA, 16 nt, Human
guguggacugugaugc

SEQ ID NO: 3712736 - RNA, 23 nt, Human
guguggagaagccacaggccuga

SEQ ID NO: 3712737 - RNA, 20 nt, Human
guguggagagggaaugugaa

SEQ ID NO: 3712738 - RNA, 18 nt, Human
guguggauccaauguuag

SEQ ID NO: 3712739 - RNA, 23 nt, Human
guguggauugccucugaaaagug

SEQ ID NO: 3712740 - RNA, 15 nt, Human
guguggcagagagag

SEQ ID NO: 3712741 - RNA, 13 nt, Human
guguggcagcagg

SEQ ID NO: 3712742 - RNA, 14 nt, Human
guguggcagugguu

SEQ ID NO: 3712743 - RNA, 14 nt, Human
guguggcccugcca

SEQ ID NO: 3712744 - RNA, 15 nt, Human
guguggccuguggcu

SEQ ID NO: 3712745 - RNA, 19 nt, Human
guguggcucacguguguga

SEQ ID NO: 3712746 - RNA, 20 nt, Human
guguggcugaggaggccucc

SEQ ID NO: 3712747 - RNA, 16 nt, Human
gugugggaagggagag

SEQ ID NO: 3712748 - RNA, 17 nt, Human
gugugggaguguguaau

SEQ ID NO: 3712749 - RNA, 23 nt, Human
guguggggccaugccuccucagg

SEQ ID NO: 3712750 - RNA, 14 nt, Human
gugugggucugugu

SEQ ID NO: 3712751 - RNA, 14 nt, Human
gugugguacagaga

SEQ ID NO: 3712752 - RNA, 13 nt, Human
gugugguggccuc

SEQ ID NO: 3712753 - RNA, 16 nt, Human
gugugguggccucagc

SEQ ID NO: 3712754 - RNA, 23 nt, Human
gugugguggccucagcugaaugc

SEQ ID NO: 3712755 - RNA, 15 nt, Human
gugugguguuuccug

SEQ ID NO: 3712756 - RNA, 21 nt, Human
gugugguuugguguguucccg

SEQ ID NO: 3712757 - RNA, 12 nt, Human
guguguaaacaa

SEQ ID NO: 3712758 - RNA, 14 nt, Human
guguguaauuuaaa

SEQ ID NO: 3712759 - RNA, 17 nt, Human
guguguagaguuaagaa

SEQ ID NO: 3712760 - RNA, 16 nt, Human
guguguagauaguaug

SEQ ID NO: 3712761 - RNA, 20 nt, Human
guguguaugugcgugugugc

SEQ ID NO: 3712762 - RNA, 12 nt, Human
guguguaugugg

SEQ ID NO: 3712763 - RNA, 15 nt, Human
guguguauguggggg

SEQ ID NO: 3712764 - RNA, 15 nt, Human
guguguauguguauu

SEQ ID NO: 3712765 - RNA, 20 nt, Human
gugugucacccuuaggccag

SEQ ID NO: 3712766 - RNA, 16 nt, Human
gugugucagcugaggc

SEQ ID NO: 3712767 - RNA, 19 nt, Human
guguguccacgacugucuc

SEQ ID NO: 3712768 - RNA, 14 nt, Human
gugugucccaggca

SEQ ID NO: 3712769 - RNA, 10 nt, Human
guguguccuu

SEQ ID NO: 3712770 - RNA, 12 nt, Human
guguguccuugu

SEQ ID NO: 3712771 - RNA, 18 nt, Human
ugcuggaggugggagcag

SEQ ID NO: 3712772 - RNA, 18 nt, Human
ugcuggagucuccugagg

SEQ ID NO: 3712773 - RNA, 20 nt, Human
ugcuggaguuucauguacaa

SEQ ID NO: 3712774 - RNA, 16 nt, Human
ugcuggauauuuucaa

SEQ ID NO: 3712775 - RNA, 20 nt, Human
ugcuggaucucccagggcua

SEQ ID NO: 3712776 - RNA, 19 nt, Human
ugcuggauggagcccaggc

SEQ ID NO: 3712777 - RNA, 20 nt, Human
ugcuggauggagcccaggcg

SEQ ID NO: 3712778 - RNA, 18 nt, Human
ugcuggaugucugccaau

SEQ ID NO: 3712779 - RNA, 18 nt, Human
ugcuggcacauuucccca

SEQ ID NO: 3712780 - RNA, 18 nt, Human
ugcuggccagccuggggc

SEQ ID NO: 3712781 - RNA, 17 nt, Human
ugcuggcccagggccca

SEQ ID NO: 3712782 - RNA, 19 nt, Human
ugcuggcccagggcccaga

SEQ ID NO: 3712783 - RNA, 21 nt, Human
ugcuggcccagggcccagagc

SEQ ID NO: 3712784 - RNA, 16 nt, Human
ugcuggccccagcccu

SEQ ID NO: 3712785 - RNA, 12 nt, Human
ugcuggccccuc

SEQ ID NO: 3712786 - RNA, 22 nt, Human
ugcuggccccucaccugggcac

SEQ ID NO: 3712787 - RNA, 15 nt, Human
ugcuggccgccucac

SEQ ID NO: 3712788 - RNA, 17 nt, Human
ugcuggccgccucaccc

SEQ ID NO: 3712789 - RNA, 15 nt, Human
ugcuggccggacacc

SEQ ID NO: 3712790 - RNA, 16 nt, Human
ugcuggccgggcacag

SEQ ID NO: 3712791 - RNA, 18 nt, Human
ugcuggccgggcacagcu

SEQ ID NO: 3712792 - RNA, 13 nt, Human
ugcuggccucugc

SEQ ID NO: 3712793 - RNA, 16 nt, Human
ugcuggccucugcgag

SEQ ID NO: 3712794 - RNA, 12 nt, Human
ugcuggccugga

SEQ ID NO: 3712795 - RNA, 14 nt, Human
ugcuggccuuugcu

SEQ ID NO: 3712796 - RNA, 14 nt, Human
ugcuggcgccucug

SEQ ID NO: 3712797 - RNA, 13 nt, Human
ugcuggcucuucu

SEQ ID NO: 3712798 - RNA, 14 nt, Human
ugcuggcugcccag

SEQ ID NO: 3712799 - RNA, 18 nt, Human
ugcuggcuguuggcuggg

SEQ ID NO: 3712800 - RNA, 19 nt, Human
ugcuggcuguuggcugggg

SEQ ID NO: 3712801 - RNA, 18 nt, Human
ugcugggacucagccuuc

SEQ ID NO: 3712802 - RNA, 15 nt, Human
ugcugggacugagcc

SEQ ID NO: 3712803 - RNA, 16 nt, Human
ugcugggacugagcca

SEQ ID NO: 3712804 - RNA, 20 nt, Human
ugcugggacugagccagucc

SEQ ID NO: 3712805 - RNA, 15 nt, Human
ugcugggacuggcca

SEQ ID NO: 3712806 - RNA, 17 nt, Human
ugcugggagaggcagcc

SEQ ID NO: 3712807 - RNA, 17 nt, Human
ugcugggagcuccacuc

SEQ ID NO: 3712808 - RNA, 18 nt, Human
ugcugggagcuccacucu

SEQ ID NO: 3712809 - RNA, 21 nt, Human
ugcugggagcuccacucugcu

SEQ ID NO: 3712810 - RNA, 20 nt, Human
ugcugggaggagggagaggg

SEQ ID NO: 3712811 - RNA, 16 nt, Human
ugcugggauggugggc

SEQ ID NO: 3712812 - RNA, 20 nt, Human
ugcugggauggugggcuuca

SEQ ID NO: 3712813 - RNA, 11 nt, Human
ugcugggcagc

SEQ ID NO: 3712814 - RNA, 14 nt, Human
ugcugggccccugc

SEQ ID NO: 3712815 - RNA, 16 nt, Human
ugcugggccccugccu

SEQ ID NO: 3712816 - RNA, 23 nt, Human
ugcugggccccugccucucugca

SEQ ID NO: 3712817 - RNA, 24 nt, Human
ugcugggccccugccucucugcag

SEQ ID NO: 3712818 - RNA, 14 nt, Human
ugcugggcucagug

SEQ ID NO: 3712819 - RNA, 16 nt, Human
ugcugggcucuccacc

SEQ ID NO: 3712820 - RNA, 18 nt, Human
ugcugggcucuccaccuc

SEQ ID NO: 3712821 - RNA, 24 nt, Human
ugcugggcugacggugcagucugg

SEQ ID NO: 3712822 - RNA, 22 nt, Human
ugcuggggaagacaguggcccc

SEQ ID NO: 3712823 - RNA, 22 nt, Human
ugcuggggacggggggccccag

SEQ ID NO: 3712824 - RNA, 17 nt, Human
ugcuggggccucagacg

SEQ ID NO: 3712825 - RNA, 22 nt, Human
ugcugggggaaugagcccagag

SEQ ID NO: 3712826 - RNA, 20 nt, Human
ugcugggggcaacuggccau

SEQ ID NO: 3712827 - RNA, 16 nt, Human
ugcugggggccgcccu

SEQ ID NO: 3712828 - RNA, 20 nt, Human
ugcugggggggauuguaaaa

SEQ ID NO: 3712829 - RNA, 22 nt, Human
ugcuggguccauaucacacaca

SEQ ID NO: 3712830 - RNA, 13 nt, Human
ugcuggguggccc

SEQ ID NO: 3712831 - RNA, 14 nt, Human
ugcuggguggccca

SEQ ID NO: 3712832 - RNA, 21 nt, Human
ugcuggguuggugcacaguga

SEQ ID NO: 3712833 - RNA, 18 nt, Human
ugcugguaaaaugaagaa

SEQ ID NO: 3712834 - RNA, 16 nt, Human
ugcuggucacagccuc

SEQ ID NO: 3712835 - RNA, 17 nt, Human
ugcuggucacagccucc

SEQ ID NO: 3712836 - RNA, 18 nt, Human
ugcuggugagccaagcag

SEQ ID NO: 3712837 - RNA, 13 nt, Human
ugcugguguaugu

SEQ ID NO: 3712838 - RNA, 15 nt, Human
ugcugguguccugac

SEQ ID NO: 3712839 - RNA, 16 nt, Human
ugcugguguccugacc

SEQ ID NO: 3712840 - RNA, 22 nt, Human
ugcugguguccugaccacccuc

SEQ ID NO: 3712841 - RNA, 13 nt, Human
ugcugguugcugu

SEQ ID NO: 3712842 - RNA, 23 nt, Human
ugcugguugucauuuuugcagua

SEQ ID NO: 3712843 - RNA, 15 nt, Human
ugcugguuuuaacaa

SEQ ID NO: 3712844 - RNA, 13 nt, Human
ugcugguuuucua

SEQ ID NO: 3712845 - RNA, 18 nt, Human
ugcugguuuuucaguuuu

SEQ ID NO: 3712846 - RNA, 17 nt, Human
ugcuguaaaaacugugg

SEQ ID NO: 3712847 - RNA, 18 nt, Human
ugcuguaaauuuggcuuc

SEQ ID NO: 3712848 - RNA, 20 nt, Human
ugcuguaaauuuggcuucug

SEQ ID NO: 3712849 - RNA, 15 nt, Human
ugcuguaagaugucu

SEQ ID NO: 3712850 - RNA, 14 nt, Human
ugcuguacaaaagc

SEQ ID NO: 3712851 - RNA, 20 nt, Human
ugcuguacacauauuugaag

SEQ ID NO: 3712852 - RNA, 15 nt, Human
ugcuguacauacuuu

SEQ ID NO: 3712853 - RNA, 17 nt, Human
ugcuguacauacuuuuu

SEQ ID NO: 3712854 - RNA, 14 nt, Human
ugcuguacuagaga

SEQ ID NO: 3712855 - RNA, 17 nt, Human
ugcuguagccuauuuuu

SEQ ID NO: 3712856 - RNA, 13 nt, Human
ugcuguauaaaau

SEQ ID NO: 3712857 - RNA, 20 nt, Human
ugcuguaugcugaucaucgc

SEQ ID NO: 3712858 - RNA, 22 nt, Human
ugcuguaugcugaucaucgcca

SEQ ID NO: 3712859 - RNA, 21 nt, Human
ugcuguauuuuaaaagaauga

SEQ ID NO: 3712860 - RNA, 14 nt, Human
ugcuguauuuucuu

SEQ ID NO: 3712861 - RNA, 18 nt, Human
ugcuguauuuucuuuuua

SEQ ID NO: 3712862 - RNA, 17 nt, Human
ugcugucaccuugcuca

SEQ ID NO: 3712863 - RNA, 22 nt, Human
ugcugucaugaaaucagcaaga

SEQ ID NO: 3712864 - RNA, 15 nt, Human
ugcuguccagacagc

SEQ ID NO: 3712865 - RNA, 20 nt, Human
ugcuguccccuuggcagguc

SEQ ID NO: 3712866 - RNA, 16 nt, Human
ugcugucccucccccu

SEQ ID NO: 3712867 - RNA, 15 nt, Human
ugcugucccuuuucc

SEQ ID NO: 3712868 - RNA, 23 nt, Human
ugcuguccuaggccacaccaucu

SEQ ID NO: 3712869 - RNA, 12 nt, Human
ugcuguccucag

SEQ ID NO: 3712870 - RNA, 19 nt, Human
ugcuguccugaucugugau

SEQ ID NO: 3712871 - RNA, 17 nt, Human
ugcugucuaaccuguga

SEQ ID NO: 3712872 - RNA, 12 nt, Human
ugcugucugcag

SEQ ID NO: 3712873 - RNA, 17 nt, Human
ugcugucugcagccuug

SEQ ID NO: 3712874 - RNA, 13 nt, Human
ugcugucuuaaac

SEQ ID NO: 3712875 - RNA, 23 nt, Human
ugcugucuuuucuuugccaucuc

SEQ ID NO: 3712876 - RNA, 14 nt, Human
ugcugugaaaaaaa

SEQ ID NO: 3712877 - RNA, 18 nt, Human
ugcugugaacccuggggc

SEQ ID NO: 3712878 - RNA, 21 nt, Human
ugcugugaacccuggggccug

SEQ ID NO: 3712879 - RNA, 17 nt, Human
ugcugugaagcuggaac

SEQ ID NO: 3712880 - RNA, 21 nt, Human
ugcugugaauuuguguaagga

SEQ ID NO: 3712881 - RNA, 18 nt, Human
ugcugugaccauuuauaa

SEQ ID NO: 3712882 - RNA, 14 nt, Human
ugcugugaggcugu

SEQ ID NO: 3712883 - RNA, 18 nt, Human
ugcugugaggcuguccug

SEQ ID NO: 3712884 - RNA, 23 nt, Human
ugcugugagggaggggaaaagca

SEQ ID NO: 3712885 - RNA, 12 nt, Human
ugcugugccccu

SEQ ID NO: 3712886 - RNA, 16 nt, Human
ugcugugccccuggcc

SEQ ID NO: 3712887 - RNA, 18 nt, Human
ugcugugcgcccagggcu

SEQ ID NO: 3712888 - RNA, 12 nt, Human
ugcuguggccag

SEQ ID NO: 3712889 - RNA, 15 nt, Human
ugcuguggccaggag

SEQ ID NO: 3712890 - RNA, 14 nt, Human
ugcuguggccaggg

SEQ ID NO: 3712891 - RNA, 17 nt, Human
ugcuguggccaggguga

SEQ ID NO: 3712892 - RNA, 23 nt, Human
ugcuguggccagggugagagcug

SEQ ID NO: 3712893 - RNA, 16 nt, Human
ugcuguggccugggca

SEQ ID NO: 3712894 - RNA, 17 nt, Human
ugcugugggaacgagag

SEQ ID NO: 3712895 - RNA, 22 nt, Human
ugcugugggaacgagaggggaa

SEQ ID NO: 3712896 - RNA, 12 nt, Human
ugcuguguaaag

SEQ ID NO: 3712897 - RNA, 13 nt, Human
ugcuguguaaagu

SEQ ID NO: 3712898 - RNA, 14 nt, Human
ugcuguguaaaguu

SEQ ID NO: 3712899 - RNA, 15 nt, Human
ugcuguguaaaguua

SEQ ID NO: 3712900 - RNA, 19 nt, Human
ugcuguguauaugguauau

SEQ ID NO: 3712901 - RNA, 21 nt, Human
ugcuguguaucugauagcucu

SEQ ID NO: 3712902 - RNA, 15 nt, Human
ugcugugugcuuuuu

SEQ ID NO: 3712903 - RNA, 18 nt, Human
ugcugugugucccaggca

SEQ ID NO: 3712904 - RNA, 23 nt, Human
ugcugugugucccaggcagggag

SEQ ID NO: 3712905 - RNA, 11 nt, Human
ugcuguguuaa

SEQ ID NO: 3712906 - RNA, 18 nt, Human
ugcuguguuaaauaaacc

SEQ ID NO: 3712907 - RNA, 21 nt, Human
ugcuguguuugagcucugcag

SEQ ID NO: 3712908 - RNA, 22 nt, Human
ugcuguuaacugcaaccuuguu

SEQ ID NO: 3712909 - RNA, 15 nt, Human
ugcuguuauauuuca

SEQ ID NO: 3712910 - RNA, 18 nt, Human
ugcuguuauauuucauca

SEQ ID NO: 3712911 - RNA, 21 nt, Human
ugcuguucacuggacacuuca

SEQ ID NO: 3712912 - RNA, 17 nt, Human
ugcuguucaugaaagau

SEQ ID NO: 3712913 - RNA, 14 nt, Human
ugcuguuccagugg

SEQ ID NO: 3712914 - RNA, 22 nt, Human
ugcuguucucuugggaacugaa

SEQ ID NO: 3712915 - RNA, 14 nt, Human
ugcuguugaaagca

SEQ ID NO: 3712916 - RNA, 12 nt, Human
ugcuguugcuua

SEQ ID NO: 3712917 - RNA, 14 nt, Human
ugcuguugcuugaa

SEQ ID NO: 3712918 - RNA, 22 nt, Human
ugcuguugucauugcuuuacug

SEQ ID NO: 3712919 - RNA, 18 nt, Human
ugcuguuguuaugaugug

SEQ ID NO: 3712920 - RNA, 20 nt, Human
ugcuguuguuaugaugugcu

SEQ ID NO: 3712921 - RNA, 16 nt, Human
uggguggacaggggcc

SEQ ID NO: 3712922 - RNA, 23 nt, Human
uggguggagaagccauugucuuc

SEQ ID NO: 3712923 - RNA, 17 nt, Human
uggguggcaccagcagc

SEQ ID NO: 3712924 - RNA, 15 nt, Human
uggguggcccauccc

SEQ ID NO: 3712925 - RNA, 15 nt, Human
uggguggccucggga

SEQ ID NO: 3712926 - RNA, 16 nt, Human
ugggugggcaggaaaa

SEQ ID NO: 3712927 - RNA, 18 nt, Human
ugggugggcaggaaaagg

SEQ ID NO: 3712928 - RNA, 12 nt, Human
uggguggggcug

SEQ ID NO: 3712929 - RNA, 16 nt, Human
ugggugggguauuuuu

SEQ ID NO: 3712930 - RNA, 15 nt, Human
uggguggggugagga

SEQ ID NO: 3712931 - RNA, 13 nt, Human
ugggugguacccu

SEQ ID NO: 3712932 - RNA, 18 nt, Human
ugggugguacccucugga

SEQ ID NO: 3712933 - RNA, 14 nt, Human
ugggugguggaucu

SEQ ID NO: 3712934 - RNA, 15 nt, Human
ugggugguggaucug

SEQ ID NO: 3712935 - RNA, 14 nt, Human
uggguguagccagg

SEQ ID NO: 3712936 - RNA, 22 nt, Human
uggguguauuuauuuuccuccc

SEQ ID NO: 3712937 - RNA, 17 nt, Human
uggguguggucuccacu

SEQ ID NO: 3712938 - RNA, 22 nt, Human
uggguguuaucaccuagcugaa

SEQ ID NO: 3712939 - RNA, 20 nt, Human
uggguguuccuggcaguuua

SEQ ID NO: 3712940 - RNA, 19 nt, Human
uggguuagggaaaacauuc

SEQ ID NO: 3712941 - RNA, 15 nt, Human
uggguuaugaauauu

SEQ ID NO: 3712942 - RNA, 20 nt, Human
uggguucagaaaugcugccu

SEQ ID NO: 3712943 - RNA, 24 nt, Human
uggguucaggggacucagcccuga

SEQ ID NO: 3712944 - RNA, 19 nt, Human
uggguucaugaugcagucu

SEQ ID NO: 3712945 - RNA, 13 nt, Human
uggguuccacaga

SEQ ID NO: 3712946 - RNA, 15 nt, Human
uggguuccacagacg

SEQ ID NO: 3712947 - RNA, 15 nt, Human
uggguuccauucuca

SEQ ID NO: 3712948 - RNA, 21 nt, Human
uggguuccucuuccccacucc

SEQ ID NO: 3712949 - RNA, 22 nt, Human
uggguuccuuccucugagccuu

SEQ ID NO: 3712950 - RNA, 16 nt, Human
uggguucuacccaggu

SEQ ID NO: 3712951 - RNA, 19 nt, Human
uggguucugccugccagcu

SEQ ID NO: 3712952 - RNA, 21 nt, Human
uggguucugccugccagcugc

SEQ ID NO: 3712953 - RNA, 17 nt, Human
uggguucuuuggaagga

SEQ ID NO: 3712954 - RNA, 14 nt, Human
uggguugacuuuca

SEQ ID NO: 3712955 - RNA, 17 nt, Human
uggguuggaaaacagua

SEQ ID NO: 3712956 - RNA, 17 nt, Human
uggguuggcgcacccuc

SEQ ID NO: 3712957 - RNA, 15 nt, Human
uggguugggaucagg

SEQ ID NO: 3712958 - RNA, 16 nt, Human
uggguuucauauuucu

SEQ ID NO: 3712959 - RNA, 18 nt, Human
uggguuuccaacaauuca

SEQ ID NO: 3712960 - RNA, 17 nt, Human
uggguuucuaaagcugc

SEQ ID NO: 3712961 - RNA, 18 nt, Human
uggguuucuaaagcugcc

SEQ ID NO: 3712962 - RNA, 16 nt, Human
uggguuuuaugagaug

SEQ ID NO: 3712963 - RNA, 19 nt, Human
uggguuuucuuaaccaucu

SEQ ID NO: 3712964 - RNA, 21 nt, Human
uggguuuuguauucucugagc

SEQ ID NO: 3712965 - RNA, 16 nt, Human
uggguuuuguucuugu

SEQ ID NO: 3712966 - RNA, 22 nt, Human
uggguuuuuauuuccuaugaug

SEQ ID NO: 3712967 - RNA, 17 nt, Human
uggguuuuuggacuucu

SEQ ID NO: 3712968 - RNA, 19 nt, Human
ugguaaaaugaagaauuua

SEQ ID NO: 3712969 - RNA, 16 nt, Human
ugguaaagacuggcuu

SEQ ID NO: 3712970 - RNA, 17 nt, Human
ugguaaagacuggcuuu

SEQ ID NO: 3712971 - RNA, 15 nt, Human
ugguaaauguuucuu

SEQ ID NO: 3712972 - RNA, 20 nt, Human
ugguaaauuuccccaacagu

SEQ ID NO: 3712973 - RNA, 22 nt, Human
ugguaaauuuccccaacagugu

SEQ ID NO: 3712974 - RNA, 17 nt, Human
ugguaacaguucauguu

SEQ ID NO: 3712975 - RNA, 22 nt, Human
ugguaacugcuuucuguuccaa

SEQ ID NO: 3712976 - RNA, 24 nt, Human
ugguaacuuuugugaauuaggcug

SEQ ID NO: 3712977 - RNA, 12 nt, Human
ugguaagaaaaa

SEQ ID NO: 3712978 - RNA, 13 nt, Human
ugguaagaaaaag

SEQ ID NO: 3712979 - RNA, 17 nt, Human
ugguaagaaaaagcaaa

SEQ ID NO: 3712980 - RNA, 22 nt, Human
ugguaagaaaaagcaaaaggca

SEQ ID NO: 3712981 - RNA, 15 nt, Human
ugguaagagacagaa

SEQ ID NO: 3712982 - RNA, 20 nt, Human
ugguaagcaacauggcuuug

SEQ ID NO: 3712983 - RNA, 15 nt, Human
ugguaagcucuggcu

SEQ ID NO: 3712984 - RNA, 19 nt, Human
ugguaagcuuccaggaaaa

SEQ ID NO: 3712985 - RNA, 13 nt, Human
ugguaagggaaaa

SEQ ID NO: 3712986 - RNA, 14 nt, Human
ugguaaucauauua

SEQ ID NO: 3712987 - RNA, 17 nt, Human
ugguaauguguuuuaga

SEQ ID NO: 3712988 - RNA, 13 nt, Human
ugguaauuguugc

SEQ ID NO: 3712989 - RNA, 15 nt, Human
ugguacaaaaauaaa

SEQ ID NO: 3712990 - RNA, 15 nt, Human
ugguacaacggaggc

SEQ ID NO: 3712991 - RNA, 16 nt, Human
ugguacaacggaggcc

SEQ ID NO: 3712992 - RNA, 16 nt, Human
ugguacagagaagcca

SEQ ID NO: 3712993 - RNA, 18 nt, Human
ugguacagagaagccagc

SEQ ID NO: 3712994 - RNA, 20 nt, Human
ugguacagagaagccagcuu

SEQ ID NO: 3712995 - RNA, 15 nt, Human
ugguacaugguguuu

SEQ ID NO: 3712996 - RNA, 14 nt, Human
ugguaccagauaaa

SEQ ID NO: 3712997 - RNA, 16 nt, Human
ugguaccagcccuggg

SEQ ID NO: 3712998 - RNA, 18 nt, Human
ugguaccagcccuggggc

SEQ ID NO: 3712999 - RNA, 20 nt, Human
ugguaccagcccuggggcug

SEQ ID NO: 3713000 - RNA, 16 nt, Human
ugguacccccuucugg

SEQ ID NO: 3713001 - RNA, 17 nt, Human
ugguacccccuucuggg

SEQ ID NO: 3713002 - RNA, 17 nt, Human
ugguacucccucucagg

SEQ ID NO: 3713003 - RNA, 22 nt, Human
ugguacucccucucaggaucca

SEQ ID NO: 3713004 - RNA, 17 nt, Human
ugguacucuccuagaga

SEQ ID NO: 3713005 - RNA, 16 nt, Human
ugguacucugaaacac

SEQ ID NO: 3713006 - RNA, 17 nt, Human
ugguacugacuuugcuu

SEQ ID NO: 3713007 - RNA, 21 nt, Human
ugguacugacuuugcuugcuu

SEQ ID NO: 3713008 - RNA, 17 nt, Human
ugguacuuuugagugug

SEQ ID NO: 3713009 - RNA, 12 nt, Human
ugguagaaacaa

SEQ ID NO: 3713010 - RNA, 19 nt, Human
ugguagaaguuuggcugcu

SEQ ID NO: 3713011 - RNA, 20 nt, Human
ugguagaauuggagaguaaa

SEQ ID NO: 3713012 - RNA, 17 nt, Human
ugguagaccacugccau

SEQ ID NO: 3713013 - RNA, 23 nt, Human
ugguagaccacugccauaugauu

SEQ ID NO: 3713014 - RNA, 13 nt, Human
ugguagagauuca

SEQ ID NO: 3713015 - RNA, 18 nt, Human
ugguagauuaaauauaga

SEQ ID NO: 3713016 - RNA, 19 nt, Human
ugguagauuaaauauagau

SEQ ID NO: 3713017 - RNA, 17 nt, Human
ugguagcuuuucccuuc

SEQ ID NO: 3713018 - RNA, 21 nt, Human
ugguagcuuuucccuucuuuu

SEQ ID NO: 3713019 - RNA, 18 nt, Human
ugguaggaauagcauguc

SEQ ID NO: 3713020 - RNA, 13 nt, Human
ugguaggguggga

SEQ ID NO: 3713021 - RNA, 21 nt, Human
ugguagguugggacaccaggg

SEQ ID NO: 3713022 - RNA, 19 nt, Human
ugguaguaaaacacagagg

SEQ ID NO: 3713023 - RNA, 17 nt, Human
ugguaguuaguagcaug

SEQ ID NO: 3713024 - RNA, 13 nt, Human
ugguauauauaca

SEQ ID NO: 3713025 - RNA, 18 nt, Human
ugguaucaaaauuacaua

SEQ ID NO: 3713026 - RNA, 22 nt, Human
ugguaucuagacccaucuucuu

SEQ ID NO: 3713027 - RNA, 13 nt, Human
ugguaucucagaa

SEQ ID NO: 3713028 - RNA, 19 nt, Human
ugguaugaacuugaggaca

SEQ ID NO: 3713029 - RNA, 19 nt, Human
ugguauggguuucucccag

SEQ ID NO: 3713030 - RNA, 15 nt, Human
ugguaugugugugua

SEQ ID NO: 3713031 - RNA, 19 nt, Human
ugguauguguguguaugcu

SEQ ID NO: 3713032 - RNA, 21 nt, Human
ugguauguguguguaugcuac

SEQ ID NO: 3713033 - RNA, 13 nt, Human
ugguauguuuuca

SEQ ID NO: 3713034 - RNA, 18 nt, Human
ugguauuacacuguauuu

SEQ ID NO: 3713035 - RNA, 20 nt, Human
ugguauuacacuguauuugu

SEQ ID NO: 3713036 - RNA, 19 nt, Human
ugguauucaggauuacaug

SEQ ID NO: 3713037 - RNA, 23 nt, Human
ugguauuggccauaagcaacaau

SEQ ID NO: 3713038 - RNA, 23 nt, Human
ugguauuguauuuauucaauaaa

SEQ ID NO: 3713039 - RNA, 19 nt, Human
ugguauuuaucuauuguaa

SEQ ID NO: 3713040 - RNA, 22 nt, Human
ugguauuuaucuauuguaagau

SEQ ID NO: 3713041 - RNA, 15 nt, Human
ugguauuugaaacac

SEQ ID NO: 3713042 - RNA, 17 nt, Human
ugguauuuucaauagcc

SEQ ID NO: 3713043 - RNA, 17 nt, Human
uggucaaaagcuggauu

SEQ ID NO: 3713044 - RNA, 18 nt, Human
uggucaacuugagcaugu

SEQ ID NO: 3713045 - RNA, 22 nt, Human
uggucaagauuuugaaugcuuc

SEQ ID NO: 3713046 - RNA, 22 nt, Human
uggucaauccgaaguaugaggg

SEQ ID NO: 3713047 - RNA, 22 nt, Human
uggucacaacuugauggcugcg

SEQ ID NO: 3713048 - RNA, 16 nt, Human
uggucacacacugaug

SEQ ID NO: 3713049 - RNA, 14 nt, Human
uggucacagagaac

SEQ ID NO: 3713050 - RNA, 15 nt, Human
uggucacagcggagg

SEQ ID NO: 3713051 - RNA, 20 nt, Human
uggucacaggacucugccuc

SEQ ID NO: 3713052 - RNA, 23 nt, Human
uggucaccaaaucagcugcuacu

SEQ ID NO: 3713053 - RNA, 22 nt, Human
uggucaccuaggaagccucaga

SEQ ID NO: 3713054 - RNA, 13 nt, Human
uggucacugccau

SEQ ID NO: 3713055 - RNA, 14 nt, Human
uggucacugcuguc

SEQ ID NO: 3713056 - RNA, 15 nt, Human
uggucacuucuucug

SEQ ID NO: 3713057 - RNA, 19 nt, Human
uggucagcucccuucucug

SEQ ID NO: 3713058 - RNA, 13 nt, Human
uggucaggcuggu

SEQ ID NO: 3713059 - RNA, 21 nt, Human
uggucauagcccagaucagcu

SEQ ID NO: 3713060 - RNA, 16 nt, Human
uggucaucuuuuucuc

SEQ ID NO: 3713061 - RNA, 19 nt, Human
uggucaugugggucuucca

SEQ ID NO: 3713062 - RNA, 20 nt, Human
uggucaugugggucuuccag

SEQ ID NO: 3713063 - RNA, 16 nt, Human
ugguccaacugcaacu

SEQ ID NO: 3713064 - RNA, 19 nt, Human
ugguccaauuaguuuccuu

SEQ ID NO: 3713065 - RNA, 21 nt, Human
ugguccacagggcaccugcca

SEQ ID NO: 3713066 - RNA, 17 nt, Human
ugguccagggaagcugg

SEQ ID NO: 3713067 - RNA, 19 nt, Human
ugguccagggaagcuggcc

SEQ ID NO: 3713068 - RNA, 14 nt, Human
ugguccaggguuga

SEQ ID NO: 3713069 - RNA, 16 nt, Human
ugguccauagagagca

SEQ ID NO: 3713070 - RNA, 17 nt, Human
ugguccauggaaugcuu

SEQ ID NO: 3713071 - RNA, 13 nt, Human
uggucccacaucc

SEQ ID NO: 3713072 - RNA, 22 nt, Human
uggucccacaucccugggccug

SEQ ID NO: 3713073 - RNA, 14 nt, Human
uggucccaccccac

SEQ ID NO: 3713074 - RNA, 16 nt, Human
uggucccaccccacac

SEQ ID NO: 3713075 - RNA, 16 nt, Human
uggucccccuuccaug

SEQ ID NO: 3713076 - RNA, 23 nt, Human
uggucccccuuccauggacuuug

SEQ ID NO: 3713077 - RNA, 17 nt, Human
uggucccugcccucauc

SEQ ID NO: 3713078 - RNA, 14 nt, Human
uggucccugggagg

SEQ ID NO: 3713079 - RNA, 19 nt, Human
uggucccugggaggaaauu

SEQ ID NO: 3713080 - RNA, 22 nt, Human
uggucccuuguauccccugcag

SEQ ID NO: 3713081 - RNA, 17 nt, Human
ugguccgugcuaaggac

SEQ ID NO: 3713082 - RNA, 22 nt, Human
ugguccuaaaagcaaaauaaaa

SEQ ID NO: 3713083 - RNA, 19 nt, Human
ugguccuaaucuucugaac

SEQ ID NO: 3713084 - RNA, 17 nt, Human
ugguccuagaggcccuu

SEQ ID NO: 3713085 - RNA, 18 nt, Human
ugguccuaggcuggaagg

SEQ ID NO: 3713086 - RNA, 17 nt, Human
ugguccuaguaagaaga

SEQ ID NO: 3713087 - RNA, 14 nt, Human
ugguccucacacuc

SEQ ID NO: 3713088 - RNA, 20 nt, Human
ugguccucuugccuccugga

SEQ ID NO: 3713089 - RNA, 20 nt, Human
ugguccugaggguccccacc

SEQ ID NO: 3713090 - RNA, 20 nt, Human
ugguccuggaggcucaaauu

SEQ ID NO: 3713091 - RNA, 16 nt, Human
ugguccuggggcucug

SEQ ID NO: 3713092 - RNA, 20 nt, Human
ugguccuguaggaguucuau

SEQ ID NO: 3713093 - RNA, 20 nt, Human
ugguccugugugcagugaag

SEQ ID NO: 3713094 - RNA, 23 nt, Human
ugguccuuccaggcccccaccac

SEQ ID NO: 3713095 - RNA, 14 nt, Human
ugguccuuuacacu

SEQ ID NO: 3713096 - RNA, 21 nt, Human
ugguccuuuacacucaggcuu

SEQ ID NO: 3713097 - RNA, 12 nt, Human
ugguccuuuggg

SEQ ID NO: 3713098 - RNA, 13 nt, Human
uggucgcccagga

SEQ ID NO: 3713099 - RNA, 15 nt, Human
uggucgcccaggaga

SEQ ID NO: 3713100 - RNA, 14 nt, Human
uggucggaaaacau

SEQ ID NO: 3713101 - RNA, 13 nt, Human
uggucguuuuuuu

SEQ ID NO: 3713102 - RNA, 18 nt, Human
uggucuaaguccagucca

SEQ ID NO: 3713103 - RNA, 17 nt, Human
uggucuacacugugcug

SEQ ID NO: 3713104 - RNA, 19 nt, Human
uggucuacacugugcugag

SEQ ID NO: 3713105 - RNA, 19 nt, Human
uggucuauaccuuaagaau

SEQ ID NO: 3713106 - RNA, 18 nt, Human
uggucucaaacuccugac

SEQ ID NO: 3713107 - RNA, 23 nt, Human
uggucucaaacucuugaccucag

SEQ ID NO: 3713108 - RNA, 12 nt, Human
uggucucagaaa

SEQ ID NO: 3713109 - RNA, 12 nt, Human
uggucucaggau

SEQ ID NO: 3713110 - RNA, 20 nt, Human
uggucuccucuuuguuuugu

SEQ ID NO: 3713111 - RNA, 16 nt, Human
uggucuccuuggaaau

SEQ ID NO: 3713112 - RNA, 16 nt, Human
uggucucuaggcuggg

SEQ ID NO: 3713113 - RNA, 19 nt, Human
uggucucuaggcuggggaa

SEQ ID NO: 3713114 - RNA, 15 nt, Human
uggucucugcauuuu

SEQ ID NO: 3713115 - RNA, 19 nt, Human
uggucucugcauuuuucug

SEQ ID NO: 3713116 - RNA, 22 nt, Human
uggucugaauguucugacauua

SEQ ID NO: 3713117 - RNA, 18 nt, Human
uggucugacccacugcuu

SEQ ID NO: 3713118 - RNA, 15 nt, Human
uggucugccaggccc

SEQ ID NO: 3713119 - RNA, 16 nt, Human
uggucuggacugacag

SEQ ID NO: 3713120 - RNA, 21 nt, Human
uggucugggacuuccuugcuc

SEQ ID NO: 3713121 - RNA, 17 nt, Human
uggucugguugggcagc

SEQ ID NO: 3713122 - RNA, 18 nt, Human
uggucuguuggcaggcug

SEQ ID NO: 3713123 - RNA, 20 nt, Human
uggucuuacagcaggcagua

SEQ ID NO: 3713124 - RNA, 13 nt, Human
uggucuuauauuu

SEQ ID NO: 3713125 - RNA, 16 nt, Human
uggucuuauuuguaaa

SEQ ID NO: 3713126 - RNA, 15 nt, Human
uggucuucagccucu

SEQ ID NO: 3713127 - RNA, 14 nt, Human
uggucuuccuuuuu

SEQ ID NO: 3713128 - RNA, 20 nt, Human
uggucuuggcagcaccuguc

SEQ ID NO: 3713129 - RNA, 13 nt, Human
uggucuuguaaga

SEQ ID NO: 3713130 - RNA, 14 nt, Human
uggucuuguaagag

SEQ ID NO: 3713131 - RNA, 14 nt, Human
uggucuuucuggag

SEQ ID NO: 3713132 - RNA, 13 nt, Human
uggucuuuguaag

SEQ ID NO: 3713133 - RNA, 19 nt, Human
uggucuuuuccucgcuucu

SEQ ID NO: 3713134 - RNA, 14 nt, Human
uggucuuuugguua

SEQ ID NO: 3713135 - RNA, 23 nt, Human
uggugaaaagcagguugauaaau

SEQ ID NO: 3713136 - RNA, 14 nt, Human
uggugaacuauauu

SEQ ID NO: 3713137 - RNA, 18 nt, Human
uggugacaucagguuuuu

SEQ ID NO: 3713138 - RNA, 22 nt, Human
uggugaccccuuuucagcuucu

SEQ ID NO: 3713139 - RNA, 15 nt, Human
uggugaccucugccu

SEQ ID NO: 3713140 - RNA, 16 nt, Human
uggugaccucugccug

SEQ ID NO: 3713141 - RNA, 23 nt, Human
uggugacuuccucgccucuccca

SEQ ID NO: 3713142 - RNA, 23 nt, Human
uggugacuuuggauaauaaggaa

SEQ ID NO: 3713143 - RNA, 20 nt, Human
uggugagaaaccuguaucuu

SEQ ID NO: 3713144 - RNA, 22 nt, Human
uggugagaacuacucagggaau

SEQ ID NO: 3713145 - RNA, 14 nt, Human
uggugagaggcauc

SEQ ID NO: 3713146 - RNA, 16 nt, Human
uggugagaugcagcug

SEQ ID NO: 3713147 - RNA, 18 nt, Human
uggugaggcaggcuuugu

SEQ ID NO: 3713148 - RNA, 18 nt, Human
uggugaucaauuaaaugu

SEQ ID NO: 3713149 - RNA, 21 nt, Human
uggugaucucccaagcuaucu

SEQ ID NO: 3713150 - RNA, 14 nt, Human
uggugaugcagucu

SEQ ID NO: 3713151 - RNA, 14 nt, Human
uggugcaaauccua

SEQ ID NO: 3713152 - RNA, 16 nt, Human
uggugcaaguugagga

SEQ ID NO: 3713153 - RNA, 19 nt, Human
uggugcaaugaccuuucaa

SEQ ID NO: 3713154 - RNA, 20 nt, Human
uggugcaaugaccuuucaau

SEQ ID NO: 3713155 - RNA, 23 nt, Human
uggugcagguagaccugucuccu

SEQ ID NO: 3713156 - RNA, 13 nt, Human
uggugcauuacag

SEQ ID NO: 3713157 - RNA, 19 nt, Human
uggugcauuacagagagga

SEQ ID NO: 3713158 - RNA, 16 nt, Human
uggugccauccccagg

SEQ ID NO: 3713159 - RNA, 16 nt, Human
uggugcccugcuuuca

SEQ ID NO: 3713160 - RNA, 22 nt, Human
uggugccuaaaguuuaaccaaa

SEQ ID NO: 3713161 - RNA, 22 nt, Human
uggugccuaguauugacaaaau

SEQ ID NO: 3713162 - RNA, 13 nt, Human
uggugccuccaga

SEQ ID NO: 3713163 - RNA, 12 nt, Human
uggugccuggcc

SEQ ID NO: 3713164 - RNA, 20 nt, Human
uggugccuuuccuguucagc

SEQ ID NO: 3713165 - RNA, 17 nt, Human
uggugcggcuggccaug

SEQ ID NO: 3713166 - RNA, 22 nt, Human
uggugcuauaggcuggagaagc

SEQ ID NO: 3713167 - RNA, 14 nt, Human
uggugcucaguugu

SEQ ID NO: 3713168 - RNA, 16 nt, Human
uggugcucucugccac

SEQ ID NO: 3713169 - RNA, 19 nt, Human
uggugcugcugcugcugug

SEQ ID NO: 3713170 - RNA, 21 nt, Human
uggugcuggauauuuucaaau

SEQ ID NO: 3713171 - RNA, 20 nt, Human
uggugcugggagaggcagcc

SEQ ID NO: 3713172 - RNA, 19 nt, Human
uggugcuuaaguuccagca

SEQ ID NO: 3713173 - RNA, 16 nt, Human
ugguggacaguccugg

SEQ ID NO: 3713174 - RNA, 13 nt, Human
ugguggagggcca

SEQ ID NO: 3713175 - RNA, 14 nt, Human
ugguggauguaaau

SEQ ID NO: 3713176 - RNA, 15 nt, Human
ugguggcacaggccc

SEQ ID NO: 3713177 - RNA, 17 nt, Human
ugguggcagaguccugg

SEQ ID NO: 3713178 - RNA, 19 nt, Human
ugguggcagcucaccucuc

SEQ ID NO: 3713179 - RNA, 15 nt, Human
ugguggcagcugcgg

SEQ ID NO: 3713180 - RNA, 19 nt, Human
ugguggcaguggagguggg

SEQ ID NO: 3713181 - RNA, 20 nt, Human
ugguggccaugcuccucuuc

SEQ ID NO: 3713182 - RNA, 16 nt, Human
ugguggcccucucccc

SEQ ID NO: 3713183 - RNA, 13 nt, Human
ugguggccucagc

SEQ ID NO: 3713184 - RNA, 16 nt, Human
ugguggcgcaagccug

SEQ ID NO: 3713185 - RNA, 21 nt, Human
ugguggcucccggagggcccu

SEQ ID NO: 3713186 - RNA, 13 nt, Human
ugguggcuggguu

SEQ ID NO: 3713187 - RNA, 14 nt, Human
ugguggcuguggaa

SEQ ID NO: 3713188 - RNA, 15 nt, Human
ugguggcuucagcuc

SEQ ID NO: 3713189 - RNA, 16 nt, Human
ugguggcuucagcucc

SEQ ID NO: 3713190 - RNA, 17 nt, Human
ugguggcuucagcucca

SEQ ID NO: 3713191 - RNA, 21 nt, Human
ugguggcuucagcuccagccc

SEQ ID NO: 3713192 - RNA, 21 nt, Human
uggugggaagcgucuguccgu

SEQ ID NO: 3713193 - RNA, 21 nt, Human
uggugggaggggcgcccaccu

SEQ ID NO: 3713194 - RNA, 23 nt, Human
uggugggaggggcgcccaccucc

SEQ ID NO: 3713195 - RNA, 15 nt, Human
uggugggagggggag

SEQ ID NO: 3713196 - RNA, 17 nt, Human
uggugggcaccaagagc

SEQ ID NO: 3713197 - RNA, 23 nt, Human
uggugggccaacaaagaacacua

SEQ ID NO: 3713198 - RNA, 15 nt, Human
ugguggggaggggcg

SEQ ID NO: 3713199 - RNA, 21 nt, Human
ugguggggaggggcgcuggcc

SEQ ID NO: 3713200 - RNA, 22 nt, Human
ugguggggaggggcgcuggccc

SEQ ID NO: 3713201 - RNA, 23 nt, Human
ugguggggaggggcgcuggccca

SEQ ID NO: 3713202 - RNA, 23 nt, Human
uggugggugccuaggccugggca

SEQ ID NO: 3713203 - RNA, 16 nt, Human
uggugguaacccuggu

SEQ ID NO: 3713204 - RNA, 15 nt, Human
ugguggucagcccua

SEQ ID NO: 3713205 - RNA, 14 nt, Human
ugguggucccuggg

SEQ ID NO: 3713206 - RNA, 23 nt, Human
uggugguugggacccaguggcag

SEQ ID NO: 3713207 - RNA, 18 nt, Human
uggugguuucagaaaugu

SEQ ID NO: 3713208 - RNA, 13 nt, Human
ugguguaauuuau

SEQ ID NO: 3713209 - RNA, 16 nt, Human
ugguguagcuacagag

SEQ ID NO: 3713210 - RNA, 23 nt, Human
ugguguauccccccccuguauag

SEQ ID NO: 3713211 - RNA, 15 nt, Human
uggugucaccccaga

SEQ ID NO: 3713212 - RNA, 16 nt, Human
uggugucaccugaaga

SEQ ID NO: 3713213 - RNA, 20 nt, Human
uggugucacugucccuccug

SEQ ID NO: 3713214 - RNA, 21 nt, Human
uggugucacugucccuccugg

SEQ ID NO: 3713215 - RNA, 16 nt, Human
uggugucacuuacugu

SEQ ID NO: 3713216 - RNA, 18 nt, Human
uggugucacuuacuguuu

SEQ ID NO: 3713217 - RNA, 20 nt, Human
uggugucacuuacuguuucu

SEQ ID NO: 3713218 - RNA, 13 nt, Human
ugguguccaccug

SEQ ID NO: 3713219 - RNA, 19 nt, Human
ugcuguuuguuugacaaag

SEQ ID NO: 3713220 - RNA, 17 nt, Human
ugcuguuuuccucccuu

SEQ ID NO: 3713221 - RNA, 22 nt, Human
ugcuguuuuccucccuucugcu

SEQ ID NO: 3713222 - RNA, 18 nt, Human
ugcuguuuugauuuguac

SEQ ID NO: 3713223 - RNA, 12 nt, Human
ugcuguuuuguu

SEQ ID NO: 3713224 - RNA, 18 nt, Human
ugcuguuuuguuauauaa

SEQ ID NO: 3713225 - RNA, 18 nt, Human
ugcuguuuuguucugugg

SEQ ID NO: 3713226 - RNA, 15 nt, Human
ugcuuaaaauaagca

SEQ ID NO: 3713227 - RNA, 18 nt, Human
ugcuuaaagaauucaaau

SEQ ID NO: 3713228 - RNA, 15 nt, Human
ugcuuaaaugugaau

SEQ ID NO: 3713229 - RNA, 20 nt, Human
ugcuuaaaugugaauuacua

SEQ ID NO: 3713230 - RNA, 16 nt, Human
ugcuuaaauuuuaacu

SEQ ID NO: 3713231 - RNA, 22 nt, Human
ugcuuaacagggaacgugauua

SEQ ID NO: 3713232 - RNA, 13 nt, Human
ugcuuaaguucca

SEQ ID NO: 3713233 - RNA, 15 nt, Human
ugcuuaauaaauugu

SEQ ID NO: 3713234 - RNA, 12 nt, Human
ugcuuaaugaaa

SEQ ID NO: 3713235 - RNA, 18 nt, Human
ugcuuaauucaaauaaua

SEQ ID NO: 3713236 - RNA, 16 nt, Human
ugcuuacacaucucag

SEQ ID NO: 3713237 - RNA, 20 nt, Human
ugcuuacacaucucagaccc

SEQ ID NO: 3713238 - RNA, 17 nt, Human
ugcuuacauuuuuacaa

SEQ ID NO: 3713239 - RNA, 20 nt, Human
ugcuuacauuuuuacaauaa

SEQ ID NO: 3713240 - RNA, 20 nt, Human
ugcuuaccuugguuggaagg

SEQ ID NO: 3713241 - RNA, 14 nt, Human
ugcuuacugauaua

SEQ ID NO: 3713242 - RNA, 22 nt, Human
ugcuuacugauauauuuuacaa

SEQ ID NO: 3713243 - RNA, 22 nt, Human
ugcuuacuuuggaauacauuuc

SEQ ID NO: 3713244 - RNA, 16 nt, Human
ugcuuagagacuauca

SEQ ID NO: 3713245 - RNA, 18 nt, Human
ugcuuagccuccugaccu

SEQ ID NO: 3713246 - RNA, 15 nt, Human
ugcuuaguaaugcua

SEQ ID NO: 3713247 - RNA, 15 nt, Human
ugcuuagucacugcc

SEQ ID NO: 3713248 - RNA, 16 nt, Human
ugcuuagucacugccu

SEQ ID NO: 3713249 - RNA, 20 nt, Human
ugcuuaguguacuuggagua

SEQ ID NO: 3713250 - RNA, 22 nt, Human
ugcuuaugcaguuuuucagagu

SEQ ID NO: 3713251 - RNA, 18 nt, Human
ugcuuaugcucuuaauug

SEQ ID NO: 3713252 - RNA, 22 nt, Human
ugcuuauuccaugacugcuugc

SEQ ID NO: 3713253 - RNA, 14 nt, Human
ugcuuauugcuuag

SEQ ID NO: 3713254 - RNA, 16 nt, Human
ugcuuauuguuccaag

SEQ ID NO: 3713255 - RNA, 17 nt, Human
ugcuuauuguuccaaga

SEQ ID NO: 3713256 - RNA, 21 nt, Human
ugcuuauuguuccaagacauu

SEQ ID NO: 3713257 - RNA, 23 nt, Human
ugcuuauuguuccaagacauugu

SEQ ID NO: 3713258 - RNA, 16 nt, Human
ugcuucaaggauccug

SEQ ID NO: 3713259 - RNA, 19 nt, Human
ugcuucaaggauccugagc

SEQ ID NO: 3713260 - RNA, 20 nt, Human
ugcuucaaggauccugagcc

SEQ ID NO: 3713261 - RNA, 13 nt, Human
ugcuucaauaguu

SEQ ID NO: 3713262 - RNA, 22 nt, Human
ugcuucaauaguucaaggaacu

SEQ ID NO: 3713263 - RNA, 16 nt, Human
ugcuucaauuaauaaa

SEQ ID NO: 3713264 - RNA, 14 nt, Human
ugcuucacaauguu

SEQ ID NO: 3713265 - RNA, 19 nt, Human
ugcuucagauguggagcca

SEQ ID NO: 3713266 - RNA, 21 nt, Human
ugcuucagauguggagccagg

SEQ ID NO: 3713267 - RNA, 12 nt, Human
ugcuucagccug

SEQ ID NO: 3713268 - RNA, 14 nt, Human
ugcuucagccugag

SEQ ID NO: 3713269 - RNA, 15 nt, Human
ugcuucagccugagg

SEQ ID NO: 3713270 - RNA, 16 nt, Human
ugcuucaugaaaaucc

SEQ ID NO: 3713271 - RNA, 15 nt, Human
ugcuucauucaauau

SEQ ID NO: 3713272 - RNA, 11 nt, Human
ugcuuccaccu

SEQ ID NO: 3713273 - RNA, 14 nt, Human
ugcuuccaccucac

SEQ ID NO: 3713274 - RNA, 15 nt, Human
ugcuuccaccucacc

SEQ ID NO: 3713275 - RNA, 18 nt, Human
ugcuuccaccucacccca

SEQ ID NO: 3713276 - RNA, 16 nt, Human
ugcuuccaggaaacuc

SEQ ID NO: 3713277 - RNA, 19 nt, Human
ugcuuccaggaaacuccac

SEQ ID NO: 3713278 - RNA, 23 nt, Human
ugcuuccagugaggcucugcccu

SEQ ID NO: 3713279 - RNA, 12 nt, Human
ugcuuccagugu

SEQ ID NO: 3713280 - RNA, 22 nt, Human
ugcuuccauggccguguagaag

SEQ ID NO: 3713281 - RNA, 14 nt, Human
ugcuucccauccua

SEQ ID NO: 3713282 - RNA, 20 nt, Human
ugcuucccauuguggcuccu

SEQ ID NO: 3713283 - RNA, 22 nt, Human
ugcuuccuagaaguuacugaau

SEQ ID NO: 3713284 - RNA, 14 nt, Human
ugcuuccuccugga

SEQ ID NO: 3713285 - RNA, 15 nt, Human
ugcuuccuccuggaa

SEQ ID NO: 3713286 - RNA, 13 nt, Human
ugcuucgggcccu

SEQ ID NO: 3713287 - RNA, 12 nt, Human
ugcuucucacug

SEQ ID NO: 3713288 - RNA, 21 nt, Human
ugcuucuccaaaaaucugccu

SEQ ID NO: 3713289 - RNA, 24 nt, Human
ugcuucuccaaaaaucugccuggg

SEQ ID NO: 3713290 - RNA, 20 nt, Human
ugcuucucccaggcaaggcu

SEQ ID NO: 3713291 - RNA, 13 nt, Human
ugcuucuccccag

SEQ ID NO: 3713292 - RNA, 15 nt, Human
ugcuucuccccagaa

SEQ ID NO: 3713293 - RNA, 19 nt, Human
ugcuucuccccagaauuca

SEQ ID NO: 3713294 - RNA, 10 nt, Human
ugcuucucua

SEQ ID NO: 3713295 - RNA, 14 nt, Human
ugcuucucuacaga

SEQ ID NO: 3713296 - RNA, 21 nt, Human
ugcuucucuagcucucuaggc

SEQ ID NO: 3713297 - RNA, 14 nt, Human
ugcuucucugacuu

SEQ ID NO: 3713298 - RNA, 17 nt, Human
ugcuucucugacuucug

SEQ ID NO: 3713299 - RNA, 12 nt, Human
ugcuucugccac

SEQ ID NO: 3713300 - RNA, 21 nt, Human
ugcuucuucuccuauguguaa

SEQ ID NO: 3713301 - RNA, 15 nt, Human
ugcuucuugugaagg

SEQ ID NO: 3713302 - RNA, 17 nt, Human
ugcuucuuucauuuucu

SEQ ID NO: 3713303 - RNA, 14 nt, Human
ugcuucuuucuaga

SEQ ID NO: 3713304 - RNA, 15 nt, Human
ugcuucuuucuagaa

SEQ ID NO: 3713305 - RNA, 14 nt, Human
ugcuugaacacagu

SEQ ID NO: 3713306 - RNA, 16 nt, Human
ugcuugaacacaguau

SEQ ID NO: 3713307 - RNA, 17 nt, Human
ugcuugaacuuacaggu

SEQ ID NO: 3713308 - RNA, 19 nt, Human
ugcuugaagcaaacaguug

SEQ ID NO: 3713309 - RNA, 20 nt, Human
ugcuugaagcaaacaguuga

SEQ ID NO: 3713310 - RNA, 19 nt, Human
ugcuugaaggcccugcuga

SEQ ID NO: 3713311 - RNA, 15 nt, Human
ugcuugaauaaacac

SEQ ID NO: 3713312 - RNA, 16 nt, Human
ugcuugacaacaucug

SEQ ID NO: 3713313 - RNA, 13 nt, Human
ugcuugagcccag

SEQ ID NO: 3713314 - RNA, 14 nt, Human
ugcuugagcccagg

SEQ ID NO: 3713315 - RNA, 18 nt, Human
ugcuugagcucaggaguu

SEQ ID NO: 3713316 - RNA, 18 nt, Human
ugcuugauagaaaugcca

SEQ ID NO: 3713317 - RNA, 16 nt, Human
ugcuugauauuuucua

SEQ ID NO: 3713318 - RNA, 17 nt, Human
ugcuugaugaagcaagg

SEQ ID NO: 3713319 - RNA, 18 nt, Human
ugcuugaugaagcaagga

SEQ ID NO: 3713320 - RNA, 19 nt, Human
ugcuugaugaagcaaggaa

SEQ ID NO: 3713321 - RNA, 20 nt, Human
ugcuugaugaagcaaggaag

SEQ ID NO: 3713322 - RNA, 22 nt, Human
ugcuugaugggauucuggacag

SEQ ID NO: 3713323 - RNA, 15 nt, Human
ugcuugcaguagauu

SEQ ID NO: 3713324 - RNA, 17 nt, Human
ugcuugcaguagauuuu

SEQ ID NO: 3713325 - RNA, 14 nt, Human
ugcuugccaaagua

SEQ ID NO: 3713326 - RNA, 15 nt, Human
ugcuugccaucccuc

SEQ ID NO: 3713327 - RNA, 20 nt, Human
ugcuugcccuaagcagaaag

SEQ ID NO: 3713328 - RNA, 20 nt, Human
ugcuugccgaaacuggaagu

SEQ ID NO: 3713329 - RNA, 15 nt, Human
ugcuugccugauaua

SEQ ID NO: 3713330 - RNA, 18 nt, Human
ugcuugcggcaaaaggaa

SEQ ID NO: 3713331 - RNA, 15 nt, Human
ugcuugcuuugaagu

SEQ ID NO: 3713332 - RNA, 23 nt, Human
ugcuugcuuuucaugcaaacucu

SEQ ID NO: 3713333 - RNA, 22 nt, Human
ugcuuggaacauacuguucacu

SEQ ID NO: 3713334 - RNA, 15 nt, Human
ugcuuggaggaagga

SEQ ID NO: 3713335 - RNA, 21 nt, Human
ugcuuggaggaaggaaaccca

SEQ ID NO: 3713336 - RNA, 12 nt, Human
ugcuuggcccag

SEQ ID NO: 3713337 - RNA, 13 nt, Human
ugcuuggcccagg

SEQ ID NO: 3713338 - RNA, 15 nt, Human
ugcuuggcccagggg

SEQ ID NO: 3713339 - RNA, 19 nt, Human
ugcuuggccuugggcuuca

SEQ ID NO: 3713340 - RNA, 21 nt, Human
ugcuuggggggugaugagggc

SEQ ID NO: 3713341 - RNA, 15 nt, Human
ugcuuggguggagaa

SEQ ID NO: 3713342 - RNA, 17 nt, Human
ugcuuggguggagaagc

SEQ ID NO: 3713343 - RNA, 18 nt, Human
ugcuuggguggagaagcc

SEQ ID NO: 3713344 - RNA, 22 nt, Human
ugcuuggguggagaagccauug

SEQ ID NO: 3713345 - RNA, 15 nt, Human
ugcuuggucuguuug

SEQ ID NO: 3713346 - RNA, 19 nt, Human
ugcuuguaacaagaaaaca

SEQ ID NO: 3713347 - RNA, 23 nt, Human
ugcuuguaacaagaaaacauaag

SEQ ID NO: 3713348 - RNA, 19 nt, Human
ugcuuguacacucauucau

SEQ ID NO: 3713349 - RNA, 12 nt, Human
ugcuuguacaua

SEQ ID NO: 3713350 - RNA, 22 nt, Human
ugcuugucuucugguacuuucu

SEQ ID NO: 3713351 - RNA, 14 nt, Human
ugcuuguuaacuga

SEQ ID NO: 3713352 - RNA, 16 nt, Human
ugcuuguuaacugagu

SEQ ID NO: 3713353 - RNA, 16 nt, Human
ugcuuguucccucucc

SEQ ID NO: 3713354 - RNA, 19 nt, Human
ugcuuguucccucucccug

SEQ ID NO: 3713355 - RNA, 15 nt, Human
ugcuuguugggauuc

SEQ ID NO: 3713356 - RNA, 14 nt, Human
ugcuuguuuccuag

SEQ ID NO: 3713357 - RNA, 23 nt, Human
ugcuuguuugcucaccuggggug

SEQ ID NO: 3713358 - RNA, 21 nt, Human
ugcuuuaaccaccccaucugc

SEQ ID NO: 3713359 - RNA, 13 nt, Human
ugcuuuaauauaa

SEQ ID NO: 3713360 - RNA, 18 nt, Human
ugcuuuaauaucaucagu

SEQ ID NO: 3713361 - RNA, 15 nt, Human
ugcuuuaauuuuagc

SEQ ID NO: 3713362 - RNA, 17 nt, Human
ugcuuuaccaaacagca

SEQ ID NO: 3713363 - RNA, 21 nt, Human
ugcuuuagacuugaaaagaga

SEQ ID NO: 3713364 - RNA, 14 nt, Human
ugcuuuauaaauaa

SEQ ID NO: 3713365 - RNA, 15 nt, Human
ugcuuuauuaauguu

SEQ ID NO: 3713366 - RNA, 17 nt, Human
ugcuuuauuaauguuuu

SEQ ID NO: 3713367 - RNA, 16 nt, Human
ugcuuuauugcuuuuu

SEQ ID NO: 3713368 - RNA, 14 nt, Human
ugcuuuauuuguaa

SEQ ID NO: 3713369 - RNA, 21 nt, Human
ugcuuucagauacuggauugu

SEQ ID NO: 3713370 - RNA, 15 nt, Human
gugugucuguucacu

SEQ ID NO: 3713371 - RNA, 22 nt, Human
gugugucuguucacuuuuccuc

SEQ ID NO: 3713372 - RNA, 21 nt, Human
gugugucuuaauuauuauuug

SEQ ID NO: 3713373 - RNA, 14 nt, Human
gugugugaaaggaa

SEQ ID NO: 3713374 - RNA, 15 nt, Human
gugugugaugugaca

SEQ ID NO: 3713375 - RNA, 14 nt, Human
gugugugcccucug

SEQ ID NO: 3713376 - RNA, 21 nt, Human
gugugugcccucugggcucug

SEQ ID NO: 3713377 - RNA, 17 nt, Human
gugugugcucugcuuca

SEQ ID NO: 3713378 - RNA, 15 nt, Human
guguguguauauaua

SEQ ID NO: 3713379 - RNA, 12 nt, Human
guguguguaugu

SEQ ID NO: 3713380 - RNA, 17 nt, Human
guguguguauguuugca

SEQ ID NO: 3713381 - RNA, 9 nt, Human
gugugugug

SEQ ID NO: 3713382 - RNA, 13 nt, Human
guguguguguggc

SEQ ID NO: 3713383 - RNA, 16 nt, Human
guguguguguguaugu

SEQ ID NO: 3713384 - RNA, 13 nt, Human
gugugugugugug

SEQ ID NO: 3713385 - RNA, 14 nt, Human
gugugugugugugu

SEQ ID NO: 3713386 - RNA, 15 nt, Human
gugugugugugugua

SEQ ID NO: 3713387 - RNA, 17 nt, Human
guguguguugugugugg

SEQ ID NO: 3713388 - RNA, 15 nt, Human
guguguuacaaugua

SEQ ID NO: 3713389 - RNA, 17 nt, Human
guguguugauacuguug

SEQ ID NO: 3713390 - RNA, 19 nt, Human
guguguugauacuguugca

SEQ ID NO: 3713391 - RNA, 15 nt, Human
guguguuuaaauaaa

SEQ ID NO: 3713392 - RNA, 16 nt, Human
guguguuuaaauaaag

SEQ ID NO: 3713393 - RNA, 19 nt, Human
guguguuuaaauaaaguau

SEQ ID NO: 3713394 - RNA, 16 nt, Human
guguguuuaugugugu

SEQ ID NO: 3713395 - RNA, 14 nt, Human
guguguuucacuuu

SEQ ID NO: 3713396 - RNA, 15 nt, Human
guguguuucugaucu

SEQ ID NO: 3713397 - RNA, 19 nt, Human
guguguuuuaaaaugagaa

SEQ ID NO: 3713398 - RNA, 21 nt, Human
guguguuuugagaguauauua

SEQ ID NO: 3713399 - RNA, 15 nt, Human
guguguuuuucuauu

SEQ ID NO: 3713400 - RNA, 21 nt, Human
guguguuuuucuauuaaaaga

SEQ ID NO: 3713401 - RNA, 22 nt, Human
guguuaacagaagggagggcag

SEQ ID NO: 3713402 - RNA, 14 nt, Human
guguuaacauucca

SEQ ID NO: 3713403 - RNA, 15 nt, Human
guguuaagcucugcu

SEQ ID NO: 3713404 - RNA, 18 nt, Human
guguuaaucaauuuaaac

SEQ ID NO: 3713405 - RNA, 16 nt, Human
guguuaaucauuucau

SEQ ID NO: 3713406 - RNA, 15 nt, Human
guguuaauuuuugau

SEQ ID NO: 3713407 - RNA, 16 nt, Human
guguuaccugaaaaca

SEQ ID NO: 3713408 - RNA, 16 nt, Human
guguuagggaagggcc

SEQ ID NO: 3713409 - RNA, 23 nt, Human
guguuagggaagggccugccaca

SEQ ID NO: 3713410 - RNA, 15 nt, Human
guguuaguggcaccg

SEQ ID NO: 3713411 - RNA, 14 nt, Human
guguuauaugaaca

SEQ ID NO: 3713412 - RNA, 18 nt, Human
guguuaugacuccagaau

SEQ ID NO: 3713413 - RNA, 15 nt, Human
guguuaugagccagg

SEQ ID NO: 3713414 - RNA, 22 nt, Human
guguuauugagagagaugugua

SEQ ID NO: 3713415 - RNA, 17 nt, Human
guguuauuuaaaugagu

SEQ ID NO: 3713416 - RNA, 20 nt, Human
guguuauuuucauucaaagu

SEQ ID NO: 3713417 - RNA, 23 nt, Human
guguuauuuuguuuuuccuucca

SEQ ID NO: 3713418 - RNA, 16 nt, Human
guguucaauauuuucu

SEQ ID NO: 3713419 - RNA, 17 nt, Human
guguucccauuucagcu

SEQ ID NO: 3713420 - RNA, 17 nt, Human
guguuccccacuguauc

SEQ ID NO: 3713421 - RNA, 19 nt, Human
guguuccccaucugggucc

SEQ ID NO: 3713422 - RNA, 18 nt, Human
guguuccuggcaauagug

SEQ ID NO: 3713423 - RNA, 19 nt, Human
guguuccuggcaguuuaaa

SEQ ID NO: 3713424 - RNA, 15 nt, Human
guguucguucuuguu

SEQ ID NO: 3713425 - RNA, 13 nt, Human
guguucuaagaug

SEQ ID NO: 3713426 - RNA, 13 nt, Human
guguucucagagg

SEQ ID NO: 3713427 - RNA, 15 nt, Human
guguucuccugcugc

SEQ ID NO: 3713428 - RNA, 18 nt, Human
guguucuggugaggccuu

SEQ ID NO: 3713429 - RNA, 19 nt, Human
guguucuguuacaaaaugu

SEQ ID NO: 3713430 - RNA, 14 nt, Human
guguucuguuuguu

SEQ ID NO: 3713431 - RNA, 17 nt, Human
guguucuguuuguuaaa

SEQ ID NO: 3713432 - RNA, 16 nt, Human
guguugaaaauguuca

SEQ ID NO: 3713433 - RNA, 23 nt, Human
guguugaaacggaugauuucuau

SEQ ID NO: 3713434 - RNA, 18 nt, Human
guguugacuuuauaaauu

SEQ ID NO: 3713435 - RNA, 15 nt, Human
guguugauacuguug

SEQ ID NO: 3713436 - RNA, 20 nt, Human
guguugauacuguugcacgu

SEQ ID NO: 3713437 - RNA, 21 nt, Human
guguugauacuguugcacgug

SEQ ID NO: 3713438 - RNA, 15 nt, Human
guguugaucccaaga

SEQ ID NO: 3713439 - RNA, 19 nt, Human
guguugauuuucuguugua

SEQ ID NO: 3713440 - RNA, 19 nt, Human
guguugccaaauauguccu

SEQ ID NO: 3713441 - RNA, 18 nt, Human
guguugccacaggacaca

SEQ ID NO: 3713442 - RNA, 19 nt, Human
guguuggacaaaugugaag

SEQ ID NO: 3713443 - RNA, 21 nt, Human
guguuggcuaaugaagggaaa

SEQ ID NO: 3713444 - RNA, 14 nt, Human
guguugggagggau

SEQ ID NO: 3713445 - RNA, 20 nt, Human
guguuguaauucuucaguug

SEQ ID NO: 3713446 - RNA, 19 nt, Human
guguuguacucaauuuuaa

SEQ ID NO: 3713447 - RNA, 18 nt, Human
guguuguauuaacaaaag

SEQ ID NO: 3713448 - RNA, 15 nt, Human
guguugucauuguaa

SEQ ID NO: 3713449 - RNA, 21 nt, Human
guguugucauuguaaacaaac

SEQ ID NO: 3713450 - RNA, 14 nt, Human
guguugucccuucu

SEQ ID NO: 3713451 - RNA, 18 nt, Human
guguugucuugaaagauu

SEQ ID NO: 3713452 - RNA, 16 nt, Human
guguugugcuuucaag

SEQ ID NO: 3713453 - RNA, 15 nt, Human
guguuguguguggga

SEQ ID NO: 3713454 - RNA, 15 nt, Human
guguuguugcuucuu

SEQ ID NO: 3713455 - RNA, 12 nt, Human
guguuuaaaaaa

SEQ ID NO: 3713456 - RNA, 12 nt, Human
guguuuaaaacu

SEQ ID NO: 3713457 - RNA, 11 nt, Human
guguuuaaaua

SEQ ID NO: 3713458 - RNA, 23 nt, Human
guguuuaacggcacuguggccuu

SEQ ID NO: 3713459 - RNA, 17 nt, Human
guguuuaucagaaaggg

SEQ ID NO: 3713460 - RNA, 17 nt, Human
guguuuauccuuucaua

SEQ ID NO: 3713461 - RNA, 18 nt, Human
guguuuaugugcuauuaa

SEQ ID NO: 3713462 - RNA, 13 nt, Human
guguuuauuuaua

SEQ ID NO: 3713463 - RNA, 13 nt, Human
guguuucacaguu

SEQ ID NO: 3713464 - RNA, 21 nt, Human
guguuucacaguuugaaauaa

SEQ ID NO: 3713465 - RNA, 18 nt, Human
guguuucacuuuuaggga

SEQ ID NO: 3713466 - RNA, 17 nt, Human
guguuucauccuuccca

SEQ ID NO: 3713467 - RNA, 18 nt, Human
guguuuccacagccugca

SEQ ID NO: 3713468 - RNA, 14 nt, Human
guguuuccaucuca

SEQ ID NO: 3713469 - RNA, 19 nt, Human
guguuucuagcacuggccu

SEQ ID NO: 3713470 - RNA, 22 nt, Human
guguuucuagcacuggccugca

SEQ ID NO: 3713471 - RNA, 19 nt, Human
guguuucuaugaguggaaa

SEQ ID NO: 3713472 - RNA, 12 nt, Human
guguuucugggg

SEQ ID NO: 3713473 - RNA, 20 nt, Human
guguuucuguccuguaacug

SEQ ID NO: 3713474 - RNA, 15 nt, Human
guguuucuguuauua

SEQ ID NO: 3713475 - RNA, 15 nt, Human
guguuucuugccuca

SEQ ID NO: 3713476 - RNA, 22 nt, Human
guguuugcacguuaugguguuu

SEQ ID NO: 3713477 - RNA, 20 nt, Human
guguuugcagccugcucuag

SEQ ID NO: 3713478 - RNA, 21 nt, Human
guguuugggucaccccuccag

SEQ ID NO: 3713479 - RNA, 14 nt, Human
guguuugguuuaca

SEQ ID NO: 3713480 - RNA, 16 nt, Human
guguuugguuuacauu

SEQ ID NO: 3713481 - RNA, 15 nt, Human
guguuugucucuucu

SEQ ID NO: 3713482 - RNA, 12 nt, Human
guguuuguguga

SEQ ID NO: 3713483 - RNA, 13 nt, Human
guguuuuaauuua

SEQ ID NO: 3713484 - RNA, 13 nt, Human
guguuuucauaau

SEQ ID NO: 3713485 - RNA, 16 nt, Human
guguuuucauaauaaa

SEQ ID NO: 3713486 - RNA, 19 nt, Human
guguuuucugaauaacauu

SEQ ID NO: 3713487 - RNA, 14 nt, Human
guguuuucugugua

SEQ ID NO: 3713488 - RNA, 20 nt, Human
guguuuugaaagaauagaac

SEQ ID NO: 3713489 - RNA, 15 nt, Human
guguuuuuaacucaa

SEQ ID NO: 3713490 - RNA, 17 nt, Human
guguuuuuagcugugac

SEQ ID NO: 3713491 - RNA, 19 nt, Human
guguuuuucuauuaaaaga

SEQ ID NO: 3713492 - RNA, 23 nt, Human
guguuuuucuauuaaaagacuca

SEQ ID NO: 3713493 - RNA, 14 nt, Human
guguuuuucuccag

SEQ ID NO: 3713494 - RNA, 15 nt, Human
guguuuuuuaagaua

SEQ ID NO: 3713495 - RNA, 21 nt, Human
guguuuuuuaagauaguguaa

SEQ ID NO: 3713496 - RNA, 17 nt, Human
guguuuuuuuauuucua

SEQ ID NO: 3713497 - RNA, 19 nt, Human
guuaaaaaaaaaaaaagga

SEQ ID NO: 3713498 - RNA, 23 nt, Human
guuaaaaaaaaaaaaaggaaaaa

SEQ ID NO: 3713499 - RNA, 20 nt, Human
guuaaaaaaaggcauuguuu

SEQ ID NO: 3713500 - RNA, 14 nt, Human
guuaaaaauaaggu

SEQ ID NO: 3713501 - RNA, 14 nt, Human
guuaaaagaugaaa

SEQ ID NO: 3713502 - RNA, 22 nt, Human
guuaaaauaccagccaguaaau

SEQ ID NO: 3713503 - RNA, 12 nt, Human
guuaaaaugugu

SEQ ID NO: 3713504 - RNA, 18 nt, Human
guuaaaccaugggauaaa

SEQ ID NO: 3713505 - RNA, 15 nt, Human
guuaaacuagcauau

SEQ ID NO: 3713506 - RNA, 20 nt, Human
guuaaacuagcauaucugcc

SEQ ID NO: 3713507 - RNA, 21 nt, Human
guuaaacuguuagcacuguug

SEQ ID NO: 3713508 - RNA, 15 nt, Human
guuaaagagaaugag

SEQ ID NO: 3713509 - RNA, 16 nt, Human
guuaaagggaagaaaa

SEQ ID NO: 3713510 - RNA, 21 nt, Human
guuaaagggauauuuuuuucu

SEQ ID NO: 3713511 - RNA, 13 nt, Human
guuaaauaaauug

SEQ ID NO: 3713512 - RNA, 19 nt, Human
guuaaauaaauuguauauu

SEQ ID NO: 3713513 - RNA, 16 nt, Human
guuaaauauuuacaua

SEQ ID NO: 3713514 - RNA, 17 nt, Human
guuaaaugaaauuguaa

SEQ ID NO: 3713515 - RNA, 12 nt, Human
guuaaauguaga

SEQ ID NO: 3713516 - RNA, 16 nt, Human
guuaaauuuguaaguu

SEQ ID NO: 3713517 - RNA, 18 nt, Human
guuaaauuuguaaguuuc

SEQ ID NO: 3713518 - RNA, 13 nt, Human
guuaacacauuuu

SEQ ID NO: 3713519 - RNA, 16 nt, Human
guuaacacauuuugua

SEQ ID NO: 3713520 - RNA, 23 nt, Human
guuaacacauuuuguauaauugu

SEQ ID NO: 3713521 - RNA, 20 nt, Human
ugcuuucagauuaaaauugu

SEQ ID NO: 3713522 - RNA, 14 nt, Human
ugcuuuccagcuca

SEQ ID NO: 3713523 - RNA, 21 nt, Human
ugcuuuccauauuuuuuuccu

SEQ ID NO: 3713524 - RNA, 18 nt, Human
ugcuuuccauucgugaaa

SEQ ID NO: 3713525 - RNA, 15 nt, Human
ugcuuuccccugugg

SEQ ID NO: 3713526 - RNA, 20 nt, Human
ugcuuuccccuguggggauc

SEQ ID NO: 3713527 - RNA, 20 nt, Human
ugcuuucgucuccagccccu

SEQ ID NO: 3713528 - RNA, 20 nt, Human
ugcuuucuccuuuaauugua

SEQ ID NO: 3713529 - RNA, 13 nt, Human
ugcuuucugaaau

SEQ ID NO: 3713530 - RNA, 14 nt, Human
ugcuuucugaacuc

SEQ ID NO: 3713531 - RNA, 23 nt, Human
ugcuuucugaagcuuuaccagcu

SEQ ID NO: 3713532 - RNA, 19 nt, Human
ugcuuucugauguugccuu

SEQ ID NO: 3713533 - RNA, 13 nt, Human
ugcuuucugcuca

SEQ ID NO: 3713534 - RNA, 14 nt, Human
ugcuuucugcucag

SEQ ID NO: 3713535 - RNA, 19 nt, Human
ugcuuucugcucagcuucu

SEQ ID NO: 3713536 - RNA, 22 nt, Human
ugcuuucuguuccaaauucagu

SEQ ID NO: 3713537 - RNA, 23 nt, Human
ugcuuucuguugucauugcuguu

SEQ ID NO: 3713538 - RNA, 22 nt, Human
ugcuuugaaaaaguuaaugcuu

SEQ ID NO: 3713539 - RNA, 22 nt, Human
ugcuuugaaagccccagaaauc

SEQ ID NO: 3713540 - RNA, 23 nt, Human
ugcuuugaaauugaaccuuugug

SEQ ID NO: 3713541 - RNA, 15 nt, Human
ugcuuugaagcaguu

SEQ ID NO: 3713542 - RNA, 18 nt, Human
ugcuuugaauaaaugugu

SEQ ID NO: 3713543 - RNA, 12 nt, Human
ugcuuugauaua

SEQ ID NO: 3713544 - RNA, 22 nt, Human
ugcuuugauuuacagcaaguag

SEQ ID NO: 3713545 - RNA, 12 nt, Human
ugcuuugcauuu

SEQ ID NO: 3713546 - RNA, 15 nt, Human
ugcuuugccccugag

SEQ ID NO: 3713547 - RNA, 22 nt, Human
ugcuuugcccuucuuucuaccc

SEQ ID NO: 3713548 - RNA, 13 nt, Human
ugcuuugcucuug

SEQ ID NO: 3713549 - RNA, 18 nt, Human
ugcuuugcuuugucugga

SEQ ID NO: 3713550 - RNA, 20 nt, Human
ugcuuuggaaaacccagaua

SEQ ID NO: 3713551 - RNA, 13 nt, Human
ugcuuuggaaauc

SEQ ID NO: 3713552 - RNA, 21 nt, Human
ugcuuuggaccuaaauggccu

SEQ ID NO: 3713553 - RNA, 14 nt, Human
ugcuuugggcugcc

SEQ ID NO: 3713554 - RNA, 15 nt, Human
ugcuuugggcugccc

SEQ ID NO: 3713555 - RNA, 18 nt, Human
ugcuuugggcugcccugg

SEQ ID NO: 3713556 - RNA, 16 nt, Human
ugcuuuggucauauga

SEQ ID NO: 3713557 - RNA, 16 nt, Human
ugcuuuguagaguuuu

SEQ ID NO: 3713558 - RNA, 17 nt, Human
ugcuuugucuccucuau

SEQ ID NO: 3713559 - RNA, 14 nt, Human
ugcuuugugaacaa

SEQ ID NO: 3713560 - RNA, 14 nt, Human
ugcuuugugauuuu

SEQ ID NO: 3713561 - RNA, 17 nt, Human
ugcuuugugugauugaa

SEQ ID NO: 3713562 - RNA, 22 nt, Human
ugcuuuguuaaaaaaaaaaaga

SEQ ID NO: 3713563 - RNA, 20 nt, Human
ugcuuuguuaccuuaaaacu

SEQ ID NO: 3713564 - RNA, 14 nt, Human
ugcuuuuaaaacua

SEQ ID NO: 3713565 - RNA, 16 nt, Human
ugcuuuuaauuaaaua

SEQ ID NO: 3713566 - RNA, 19 nt, Human
ugcuuuuagugugugcaua

SEQ ID NO: 3713567 - RNA, 14 nt, Human
ugcuuuuauuuuga

SEQ ID NO: 3713568 - RNA, 18 nt, Human
ugcuuuucacugcugcaa

SEQ ID NO: 3713569 - RNA, 20 nt, Human
ugcuuuucaugcaaacucuu

SEQ ID NO: 3713570 - RNA, 12 nt, Human
ugcuuuucucca

SEQ ID NO: 3713571 - RNA, 20 nt, Human
ugcuuuucuccaauaucagu

SEQ ID NO: 3713572 - RNA, 23 nt, Human
ugcuuuucuccaauaucagugcu

SEQ ID NO: 3713573 - RNA, 16 nt, Human
ugcuuuucugcccugg

SEQ ID NO: 3713574 - RNA, 17 nt, Human
ugcuuuuggucugugug

SEQ ID NO: 3713575 - RNA, 23 nt, Human
ugcuuuuguuccaaugucaaugu

SEQ ID NO: 3713576 - RNA, 22 nt, Human
ugcuuuuucuuguuuguuuaaa

SEQ ID NO: 3713577 - RNA, 17 nt, Human
ugcuuuuugagguggca

SEQ ID NO: 3713578 - RNA, 15 nt, Human
ugcuuuuuuuggccu

SEQ ID NO: 3713579 - RNA, 22 nt, Human
ugcuuuuuuuuuuccagcaagu

SEQ ID NO: 3713580 - RNA, 20 nt, Human
uggaaaaaccacccccaaau

SEQ ID NO: 3713581 - RNA, 17 nt, Human
uggaaaaagugauggag

SEQ ID NO: 3713582 - RNA, 12 nt, Human
uggaaaaauaaa

SEQ ID NO: 3713583 - RNA, 19 nt, Human
uggaaaaauccagaaagaa

SEQ ID NO: 3713584 - RNA, 13 nt, Human
uggaaaaaugcca

SEQ ID NO: 3713585 - RNA, 19 nt, Human
uggaaaaaugccaucaaau

SEQ ID NO: 3713586 - RNA, 16 nt, Human
uggaaaacagaacacu

SEQ ID NO: 3713587 - RNA, 19 nt, Human
uggaaaacagaacacuuau

SEQ ID NO: 3713588 - RNA, 20 nt, Human
uggaaaacagaacacuuaug

SEQ ID NO: 3713589 - RNA, 16 nt, Human
uggaaaacuuaguuug

SEQ ID NO: 3713590 - RNA, 14 nt, Human
uggaaaagaauaaa

SEQ ID NO: 3713591 - RNA, 18 nt, Human
uggaaaaggaagacuaga

SEQ ID NO: 3713592 - RNA, 22 nt, Human
uggaaaagggucuugggaaaua

SEQ ID NO: 3713593 - RNA, 11 nt, Human
uggaaaauaaa

SEQ ID NO: 3713594 - RNA, 13 nt, Human
uggaaacaaagug

SEQ ID NO: 3713595 - RNA, 14 nt, Human
uggaaacaaagugg

SEQ ID NO: 3713596 - RNA, 23 nt, Human
uggaaacaaaguggaaggaaaga

SEQ ID NO: 3713597 - RNA, 24 nt, Human
uggaaacaaaguggaaggaaagau

SEQ ID NO: 3713598 - RNA, 17 nt, Human
uggaaacaagucaguca

SEQ ID NO: 3713599 - RNA, 13 nt, Human
uggaaacacuaaa

SEQ ID NO: 3713600 - RNA, 16 nt, Human
uggaaacacuaaaugu

SEQ ID NO: 3713601 - RNA, 18 nt, Human
uggaaacacuaaauguua

SEQ ID NO: 3713602 - RNA, 22 nt, Human
uggaaacacuaaauguuaaaga

SEQ ID NO: 3713603 - RNA, 18 nt, Human
uggaaacagaggaccagc

SEQ ID NO: 3713604 - RNA, 20 nt, Human
uggaaacagaggaccagcac

SEQ ID NO: 3713605 - RNA, 17 nt, Human
uggaaacagcucgacuu

SEQ ID NO: 3713606 - RNA, 18 nt, Human
uggaaacauucaggagcu

SEQ ID NO: 3713607 - RNA, 12 nt, Human
uggaaaccacag

SEQ ID NO: 3713608 - RNA, 17 nt, Human
uggaaaccucuacauau

SEQ ID NO: 3713609 - RNA, 19 nt, Human
uggaaaccugcccugccug

SEQ ID NO: 3713610 - RNA, 20 nt, Human
uggaaaccugcccugccuga

SEQ ID NO: 3713611 - RNA, 21 nt, Human
uggaaaccugcccugccugag

SEQ ID NO: 3713612 - RNA, 24 nt, Human
uggaaaccugcccugccugagggc

SEQ ID NO: 3713613 - RNA, 16 nt, Human
uggaaacuaauaaaau

SEQ ID NO: 3713614 - RNA, 14 nt, Human
uggaaacugaaugc

SEQ ID NO: 3713615 - RNA, 14 nt, Human
uggaaacuuuucuu

SEQ ID NO: 3713616 - RNA, 19 nt, Human
uggaaagacagcuucucau

SEQ ID NO: 3713617 - RNA, 20 nt, Human
uggaaagaguaggaagacuu

SEQ ID NO: 3713618 - RNA, 23 nt, Human
uggaaagauaacuaggaaaucca

SEQ ID NO: 3713619 - RNA, 15 nt, Human
uggaaagcaaagggc

SEQ ID NO: 3713620 - RNA, 15 nt, Human
uggaaagccucugcu

SEQ ID NO: 3713621 - RNA, 18 nt, Human
uggaaagccucugcugcc

SEQ ID NO: 3713622 - RNA, 12 nt, Human
uggaaaggaaug

SEQ ID NO: 3713623 - RNA, 19 nt, Human
uggaaaggagaggaaagaa

SEQ ID NO: 3713624 - RNA, 21 nt, Human
uggaaaggcucagucucagga

SEQ ID NO: 3713625 - RNA, 14 nt, Human
uggaaaggggagag

SEQ ID NO: 3713626 - RNA, 17 nt, Human
uggaaaggggagagccu

SEQ ID NO: 3713627 - RNA, 23 nt, Human
uggaaaggggagagccugcuggc

SEQ ID NO: 3713628 - RNA, 18 nt, Human
uggaaaggggggagcugg

SEQ ID NO: 3713629 - RNA, 19 nt, Human
uggaaaggugugagacugg

SEQ ID NO: 3713630 - RNA, 19 nt, Human
uggaaaguacacucugcug

SEQ ID NO: 3713631 - RNA, 12 nt, Human
uggaaagucaga

SEQ ID NO: 3713632 - RNA, 16 nt, Human
uggaaagugaauuuga

SEQ ID NO: 3713633 - RNA, 20 nt, Human
uggaaagugaauuugaauga

SEQ ID NO: 3713634 - RNA, 16 nt, Human
uggaaauaaagucaga

SEQ ID NO: 3713635 - RNA, 18 nt, Human
uggaaauaaaucuuccua

SEQ ID NO: 3713636 - RNA, 15 nt, Human
uggaaauaaauguau

SEQ ID NO: 3713637 - RNA, 18 nt, Human
uggaaauacaguuguugg

SEQ ID NO: 3713638 - RNA, 22 nt, Human
uggaaauacaguuguuggccuc

SEQ ID NO: 3713639 - RNA, 15 nt, Human
uggaaauacuagauu

SEQ ID NO: 3713640 - RNA, 16 nt, Human
uggaaauagugauuuc

SEQ ID NO: 3713641 - RNA, 14 nt, Human
uggaaauauauauu

SEQ ID NO: 3713642 - RNA, 22 nt, Human
uggaaauaucaguuacucagcc

SEQ ID NO: 3713643 - RNA, 18 nt, Human
uggaaaucaaauguaaag

SEQ ID NO: 3713644 - RNA, 19 nt, Human
uggaaaucaaauguaaagu

SEQ ID NO: 3713645 - RNA, 23 nt, Human
uggaaaugggcagagcagagacc

SEQ ID NO: 3713646 - RNA, 22 nt, Human
uggaaauuagguugaaacauau

SEQ ID NO: 3713647 - RNA, 13 nt, Human
uggaaauuccugu

SEQ ID NO: 3713648 - RNA, 17 nt, Human
uggaaauuggaagagca

SEQ ID NO: 3713649 - RNA, 21 nt, Human
uggaaauuuaaagcagguucu

SEQ ID NO: 3713650 - RNA, 22 nt, Human
uggaaauuuaaagcagguucuu

SEQ ID NO: 3713651 - RNA, 23 nt, Human
uggaaauuuguuauaaugaauga

SEQ ID NO: 3713652 - RNA, 16 nt, Human
uggaacaaagugaagg

SEQ ID NO: 3713653 - RNA, 19 nt, Human
uggaacacaaacacauugu

SEQ ID NO: 3713654 - RNA, 20 nt, Human
uggaacacuagacaagccag

SEQ ID NO: 3713655 - RNA, 13 nt, Human
uggaacacuucga

SEQ ID NO: 3713656 - RNA, 12 nt, Human
uggaacagugcu

SEQ ID NO: 3713657 - RNA, 21 nt, Human
uggaacauaaaauacaauguu

SEQ ID NO: 3713658 - RNA, 23 nt, Human
uggaacaucaucaaggcacugcc

SEQ ID NO: 3713659 - RNA, 17 nt, Human
uggaacauuggaauguu

SEQ ID NO: 3713660 - RNA, 17 nt, Human
uggaaccacauugaaga

SEQ ID NO: 3713661 - RNA, 16 nt, Human
uggaacccagacucag

SEQ ID NO: 3713662 - RNA, 16 nt, Human
uggaaccgcaggaagc

SEQ ID NO: 3713663 - RNA, 18 nt, Human
uggaaccguugccaaccg

SEQ ID NO: 3713664 - RNA, 16 nt, Human
uggaaccucagccugg

SEQ ID NO: 3713665 - RNA, 23 nt, Human
uggaaccucagccuggccagaca

SEQ ID NO: 3713666 - RNA, 15 nt, Human
uggaaccuccuuucu

SEQ ID NO: 3713667 - RNA, 21 nt, Human
uggaaccuccuuucucuucuc

SEQ ID NO: 3713668 - RNA, 13 nt, Human
uggaaccucuguc

SEQ ID NO: 3713669 - RNA, 13 nt, Human
uggaaccuugcug

SEQ ID NO: 3713670 - RNA, 20 nt, Human
guuaacaucaugaauuuauu

SEQ ID NO: 3713671 - RNA, 16 nt, Human
guuaacauggacauga

SEQ ID NO: 3713672 - RNA, 15 nt, Human
guuaacauugaccaa

SEQ ID NO: 3713673 - RNA, 13 nt, Human
guuaacauuguug

SEQ ID NO: 3713674 - RNA, 17 nt, Human
guuaacuauugcauuua

SEQ ID NO: 3713675 - RNA, 20 nt, Human
guuaacugaauaccacucug

SEQ ID NO: 3713676 - RNA, 23 nt, Human
guuaacugaauaccacucuguaa

SEQ ID NO: 3713677 - RNA, 17 nt, Human
guuaacugauuugcaau

SEQ ID NO: 3713678 - RNA, 17 nt, Human
guuaacuuuaagacuga

SEQ ID NO: 3713679 - RNA, 23 nt, Human
guuaacuuuaagacugagcaccu

SEQ ID NO: 3713680 - RNA, 15 nt, Human
guuaagaaaauaaau

SEQ ID NO: 3713681 - RNA, 13 nt, Human
guuaagaagcugu

SEQ ID NO: 3713682 - RNA, 20 nt, Human
guuaagaagcuguuguacau

SEQ ID NO: 3713683 - RNA, 18 nt, Human
guuaagacaaacugcaua

SEQ ID NO: 3713684 - RNA, 13 nt, Human
guuaagaccuggc

SEQ ID NO: 3713685 - RNA, 16 nt, Human
guuaagaccuggcagc

SEQ ID NO: 3713686 - RNA, 14 nt, Human
guuaagagaaacuu

SEQ ID NO: 3713687 - RNA, 18 nt, Human
guuaagagaaaugagcuu

SEQ ID NO: 3713688 - RNA, 21 nt, Human
guuaagagaggucuggaaagu

SEQ ID NO: 3713689 - RNA, 22 nt, Human
guuaagagugggggagagcagg

SEQ ID NO: 3713690 - RNA, 15 nt, Human
guuaagauaugaugu

SEQ ID NO: 3713691 - RNA, 14 nt, Human
guuaagcagccgcc

SEQ ID NO: 3713692 - RNA, 20 nt, Human
guuaagcauuaccacucagg

SEQ ID NO: 3713693 - RNA, 14 nt, Human
guuaagcccuggca

SEQ ID NO: 3713694 - RNA, 14 nt, Human
guuaaggaaacucu

SEQ ID NO: 3713695 - RNA, 22 nt, Human
guuaaggagaaucauguuucuu

SEQ ID NO: 3713696 - RNA, 17 nt, Human
guuaaggcugaggaaag

SEQ ID NO: 3713697 - RNA, 17 nt, Human
guuaaguccucccugac

SEQ ID NO: 3713698 - RNA, 14 nt, Human
guuaaguucuauug

SEQ ID NO: 3713699 - RNA, 22 nt, Human
guuaaguuuuucccuucaucug

SEQ ID NO: 3713700 - RNA, 15 nt, Human
guuaauaaauuaaaa

SEQ ID NO: 3713701 - RNA, 14 nt, Human
guuaauacaaggua

SEQ ID NO: 3713702 - RNA, 13 nt, Human
guuaauaccagcu

SEQ ID NO: 3713703 - RNA, 18 nt, Human
guuaauaucacucauuaa

SEQ ID NO: 3713704 - RNA, 14 nt, Human
guuaauauggcuga

SEQ ID NO: 3713705 - RNA, 21 nt, Human
guuaauauugauuuauuaaua

SEQ ID NO: 3713706 - RNA, 19 nt, Human
guuaauauuuauaggucac

SEQ ID NO: 3713707 - RNA, 12 nt, Human
guuaaucaauuu

SEQ ID NO: 3713708 - RNA, 18 nt, Human
guuaaucauuagguguga

SEQ ID NO: 3713709 - RNA, 22 nt, Human
guuaaucucuguuauguacugu

SEQ ID NO: 3713710 - RNA, 12 nt, Human
guuaaucuuagg

SEQ ID NO: 3713711 - RNA, 16 nt, Human
guuaaucuugcuuucu

SEQ ID NO: 3713712 - RNA, 17 nt, Human
guuaaugaaaaugucag

SEQ ID NO: 3713713 - RNA, 22 nt, Human
guuaaugaugguugauggguuc

SEQ ID NO: 3713714 - RNA, 13 nt, Human
guuaaugcuuucu

SEQ ID NO: 3713715 - RNA, 15 nt, Human
guuaaugcuuucuga

SEQ ID NO: 3713716 - RNA, 20 nt, Human
guuaauguaaucugauggcu

SEQ ID NO: 3713717 - RNA, 17 nt, Human
guuaauguauauaaaaa

SEQ ID NO: 3713718 - RNA, 11 nt, Human
guuaauguauu

SEQ ID NO: 3713719 - RNA, 22 nt, Human
guuaauguauuuguucauguuu

SEQ ID NO: 3713720 - RNA, 15 nt, Human
guuaauguuauauca

SEQ ID NO: 3713721 - RNA, 19 nt, Human
guuaauuccaauuauauga

SEQ ID NO: 3713722 - RNA, 12 nt, Human
guuaauuuaagu

SEQ ID NO: 3713723 - RNA, 19 nt, Human
guuaauuuagaaaacuuua

SEQ ID NO: 3713724 - RNA, 22 nt, Human
guuaauuuaguggaaaaggcac

SEQ ID NO: 3713725 - RNA, 12 nt, Human
guuaauuuggac

SEQ ID NO: 3713726 - RNA, 17 nt, Human
guuaauuuggaccauuu

SEQ ID NO: 3713727 - RNA, 20 nt, Human
guuaauuuggaccauuuucc

SEQ ID NO: 3713728 - RNA, 18 nt, Human
guuaauuuuuugguacaa

SEQ ID NO: 3713729 - RNA, 14 nt, Human
guuacaaaauguaa

SEQ ID NO: 3713730 - RNA, 18 nt, Human
guuacaaaauguaacugu

SEQ ID NO: 3713731 - RNA, 13 nt, Human
guuacaaacugca

SEQ ID NO: 3713732 - RNA, 21 nt, Human
guuacaaacugcaauagagac

SEQ ID NO: 3713733 - RNA, 15 nt, Human
guuacaaauuauaau

SEQ ID NO: 3713734 - RNA, 13 nt, Human
guuacaacagauu

SEQ ID NO: 3713735 - RNA, 20 nt, Human
guuacaacagauuugugaac

SEQ ID NO: 3713736 - RNA, 13 nt, Human
guuacaaguauac

SEQ ID NO: 3713737 - RNA, 21 nt, Human
guuacacacuuuuuaagaaau

SEQ ID NO: 3713738 - RNA, 21 nt, Human
guuacacagaaaugcugcugg

SEQ ID NO: 3713739 - RNA, 22 nt, Human
guuacacagaaaugcugcuggc

SEQ ID NO: 3713740 - RNA, 14 nt, Human
guuacacuguuaga

SEQ ID NO: 3713741 - RNA, 19 nt, Human
guuacacuguuagaacacu

SEQ ID NO: 3713742 - RNA, 13 nt, Human
guuacagaaagug

SEQ ID NO: 3713743 - RNA, 22 nt, Human
guuacagaaaguggugcucagu

SEQ ID NO: 3713744 - RNA, 13 nt, Human
guuacagaagccc

SEQ ID NO: 3713745 - RNA, 13 nt, Human
guuacagaagcug

SEQ ID NO: 3713746 - RNA, 17 nt, Human
guuacagacaaagcgug

SEQ ID NO: 3713747 - RNA, 15 nt, Human
guuacagcacaaaau

SEQ ID NO: 3713748 - RNA, 23 nt, Human
guuacagccaagugccaaaugcu

SEQ ID NO: 3713749 - RNA, 12 nt, Human
guuacagccugg

SEQ ID NO: 3713750 - RNA, 19 nt, Human
uaugaagauaaguguauuu

SEQ ID NO: 3713751 - RNA, 24 nt, Human
uaugaagcucaccuguugcuuaca

SEQ ID NO: 3713752 - RNA, 22 nt, Human
uaugaagcuuuuaugugaaaca

SEQ ID NO: 3713753 - RNA, 21 nt, Human
uaugaaguuuaaaacaguauu

SEQ ID NO: 3713754 - RNA, 20 nt, Human
uaugaauacagcagcaagaa

SEQ ID NO: 3713755 - RNA, 15 nt, Human
uaugaaucuaugcca

SEQ ID NO: 3713756 - RNA, 22 nt, Human
uaugaaucuaugccaaagauca

SEQ ID NO: 3713757 - RNA, 18 nt, Human
uaugaaucuauuauacug

SEQ ID NO: 3713758 - RNA, 21 nt, Human
uaugaaucucuacgcaaaaaa

SEQ ID NO: 3713759 - RNA, 15 nt, Human
uaugaaucugagaga

SEQ ID NO: 3713760 - RNA, 21 nt, Human
uaugaaugcccccagcuggcc

SEQ ID NO: 3713761 - RNA, 22 nt, Human
uaugaaugggcaaaacugaauu

SEQ ID NO: 3713762 - RNA, 20 nt, Human
uaugaauguacugcauguua

SEQ ID NO: 3713763 - RNA, 19 nt, Human
uaugaauuauucaauuuau

SEQ ID NO: 3713764 - RNA, 22 nt, Human
uaugaauuguacagaauauuuc

SEQ ID NO: 3713765 - RNA, 21 nt, Human
uaugaauuuaaauauaauucu

SEQ ID NO: 3713766 - RNA, 13 nt, Human
uaugacaaauguu

SEQ ID NO: 3713767 - RNA, 14 nt, Human
uaugacaaauguuu

SEQ ID NO: 3713768 - RNA, 16 nt, Human
uaugacaaauguuucu

SEQ ID NO: 3713769 - RNA, 17 nt, Human
uaugacaaauguuucua

SEQ ID NO: 3713770 - RNA, 12 nt, Human
uaugacacaugc

SEQ ID NO: 3713771 - RNA, 22 nt, Human
uaugacacaugcaaggucauuu

SEQ ID NO: 3713772 - RNA, 19 nt, Human
uaugacauaaaaacaacuu

SEQ ID NO: 3713773 - RNA, 23 nt, Human
uaugacaucacuuguacaaaaua

SEQ ID NO: 3713774 - RNA, 14 nt, Human
uaugaccacacucc

SEQ ID NO: 3713775 - RNA, 17 nt, Human
uaugacgcugauacaua

SEQ ID NO: 3713776 - RNA, 20 nt, Human
uaugacggaagaacauagaa

SEQ ID NO: 3713777 - RNA, 16 nt, Human
uaugacuaaagagaga

SEQ ID NO: 3713778 - RNA, 18 nt, Human
uaugacuaaagagagaau

SEQ ID NO: 3713779 - RNA, 16 nt, Human
uaugacuccagaauuu

SEQ ID NO: 3713780 - RNA, 23 nt, Human
uaugacuccagaauuucccaaag

SEQ ID NO: 3713781 - RNA, 17 nt, Human
uaugacugcuucaugac

SEQ ID NO: 3713782 - RNA, 23 nt, Human
uaugacugcuucaugacauuccu

SEQ ID NO: 3713783 - RNA, 20 nt, Human
uaugacuucauuaauaauaa

SEQ ID NO: 3713784 - RNA, 23 nt, Human
uaugacuugggcacccccagccu

SEQ ID NO: 3713785 - RNA, 15 nt, Human
uaugagacacaggau

SEQ ID NO: 3713786 - RNA, 13 nt, Human
uaugagcagaagg

SEQ ID NO: 3713787 - RNA, 15 nt, Human
uaugagcagaaggaa

SEQ ID NO: 3713788 - RNA, 17 nt, Human
uaugagcauccugagcc

SEQ ID NO: 3713789 - RNA, 16 nt, Human
uaugagccagacaaau

SEQ ID NO: 3713790 - RNA, 17 nt, Human
uaugagccagacaaaug

SEQ ID NO: 3713791 - RNA, 19 nt, Human
uaugagccagacaaaugga

SEQ ID NO: 3713792 - RNA, 17 nt, Human
uaugagcucauguagca

SEQ ID NO: 3713793 - RNA, 16 nt, Human
uaugagcugagggggg

SEQ ID NO: 3713794 - RNA, 21 nt, Human
uaugagcuuccuucugugaaa

SEQ ID NO: 3713795 - RNA, 16 nt, Human
uaugagcuuuauguaa

SEQ ID NO: 3713796 - RNA, 14 nt, Human
uaugaggaggggag

SEQ ID NO: 3713797 - RNA, 21 nt, Human
uaugaggcauuuguuugaacu

SEQ ID NO: 3713798 - RNA, 20 nt, Human
uaugaguacaaaugccuuaa

SEQ ID NO: 3713799 - RNA, 15 nt, Human
uaugaguauacaaua

SEQ ID NO: 3713800 - RNA, 23 nt, Human
uaugagucaaugugcaguguagc

SEQ ID NO: 3713801 - RNA, 14 nt, Human
uaugagucuagaug

SEQ ID NO: 3713802 - RNA, 23 nt, Human
uaugauacuucgacacuguucuu

SEQ ID NO: 3713803 - RNA, 20 nt, Human
uaugauagcgggaaaaggag

SEQ ID NO: 3713804 - RNA, 15 nt, Human
uaugauauuuucugu

SEQ ID NO: 3713805 - RNA, 22 nt, Human
uaugauauuuuuuuaagucuuu

SEQ ID NO: 3713806 - RNA, 14 nt, Human
uaugaucaaauguu

SEQ ID NO: 3713807 - RNA, 17 nt, Human
uaugaucaguguuguug

SEQ ID NO: 3713808 - RNA, 11 nt, Human
uaugauccagc

SEQ ID NO: 3713809 - RNA, 16 nt, Human
uaugaucugucugugg

SEQ ID NO: 3713810 - RNA, 22 nt, Human
uaugaugaugaaaauuuuacca

SEQ ID NO: 3713811 - RNA, 21 nt, Human
uaugauggaagacaggaaagu

SEQ ID NO: 3713812 - RNA, 21 nt, Human
uaugauggguguuuuuagcag

SEQ ID NO: 3713813 - RNA, 16 nt, Human
uaugaugguuuuaaac

SEQ ID NO: 3713814 - RNA, 14 nt, Human
uaugaugugcuuaa

SEQ ID NO: 3713815 - RNA, 18 nt, Human
uaugaugugggucaagga

SEQ ID NO: 3713816 - RNA, 14 nt, Human
uaugauguuaaaaa

SEQ ID NO: 3713817 - RNA, 18 nt, Human
uaugauguuaaaaaaaua

SEQ ID NO: 3713818 - RNA, 17 nt, Human
uaugauuaaaaauauca

SEQ ID NO: 3713819 - RNA, 21 nt, Human
uaugauuaaguaaugauaacu

SEQ ID NO: 3713820 - RNA, 15 nt, Human
uaugauuacuggccu

SEQ ID NO: 3713821 - RNA, 21 nt, Human
uaugauucagauuguuaucua

SEQ ID NO: 3713822 - RNA, 14 nt, Human
uaugauuuaauaaa

SEQ ID NO: 3713823 - RNA, 17 nt, Human
uaugauuuaauaaaaua

SEQ ID NO: 3713824 - RNA, 17 nt, Human
uaugauuuaauuugaaa

SEQ ID NO: 3713825 - RNA, 17 nt, Human
uaugauuuggaaaauaa

SEQ ID NO: 3713826 - RNA, 21 nt, Human
uaugauuuuuuaaaagaaauu

SEQ ID NO: 3713827 - RNA, 17 nt, Human
uaugauuuuuuuuucau

SEQ ID NO: 3713828 - RNA, 13 nt, Human
uaugcaaaaugga

SEQ ID NO: 3713829 - RNA, 13 nt, Human
uaugcaaagucua

SEQ ID NO: 3713830 - RNA, 20 nt, Human
uaugcaaauauuuuuuugua

SEQ ID NO: 3713831 - RNA, 14 nt, Human
uaugcaaauuccca

SEQ ID NO: 3713832 - RNA, 13 nt, Human
uaugcaagcaguu

SEQ ID NO: 3713833 - RNA, 23 nt, Human
uaugcaagcaguuucaauaaagu

SEQ ID NO: 3713834 - RNA, 14 nt, Human
uaugcacacacaua

SEQ ID NO: 3713835 - RNA, 13 nt, Human
uaugcacacauuu

SEQ ID NO: 3713836 - RNA, 21 nt, Human
uaugcacaccucccacccccu

SEQ ID NO: 3713837 - RNA, 13 nt, Human
uaugcacauaugg

SEQ ID NO: 3713838 - RNA, 19 nt, Human
uaugcacauauggacucug

SEQ ID NO: 3713839 - RNA, 19 nt, Human
uaugcacaugaacuuagau

SEQ ID NO: 3713840 - RNA, 15 nt, Human
uaugcacuaaauaug

SEQ ID NO: 3713841 - RNA, 18 nt, Human
uaugcacuaagucucuuu

SEQ ID NO: 3713842 - RNA, 14 nt, Human
uaugcacuuggccu

SEQ ID NO: 3713843 - RNA, 20 nt, Human
uaugcagaaauagacaaaaa

SEQ ID NO: 3713844 - RNA, 22 nt, Human
uaugcagaaauagacaaaaagu

SEQ ID NO: 3713845 - RNA, 20 nt, Human
uaugcagaacacauuucaaa

SEQ ID NO: 3713846 - RNA, 15 nt, Human
uaugcagaauacuuu

SEQ ID NO: 3713847 - RNA, 19 nt, Human
uaugcagaauggcauuugc

SEQ ID NO: 3713848 - RNA, 18 nt, Human
uaugcagagguccacaac

SEQ ID NO: 3713849 - RNA, 22 nt, Human
uaugcagugauauggcagaaga

SEQ ID NO: 3713850 - RNA, 15 nt, Human
uaugcagugcugcuu

SEQ ID NO: 3713851 - RNA, 14 nt, Human
uaugcauaaaguca

SEQ ID NO: 3713852 - RNA, 20 nt, Human
uaugcauaacugacaaauca

SEQ ID NO: 3713853 - RNA, 17 nt, Human
uaugcaucauuucagga

SEQ ID NO: 3713854 - RNA, 18 nt, Human
uaugcaucauuucaggag

SEQ ID NO: 3713855 - RNA, 17 nt, Human
uaugcaucuaauaaaaa

SEQ ID NO: 3713856 - RNA, 13 nt, Human
uaugcaugaagua

SEQ ID NO: 3713857 - RNA, 18 nt, Human
uaugcaugaaguaauaug

SEQ ID NO: 3713858 - RNA, 18 nt, Human
uaugcauggugccccagg

SEQ ID NO: 3713859 - RNA, 16 nt, Human
uaugcaugguuucagc

SEQ ID NO: 3713860 - RNA, 21 nt, Human
uaugcauuuaaauacagucuu

SEQ ID NO: 3713861 - RNA, 22 nt, Human
uaugcauuuaaauacagucuuc

SEQ ID NO: 3713862 - RNA, 14 nt, Human
uaugccaaagauca

SEQ ID NO: 3713863 - RNA, 15 nt, Human
uaugccacuuccuuu

SEQ ID NO: 3713864 - RNA, 17 nt, Human
uaugccaugauggaaau

SEQ ID NO: 3713865 - RNA, 15 nt, Human
uaugcccacauuuag

SEQ ID NO: 3713866 - RNA, 18 nt, Human
uaugcccacauuuagucu

SEQ ID NO: 3713867 - RNA, 23 nt, Human
uaugcccacauuuagucucuuua

SEQ ID NO: 3713868 - RNA, 15 nt, Human
uaugccccaaauaua

SEQ ID NO: 3713869 - RNA, 21 nt, Human
uaugccggaugugcuuuucuc

SEQ ID NO: 3713870 - RNA, 20 nt, Human
uaugccucuccuuuguauau

SEQ ID NO: 3713871 - RNA, 14 nt, Human
uaugccugcuauuu

SEQ ID NO: 3713872 - RNA, 17 nt, Human
uaugccugggcagaagg

SEQ ID NO: 3713873 - RNA, 22 nt, Human
uaugccuuuaaaucugugauga

SEQ ID NO: 3713874 - RNA, 20 nt, Human
uaugccuuugauguauuuuc

SEQ ID NO: 3713875 - RNA, 13 nt, Human
ucaaccagauaac

SEQ ID NO: 3713876 - RNA, 14 nt, Human
ucaaccagcagaug

SEQ ID NO: 3713877 - RNA, 16 nt, Human
ucaaccaucgcuuuau

SEQ ID NO: 3713878 - RNA, 20 nt, Human
ucaaccccaccacuucuuuu

SEQ ID NO: 3713879 - RNA, 18 nt, Human
ucaaccccacccuguuug

SEQ ID NO: 3713880 - RNA, 16 nt, Human
ucaaccccagacacug

SEQ ID NO: 3713881 - RNA, 17 nt, Human
ucaaccccagacacugg

SEQ ID NO: 3713882 - RNA, 18 nt, Human
ucaacccccauuucuauu

SEQ ID NO: 3713883 - RNA, 16 nt, Human
ucaaccccuccccucc

SEQ ID NO: 3713884 - RNA, 21 nt, Human
ucaaccccuccccuccauccc

SEQ ID NO: 3713885 - RNA, 18 nt, Human
ucaaccccuucgcuccug

SEQ ID NO: 3713886 - RNA, 19 nt, Human
ucaaccccuucgcuccugu

SEQ ID NO: 3713887 - RNA, 18 nt, Human
ucaacccuaaaaagcaga

SEQ ID NO: 3713888 - RNA, 13 nt, Human
ucaacccuggaga

SEQ ID NO: 3713889 - RNA, 14 nt, Human
ucaacccuggagag

SEQ ID NO: 3713890 - RNA, 20 nt, Human
ucaacccuuuugucugccuc

SEQ ID NO: 3713891 - RNA, 21 nt, Human
ucaacccuuuugucugccucu

SEQ ID NO: 3713892 - RNA, 15 nt, Human
ucaaccguacaaugg

SEQ ID NO: 3713893 - RNA, 20 nt, Human
ucaaccuaccaccccuuccu

SEQ ID NO: 3713894 - RNA, 21 nt, Human
ucaaccuaccaccccuuccug

SEQ ID NO: 3713895 - RNA, 12 nt, Human
ucaaccucccaa

SEQ ID NO: 3713896 - RNA, 18 nt, Human
ucaaccuccuguggaacc

SEQ ID NO: 3713897 - RNA, 18 nt, Human
ucaaccucuucuggcuca

SEQ ID NO: 3713898 - RNA, 18 nt, Human
ucaaccugggcaaagccu

SEQ ID NO: 3713899 - RNA, 12 nt, Human
ucaaccuguaaa

SEQ ID NO: 3713900 - RNA, 13 nt, Human
ucaaccuguaaau

SEQ ID NO: 3713901 - RNA, 15 nt, Human
ucaaccuguaaauua

SEQ ID NO: 3713902 - RNA, 15 nt, Human
ucaaccugugaugag

SEQ ID NO: 3713903 - RNA, 15 nt, Human
ucaaccuuaagaccu

SEQ ID NO: 3713904 - RNA, 19 nt, Human
ucaacgccucacugaaaca

SEQ ID NO: 3713905 - RNA, 19 nt, Human
ucaacuaaaaaaaaaaaag

SEQ ID NO: 3713906 - RNA, 18 nt, Human
ucaacuaaaguuguacuu

SEQ ID NO: 3713907 - RNA, 21 nt, Human
ucaacuaaaguuguacuuuaa

SEQ ID NO: 3713908 - RNA, 15 nt, Human
ucaacuaggaucaga

SEQ ID NO: 3713909 - RNA, 21 nt, Human
ucaacuagugggguuuccugg

SEQ ID NO: 3713910 - RNA, 19 nt, Human
ucaacucauaagacuuugg

SEQ ID NO: 3713911 - RNA, 16 nt, Human
ucaacucccugccccc

SEQ ID NO: 3713912 - RNA, 23 nt, Human
ucaacucccugccccccagcccu

SEQ ID NO: 3713913 - RNA, 14 nt, Human
ucaacuccucccau

SEQ ID NO: 3713914 - RNA, 19 nt, Human
ucaacuccucgacaucacu

SEQ ID NO: 3713915 - RNA, 20 nt, Human
ucaacucuccuccagaguca

SEQ ID NO: 3713916 - RNA, 21 nt, Human
ucaacucucuuauugccucac

SEQ ID NO: 3713917 - RNA, 22 nt, Human
ucaacucuuuguuauuugaaaa

SEQ ID NO: 3713918 - RNA, 18 nt, Human
ucaacugccuacuccaaa

SEQ ID NO: 3713919 - RNA, 20 nt, Human
ucaacugccuacuccaaaau

SEQ ID NO: 3713920 - RNA, 18 nt, Human
ucaacugggcugaacacu

SEQ ID NO: 3713921 - RNA, 17 nt, Human
ucaacuggguccagaag

SEQ ID NO: 3713922 - RNA, 18 nt, Human
ucaacuggguccagaaga

SEQ ID NO: 3713923 - RNA, 22 nt, Human
ucaacugucuccuaccucugcu

SEQ ID NO: 3713924 - RNA, 19 nt, Human
ucaacuuauuaacaauuag

SEQ ID NO: 3713925 - RNA, 14 nt, Human
ucaacuucaggaaa

SEQ ID NO: 3713926 - RNA, 13 nt, Human
ucaacuugcaaaa

SEQ ID NO: 3713927 - RNA, 14 nt, Human
ucaacuugcaaaau

SEQ ID NO: 3713928 - RNA, 14 nt, Human
ucaacuugcuuauc

SEQ ID NO: 3713929 - RNA, 14 nt, Human
ucaacuuuaugcag

SEQ ID NO: 3713930 - RNA, 15 nt, Human
ucaacuuugaauaaa

SEQ ID NO: 3713931 - RNA, 14 nt, Human
ucaacuuuguaaaa

SEQ ID NO: 3713932 - RNA, 21 nt, Human
ucaacuuuuccuuugaauccu

SEQ ID NO: 3713933 - RNA, 16 nt, Human
ucaagaaaaaauaaau

SEQ ID NO: 3713934 - RNA, 18 nt, Human
ucaagaaaaaauaaaugg

SEQ ID NO: 3713935 - RNA, 21 nt, Human
ucaagaaaaauuauuguauaa

SEQ ID NO: 3713936 - RNA, 15 nt, Human
ucaagaaaacaggca

SEQ ID NO: 3713937 - RNA, 20 nt, Human
ucaagaaacagccagcaaga

SEQ ID NO: 3713938 - RNA, 13 nt, Human
ucaagaaacugag

SEQ ID NO: 3713939 - RNA, 22 nt, Human
ucaagaaauaaaaggaagccaa

SEQ ID NO: 3713940 - RNA, 15 nt, Human
ucaagaaaugaagag

SEQ ID NO: 3713941 - RNA, 18 nt, Human
ucaagaaaugaagagcug

SEQ ID NO: 3713942 - RNA, 14 nt, Human
ucaagaacuuguuu

SEQ ID NO: 3713943 - RNA, 14 nt, Human
ucaagaagaaaaag

SEQ ID NO: 3713944 - RNA, 18 nt, Human
ucaagaagaaaaagguuu

SEQ ID NO: 3713945 - RNA, 14 nt, Human
ucaagaagggcugc

SEQ ID NO: 3713946 - RNA, 22 nt, Human
ucaagaauggggaucacagaga

SEQ ID NO: 3713947 - RNA, 13 nt, Human
ucaagaccaaaug

SEQ ID NO: 3713948 - RNA, 19 nt, Human
ucaagaccaaauggaaaca

SEQ ID NO: 3713949 - RNA, 13 nt, Human
ucaagaccagccu

SEQ ID NO: 3713950 - RNA, 15 nt, Human
ucaagaccagccugg

SEQ ID NO: 3713951 - RNA, 20 nt, Human
ucaagacuggaaggugggga

SEQ ID NO: 3713952 - RNA, 11 nt, Human
ucaagagccuu

SEQ ID NO: 3713953 - RNA, 15 nt, Human
ucaagagccuuaaaa

SEQ ID NO: 3713954 - RNA, 18 nt, Human
ucaagagccuuaaaacau

SEQ ID NO: 3713955 - RNA, 21 nt, Human
ucaagagccuuaaaacaucau

SEQ ID NO: 3713956 - RNA, 16 nt, Human
ucaagagcugcccucc

SEQ ID NO: 3713957 - RNA, 17 nt, Human
ucaagagcugcccuccu

SEQ ID NO: 3713958 - RNA, 20 nt, Human
ucaagaggagcccccacccu

SEQ ID NO: 3713959 - RNA, 18 nt, Human
ucaagaggcaaaggaauc

SEQ ID NO: 3713960 - RNA, 13 nt, Human
ucaagauagaaag

SEQ ID NO: 3713961 - RNA, 19 nt, Human
ucaagaucaaaaaggcuua

SEQ ID NO: 3713962 - RNA, 22 nt, Human
ucaagaucaaugaaaugauguc

SEQ ID NO: 3713963 - RNA, 17 nt, Human
ucaagauucccaggagu

SEQ ID NO: 3713964 - RNA, 20 nt, Human
ucaagauucccaggaguucu

SEQ ID NO: 3713965 - RNA, 17 nt, Human
ucaagauuucaggauua

SEQ ID NO: 3713966 - RNA, 17 nt, Human
ucaagcaagauuucaga

SEQ ID NO: 3713967 - RNA, 18 nt, Human
ucaagcaauccuccugag

SEQ ID NO: 3713968 - RNA, 20 nt, Human
ucaagcaauccucucaccuc

SEQ ID NO: 3713969 - RNA, 12 nt, Human
ucaagcagccaa

SEQ ID NO: 3713970 - RNA, 17 nt, Human
ucaagcagguuagagaa

SEQ ID NO: 3713971 - RNA, 23 nt, Human
ucaagcagguuagagaaaauaga

SEQ ID NO: 3713972 - RNA, 14 nt, Human
ucaagcaucuccug

SEQ ID NO: 3713973 - RNA, 18 nt, Human
ucaagcaucuccugagga

SEQ ID NO: 3713974 - RNA, 23 nt, Human
ucaagcaucuccugaggaucaga

SEQ ID NO: 3713975 - RNA, 15 nt, Human
ucaagcauguauuuu

SEQ ID NO: 3713976 - RNA, 15 nt, Human
ucaagccaagcagcc

SEQ ID NO: 3713977 - RNA, 20 nt, Human
ucaagccaagcagccaagcu

SEQ ID NO: 3713978 - RNA, 16 nt, Human
ucaagccaauccccuc

SEQ ID NO: 3713979 - RNA, 21 nt, Human
ucaagccaauccccuccuugg

SEQ ID NO: 3713980 - RNA, 19 nt, Human
ucaagccagcaacacagag

SEQ ID NO: 3713981 - RNA, 21 nt, Human
ucaagccagcaacacagagca

SEQ ID NO: 3713982 - RNA, 21 nt, Human
ucaagcccagccacguggagc

SEQ ID NO: 3713983 - RNA, 13 nt, Human
ucaagcccaggag

SEQ ID NO: 3713984 - RNA, 16 nt, Human
ucaagcgauucuccug

SEQ ID NO: 3713985 - RNA, 16 nt, Human
ucaagcgauucuucug

SEQ ID NO: 3713986 - RNA, 17 nt, Human
ucaagcgauucuucugc

SEQ ID NO: 3713987 - RNA, 18 nt, Human
ucaagcgauucuucugcu

SEQ ID NO: 3713988 - RNA, 21 nt, Human
ucaagcgauucuucugcuuca

SEQ ID NO: 3713989 - RNA, 19 nt, Human
ucaagcuaauaaaauauca

SEQ ID NO: 3713990 - RNA, 22 nt, Human
ucaagcuaauaaaauaucauuc

SEQ ID NO: 3713991 - RNA, 14 nt, Human
ucaagcuccuccuc

SEQ ID NO: 3713992 - RNA, 13 nt, Human
ucaagcucugagg

SEQ ID NO: 3713993 - RNA, 15 nt, Human
ucaagcucugaggga

SEQ ID NO: 3713994 - RNA, 23 nt, Human
ucaagcugaguauuaaaauguau

SEQ ID NO: 3713995 - RNA, 21 nt, Human
ucaagcugugagacaguggga

SEQ ID NO: 3713996 - RNA, 19 nt, Human
ucaagcuucaguuuccugg

SEQ ID NO: 3713997 - RNA, 22 nt, Human
ucaaggaacuugaaaaauacuu

SEQ ID NO: 3713998 - RNA, 18 nt, Human
ucaaggaagguucaugua

SEQ ID NO: 3713999 - RNA, 20 nt, Human
ucaaggaaguagaaacaaaa

SEQ ID NO: 3714000 - RNA, 23 nt, Human
ucaaggaauuucuuaacuucuug

SEQ ID NO: 3714001 - RNA, 21 nt, Human
ucaaggacaaagucuccagcc

SEQ ID NO: 3714002 - RNA, 19 nt, Human
ucaaggacuugaaagcauc

SEQ ID NO: 3714003 - RNA, 14 nt, Human
ucaaggagaggagg

SEQ ID NO: 3714004 - RNA, 16 nt, Human
ucaaggcacucuagau

SEQ ID NO: 3714005 - RNA, 18 nt, Human
ucaaggcacucuagauuc

SEQ ID NO: 3714006 - RNA, 20 nt, Human
ucaaggcacucuagauucca

SEQ ID NO: 3714007 - RNA, 13 nt, Human
ucaaggcacugcc

SEQ ID NO: 3714008 - RNA, 17 nt, Human
ucaaggcaucaugcaga

SEQ ID NO: 3714009 - RNA, 14 nt, Human
ucaaggccucccac

SEQ ID NO: 3714010 - RNA, 18 nt, Human
ucaaggccucccacagug

SEQ ID NO: 3714011 - RNA, 16 nt, Human
ucaaggcggugcuuga

SEQ ID NO: 3714012 - RNA, 20 nt, Human
ucaaggcuacagaugugcug

SEQ ID NO: 3714013 - RNA, 11 nt, Human
ucaaggcucag

SEQ ID NO: 3714014 - RNA, 17 nt, Human
ucaaggcugcuuagaau

SEQ ID NO: 3714015 - RNA, 18 nt, Human
ucaaggcuuauauucaac

SEQ ID NO: 3714016 - RNA, 19 nt, Human
ucaagggaauguaacugcu

SEQ ID NO: 3714017 - RNA, 15 nt, Human
ucaagggacaaggac

SEQ ID NO: 3714018 - RNA, 23 nt, Human
ucaagggcagcuuugcucauauu

SEQ ID NO: 3714019 - RNA, 14 nt, Human
ucaaggggucacuu

SEQ ID NO: 3714020 - RNA, 15 nt, Human
ucaagggucaggccu

SEQ ID NO: 3714021 - RNA, 15 nt, Human
ucaagguaaaauucu

SEQ ID NO: 3714022 - RNA, 18 nt, Human
ucaagguaaaauucuaaa

SEQ ID NO: 3714023 - RNA, 18 nt, Human
ucaaggucacuguuuccu

SEQ ID NO: 3714024 - RNA, 21 nt, Human
ucaaggucguuuuuuucauuc

SEQ ID NO: 3714025 - RNA, 17 nt, Human
uaugcuaaaauacauuu

SEQ ID NO: 3714026 - RNA, 14 nt, Human
uaugcuaccaccag

SEQ ID NO: 3714027 - RNA, 15 nt, Human
uaugcuauugacaau

SEQ ID NO: 3714028 - RNA, 17 nt, Human
uaugcuauugacaauaa

SEQ ID NO: 3714029 - RNA, 20 nt, Human
uaugcuauugacaauaaaau

SEQ ID NO: 3714030 - RNA, 16 nt, Human
uaugcuauuucuauau

SEQ ID NO: 3714031 - RNA, 13 nt, Human
uaugcuauuucug

SEQ ID NO: 3714032 - RNA, 14 nt, Human
uaugcuauuucugu

SEQ ID NO: 3714033 - RNA, 14 nt, Human
uaugcucugcaugu

SEQ ID NO: 3714034 - RNA, 22 nt, Human
uaugcugaguauguuaagcucu

SEQ ID NO: 3714035 - RNA, 22 nt, Human
uaugcugaucaucgccagaggu

SEQ ID NO: 3714036 - RNA, 15 nt, Human
uaugcugauuuauuu

SEQ ID NO: 3714037 - RNA, 19 nt, Human
uaugcugcaacaaaaugua

SEQ ID NO: 3714038 - RNA, 16 nt, Human
uaugcugccaaauuuu

SEQ ID NO: 3714039 - RNA, 13 nt, Human
uaugcuguauuuu

SEQ ID NO: 3714040 - RNA, 20 nt, Human
uaugcuguauuuucuuuuua

SEQ ID NO: 3714041 - RNA, 17 nt, Human
uaugcuuauuuuaaaau

SEQ ID NO: 3714042 - RNA, 19 nt, Human
uaugcuuauuuuaaaauuu

SEQ ID NO: 3714043 - RNA, 16 nt, Human
uaugcuucauacaggg

SEQ ID NO: 3714044 - RNA, 15 nt, Human
uaugcuuuaaacauu

SEQ ID NO: 3714045 - RNA, 21 nt, Human
uaugcuuuccuucuuugggau

SEQ ID NO: 3714046 - RNA, 14 nt, Human
uauggaaaaauaaa

SEQ ID NO: 3714047 - RNA, 16 nt, Human
uauggaaaaucagcug

SEQ ID NO: 3714048 - RNA, 17 nt, Human
uauggaaauaaauguau

SEQ ID NO: 3714049 - RNA, 14 nt, Human
uauggaaauauaua

SEQ ID NO: 3714050 - RNA, 13 nt, Human
uauggaacacucu

SEQ ID NO: 3714051 - RNA, 17 nt, Human
uauggaacacucugaga

SEQ ID NO: 3714052 - RNA, 18 nt, Human
uauggaacacucugagac

SEQ ID NO: 3714053 - RNA, 19 nt, Human
uauggaacacucugagacu

SEQ ID NO: 3714054 - RNA, 17 nt, Human
uauggaacucucuccac

SEQ ID NO: 3714055 - RNA, 22 nt, Human
uauggaaggguuuguggcuggg

SEQ ID NO: 3714056 - RNA, 14 nt, Human
uauggaauacagug

SEQ ID NO: 3714057 - RNA, 13 nt, Human
uauggaaucaauu

SEQ ID NO: 3714058 - RNA, 15 nt, Human
uauggaaucaauuca

SEQ ID NO: 3714059 - RNA, 22 nt, Human
uauggaauuacauguaaaacau

SEQ ID NO: 3714060 - RNA, 11 nt, Human
uauggaauuga

SEQ ID NO: 3714061 - RNA, 18 nt, Human
uauggaauugauuugcau

SEQ ID NO: 3714062 - RNA, 16 nt, Human
uauggacaaaacaaga

SEQ ID NO: 3714063 - RNA, 14 nt, Human
uauggacacagggu

SEQ ID NO: 3714064 - RNA, 18 nt, Human
uauggacagggcugucuc

SEQ ID NO: 3714065 - RNA, 13 nt, Human
uauggacuaucug

SEQ ID NO: 3714066 - RNA, 17 nt, Human
uauggacuaucugucug

SEQ ID NO: 3714067 - RNA, 18 nt, Human
uauggacuaucugucugg

SEQ ID NO: 3714068 - RNA, 21 nt, Human
uauggacuaucugucuggugg

SEQ ID NO: 3714069 - RNA, 16 nt, Human
uauggagaauugcuga

SEQ ID NO: 3714070 - RNA, 13 nt, Human
uauggagccuggc

SEQ ID NO: 3714071 - RNA, 18 nt, Human
uauggaggaacaacucuc

SEQ ID NO: 3714072 - RNA, 14 nt, Human
uauggaggcaggag

SEQ ID NO: 3714073 - RNA, 13 nt, Human
uauggauaaugcc

SEQ ID NO: 3714074 - RNA, 23 nt, Human
uauggauccacuggcuggacaaa

SEQ ID NO: 3714075 - RNA, 16 nt, Human
uauggauguccccagc

SEQ ID NO: 3714076 - RNA, 14 nt, Human
uauggauucuaaaa

SEQ ID NO: 3714077 - RNA, 14 nt, Human
uauggcagaagaca

SEQ ID NO: 3714078 - RNA, 16 nt, Human
uauggcagaagacacc

SEQ ID NO: 3714079 - RNA, 23 nt, Human
uauggcagaagacaccagagcag

SEQ ID NO: 3714080 - RNA, 17 nt, Human
uauggcagaguuguaaa

SEQ ID NO: 3714081 - RNA, 21 nt, Human
uauggcagaguuguaaauaua

SEQ ID NO: 3714082 - RNA, 19 nt, Human
uauggccacauuuaauauc

SEQ ID NO: 3714083 - RNA, 22 nt, Human
uauggcccuggccuagcauacg

SEQ ID NO: 3714084 - RNA, 23 nt, Human
uauggccuaaauuuauuaaauaa

SEQ ID NO: 3714085 - RNA, 14 nt, Human
uauggccuguggau

SEQ ID NO: 3714086 - RNA, 20 nt, Human
uauggcguaaguacagagaa

SEQ ID NO: 3714087 - RNA, 17 nt, Human
uauggcucacuaugaau

SEQ ID NO: 3714088 - RNA, 22 nt, Human
uauggcucugcaccccucugcc

SEQ ID NO: 3714089 - RNA, 21 nt, Human
uauggcuuuauuuuuuugaac

SEQ ID NO: 3714090 - RNA, 16 nt, Human
uauggcuuuugugcau

SEQ ID NO: 3714091 - RNA, 18 nt, Human
uauggcuuuugugcauua

SEQ ID NO: 3714092 - RNA, 21 nt, Human
uauggcuuuugugcauuaucu

SEQ ID NO: 3714093 - RNA, 14 nt, Human
uaugggagaaauag

SEQ ID NO: 3714094 - RNA, 13 nt, Human
uaugggagcuguc

SEQ ID NO: 3714095 - RNA, 15 nt, Human
uaugggcauugacaa

SEQ ID NO: 3714096 - RNA, 16 nt, Human
uaugggcauugacaaa

SEQ ID NO: 3714097 - RNA, 15 nt, Human
uaugggccccuggca

SEQ ID NO: 3714098 - RNA, 17 nt, Human
uauggggauagaugugu

SEQ ID NO: 3714099 - RNA, 21 nt, Human
uauggguaucaaacagcucag

SEQ ID NO: 3714100 - RNA, 22 nt, Human
uauggguuuaguuacuuuagau

SEQ ID NO: 3714101 - RNA, 11 nt, Human
uaugguaaaaa

SEQ ID NO: 3714102 - RNA, 15 nt, Human
uaugguaaagauauu

SEQ ID NO: 3714103 - RNA, 14 nt, Human
uaugguaaucauau

SEQ ID NO: 3714104 - RNA, 16 nt, Human
uaugguagaaaaauuu

SEQ ID NO: 3714105 - RNA, 22 nt, Human
uaugguagaaaaauuucacgau

SEQ ID NO: 3714106 - RNA, 21 nt, Human
uaugguaggaacugcugggcu

SEQ ID NO: 3714107 - RNA, 20 nt, Human
uaugguauaaugguugacug

SEQ ID NO: 3714108 - RNA, 19 nt, Human
uaugguccuaaaagcaaaa

SEQ ID NO: 3714109 - RNA, 13 nt, Human
uauggucuaaugu

SEQ ID NO: 3714110 - RNA, 14 nt, Human
uauggugagaugca

SEQ ID NO: 3714111 - RNA, 20 nt, Human
uauggugcaauguguguaua

SEQ ID NO: 3714112 - RNA, 13 nt, Human
uauggugccaaug

SEQ ID NO: 3714113 - RNA, 15 nt, Human
uauggugccaaugga

SEQ ID NO: 3714114 - RNA, 19 nt, Human
uauggugccaauggaaccu

SEQ ID NO: 3714115 - RNA, 17 nt, Human
uauggugccuaguauug

SEQ ID NO: 3714116 - RNA, 19 nt, Human
uauggugccuaguauugac

SEQ ID NO: 3714117 - RNA, 22 nt, Human
uauggugccuaguauugacaaa

SEQ ID NO: 3714118 - RNA, 19 nt, Human
uaugguuacuucuucucuu

SEQ ID NO: 3714119 - RNA, 13 nt, Human
uaugguuauguuu

SEQ ID NO: 3714120 - RNA, 14 nt, Human
uaugguuauguuuu

SEQ ID NO: 3714121 - RNA, 22 nt, Human
uaugguugauaguuuaccugaa

SEQ ID NO: 3714122 - RNA, 10 nt, Human
uauguaaaaa

SEQ ID NO: 3714123 - RNA, 23 nt, Human
uauguaaaaggccaaaccucugu

SEQ ID NO: 3714124 - RNA, 17 nt, Human
uauguaaaauguuuuag

SEQ ID NO: 3714125 - RNA, 21 nt, Human
uauguaaacaaaucuuuccau

SEQ ID NO: 3714126 - RNA, 15 nt, Human
uauguaaauaauucu

SEQ ID NO: 3714127 - RNA, 19 nt, Human
uauguaaaucccauuauuc

SEQ ID NO: 3714128 - RNA, 23 nt, Human
uauguaaaucccauuauucaaag

SEQ ID NO: 3714129 - RNA, 10 nt, Human
uauguaaaug

SEQ ID NO: 3714130 - RNA, 20 nt, Human
uauguaaaugguaugucauu

SEQ ID NO: 3714131 - RNA, 21 nt, Human
uauguaaaugguaugucauuc

SEQ ID NO: 3714132 - RNA, 14 nt, Human
uauguaaauguaua

SEQ ID NO: 3714133 - RNA, 21 nt, Human
uauguaacaaaccugcacuua

SEQ ID NO: 3714134 - RNA, 15 nt, Human
uauguaauaauguga

SEQ ID NO: 3714135 - RNA, 13 nt, Human
uauguaaucuaug

SEQ ID NO: 3714136 - RNA, 14 nt, Human
uauguaaugcaaaa

SEQ ID NO: 3714137 - RNA, 21 nt, Human
uauguacaauauuuuaagcau

SEQ ID NO: 3714138 - RNA, 14 nt, Human
uauguacaauugug

SEQ ID NO: 3714139 - RNA, 21 nt, Human
uauguaccauaugaucuguuu

SEQ ID NO: 3714140 - RNA, 22 nt, Human
uauguaccauaugaucuguuuu

SEQ ID NO: 3714141 - RNA, 18 nt, Human
uauguacccucugaaaua

SEQ ID NO: 3714142 - RNA, 16 nt, Human
uauguaccucuuuuag

SEQ ID NO: 3714143 - RNA, 21 nt, Human
uauguacguuuguaugugugu

SEQ ID NO: 3714144 - RNA, 22 nt, Human
uauguacguuuguaugugugua

SEQ ID NO: 3714145 - RNA, 14 nt, Human
uauguacuguacua

SEQ ID NO: 3714146 - RNA, 13 nt, Human
uauguacuucaug

SEQ ID NO: 3714147 - RNA, 17 nt, Human
uauguacuucaugcugu

SEQ ID NO: 3714148 - RNA, 16 nt, Human
uauguacuugucaaag

SEQ ID NO: 3714149 - RNA, 21 nt, Human
uauguacuuuuauuuuacaca

SEQ ID NO: 3714150 - RNA, 15 nt, Human
uauguagacaauaua

SEQ ID NO: 3714151 - RNA, 17 nt, Human
uauguagacuauauaca

SEQ ID NO: 3714152 - RNA, 18 nt, Human
uauguagacuauauacau

SEQ ID NO: 3714153 - RNA, 14 nt, Human
uauguagauaacaa

SEQ ID NO: 3714154 - RNA, 23 nt, Human
uauguagauauuuggcuuaaaua

SEQ ID NO: 3714155 - RNA, 21 nt, Human
uauguagcaggaaauaaagua

SEQ ID NO: 3714156 - RNA, 21 nt, Human
uauguagguaagacuguagau

SEQ ID NO: 3714157 - RNA, 17 nt, Human
uauguaguaauugacau

SEQ ID NO: 3714158 - RNA, 19 nt, Human
uauguaguaucuauaugac

SEQ ID NO: 3714159 - RNA, 13 nt, Human
uauguauacaugu

SEQ ID NO: 3714160 - RNA, 18 nt, Human
uauguauauuaaaaaaga

SEQ ID NO: 3714161 - RNA, 23 nt, Human
uauguauauuuuuuuaauuuaac

SEQ ID NO: 3714162 - RNA, 17 nt, Human
uauguaugguauccaag

SEQ ID NO: 3714163 - RNA, 17 nt, Human
uauguaugguuugaaaa

SEQ ID NO: 3714164 - RNA, 13 nt, Human
uauguaugugugu

SEQ ID NO: 3714165 - RNA, 13 nt, Human
uauguauguguuu

SEQ ID NO: 3714166 - RNA, 16 nt, Human
uauguauguguuuaga

SEQ ID NO: 3714167 - RNA, 21 nt, Human
uauguauguguuuagaauuga

SEQ ID NO: 3714168 - RNA, 13 nt, Human
uauguauguuuac

SEQ ID NO: 3714169 - RNA, 18 nt, Human
uauguauguuuacacugu

SEQ ID NO: 3714170 - RNA, 14 nt, Human
uauguauuaacacu

SEQ ID NO: 3714171 - RNA, 19 nt, Human
uauguauuauuuacauuua

SEQ ID NO: 3714172 - RNA, 21 nt, Human
uauguauuauuuauaauuccu

SEQ ID NO: 3714173 - RNA, 13 nt, Human
uauguauucugua

SEQ ID NO: 3714174 - RNA, 14 nt, Human
uauguauucuuuuc

SEQ ID NO: 3714175 - RNA, 15 nt, Human
gccucccucugcugu

SEQ ID NO: 3714176 - RNA, 22 nt, Human
gccucccugaaaauguuuuucu

SEQ ID NO: 3714177 - RNA, 13 nt, Human
gccucccugaagc

SEQ ID NO: 3714178 - RNA, 23 nt, Human
gccucccugacccugcagagaug

SEQ ID NO: 3714179 - RNA, 17 nt, Human
gccucccugccucaggc

SEQ ID NO: 3714180 - RNA, 20 nt, Human
gccucccuguugaagcucug

SEQ ID NO: 3714181 - RNA, 22 nt, Human
gccucccuucaugcauggaaau

SEQ ID NO: 3714182 - RNA, 15 nt, Human
gccuccgagagggag

SEQ ID NO: 3714183 - RNA, 18 nt, Human
gccuccgagagggagaga

SEQ ID NO: 3714184 - RNA, 13 nt, Human
gccuccgagggac

SEQ ID NO: 3714185 - RNA, 21 nt, Human
gccuccgagggacgcggcucc

SEQ ID NO: 3714186 - RNA, 15 nt, Human
gccuccgcuucccug

SEQ ID NO: 3714187 - RNA, 16 nt, Human
gccuccgcuucccugg

SEQ ID NO: 3714188 - RNA, 20 nt, Human
gccuccggcgucagccucca

SEQ ID NO: 3714189 - RNA, 17 nt, Human
gccuccgggacccccag

SEQ ID NO: 3714190 - RNA, 18 nt, Human
gccuccgggacccccagg

SEQ ID NO: 3714191 - RNA, 12 nt, Human
gccuccucaucc

SEQ ID NO: 3714192 - RNA, 14 nt, Human
gccuccucaucugg

SEQ ID NO: 3714193 - RNA, 23 nt, Human
gccuccucaucugggggagugga

SEQ ID NO: 3714194 - RNA, 11 nt, Human
gccuccucccu

SEQ ID NO: 3714195 - RNA, 16 nt, Human
gccuccucccucccuc

SEQ ID NO: 3714196 - RNA, 17 nt, Human
gccuccucccucccucu

SEQ ID NO: 3714197 - RNA, 13 nt, Human
gccuccucuucac

SEQ ID NO: 3714198 - RNA, 21 nt, Human
gccuccugaccugaggcuccu

SEQ ID NO: 3714199 - RNA, 19 nt, Human
gccuccugaguagcuggga

SEQ ID NO: 3714200 - RNA, 14 nt, Human
gccuccugccugcc

SEQ ID NO: 3714201 - RNA, 21 nt, Human
gccuccuggcugucugaggcu

SEQ ID NO: 3714202 - RNA, 18 nt, Human
gccuccuguggccugcca

SEQ ID NO: 3714203 - RNA, 20 nt, Human
gccuccuguggccugccagu

SEQ ID NO: 3714204 - RNA, 12 nt, Human
gccuccuguggg

SEQ ID NO: 3714205 - RNA, 13 nt, Human
gccuccuguguaa

SEQ ID NO: 3714206 - RNA, 16 nt, Human
gccuccuguguacugu

SEQ ID NO: 3714207 - RNA, 18 nt, Human
gccuccuguguacugugu

SEQ ID NO: 3714208 - RNA, 18 nt, Human
gccuccuguguagcuggg

SEQ ID NO: 3714209 - RNA, 19 nt, Human
gccuccuuagaaaaaaaau

SEQ ID NO: 3714210 - RNA, 20 nt, Human
gccuccuuccuugcuguccu

SEQ ID NO: 3714211 - RNA, 20 nt, Human
gccuccuucugagcuccugu

SEQ ID NO: 3714212 - RNA, 20 nt, Human
gccuccuugauauuuguauu

SEQ ID NO: 3714213 - RNA, 10 nt, Human
gccuccuuua

SEQ ID NO: 3714214 - RNA, 16 nt, Human
gccuccuuuccccucc

SEQ ID NO: 3714215 - RNA, 19 nt, Human
gccuccuuugugaggaagc

SEQ ID NO: 3714216 - RNA, 16 nt, Human
gccucgaaacacagaa

SEQ ID NO: 3714217 - RNA, 19 nt, Human
gccucgaacuccugggcuc

SEQ ID NO: 3714218 - RNA, 20 nt, Human
gccucgaacuccugggcuca

SEQ ID NO: 3714219 - RNA, 13 nt, Human
gccucgaacuggc

SEQ ID NO: 3714220 - RNA, 23 nt, Human
gccucgaggugccuucuucaggg

SEQ ID NO: 3714221 - RNA, 12 nt, Human
gccucgcaaccc

SEQ ID NO: 3714222 - RNA, 14 nt, Human
gccucgcaggaaga

SEQ ID NO: 3714223 - RNA, 20 nt, Human
gccucgcccaccgcaugccc

SEQ ID NO: 3714224 - RNA, 23 nt, Human
gccucgcccaccgcaugcccccu

SEQ ID NO: 3714225 - RNA, 14 nt, Human
gccucgccccuggc

SEQ ID NO: 3714226 - RNA, 16 nt, Human
gccucgcuccccacuc

SEQ ID NO: 3714227 - RNA, 23 nt, Human
gccucgcuccccacucugcucug

SEQ ID NO: 3714228 - RNA, 20 nt, Human
gccucgcucuguuacccagg

SEQ ID NO: 3714229 - RNA, 15 nt, Human
gccucggagccucau

SEQ ID NO: 3714230 - RNA, 23 nt, Human
gccucggagccucauccgaggca

SEQ ID NO: 3714231 - RNA, 18 nt, Human
gccucggcuccugcugca

SEQ ID NO: 3714232 - RNA, 15 nt, Human
gccucggcuggcucc

SEQ ID NO: 3714233 - RNA, 18 nt, Human
gccucggcuggcuccccu

SEQ ID NO: 3714234 - RNA, 19 nt, Human
gccucuaaccccaggcccc

SEQ ID NO: 3714235 - RNA, 21 nt, Human
gccucuaaccccaggccccga

SEQ ID NO: 3714236 - RNA, 13 nt, Human
gccucuagcugaa

SEQ ID NO: 3714237 - RNA, 19 nt, Human
gccucuagggaccccuccu

SEQ ID NO: 3714238 - RNA, 20 nt, Human
gccucuagggaccccuccuc

SEQ ID NO: 3714239 - RNA, 21 nt, Human
gccucuauccuacaaggccua

SEQ ID NO: 3714240 - RNA, 13 nt, Human
gccucucacacac

SEQ ID NO: 3714241 - RNA, 23 nt, Human
gccucucaccucugugccucugu

SEQ ID NO: 3714242 - RNA, 16 nt, Human
gccucucaucaacuga

SEQ ID NO: 3714243 - RNA, 17 nt, Human
gccucucaucccccauu

SEQ ID NO: 3714244 - RNA, 14 nt, Human
gccucuccagccuc

SEQ ID NO: 3714245 - RNA, 23 nt, Human
gccucuccaggcaccaucucccu

SEQ ID NO: 3714246 - RNA, 13 nt, Human
gccucucccaccc

SEQ ID NO: 3714247 - RNA, 15 nt, Human
gccucucccaggcag

SEQ ID NO: 3714248 - RNA, 20 nt, Human
gccucucccaggcaggggcc

SEQ ID NO: 3714249 - RNA, 15 nt, Human
gccucucccaucacu

SEQ ID NO: 3714250 - RNA, 21 nt, Human
gccucucccaucacuucccua

SEQ ID NO: 3714251 - RNA, 12 nt, Human
gccucuccccug

SEQ ID NO: 3714252 - RNA, 16 nt, Human
gccucuccccugccug

SEQ ID NO: 3714253 - RNA, 17 nt, Human
gccucucccgucagggc

SEQ ID NO: 3714254 - RNA, 22 nt, Human
gccucucccuccuccaggaagc

SEQ ID NO: 3714255 - RNA, 19 nt, Human
gccucucccugcugcuccu

SEQ ID NO: 3714256 - RNA, 21 nt, Human
gccucucccugcugcuccuag

SEQ ID NO: 3714257 - RNA, 14 nt, Human
gccucucccuggcc

SEQ ID NO: 3714258 - RNA, 16 nt, Human
gccucucccuggcccu

SEQ ID NO: 3714259 - RNA, 20 nt, Human
gccucuccgccccugagccc

SEQ ID NO: 3714260 - RNA, 20 nt, Human
gccucuccuuguggccuggg

SEQ ID NO: 3714261 - RNA, 21 nt, Human
gccucuccuuguggccugggc

SEQ ID NO: 3714262 - RNA, 14 nt, Human
gccucuccuuugua

SEQ ID NO: 3714263 - RNA, 15 nt, Human
gccucuccuuuguau

SEQ ID NO: 3714264 - RNA, 17 nt, Human
gccucuccuuuguauau

SEQ ID NO: 3714265 - RNA, 19 nt, Human
gccucucgcuccucaaccc

SEQ ID NO: 3714266 - RNA, 22 nt, Human
gccucucgcuccucaaccccuc

SEQ ID NO: 3714267 - RNA, 18 nt, Human
gccucucgguugaaaccu

SEQ ID NO: 3714268 - RNA, 22 nt, Human
gccucucgguugaaaccuguau

SEQ ID NO: 3714269 - RNA, 20 nt, Human
gccucucuauccucucuucc

SEQ ID NO: 3714270 - RNA, 17 nt, Human
gccucucugcagguccc

SEQ ID NO: 3714271 - RNA, 15 nt, Human
gccucucuggccucc

SEQ ID NO: 3714272 - RNA, 16 nt, Human
gccucucuggccuccc

SEQ ID NO: 3714273 - RNA, 19 nt, Human
gccucucuggccucccacc

SEQ ID NO: 3714274 - RNA, 23 nt, Human
gccucucuuccuaucccauccca

SEQ ID NO: 3714275 - RNA, 23 nt, Human
gccucucuuguaauuuggaucuc

SEQ ID NO: 3714276 - RNA, 15 nt, Human
gccucugacacacag

SEQ ID NO: 3714277 - RNA, 21 nt, Human
gccucugacacacagcucugu

SEQ ID NO: 3714278 - RNA, 19 nt, Human
gccucugaccccuccucac

SEQ ID NO: 3714279 - RNA, 19 nt, Human
gccucugacuuaagcugcc

SEQ ID NO: 3714280 - RNA, 13 nt, Human
gccucugagagca

SEQ ID NO: 3714281 - RNA, 13 nt, Human
gccucugaggcca

SEQ ID NO: 3714282 - RNA, 18 nt, Human
gccucugaggccagccug

SEQ ID NO: 3714283 - RNA, 20 nt, Human
gccucugaggccagccuggc

SEQ ID NO: 3714284 - RNA, 21 nt, Human
gccucugaggccagccuggcc

SEQ ID NO: 3714285 - RNA, 22 nt, Human
gccucugagggaaagcccagaa

SEQ ID NO: 3714286 - RNA, 17 nt, Human
gccucugauaugggacu

SEQ ID NO: 3714287 - RNA, 23 nt, Human
gccucugauaugggacugagccu

SEQ ID NO: 3714288 - RNA, 21 nt, Human
gccucugcacacccuccagag

SEQ ID NO: 3714289 - RNA, 17 nt, Human
gccucugcacuccccug

SEQ ID NO: 3714290 - RNA, 20 nt, Human
gccucugcacuccccugcug

SEQ ID NO: 3714291 - RNA, 21 nt, Human
gccucugcacuccccugcugg

SEQ ID NO: 3714292 - RNA, 15 nt, Human
gccucugcauucagg

SEQ ID NO: 3714293 - RNA, 10 nt, Human
gccucugccu

SEQ ID NO: 3714294 - RNA, 18 nt, Human
gccucugccucugacaca

SEQ ID NO: 3714295 - RNA, 21 nt, Human
gccucugccugucucccccac

SEQ ID NO: 3714296 - RNA, 18 nt, Human
gccucugccuuagaggag

SEQ ID NO: 3714297 - RNA, 19 nt, Human
gccucugccuuagaggagc

SEQ ID NO: 3714298 - RNA, 19 nt, Human
gccucugcgagugguuucu

SEQ ID NO: 3714299 - RNA, 15 nt, Human
gccucugcugccaug

SEQ ID NO: 3714300 - RNA, 12 nt, Human
gccucugcuggc

SEQ ID NO: 3714301 - RNA, 17 nt, Human
gccucuggaaagcaaag

SEQ ID NO: 3714302 - RNA, 12 nt, Human
gccucuggcuag

SEQ ID NO: 3714303 - RNA, 23 nt, Human
gccucugguuuggggcgaggcag

SEQ ID NO: 3714304 - RNA, 20 nt, Human
gccucugucacugcaggcac

SEQ ID NO: 3714305 - RNA, 18 nt, Human
gccucuguccccuucucu

SEQ ID NO: 3714306 - RNA, 22 nt, Human
gccucuguccccuucucucauc

SEQ ID NO: 3714307 - RNA, 15 nt, Human
gccucuguccucgcu

SEQ ID NO: 3714308 - RNA, 15 nt, Human
gccucugucuagcau

SEQ ID NO: 3714309 - RNA, 21 nt, Human
gccucugucuagcaugccaac

SEQ ID NO: 3714310 - RNA, 17 nt, Human
gccucugugcugugugu

SEQ ID NO: 3714311 - RNA, 18 nt, Human
gccucugugcugugugug

SEQ ID NO: 3714312 - RNA, 12 nt, Human
gccucuguguca

SEQ ID NO: 3714313 - RNA, 22 nt, Human
gccucugugucacuggcugccu

SEQ ID NO: 3714314 - RNA, 14 nt, Human
gccucuguguccuu

SEQ ID NO: 3714315 - RNA, 17 nt, Human
gccucuguuugacaaac

SEQ ID NO: 3714316 - RNA, 20 nt, Human
gccucuuaaagcugccugua

SEQ ID NO: 3714317 - RNA, 18 nt, Human
gccucuuagacuucugcu

SEQ ID NO: 3714318 - RNA, 21 nt, Human
gccucuuccagucuuccugac

SEQ ID NO: 3714319 - RNA, 18 nt, Human
gccucuucccccugcuuc

SEQ ID NO: 3714320 - RNA, 20 nt, Human
gccucuucccgccgcccagc

SEQ ID NO: 3714321 - RNA, 15 nt, Human
gccucuucucucaga

SEQ ID NO: 3714322 - RNA, 14 nt, Human
gccucuucugggag

SEQ ID NO: 3714323 - RNA, 20 nt, Human
gccucuugaccaggcugccu

SEQ ID NO: 3714324 - RNA, 16 nt, Human
ucaaggugcuguuguc

SEQ ID NO: 3714325 - RNA, 20 nt, Human
ucaagguggccaaauuauuu

SEQ ID NO: 3714326 - RNA, 11 nt, Human
ucaagguucua

SEQ ID NO: 3714327 - RNA, 21 nt, Human
ucaagguuuuagguucuaaag

SEQ ID NO: 3714328 - RNA, 22 nt, Human
ucaaguaagaagacaugaacca

SEQ ID NO: 3714329 - RNA, 13 nt, Human
ucaaguacacuga

SEQ ID NO: 3714330 - RNA, 18 nt, Human
ucaaguagacuacuguuc

SEQ ID NO: 3714331 - RNA, 13 nt, Human
ucaaguagcauuu

SEQ ID NO: 3714332 - RNA, 17 nt, Human
ucaaguauagaaaaucu

SEQ ID NO: 3714333 - RNA, 11 nt, Human
ucaaguauuau

SEQ ID NO: 3714334 - RNA, 14 nt, Human
ucaaguauuauaaa

SEQ ID NO: 3714335 - RNA, 15 nt, Human
ucaaguauuauaccu

SEQ ID NO: 3714336 - RNA, 16 nt, Human
ucaaguauuauaccuu

SEQ ID NO: 3714337 - RNA, 12 nt, Human
ucaaguauuuug

SEQ ID NO: 3714338 - RNA, 14 nt, Human
ucaagucagcucuu

SEQ ID NO: 3714339 - RNA, 20 nt, Human
ucaaguccugccucuuaaau

SEQ ID NO: 3714340 - RNA, 20 nt, Human
ucaagucggaucuaguccag

SEQ ID NO: 3714341 - RNA, 15 nt, Human
ucaagucuaccaacc

SEQ ID NO: 3714342 - RNA, 16 nt, Human
ucaagucucugcuggc

SEQ ID NO: 3714343 - RNA, 19 nt, Human
ucaagucucugcuggccca

SEQ ID NO: 3714344 - RNA, 20 nt, Human
ucaagucugugccuggagcu

SEQ ID NO: 3714345 - RNA, 15 nt, Human
ucaagucuuucucuu

SEQ ID NO: 3714346 - RNA, 21 nt, Human
ucaagucuuucucuuucccug

SEQ ID NO: 3714347 - RNA, 22 nt, Human
ucaagucuuucucuuucccugg

SEQ ID NO: 3714348 - RNA, 19 nt, Human
ucaagugaaucuaaaagcu

SEQ ID NO: 3714349 - RNA, 20 nt, Human
ucaagugcaugcucucugca

SEQ ID NO: 3714350 - RNA, 14 nt, Human
ucaaguggcaaagc

SEQ ID NO: 3714351 - RNA, 16 nt, Human
ucaaguggggcucgcc

SEQ ID NO: 3714352 - RNA, 21 nt, Human
ucaagugucucaguccaccug

SEQ ID NO: 3714353 - RNA, 13 nt, Human
ucaaguucacacc

SEQ ID NO: 3714354 - RNA, 16 nt, Human
ucaaguucacaccugc

SEQ ID NO: 3714355 - RNA, 14 nt, Human
ucaaguuccuuugg

SEQ ID NO: 3714356 - RNA, 16 nt, Human
ucaaguuccuuugggu

SEQ ID NO: 3714357 - RNA, 15 nt, Human
ucaaguucuaagauu

SEQ ID NO: 3714358 - RNA, 20 nt, Human
ucaaguugcacacucacugg

SEQ ID NO: 3714359 - RNA, 16 nt, Human
ucaaguuguaaauaau

SEQ ID NO: 3714360 - RNA, 21 nt, Human
ucaaguuguaacuuauauuga

SEQ ID NO: 3714361 - RNA, 13 nt, Human
ucaaguugugcuu

SEQ ID NO: 3714362 - RNA, 23 nt, Human
ucaaguuguuccuuaagucagaa

SEQ ID NO: 3714363 - RNA, 17 nt, Human
ucaaguuuuaaaguuca

SEQ ID NO: 3714364 - RNA, 19 nt, Human
ucaaguuuuggguauguuu

SEQ ID NO: 3714365 - RNA, 22 nt, Human
ucaauaaaaaaaagaaaugaaa

SEQ ID NO: 3714366 - RNA, 14 nt, Human
ucaauaaaaaauua

SEQ ID NO: 3714367 - RNA, 16 nt, Human
ucaauaaaaaauuaug

SEQ ID NO: 3714368 - RNA, 19 nt, Human
ucaauaaaaaauuaugaca

SEQ ID NO: 3714369 - RNA, 16 nt, Human
ucaauaaaaucaugua

SEQ ID NO: 3714370 - RNA, 14 nt, Human
ucaauaaaauguga

SEQ ID NO: 3714371 - RNA, 16 nt, Human
ucaauaaaaugugauu

SEQ ID NO: 3714372 - RNA, 22 nt, Human
ucaauaaaaugugauuuuucug

SEQ ID NO: 3714373 - RNA, 14 nt, Human
ucaauaaaauuaua

SEQ ID NO: 3714374 - RNA, 16 nt, Human
ucaauaaacaacagcu

SEQ ID NO: 3714375 - RNA, 21 nt, Human
ucaauaaacagcuucaugccu

SEQ ID NO: 3714376 - RNA, 23 nt, Human
ucaauaaacagcuucaugccuuu

SEQ ID NO: 3714377 - RNA, 13 nt, Human
ucaauaaacgauu

SEQ ID NO: 3714378 - RNA, 15 nt, Human
ucaauaaacgauuua

SEQ ID NO: 3714379 - RNA, 17 nt, Human
ucaauaaacgauuuaau

SEQ ID NO: 3714380 - RNA, 12 nt, Human
ucaauaaacuua

SEQ ID NO: 3714381 - RNA, 15 nt, Human
ucaauaaagaaaacu

SEQ ID NO: 3714382 - RNA, 16 nt, Human
ucaauaaagaaaacuu

SEQ ID NO: 3714383 - RNA, 13 nt, Human
ucaauaaaguauc

SEQ ID NO: 3714384 - RNA, 14 nt, Human
ucaauaaaguuuga

SEQ ID NO: 3714385 - RNA, 17 nt, Human
ucaauaaaguuugaucu

SEQ ID NO: 3714386 - RNA, 15 nt, Human
ucaauaaaugguaua

SEQ ID NO: 3714387 - RNA, 15 nt, Human
ucaauaaaugucugu

SEQ ID NO: 3714388 - RNA, 16 nt, Human
ucaauaaaugucuguu

SEQ ID NO: 3714389 - RNA, 14 nt, Human
ucaauaacagccgc

SEQ ID NO: 3714390 - RNA, 18 nt, Human
ucaauaacagccgcucca

SEQ ID NO: 3714391 - RNA, 21 nt, Human
ucaauaacagccgcuccagag

SEQ ID NO: 3714392 - RNA, 22 nt, Human
ucaauaacgaaguugggcaaua

SEQ ID NO: 3714393 - RNA, 22 nt, Human
ucaauaagccucagcuuucuaa

SEQ ID NO: 3714394 - RNA, 20 nt, Human
ucaauaauauauuuucuguu

SEQ ID NO: 3714395 - RNA, 16 nt, Human
ucaauaauccaugaaa

SEQ ID NO: 3714396 - RNA, 23 nt, Human
ucaauaauuuguggugauuugga

SEQ ID NO: 3714397 - RNA, 14 nt, Human
ucaauacagauaua

SEQ ID NO: 3714398 - RNA, 17 nt, Human
ucaauacaguacaggca

SEQ ID NO: 3714399 - RNA, 16 nt, Human
ucaauagcguguguag

SEQ ID NO: 3714400 - RNA, 14 nt, Human
ucaauaguaauaua

SEQ ID NO: 3714401 - RNA, 13 nt, Human
ucaauaguguccu

SEQ ID NO: 3714402 - RNA, 21 nt, Human
ucaauaguguccuaugcaaua

SEQ ID NO: 3714403 - RNA, 14 nt, Human
ucaauaguucaagg

SEQ ID NO: 3714404 - RNA, 15 nt, Human
ucaauaguugaauua

SEQ ID NO: 3714405 - RNA, 16 nt, Human
ucaauaguugaauuag

SEQ ID NO: 3714406 - RNA, 18 nt, Human
ucaauauaagcuuuucuu

SEQ ID NO: 3714407 - RNA, 16 nt, Human
ucaauauauugaacuu

SEQ ID NO: 3714408 - RNA, 18 nt, Human
ucaauauccaaaccaaau

SEQ ID NO: 3714409 - RNA, 16 nt, Human
ucaauauccuuugccu

SEQ ID NO: 3714410 - RNA, 22 nt, Human
ucaauaucuuuuuuuuaauaaa

SEQ ID NO: 3714411 - RNA, 19 nt, Human
ucaauauuaaauacagaca

SEQ ID NO: 3714412 - RNA, 17 nt, Human
ucaauauuccugaauga

SEQ ID NO: 3714413 - RNA, 21 nt, Human
ucaauauuccugaaugaaaua

SEQ ID NO: 3714414 - RNA, 22 nt, Human
ucaauauugaauuuuuccuaug

SEQ ID NO: 3714415 - RNA, 18 nt, Human
ucaauauugacauuugua

SEQ ID NO: 3714416 - RNA, 17 nt, Human
ucaauauugucauuccu

SEQ ID NO: 3714417 - RNA, 10 nt, Human
ucaauauuua

SEQ ID NO: 3714418 - RNA, 13 nt, Human
ucaauauuuaaac

SEQ ID NO: 3714419 - RNA, 23 nt, Human
ucaauauuucagauaaucacaau

SEQ ID NO: 3714420 - RNA, 15 nt, Human
ucaauauuuuccaug

SEQ ID NO: 3714421 - RNA, 13 nt, Human
ucaaucaacacua

SEQ ID NO: 3714422 - RNA, 15 nt, Human
ucaaucaacacuacc

SEQ ID NO: 3714423 - RNA, 17 nt, Human
ucaaucaagccauguau

SEQ ID NO: 3714424 - RNA, 20 nt, Human
ucaaucacagcuuguauuuu

SEQ ID NO: 3714425 - RNA, 22 nt, Human
ucaaucacuguccuccacacaa

SEQ ID NO: 3714426 - RNA, 14 nt, Human
ucaaucaguauaau

SEQ ID NO: 3714427 - RNA, 16 nt, Human
ucaaucaguauaauuc

SEQ ID NO: 3714428 - RNA, 21 nt, Human
ucaaucaguauaauucuguac

SEQ ID NO: 3714429 - RNA, 19 nt, Human
ucaaucagucucagaaugu

SEQ ID NO: 3714430 - RNA, 15 nt, Human
ucaaucauuguacag

SEQ ID NO: 3714431 - RNA, 15 nt, Human
ucaauccagcuaugu

SEQ ID NO: 3714432 - RNA, 17 nt, Human
ucaauccccucauucag

SEQ ID NO: 3714433 - RNA, 20 nt, Human
ucaauccccucauucaggaa

SEQ ID NO: 3714434 - RNA, 21 nt, Human
ucaauccugauuccucucuaa

SEQ ID NO: 3714435 - RNA, 18 nt, Human
ucaaucucccgcugcugc

SEQ ID NO: 3714436 - RNA, 20 nt, Human
ucaaucucccgcugcugcug

SEQ ID NO: 3714437 - RNA, 16 nt, Human
ucaaucucguauagaa

SEQ ID NO: 3714438 - RNA, 20 nt, Human
ucaaucucguauagaagucu

SEQ ID NO: 3714439 - RNA, 15 nt, Human
ucaaucucucuuaga

SEQ ID NO: 3714440 - RNA, 13 nt, Human
ucaaucuguaaac

SEQ ID NO: 3714441 - RNA, 14 nt, Human
ucaaucuguaaacu

SEQ ID NO: 3714442 - RNA, 17 nt, Human
ucaaucuguaaacugug

SEQ ID NO: 3714443 - RNA, 16 nt, Human
ucaaucuguuuuucau

SEQ ID NO: 3714444 - RNA, 17 nt, Human
ucaaugacagagccuuc

SEQ ID NO: 3714445 - RNA, 18 nt, Human
ucaaugacagagccuucu

SEQ ID NO: 3714446 - RNA, 16 nt, Human
ucaaugacaugaauuu

SEQ ID NO: 3714447 - RNA, 12 nt, Human
ucaaugagcaug

SEQ ID NO: 3714448 - RNA, 15 nt, Human
ucaaugaucuagguu

SEQ ID NO: 3714449 - RNA, 17 nt, Human
ucaaugaucuagguuua

SEQ ID NO: 3714450 - RNA, 22 nt, Human
ucaaugcaagagugauugcagc

SEQ ID NO: 3714451 - RNA, 14 nt, Human
ucaaugcacugaca

SEQ ID NO: 3714452 - RNA, 15 nt, Human
ucaaugcagccagac

SEQ ID NO: 3714453 - RNA, 19 nt, Human
ucaaugcagccagaccuau

SEQ ID NO: 3714454 - RNA, 17 nt, Human
ucaaugcaguugucucu

SEQ ID NO: 3714455 - RNA, 17 nt, Human
ucaaugccccugaauuu

SEQ ID NO: 3714456 - RNA, 18 nt, Human
ucaaugccccugaauuua

SEQ ID NO: 3714457 - RNA, 16 nt, Human
ucaaugcuuuauuugu

SEQ ID NO: 3714458 - RNA, 19 nt, Human
ucaaugcuuuauuuguaaa

SEQ ID NO: 3714459 - RNA, 20 nt, Human
ucaaugcuuuauuuguaaau

SEQ ID NO: 3714460 - RNA, 20 nt, Human
ucaauggauuugaugcuguu

SEQ ID NO: 3714461 - RNA, 21 nt, Human
ucaauggccuaaaacuggccu

SEQ ID NO: 3714462 - RNA, 12 nt, Human
ucaauggcuuuu

SEQ ID NO: 3714463 - RNA, 14 nt, Human
ucaaugggaaauac

SEQ ID NO: 3714464 - RNA, 16 nt, Human
ucaaugggaccugugg

SEQ ID NO: 3714465 - RNA, 17 nt, Human
ucaaugggcaaugacag

SEQ ID NO: 3714466 - RNA, 14 nt, Human
ucaauggggccagu

SEQ ID NO: 3714467 - RNA, 19 nt, Human
ucaaugguuuaacauauaa

SEQ ID NO: 3714468 - RNA, 15 nt, Human
ucaaugugauucuaa

SEQ ID NO: 3714469 - RNA, 16 nt, Human
ucaaugugauucuaau

SEQ ID NO: 3714470 - RNA, 18 nt, Human
ucaauguggugaugaaau

SEQ ID NO: 3714471 - RNA, 18 nt, Human
ucaauguucauuguaaug

SEQ ID NO: 3714472 - RNA, 11 nt, Human
ucaauguuuga

SEQ ID NO: 3714473 - RNA, 22 nt, Human
ucaauguuugaggagcauguuu

SEQ ID NO: 3714474 - RNA, 14 nt, Human
ucaauguuuuuaaa

SEQ ID NO: 3714475 - RNA, 18 nt, Human
uauguauuguaaacaugu

SEQ ID NO: 3714476 - RNA, 22 nt, Human
uauguauuguaaacauguguuu

SEQ ID NO: 3714477 - RNA, 15 nt, Human
uauguauugugcaau

SEQ ID NO: 3714478 - RNA, 10 nt, Human
uauguauuuu

SEQ ID NO: 3714479 - RNA, 19 nt, Human
uauguauuuuauguauguu

SEQ ID NO: 3714480 - RNA, 14 nt, Human
uaugucaaagcagg

SEQ ID NO: 3714481 - RNA, 23 nt, Human
uaugucaagggcagcuuugcuca

SEQ ID NO: 3714482 - RNA, 15 nt, Human
uaugucaucacucua

SEQ ID NO: 3714483 - RNA, 15 nt, Human
uaugucauuucaugu

SEQ ID NO: 3714484 - RNA, 23 nt, Human
uaugucauuuccuucaaggcauc

SEQ ID NO: 3714485 - RNA, 23 nt, Human
uauguccacuguguauagaagua

SEQ ID NO: 3714486 - RNA, 15 nt, Human
uaugucccuugcugu

SEQ ID NO: 3714487 - RNA, 20 nt, Human
uauguccugugagaugugua

SEQ ID NO: 3714488 - RNA, 18 nt, Human
uaugucugcuccuuuccc

SEQ ID NO: 3714489 - RNA, 13 nt, Human
uaugucugguucu

SEQ ID NO: 3714490 - RNA, 10 nt, Human
uaugucuguu

SEQ ID NO: 3714491 - RNA, 18 nt, Human
uaugucuguuuaagaaaa

SEQ ID NO: 3714492 - RNA, 14 nt, Human
uaugucuuaaaacc

SEQ ID NO: 3714493 - RNA, 17 nt, Human
uaugucuuaaaaccugc

SEQ ID NO: 3714494 - RNA, 14 nt, Human
uaugucuuggacac

SEQ ID NO: 3714495 - RNA, 19 nt, Human
uaugucuuggacacuguac

SEQ ID NO: 3714496 - RNA, 12 nt, Human
uaugugaacagu

SEQ ID NO: 3714497 - RNA, 22 nt, Human
uaugugaacaguuguguuugaa

SEQ ID NO: 3714498 - RNA, 12 nt, Human
uaugugaaugau

SEQ ID NO: 3714499 - RNA, 12 nt, Human
uaugugaauuuu

SEQ ID NO: 3714500 - RNA, 18 nt, Human
uaugugacauuuuacauu

SEQ ID NO: 3714501 - RNA, 19 nt, Human
uaugugacauuuuacauua

SEQ ID NO: 3714502 - RNA, 21 nt, Human
uaugugacauuuuacauuaaa

SEQ ID NO: 3714503 - RNA, 13 nt, Human
uaugugagugugu

SEQ ID NO: 3714504 - RNA, 18 nt, Human
uaugugaucugucuugua

SEQ ID NO: 3714505 - RNA, 19 nt, Human
uaugugaucugucuuguaa

SEQ ID NO: 3714506 - RNA, 18 nt, Human
uaugugauuuuaacucug

SEQ ID NO: 3714507 - RNA, 22 nt, Human
uaugugauuuuuuuucccauuu

SEQ ID NO: 3714508 - RNA, 20 nt, Human
uaugugcacugucacuuugc

SEQ ID NO: 3714509 - RNA, 20 nt, Human
uauguggaguucaucuugaa

SEQ ID NO: 3714510 - RNA, 17 nt, Human
uaugugggcagauuuuc

SEQ ID NO: 3714511 - RNA, 19 nt, Human
uaugugguuuuagauuuuc

SEQ ID NO: 3714512 - RNA, 13 nt, Human
uauguguaggcag

SEQ ID NO: 3714513 - RNA, 17 nt, Human
uauguguauauauacau

SEQ ID NO: 3714514 - RNA, 22 nt, Human
uauguguauauauacauacacu

SEQ ID NO: 3714515 - RNA, 16 nt, Human
uaugugugaggagcug

SEQ ID NO: 3714516 - RNA, 13 nt, Human
uaugugugcaugu

SEQ ID NO: 3714517 - RNA, 20 nt, Human
uaugugugcauguguguaua

SEQ ID NO: 3714518 - RNA, 12 nt, Human
uauguguguaug

SEQ ID NO: 3714519 - RNA, 13 nt, Human
uauguguguguau

SEQ ID NO: 3714520 - RNA, 19 nt, Human
uauguguguguauguuugc

SEQ ID NO: 3714521 - RNA, 14 nt, Human
uauguguguguguu

SEQ ID NO: 3714522 - RNA, 14 nt, Human
uauguguguuuaaa

SEQ ID NO: 3714523 - RNA, 16 nt, Human
uauguguugaaaacca

SEQ ID NO: 3714524 - RNA, 18 nt, Human
uauguguugaaaaccaaa

SEQ ID NO: 3714525 - RNA, 23 nt, Human
uauguguugaaaaccaaaaugac

SEQ ID NO: 3714526 - RNA, 14 nt, Human
uauguguuggcuug

SEQ ID NO: 3714527 - RNA, 16 nt, Human
uauguguuuacuuuaa

SEQ ID NO: 3714528 - RNA, 17 nt, Human
uauguguuuuucacauu

SEQ ID NO: 3714529 - RNA, 21 nt, Human
uauguguuuuucucauauuug

SEQ ID NO: 3714530 - RNA, 12 nt, Human
uauguuaaaacu

SEQ ID NO: 3714531 - RNA, 21 nt, Human
uauguuaaacuagcauaucug

SEQ ID NO: 3714532 - RNA, 20 nt, Human
uauguuaaccucagugucau

SEQ ID NO: 3714533 - RNA, 22 nt, Human
uauguuaaccucagugucauuu

SEQ ID NO: 3714534 - RNA, 19 nt, Human
uauguuaagcucuuuauga

SEQ ID NO: 3714535 - RNA, 19 nt, Human
uauguuaagggaagaauuc

SEQ ID NO: 3714536 - RNA, 15 nt, Human
uauguuaaguuacuu

SEQ ID NO: 3714537 - RNA, 22 nt, Human
uauguuacaucuguuuuaaauu

SEQ ID NO: 3714538 - RNA, 16 nt, Human
uauguuacuauuuucu

SEQ ID NO: 3714539 - RNA, 20 nt, Human
uauguuauacaaccuucauu

SEQ ID NO: 3714540 - RNA, 21 nt, Human
uauguuauacaaccuucauuu

SEQ ID NO: 3714541 - RNA, 22 nt, Human
uauguuauagaacuucauggau

SEQ ID NO: 3714542 - RNA, 20 nt, Human
uauguuauauauaaauauau

SEQ ID NO: 3714543 - RNA, 14 nt, Human
uauguucacaccua

SEQ ID NO: 3714544 - RNA, 17 nt, Human
uauguucuaagaaguga

SEQ ID NO: 3714545 - RNA, 16 nt, Human
uauguugaaaaaauuu

SEQ ID NO: 3714546 - RNA, 12 nt, Human
uauguugaauac

SEQ ID NO: 3714547 - RNA, 15 nt, Human
uauguugacauuugu

SEQ ID NO: 3714548 - RNA, 16 nt, Human
uauguugacauuuguu

SEQ ID NO: 3714549 - RNA, 18 nt, Human
uauguugaccuaagauuu

SEQ ID NO: 3714550 - RNA, 18 nt, Human
uauguugauccauccagc

SEQ ID NO: 3714551 - RNA, 16 nt, Human
uauguugcauagaaua

SEQ ID NO: 3714552 - RNA, 13 nt, Human
uauguugcccagg

SEQ ID NO: 3714553 - RNA, 20 nt, Human
uauguugcccaggcaggucu

SEQ ID NO: 3714554 - RNA, 18 nt, Human
uauguugccuuuaugguu

SEQ ID NO: 3714555 - RNA, 20 nt, Human
uauguugccuuuaugguuuc

SEQ ID NO: 3714556 - RNA, 18 nt, Human
uauguugguagauucuaa

SEQ ID NO: 3714557 - RNA, 16 nt, Human
uauguuguccaauugu

SEQ ID NO: 3714558 - RNA, 15 nt, Human
uauguugugaagaug

SEQ ID NO: 3714559 - RNA, 18 nt, Human
uauguuguuuauaauaaa

SEQ ID NO: 3714560 - RNA, 16 nt, Human
uauguuguuuuguaca

SEQ ID NO: 3714561 - RNA, 22 nt, Human
uauguuuaaaguaauuguucca

SEQ ID NO: 3714562 - RNA, 13 nt, Human
uauguuuacacug

SEQ ID NO: 3714563 - RNA, 15 nt, Human
uauguuuacacuguc

SEQ ID NO: 3714564 - RNA, 16 nt, Human
uauguuuacacuguca

SEQ ID NO: 3714565 - RNA, 15 nt, Human
uauguuucaaacuuu

SEQ ID NO: 3714566 - RNA, 12 nt, Human
uauguuuccuug

SEQ ID NO: 3714567 - RNA, 23 nt, Human
uauguuucucuuugauuauuugc

SEQ ID NO: 3714568 - RNA, 14 nt, Human
uauguuugaauaug

SEQ ID NO: 3714569 - RNA, 17 nt, Human
uauguuugaauauggac

SEQ ID NO: 3714570 - RNA, 14 nt, Human
uauguuugcacacu

SEQ ID NO: 3714571 - RNA, 19 nt, Human
uauguuugcacacuugugu

SEQ ID NO: 3714572 - RNA, 23 nt, Human
uauguuugcucagaacacauucu

SEQ ID NO: 3714573 - RNA, 17 nt, Human
uauguuuuaagaggcag

SEQ ID NO: 3714574 - RNA, 19 nt, Human
uauguuuuaagaggcaggg

SEQ ID NO: 3714575 - RNA, 15 nt, Human
uauguuuuauauagc

SEQ ID NO: 3714576 - RNA, 14 nt, Human
uauguuuugguauc

SEQ ID NO: 3714577 - RNA, 18 nt, Human
uauguuuugguaucuguu

SEQ ID NO: 3714578 - RNA, 15 nt, Human
uauguuuuguuucug

SEQ ID NO: 3714579 - RNA, 13 nt, Human
uauguuuuuaaug

SEQ ID NO: 3714580 - RNA, 11 nt, Human
uauguuuuuca

SEQ ID NO: 3714581 - RNA, 16 nt, Human
uauguuuuucaguuca

SEQ ID NO: 3714582 - RNA, 13 nt, Human
uauguuuuucugu

SEQ ID NO: 3714583 - RNA, 22 nt, Human
uauguuuuucugugugucaguu

SEQ ID NO: 3714584 - RNA, 14 nt, Human
uauguuuuugugua

SEQ ID NO: 3714585 - RNA, 14 nt, Human
uauuaaaaaaaaca

SEQ ID NO: 3714586 - RNA, 15 nt, Human
uauuaaaaaacuuca

SEQ ID NO: 3714587 - RNA, 15 nt, Human
uauuaaaaaagucua

SEQ ID NO: 3714588 - RNA, 22 nt, Human
uauuaaaaauauggaacuucua

SEQ ID NO: 3714589 - RNA, 18 nt, Human
uauuaaaaaucucaaauu

SEQ ID NO: 3714590 - RNA, 23 nt, Human
uauuaaaaaucucaaauuucuaa

SEQ ID NO: 3714591 - RNA, 17 nt, Human
uauuaaaacauuggauu

SEQ ID NO: 3714592 - RNA, 19 nt, Human
uauuaaaacauuggauuau

SEQ ID NO: 3714593 - RNA, 12 nt, Human
uauuaaaacuaa

SEQ ID NO: 3714594 - RNA, 16 nt, Human
uauuaaaacucauuuu

SEQ ID NO: 3714595 - RNA, 16 nt, Human
uauuaaaauauuucag

SEQ ID NO: 3714596 - RNA, 22 nt, Human
uauuaaaaugauuguaaaauag

SEQ ID NO: 3714597 - RNA, 13 nt, Human
uauuaaaauguau

SEQ ID NO: 3714598 - RNA, 14 nt, Human
uauuaaaauuccaa

SEQ ID NO: 3714599 - RNA, 19 nt, Human
uauuaaaauucugaauuuu

SEQ ID NO: 3714600 - RNA, 16 nt, Human
uauuaaaauuguuguc

SEQ ID NO: 3714601 - RNA, 13 nt, Human
uauuaaacaaagu

SEQ ID NO: 3714602 - RNA, 19 nt, Human
uauuaaacaaaguuucaga

SEQ ID NO: 3714603 - RNA, 21 nt, Human
uauuaaacagauuuuuacaaa

SEQ ID NO: 3714604 - RNA, 15 nt, Human
uauuaaacaugcugu

SEQ ID NO: 3714605 - RNA, 20 nt, Human
uauuaaacguaugcauguga

SEQ ID NO: 3714606 - RNA, 22 nt, Human
uauuaaacguaugcaugugaag

SEQ ID NO: 3714607 - RNA, 13 nt, Human
uauuaaagaaaaa

SEQ ID NO: 3714608 - RNA, 22 nt, Human
uauuaaagaaaaaaauguauuu

SEQ ID NO: 3714609 - RNA, 20 nt, Human
uauuaaagccauguuuauua

SEQ ID NO: 3714610 - RNA, 22 nt, Human
uauuaaagugcuaagguucuaa

SEQ ID NO: 3714611 - RNA, 13 nt, Human
uauuaaaguuuca

SEQ ID NO: 3714612 - RNA, 16 nt, Human
uauuaaaguuucaaaa

SEQ ID NO: 3714613 - RNA, 14 nt, Human
uauuaaauaaaaug

SEQ ID NO: 3714614 - RNA, 23 nt, Human
uauuaaauaaaaugcacaaaacu

SEQ ID NO: 3714615 - RNA, 16 nt, Human
uauuaaauacaaaacu

SEQ ID NO: 3714616 - RNA, 19 nt, Human
uauuaaauacaaaacuucc

SEQ ID NO: 3714617 - RNA, 18 nt, Human
uauuaaauacagacacua

SEQ ID NO: 3714618 - RNA, 23 nt, Human
uauuaaauauaugauuagccagg

SEQ ID NO: 3714619 - RNA, 19 nt, Human
uauuaaaugcccagccccu

SEQ ID NO: 3714620 - RNA, 19 nt, Human
uauuaaauuaaauuuugug

SEQ ID NO: 3714621 - RNA, 20 nt, Human
uauuaaauuuuuuuguauga

SEQ ID NO: 3714622 - RNA, 22 nt, Human
uauuaaauuuuuuuguaugaaa

SEQ ID NO: 3714623 - RNA, 14 nt, Human
uauuaacaaaaguu

SEQ ID NO: 3714624 - RNA, 23 nt, Human
uauuaacaaacaucacucugcug

SEQ ID NO: 3714625 - RNA, 23 nt, Human
ucaauuaaaauagucucuuuaaa

SEQ ID NO: 3714626 - RNA, 14 nt, Human
ucaauuaaacggau

SEQ ID NO: 3714627 - RNA, 12 nt, Human
ucaauuaaaugu

SEQ ID NO: 3714628 - RNA, 13 nt, Human
ucaauuaacaaua

SEQ ID NO: 3714629 - RNA, 13 nt, Human
ucaauuacaggaa

SEQ ID NO: 3714630 - RNA, 21 nt, Human
ucaauuacaggaaguacugga

SEQ ID NO: 3714631 - RNA, 23 nt, Human
ucaauuacaggaaguacuggaga

SEQ ID NO: 3714632 - RNA, 17 nt, Human
ucaauuaccagaaagau

SEQ ID NO: 3714633 - RNA, 13 nt, Human
ucaauuacugguc

SEQ ID NO: 3714634 - RNA, 16 nt, Human
ucaauuacugguccaa

SEQ ID NO: 3714635 - RNA, 20 nt, Human
ucaauuaguaacauucaugu

SEQ ID NO: 3714636 - RNA, 14 nt, Human
ucaauuauaguuuc

SEQ ID NO: 3714637 - RNA, 15 nt, Human
ucaauuauaguuucu

SEQ ID NO: 3714638 - RNA, 18 nt, Human
ucaauuauaguuucugag

SEQ ID NO: 3714639 - RNA, 23 nt, Human
ucaauuccaacacugauuucccc

SEQ ID NO: 3714640 - RNA, 19 nt, Human
ucaauuccaacaguuuaau

SEQ ID NO: 3714641 - RNA, 15 nt, Human
ucaauugaaugguca

SEQ ID NO: 3714642 - RNA, 18 nt, Human
ucaauugcaucucccaga

SEQ ID NO: 3714643 - RNA, 13 nt, Human
ucaauuguaaauu

SEQ ID NO: 3714644 - RNA, 14 nt, Human
ucaauuguaaauug

SEQ ID NO: 3714645 - RNA, 20 nt, Human
ucaauuuauucaagaaaagu

SEQ ID NO: 3714646 - RNA, 20 nt, Human
ucaauuuauuugaaugauuu

SEQ ID NO: 3714647 - RNA, 20 nt, Human
ucaauuuccaagagcugagg

SEQ ID NO: 3714648 - RNA, 18 nt, Human
ucaauuucccugacuccu

SEQ ID NO: 3714649 - RNA, 15 nt, Human
ucaauuucuguguug

SEQ ID NO: 3714650 - RNA, 23 nt, Human
ucaauuucuguguugccaagcuc

SEQ ID NO: 3714651 - RNA, 18 nt, Human
ucaauuugucauuuugaa

SEQ ID NO: 3714652 - RNA, 17 nt, Human
ucaauuuuugucucaga

SEQ ID NO: 3714653 - RNA, 20 nt, Human
ucacaaaaauuugaacacug

SEQ ID NO: 3714654 - RNA, 21 nt, Human
ucacaaaaauuugaacacugg

SEQ ID NO: 3714655 - RNA, 16 nt, Human
ucacaaaacagccuuu

SEQ ID NO: 3714656 - RNA, 22 nt, Human
ucacaaaacagccuuugggaaa

SEQ ID NO: 3714657 - RNA, 15 nt, Human
ucacaaaauaucacc

SEQ ID NO: 3714658 - RNA, 14 nt, Human
ucacaaaauuuuau

SEQ ID NO: 3714659 - RNA, 15 nt, Human
ucacaaacuuuuaua

SEQ ID NO: 3714660 - RNA, 11 nt, Human
ucacaaaggau

SEQ ID NO: 3714661 - RNA, 14 nt, Human
ucacaaauauuaaa

SEQ ID NO: 3714662 - RNA, 15 nt, Human
ucacaaauauuaaaa

SEQ ID NO: 3714663 - RNA, 15 nt, Human
ucacaaaugacuuua

SEQ ID NO: 3714664 - RNA, 14 nt, Human
ucacaaauuucucu

SEQ ID NO: 3714665 - RNA, 19 nt, Human
ucacaaauuucucuguucc

SEQ ID NO: 3714666 - RNA, 21 nt, Human
ucacaacagauuauuaccuua

SEQ ID NO: 3714667 - RNA, 14 nt, Human
ucacaacagccuga

SEQ ID NO: 3714668 - RNA, 19 nt, Human
ucacaaccaccguuacaag

SEQ ID NO: 3714669 - RNA, 14 nt, Human
ucacaaccugaacc

SEQ ID NO: 3714670 - RNA, 19 nt, Human
ucacaaccugaaccuagga

SEQ ID NO: 3714671 - RNA, 14 nt, Human
ucacaaccuucugu

SEQ ID NO: 3714672 - RNA, 16 nt, Human
ucacaacgugcauugu

SEQ ID NO: 3714673 - RNA, 18 nt, Human
ucacaacgugcauugugc

SEQ ID NO: 3714674 - RNA, 19 nt, Human
ucacaacgugcauugugcu

SEQ ID NO: 3714675 - RNA, 21 nt, Human
ucacaacgugcauugugcuuc

SEQ ID NO: 3714676 - RNA, 12 nt, Human
ucacaagaacac

SEQ ID NO: 3714677 - RNA, 22 nt, Human
ucacaagacccaaaaggcagaa

SEQ ID NO: 3714678 - RNA, 13 nt, Human
ucacaagcugccu

SEQ ID NO: 3714679 - RNA, 23 nt, Human
ucacaagcugccucccuguccac

SEQ ID NO: 3714680 - RNA, 18 nt, Human
ucacaaggcagcaaggcc

SEQ ID NO: 3714681 - RNA, 18 nt, Human
ucacaagggacgcuuugg

SEQ ID NO: 3714682 - RNA, 22 nt, Human
ucacaagggcaaacuuuuuccu

SEQ ID NO: 3714683 - RNA, 20 nt, Human
ucacaauaaaaauggcucag

SEQ ID NO: 3714684 - RNA, 18 nt, Human
ucacaauaaauguauuca

SEQ ID NO: 3714685 - RNA, 14 nt, Human
ucacaauacagaua

SEQ ID NO: 3714686 - RNA, 15 nt, Human
ucacaauacagauaa

SEQ ID NO: 3714687 - RNA, 21 nt, Human
ucacaauggugcucauuucau

SEQ ID NO: 3714688 - RNA, 14 nt, Human
ucacaauguucuuu

SEQ ID NO: 3714689 - RNA, 16 nt, Human
ucacaauguucuuuau

SEQ ID NO: 3714690 - RNA, 17 nt, Human
ucacaauguucuuuaua

SEQ ID NO: 3714691 - RNA, 13 nt, Human
ucacaauuuuuaa

SEQ ID NO: 3714692 - RNA, 10 nt, Human
ucacacacac

SEQ ID NO: 3714693 - RNA, 19 nt, Human
ucacacacagacuguuguc

SEQ ID NO: 3714694 - RNA, 14 nt, Human
ucacacacauagau

SEQ ID NO: 3714695 - RNA, 16 nt, Human
ucacacacccugaggu

SEQ ID NO: 3714696 - RNA, 15 nt, Human
ucacacacuuuggcu

SEQ ID NO: 3714697 - RNA, 18 nt, Human
ucacacagccaggugccu

SEQ ID NO: 3714698 - RNA, 22 nt, Human
ucacacagccaggugccuugga

SEQ ID NO: 3714699 - RNA, 19 nt, Human
ucacacaggcauuuccugg

SEQ ID NO: 3714700 - RNA, 22 nt, Human
ucacacaugagcaucaggccag

SEQ ID NO: 3714701 - RNA, 20 nt, Human
ucacaccacuagccucaggg

SEQ ID NO: 3714702 - RNA, 22 nt, Human
ucacaccaggcuugccugcagg

SEQ ID NO: 3714703 - RNA, 22 nt, Human
ucacacccaacuugguuuugcu

SEQ ID NO: 3714704 - RNA, 11 nt, Human
ucacacccacc

SEQ ID NO: 3714705 - RNA, 20 nt, Human
ucacacccaccguccgcccu

SEQ ID NO: 3714706 - RNA, 21 nt, Human
ucacacccaccguccgcccug

SEQ ID NO: 3714707 - RNA, 16 nt, Human
ucacaccccaccugcg

SEQ ID NO: 3714708 - RNA, 12 nt, Human
ucacacccugca

SEQ ID NO: 3714709 - RNA, 13 nt, Human
ucacacccugcaa

SEQ ID NO: 3714710 - RNA, 15 nt, Human
ucacacccugcaagg

SEQ ID NO: 3714711 - RNA, 17 nt, Human
ucacacccugcaaggcc

SEQ ID NO: 3714712 - RNA, 21 nt, Human
ucacacccugcaaggcccaca

SEQ ID NO: 3714713 - RNA, 19 nt, Human
ucacaccugacucugaaau

SEQ ID NO: 3714714 - RNA, 13 nt, Human
ucacaccugcaga

SEQ ID NO: 3714715 - RNA, 19 nt, Human
ucacaccuguaaucccaac

SEQ ID NO: 3714716 - RNA, 17 nt, Human
ucacacgggggcagcug

SEQ ID NO: 3714717 - RNA, 18 nt, Human
ucacacgggggcagcuga

SEQ ID NO: 3714718 - RNA, 22 nt, Human
ucacacgucuggcuucacagau

SEQ ID NO: 3714719 - RNA, 16 nt, Human
ucacacucuaacugua

SEQ ID NO: 3714720 - RNA, 21 nt, Human
ucacacucuaacuguauauuu

SEQ ID NO: 3714721 - RNA, 17 nt, Human
ucacacucucacauguu

SEQ ID NO: 3714722 - RNA, 19 nt, Human
ucacacugagaauguaaga

SEQ ID NO: 3714723 - RNA, 21 nt, Human
ucacacugagaauguaagaac

SEQ ID NO: 3714724 - RNA, 20 nt, Human
ucacacugcaagagccuugg

SEQ ID NO: 3714725 - RNA, 16 nt, Human
ucacacuggguggugg

SEQ ID NO: 3714726 - RNA, 20 nt, Human
ucacacugguucucaaugaa

SEQ ID NO: 3714727 - RNA, 16 nt, Human
ucacacugucuucuga

SEQ ID NO: 3714728 - RNA, 18 nt, Human
ucacacuuccaccagccu

SEQ ID NO: 3714729 - RNA, 16 nt, Human
ucacacuucugugaga

SEQ ID NO: 3714730 - RNA, 23 nt, Human
ucacagaaaugagaucaggcucu

SEQ ID NO: 3714731 - RNA, 12 nt, Human
ucacagaagaau

SEQ ID NO: 3714732 - RNA, 15 nt, Human
ucacagacaggaccc

SEQ ID NO: 3714733 - RNA, 14 nt, Human
ucacagaccuggag

SEQ ID NO: 3714734 - RNA, 19 nt, Human
ucacagaccuggagccccu

SEQ ID NO: 3714735 - RNA, 22 nt, Human
ucacagaccuggagccccuggg

SEQ ID NO: 3714736 - RNA, 16 nt, Human
ucacagacuggagaca

SEQ ID NO: 3714737 - RNA, 15 nt, Human
ucacagagacacagg

SEQ ID NO: 3714738 - RNA, 23 nt, Human
ucacagagacauuccuccgagcc

SEQ ID NO: 3714739 - RNA, 12 nt, Human
ucacagaggcuu

SEQ ID NO: 3714740 - RNA, 17 nt, Human
ucacagaggcuucuuca

SEQ ID NO: 3714741 - RNA, 12 nt, Human
ucacagagucaa

SEQ ID NO: 3714742 - RNA, 16 nt, Human
ucacagagucaaggcc

SEQ ID NO: 3714743 - RNA, 18 nt, Human
ucacagagucaaggccug

SEQ ID NO: 3714744 - RNA, 14 nt, Human
ucacagagugugcu

SEQ ID NO: 3714745 - RNA, 19 nt, Human
ucacagagugugcuggagg

SEQ ID NO: 3714746 - RNA, 22 nt, Human
ucacagaugaguuaucuaagaa

SEQ ID NO: 3714747 - RNA, 23 nt, Human
ucacagcaagucacuggccagug

SEQ ID NO: 3714748 - RNA, 13 nt, Human
ucacagcagccuc

SEQ ID NO: 3714749 - RNA, 16 nt, Human
ucacagccaccccuga

SEQ ID NO: 3714750 - RNA, 15 nt, Human
ucacagcccagcccg

SEQ ID NO: 3714751 - RNA, 13 nt, Human
ucacagccuccuc

SEQ ID NO: 3714752 - RNA, 17 nt, Human
ucacagccuccucuguc

SEQ ID NO: 3714753 - RNA, 19 nt, Human
ucacagccuccucugucug

SEQ ID NO: 3714754 - RNA, 20 nt, Human
ucacagccuccucugucugc

SEQ ID NO: 3714755 - RNA, 11 nt, Human
ucacagccucu

SEQ ID NO: 3714756 - RNA, 13 nt, Human
ucacagccucuga

SEQ ID NO: 3714757 - RNA, 17 nt, Human
ucacagccucugacccc

SEQ ID NO: 3714758 - RNA, 18 nt, Human
ucacagccucugaccccu

SEQ ID NO: 3714759 - RNA, 19 nt, Human
ucacagccucugaccccuc

SEQ ID NO: 3714760 - RNA, 11 nt, Human
ucacagcugcu

SEQ ID NO: 3714761 - RNA, 13 nt, Human
ucacagcugcuuu

SEQ ID NO: 3714762 - RNA, 15 nt, Human
ucacagcuucagcca

SEQ ID NO: 3714763 - RNA, 16 nt, Human
ucacagcuucagccag

SEQ ID NO: 3714764 - RNA, 17 nt, Human
ucacagcuucagccagg

SEQ ID NO: 3714765 - RNA, 19 nt, Human
ucacagcuucagccaggag

SEQ ID NO: 3714766 - RNA, 17 nt, Human
ucacagcuuguuuugga

SEQ ID NO: 3714767 - RNA, 14 nt, Human
ucacaggaaguaga

SEQ ID NO: 3714768 - RNA, 19 nt, Human
ucacaggaaguagaggagg

SEQ ID NO: 3714769 - RNA, 18 nt, Human
ucacaggacucugccucc

SEQ ID NO: 3714770 - RNA, 22 nt, Human
ucacaggagggagggggaaggc

SEQ ID NO: 3714771 - RNA, 19 nt, Human
ucacaggcagccagugccc

SEQ ID NO: 3714772 - RNA, 22 nt, Human
ucacaggcagccagugcccuga

SEQ ID NO: 3714773 - RNA, 11 nt, Human
ucacaggcagg

SEQ ID NO: 3714774 - RNA, 12 nt, Human
ucacaggcaggu

SEQ ID NO: 3714775 - RNA, 17 nt, Human
gccucuuguaaagacug

SEQ ID NO: 3714776 - RNA, 12 nt, Human
gccucuugucuu

SEQ ID NO: 3714777 - RNA, 16 nt, Human
gccucuuucccuagga

SEQ ID NO: 3714778 - RNA, 14 nt, Human
gccucuuucccuuc

SEQ ID NO: 3714779 - RNA, 17 nt, Human
gccucuuucugucccuu

SEQ ID NO: 3714780 - RNA, 17 nt, Human
gccucuuuuaccugcug

SEQ ID NO: 3714781 - RNA, 22 nt, Human
gccucuuuuaccugcugcuucu

SEQ ID NO: 3714782 - RNA, 16 nt, Human
gccugaaagaggcuga

SEQ ID NO: 3714783 - RNA, 23 nt, Human
gccugaaagaggcugaggccugg

SEQ ID NO: 3714784 - RNA, 17 nt, Human
gccugaaaggagcccuu

SEQ ID NO: 3714785 - RNA, 23 nt, Human
gccugaaaggagcccuuaucugu

SEQ ID NO: 3714786 - RNA, 19 nt, Human
gccugaaauccugguuccu

SEQ ID NO: 3714787 - RNA, 18 nt, Human
gccugaaauuucaccauu

SEQ ID NO: 3714788 - RNA, 20 nt, Human
gccugaacagaagcucuuac

SEQ ID NO: 3714789 - RNA, 15 nt, Human
gccugaacauccuuc

SEQ ID NO: 3714790 - RNA, 18 nt, Human
gccugaagaguccucuga

SEQ ID NO: 3714791 - RNA, 15 nt, Human
gccugaagccagcug

SEQ ID NO: 3714792 - RNA, 17 nt, Human
gccugaagucacacagu

SEQ ID NO: 3714793 - RNA, 18 nt, Human
gccugaagucacacagug

SEQ ID NO: 3714794 - RNA, 14 nt, Human
gccugaccuccccc

SEQ ID NO: 3714795 - RNA, 14 nt, Human
gccugacugccaag

SEQ ID NO: 3714796 - RNA, 15 nt, Human
gccugacugccaagc

SEQ ID NO: 3714797 - RNA, 16 nt, Human
gccugacugccaagcc

SEQ ID NO: 3714798 - RNA, 13 nt, Human
gccugacuugggg

SEQ ID NO: 3714799 - RNA, 15 nt, Human
gccugagacccagga

SEQ ID NO: 3714800 - RNA, 19 nt, Human
gccugagagaauuggcuca

SEQ ID NO: 3714801 - RNA, 19 nt, Human
gccugagagacauggcuuu

SEQ ID NO: 3714802 - RNA, 21 nt, Human
gccugagaguauuuaggcaga

SEQ ID NO: 3714803 - RNA, 13 nt, Human
gccugagaugguc

SEQ ID NO: 3714804 - RNA, 22 nt, Human
gccugagauuucaucugcucuc

SEQ ID NO: 3714805 - RNA, 23 nt, Human
gccugagauuucaucugcucucc

SEQ ID NO: 3714806 - RNA, 20 nt, Human
gccugagcaccucccagccc

SEQ ID NO: 3714807 - RNA, 16 nt, Human
gccugagcccagggag

SEQ ID NO: 3714808 - RNA, 20 nt, Human
gccugagcgacagugagacu

SEQ ID NO: 3714809 - RNA, 16 nt, Human
gccugaggagcagcag

SEQ ID NO: 3714810 - RNA, 14 nt, Human
gccugaggaugagc

SEQ ID NO: 3714811 - RNA, 15 nt, Human
gccugaggcugagac

SEQ ID NO: 3714812 - RNA, 17 nt, Human
gccugaggcugagacug

SEQ ID NO: 3714813 - RNA, 18 nt, Human
gccugaggcugagacugc

SEQ ID NO: 3714814 - RNA, 13 nt, Human
gccugaggcuggg

SEQ ID NO: 3714815 - RNA, 18 nt, Human
gccugagggaaaggccag

SEQ ID NO: 3714816 - RNA, 16 nt, Human
gccugagggccccucu

SEQ ID NO: 3714817 - RNA, 17 nt, Human
gccugagggccccucug

SEQ ID NO: 3714818 - RNA, 19 nt, Human
gccugagggccccucugcc

SEQ ID NO: 3714819 - RNA, 21 nt, Human
gccugagggccccucugccca

SEQ ID NO: 3714820 - RNA, 23 nt, Human
gccugagggcgaggggagggugg

SEQ ID NO: 3714821 - RNA, 19 nt, Human
gccugaggggcagccugcc

SEQ ID NO: 3714822 - RNA, 17 nt, Human
gccugaggguggagacu

SEQ ID NO: 3714823 - RNA, 21 nt, Human
gccugaggucucgcugaugcu

SEQ ID NO: 3714824 - RNA, 18 nt, Human
gccugaggucuggcugcu

SEQ ID NO: 3714825 - RNA, 19 nt, Human
gccugaggucuggcugcuu

SEQ ID NO: 3714826 - RNA, 20 nt, Human
gccugaggucuggcugcuug

SEQ ID NO: 3714827 - RNA, 18 nt, Human
gccugaggucuguacguu

SEQ ID NO: 3714828 - RNA, 13 nt, Human
gccugaguacucc

SEQ ID NO: 3714829 - RNA, 18 nt, Human
gccugagucagggcccag

SEQ ID NO: 3714830 - RNA, 22 nt, Human
gccugagucagggcccagaggc

SEQ ID NO: 3714831 - RNA, 23 nt, Human
gccugaguccacgaccuaggcag

SEQ ID NO: 3714832 - RNA, 22 nt, Human
gccugagucgugaccugcuagg

SEQ ID NO: 3714833 - RNA, 15 nt, Human
gccugagucuccugu

SEQ ID NO: 3714834 - RNA, 16 nt, Human
gccugagucuccugug

SEQ ID NO: 3714835 - RNA, 20 nt, Human
gccugauaagcuucaaagcu

SEQ ID NO: 3714836 - RNA, 18 nt, Human
gccugauccagccucucc

SEQ ID NO: 3714837 - RNA, 22 nt, Human
gccugauccagccucuccccug

SEQ ID NO: 3714838 - RNA, 14 nt, Human
gccugaucucuucc

SEQ ID NO: 3714839 - RNA, 15 nt, Human
gccugaucugcccau

SEQ ID NO: 3714840 - RNA, 20 nt, Human
gccugaugacaauaaagcuu

SEQ ID NO: 3714841 - RNA, 12 nt, Human
gccugaugacag

SEQ ID NO: 3714842 - RNA, 16 nt, Human
gccugaugcucccucc

SEQ ID NO: 3714843 - RNA, 20 nt, Human
gccugaugcucccuccccug

SEQ ID NO: 3714844 - RNA, 17 nt, Human
gccugauggggaggguc

SEQ ID NO: 3714845 - RNA, 13 nt, Human
gccugauuaaaga

SEQ ID NO: 3714846 - RNA, 17 nt, Human
gccugauucggcugucu

SEQ ID NO: 3714847 - RNA, 19 nt, Human
gccugauugccaagcucag

SEQ ID NO: 3714848 - RNA, 21 nt, Human
gccugauugccaagcucagga

SEQ ID NO: 3714849 - RNA, 17 nt, Human
gccugcaaacgcugccu

SEQ ID NO: 3714850 - RNA, 18 nt, Human
gccugcaaacgcugccug

SEQ ID NO: 3714851 - RNA, 20 nt, Human
gccugcaaacgcugccugcc

SEQ ID NO: 3714852 - RNA, 21 nt, Human
gccugcaaacgcugccugccc

SEQ ID NO: 3714853 - RNA, 17 nt, Human
gccugcaaacugggaac

SEQ ID NO: 3714854 - RNA, 12 nt, Human
gccugcaccagg

SEQ ID NO: 3714855 - RNA, 13 nt, Human
gccugcaccagga

SEQ ID NO: 3714856 - RNA, 16 nt, Human
gccugcaccaggagac

SEQ ID NO: 3714857 - RNA, 23 nt, Human
gccugcacggugaauggcuuugu

SEQ ID NO: 3714858 - RNA, 21 nt, Human
gccugcacggugggccuugcu

SEQ ID NO: 3714859 - RNA, 22 nt, Human
gccugcacggugggccuugcug

SEQ ID NO: 3714860 - RNA, 16 nt, Human
gccugcagaauuuggg

SEQ ID NO: 3714861 - RNA, 12 nt, Human
gccugcagagag

SEQ ID NO: 3714862 - RNA, 17 nt, Human
gccugcagagagaagcc

SEQ ID NO: 3714863 - RNA, 18 nt, Human
gccugcagagagaagccu

SEQ ID NO: 3714864 - RNA, 21 nt, Human
gccugcagaggucugugcuga

SEQ ID NO: 3714865 - RNA, 23 nt, Human
gccugcaggaccucgugccaccc

SEQ ID NO: 3714866 - RNA, 17 nt, Human
gccugcaggaccugccu

SEQ ID NO: 3714867 - RNA, 20 nt, Human
gccugcagggaagccccaca

SEQ ID NO: 3714868 - RNA, 13 nt, Human
gccugcagggcca

SEQ ID NO: 3714869 - RNA, 19 nt, Human
gccugcaggguggugcugg

SEQ ID NO: 3714870 - RNA, 14 nt, Human
gccugcaggugcug

SEQ ID NO: 3714871 - RNA, 19 nt, Human
gccugcaggugcugcugcg

SEQ ID NO: 3714872 - RNA, 22 nt, Human
gccugcauaggaguuuggagga

SEQ ID NO: 3714873 - RNA, 23 nt, Human
gccugcaucccaggaugcugggu

SEQ ID NO: 3714874 - RNA, 13 nt, Human
gccugcauucugc

SEQ ID NO: 3714875 - RNA, 21 nt, Human
gccugcauugagcuugcaugc

SEQ ID NO: 3714876 - RNA, 15 nt, Human
gccugccagcugcac

SEQ ID NO: 3714877 - RNA, 11 nt, Human
gccugccagga

SEQ ID NO: 3714878 - RNA, 12 nt, Human
gccugccaggag

SEQ ID NO: 3714879 - RNA, 14 nt, Human
gccugccaggagga

SEQ ID NO: 3714880 - RNA, 20 nt, Human
gccugccaggaggacccagg

SEQ ID NO: 3714881 - RNA, 21 nt, Human
gccugccaggaggacccaggg

SEQ ID NO: 3714882 - RNA, 19 nt, Human
gccugccaguccuagcugc

SEQ ID NO: 3714883 - RNA, 14 nt, Human
gccugccauguacc

SEQ ID NO: 3714884 - RNA, 10 nt, Human
gccugcccac

SEQ ID NO: 3714885 - RNA, 19 nt, Human
gccugcccaccugccuggc

SEQ ID NO: 3714886 - RNA, 16 nt, Human
gccugcccagacaaga

SEQ ID NO: 3714887 - RNA, 13 nt, Human
gccugcccaggcc

SEQ ID NO: 3714888 - RNA, 19 nt, Human
gccugcccaggccccugcc

SEQ ID NO: 3714889 - RNA, 22 nt, Human
gccugcccauucugcccugugg

SEQ ID NO: 3714890 - RNA, 23 nt, Human
gccugccccaaacaaauaugcaa

SEQ ID NO: 3714891 - RNA, 12 nt, Human
gccugcccccac

SEQ ID NO: 3714892 - RNA, 19 nt, Human
gccugcccccaccccauuc

SEQ ID NO: 3714893 - RNA, 20 nt, Human
gccugccccgcccccagucc

SEQ ID NO: 3714894 - RNA, 22 nt, Human
gccugccccuacccuggacuug

SEQ ID NO: 3714895 - RNA, 14 nt, Human
gccugccccuccca

SEQ ID NO: 3714896 - RNA, 15 nt, Human
gccugccccucccag

SEQ ID NO: 3714897 - RNA, 16 nt, Human
gccugccccucccaga

SEQ ID NO: 3714898 - RNA, 14 nt, Human
gccugcccgcacag

SEQ ID NO: 3714899 - RNA, 19 nt, Human
gccugcccgcacagcagcc

SEQ ID NO: 3714900 - RNA, 21 nt, Human
gccugcccgcacagcagccug

SEQ ID NO: 3714901 - RNA, 16 nt, Human
gccugcccguaaacac

SEQ ID NO: 3714902 - RNA, 20 nt, Human
gccugcccgucucucuccca

SEQ ID NO: 3714903 - RNA, 14 nt, Human
gccugcccucaggg

SEQ ID NO: 3714904 - RNA, 22 nt, Human
gccugcccucauggccccucug

SEQ ID NO: 3714905 - RNA, 15 nt, Human
gccugcccuccccag

SEQ ID NO: 3714906 - RNA, 18 nt, Human
gccugcccuccccagagc

SEQ ID NO: 3714907 - RNA, 21 nt, Human
gccugcccuccccagagcacu

SEQ ID NO: 3714908 - RNA, 19 nt, Human
gccuguucccauucuugca

SEQ ID NO: 3714909 - RNA, 23 nt, Human
gccuguucccauucuugcauggc

SEQ ID NO: 3714910 - RNA, 16 nt, Human
gccuguugggccagga

SEQ ID NO: 3714911 - RNA, 18 nt, Human
gccuguugggccaggagc

SEQ ID NO: 3714912 - RNA, 14 nt, Human
gccuuaaaaccaaa

SEQ ID NO: 3714913 - RNA, 13 nt, Human
gccuuaaaacuuu

SEQ ID NO: 3714914 - RNA, 13 nt, Human
gccuuaaaaugga

SEQ ID NO: 3714915 - RNA, 19 nt, Human
gccuuaaaauggaauugaa

SEQ ID NO: 3714916 - RNA, 22 nt, Human
gccuuaaaauggaauugaaaaa

SEQ ID NO: 3714917 - RNA, 20 nt, Human
gccuuaaacacucaccuucu

SEQ ID NO: 3714918 - RNA, 22 nt, Human
gccuuaaagacaagacagcauu

SEQ ID NO: 3714919 - RNA, 14 nt, Human
gccuuaagcugauc

SEQ ID NO: 3714920 - RNA, 19 nt, Human
gccuuaauaaaaaaugaaa

SEQ ID NO: 3714921 - RNA, 19 nt, Human
gccuuaauuuccuuuuuga

SEQ ID NO: 3714922 - RNA, 23 nt, Human
gccuuaauuuccuuuuugacacu

SEQ ID NO: 3714923 - RNA, 16 nt, Human
gccuuacacaaugguu

SEQ ID NO: 3714924 - RNA, 19 nt, Human
gccuuaccuccugcccagg

SEQ ID NO: 3714925 - RNA, 21 nt, Human
gccuuaccuccugcccaggag

SEQ ID NO: 3714926 - RNA, 13 nt, Human
gccuuacuuugua

SEQ ID NO: 3714927 - RNA, 16 nt, Human
gccuuacuuuguauga

SEQ ID NO: 3714928 - RNA, 19 nt, Human
gccuuacuuuguaugauau

SEQ ID NO: 3714929 - RNA, 22 nt, Human
gccuuagaaauguaaacugcca

SEQ ID NO: 3714930 - RNA, 17 nt, Human
gccuuagaaccuuucuu

SEQ ID NO: 3714931 - RNA, 20 nt, Human
gccuuagaagucacacagua

SEQ ID NO: 3714932 - RNA, 13 nt, Human
gccuuagagccag

SEQ ID NO: 3714933 - RNA, 15 nt, Human
gccuuagagccaggc

SEQ ID NO: 3714934 - RNA, 23 nt, Human
gccuuagagccaggcacacacug

SEQ ID NO: 3714935 - RNA, 13 nt, Human
gccuuagaggagc

SEQ ID NO: 3714936 - RNA, 17 nt, Human
gccuuagcauguuugcu

SEQ ID NO: 3714937 - RNA, 15 nt, Human
gccuuagcuucagga

SEQ ID NO: 3714938 - RNA, 16 nt, Human
gccuuagcuucaggaa

SEQ ID NO: 3714939 - RNA, 17 nt, Human
gccuuagcuucaggaac

SEQ ID NO: 3714940 - RNA, 18 nt, Human
gccuuagcuucaggaacc

SEQ ID NO: 3714941 - RNA, 19 nt, Human
gccuuagcuucaggaaccu

SEQ ID NO: 3714942 - RNA, 14 nt, Human
gccuuagugggcca

SEQ ID NO: 3714943 - RNA, 17 nt, Human
gccuuagugggccaggg

SEQ ID NO: 3714944 - RNA, 13 nt, Human
gccuuaucaagug

SEQ ID NO: 3714945 - RNA, 14 nt, Human
gccuuaucaagugu

SEQ ID NO: 3714946 - RNA, 17 nt, Human
gccuuaucaagugucuu

SEQ ID NO: 3714947 - RNA, 20 nt, Human
gccuuaucaagugucuucca

SEQ ID NO: 3714948 - RNA, 16 nt, Human
gccuuauccucugauc

SEQ ID NO: 3714949 - RNA, 17 nt, Human
gccuuauccucugaucu

SEQ ID NO: 3714950 - RNA, 22 nt, Human
gccuuaucuugcaccccaaagc

SEQ ID NO: 3714951 - RNA, 18 nt, Human
gccuuauggaacacucug

SEQ ID NO: 3714952 - RNA, 19 nt, Human
gccuucaaaacuauagcuu

SEQ ID NO: 3714953 - RNA, 22 nt, Human
gccuucaaaacuauagcuugca

SEQ ID NO: 3714954 - RNA, 20 nt, Human
gccuucaagaaaacaggcac

SEQ ID NO: 3714955 - RNA, 22 nt, Human
gccuucaagaaaacaggcacug

SEQ ID NO: 3714956 - RNA, 22 nt, Human
gccuucaagcucugagggaaag

SEQ ID NO: 3714957 - RNA, 22 nt, Human
gccuucacaaucugucaguucu

SEQ ID NO: 3714958 - RNA, 17 nt, Human
gccuucagaaccaucca

SEQ ID NO: 3714959 - RNA, 21 nt, Human
gccuucagggagugagggauu

SEQ ID NO: 3714960 - RNA, 18 nt, Human
gccuucauaucauccaca

SEQ ID NO: 3714961 - RNA, 13 nt, Human
gccuucaucuccc

SEQ ID NO: 3714962 - RNA, 13 nt, Human
gccuucauuaccu

SEQ ID NO: 3714963 - RNA, 21 nt, Human
gccuuccagauccucucuggg

SEQ ID NO: 3714964 - RNA, 15 nt, Human
gccuuccagcugcug

SEQ ID NO: 3714965 - RNA, 14 nt, Human
uauuuaaggagaug

SEQ ID NO: 3714966 - RNA, 11 nt, Human
uauuuaauaac

SEQ ID NO: 3714967 - RNA, 17 nt, Human
uauuuaauaacaauugu

SEQ ID NO: 3714968 - RNA, 13 nt, Human
uauuuaauaacau

SEQ ID NO: 3714969 - RNA, 14 nt, Human
uauuuaauauuuaa

SEQ ID NO: 3714970 - RNA, 15 nt, Human
uauuuaaucuuuuau

SEQ ID NO: 3714971 - RNA, 21 nt, Human
uauuuaaugaaagacuguaca

SEQ ID NO: 3714972 - RNA, 19 nt, Human
uauuuaaugauaaguaaau

SEQ ID NO: 3714973 - RNA, 21 nt, Human
uauuuaaugccgauauacucu

SEQ ID NO: 3714974 - RNA, 20 nt, Human
uauuuaauggaaguguauuu

SEQ ID NO: 3714975 - RNA, 20 nt, Human
uauuuaauguugaacaaaau

SEQ ID NO: 3714976 - RNA, 13 nt, Human
uauuuaauguuuu

SEQ ID NO: 3714977 - RNA, 14 nt, Human
uauuuaauuauuaa

SEQ ID NO: 3714978 - RNA, 18 nt, Human
uauuuaauuguaaacugu

SEQ ID NO: 3714979 - RNA, 16 nt, Human
uauuuaauuugaaggu

SEQ ID NO: 3714980 - RNA, 23 nt, Human
uauuuaauuuuuuugagacagag

SEQ ID NO: 3714981 - RNA, 21 nt, Human
uauuuacaaauguuuugcuca

SEQ ID NO: 3714982 - RNA, 14 nt, Human
uauuuacaauguau

SEQ ID NO: 3714983 - RNA, 20 nt, Human
uauuuacagugaaaauguaa

SEQ ID NO: 3714984 - RNA, 14 nt, Human
uauuuaccaaaaau

SEQ ID NO: 3714985 - RNA, 18 nt, Human
uauuuacuaaaauggacu

SEQ ID NO: 3714986 - RNA, 19 nt, Human
uauuuacugagcuucucug

SEQ ID NO: 3714987 - RNA, 22 nt, Human
uauuuacugagcuucucuguga

SEQ ID NO: 3714988 - RNA, 15 nt, Human
uauuuagacaagaga

SEQ ID NO: 3714989 - RNA, 19 nt, Human
uauuuagacaagagauggg

SEQ ID NO: 3714990 - RNA, 17 nt, Human
uauuuagauuguuaaaa

SEQ ID NO: 3714991 - RNA, 22 nt, Human
uauuuagcuccaaaccuucaca

SEQ ID NO: 3714992 - RNA, 17 nt, Human
uauuuaguuauaguuuc

SEQ ID NO: 3714993 - RNA, 24 nt, Human
uauuuauaaaaauaaaaaacacug

SEQ ID NO: 3714994 - RNA, 15 nt, Human
uauuuauaaaacuuc

SEQ ID NO: 3714995 - RNA, 17 nt, Human
uauuuauaaaacuucuc

SEQ ID NO: 3714996 - RNA, 16 nt, Human
uauuuauaaauauauu

SEQ ID NO: 3714997 - RNA, 17 nt, Human
uauuuauaaauauauuu

SEQ ID NO: 3714998 - RNA, 19 nt, Human
uauuuauaacaaccuaaau

SEQ ID NO: 3714999 - RNA, 13 nt, Human
uauuuauaacuca

SEQ ID NO: 3715000 - RNA, 20 nt, Human
uauuuauaacucaucauaaa

SEQ ID NO: 3715001 - RNA, 23 nt, Human
uauuuauaacucaucauaaaaua

SEQ ID NO: 3715002 - RNA, 16 nt, Human
uauuuauaauacagaa

SEQ ID NO: 3715003 - RNA, 20 nt, Human
uauuuauaauacagaaucuu

SEQ ID NO: 3715004 - RNA, 15 nt, Human
uauuuauaauuccua

SEQ ID NO: 3715005 - RNA, 13 nt, Human
uauuuauauaauu

SEQ ID NO: 3715006 - RNA, 17 nt, Human
uauuuauauaauuaugu

SEQ ID NO: 3715007 - RNA, 18 nt, Human
uauuuauauaauuauguu

SEQ ID NO: 3715008 - RNA, 17 nt, Human
uauuuauauauuuauaa

SEQ ID NO: 3715009 - RNA, 15 nt, Human
uauuuauauguacau

SEQ ID NO: 3715010 - RNA, 21 nt, Human
uauuuauauguauguguuuag

SEQ ID NO: 3715011 - RNA, 22 nt, Human
uauuuauauguauguguuuaga

SEQ ID NO: 3715012 - RNA, 16 nt, Human
uauuuauauuuauuga

SEQ ID NO: 3715013 - RNA, 14 nt, Human
uauuuauauuucac

SEQ ID NO: 3715014 - RNA, 20 nt, Human
uauuuauccagaaaacugug

SEQ ID NO: 3715015 - RNA, 21 nt, Human
uauuuauccagaaaacuguga

SEQ ID NO: 3715016 - RNA, 19 nt, Human
uauuuaucuauuguaagau

SEQ ID NO: 3715017 - RNA, 16 nt, Human
uauuuaucugauuaag

SEQ ID NO: 3715018 - RNA, 16 nt, Human
uauuuaucuguucaaa

SEQ ID NO: 3715019 - RNA, 22 nt, Human
uauuuaugaaguuuaaaacagu

SEQ ID NO: 3715020 - RNA, 20 nt, Human
uauuuaugccucuguauuua

SEQ ID NO: 3715021 - RNA, 19 nt, Human
uauuuaugccuugaugauu

SEQ ID NO: 3715022 - RNA, 22 nt, Human
uauuuaugggccccuggcacuc

SEQ ID NO: 3715023 - RNA, 18 nt, Human
uauuuauguaaugaagua

SEQ ID NO: 3715024 - RNA, 11 nt, Human
uauuuauuaaa

SEQ ID NO: 3715025 - RNA, 13 nt, Human
uauuuauuaaaua

SEQ ID NO: 3715026 - RNA, 17 nt, Human
uauuuauuaauauuuaa

SEQ ID NO: 3715027 - RNA, 15 nt, Human
uauuuauuaccucug

SEQ ID NO: 3715028 - RNA, 16 nt, Human
uauuuauuaccucuga

SEQ ID NO: 3715029 - RNA, 14 nt, Human
uauuuauuacuaug

SEQ ID NO: 3715030 - RNA, 20 nt, Human
uauuuauucaauaaaguauu

SEQ ID NO: 3715031 - RNA, 12 nt, Human
uauuuauugaaa

SEQ ID NO: 3715032 - RNA, 16 nt, Human
uauuuauugaaaugau

SEQ ID NO: 3715033 - RNA, 21 nt, Human
uauuuauugaagaaacagaua

SEQ ID NO: 3715034 - RNA, 14 nt, Human
uauuuauugguuuu

SEQ ID NO: 3715035 - RNA, 17 nt, Human
uauuuauuguauucugg

SEQ ID NO: 3715036 - RNA, 22 nt, Human
uauuuauuguuuauuuaucagu

SEQ ID NO: 3715037 - RNA, 12 nt, Human
uauuuauuuaaa

SEQ ID NO: 3715038 - RNA, 16 nt, Human
uauuuauuuaaagcau

SEQ ID NO: 3715039 - RNA, 18 nt, Human
uauuuauuuaaaugucua

SEQ ID NO: 3715040 - RNA, 15 nt, Human
uauuuauuuacaaau

SEQ ID NO: 3715041 - RNA, 18 nt, Human
uauuuauuuauguacuuu

SEQ ID NO: 3715042 - RNA, 14 nt, Human
uauuuauuuauuua

SEQ ID NO: 3715043 - RNA, 16 nt, Human
uauuuauuuuaauaau

SEQ ID NO: 3715044 - RNA, 20 nt, Human
uauuucaaaaauuuggaauu

SEQ ID NO: 3715045 - RNA, 19 nt, Human
uauuucaaguacacugaau

SEQ ID NO: 3715046 - RNA, 15 nt, Human
uauuucaauguaauu

SEQ ID NO: 3715047 - RNA, 16 nt, Human
uauuucaauguaauua

SEQ ID NO: 3715048 - RNA, 19 nt, Human
uauuucaauguaauuaaac

SEQ ID NO: 3715049 - RNA, 15 nt, Human
uauuucaauguuagc

SEQ ID NO: 3715050 - RNA, 15 nt, Human
uauuucacaacagcc

SEQ ID NO: 3715051 - RNA, 16 nt, Human
uauuucacuugaugau

SEQ ID NO: 3715052 - RNA, 20 nt, Human
uauuucacuuuagaugcuga

SEQ ID NO: 3715053 - RNA, 12 nt, Human
uauuucagaaau

SEQ ID NO: 3715054 - RNA, 14 nt, Human
uauuucagaaauac

SEQ ID NO: 3715055 - RNA, 21 nt, Human
uauuucagauguaauguuuuc

SEQ ID NO: 3715056 - RNA, 16 nt, Human
uauuucagauuuugau

SEQ ID NO: 3715057 - RNA, 18 nt, Human
uauuucagauuuugauaa

SEQ ID NO: 3715058 - RNA, 16 nt, Human
uauuucagcaaacuug

SEQ ID NO: 3715059 - RNA, 14 nt, Human
uauuucaggauucu

SEQ ID NO: 3715060 - RNA, 21 nt, Human
uauuucaguguaguuaauuua

SEQ ID NO: 3715061 - RNA, 18 nt, Human
uauuucaguguuaccugu

SEQ ID NO: 3715062 - RNA, 19 nt, Human
uauuucaguguuaccugug

SEQ ID NO: 3715063 - RNA, 20 nt, Human
uauuucaguguuaccugugu

SEQ ID NO: 3715064 - RNA, 22 nt, Human
uauuucaguuauugucccuggc

SEQ ID NO: 3715065 - RNA, 22 nt, Human
uauuucaguuccgucagaaagu

SEQ ID NO: 3715066 - RNA, 20 nt, Human
uauuucaguuuuaaauguac

SEQ ID NO: 3715067 - RNA, 20 nt, Human
uauuucauaaacaacuuaau

SEQ ID NO: 3715068 - RNA, 12 nt, Human
uauuucaugugg

SEQ ID NO: 3715069 - RNA, 15 nt, Human
uauuuccacuaaaaa

SEQ ID NO: 3715070 - RNA, 13 nt, Human
uauuuccacuucu

SEQ ID NO: 3715071 - RNA, 21 nt, Human
uauuuccauuaaaaaaucagu

SEQ ID NO: 3715072 - RNA, 22 nt, Human
uauuuccccaggggaaaaugaa

SEQ ID NO: 3715073 - RNA, 16 nt, Human
uauuucccuaaaauac

SEQ ID NO: 3715074 - RNA, 20 nt, Human
uauuucccuaaaauacauuu

SEQ ID NO: 3715075 - RNA, 21 nt, Human
uauuucccuaaaauacauuua

SEQ ID NO: 3715076 - RNA, 13 nt, Human
uauuucccuuuag

SEQ ID NO: 3715077 - RNA, 19 nt, Human
uauuuccuauaccauuucc

SEQ ID NO: 3715078 - RNA, 23 nt, Human
uauuuccuauauuguuuucagug

SEQ ID NO: 3715079 - RNA, 11 nt, Human
uauuuccuuua

SEQ ID NO: 3715080 - RNA, 14 nt, Human
uauuuccuuuaugu

SEQ ID NO: 3715081 - RNA, 17 nt, Human
uauuuccuuuaugugaa

SEQ ID NO: 3715082 - RNA, 18 nt, Human
uauuuccuuuaugugaau

SEQ ID NO: 3715083 - RNA, 12 nt, Human
uauuucuacugu

SEQ ID NO: 3715084 - RNA, 17 nt, Human
uauuucuaggaagaauu

SEQ ID NO: 3715085 - RNA, 13 nt, Human
uauuucuaugaaa

SEQ ID NO: 3715086 - RNA, 14 nt, Human
uauuucuauuauua

SEQ ID NO: 3715087 - RNA, 18 nt, Human
uauuucuauuuccuggaa

SEQ ID NO: 3715088 - RNA, 15 nt, Human
uauuucuccuuuugu

SEQ ID NO: 3715089 - RNA, 16 nt, Human
uauuucucuaguaguu

SEQ ID NO: 3715090 - RNA, 19 nt, Human
uauuucucugauuugcaaa

SEQ ID NO: 3715091 - RNA, 11 nt, Human
uauuucugaga

SEQ ID NO: 3715092 - RNA, 21 nt, Human
uauuucugagaagguccuuaa

SEQ ID NO: 3715093 - RNA, 17 nt, Human
uauuucugcauauguug

SEQ ID NO: 3715094 - RNA, 21 nt, Human
uauuucugcugaauuuucaca

SEQ ID NO: 3715095 - RNA, 20 nt, Human
uauuucugucauucaaaugg

SEQ ID NO: 3715096 - RNA, 18 nt, Human
uauuucuuaauuauuaua

SEQ ID NO: 3715097 - RNA, 23 nt, Human
uauuucuucaaauaucucuauuu

SEQ ID NO: 3715098 - RNA, 22 nt, Human
uauuucuuccuaccaagucaaa

SEQ ID NO: 3715099 - RNA, 16 nt, Human
uauuugaaaaaaacuu

SEQ ID NO: 3715100 - RNA, 23 nt, Human
uauuugaaaaaaacuucauucuc

SEQ ID NO: 3715101 - RNA, 14 nt, Human
uauuugaaaacaga

SEQ ID NO: 3715102 - RNA, 18 nt, Human
uauuugaaaacagaaauu

SEQ ID NO: 3715103 - RNA, 19 nt, Human
uauuugaaaacagaaauug

SEQ ID NO: 3715104 - RNA, 22 nt, Human
uauuugaaaacauauaaagcac

SEQ ID NO: 3715105 - RNA, 12 nt, Human
uauuugaaacuu

SEQ ID NO: 3715106 - RNA, 14 nt, Human
uauuugaaagugcc

SEQ ID NO: 3715107 - RNA, 19 nt, Human
uauuugaaucuugucucaa

SEQ ID NO: 3715108 - RNA, 23 nt, Human
uauuugaauguaugcuucauaca

SEQ ID NO: 3715109 - RNA, 18 nt, Human
uauuugaauuaaaacuuc

SEQ ID NO: 3715110 - RNA, 21 nt, Human
uauuugaauuuuaaaucuaaa

SEQ ID NO: 3715111 - RNA, 21 nt, Human
uauuugacaacguuucagcga

SEQ ID NO: 3715112 - RNA, 17 nt, Human
uauuugacuugcaugaa

SEQ ID NO: 3715113 - RNA, 20 nt, Human
uauuugacuuuaauuuaugu

SEQ ID NO: 3715114 - RNA, 18 nt, Human
uauuugagaguucuaaau

SEQ ID NO: 3715115 - RNA, 17 nt, Human
uauuugaggaguguuaa

SEQ ID NO: 3715116 - RNA, 14 nt, Human
uauuugauuauuua

SEQ ID NO: 3715117 - RNA, 13 nt, Human
uauuugauuuauu

SEQ ID NO: 3715118 - RNA, 15 nt, Human
uauuugauuuauuaa

SEQ ID NO: 3715119 - RNA, 19 nt, Human
uauuugauuuauuaacuua

SEQ ID NO: 3715120 - RNA, 14 nt, Human
uauuugcaacauuu

SEQ ID NO: 3715121 - RNA, 14 nt, Human
uauuugcaauuccu

SEQ ID NO: 3715122 - RNA, 18 nt, Human
uauuugcacuaagauauu

SEQ ID NO: 3715123 - RNA, 16 nt, Human
uauuugcagacuagaa

SEQ ID NO: 3715124 - RNA, 22 nt, Human
uauuugcaggucuuuaaaucau

SEQ ID NO: 3715125 - RNA, 20 nt, Human
uauuugcagugcaguauaga

SEQ ID NO: 3715126 - RNA, 22 nt, Human
uauuugcagugcaguauagaau

SEQ ID NO: 3715127 - RNA, 23 nt, Human
uauuugcaguucaccugcacuua

SEQ ID NO: 3715128 - RNA, 21 nt, Human
uauuugcauaacaauuccucu

SEQ ID NO: 3715129 - RNA, 22 nt, Human
uauuugcauaacaauuccucua

SEQ ID NO: 3715130 - RNA, 11 nt, Human
uauuugcaugu

SEQ ID NO: 3715131 - RNA, 16 nt, Human
uauuugcauguuaccu

SEQ ID NO: 3715132 - RNA, 19 nt, Human
uauuugcauguuauguuua

SEQ ID NO: 3715133 - RNA, 14 nt, Human
uauuugcuaauuuu

SEQ ID NO: 3715134 - RNA, 16 nt, Human
uauuuggaaauaaagu

SEQ ID NO: 3715135 - RNA, 14 nt, Human
uauuuggaauuaga

SEQ ID NO: 3715136 - RNA, 14 nt, Human
uauuuggauaucug

SEQ ID NO: 3715137 - RNA, 16 nt, Human
uauuuggauaucuguu

SEQ ID NO: 3715138 - RNA, 14 nt, Human
uauuuggcaguuug

SEQ ID NO: 3715139 - RNA, 17 nt, Human
uauuuggcaguuuggua

SEQ ID NO: 3715140 - RNA, 15 nt, Human
uauuuggcuuaaaua

SEQ ID NO: 3715141 - RNA, 16 nt, Human
uauuuggcuuaaauau

SEQ ID NO: 3715142 - RNA, 21 nt, Human
uauuugggaaacuugucacuu

SEQ ID NO: 3715143 - RNA, 22 nt, Human
uauuugggagggaaaagggaag

SEQ ID NO: 3715144 - RNA, 22 nt, Human
uauuugggguugcaucagaaau

SEQ ID NO: 3715145 - RNA, 18 nt, Human
uauuuggucucuauuuca

SEQ ID NO: 3715146 - RNA, 13 nt, Human
uauuuguaaagcu

SEQ ID NO: 3715147 - RNA, 16 nt, Human
uauuuguaaauuuaug

SEQ ID NO: 3715148 - RNA, 12 nt, Human
uauuuguacaua

SEQ ID NO: 3715149 - RNA, 24 nt, Human
uauuuguacuguuuaauguucugu

SEQ ID NO: 3715150 - RNA, 16 nt, Human
uauuuguacuuucugu

SEQ ID NO: 3715151 - RNA, 14 nt, Human
uauuuguaguguua

SEQ ID NO: 3715152 - RNA, 22 nt, Human
uauuuguauaaaagugugaaau

SEQ ID NO: 3715153 - RNA, 17 nt, Human
uauuuguauaguugcuu

SEQ ID NO: 3715154 - RNA, 12 nt, Human
uauuuguaucuc

SEQ ID NO: 3715155 - RNA, 22 nt, Human
uauuuguaucucugaagcaugu

SEQ ID NO: 3715156 - RNA, 14 nt, Human
uauuuguaugauau

SEQ ID NO: 3715157 - RNA, 20 nt, Human
uauuuguaugauauuuuaaa

SEQ ID NO: 3715158 - RNA, 13 nt, Human
uauuugugcauuu

SEQ ID NO: 3715159 - RNA, 21 nt, Human
uauuugugcuauaguauuuga

SEQ ID NO: 3715160 - RNA, 17 nt, Human
uauuuguguaauagaaa

SEQ ID NO: 3715161 - RNA, 15 nt, Human
uauuuguguauuuaa

SEQ ID NO: 3715162 - RNA, 16 nt, Human
uauuuguuauggcaga

SEQ ID NO: 3715163 - RNA, 14 nt, Human
uauuuguucauguu

SEQ ID NO: 3715164 - RNA, 15 nt, Human
uauuuguucauguuu

SEQ ID NO: 3715165 - RNA, 17 nt, Human
uauuuguucccaagagc

SEQ ID NO: 3715166 - RNA, 16 nt, Human
uauuuguucuucaaga

SEQ ID NO: 3715167 - RNA, 13 nt, Human
uauuuguuuucau

SEQ ID NO: 3715168 - RNA, 14 nt, Human
uauuuguuuucaug

SEQ ID NO: 3715169 - RNA, 19 nt, Human
uauuuuaaaaaaugaaaau

SEQ ID NO: 3715170 - RNA, 14 nt, Human
uauuuuaaaaauau

SEQ ID NO: 3715171 - RNA, 14 nt, Human
uauuuuaaaagaau

SEQ ID NO: 3715172 - RNA, 18 nt, Human
uauuuuaaaagaaugauu

SEQ ID NO: 3715173 - RNA, 21 nt, Human
uauuuuaaaagauaaauauua

SEQ ID NO: 3715174 - RNA, 12 nt, Human
uauuuuaaaagc

SEQ ID NO: 3715175 - RNA, 22 nt, Human
uauuuuaaaauagcguucuugu

SEQ ID NO: 3715176 - RNA, 15 nt, Human
uauuuuaaaauuuca

SEQ ID NO: 3715177 - RNA, 20 nt, Human
uauuuuaaauuauaaggacu

SEQ ID NO: 3715178 - RNA, 18 nt, Human
uauuuuaagacugauuuu

SEQ ID NO: 3715179 - RNA, 13 nt, Human
uauuuuaagcauu

SEQ ID NO: 3715180 - RNA, 20 nt, Human
uauuuuaagcauuacucuug

SEQ ID NO: 3715181 - RNA, 17 nt, Human
uauuuuaauaaacacuc

SEQ ID NO: 3715182 - RNA, 13 nt, Human
uauuuuaauuuca

SEQ ID NO: 3715183 - RNA, 16 nt, Human
uauuuuaauuucaagc

SEQ ID NO: 3715184 - RNA, 14 nt, Human
uauuuuacaauuuu

SEQ ID NO: 3715185 - RNA, 23 nt, Human
uauuuuacaauuuuuuaucaugc

SEQ ID NO: 3715186 - RNA, 18 nt, Human
uauuuuacagcucauuaa

SEQ ID NO: 3715187 - RNA, 21 nt, Human
uauuuuacagcucauuaaacu

SEQ ID NO: 3715188 - RNA, 13 nt, Human
uauuuuacauaaa

SEQ ID NO: 3715189 - RNA, 13 nt, Human
uauuuuacuuuuu

SEQ ID NO: 3715190 - RNA, 13 nt, Human
uauuuuagcaguu

SEQ ID NO: 3715191 - RNA, 22 nt, Human
uauuuuagguguaaaauaauua

SEQ ID NO: 3715192 - RNA, 21 nt, Human
uauuuuagugaacuugaaaua

SEQ ID NO: 3715193 - RNA, 20 nt, Human
uauuuuaguuucuguucugu

SEQ ID NO: 3715194 - RNA, 15 nt, Human
uauuuuauaagaaaa

SEQ ID NO: 3715195 - RNA, 17 nt, Human
uauuuuauaagaaaaac

SEQ ID NO: 3715196 - RNA, 16 nt, Human
uauuuuauaaugucca

SEQ ID NO: 3715197 - RNA, 13 nt, Human
uauuuuauauaaa

SEQ ID NO: 3715198 - RNA, 21 nt, Human
uauuuuauaucaauuuaaaaa

SEQ ID NO: 3715199 - RNA, 15 nt, Human
uauuuuaugagaaau

SEQ ID NO: 3715200 - RNA, 16 nt, Human
uauuuuaugagaaaug

SEQ ID NO: 3715201 - RNA, 23 nt, Human
uauuuuaugguuauguuuuucug

SEQ ID NO: 3715202 - RNA, 14 nt, Human
uauuuuauguaugu

SEQ ID NO: 3715203 - RNA, 16 nt, Human
uauuuuauguugcaua

SEQ ID NO: 3715204 - RNA, 17 nt, Human
uauuuuauguugcauag

SEQ ID NO: 3715205 - RNA, 21 nt, Human
uauuuuauuacaucuuucaca

SEQ ID NO: 3715206 - RNA, 13 nt, Human
uauuuuauuauga

SEQ ID NO: 3715207 - RNA, 11 nt, Human
uauuuuauuca

SEQ ID NO: 3715208 - RNA, 15 nt, Human
uauuuuauucaaggu

SEQ ID NO: 3715209 - RNA, 19 nt, Human
uauuuuauucccuuucaca

SEQ ID NO: 3715210 - RNA, 16 nt, Human
uauuuuauuguaacag

SEQ ID NO: 3715211 - RNA, 17 nt, Human
uauuuuauuguaacaga

SEQ ID NO: 3715212 - RNA, 23 nt, Human
uauuuuauuguaacagacauugu

SEQ ID NO: 3715213 - RNA, 17 nt, Human
uauuuuauuuuuuucua

SEQ ID NO: 3715214 - RNA, 13 nt, Human
uauuuucaagaaa

SEQ ID NO: 3715215 - RNA, 16 nt, Human
uauuuucaagaaacug

SEQ ID NO: 3715216 - RNA, 21 nt, Human
uauuuucaaggcccucagcau

SEQ ID NO: 3715217 - RNA, 22 nt, Human
uauuuucagaaucugaauguaa

SEQ ID NO: 3715218 - RNA, 23 nt, Human
uauuuucagaaucugaauguaau

SEQ ID NO: 3715219 - RNA, 17 nt, Human
uauuuucaguauuuugg

SEQ ID NO: 3715220 - RNA, 19 nt, Human
uauuuucagucaaaacuuu

SEQ ID NO: 3715221 - RNA, 21 nt, Human
uauuuucagucaaaacuuuaa

SEQ ID NO: 3715222 - RNA, 18 nt, Human
uauuuucauacagcauua

SEQ ID NO: 3715223 - RNA, 13 nt, Human
uauuuucauuaca

SEQ ID NO: 3715224 - RNA, 15 nt, Human
uauuuucauucuccu

SEQ ID NO: 3715225 - RNA, 15 nt, Human
uauuuucauuguaaa

SEQ ID NO: 3715226 - RNA, 15 nt, Human
uauuuuccaagugug

SEQ ID NO: 3715227 - RNA, 24 nt, Human
uauuuuccaagugugcauauugua

SEQ ID NO: 3715228 - RNA, 13 nt, Human
uauuuuccaggcu

SEQ ID NO: 3715229 - RNA, 19 nt, Human
uauuuuccccuaucauuua

SEQ ID NO: 3715230 - RNA, 20 nt, Human
uauuuuccccuaucauuuau

SEQ ID NO: 3715231 - RNA, 21 nt, Human
uauuuuccccuaucauuuauu

SEQ ID NO: 3715232 - RNA, 12 nt, Human
uauuuuccuaaa

SEQ ID NO: 3715233 - RNA, 12 nt, Human
uauuuuccuccc

SEQ ID NO: 3715234 - RNA, 14 nt, Human
uauuuuccugauag

SEQ ID NO: 3715235 - RNA, 14 nt, Human
uauuuucuacguuu

SEQ ID NO: 3715236 - RNA, 16 nt, Human
uauuuucuauguacua

SEQ ID NO: 3715237 - RNA, 21 nt, Human
uauuuucucugauacuuuuuu

SEQ ID NO: 3715238 - RNA, 21 nt, Human
uauuuucugucagaugagaac

SEQ ID NO: 3715239 - RNA, 11 nt, Human
uauuuucugug

SEQ ID NO: 3715240 - RNA, 14 nt, Human
uauuuucugugugu

SEQ ID NO: 3715241 - RNA, 16 nt, Human
uauuuucuguguguuc

SEQ ID NO: 3715242 - RNA, 13 nt, Human
uauuuucuuggau

SEQ ID NO: 3715243 - RNA, 11 nt, Human
uauuuugaagu

SEQ ID NO: 3715244 - RNA, 16 nt, Human
uauuuugaaucaauaa

SEQ ID NO: 3715245 - RNA, 18 nt, Human
uauuuugacauaaaguug

SEQ ID NO: 3715246 - RNA, 15 nt, Human
uauuuugauaauaaa

SEQ ID NO: 3715247 - RNA, 20 nt, Human
uauuuugauaauaaauugaa

SEQ ID NO: 3715248 - RNA, 19 nt, Human
uauuuugauaauaauauug

SEQ ID NO: 3715249 - RNA, 15 nt, Human
uauuuugaucuucaa

SEQ ID NO: 3715250 - RNA, 23 nt, Human
uauuuugaugcagcauuugauaa

SEQ ID NO: 3715251 - RNA, 18 nt, Human
uauuuugauuauuguauu

SEQ ID NO: 3715252 - RNA, 13 nt, Human
uauuuugccauuu

SEQ ID NO: 3715253 - RNA, 14 nt, Human
uauuuugcuggaau

SEQ ID NO: 3715254 - RNA, 20 nt, Human
uauuuugcuuugugauuuuu

SEQ ID NO: 3715255 - RNA, 16 nt, Human
uauuuuguaaaaugua

SEQ ID NO: 3715256 - RNA, 14 nt, Human
uauuuuguaauuau

SEQ ID NO: 3715257 - RNA, 13 nt, Human
uauuuuguaugca

SEQ ID NO: 3715258 - RNA, 19 nt, Human
uauuuuguauuauugcugu

SEQ ID NO: 3715259 - RNA, 16 nt, Human
uauuuuguauuguggu

SEQ ID NO: 3715260 - RNA, 16 nt, Human
uauuuugucauaucaa

SEQ ID NO: 3715261 - RNA, 13 nt, Human
uauuuugucuaaa

SEQ ID NO: 3715262 - RNA, 17 nt, Human
uauuuuguggaggcagu

SEQ ID NO: 3715263 - RNA, 21 nt, Human
uauuuuguggaggcaguguca

SEQ ID NO: 3715264 - RNA, 12 nt, Human
uauuuuguguaa

SEQ ID NO: 3715265 - RNA, 13 nt, Human
ucacuuuuuucca

SEQ ID NO: 3715266 - RNA, 16 nt, Human
ucacuuuuuuccacau

SEQ ID NO: 3715267 - RNA, 17 nt, Human
ucacuuuuuuuuuccaa

SEQ ID NO: 3715268 - RNA, 19 nt, Human
ucacuuuuuuuuuccaaaa

SEQ ID NO: 3715269 - RNA, 18 nt, Human
ucacuuuuuuuuuuuguu

SEQ ID NO: 3715270 - RNA, 16 nt, Human
ucagaaaaacaauaag

SEQ ID NO: 3715271 - RNA, 12 nt, Human
ucagaaaacaga

SEQ ID NO: 3715272 - RNA, 18 nt, Human
ucagaaaacuuuaaaaaa

SEQ ID NO: 3715273 - RNA, 18 nt, Human
ucagaaaaugaaaaaucu

SEQ ID NO: 3715274 - RNA, 22 nt, Human
ucagaaacacccucacacuggg

SEQ ID NO: 3715275 - RNA, 15 nt, Human
ucagaaacuugugaa

SEQ ID NO: 3715276 - RNA, 18 nt, Human
ucagaaacuugugaagug

SEQ ID NO: 3715277 - RNA, 13 nt, Human
ucagaaagacuug

SEQ ID NO: 3715278 - RNA, 17 nt, Human
ucagaaagcauuacauu

SEQ ID NO: 3715279 - RNA, 17 nt, Human
ucagaaagccuuucauu

SEQ ID NO: 3715280 - RNA, 19 nt, Human
ucagaaagcuuuauuuuga

SEQ ID NO: 3715281 - RNA, 14 nt, Human
ucagaaagggaggg

SEQ ID NO: 3715282 - RNA, 17 nt, Human
ucagaaagggagggcuc

SEQ ID NO: 3715283 - RNA, 20 nt, Human
ucagaaagggagggcucuga

SEQ ID NO: 3715284 - RNA, 23 nt, Human
ucagaaagggagggcucugaggc

SEQ ID NO: 3715285 - RNA, 20 nt, Human
ucagaaagggcagaaguagg

SEQ ID NO: 3715286 - RNA, 16 nt, Human
ucagaaaguaauuucu

SEQ ID NO: 3715287 - RNA, 23 nt, Human
ucagaaagugccugacacacuaa

SEQ ID NO: 3715288 - RNA, 23 nt, Human
ucagaaagugugcuuuaugcuga

SEQ ID NO: 3715289 - RNA, 17 nt, Human
ucagaaauacagauaaa

SEQ ID NO: 3715290 - RNA, 20 nt, Human
ucagaaauacagauuuugau

SEQ ID NO: 3715291 - RNA, 13 nt, Human
ucagaaauauaac

SEQ ID NO: 3715292 - RNA, 12 nt, Human
ucagaaauaugu

SEQ ID NO: 3715293 - RNA, 15 nt, Human
ucagaaaugcugccu

SEQ ID NO: 3715294 - RNA, 19 nt, Human
ucagaaaugcugccugccu

SEQ ID NO: 3715295 - RNA, 10 nt, Human
ucagaaaugu

SEQ ID NO: 3715296 - RNA, 16 nt, Human
ucagaaauuggaacag

SEQ ID NO: 3715297 - RNA, 23 nt, Human
ucagaaauuuaauucauguuucu

SEQ ID NO: 3715298 - RNA, 12 nt, Human
ucagaacacauu

SEQ ID NO: 3715299 - RNA, 14 nt, Human
ucagaacagcuguu

SEQ ID NO: 3715300 - RNA, 13 nt, Human
ucagaacccaggg

SEQ ID NO: 3715301 - RNA, 23 nt, Human
ucagaacccagggcucugcccca

SEQ ID NO: 3715302 - RNA, 16 nt, Human
ucagaacccugccaug

SEQ ID NO: 3715303 - RNA, 18 nt, Human
ucagaacccuuggcuugc

SEQ ID NO: 3715304 - RNA, 20 nt, Human
ucagaacccuuggcuugccc

SEQ ID NO: 3715305 - RNA, 24 nt, Human
ucagaacccuuggcuugcccacgu

SEQ ID NO: 3715306 - RNA, 22 nt, Human
ucagaacucaaauggggccaga

SEQ ID NO: 3715307 - RNA, 15 nt, Human
ucagaacuguuuuug

SEQ ID NO: 3715308 - RNA, 17 nt, Human
ucagaacuugcugcugu

SEQ ID NO: 3715309 - RNA, 19 nt, Human
ucagaacuugcugcugucu

SEQ ID NO: 3715310 - RNA, 13 nt, Human
ucagaagaaaaag

SEQ ID NO: 3715311 - RNA, 16 nt, Human
ucagaagaaaaagaag

SEQ ID NO: 3715312 - RNA, 14 nt, Human
ucagaagaaauaaa

SEQ ID NO: 3715313 - RNA, 14 nt, Human
ucagaagcaaacaa

SEQ ID NO: 3715314 - RNA, 13 nt, Human
ucagaagccugag

SEQ ID NO: 3715315 - RNA, 13 nt, Human
ucagaagccuggg

SEQ ID NO: 3715316 - RNA, 16 nt, Human
ucagaagccugggggc

SEQ ID NO: 3715317 - RNA, 22 nt, Human
ucagaagccugggggccuggcu

SEQ ID NO: 3715318 - RNA, 15 nt, Human
ucagaaggagcuaca

SEQ ID NO: 3715319 - RNA, 19 nt, Human
ucagaaggcaaaugacuuu

SEQ ID NO: 3715320 - RNA, 22 nt, Human
ucagaaggcaaaugacuuugga

SEQ ID NO: 3715321 - RNA, 20 nt, Human
ucagaaggcucuucugacua

SEQ ID NO: 3715322 - RNA, 12 nt, Human
ucagaagggagg

SEQ ID NO: 3715323 - RNA, 14 nt, Human
ucagaaggucuguu

SEQ ID NO: 3715324 - RNA, 15 nt, Human
ucagaagucuuucag

SEQ ID NO: 3715325 - RNA, 15 nt, Human
ucagaagugagcuuu

SEQ ID NO: 3715326 - RNA, 17 nt, Human
ucagaaguuaguuugua

SEQ ID NO: 3715327 - RNA, 15 nt, Human
ucagaaguuuaaaua

SEQ ID NO: 3715328 - RNA, 19 nt, Human
ucagaaguuucugccgcag

SEQ ID NO: 3715329 - RNA, 16 nt, Human
ucagaauagaaauuag

SEQ ID NO: 3715330 - RNA, 21 nt, Human
ucagaauagccacauuuggaa

SEQ ID NO: 3715331 - RNA, 19 nt, Human
ucagaaucacuucugagaa

SEQ ID NO: 3715332 - RNA, 22 nt, Human
ucagaauccaagugaacacuag

SEQ ID NO: 3715333 - RNA, 18 nt, Human
ucagaaucucaaauaacu

SEQ ID NO: 3715334 - RNA, 19 nt, Human
ucagaaugcuauugaaaau

SEQ ID NO: 3715335 - RNA, 22 nt, Human
ucagaauggaagagagaaagca

SEQ ID NO: 3715336 - RNA, 18 nt, Human
ucagaauguaaaagaacu

SEQ ID NO: 3715337 - RNA, 20 nt, Human
ucagaauuaaacuuuuaauu

SEQ ID NO: 3715338 - RNA, 23 nt, Human
ucagaauuaaacuuuuaauucau

SEQ ID NO: 3715339 - RNA, 14 nt, Human
ucagaauuaugaug

SEQ ID NO: 3715340 - RNA, 23 nt, Human
ucagaauucucuaguuugauuaa

SEQ ID NO: 3715341 - RNA, 16 nt, Human
ucagaauugaaacacu

SEQ ID NO: 3715342 - RNA, 17 nt, Human
ucagaauugaaacacuu

SEQ ID NO: 3715343 - RNA, 21 nt, Human
ucagaauugaucauuuucccc

SEQ ID NO: 3715344 - RNA, 21 nt, Human
ucagaauuuaguguauccaua

SEQ ID NO: 3715345 - RNA, 22 nt, Human
ucagaauuuguguugaaggaac

SEQ ID NO: 3715346 - RNA, 13 nt, Human
ucagacaaaaugg

SEQ ID NO: 3715347 - RNA, 21 nt, Human
ucagacaaaauggauacauaa

SEQ ID NO: 3715348 - RNA, 17 nt, Human
ucagacacccucaaccu

SEQ ID NO: 3715349 - RNA, 15 nt, Human
ucagacacucuggcu

SEQ ID NO: 3715350 - RNA, 17 nt, Human
ucagacacucuggcugg

SEQ ID NO: 3715351 - RNA, 22 nt, Human
ucagacagaucuggaaugugaa

SEQ ID NO: 3715352 - RNA, 14 nt, Human
ucagacagcugccu

SEQ ID NO: 3715353 - RNA, 12 nt, Human
ucagacauaaag

SEQ ID NO: 3715354 - RNA, 21 nt, Human
ucagacauccauguuuguaaa

SEQ ID NO: 3715355 - RNA, 14 nt, Human
ucagacauguuuuc

SEQ ID NO: 3715356 - RNA, 20 nt, Human
ucagacauguuuuccgugaa

SEQ ID NO: 3715357 - RNA, 13 nt, Human
ucagaccagagaa

SEQ ID NO: 3715358 - RNA, 17 nt, Human
ucagaccccagcggcug

SEQ ID NO: 3715359 - RNA, 12 nt, Human
ucagacccccac

SEQ ID NO: 3715360 - RNA, 22 nt, Human
ucagacccccacucucauuccc

SEQ ID NO: 3715361 - RNA, 13 nt, Human
ucagacccuuuag

SEQ ID NO: 3715362 - RNA, 18 nt, Human
ucagacgcacucgcauug

SEQ ID NO: 3715363 - RNA, 15 nt, Human
ucagacuaagccagc

SEQ ID NO: 3715364 - RNA, 21 nt, Human
ucagacucccauuccugaaga

SEQ ID NO: 3715365 - RNA, 20 nt, Human
ucagacucucagcccagaag

SEQ ID NO: 3715366 - RNA, 21 nt, Human
ucagacucucagcccagaaga

SEQ ID NO: 3715367 - RNA, 14 nt, Human
ucagacugaacaug

SEQ ID NO: 3715368 - RNA, 13 nt, Human
ucagacugcuggg

SEQ ID NO: 3715369 - RNA, 16 nt, Human
ucagacugcugggacu

SEQ ID NO: 3715370 - RNA, 17 nt, Human
ucagacugcugggacug

SEQ ID NO: 3715371 - RNA, 23 nt, Human
ucagacugcugggacuggccagg

SEQ ID NO: 3715372 - RNA, 16 nt, Human
ucagacugcuuugaga

SEQ ID NO: 3715373 - RNA, 23 nt, Human
ucagacuuuaaagaauaauaugc

SEQ ID NO: 3715374 - RNA, 14 nt, Human
ucagagaaggaaca

SEQ ID NO: 3715375 - RNA, 13 nt, Human
ucagagaauuucu

SEQ ID NO: 3715376 - RNA, 19 nt, Human
ucagagacaucagcccuug

SEQ ID NO: 3715377 - RNA, 15 nt, Human
ucagagacaugcaga

SEQ ID NO: 3715378 - RNA, 12 nt, Human
ucagagaccagg

SEQ ID NO: 3715379 - RNA, 18 nt, Human
ucagagaccaggcccugg

SEQ ID NO: 3715380 - RNA, 14 nt, Human
ucagagaccagggc

SEQ ID NO: 3715381 - RNA, 15 nt, Human
ucagagaccauugca

SEQ ID NO: 3715382 - RNA, 19 nt, Human
ucagagacucagggcccca

SEQ ID NO: 3715383 - RNA, 16 nt, Human
ucagagacuccugcag

SEQ ID NO: 3715384 - RNA, 21 nt, Human
ucagagacuccugcaggcagc

SEQ ID NO: 3715385 - RNA, 12 nt, Human
ucagagagcagu

SEQ ID NO: 3715386 - RNA, 22 nt, Human
ucagagagcgagcgcuacccac

SEQ ID NO: 3715387 - RNA, 13 nt, Human
ucagagagcuggu

SEQ ID NO: 3715388 - RNA, 17 nt, Human
ucagagaggagucagag

SEQ ID NO: 3715389 - RNA, 20 nt, Human
ucagagaggagucagagaga

SEQ ID NO: 3715390 - RNA, 18 nt, Human
ucagagaugaacaucuaa

SEQ ID NO: 3715391 - RNA, 20 nt, Human
ucagagaugcauuuggaaca

SEQ ID NO: 3715392 - RNA, 16 nt, Human
ucagagcaaauuuggg

SEQ ID NO: 3715393 - RNA, 18 nt, Human
ucagagcaggaccucccu

SEQ ID NO: 3715394 - RNA, 19 nt, Human
ucagagcaggugcuggcuc

SEQ ID NO: 3715395 - RNA, 21 nt, Human
ucagagccaccccuaaagaga

SEQ ID NO: 3715396 - RNA, 22 nt, Human
ucagagccaugucuucucccug

SEQ ID NO: 3715397 - RNA, 12 nt, Human
ucagagccugca

SEQ ID NO: 3715398 - RNA, 20 nt, Human
ucagagccuuuccucaaaac

SEQ ID NO: 3715399 - RNA, 17 nt, Human
ucagagcuacuugggcc

SEQ ID NO: 3715400 - RNA, 14 nt, Human
ucagagcuccucug

SEQ ID NO: 3715401 - RNA, 22 nt, Human
ucagagcugcccucuccugggc

SEQ ID NO: 3715402 - RNA, 14 nt, Human
ucagaggaccugua

SEQ ID NO: 3715403 - RNA, 21 nt, Human
ucagaggaccuguauuuaagc

SEQ ID NO: 3715404 - RNA, 23 nt, Human
ucagaggaccuguauuuaagcaa

SEQ ID NO: 3715405 - RNA, 21 nt, Human
ucagaggagagauagccugug

SEQ ID NO: 3715406 - RNA, 23 nt, Human
ucagaggagagauagccuguggc

SEQ ID NO: 3715407 - RNA, 12 nt, Human
ucagaggcccca

SEQ ID NO: 3715408 - RNA, 15 nt, Human
ucagaggccuauaau

SEQ ID NO: 3715409 - RNA, 20 nt, Human
ucagaggccuauaaugaagc

SEQ ID NO: 3715410 - RNA, 16 nt, Human
ucagaggcgcacugug

SEQ ID NO: 3715411 - RNA, 15 nt, Human
ucagaggcugaggug

SEQ ID NO: 3715412 - RNA, 14 nt, Human
ucagagggaggaau

SEQ ID NO: 3715413 - RNA, 14 nt, Human
ucagagggcccaaa

SEQ ID NO: 3715414 - RNA, 21 nt, Human
ucagaggggaauaaacuguug

SEQ ID NO: 3715415 - RNA, 16 nt, Human
gccuuccagcugcugu

SEQ ID NO: 3715416 - RNA, 17 nt, Human
gccuuccagcugcuguc

SEQ ID NO: 3715417 - RNA, 16 nt, Human
gccuuccagggguggg

SEQ ID NO: 3715418 - RNA, 21 nt, Human
gccuuccaggggugggacacc

SEQ ID NO: 3715419 - RNA, 16 nt, Human
gccuuccauaauuaug

SEQ ID NO: 3715420 - RNA, 21 nt, Human
gccuuccauaauuaugacagu

SEQ ID NO: 3715421 - RNA, 18 nt, Human
gccuuccaugucggccuc

SEQ ID NO: 3715422 - RNA, 20 nt, Human
gccuucccaaguugugcuug

SEQ ID NO: 3715423 - RNA, 22 nt, Human
gccuuccccacccaccaacccu

SEQ ID NO: 3715424 - RNA, 14 nt, Human
gccuuccccugggc

SEQ ID NO: 3715425 - RNA, 16 nt, Human
gccuuccccuugccca

SEQ ID NO: 3715426 - RNA, 18 nt, Human
gccuuccccuugcccagg

SEQ ID NO: 3715427 - RNA, 13 nt, Human
gccuucccuccug

SEQ ID NO: 3715428 - RNA, 20 nt, Human
gccuuccuaagccuguggcu

SEQ ID NO: 3715429 - RNA, 19 nt, Human
gccuuccuauuuugcauaa

SEQ ID NO: 3715430 - RNA, 17 nt, Human
gccuuccuccacauccu

SEQ ID NO: 3715431 - RNA, 17 nt, Human
gccuuccuccugggccc

SEQ ID NO: 3715432 - RNA, 22 nt, Human
gccuuccuccugggcccucucu

SEQ ID NO: 3715433 - RNA, 13 nt, Human
gccuuccucucuc

SEQ ID NO: 3715434 - RNA, 17 nt, Human
gccuuccucucuccaga

SEQ ID NO: 3715435 - RNA, 11 nt, Human
gccuuccuucc

SEQ ID NO: 3715436 - RNA, 19 nt, Human
gccuuccuugaccuuccuc

SEQ ID NO: 3715437 - RNA, 20 nt, Human
gccuuccuugaccuuccucu

SEQ ID NO: 3715438 - RNA, 20 nt, Human
gccuuccuuucuccaggacc

SEQ ID NO: 3715439 - RNA, 21 nt, Human
gccuuccuuucuccaggacca

SEQ ID NO: 3715440 - RNA, 23 nt, Human
gccuucgauacaccgggccugga

SEQ ID NO: 3715441 - RNA, 22 nt, Human
gccuucgcgguggaaggcccga

SEQ ID NO: 3715442 - RNA, 20 nt, Human
gccuucgcuucuugccucug

SEQ ID NO: 3715443 - RNA, 19 nt, Human
gccuucgguacccaccaca

SEQ ID NO: 3715444 - RNA, 19 nt, Human
gccuucgugcccccccuuc

SEQ ID NO: 3715445 - RNA, 18 nt, Human
gccuucguuaacugugua

SEQ ID NO: 3715446 - RNA, 21 nt, Human
gccuucucaccagcugcaaag

SEQ ID NO: 3715447 - RNA, 22 nt, Human
gccuucucaccagcugcaaagu

SEQ ID NO: 3715448 - RNA, 16 nt, Human
gccuucucagaagcac

SEQ ID NO: 3715449 - RNA, 13 nt, Human
gccuucuccuccc

SEQ ID NO: 3715450 - RNA, 16 nt, Human
gccuucucugaaggac

SEQ ID NO: 3715451 - RNA, 14 nt, Human
gccuucucuguuca

SEQ ID NO: 3715452 - RNA, 16 nt, Human
gccuucucuguucauu

SEQ ID NO: 3715453 - RNA, 16 nt, Human
gccuucugaugaaaug

SEQ ID NO: 3715454 - RNA, 19 nt, Human
gccuucuggauucuuggcc

SEQ ID NO: 3715455 - RNA, 19 nt, Human
gccuucugguguuggacaa

SEQ ID NO: 3715456 - RNA, 17 nt, Human
gccuucuucagggccug

SEQ ID NO: 3715457 - RNA, 19 nt, Human
gccuucuucagggccuggu

SEQ ID NO: 3715458 - RNA, 14 nt, Human
gccuucuuccaucc

SEQ ID NO: 3715459 - RNA, 23 nt, Human
gccuucuucggggaacuccugga

SEQ ID NO: 3715460 - RNA, 21 nt, Human
gccuucuucuuuuugcuguug

SEQ ID NO: 3715461 - RNA, 11 nt, Human
gccuucuuuga

SEQ ID NO: 3715462 - RNA, 14 nt, Human
gccuucuuugaaga

SEQ ID NO: 3715463 - RNA, 15 nt, Human
gccuucuuugaagaa

SEQ ID NO: 3715464 - RNA, 18 nt, Human
gccuucuuugcuugccuc

SEQ ID NO: 3715465 - RNA, 17 nt, Human
gccuugaaccugugagu

SEQ ID NO: 3715466 - RNA, 21 nt, Human
gccuugacaucaguuccuuug

SEQ ID NO: 3715467 - RNA, 19 nt, Human
gccuugaccauucuccacc

SEQ ID NO: 3715468 - RNA, 21 nt, Human
gccuugaccauucuccaccug

SEQ ID NO: 3715469 - RNA, 22 nt, Human
gccuugaccauucuccaccugc

SEQ ID NO: 3715470 - RNA, 15 nt, Human
gccuugagcccuggc

SEQ ID NO: 3715471 - RNA, 20 nt, Human
gccuugauucccuuguuauu

SEQ ID NO: 3715472 - RNA, 17 nt, Human
gccuugcagaacugcca

SEQ ID NO: 3715473 - RNA, 20 nt, Human
gccuugcagaacugccauua

SEQ ID NO: 3715474 - RNA, 21 nt, Human
gccuugcagcacucacacagg

SEQ ID NO: 3715475 - RNA, 23 nt, Human
gccuugcagcacucacacaggac

SEQ ID NO: 3715476 - RNA, 12 nt, Human
gccuugccagag

SEQ ID NO: 3715477 - RNA, 13 nt, Human
gccuugccagaga

SEQ ID NO: 3715478 - RNA, 14 nt, Human
gccuugccagagau

SEQ ID NO: 3715479 - RNA, 12 nt, Human
gccuugcccaga

SEQ ID NO: 3715480 - RNA, 16 nt, Human
gccuugcccagagaug

SEQ ID NO: 3715481 - RNA, 22 nt, Human
gccuugcgguauccgcccccaa

SEQ ID NO: 3715482 - RNA, 22 nt, Human
gccuugcucccaaccccacacg

SEQ ID NO: 3715483 - RNA, 14 nt, Human
gccuugcuggacgg

SEQ ID NO: 3715484 - RNA, 13 nt, Human
gccuuggaaauuc

SEQ ID NO: 3715485 - RNA, 19 nt, Human
gccuuggaaguugcauggc

SEQ ID NO: 3715486 - RNA, 19 nt, Human
gccuuggagggucccaagc

SEQ ID NO: 3715487 - RNA, 21 nt, Human
gccuuggagggucccaagcug

SEQ ID NO: 3715488 - RNA, 21 nt, Human
gccuuggauaaugcuguugcc

SEQ ID NO: 3715489 - RNA, 15 nt, Human
gccuuggccggcugu

SEQ ID NO: 3715490 - RNA, 12 nt, Human
gccuuggccugg

SEQ ID NO: 3715491 - RNA, 13 nt, Human
gccuuggccugga

SEQ ID NO: 3715492 - RNA, 15 nt, Human
gccuuggccuguguu

SEQ ID NO: 3715493 - RNA, 20 nt, Human
gccuuggcuguuggcaguga

SEQ ID NO: 3715494 - RNA, 17 nt, Human
gccuugggcucugcuga

SEQ ID NO: 3715495 - RNA, 14 nt, Human
gccuugggcugcuc

SEQ ID NO: 3715496 - RNA, 16 nt, Human
gccuugggcugcuccu

SEQ ID NO: 3715497 - RNA, 18 nt, Human
gccuugggcugcuccuca

SEQ ID NO: 3715498 - RNA, 19 nt, Human
gccuuggggaauuuccucu

SEQ ID NO: 3715499 - RNA, 19 nt, Human
gccuugguguccaccuggc

SEQ ID NO: 3715500 - RNA, 17 nt, Human
gccuuguaauucuaaau

SEQ ID NO: 3715501 - RNA, 17 nt, Human
gccuugucccagaggcu

SEQ ID NO: 3715502 - RNA, 23 nt, Human
gccuuguccccugccugugccug

SEQ ID NO: 3715503 - RNA, 20 nt, Human
gccuugucuccuacuccuga

SEQ ID NO: 3715504 - RNA, 23 nt, Human
gccuuguuuaaugguaguuuuac

SEQ ID NO: 3715505 - RNA, 15 nt, Human
gccuuguuuuuuucu

SEQ ID NO: 3715506 - RNA, 19 nt, Human
gccuuuaaaucugugauga

SEQ ID NO: 3715507 - RNA, 20 nt, Human
gccuuuacauggacagaauu

SEQ ID NO: 3715508 - RNA, 23 nt, Human
gccuuuacugacccuggggcugg

SEQ ID NO: 3715509 - RNA, 21 nt, Human
gccuuuauuaaaaacugagug

SEQ ID NO: 3715510 - RNA, 13 nt, Human
gccuuuauugugu

SEQ ID NO: 3715511 - RNA, 20 nt, Human
gccuuuauuguguuugucau

SEQ ID NO: 3715512 - RNA, 23 nt, Human
gccuuuauuguguuugucauuag

SEQ ID NO: 3715513 - RNA, 14 nt, Human
gccuuuauuuguua

SEQ ID NO: 3715514 - RNA, 16 nt, Human
gccuuucagcaggcag

SEQ ID NO: 3715515 - RNA, 17 nt, Human
gccuuucagcaggcagc

SEQ ID NO: 3715516 - RNA, 17 nt, Human
gccuuucaggaucuauu

SEQ ID NO: 3715517 - RNA, 18 nt, Human
gccuuucaggaucuauuu

SEQ ID NO: 3715518 - RNA, 15 nt, Human
gccuuucauuuugcu

SEQ ID NO: 3715519 - RNA, 18 nt, Human
gccuuucauuuugcuuua

SEQ ID NO: 3715520 - RNA, 14 nt, Human
gccuuuccucaaaa

SEQ ID NO: 3715521 - RNA, 13 nt, Human
gccuuuccucucu

SEQ ID NO: 3715522 - RNA, 18 nt, Human
gccuuuccuguucagcau

SEQ ID NO: 3715523 - RNA, 23 nt, Human
gccuuuccuuuucgccuuuccuc

SEQ ID NO: 3715524 - RNA, 19 nt, Human
gccuuucugcaguuuuuca

SEQ ID NO: 3715525 - RNA, 13 nt, Human
gccuuucugugug

SEQ ID NO: 3715526 - RNA, 17 nt, Human
gccuuucuuuucuuucu

SEQ ID NO: 3715527 - RNA, 14 nt, Human
gccuuugaauguua

SEQ ID NO: 3715528 - RNA, 19 nt, Human
gccuuugagacaguuucuu

SEQ ID NO: 3715529 - RNA, 18 nt, Human
gccuuugagcccacaaag

SEQ ID NO: 3715530 - RNA, 17 nt, Human
gccuuugaucagguggg

SEQ ID NO: 3715531 - RNA, 18 nt, Human
gccuuugcaaaucagugu

SEQ ID NO: 3715532 - RNA, 15 nt, Human
gccuuugcagaaaca

SEQ ID NO: 3715533 - RNA, 16 nt, Human
gccuuugcagcucaga

SEQ ID NO: 3715534 - RNA, 14 nt, Human
gccuuugccaggug

SEQ ID NO: 3715535 - RNA, 15 nt, Human
gccuuugcgcuccug

SEQ ID NO: 3715536 - RNA, 19 nt, Human
gccuuugcgcuccuggccc

SEQ ID NO: 3715537 - RNA, 13 nt, Human
gccuuugcuccuc

SEQ ID NO: 3715538 - RNA, 16 nt, Human
gccuuuggcagaguuc

SEQ ID NO: 3715539 - RNA, 13 nt, Human
gccuuuggcaggu

SEQ ID NO: 3715540 - RNA, 13 nt, Human
gccuuuggcucug

SEQ ID NO: 3715541 - RNA, 16 nt, Human
gccuuuggcucuggag

SEQ ID NO: 3715542 - RNA, 22 nt, Human
gccuuuguaaccacaacuuuca

SEQ ID NO: 3715543 - RNA, 21 nt, Human
gccuuuguuccccacuggagc

SEQ ID NO: 3715544 - RNA, 22 nt, Human
gccuuuguuccccacuggagca

SEQ ID NO: 3715545 - RNA, 15 nt, Human
gccuuuuaacauuuu

SEQ ID NO: 3715546 - RNA, 21 nt, Human
gccuuuuaacauuuuguucuu

SEQ ID NO: 3715547 - RNA, 14 nt, Human
gccuuuuaauuuuu

SEQ ID NO: 3715548 - RNA, 16 nt, Human
gccuuuuaguuccugu

SEQ ID NO: 3715549 - RNA, 14 nt, Human
gccuuuuauagcua

SEQ ID NO: 3715550 - RNA, 20 nt, Human
gccuuuucccucuuuggcuc

SEQ ID NO: 3715551 - RNA, 15 nt, Human
gccuuuucuggcacc

SEQ ID NO: 3715552 - RNA, 16 nt, Human
gccuuuucuggcaccg

SEQ ID NO: 3715553 - RNA, 12 nt, Human
gccuuuugaaag

SEQ ID NO: 3715554 - RNA, 15 nt, Human
gccuuuugcaccccu

SEQ ID NO: 3715555 - RNA, 16 nt, Human
gccuuuugcaccccuc

SEQ ID NO: 3715556 - RNA, 13 nt, Human
gccuuuuguauac

SEQ ID NO: 3715557 - RNA, 14 nt, Human
gccuuuuguauaca

SEQ ID NO: 3715558 - RNA, 22 nt, Human
gccuuuuuaaaacacauguuuu

SEQ ID NO: 3715559 - RNA, 19 nt, Human
gccuuuuuauaacuuuuua

SEQ ID NO: 3715560 - RNA, 15 nt, Human
gccuuuuucauuuau

SEQ ID NO: 3715561 - RNA, 17 nt, Human
gccuuuuucauuuaucu

SEQ ID NO: 3715562 - RNA, 18 nt, Human
gccuuuuucauuuaucua

SEQ ID NO: 3715563 - RNA, 17 nt, Human
gccuuuuucauuuucca

SEQ ID NO: 3715564 - RNA, 19 nt, Human
gccuuuuucauuuuccaau

SEQ ID NO: 3715565 - RNA, 23 nt, Human
uauuuuguguccuccaggagcuu

SEQ ID NO: 3715566 - RNA, 15 nt, Human
uauuuugugugacca

SEQ ID NO: 3715567 - RNA, 21 nt, Human
uauuuugugugaccaacugug

SEQ ID NO: 3715568 - RNA, 23 nt, Human
uauuuugugugaccaacuguguu

SEQ ID NO: 3715569 - RNA, 15 nt, Human
uauuuuguucauaca

SEQ ID NO: 3715570 - RNA, 23 nt, Human
uauuuuuaaaaaaugaaauccuu

SEQ ID NO: 3715571 - RNA, 12 nt, Human
uauuuuuaaugg

SEQ ID NO: 3715572 - RNA, 21 nt, Human
uauuuuuaauuaauugggcca

SEQ ID NO: 3715573 - RNA, 13 nt, Human
uauuuuuagaugg

SEQ ID NO: 3715574 - RNA, 20 nt, Human
uauuuuuagaugguuacacu

SEQ ID NO: 3715575 - RNA, 20 nt, Human
uauuuuuauaauuguacaaa

SEQ ID NO: 3715576 - RNA, 17 nt, Human
uauuuuuauacaaaccu

SEQ ID NO: 3715577 - RNA, 19 nt, Human
uauuuuuauauagcuugaa

SEQ ID NO: 3715578 - RNA, 19 nt, Human
uauuuuuauaucaugcaaa

SEQ ID NO: 3715579 - RNA, 16 nt, Human
uauuuuuauauuuacu

SEQ ID NO: 3715580 - RNA, 21 nt, Human
uauuuuuauauuuaguuauag

SEQ ID NO: 3715581 - RNA, 21 nt, Human
uauuuuuaucaguuacacaug

SEQ ID NO: 3715582 - RNA, 18 nt, Human
uauuuuuaucuauauaaa

SEQ ID NO: 3715583 - RNA, 17 nt, Human
uauuuuuauuuguuugu

SEQ ID NO: 3715584 - RNA, 20 nt, Human
uauuuuucaauaaagcauuu

SEQ ID NO: 3715585 - RNA, 15 nt, Human
uauuuuucacaguuu

SEQ ID NO: 3715586 - RNA, 13 nt, Human
uauuuuucacaua

SEQ ID NO: 3715587 - RNA, 12 nt, Human
uauuuuucacuc

SEQ ID NO: 3715588 - RNA, 21 nt, Human
uauuuuucagagauuuauaua

SEQ ID NO: 3715589 - RNA, 18 nt, Human
uauuuuucauaaacaagu

SEQ ID NO: 3715590 - RNA, 14 nt, Human
uauuuuucauauug

SEQ ID NO: 3715591 - RNA, 15 nt, Human
uauuuuucauauugu

SEQ ID NO: 3715592 - RNA, 16 nt, Human
uauuuuucauccuaaa

SEQ ID NO: 3715593 - RNA, 13 nt, Human
uauuuuucuaaac

SEQ ID NO: 3715594 - RNA, 13 nt, Human
uauuuuucuaacu

SEQ ID NO: 3715595 - RNA, 15 nt, Human
uauuuuugacagaau

SEQ ID NO: 3715596 - RNA, 13 nt, Human
uauuuuugcccug

SEQ ID NO: 3715597 - RNA, 16 nt, Human
uauuuuugcugcuucu

SEQ ID NO: 3715598 - RNA, 16 nt, Human
uauuuuuggagguuua

SEQ ID NO: 3715599 - RNA, 20 nt, Human
uauuuuuggcagucugaauu

SEQ ID NO: 3715600 - RNA, 14 nt, Human
uauuuuuguacaug

SEQ ID NO: 3715601 - RNA, 13 nt, Human
uauuuuuguagca

SEQ ID NO: 3715602 - RNA, 19 nt, Human
uauuuuuguagcacugaca

SEQ ID NO: 3715603 - RNA, 20 nt, Human
uauuuuuguuuuuauuaaaa

SEQ ID NO: 3715604 - RNA, 13 nt, Human
uauuuuuuaaaaa

SEQ ID NO: 3715605 - RNA, 16 nt, Human
uauuuuuuaauuugau

SEQ ID NO: 3715606 - RNA, 16 nt, Human
uauuuuuuauauauac

SEQ ID NO: 3715607 - RNA, 19 nt, Human
uauuuuuuauaucuggaau

SEQ ID NO: 3715608 - RNA, 12 nt, Human
uauuuuuucaga

SEQ ID NO: 3715609 - RNA, 14 nt, Human
uauuuuuucagacc

SEQ ID NO: 3715610 - RNA, 14 nt, Human
uauuuuuucccaaa

SEQ ID NO: 3715611 - RNA, 14 nt, Human
uauuuuuuccuuuu

SEQ ID NO: 3715612 - RNA, 18 nt, Human
uauuuuuucuugcauuga

SEQ ID NO: 3715613 - RNA, 19 nt, Human
uauuuuuucuugcauugac

SEQ ID NO: 3715614 - RNA, 13 nt, Human
uauuuuuugaaaa

SEQ ID NO: 3715615 - RNA, 15 nt, Human
uauuuuuuggacuuc

SEQ ID NO: 3715616 - RNA, 16 nt, Human
uauuuuuuuaaaauuu

SEQ ID NO: 3715617 - RNA, 19 nt, Human
uauuuuuuuaagcuguaaa

SEQ ID NO: 3715618 - RNA, 18 nt, Human
uauuuuuuuccuuacaua

SEQ ID NO: 3715619 - RNA, 23 nt, Human
uauuuuuuucuaccuugaggucu

SEQ ID NO: 3715620 - RNA, 13 nt, Human
uauuuuuuugcaa

SEQ ID NO: 3715621 - RNA, 19 nt, Human
uauuuuuuuguaauugcuu

SEQ ID NO: 3715622 - RNA, 20 nt, Human
ucaaaaaaaaaaaaaugcac

SEQ ID NO: 3715623 - RNA, 16 nt, Human
ucaaaaaaacacuagu

SEQ ID NO: 3715624 - RNA, 14 nt, Human
ucaaaaaacuugua

SEQ ID NO: 3715625 - RNA, 22 nt, Human
ucaaaaacugucaaagaaucaa

SEQ ID NO: 3715626 - RNA, 22 nt, Human
ucaaaaacuuuggaguccccuc

SEQ ID NO: 3715627 - RNA, 17 nt, Human
ucaaaaaggcuuauaaa

SEQ ID NO: 3715628 - RNA, 23 nt, Human
ucaaaaagucuacgcucuccuuu

SEQ ID NO: 3715629 - RNA, 12 nt, Human
ucaaaaaguguu

SEQ ID NO: 3715630 - RNA, 15 nt, Human
ucaaaaaguguuuau

SEQ ID NO: 3715631 - RNA, 14 nt, Human
ucaaaaauauaacu

SEQ ID NO: 3715632 - RNA, 16 nt, Human
ucaaaaaucugaagau

SEQ ID NO: 3715633 - RNA, 17 nt, Human
ucaaaaaucugaagauu

SEQ ID NO: 3715634 - RNA, 23 nt, Human
ucaaaaauguacaaaauaaaguu

SEQ ID NO: 3715635 - RNA, 12 nt, Human
ucaaaaauuaaa

SEQ ID NO: 3715636 - RNA, 22 nt, Human
ucaaaacaaacagaugcucuga

SEQ ID NO: 3715637 - RNA, 12 nt, Human
ucaaaacacugu

SEQ ID NO: 3715638 - RNA, 17 nt, Human
ucaaaacacuuguaauu

SEQ ID NO: 3715639 - RNA, 15 nt, Human
ucaaaacagagaugu

SEQ ID NO: 3715640 - RNA, 14 nt, Human
ucaaaacucaaaug

SEQ ID NO: 3715641 - RNA, 15 nt, Human
ucaaaacucaaaugc

SEQ ID NO: 3715642 - RNA, 18 nt, Human
ucaaaacucacaagugcu

SEQ ID NO: 3715643 - RNA, 18 nt, Human
ucaaaagaaagaaaauca

SEQ ID NO: 3715644 - RNA, 23 nt, Human
ucaaaagacaauucuuuauacaa

SEQ ID NO: 3715645 - RNA, 18 nt, Human
ucaaaagcaaaugagauc

SEQ ID NO: 3715646 - RNA, 15 nt, Human
ucaaaagcuggauua

SEQ ID NO: 3715647 - RNA, 21 nt, Human
ucaaaaggaaccaggagguuu

SEQ ID NO: 3715648 - RNA, 14 nt, Human
ucaaaagggccaaa

SEQ ID NO: 3715649 - RNA, 17 nt, Human
ucaaaaguaaugccucu

SEQ ID NO: 3715650 - RNA, 15 nt, Human
ucaaaaguauuuucc

SEQ ID NO: 3715651 - RNA, 16 nt, Human
ucaaaaguauuuuccu

SEQ ID NO: 3715652 - RNA, 17 nt, Human
ucaaaaguauuuuccug

SEQ ID NO: 3715653 - RNA, 12 nt, Human
ucaaaagugccu

SEQ ID NO: 3715654 - RNA, 14 nt, Human
ucaaaaguuccaag

SEQ ID NO: 3715655 - RNA, 15 nt, Human
ucaaaaguuccaaga

SEQ ID NO: 3715656 - RNA, 17 nt, Human
ucaaaaguuccaagagu

SEQ ID NO: 3715657 - RNA, 22 nt, Human
ucaaaaguuccaagagucuaaa

SEQ ID NO: 3715658 - RNA, 12 nt, Human
ucaaaauaaaaa

SEQ ID NO: 3715659 - RNA, 20 nt, Human
ucaaaauaaaaagugacaca

SEQ ID NO: 3715660 - RNA, 23 nt, Human
ucaaaauaaaaagugacacagca

SEQ ID NO: 3715661 - RNA, 23 nt, Human
ucaaaauaccaugccauuuaaag

SEQ ID NO: 3715662 - RNA, 14 nt, Human
ucaaaauagaaaag

SEQ ID NO: 3715663 - RNA, 17 nt, Human
ucaaaauagguuuuuau

SEQ ID NO: 3715664 - RNA, 20 nt, Human
ucaaaauauaaaaugccaag

SEQ ID NO: 3715665 - RNA, 21 nt, Human
ucaaaauaugccccauucaac

SEQ ID NO: 3715666 - RNA, 15 nt, Human
ucaaaauauuacuca

SEQ ID NO: 3715667 - RNA, 13 nt, Human
ucaaaauauugag

SEQ ID NO: 3715668 - RNA, 22 nt, Human
ucaaaauauugagcagaauuca

SEQ ID NO: 3715669 - RNA, 19 nt, Human
ucaaaauauuuaaaaaugu

SEQ ID NO: 3715670 - RNA, 23 nt, Human
ucaaaauauuuaaaaaugucuug

SEQ ID NO: 3715671 - RNA, 17 nt, Human
ucaaaauauuuguacau

SEQ ID NO: 3715672 - RNA, 20 nt, Human
ucaaaauauuuuuaaaagau

SEQ ID NO: 3715673 - RNA, 19 nt, Human
ucaaaaucuagaagagucu

SEQ ID NO: 3715674 - RNA, 23 nt, Human
ucaaaaucucuccacuuucagcu

SEQ ID NO: 3715675 - RNA, 12 nt, Human
ucaaaaucuuuc

SEQ ID NO: 3715676 - RNA, 15 nt, Human
ucaaaaugacagcca

SEQ ID NO: 3715677 - RNA, 21 nt, Human
ucaaaaugauuuccucuguaa

SEQ ID NO: 3715678 - RNA, 22 nt, Human
ucaaaaugauuuccucuguaau

SEQ ID NO: 3715679 - RNA, 13 nt, Human
ucaaaaugcaaaa

SEQ ID NO: 3715680 - RNA, 22 nt, Human
ucaaaauguauauauuuagugc

SEQ ID NO: 3715681 - RNA, 22 nt, Human
ucaaaauuauaggagacuugua

SEQ ID NO: 3715682 - RNA, 16 nt, Human
ucaaaauuguuacaaa

SEQ ID NO: 3715683 - RNA, 19 nt, Human
ucaaaauuguuuaaaaauu

SEQ ID NO: 3715684 - RNA, 21 nt, Human
ucaaaauuuaacaguuaccug

SEQ ID NO: 3715685 - RNA, 16 nt, Human
ucaaaauuugaagaau

SEQ ID NO: 3715686 - RNA, 14 nt, Human
ucaaacaaagccag

SEQ ID NO: 3715687 - RNA, 21 nt, Human
ucaaacaaagccagaagcuga

SEQ ID NO: 3715688 - RNA, 19 nt, Human
ucaaacaaugacaaagcag

SEQ ID NO: 3715689 - RNA, 21 nt, Human
ucaaacaccaacauaaaaaug

SEQ ID NO: 3715690 - RNA, 13 nt, Human
ucaaacagucuca

SEQ ID NO: 3715691 - RNA, 20 nt, Human
ucaaacagucucaggaaauc

SEQ ID NO: 3715692 - RNA, 22 nt, Human
ucaaacagucucaggaaaucaa

SEQ ID NO: 3715693 - RNA, 17 nt, Human
ucaaacaugagaugugu

SEQ ID NO: 3715694 - RNA, 15 nt, Human
ucaaacauuaguacu

SEQ ID NO: 3715695 - RNA, 19 nt, Human
ucaaacauuaguacuuuau

SEQ ID NO: 3715696 - RNA, 12 nt, Human
ucaaacauuuug

SEQ ID NO: 3715697 - RNA, 17 nt, Human
ucaaacauuuugaaagu

SEQ ID NO: 3715698 - RNA, 18 nt, Human
ucaaacauuuugaaaguc

SEQ ID NO: 3715699 - RNA, 18 nt, Human
ucaaacccuagccuugcu

SEQ ID NO: 3715700 - RNA, 17 nt, Human
ucaaaccuccucuucug

SEQ ID NO: 3715701 - RNA, 17 nt, Human
ucaaaccuguuuaaaua

SEQ ID NO: 3715702 - RNA, 19 nt, Human
ucaaaccuguuuaaauauu

SEQ ID NO: 3715703 - RNA, 22 nt, Human
ucaaaccuguuuaaauauuuca

SEQ ID NO: 3715704 - RNA, 23 nt, Human
ucaaacggccucacuaggcuucu

SEQ ID NO: 3715705 - RNA, 16 nt, Human
ucaaacgugaaaaugc

SEQ ID NO: 3715706 - RNA, 14 nt, Human
ucaaacuaaaagac

SEQ ID NO: 3715707 - RNA, 17 nt, Human
ucaaacuaaaagacauu

SEQ ID NO: 3715708 - RNA, 13 nt, Human
ucaaacuaacagg

SEQ ID NO: 3715709 - RNA, 23 nt, Human
ucaaacucaaugcuuuauuugua

SEQ ID NO: 3715710 - RNA, 22 nt, Human
ucaaacuccaagguucccuugu

SEQ ID NO: 3715711 - RNA, 21 nt, Human
ucaaacuccugaccucaggca

SEQ ID NO: 3715712 - RNA, 14 nt, Human
ucaaacucuuaaaa

SEQ ID NO: 3715713 - RNA, 12 nt, Human
ucaaacugaaaa

SEQ ID NO: 3715714 - RNA, 23 nt, Human
ucaaacugaaugaaacccccaca

SEQ ID NO: 3715715 - RNA, 17 nt, Human
ucagagggggacugcug

SEQ ID NO: 3715716 - RNA, 21 nt, Human
ucagaguaauccaagcaaaug

SEQ ID NO: 3715717 - RNA, 22 nt, Human
ucagaguaauccaagcaaaugu

SEQ ID NO: 3715718 - RNA, 14 nt, Human
ucagaguagaaaua

SEQ ID NO: 3715719 - RNA, 15 nt, Human
ucagaguagaaauaa

SEQ ID NO: 3715720 - RNA, 22 nt, Human
ucagaguauauuguugaagaga

SEQ ID NO: 3715721 - RNA, 13 nt, Human
ucagaguccaggc

SEQ ID NO: 3715722 - RNA, 14 nt, Human
ucagaguccaggcc

SEQ ID NO: 3715723 - RNA, 18 nt, Human
ucagaguccuuaaaaugu

SEQ ID NO: 3715724 - RNA, 20 nt, Human
ucagaguucccaagaaagga

SEQ ID NO: 3715725 - RNA, 16 nt, Human
ucagaguucuuuuuga

SEQ ID NO: 3715726 - RNA, 22 nt, Human
ucagaguugaugguuguacaua

SEQ ID NO: 3715727 - RNA, 21 nt, Human
ucagaguugcugcaaaccuga

SEQ ID NO: 3715728 - RNA, 14 nt, Human
ucagauacaucacu

SEQ ID NO: 3715729 - RNA, 19 nt, Human
ucagauacaucacugcuug

SEQ ID NO: 3715730 - RNA, 14 nt, Human
ucagauacuggauu

SEQ ID NO: 3715731 - RNA, 17 nt, Human
ucagauagaaugacagu

SEQ ID NO: 3715732 - RNA, 21 nt, Human
ucagauaucuuggacaaauca

SEQ ID NO: 3715733 - RNA, 16 nt, Human
ucagauaugauucaaa

SEQ ID NO: 3715734 - RNA, 15 nt, Human
ucagauauucugcuc

SEQ ID NO: 3715735 - RNA, 13 nt, Human
ucagauauuugca

SEQ ID NO: 3715736 - RNA, 21 nt, Human
ucagauauuuuuucagaaaua

SEQ ID NO: 3715737 - RNA, 23 nt, Human
ucagauauuuuuucagaaauaug

SEQ ID NO: 3715738 - RNA, 15 nt, Human
ucagaucacuacugc

SEQ ID NO: 3715739 - RNA, 13 nt, Human
ucagaucagugcu

SEQ ID NO: 3715740 - RNA, 16 nt, Human
ucagauccaggagcuc

SEQ ID NO: 3715741 - RNA, 14 nt, Human
ucagauccuacccc

SEQ ID NO: 3715742 - RNA, 13 nt, Human
ucagauccuccuc

SEQ ID NO: 3715743 - RNA, 14 nt, Human
ucagauccuccuca

SEQ ID NO: 3715744 - RNA, 20 nt, Human
ucagauccugaucuuaagag

SEQ ID NO: 3715745 - RNA, 19 nt, Human
ucagauccuuguuucaaac

SEQ ID NO: 3715746 - RNA, 16 nt, Human
ucagaucucuaacuuc

SEQ ID NO: 3715747 - RNA, 13 nt, Human
ucagaucugucug

SEQ ID NO: 3715748 - RNA, 16 nt, Human
ucagaugagaacaaag

SEQ ID NO: 3715749 - RNA, 21 nt, Human
ucagaugagaacaaagcuguu

SEQ ID NO: 3715750 - RNA, 16 nt, Human
ucagaugcaguuugga

SEQ ID NO: 3715751 - RNA, 19 nt, Human
ucagaugccacuucuaaga

SEQ ID NO: 3715752 - RNA, 13 nt, Human
ucagaugcucaaa

SEQ ID NO: 3715753 - RNA, 19 nt, Human
ucagauggaaaauucauuu

SEQ ID NO: 3715754 - RNA, 18 nt, Human
ucagaugggaagacauga

SEQ ID NO: 3715755 - RNA, 22 nt, Human
ucagaugggaggaaagagagca

SEQ ID NO: 3715756 - RNA, 16 nt, Human
ucagauguaauguuuu

SEQ ID NO: 3715757 - RNA, 13 nt, Human
ucagaugucccuu

SEQ ID NO: 3715758 - RNA, 14 nt, Human
ucagaugucuucug

SEQ ID NO: 3715759 - RNA, 20 nt, Human
ucagaugucuucugccuguu

SEQ ID NO: 3715760 - RNA, 15 nt, Human
ucagauguggagcca

SEQ ID NO: 3715761 - RNA, 20 nt, Human
ucagauguggagccaggcgu

SEQ ID NO: 3715762 - RNA, 15 nt, Human
ucagauguuaaaaua

SEQ ID NO: 3715763 - RNA, 13 nt, Human
ucagauguuuaaa

SEQ ID NO: 3715764 - RNA, 16 nt, Human
ucagauucaggcauuu

SEQ ID NO: 3715765 - RNA, 15 nt, Human
ucagauuccuuuccc

SEQ ID NO: 3715766 - RNA, 14 nt, Human
ucagauugcaugug

SEQ ID NO: 3715767 - RNA, 16 nt, Human
ucagauugcaugugac

SEQ ID NO: 3715768 - RNA, 17 nt, Human
ucagauugcaugugacu

SEQ ID NO: 3715769 - RNA, 23 nt, Human
ucagauuguggaauguuggauaa

SEQ ID NO: 3715770 - RNA, 17 nt, Human
ucagauuuccagucucc

SEQ ID NO: 3715771 - RNA, 19 nt, Human
ucagauuucucuuugaaac

SEQ ID NO: 3715772 - RNA, 21 nt, Human
ucagauuugaacucuucaauc

SEQ ID NO: 3715773 - RNA, 20 nt, Human
ucagauuugcacaaaaagau

SEQ ID NO: 3715774 - RNA, 22 nt, Human
ucagauuugccuuauuggcagc

SEQ ID NO: 3715775 - RNA, 19 nt, Human
ucagauuuuaaaaagucuu

SEQ ID NO: 3715776 - RNA, 21 nt, Human
ucagauuuuaaaaagucuuca

SEQ ID NO: 3715777 - RNA, 13 nt, Human
ucagauuuuauua

SEQ ID NO: 3715778 - RNA, 22 nt, Human
ucagauuuuauuauguaaaucc

SEQ ID NO: 3715779 - RNA, 12 nt, Human
ucagauuuugau

SEQ ID NO: 3715780 - RNA, 21 nt, Human
ucagauuuugauaacuguuua

SEQ ID NO: 3715781 - RNA, 20 nt, Human
ucagcaaaaauauuuuauga

SEQ ID NO: 3715782 - RNA, 15 nt, Human
ucagcaaaagaugcu

SEQ ID NO: 3715783 - RNA, 15 nt, Human
ucagcaaagaaaaaa

SEQ ID NO: 3715784 - RNA, 18 nt, Human
ucagcaaagugguucccu

SEQ ID NO: 3715785 - RNA, 20 nt, Human
ucagcaaagugguucccucu

SEQ ID NO: 3715786 - RNA, 21 nt, Human
ucagcaaauuaauuggcagca

SEQ ID NO: 3715787 - RNA, 12 nt, Human
ucagcaagagaa

SEQ ID NO: 3715788 - RNA, 15 nt, Human
ucagcaagagagaac

SEQ ID NO: 3715789 - RNA, 16 nt, Human
ucagcaagagagaacc

SEQ ID NO: 3715790 - RNA, 15 nt, Human
ucagcaaggccaccu

SEQ ID NO: 3715791 - RNA, 18 nt, Human
ucagcaaggccaccucuu

SEQ ID NO: 3715792 - RNA, 23 nt, Human
ucagcaaggccaccucuuccugg

SEQ ID NO: 3715793 - RNA, 22 nt, Human
ucagcaaggcgcuaacuugcuu

SEQ ID NO: 3715794 - RNA, 19 nt, Human
ucagcaaguuagaacuagc

SEQ ID NO: 3715795 - RNA, 21 nt, Human
ucagcaaguuagaacuagcca

SEQ ID NO: 3715796 - RNA, 19 nt, Human
ucagcaauuuaacuagaca

SEQ ID NO: 3715797 - RNA, 13 nt, Human
ucagcacaaggcc

SEQ ID NO: 3715798 - RNA, 14 nt, Human
ucagcacaucucaa

SEQ ID NO: 3715799 - RNA, 16 nt, Human
ucagcacaucucaaca

SEQ ID NO: 3715800 - RNA, 20 nt, Human
ucagcacaucucaacaggcc

SEQ ID NO: 3715801 - RNA, 15 nt, Human
ucagcacgauuucug

SEQ ID NO: 3715802 - RNA, 19 nt, Human
ucagcacgauuucuguuua

SEQ ID NO: 3715803 - RNA, 11 nt, Human
ucagcacugaa

SEQ ID NO: 3715804 - RNA, 12 nt, Human
ucagcacugaaa

SEQ ID NO: 3715805 - RNA, 17 nt, Human
ucagcacugauuucaca

SEQ ID NO: 3715806 - RNA, 20 nt, Human
ucagcacugauuucacaaca

SEQ ID NO: 3715807 - RNA, 15 nt, Human
ucagcacugccugcu

SEQ ID NO: 3715808 - RNA, 18 nt, Human
ucagcacugccugcuccc

SEQ ID NO: 3715809 - RNA, 19 nt, Human
ucagcacuuggcccuucua

SEQ ID NO: 3715810 - RNA, 13 nt, Human
ucagcagacugau

SEQ ID NO: 3715811 - RNA, 22 nt, Human
ucagcagagugcuuuaccaauu

SEQ ID NO: 3715812 - RNA, 17 nt, Human
ucagcagccucccugaa

SEQ ID NO: 3715813 - RNA, 14 nt, Human
ucagcagcuagaaa

SEQ ID NO: 3715814 - RNA, 14 nt, Human
ucagcaggaagcaa

SEQ ID NO: 3715815 - RNA, 12 nt, Human
ucagcaggcagc

SEQ ID NO: 3715816 - RNA, 15 nt, Human
ucagcaggcagccuu

SEQ ID NO: 3715817 - RNA, 17 nt, Human
ucagcaguugcugguaa

SEQ ID NO: 3715818 - RNA, 19 nt, Human
ucagcaguugcugguaaaa

SEQ ID NO: 3715819 - RNA, 20 nt, Human
ucagcaguugcugguaaaau

SEQ ID NO: 3715820 - RNA, 17 nt, Human
ucagcauccuggcaccc

SEQ ID NO: 3715821 - RNA, 18 nt, Human
ucagcauccuggcacccg

SEQ ID NO: 3715822 - RNA, 13 nt, Human
ucagcaugaaaau

SEQ ID NO: 3715823 - RNA, 14 nt, Human
ucagcaugaauuug

SEQ ID NO: 3715824 - RNA, 15 nt, Human
ucagcaugaauuugu

SEQ ID NO: 3715825 - RNA, 20 nt, Human
ucagcauucuuagccugugg

SEQ ID NO: 3715826 - RNA, 22 nt, Human
ucagcauuucuuuucuggccaa

SEQ ID NO: 3715827 - RNA, 12 nt, Human
ucagcauuugac

SEQ ID NO: 3715828 - RNA, 22 nt, Human
ucagccaaauguaauugaauaa

SEQ ID NO: 3715829 - RNA, 23 nt, Human
ucagccaaauguaauugaauaaa

SEQ ID NO: 3715830 - RNA, 17 nt, Human
ucagccaaccuuacuua

SEQ ID NO: 3715831 - RNA, 22 nt, Human
ucagccaaccuuacuuacagca

SEQ ID NO: 3715832 - RNA, 21 nt, Human
ucagccaacgaguaauuuauu

SEQ ID NO: 3715833 - RNA, 20 nt, Human
ucagccaagcacaguggugg

SEQ ID NO: 3715834 - RNA, 13 nt, Human
ucagccaauuaug

SEQ ID NO: 3715835 - RNA, 15 nt, Human
ucagccaauuauguu

SEQ ID NO: 3715836 - RNA, 17 nt, Human
ucagccaauuauguuaa

SEQ ID NO: 3715837 - RNA, 18 nt, Human
ucagccaauuauguuaaa

SEQ ID NO: 3715838 - RNA, 15 nt, Human
ucagccacacccagg

SEQ ID NO: 3715839 - RNA, 12 nt, Human
ucagccagcacu

SEQ ID NO: 3715840 - RNA, 17 nt, Human
ucagccagccccaucag

SEQ ID NO: 3715841 - RNA, 13 nt, Human
ucagccagccucg

SEQ ID NO: 3715842 - RNA, 21 nt, Human
ucagccagccucgcccauccc

SEQ ID NO: 3715843 - RNA, 19 nt, Human
ucagccaggagcugggcag

SEQ ID NO: 3715844 - RNA, 18 nt, Human
ucagccaggagcugucac

SEQ ID NO: 3715845 - RNA, 19 nt, Human
ucagccaggagcugucacc

SEQ ID NO: 3715846 - RNA, 12 nt, Human
ucagccagggcc

SEQ ID NO: 3715847 - RNA, 18 nt, Human
ucagccagggccaggggu

SEQ ID NO: 3715848 - RNA, 21 nt, Human
ucagccaugaggaguugcugu

SEQ ID NO: 3715849 - RNA, 14 nt, Human
ucagccauguacag

SEQ ID NO: 3715850 - RNA, 14 nt, Human
ucagccauguauuu

SEQ ID NO: 3715851 - RNA, 14 nt, Human
ucagccaugugcug

SEQ ID NO: 3715852 - RNA, 21 nt, Human
ucagcccaaaccaccagaagc

SEQ ID NO: 3715853 - RNA, 16 nt, Human
ucagcccaagaugcuu

SEQ ID NO: 3715854 - RNA, 13 nt, Human
ucagcccaccccc

SEQ ID NO: 3715855 - RNA, 17 nt, Human
ucagcccaccccccuca

SEQ ID NO: 3715856 - RNA, 24 nt, Human
ucagcccagaagaaaauucuccug

SEQ ID NO: 3715857 - RNA, 16 nt, Human
ucagcccauauuucau

SEQ ID NO: 3715858 - RNA, 19 nt, Human
ucagcccccagccccuccc

SEQ ID NO: 3715859 - RNA, 12 nt, Human
ucagccccuccu

SEQ ID NO: 3715860 - RNA, 14 nt, Human
ucagccccuccucu

SEQ ID NO: 3715861 - RNA, 18 nt, Human
ucagccccuccucugcca

SEQ ID NO: 3715862 - RNA, 20 nt, Human
ucagccccuccucugccacc

SEQ ID NO: 3715863 - RNA, 22 nt, Human
ucagccccuccucugccaccuc

SEQ ID NO: 3715864 - RNA, 11 nt, Human
ucagccccucu

SEQ ID NO: 3715865 - RNA, 21 nt, Human
gccuuuuuccuagccuguuuc

SEQ ID NO: 3715866 - RNA, 15 nt, Human
gccuuuuuuccccag

SEQ ID NO: 3715867 - RNA, 16 nt, Human
gccuuuuuuccccaga

SEQ ID NO: 3715868 - RNA, 23 nt, Human
gccuuuuuucuguauaaaugucu

SEQ ID NO: 3715869 - RNA, 22 nt, Human
gcgaaaaaaucagguggcuuuu

SEQ ID NO: 3715870 - RNA, 23 nt, Human
gcgaaaaacucaaccaaauggua

SEQ ID NO: 3715871 - RNA, 11 nt, Human
gcgaaaauagu

SEQ ID NO: 3715872 - RNA, 19 nt, Human
gcgaaaauaguuuguuuaa

SEQ ID NO: 3715873 - RNA, 15 nt, Human
gcgaaccaauauuug

SEQ ID NO: 3715874 - RNA, 15 nt, Human
gcgaaggggcccugg

SEQ ID NO: 3715875 - RNA, 20 nt, Human
gcgaaguagcuugcucccug

SEQ ID NO: 3715876 - RNA, 17 nt, Human
gcgaaguccuauggaaa

SEQ ID NO: 3715877 - RNA, 21 nt, Human
gcgaauccaagcucccugccc

SEQ ID NO: 3715878 - RNA, 22 nt, Human
gcgaauggacuuuggaagcagg

SEQ ID NO: 3715879 - RNA, 20 nt, Human
gcgaaugguagucuaaccaa

SEQ ID NO: 3715880 - RNA, 13 nt, Human
gcgacaacagauu

SEQ ID NO: 3715881 - RNA, 12 nt, Human
gcgacaaugcaa

SEQ ID NO: 3715882 - RNA, 13 nt, Human
gcgacaaugcaaa

SEQ ID NO: 3715883 - RNA, 23 nt, Human
gcgacaaugcaaaccaucauuga

SEQ ID NO: 3715884 - RNA, 18 nt, Human
gcgacaggaguauuuuuu

SEQ ID NO: 3715885 - RNA, 16 nt, Human
gcgacauagcccaucc

SEQ ID NO: 3715886 - RNA, 18 nt, Human
gcgacauagcccaucccu

SEQ ID NO: 3715887 - RNA, 16 nt, Human
gcgaccaccccugccu

SEQ ID NO: 3715888 - RNA, 16 nt, Human
gcgaccccaucugccc

SEQ ID NO: 3715889 - RNA, 18 nt, Human
gcgaccccaucugcccag

SEQ ID NO: 3715890 - RNA, 21 nt, Human
gcgaccccaucugcccaggac

SEQ ID NO: 3715891 - RNA, 17 nt, Human
gcgaccccgucacagcc

SEQ ID NO: 3715892 - RNA, 23 nt, Human
gcgacccugggggcacaggaggc

SEQ ID NO: 3715893 - RNA, 14 nt, Human
gcgaccgcccccuc

SEQ ID NO: 3715894 - RNA, 15 nt, Human
gcgaccgcccccucc

SEQ ID NO: 3715895 - RNA, 22 nt, Human
gcgaccgcccuccgcgaaaaua

SEQ ID NO: 3715896 - RNA, 22 nt, Human
gcgaccuuccucauccacccca

SEQ ID NO: 3715897 - RNA, 16 nt, Human
gcgacggagagaaaaa

SEQ ID NO: 3715898 - RNA, 17 nt, Human
gcgacuaaacuagauuu

SEQ ID NO: 3715899 - RNA, 23 nt, Human
gcgacuaauuucaaaaugcuuuu

SEQ ID NO: 3715900 - RNA, 18 nt, Human
gcgacuccguuggccacu

SEQ ID NO: 3715901 - RNA, 14 nt, Human
gcgacuuucugccu

SEQ ID NO: 3715902 - RNA, 15 nt, Human
gcgagagaugugugu

SEQ ID NO: 3715903 - RNA, 22 nt, Human
gcgagagauguguguugauacu

SEQ ID NO: 3715904 - RNA, 16 nt, Human
gcgagagucugucuca

SEQ ID NO: 3715905 - RNA, 20 nt, Human
gcgagccauuugucccaagu

SEQ ID NO: 3715906 - RNA, 13 nt, Human
gcgagccugcuag

SEQ ID NO: 3715907 - RNA, 16 nt, Human
gcgaggaggcuccaga

SEQ ID NO: 3715908 - RNA, 13 nt, Human
gcgaggcaggccg

SEQ ID NO: 3715909 - RNA, 12 nt, Human
gcgagggcagcu

SEQ ID NO: 3715910 - RNA, 16 nt, Human
gcgagggcagcugcua

SEQ ID NO: 3715911 - RNA, 14 nt, Human
gcgaggggagggug

SEQ ID NO: 3715912 - RNA, 17 nt, Human
gcgaggucaacagagaa

SEQ ID NO: 3715913 - RNA, 23 nt, Human
gcgaggucaacagagaaggcagg

SEQ ID NO: 3715914 - RNA, 17 nt, Human
gcgaucauggcucacug

SEQ ID NO: 3715915 - RNA, 21 nt, Human
gcgaucauggcucacugcagc

SEQ ID NO: 3715916 - RNA, 16 nt, Human
gcgaucucggcucagu

SEQ ID NO: 3715917 - RNA, 17 nt, Human
gcgaucucuccacugug

SEQ ID NO: 3715918 - RNA, 13 nt, Human
gcgaugccagcca

SEQ ID NO: 3715919 - RNA, 14 nt, Human
gcgaugccagccaa

SEQ ID NO: 3715920 - RNA, 22 nt, Human
gcgaugggucagguagggggga

SEQ ID NO: 3715921 - RNA, 20 nt, Human
gcgauguggaacugcugcca

SEQ ID NO: 3715922 - RNA, 23 nt, Human
gcgauguggaacugcugccacug

SEQ ID NO: 3715923 - RNA, 23 nt, Human
gcgauguuucaggaggcuggagg

SEQ ID NO: 3715924 - RNA, 16 nt, Human
gcgauucccauugaaa

SEQ ID NO: 3715925 - RNA, 17 nt, Human
gcgauucuccugccuca

SEQ ID NO: 3715926 - RNA, 18 nt, Human
gcgauucucuugccucaa

SEQ ID NO: 3715927 - RNA, 13 nt, Human
gcgauucuucugc

SEQ ID NO: 3715928 - RNA, 15 nt, Human
gcgauuuuauuacug

SEQ ID NO: 3715929 - RNA, 13 nt, Human
gcgcaagccugua

SEQ ID NO: 3715930 - RNA, 17 nt, Human
gcgcacaaggcugacca

SEQ ID NO: 3715931 - RNA, 13 nt, Human
gcgcacacacaca

SEQ ID NO: 3715932 - RNA, 14 nt, Human
gcgcacagcugcuc

SEQ ID NO: 3715933 - RNA, 15 nt, Human
gcgcacccuccccuc

SEQ ID NO: 3715934 - RNA, 16 nt, Human
gcgcacccuccccucc

SEQ ID NO: 3715935 - RNA, 17 nt, Human
gcgcacccuccccuccc

SEQ ID NO: 3715936 - RNA, 15 nt, Human
gcgcaccgaaaaacu

SEQ ID NO: 3715937 - RNA, 17 nt, Human
gcgcaccugcccccugg

SEQ ID NO: 3715938 - RNA, 19 nt, Human
gcgcaccugcccccuggug

SEQ ID NO: 3715939 - RNA, 13 nt, Human
gcgcacugccucu

SEQ ID NO: 3715940 - RNA, 17 nt, Human
gcgcagcauccgaccag

SEQ ID NO: 3715941 - RNA, 19 nt, Human
gcgcaggccgugacgucug

SEQ ID NO: 3715942 - RNA, 18 nt, Human
gcgcaggcuggcccugcc

SEQ ID NO: 3715943 - RNA, 19 nt, Human
gcgcaggcuggcccugccc

SEQ ID NO: 3715944 - RNA, 20 nt, Human
gcgcaggcuggcccugcccu

SEQ ID NO: 3715945 - RNA, 21 nt, Human
gcgcaggcuggcccugcccug

SEQ ID NO: 3715946 - RNA, 14 nt, Human
gcgcagugccucug

SEQ ID NO: 3715947 - RNA, 15 nt, Human
gcgcagugccucugg

SEQ ID NO: 3715948 - RNA, 18 nt, Human
gcgcagugcuucucuaca

SEQ ID NO: 3715949 - RNA, 17 nt, Human
gcgcaguguuuugcaag

SEQ ID NO: 3715950 - RNA, 22 nt, Human
gcgcaguuuuuuuuuucuuguc

SEQ ID NO: 3715951 - RNA, 18 nt, Human
gcgcaucuugccuccagg

SEQ ID NO: 3715952 - RNA, 18 nt, Human
gcgccaaauaaugucucu

SEQ ID NO: 3715953 - RNA, 21 nt, Human
gcgccaagcaaccugggucca

SEQ ID NO: 3715954 - RNA, 14 nt, Human
gcgccacaggaccc

SEQ ID NO: 3715955 - RNA, 22 nt, Human
gcgccacuacacuccagccugg

SEQ ID NO: 3715956 - RNA, 19 nt, Human
gcgccacugcuccguggag

SEQ ID NO: 3715957 - RNA, 23 nt, Human
gcgccaguguaaucccccaggag

SEQ ID NO: 3715958 - RNA, 16 nt, Human
gcgcccaccccgcucu

SEQ ID NO: 3715959 - RNA, 16 nt, Human
gcgcccagccucaucu

SEQ ID NO: 3715960 - RNA, 14 nt, Human
gcgcccagcuccug

SEQ ID NO: 3715961 - RNA, 14 nt, Human
gcgccccccuccca

SEQ ID NO: 3715962 - RNA, 17 nt, Human
gcgccccccucccagag

SEQ ID NO: 3715963 - RNA, 18 nt, Human
gcgccccccucccagagg

SEQ ID NO: 3715964 - RNA, 21 nt, Human
gcgcccccuccgcccugccac

SEQ ID NO: 3715965 - RNA, 15 nt, Human
gcgcccgcugggcug

SEQ ID NO: 3715966 - RNA, 18 nt, Human
gcgcccugcagacccugc

SEQ ID NO: 3715967 - RNA, 15 nt, Human
gcgcccuggccccca

SEQ ID NO: 3715968 - RNA, 22 nt, Human
gcgcccuuaacugcauccagcc

SEQ ID NO: 3715969 - RNA, 14 nt, Human
gcgcccuuccucuc

SEQ ID NO: 3715970 - RNA, 20 nt, Human
gcgcccuuggcuucugugau

SEQ ID NO: 3715971 - RNA, 23 nt, Human
gcgcccuuuccccgacgcccacc

SEQ ID NO: 3715972 - RNA, 20 nt, Human
gcgccgagucugucucuguc

SEQ ID NO: 3715973 - RNA, 18 nt, Human
gcgccgcaaaccacacug

SEQ ID NO: 3715974 - RNA, 21 nt, Human
gcgccgcaaaccacacuggac

SEQ ID NO: 3715975 - RNA, 23 nt, Human
gcgccggcaaaacuuuggcacug

SEQ ID NO: 3715976 - RNA, 13 nt, Human
gcgccgucuccag

SEQ ID NO: 3715977 - RNA, 19 nt, Human
gcgccgugaguucucaggg

SEQ ID NO: 3715978 - RNA, 23 nt, Human
gcgccgugaguucucagggcucc

SEQ ID NO: 3715979 - RNA, 14 nt, Human
gcgccgugcugggc

SEQ ID NO: 3715980 - RNA, 20 nt, Human
gcgccgugcugggcagcccg

SEQ ID NO: 3715981 - RNA, 20 nt, Human
gcgccuacaggagugagcac

SEQ ID NO: 3715982 - RNA, 21 nt, Human
gcgccuacaggagugagcacu

SEQ ID NO: 3715983 - RNA, 21 nt, Human
gcgccucaacucugcugaggg

SEQ ID NO: 3715984 - RNA, 16 nt, Human
gcgccucccuccaccc

SEQ ID NO: 3715985 - RNA, 18 nt, Human
gcgccucccuccacccca

SEQ ID NO: 3715986 - RNA, 16 nt, Human
gcgccuggccuccagg

SEQ ID NO: 3715987 - RNA, 16 nt, Human
gcgccugugaugcugg

SEQ ID NO: 3715988 - RNA, 15 nt, Human
gcgccugugcacaca

SEQ ID NO: 3715989 - RNA, 17 nt, Human
gcgccugugcacacaca

SEQ ID NO: 3715990 - RNA, 21 nt, Human
gcgccuugucuccuacuccug

SEQ ID NO: 3715991 - RNA, 22 nt, Human
gcgccuugucuccuacuccuga

SEQ ID NO: 3715992 - RNA, 16 nt, Human
gcgccuuucccaacuc

SEQ ID NO: 3715993 - RNA, 20 nt, Human
gcgcgagggccucaaaggcc

SEQ ID NO: 3715994 - RNA, 14 nt, Human
gcgcgccccuagcc

SEQ ID NO: 3715995 - RNA, 15 nt, Human
gcgcggccagccccg

SEQ ID NO: 3715996 - RNA, 18 nt, Human
gcgcggcugggaggaggg

SEQ ID NO: 3715997 - RNA, 19 nt, Human
gcgcgugcaugugugcgug

SEQ ID NO: 3715998 - RNA, 15 nt, Human
gcgcuaacuugcuua

SEQ ID NO: 3715999 - RNA, 15 nt, Human
gcgcuaucucccugc

SEQ ID NO: 3716000 - RNA, 13 nt, Human
gcgcucagggcca

SEQ ID NO: 3716001 - RNA, 14 nt, Human
gcgcuccgggcuuu

SEQ ID NO: 3716002 - RNA, 20 nt, Human
gcgcuccugccgcagagcug

SEQ ID NO: 3716003 - RNA, 21 nt, Human
gcgcuccugccgcagagcugg

SEQ ID NO: 3716004 - RNA, 19 nt, Human
gcgcuccuggcccagccuu

SEQ ID NO: 3716005 - RNA, 16 nt, Human
gcgcucuagccugggc

SEQ ID NO: 3716006 - RNA, 11 nt, Human
gcgcugcaaau

SEQ ID NO: 3716007 - RNA, 18 nt, Human
gcgcugccccuggcagcc

SEQ ID NO: 3716008 - RNA, 17 nt, Human
gcgcugccgcaccccag

SEQ ID NO: 3716009 - RNA, 14 nt, Human
gcgcugccugugug

SEQ ID NO: 3716010 - RNA, 19 nt, Human
gcgcugccugugugguguc

SEQ ID NO: 3716011 - RNA, 11 nt, Human
gcgcuggccca

SEQ ID NO: 3716012 - RNA, 19 nt, Human
gcgcuggccgggaccccga

SEQ ID NO: 3716013 - RNA, 22 nt, Human
gcgcuguuuuuguugugugugc

SEQ ID NO: 3716014 - RNA, 19 nt, Human
ucaaacuggggccuccaga

SEQ ID NO: 3716015 - RNA, 22 nt, Human
ucaaacuggggccuccagaacu

SEQ ID NO: 3716016 - RNA, 17 nt, Human
ucaaacuguagaaauga

SEQ ID NO: 3716017 - RNA, 20 nt, Human
ucaaacuucuggcucccucu

SEQ ID NO: 3716018 - RNA, 12 nt, Human
ucaaacuuggau

SEQ ID NO: 3716019 - RNA, 13 nt, Human
ucaaacuuuacua

SEQ ID NO: 3716020 - RNA, 16 nt, Human
ucaaacuuuacuaugg

SEQ ID NO: 3716021 - RNA, 21 nt, Human
ucaaagaaagaaaguuuagaa

SEQ ID NO: 3716022 - RNA, 12 nt, Human
ucaaagaaagug

SEQ ID NO: 3716023 - RNA, 14 nt, Human
ucaaagaaagugua

SEQ ID NO: 3716024 - RNA, 15 nt, Human
ucaaagaaauauuaa

SEQ ID NO: 3716025 - RNA, 16 nt, Human
ucaaagaaggauggca

SEQ ID NO: 3716026 - RNA, 21 nt, Human
ucaaagaccuggggcugcugu

SEQ ID NO: 3716027 - RNA, 20 nt, Human
ucaaagagagaaaauaaaga

SEQ ID NO: 3716028 - RNA, 12 nt, Human
ucaaagaugcug

SEQ ID NO: 3716029 - RNA, 15 nt, Human
ucaaagcaaaagugc

SEQ ID NO: 3716030 - RNA, 16 nt, Human
ucaaagcaaaagugcu

SEQ ID NO: 3716031 - RNA, 15 nt, Human
ucaaagcaaaugucu

SEQ ID NO: 3716032 - RNA, 15 nt, Human
ucaaagcaagcauuc

SEQ ID NO: 3716033 - RNA, 19 nt, Human
ucaaagcaagcauucagaa

SEQ ID NO: 3716034 - RNA, 20 nt, Human
ucaaagcaaggaaacuaugu

SEQ ID NO: 3716035 - RNA, 16 nt, Human
ucaaagcaaugcauuu

SEQ ID NO: 3716036 - RNA, 21 nt, Human
ucaaagcaccaaaauaagaaa

SEQ ID NO: 3716037 - RNA, 20 nt, Human
ucaaagcauggacauuuaga

SEQ ID NO: 3716038 - RNA, 22 nt, Human
ucaaagcauggacauuuagaag

SEQ ID NO: 3716039 - RNA, 21 nt, Human
ucaaagcaugggauuauuaga

SEQ ID NO: 3716040 - RNA, 18 nt, Human
ucaaagccaaguuuauau

SEQ ID NO: 3716041 - RNA, 15 nt, Human
ucaaagccacauuau

SEQ ID NO: 3716042 - RNA, 17 nt, Human
ucaaagccacauuauuu

SEQ ID NO: 3716043 - RNA, 20 nt, Human
ucaaagccacauuauuucua

SEQ ID NO: 3716044 - RNA, 21 nt, Human
ucaaagccacauuauuucuag

SEQ ID NO: 3716045 - RNA, 17 nt, Human
ucaaagccccauuaacu

SEQ ID NO: 3716046 - RNA, 18 nt, Human
ucaaagccccauuaacug

SEQ ID NO: 3716047 - RNA, 20 nt, Human
ucaaagccccauuaacugcu

SEQ ID NO: 3716048 - RNA, 17 nt, Human
ucaaagcugaagccgcc

SEQ ID NO: 3716049 - RNA, 18 nt, Human
ucaaagcugccugucccu

SEQ ID NO: 3716050 - RNA, 21 nt, Human
ucaaagcuuggauuaaauaca

SEQ ID NO: 3716051 - RNA, 16 nt, Human
ucaaagcuuuuuccag

SEQ ID NO: 3716052 - RNA, 12 nt, Human
ucaaaggccaga

SEQ ID NO: 3716053 - RNA, 21 nt, Human
ucaaagguucuagguuucaaa

SEQ ID NO: 3716054 - RNA, 19 nt, Human
ucaaaguaaaacuugcugc

SEQ ID NO: 3716055 - RNA, 13 nt, Human
ucaaagucaaaaa

SEQ ID NO: 3716056 - RNA, 16 nt, Human
ucaaagucaugauguu

SEQ ID NO: 3716057 - RNA, 14 nt, Human
ucaaagugcuauua

SEQ ID NO: 3716058 - RNA, 19 nt, Human
ucaaaguguuuucucugaa

SEQ ID NO: 3716059 - RNA, 14 nt, Human
ucaaaguugaaaau

SEQ ID NO: 3716060 - RNA, 18 nt, Human
ucaaaguugaaaauucau

SEQ ID NO: 3716061 - RNA, 21 nt, Human
ucaaaguugccuaaauccauu

SEQ ID NO: 3716062 - RNA, 22 nt, Human
ucaaaguuuccuaaucagaaau

SEQ ID NO: 3716063 - RNA, 14 nt, Human
ucaaaguuuugaaa

SEQ ID NO: 3716064 - RNA, 17 nt, Human
ucaaaguuuugaaaagc

SEQ ID NO: 3716065 - RNA, 15 nt, Human
ucaaauaaaaauucu

SEQ ID NO: 3716066 - RNA, 15 nt, Human
gcuacucagaagccu

SEQ ID NO: 3716067 - RNA, 16 nt, Human
gcuacucagaagccug

SEQ ID NO: 3716068 - RNA, 11 nt, Human
gcuacucagca

SEQ ID NO: 3716069 - RNA, 12 nt, Human
gcuacucagcag

SEQ ID NO: 3716070 - RNA, 18 nt, Human
gcuacucagcagcccucc

SEQ ID NO: 3716071 - RNA, 23 nt, Human
gcuacucaggaggcugaggcaga

SEQ ID NO: 3716072 - RNA, 17 nt, Human
gcuacucgggaggcuga

SEQ ID NO: 3716073 - RNA, 23 nt, Human
gcuacucuccccacgagggcugg

SEQ ID NO: 3716074 - RNA, 15 nt, Human
gcuacucugugccag

SEQ ID NO: 3716075 - RNA, 20 nt, Human
gcuacucugugccagagccu

SEQ ID NO: 3716076 - RNA, 21 nt, Human
gcuacucugugccagagccug

SEQ ID NO: 3716077 - RNA, 16 nt, Human
gcuacugauuuuugug

SEQ ID NO: 3716078 - RNA, 20 nt, Human
gcuacugcacuccagccugg

SEQ ID NO: 3716079 - RNA, 18 nt, Human
gcuacugccgucagugcu

SEQ ID NO: 3716080 - RNA, 15 nt, Human
gcuacuggauucuua

SEQ ID NO: 3716081 - RNA, 18 nt, Human
gcuacuggggaaacuggc

SEQ ID NO: 3716082 - RNA, 20 nt, Human
gcuacuggggaaacuggcca

SEQ ID NO: 3716083 - RNA, 22 nt, Human
gcuacuguaauuuuauaugaag

SEQ ID NO: 3716084 - RNA, 19 nt, Human
gcuacugugugugugaaug

SEQ ID NO: 3716085 - RNA, 17 nt, Human
gcuacuuaauuccuuuc

SEQ ID NO: 3716086 - RNA, 21 nt, Human
gcuacuuaauuccuuucucau

SEQ ID NO: 3716087 - RNA, 23 nt, Human
gcuacuuaauuccuuucucaucc

SEQ ID NO: 3716088 - RNA, 20 nt, Human
gcuacuucccucacccacuu

SEQ ID NO: 3716089 - RNA, 18 nt, Human
gcuacuuccuccucccca

SEQ ID NO: 3716090 - RNA, 19 nt, Human
gcuacuuccuccuccccac

SEQ ID NO: 3716091 - RNA, 17 nt, Human
gcuacuuccugccuggu

SEQ ID NO: 3716092 - RNA, 11 nt, Human
gcuagaaaugg

SEQ ID NO: 3716093 - RNA, 18 nt, Human
gcuagaaccaagaagggc

SEQ ID NO: 3716094 - RNA, 20 nt, Human
gcuagaaccaagaagggcua

SEQ ID NO: 3716095 - RNA, 20 nt, Human
gcuagaaccuagaagggcua

SEQ ID NO: 3716096 - RNA, 20 nt, Human
gcuagaaccuguagagcuag

SEQ ID NO: 3716097 - RNA, 12 nt, Human
gcuagaacuccc

SEQ ID NO: 3716098 - RNA, 16 nt, Human
gcuagaacucccuuuc

SEQ ID NO: 3716099 - RNA, 19 nt, Human
gcuagaacucccuuucaac

SEQ ID NO: 3716100 - RNA, 10 nt, Human
gcuagaacuu

SEQ ID NO: 3716101 - RNA, 14 nt, Human
gcuagaacuuuuuu

SEQ ID NO: 3716102 - RNA, 19 nt, Human
gcuagaacuuuuuuaaaua

SEQ ID NO: 3716103 - RNA, 14 nt, Human
gcuagaagcuggag

SEQ ID NO: 3716104 - RNA, 15 nt, Human
gcuagaagcuggagg

SEQ ID NO: 3716105 - RNA, 15 nt, Human
gcuagaauacuuuuu

SEQ ID NO: 3716106 - RNA, 21 nt, Human
gcuagacgagcaggcuucuuc

SEQ ID NO: 3716107 - RNA, 13 nt, Human
gcuagacugguga

SEQ ID NO: 3716108 - RNA, 20 nt, Human
gcuagacuggugacugauuc

SEQ ID NO: 3716109 - RNA, 20 nt, Human
gcuagagauauggcagcgaa

SEQ ID NO: 3716110 - RNA, 13 nt, Human
gcuagagcuccuc

SEQ ID NO: 3716111 - RNA, 16 nt, Human
gcuagagcuccucccu

SEQ ID NO: 3716112 - RNA, 20 nt, Human
gcuagaggccagccccaccc

SEQ ID NO: 3716113 - RNA, 20 nt, Human
gcuagaggccauggaggcag

SEQ ID NO: 3716114 - RNA, 19 nt, Human
gcuagagguucaaagauau

SEQ ID NO: 3716115 - RNA, 21 nt, Human
gcuagagguucaaagauauuu

SEQ ID NO: 3716116 - RNA, 18 nt, Human
gcuagaguccucacuccc

SEQ ID NO: 3716117 - RNA, 19 nt, Human
gcuagaugggcauggggug

SEQ ID NO: 3716118 - RNA, 13 nt, Human
gcuagauguaugu

SEQ ID NO: 3716119 - RNA, 16 nt, Human
gcuagauguauguacu

SEQ ID NO: 3716120 - RNA, 18 nt, Human
gcuagauguauguacuuc

SEQ ID NO: 3716121 - RNA, 19 nt, Human
gcuagcaguaaaagaugaa

SEQ ID NO: 3716122 - RNA, 14 nt, Human
gcuagcaguggcag

SEQ ID NO: 3716123 - RNA, 15 nt, Human
gcuagcgcugccgca

SEQ ID NO: 3716124 - RNA, 14 nt, Human
gcuagcuagcucaa

SEQ ID NO: 3716125 - RNA, 17 nt, Human
gcuagcuagcucaacua

SEQ ID NO: 3716126 - RNA, 16 nt, Human
gcuagcuccccuccuc

SEQ ID NO: 3716127 - RNA, 16 nt, Human
gcuagcuuuuaggaaa

SEQ ID NO: 3716128 - RNA, 21 nt, Human
gcuagcuuuuaggaaaaucac

SEQ ID NO: 3716129 - RNA, 14 nt, Human
gcuaggaacaaauc

SEQ ID NO: 3716130 - RNA, 15 nt, Human
gcuaggaacacuccu

SEQ ID NO: 3716131 - RNA, 19 nt, Human
gcuaggaacacuccuucac

SEQ ID NO: 3716132 - RNA, 13 nt, Human
gcuaggaagaguc

SEQ ID NO: 3716133 - RNA, 16 nt, Human
gcuaggagcaaagccu

SEQ ID NO: 3716134 - RNA, 18 nt, Human
gcuaggagcaaagccugu

SEQ ID NO: 3716135 - RNA, 18 nt, Human
gcuaggauguugcucaga

SEQ ID NO: 3716136 - RNA, 19 nt, Human
gcuaggcagggugucugcc

SEQ ID NO: 3716137 - RNA, 16 nt, Human
gcuaggccagagccca

SEQ ID NO: 3716138 - RNA, 17 nt, Human
gcuaggccagagcccac

SEQ ID NO: 3716139 - RNA, 17 nt, Human
gcuaggccuggccagau

SEQ ID NO: 3716140 - RNA, 16 nt, Human
gcuaggcgagugccag

SEQ ID NO: 3716141 - RNA, 19 nt, Human
gcuaggcucgccuucccuc

SEQ ID NO: 3716142 - RNA, 21 nt, Human
gcuaggcucgccuucccuccu

SEQ ID NO: 3716143 - RNA, 22 nt, Human
gcuaggcucgccuucccuccug

SEQ ID NO: 3716144 - RNA, 23 nt, Human
gcuaggcucugucuggaagaugg

SEQ ID NO: 3716145 - RNA, 18 nt, Human
gcuagggaaacuucccgu

SEQ ID NO: 3716146 - RNA, 15 nt, Human
gcuaggguggcccuu

SEQ ID NO: 3716147 - RNA, 18 nt, Human
gcuaggguggggagagac

SEQ ID NO: 3716148 - RNA, 22 nt, Human
gcuaggugacauauacauacuu

SEQ ID NO: 3716149 - RNA, 19 nt, Human
gcuaggugcuaauuaauaa

SEQ ID NO: 3716150 - RNA, 19 nt, Human
gcuaggugggccagccccu

SEQ ID NO: 3716151 - RNA, 15 nt, Human
gcuaguauuugaauu

SEQ ID NO: 3716152 - RNA, 22 nt, Human
gcuaguauuugaauuaaaacuu

SEQ ID NO: 3716153 - RNA, 13 nt, Human
gcuagucaacagu

SEQ ID NO: 3716154 - RNA, 22 nt, Human
gcuagucaacaguacccugguu

SEQ ID NO: 3716155 - RNA, 23 nt, Human
gcuagucaagcuccuccucccug

SEQ ID NO: 3716156 - RNA, 14 nt, Human
gcuagucagagaga

SEQ ID NO: 3716157 - RNA, 15 nt, Human
gcuaguccuagugaa

SEQ ID NO: 3716158 - RNA, 16 nt, Human
gcuagucuuaagaacu

SEQ ID NO: 3716159 - RNA, 14 nt, Human
gcuagugacuugug

SEQ ID NO: 3716160 - RNA, 21 nt, Human
gcuaguugggcuuccucauag

SEQ ID NO: 3716161 - RNA, 15 nt, Human
gcuauaaauauauaa

SEQ ID NO: 3716162 - RNA, 18 nt, Human
gcuauaacaguagggaug

SEQ ID NO: 3716163 - RNA, 17 nt, Human
gcuauaccugugccucg

SEQ ID NO: 3716164 - RNA, 21 nt, Human
gcuauacugcauacuuuuuaa

SEQ ID NO: 3716165 - RNA, 16 nt, Human
gcuauagcuacaggaa

SEQ ID NO: 3716166 - RNA, 18 nt, Human
gcuauagcuacaggaagc

SEQ ID NO: 3716167 - RNA, 17 nt, Human
gcuauagcucaggaccu

SEQ ID NO: 3716168 - RNA, 19 nt, Human
gcuauaggcuggagaagcu

SEQ ID NO: 3716169 - RNA, 13 nt, Human
gcuauaggugcua

SEQ ID NO: 3716170 - RNA, 14 nt, Human
gcuauaguauuuga

SEQ ID NO: 3716171 - RNA, 17 nt, Human
gcuauauaagacaagaa

SEQ ID NO: 3716172 - RNA, 14 nt, Human
gcuauauauaaaac

SEQ ID NO: 3716173 - RNA, 14 nt, Human
gcuauauauauaaa

SEQ ID NO: 3716174 - RNA, 16 nt, Human
gcuauauauauaaaua

SEQ ID NO: 3716175 - RNA, 19 nt, Human
gcuauauauauaaauauuu

SEQ ID NO: 3716176 - RNA, 19 nt, Human
gcuauauccauguacugua

SEQ ID NO: 3716177 - RNA, 15 nt, Human
gcuauaucuauauau

SEQ ID NO: 3716178 - RNA, 19 nt, Human
gcuauauugcccaggcugg

SEQ ID NO: 3716179 - RNA, 23 nt, Human
gcuauauuuucaugacuuuucca

SEQ ID NO: 3716180 - RNA, 20 nt, Human
gcuaucaaaauaaauugaaa

SEQ ID NO: 3716181 - RNA, 23 nt, Human
gcuaucaaaauaaauugaaauau

SEQ ID NO: 3716182 - RNA, 23 nt, Human
gcuauccccaucucccugccugg

SEQ ID NO: 3716183 - RNA, 15 nt, Human
gcuauccuggcucuu

SEQ ID NO: 3716184 - RNA, 16 nt, Human
gcuaucguaaaauuaa

SEQ ID NO: 3716185 - RNA, 16 nt, Human
gcuaucucccccagcc

SEQ ID NO: 3716186 - RNA, 18 nt, Human
gcuaucucccccagcccc

SEQ ID NO: 3716187 - RNA, 23 nt, Human
gcuaucucucagugaacugugag

SEQ ID NO: 3716188 - RNA, 16 nt, Human
gcuaucucugugugca

SEQ ID NO: 3716189 - RNA, 12 nt, Human
gcuaucuuaauu

SEQ ID NO: 3716190 - RNA, 15 nt, Human
gcuaucuuaauuuug

SEQ ID NO: 3716191 - RNA, 11 nt, Human
gcuaugacuua

SEQ ID NO: 3716192 - RNA, 17 nt, Human
gcuaugagcuggggaug

SEQ ID NO: 3716193 - RNA, 17 nt, Human
gcuaugaucgcgccacu

SEQ ID NO: 3716194 - RNA, 13 nt, Human
gcuaugcuugaau

SEQ ID NO: 3716195 - RNA, 22 nt, Human
gcuauggauuuucuaaggaaga

SEQ ID NO: 3716196 - RNA, 17 nt, Human
gcuaugggagccccagg

SEQ ID NO: 3716197 - RNA, 21 nt, Human
gcuauggggauagaugugugg

SEQ ID NO: 3716198 - RNA, 16 nt, Human
gcuauggugagaugca

SEQ ID NO: 3716199 - RNA, 16 nt, Human
gcuauguauaaaauac

SEQ ID NO: 3716200 - RNA, 15 nt, Human
gcuaugucaguacua

SEQ ID NO: 3716201 - RNA, 12 nt, Human
gcuaugucauuu

SEQ ID NO: 3716202 - RNA, 11 nt, Human
gcuaugugacu

SEQ ID NO: 3716203 - RNA, 19 nt, Human
gcuauguuuugacauuuuu

SEQ ID NO: 3716204 - RNA, 12 nt, Human
gcuauuaaaaaa

SEQ ID NO: 3716205 - RNA, 16 nt, Human
gcuauuaaaaaagucu

SEQ ID NO: 3716206 - RNA, 13 nt, Human
ucauaaauucaaa

SEQ ID NO: 3716207 - RNA, 16 nt, Human
ucauaacagugccauu

SEQ ID NO: 3716208 - RNA, 20 nt, Human
ucauaacagugccauugucu

SEQ ID NO: 3716209 - RNA, 22 nt, Human
ucauaacagugccauugucuuu

SEQ ID NO: 3716210 - RNA, 23 nt, Human
ucauaacagugccauugucuuua

SEQ ID NO: 3716211 - RNA, 14 nt, Human
ucauaacggaucag

SEQ ID NO: 3716212 - RNA, 22 nt, Human
ucauaacggaucagaaauacag

SEQ ID NO: 3716213 - RNA, 23 nt, Human
ucauaacggaucagaaauacaga

SEQ ID NO: 3716214 - RNA, 13 nt, Human
ucauaacuagaac

SEQ ID NO: 3716215 - RNA, 15 nt, Human
ucauaacuagaacug

SEQ ID NO: 3716216 - RNA, 11 nt, Human
ucauaacuuau

SEQ ID NO: 3716217 - RNA, 15 nt, Human
ucauaacuuauugcu

SEQ ID NO: 3716218 - RNA, 18 nt, Human
ucauaacuuauugcugau

SEQ ID NO: 3716219 - RNA, 17 nt, Human
ucauaacuuccuguacu

SEQ ID NO: 3716220 - RNA, 17 nt, Human
ucauaacuuucauuaaa

SEQ ID NO: 3716221 - RNA, 19 nt, Human
ucauaagacuuugggauag

SEQ ID NO: 3716222 - RNA, 16 nt, Human
ucauaagauauuuuau

SEQ ID NO: 3716223 - RNA, 18 nt, Human
ucauaagauauuuuucau

SEQ ID NO: 3716224 - RNA, 21 nt, Human
ucauaagauauuuuucaugau

SEQ ID NO: 3716225 - RNA, 15 nt, Human
ucauaagccaauuuu

SEQ ID NO: 3716226 - RNA, 14 nt, Human
ucauaaggcuucaa

SEQ ID NO: 3716227 - RNA, 20 nt, Human
ucauaaggcuucaaaauguu

SEQ ID NO: 3716228 - RNA, 15 nt, Human
ucauaaguauuucaa

SEQ ID NO: 3716229 - RNA, 20 nt, Human
ucauaaguauuucaaauugg

SEQ ID NO: 3716230 - RNA, 19 nt, Human
ucauaauaaauaucuguac

SEQ ID NO: 3716231 - RNA, 15 nt, Human
ucauaaucuuugcuu

SEQ ID NO: 3716232 - RNA, 13 nt, Human
ucauaaugacuua

SEQ ID NO: 3716233 - RNA, 19 nt, Human
ucauaauggggguaaaguu

SEQ ID NO: 3716234 - RNA, 13 nt, Human
ucauaaugugaag

SEQ ID NO: 3716235 - RNA, 15 nt, Human
ucauaaugugaagug

SEQ ID NO: 3716236 - RNA, 19 nt, Human
ucauaauugcauugacuuu

SEQ ID NO: 3716237 - RNA, 19 nt, Human
ucauaauuuguuuccagca

SEQ ID NO: 3716238 - RNA, 13 nt, Human
ucauacacagaaa

SEQ ID NO: 3716239 - RNA, 11 nt, Human
ucauacagaga

SEQ ID NO: 3716240 - RNA, 12 nt, Human
ucauacagagaa

SEQ ID NO: 3716241 - RNA, 13 nt, Human
ucauacagagaag

SEQ ID NO: 3716242 - RNA, 17 nt, Human
ucauacagagaagucac

SEQ ID NO: 3716243 - RNA, 16 nt, Human
ucauacauuguacgaa

SEQ ID NO: 3716244 - RNA, 21 nt, Human
ucauacauuuucuaagaaaca

SEQ ID NO: 3716245 - RNA, 15 nt, Human
ucauacccaccccca

SEQ ID NO: 3716246 - RNA, 18 nt, Human
ucauaccuaaguacugua

SEQ ID NO: 3716247 - RNA, 16 nt, Human
ucauaccuacauguau

SEQ ID NO: 3716248 - RNA, 21 nt, Human
ucauacuacugaaacagauuu

SEQ ID NO: 3716249 - RNA, 16 nt, Human
ucauacuccuaugcuu

SEQ ID NO: 3716250 - RNA, 16 nt, Human
ucauacucgagucuga

SEQ ID NO: 3716251 - RNA, 14 nt, Human
ucauacucuagauu

SEQ ID NO: 3716252 - RNA, 14 nt, Human
ucauacugaugugu

SEQ ID NO: 3716253 - RNA, 17 nt, Human
ucauacugugcuggagc

SEQ ID NO: 3716254 - RNA, 15 nt, Human
ucauacuugaacguu

SEQ ID NO: 3716255 - RNA, 19 nt, Human
ucauacuugaacguuuucu

SEQ ID NO: 3716256 - RNA, 22 nt, Human
ucauagaaauaguuugagaaau

SEQ ID NO: 3716257 - RNA, 22 nt, Human
ucauagaaauguaacuuuugua

SEQ ID NO: 3716258 - RNA, 23 nt, Human
ucauagaaauguaacuuuuguaa

SEQ ID NO: 3716259 - RNA, 12 nt, Human
ucauagaagaac

SEQ ID NO: 3716260 - RNA, 12 nt, Human
ucauagaauagc

SEQ ID NO: 3716261 - RNA, 18 nt, Human
ucauagaauagcauguug

SEQ ID NO: 3716262 - RNA, 16 nt, Human
ucauagacccucucaa

SEQ ID NO: 3716263 - RNA, 19 nt, Human
ucauagauuucugauuuua

SEQ ID NO: 3716264 - RNA, 23 nt, Human
ucauagauuucugauuuuaugua

SEQ ID NO: 3716265 - RNA, 19 nt, Human
ucauagcauuaacuaaucu

SEQ ID NO: 3716266 - RNA, 13 nt, Human
ucauagcauucac

SEQ ID NO: 3716267 - RNA, 20 nt, Human
ucauagcauugucuauuuuu

SEQ ID NO: 3716268 - RNA, 22 nt, Human
ucauagcccaguagaccuuguu

SEQ ID NO: 3716269 - RNA, 12 nt, Human
ucauagcuaaga

SEQ ID NO: 3716270 - RNA, 20 nt, Human
ucauaggaagggaccaaggc

SEQ ID NO: 3716271 - RNA, 21 nt, Human
ucauaggaagggaccaaggca

SEQ ID NO: 3716272 - RNA, 19 nt, Human
ucauagggaagaccugcug

SEQ ID NO: 3716273 - RNA, 15 nt, Human
ucauaggucugaaau

SEQ ID NO: 3716274 - RNA, 14 nt, Human
ucauagguuaaaaa

SEQ ID NO: 3716275 - RNA, 15 nt, Human
ucauagguuaaaaaa

SEQ ID NO: 3716276 - RNA, 23 nt, Human
ucauagguuaaaaaaaaaaguca

SEQ ID NO: 3716277 - RNA, 16 nt, Human
ucauagguugccaaua

SEQ ID NO: 3716278 - RNA, 18 nt, Human
ucauaguaacuucuuaug

SEQ ID NO: 3716279 - RNA, 22 nt, Human
ucauaguaguuuuuacagcugu

SEQ ID NO: 3716280 - RNA, 20 nt, Human
ucauaguauccauauuuuau

SEQ ID NO: 3716281 - RNA, 15 nt, Human
ucauaguaugguggc

SEQ ID NO: 3716282 - RNA, 15 nt, Human
ucauaguuaaauguu

SEQ ID NO: 3716283 - RNA, 15 nt, Human
ucauaguuacugugu

SEQ ID NO: 3716284 - RNA, 20 nt, Human
ucauaguuacuguguaaacu

SEQ ID NO: 3716285 - RNA, 21 nt, Human
ucauaguuacuguguaaacuc

SEQ ID NO: 3716286 - RNA, 21 nt, Human
ucauaguuauuguuucugguc

SEQ ID NO: 3716287 - RNA, 13 nt, Human
ucauaguucagaa

SEQ ID NO: 3716288 - RNA, 14 nt, Human
ucauaguucagaau

SEQ ID NO: 3716289 - RNA, 13 nt, Human
ucauaguuuaauu

SEQ ID NO: 3716290 - RNA, 15 nt, Human
ucauauaauaaaugu

SEQ ID NO: 3716291 - RNA, 16 nt, Human
ucauauaauuauaugu

SEQ ID NO: 3716292 - RNA, 15 nt, Human
ucauauacugccaug

SEQ ID NO: 3716293 - RNA, 20 nt, Human
ucauauaguuagcuaauaaa

SEQ ID NO: 3716294 - RNA, 14 nt, Human
ucauauauauacau

SEQ ID NO: 3716295 - RNA, 14 nt, Human
ucauauauaucuau

SEQ ID NO: 3716296 - RNA, 22 nt, Human
ucauauauggggggccaacacc

SEQ ID NO: 3716297 - RNA, 20 nt, Human
ucauauauuaaacauccaca

SEQ ID NO: 3716298 - RNA, 16 nt, Human
ucauaucauccacaca

SEQ ID NO: 3716299 - RNA, 13 nt, Human
ucauaucauuucu

SEQ ID NO: 3716300 - RNA, 15 nt, Human
ucauaucuucacaau

SEQ ID NO: 3716301 - RNA, 12 nt, Human
ucauaugaaaaa

SEQ ID NO: 3716302 - RNA, 20 nt, Human
ucauaugaaaggugccaugg

SEQ ID NO: 3716303 - RNA, 20 nt, Human
ucauaugacauucaugccug

SEQ ID NO: 3716304 - RNA, 15 nt, Human
ucauaugauucugcu

SEQ ID NO: 3716305 - RNA, 19 nt, Human
ucauaugauucugcuuuua

SEQ ID NO: 3716306 - RNA, 13 nt, Human
ucauaugcauauu

SEQ ID NO: 3716307 - RNA, 16 nt, Human
ucauauguaaucucua

SEQ ID NO: 3716308 - RNA, 22 nt, Human
ucauauguaaucucuaggaagu

SEQ ID NO: 3716309 - RNA, 22 nt, Human
ucauauguaccauguacaugaa

SEQ ID NO: 3716310 - RNA, 15 nt, Human
ucauaugugaucugu

SEQ ID NO: 3716311 - RNA, 19 nt, Human
ucauauguugcucagucuc

SEQ ID NO: 3716312 - RNA, 20 nt, Human
ucauauguugcucagucucc

SEQ ID NO: 3716313 - RNA, 14 nt, Human
ucauauuaagaaug

SEQ ID NO: 3716314 - RNA, 19 nt, Human
ucauauuaauauauuucca

SEQ ID NO: 3716315 - RNA, 13 nt, Human
ucauauuacaaua

SEQ ID NO: 3716316 - RNA, 15 nt, Human
ucauauuacaauauu

SEQ ID NO: 3716317 - RNA, 13 nt, Human
ucauauuagacuu

SEQ ID NO: 3716318 - RNA, 12 nt, Human
ucauauuauaca

SEQ ID NO: 3716319 - RNA, 15 nt, Human
ucauauucagcuugc

SEQ ID NO: 3716320 - RNA, 14 nt, Human
ucauauucaugcaa

SEQ ID NO: 3716321 - RNA, 18 nt, Human
ucauauucuaaaaccauu

SEQ ID NO: 3716322 - RNA, 14 nt, Human
ucauauugaauaua

SEQ ID NO: 3716323 - RNA, 19 nt, Human
ucauauugaauguuuccaa

SEQ ID NO: 3716324 - RNA, 18 nt, Human
ucauauugaugaaaagau

SEQ ID NO: 3716325 - RNA, 19 nt, Human
ucauauugaugaaaagauu

SEQ ID NO: 3716326 - RNA, 21 nt, Human
ucauauugaugaaaagauuua

SEQ ID NO: 3716327 - RNA, 21 nt, Human
ucauauugugauucugccuuu

SEQ ID NO: 3716328 - RNA, 20 nt, Human
ucauauugugccaauaugua

SEQ ID NO: 3716329 - RNA, 22 nt, Human
ucauauugugccaauauguauu

SEQ ID NO: 3716330 - RNA, 14 nt, Human
ucauauuguuuccu

SEQ ID NO: 3716331 - RNA, 16 nt, Human
ucauauuuacuucuua

SEQ ID NO: 3716332 - RNA, 21 nt, Human
ucauauuuacuucuuauacau

SEQ ID NO: 3716333 - RNA, 19 nt, Human
ucauauuucccaugauuuc

SEQ ID NO: 3716334 - RNA, 22 nt, Human
ucauauuucuuaucaccacagu

SEQ ID NO: 3716335 - RNA, 14 nt, Human
ucauauuuguacuu

SEQ ID NO: 3716336 - RNA, 16 nt, Human
ucauauuuuaauuuca

SEQ ID NO: 3716337 - RNA, 21 nt, Human
ucauauuuuaauuucaagcuu

SEQ ID NO: 3716338 - RNA, 15 nt, Human
ucauauuuuguauau

SEQ ID NO: 3716339 - RNA, 17 nt, Human
ucaucaaagaacaaaca

SEQ ID NO: 3716340 - RNA, 19 nt, Human
ucaucaaauggaagacaca

SEQ ID NO: 3716341 - RNA, 13 nt, Human
ucaucaacaagau

SEQ ID NO: 3716342 - RNA, 22 nt, Human
ucaucaacugaaugaggucagc

SEQ ID NO: 3716343 - RNA, 13 nt, Human
ucaucaagaaggg

SEQ ID NO: 3716344 - RNA, 21 nt, Human
ucaucaagaagggcugcauga

SEQ ID NO: 3716345 - RNA, 17 nt, Human
ucaucaaggcacugccu

SEQ ID NO: 3716346 - RNA, 23 nt, Human
ucaucaaucaaauaaguauuuau

SEQ ID NO: 3716347 - RNA, 24 nt, Human
ucaucaauugaauggucagcguug

SEQ ID NO: 3716348 - RNA, 23 nt, Human
ucaucacaagaacacacacauau

SEQ ID NO: 3716349 - RNA, 16 nt, Human
ucaucacacacaugga

SEQ ID NO: 3716350 - RNA, 14 nt, Human
ucaucacacugggu

SEQ ID NO: 3716351 - RNA, 14 nt, Human
ucaucacuccccuc

SEQ ID NO: 3716352 - RNA, 16 nt, Human
ucaucacuccccucca

SEQ ID NO: 3716353 - RNA, 18 nt, Human
ucaucagaacagcuguug

SEQ ID NO: 3716354 - RNA, 22 nt, Human
ucaucagaugcuugcggcaaaa

SEQ ID NO: 3716355 - RNA, 15 nt, Human
ucaucagauggaaau

SEQ ID NO: 3716356 - RNA, 22 nt, Human
ucaauugcaucucccagauaau

SEQ ID NO: 3716357 - RNA, 13 nt, Human
ucaauuuaaaaaa

SEQ ID NO: 3716358 - RNA, 19 nt, Human
ucaauuuauaccucaauuu

SEQ ID NO: 3716359 - RNA, 14 nt, Human
ucaauuuauuugaa

SEQ ID NO: 3716360 - RNA, 16 nt, Human
ucaauuuauuugaaug

SEQ ID NO: 3716361 - RNA, 13 nt, Human
ucaauuucaggcu

SEQ ID NO: 3716362 - RNA, 15 nt, Human
ucaauuucugaacac

SEQ ID NO: 3716363 - RNA, 16 nt, Human
ucaauuugauguggug

SEQ ID NO: 3716364 - RNA, 13 nt, Human
ucaauuugucauu

SEQ ID NO: 3716365 - RNA, 14 nt, Human
ucaauuugucauuu

SEQ ID NO: 3716366 - RNA, 15 nt, Human
ucaauuugucauuuu

SEQ ID NO: 3716367 - RNA, 17 nt, Human
ucaauuugucauuuuga

SEQ ID NO: 3716368 - RNA, 15 nt, Human
ucaauuuuaaacaua

SEQ ID NO: 3716369 - RNA, 13 nt, Human
ucaauuuuaaaga

SEQ ID NO: 3716370 - RNA, 22 nt, Human
ucaauuuuaucccucaccugua

SEQ ID NO: 3716371 - RNA, 16 nt, Human
ucaauuuucacugugu

SEQ ID NO: 3716372 - RNA, 14 nt, Human
ucaauuuucuuuaa

SEQ ID NO: 3716373 - RNA, 13 nt, Human
ucaauuuugacuu

SEQ ID NO: 3716374 - RNA, 20 nt, Human
ucaauuuuucuuauuucauu

SEQ ID NO: 3716375 - RNA, 14 nt, Human
ucacaaaaaagaag

SEQ ID NO: 3716376 - RNA, 20 nt, Human
ucacaaaauauauuuuguuu

SEQ ID NO: 3716377 - RNA, 19 nt, Human
ucacaaacuucauuucaga

SEQ ID NO: 3716378 - RNA, 15 nt, Human
ucacaaagcccaagg

SEQ ID NO: 3716379 - RNA, 21 nt, Human
ucacaaaggaauggaggcucu

SEQ ID NO: 3716380 - RNA, 12 nt, Human
ucacaaauaaua

SEQ ID NO: 3716381 - RNA, 13 nt, Human
ucacaaauaauag

SEQ ID NO: 3716382 - RNA, 17 nt, Human
ucacaaauauuaaaaag

SEQ ID NO: 3716383 - RNA, 18 nt, Human
ucacaaauauuaaaaagu

SEQ ID NO: 3716384 - RNA, 23 nt, Human
ucacaaauauuaaaaagucuuuu

SEQ ID NO: 3716385 - RNA, 13 nt, Human
ucacaaaugacuu

SEQ ID NO: 3716386 - RNA, 18 nt, Human
ucacaaaugacuuuauua

SEQ ID NO: 3716387 - RNA, 20 nt, Human
ucacaaaugacuuuauuauu

SEQ ID NO: 3716388 - RNA, 12 nt, Human
ucacaacagauc

SEQ ID NO: 3716389 - RNA, 16 nt, Human
ucacaaccugaaccua

SEQ ID NO: 3716390 - RNA, 17 nt, Human
ucacaacgugcauugug

SEQ ID NO: 3716391 - RNA, 17 nt, Human
ucacaagacccaaaagg

SEQ ID NO: 3716392 - RNA, 23 nt, Human
ucacaagauggaauuuaucaaac

SEQ ID NO: 3716393 - RNA, 14 nt, Human
ucacaagcugccuc

SEQ ID NO: 3716394 - RNA, 16 nt, Human
ucacaagcugccuccc

SEQ ID NO: 3716395 - RNA, 22 nt, Human
ucacaagcugccucccugucca

SEQ ID NO: 3716396 - RNA, 16 nt, Human
ucacaaggcagcaagg

SEQ ID NO: 3716397 - RNA, 22 nt, Human
ucacaaggcagcaaggcccgag

SEQ ID NO: 3716398 - RNA, 20 nt, Human
ucacaagggacgcuuuggga

SEQ ID NO: 3716399 - RNA, 20 nt, Human
ucacaaguggguacccccag

SEQ ID NO: 3716400 - RNA, 22 nt, Human
ucacaaguggguacccccagga

SEQ ID NO: 3716401 - RNA, 16 nt, Human
ucacaauaauuuucua

SEQ ID NO: 3716402 - RNA, 13 nt, Human
ucacaauacuguu

SEQ ID NO: 3716403 - RNA, 15 nt, Human
ucacaaugagauuga

SEQ ID NO: 3716404 - RNA, 19 nt, Human
ucacaaugucaguauuuca

SEQ ID NO: 3716405 - RNA, 13 nt, Human
ucacacaaagcag

SEQ ID NO: 3716406 - RNA, 19 nt, Human
ucacacaauacaauaaguu

SEQ ID NO: 3716407 - RNA, 24 nt, Human
ucacacacacaaaaaaugcacaaa

SEQ ID NO: 3716408 - RNA, 14 nt, Human
ucacacacagacug

SEQ ID NO: 3716409 - RNA, 20 nt, Human
ucacacacaggcaacugagg

SEQ ID NO: 3716410 - RNA, 21 nt, Human
ucacacacaggcaacugaggc

SEQ ID NO: 3716411 - RNA, 13 nt, Human
ucacacacgugag

SEQ ID NO: 3716412 - RNA, 14 nt, Human
ucacacagacacua

SEQ ID NO: 3716413 - RNA, 19 nt, Human
ucacacagccaggugccuu

SEQ ID NO: 3716414 - RNA, 23 nt, Human
ucacacaggcauuuccugggugg

SEQ ID NO: 3716415 - RNA, 23 nt, Human
ucacacagugggugguggaucug

SEQ ID NO: 3716416 - RNA, 14 nt, Human
ucacacauccagac

SEQ ID NO: 3716417 - RNA, 19 nt, Human
ucacacauccagacaucau

SEQ ID NO: 3716418 - RNA, 21 nt, Human
ucacacaugagcaucaggcca

SEQ ID NO: 3716419 - RNA, 14 nt, Human
ucacacauuugccu

SEQ ID NO: 3716420 - RNA, 11 nt, Human
ucacaccagcc

SEQ ID NO: 3716421 - RNA, 13 nt, Human
ucacaccagccau

SEQ ID NO: 3716422 - RNA, 24 nt, Human
ucacacccaccguccgcccugcuc

SEQ ID NO: 3716423 - RNA, 18 nt, Human
ucacaccccaccugcgcu

SEQ ID NO: 3716424 - RNA, 20 nt, Human
ucacaccccaccugcgcuuc

SEQ ID NO: 3716425 - RNA, 20 nt, Human
ucacaccuagcgucaguauu

SEQ ID NO: 3716426 - RNA, 20 nt, Human
ucacaccugacucugaaauc

SEQ ID NO: 3716427 - RNA, 19 nt, Human
ucacacgaggggccccgug

SEQ ID NO: 3716428 - RNA, 13 nt, Human
ucacacuauuuua

SEQ ID NO: 3716429 - RNA, 21 nt, Human
ucacacucaguugugacuaac

SEQ ID NO: 3716430 - RNA, 16 nt, Human
ucacacucgacaugaa

SEQ ID NO: 3716431 - RNA, 18 nt, Human
ucacacucuaacuguaua

SEQ ID NO: 3716432 - RNA, 16 nt, Human
ucacacucucacaugu

SEQ ID NO: 3716433 - RNA, 23 nt, Human
ucacacugggugguggccugguc

SEQ ID NO: 3716434 - RNA, 18 nt, Human
ucacacuggucugcuguc

SEQ ID NO: 3716435 - RNA, 15 nt, Human
ucacacugguucuca

SEQ ID NO: 3716436 - RNA, 20 nt, Human
ucacacuuacuguaagacau

SEQ ID NO: 3716437 - RNA, 21 nt, Human
ucacacuuacuguaagacauu

SEQ ID NO: 3716438 - RNA, 22 nt, Human
ucacacuuacuguaagacauua

SEQ ID NO: 3716439 - RNA, 19 nt, Human
ucacacuuccaccagccug

SEQ ID NO: 3716440 - RNA, 22 nt, Human
ucacacuucugugagaccccca

SEQ ID NO: 3716441 - RNA, 21 nt, Human
ucacagaacccuuggagccaa

SEQ ID NO: 3716442 - RNA, 21 nt, Human
ucacagacaggaccccugcag

SEQ ID NO: 3716443 - RNA, 17 nt, Human
ucacagaccuggagccc

SEQ ID NO: 3716444 - RNA, 15 nt, Human
ucacagagcagaguc

SEQ ID NO: 3716445 - RNA, 19 nt, Human
ucacagagucaaggccugc

SEQ ID NO: 3716446 - RNA, 15 nt, Human
ucacagaugggugcu

SEQ ID NO: 3716447 - RNA, 17 nt, Human
ucacagcacaugcuggc

SEQ ID NO: 3716448 - RNA, 19 nt, Human
ucacagcacaugcuggcca

SEQ ID NO: 3716449 - RNA, 20 nt, Human
ucacagcacaugcuggccag

SEQ ID NO: 3716450 - RNA, 21 nt, Human
ucacagcacaugcuggccagc

SEQ ID NO: 3716451 - RNA, 23 nt, Human
ucacagcagugagacuggggcca

SEQ ID NO: 3716452 - RNA, 12 nt, Human
ucacagccucug

SEQ ID NO: 3716453 - RNA, 20 nt, Human
ucacagccucugaccccucc

SEQ ID NO: 3716454 - RNA, 11 nt, Human
ucacagcuccu

SEQ ID NO: 3716455 - RNA, 16 nt, Human
ucacagcuccucccac

SEQ ID NO: 3716456 - RNA, 22 nt, Human
ucacagcuuauuuccucauuuu

SEQ ID NO: 3716457 - RNA, 16 nt, Human
ucacaggacucugccu

SEQ ID NO: 3716458 - RNA, 19 nt, Human
ucacaggacucugccuccu

SEQ ID NO: 3716459 - RNA, 12 nt, Human
ucacaggcagcc

SEQ ID NO: 3716460 - RNA, 15 nt, Human
ucacaggcaggucca

SEQ ID NO: 3716461 - RNA, 12 nt, Human
ucacaggcuaau

SEQ ID NO: 3716462 - RNA, 18 nt, Human
ucacagggcagagccggg

SEQ ID NO: 3716463 - RNA, 18 nt, Human
ucacagggcaguaccuga

SEQ ID NO: 3716464 - RNA, 14 nt, Human
ucacagggccaacu

SEQ ID NO: 3716465 - RNA, 22 nt, Human
ucacagggccaacuugagggcc

SEQ ID NO: 3716466 - RNA, 16 nt, Human
ucacagggccccagaa

SEQ ID NO: 3716467 - RNA, 17 nt, Human
ucacagggccccagaag

SEQ ID NO: 3716468 - RNA, 23 nt, Human
ucacagggccccagaaggcaggg

SEQ ID NO: 3716469 - RNA, 12 nt, Human
ucacaggguggg

SEQ ID NO: 3716470 - RNA, 15 nt, Human
ucacagggugggccu

SEQ ID NO: 3716471 - RNA, 16 nt, Human
ucacaggguugggccc

SEQ ID NO: 3716472 - RNA, 20 nt, Human
ucacagguuggaagagaauc

SEQ ID NO: 3716473 - RNA, 16 nt, Human
ucacaguaaaaauaaa

SEQ ID NO: 3716474 - RNA, 17 nt, Human
ucacaguacagcaugug

SEQ ID NO: 3716475 - RNA, 14 nt, Human
ucacaguagagcca

SEQ ID NO: 3716476 - RNA, 18 nt, Human
ucacaguagagccagcuu

SEQ ID NO: 3716477 - RNA, 20 nt, Human
ucacaguagagccagcuugg

SEQ ID NO: 3716478 - RNA, 19 nt, Human
ucacagucacaugcuugau

SEQ ID NO: 3716479 - RNA, 15 nt, Human
ucacagucccacugu

SEQ ID NO: 3716480 - RNA, 17 nt, Human
ucacagucccacugugc

SEQ ID NO: 3716481 - RNA, 22 nt, Human
ucacaguccuuaccagcagagc

SEQ ID NO: 3716482 - RNA, 16 nt, Human
ucacagucuaauuuuu

SEQ ID NO: 3716483 - RNA, 19 nt, Human
ucacagucucuuuaaucuu

SEQ ID NO: 3716484 - RNA, 21 nt, Human
ucacagucucuuuaaucuuca

SEQ ID NO: 3716485 - RNA, 23 nt, Human
ucacagucucuuuaaucuucagu

SEQ ID NO: 3716486 - RNA, 17 nt, Human
ucacagugcucuuuucu

SEQ ID NO: 3716487 - RNA, 14 nt, Human
ucacagugcugugu

SEQ ID NO: 3716488 - RNA, 16 nt, Human
ucacagugugauuuug

SEQ ID NO: 3716489 - RNA, 13 nt, Human
ucacaguguguuu

SEQ ID NO: 3716490 - RNA, 11 nt, Human
ucacaguguuu

SEQ ID NO: 3716491 - RNA, 18 nt, Human
ucacaguguuugcaaugg

SEQ ID NO: 3716492 - RNA, 22 nt, Human
ucacaguuacccuaaacucucu

SEQ ID NO: 3716493 - RNA, 23 nt, Human
ucacaguucaaaauucuaaaugu

SEQ ID NO: 3716494 - RNA, 20 nt, Human
ucacaguuccucgcccuggg

SEQ ID NO: 3716495 - RNA, 22 nt, Human
ucacaguuccucgcccuggguc

SEQ ID NO: 3716496 - RNA, 16 nt, Human
ucacaguucucuccuu

SEQ ID NO: 3716497 - RNA, 20 nt, Human
ucacaguucucuccuucuuc

SEQ ID NO: 3716498 - RNA, 19 nt, Human
ucacaguucuuugggccag

SEQ ID NO: 3716499 - RNA, 22 nt, Human
ucacaguucuuugggccagaca

SEQ ID NO: 3716500 - RNA, 13 nt, Human
ucacaguugacaa

SEQ ID NO: 3716501 - RNA, 19 nt, Human
ucacaguuuuuccuggaau

SEQ ID NO: 3716502 - RNA, 18 nt, Human
ucacauaaaugcagccca

SEQ ID NO: 3716503 - RNA, 15 nt, Human
ucacauacccucccc

SEQ ID NO: 3716504 - RNA, 17 nt, Human
ucacauagagugaucuu

SEQ ID NO: 3716505 - RNA, 14 nt, Human
ucaucaggaugaac

SEQ ID NO: 3716506 - RNA, 12 nt, Human
ucaucagggccu

SEQ ID NO: 3716507 - RNA, 14 nt, Human
ucaucagggccugg

SEQ ID NO: 3716508 - RNA, 23 nt, Human
ucaucaguauugaagcauuuuau

SEQ ID NO: 3716509 - RNA, 13 nt, Human
ucaucauaaaaua

SEQ ID NO: 3716510 - RNA, 14 nt, Human
ucaucauaaaauaa

SEQ ID NO: 3716511 - RNA, 14 nt, Human
ucaucauauuauac

SEQ ID NO: 3716512 - RNA, 14 nt, Human
ucaucaucagagcc

SEQ ID NO: 3716513 - RNA, 14 nt, Human
ucaucaucagggcc

SEQ ID NO: 3716514 - RNA, 15 nt, Human
ucaucaucagggccu

SEQ ID NO: 3716515 - RNA, 17 nt, Human
ucaucaucauggccagc

SEQ ID NO: 3716516 - RNA, 16 nt, Human
ucaucaugauaauuca

SEQ ID NO: 3716517 - RNA, 13 nt, Human
ucaucaugcagcu

SEQ ID NO: 3716518 - RNA, 17 nt, Human
ucaucauggccagcugg

SEQ ID NO: 3716519 - RNA, 22 nt, Human
ucaucauggccagcuggaggca

SEQ ID NO: 3716520 - RNA, 15 nt, Human
ucaucauguuuugau

SEQ ID NO: 3716521 - RNA, 13 nt, Human
ucaucauuauuau

SEQ ID NO: 3716522 - RNA, 22 nt, Human
ucaucauucacuucacugugcu

SEQ ID NO: 3716523 - RNA, 17 nt, Human
ucaucauuccuugagaa

SEQ ID NO: 3716524 - RNA, 18 nt, Human
ucaucauucucugucuca

SEQ ID NO: 3716525 - RNA, 19 nt, Human
ucaucauuguauauaugug

SEQ ID NO: 3716526 - RNA, 12 nt, Human
ucaucauuguuu

SEQ ID NO: 3716527 - RNA, 22 nt, Human
ucaucauuguuucugcaugaau

SEQ ID NO: 3716528 - RNA, 19 nt, Human
ucauccaaacaauuuaaaa

SEQ ID NO: 3716529 - RNA, 15 nt, Human
ucauccacauuguuu

SEQ ID NO: 3716530 - RNA, 20 nt, Human
ucauccacuagugcaaauca

SEQ ID NO: 3716531 - RNA, 21 nt, Human
ucauccacuagugcaaaucau

SEQ ID NO: 3716532 - RNA, 20 nt, Human
ucauccaggcccaacuguga

SEQ ID NO: 3716533 - RNA, 15 nt, Human
ucauccauaacugaa

SEQ ID NO: 3716534 - RNA, 11 nt, Human
ucauccaucau

SEQ ID NO: 3716535 - RNA, 12 nt, Human
ucauccaucauc

SEQ ID NO: 3716536 - RNA, 14 nt, Human
ucauccaucaucau

SEQ ID NO: 3716537 - RNA, 15 nt, Human
ucauccaucaucaug

SEQ ID NO: 3716538 - RNA, 16 nt, Human
ucauccaucaucaugu

SEQ ID NO: 3716539 - RNA, 13 nt, Human
ucauccauccagg

SEQ ID NO: 3716540 - RNA, 23 nt, Human
ucaucccaaaggacagccgccug

SEQ ID NO: 3716541 - RNA, 16 nt, Human
ucaucccaacugucuu

SEQ ID NO: 3716542 - RNA, 13 nt, Human
ucaucccagcugc

SEQ ID NO: 3716543 - RNA, 22 nt, Human
ucaucccaucuaagcugcagcu

SEQ ID NO: 3716544 - RNA, 23 nt, Human
ucaucccauuccaggcagccucu

SEQ ID NO: 3716545 - RNA, 14 nt, Human
ucaucccauugucu

SEQ ID NO: 3716546 - RNA, 21 nt, Human
ucauccccaggggucccagcc

SEQ ID NO: 3716547 - RNA, 14 nt, Human
ucauccccucagaa

SEQ ID NO: 3716548 - RNA, 23 nt, Human
ucaucccgagcaccuccacaucc

SEQ ID NO: 3716549 - RNA, 13 nt, Human
ucaucccuuucca

SEQ ID NO: 3716550 - RNA, 17 nt, Human
ucauccggcagccugga

SEQ ID NO: 3716551 - RNA, 15 nt, Human
ucauccuaagcuauu

SEQ ID NO: 3716552 - RNA, 14 nt, Human
ucauccucaaagaa

SEQ ID NO: 3716553 - RNA, 21 nt, Human
ucauccucaaagaaaguguau

SEQ ID NO: 3716554 - RNA, 13 nt, Human
ucauccuccucag

SEQ ID NO: 3716555 - RNA, 19 nt, Human
ucauccuccucagaucuuc

SEQ ID NO: 3716556 - RNA, 16 nt, Human
ucauccuccuggaacc

SEQ ID NO: 3716557 - RNA, 23 nt, Human
ucauccuccuggaaccuugcugu

SEQ ID NO: 3716558 - RNA, 17 nt, Human
ucauccugacucugccc

SEQ ID NO: 3716559 - RNA, 13 nt, Human
ucauccugcaggc

SEQ ID NO: 3716560 - RNA, 15 nt, Human
ucauccugccuucau

SEQ ID NO: 3716561 - RNA, 17 nt, Human
ucauccugccuucaugg

SEQ ID NO: 3716562 - RNA, 11 nt, Human
ucauccuggcu

SEQ ID NO: 3716563 - RNA, 17 nt, Human
ucauccuuggucuuugu

SEQ ID NO: 3716564 - RNA, 21 nt, Human
ucauccuuggucuuuguaucu

SEQ ID NO: 3716565 - RNA, 14 nt, Human
ucauccuugucuua

SEQ ID NO: 3716566 - RNA, 23 nt, Human
ucauccuuucacuucuuucccuu

SEQ ID NO: 3716567 - RNA, 16 nt, Human
ucauccuuuccagcau

SEQ ID NO: 3716568 - RNA, 17 nt, Human
ucauccuuuccagcaug

SEQ ID NO: 3716569 - RNA, 19 nt, Human
ucauccuuuucuccuaucu

SEQ ID NO: 3716570 - RNA, 14 nt, Human
ucaucgaaucuacu

SEQ ID NO: 3716571 - RNA, 17 nt, Human
ucaucgccagacaacug

SEQ ID NO: 3716572 - RNA, 23 nt, Human
ucaucgcucguguguucuaucca

SEQ ID NO: 3716573 - RNA, 22 nt, Human
ucaucggagucagccaggagcu

SEQ ID NO: 3716574 - RNA, 15 nt, Human
ucaucggcuuucccc

SEQ ID NO: 3716575 - RNA, 19 nt, Human
ucaucgggaauacuaggga

SEQ ID NO: 3716576 - RNA, 22 nt, Human
ucaucuaccauuuucugguucu

SEQ ID NO: 3716577 - RNA, 16 nt, Human
ucaucuaccuuuucuc

SEQ ID NO: 3716578 - RNA, 17 nt, Human
ucaucuaccuuuucucu

SEQ ID NO: 3716579 - RNA, 20 nt, Human
ucaucuacucauuuaaagua

SEQ ID NO: 3716580 - RNA, 13 nt, Human
ucaucuaggauuu

SEQ ID NO: 3716581 - RNA, 13 nt, Human
ucaucuauaaaga

SEQ ID NO: 3716582 - RNA, 23 nt, Human
ucaucuauaaagaagaacuugca

SEQ ID NO: 3716583 - RNA, 17 nt, Human
ucaucuaugaggaaagg

SEQ ID NO: 3716584 - RNA, 21 nt, Human
ucaucuauucaagcacuuaca

SEQ ID NO: 3716585 - RNA, 18 nt, Human
ucaucucagcucacugca

SEQ ID NO: 3716586 - RNA, 16 nt, Human
ucaucucagguagaag

SEQ ID NO: 3716587 - RNA, 22 nt, Human
ucaucucagugaagaauacuuc

SEQ ID NO: 3716588 - RNA, 22 nt, Human
ucaucucauuuaagggaaaaau

SEQ ID NO: 3716589 - RNA, 17 nt, Human
ucaucuccaucagcugu

SEQ ID NO: 3716590 - RNA, 15 nt, Human
ucaucuccugccuuc

SEQ ID NO: 3716591 - RNA, 22 nt, Human
ucaucucuagggaccagaacca

SEQ ID NO: 3716592 - RNA, 23 nt, Human
ucaucucuccuccaagacacugu

SEQ ID NO: 3716593 - RNA, 14 nt, Human
ucaucucuguccca

SEQ ID NO: 3716594 - RNA, 14 nt, Human
ucaucucuuagcuc

SEQ ID NO: 3716595 - RNA, 19 nt, Human
ucaucucuuagcuccccuc

SEQ ID NO: 3716596 - RNA, 14 nt, Human
ucaucucuucuuuu

SEQ ID NO: 3716597 - RNA, 14 nt, Human
ucaucugaaauguu

SEQ ID NO: 3716598 - RNA, 13 nt, Human
ucaucugaagggg

SEQ ID NO: 3716599 - RNA, 22 nt, Human
ucaucugaauuugcccugggaa

SEQ ID NO: 3716600 - RNA, 15 nt, Human
ucaucugagaaugaa

SEQ ID NO: 3716601 - RNA, 16 nt, Human
ucaucugagaaugaac

SEQ ID NO: 3716602 - RNA, 18 nt, Human
ucaucugaggcauccagc

SEQ ID NO: 3716603 - RNA, 12 nt, Human
ucaucugcaaaa

SEQ ID NO: 3716604 - RNA, 13 nt, Human
ucaucugcaaaag

SEQ ID NO: 3716605 - RNA, 21 nt, Human
ucaucugcacccuucuuuucu

SEQ ID NO: 3716606 - RNA, 22 nt, Human
ucaucugcacccuucuuuucuc

SEQ ID NO: 3716607 - RNA, 13 nt, Human
ucaucugccgugc

SEQ ID NO: 3716608 - RNA, 14 nt, Human
ucaucugcucuccu

SEQ ID NO: 3716609 - RNA, 16 nt, Human
ucaucugcucuccuuc

SEQ ID NO: 3716610 - RNA, 21 nt, Human
ucaucugcucuccuuccugga

SEQ ID NO: 3716611 - RNA, 12 nt, Human
ucaucuggaacc

SEQ ID NO: 3716612 - RNA, 13 nt, Human
ucaucuggaacca

SEQ ID NO: 3716613 - RNA, 20 nt, Human
ucaucuggaguucucaaaga

SEQ ID NO: 3716614 - RNA, 22 nt, Human
ucaucuggauaggagccugcug

SEQ ID NO: 3716615 - RNA, 12 nt, Human
ucaucugggaaa

SEQ ID NO: 3716616 - RNA, 18 nt, Human
ucaucugggaaagacauc

SEQ ID NO: 3716617 - RNA, 21 nt, Human
ucaucuggggagcaggcagcc

SEQ ID NO: 3716618 - RNA, 18 nt, Human
ucaucugggggaguggaa

SEQ ID NO: 3716619 - RNA, 20 nt, Human
ucaucugggggaguggaaua

SEQ ID NO: 3716620 - RNA, 20 nt, Human
ucaucugguugaacucuggu

SEQ ID NO: 3716621 - RNA, 11 nt, Human
ucaucuguaag

SEQ ID NO: 3716622 - RNA, 13 nt, Human
ucaucuguagaua

SEQ ID NO: 3716623 - RNA, 17 nt, Human
ucaucugugugaaaaug

SEQ ID NO: 3716624 - RNA, 19 nt, Human
ucaucugugugaaaauggg

SEQ ID NO: 3716625 - RNA, 15 nt, Human
ucaucuguuacacaa

SEQ ID NO: 3716626 - RNA, 16 nt, Human
ucaucuguuagggccu

SEQ ID NO: 3716627 - RNA, 19 nt, Human
ucaucuguuagggccuugg

SEQ ID NO: 3716628 - RNA, 12 nt, Human
ucaucuuacugu

SEQ ID NO: 3716629 - RNA, 20 nt, Human
ucaucuucaguugucucuga

SEQ ID NO: 3716630 - RNA, 19 nt, Human
ucaucuucucagcucccau

SEQ ID NO: 3716631 - RNA, 13 nt, Human
ucaucuucucugg

SEQ ID NO: 3716632 - RNA, 16 nt, Human
ucaucuucuucaccau

SEQ ID NO: 3716633 - RNA, 22 nt, Human
ucaucuugaccaagcaggaagc

SEQ ID NO: 3716634 - RNA, 22 nt, Human
ucaucuugcuaccaguauuuag

SEQ ID NO: 3716635 - RNA, 22 nt, Human
ucaucuugguacuacuagaugu

SEQ ID NO: 3716636 - RNA, 13 nt, Human
ucaucuugugaaa

SEQ ID NO: 3716637 - RNA, 15 nt, Human
ucaucuugugaaaug

SEQ ID NO: 3716638 - RNA, 15 nt, Human
ucaucuuguguuuua

SEQ ID NO: 3716639 - RNA, 15 nt, Human
ucaucuuucccuccu

SEQ ID NO: 3716640 - RNA, 19 nt, Human
ucaucuuucccuccuuggu

SEQ ID NO: 3716641 - RNA, 13 nt, Human
ucaucuuucuuga

SEQ ID NO: 3716642 - RNA, 14 nt, Human
ucaucuuugugaag

SEQ ID NO: 3716643 - RNA, 16 nt, Human
ucaugaaagauucaau

SEQ ID NO: 3716644 - RNA, 22 nt, Human
ucaugaaaguagacaguuuuga

SEQ ID NO: 3716645 - RNA, 21 nt, Human
ucaugaaaugcuaugucauuu

SEQ ID NO: 3716646 - RNA, 15 nt, Human
ucaugaaauuacccu

SEQ ID NO: 3716647 - RNA, 12 nt, Human
ucaugaacacau

SEQ ID NO: 3716648 - RNA, 23 nt, Human
ucaugaacauguuccugaauucu

SEQ ID NO: 3716649 - RNA, 22 nt, Human
ucaugaaccucaagcugcaucu

SEQ ID NO: 3716650 - RNA, 15 nt, Human
ucaugaacuucgcau

SEQ ID NO: 3716651 - RNA, 21 nt, Human
ucaugaacuucgcaucaaaag

SEQ ID NO: 3716652 - RNA, 19 nt, Human
ucaugaagauauuuuucca

SEQ ID NO: 3716653 - RNA, 12 nt, Human
ucaugaagccca

SEQ ID NO: 3716654 - RNA, 13 nt, Human
ucaugaagcccaa

SEQ ID NO: 3716655 - RNA, 21 nt, Human
ucaugaauaacugauuaguaa

SEQ ID NO: 3716656 - RNA, 18 nt, Human
gcuauuaaaacucuuuua

SEQ ID NO: 3716657 - RNA, 15 nt, Human
gcuauuaauauuugu

SEQ ID NO: 3716658 - RNA, 23 nt, Human
gcuauuacuaaggaguaaucugu

SEQ ID NO: 3716659 - RNA, 19 nt, Human
gcuauuccagcuguccccc

SEQ ID NO: 3716660 - RNA, 19 nt, Human
gcuauuccuuucccuuccu

SEQ ID NO: 3716661 - RNA, 22 nt, Human
gcuauugauauaaauaaaacau

SEQ ID NO: 3716662 - RNA, 16 nt, Human
gcuauuggaggaucag

SEQ ID NO: 3716663 - RNA, 16 nt, Human
gcuauuguaaauaugu

SEQ ID NO: 3716664 - RNA, 16 nt, Human
gcuauugucaccaggg

SEQ ID NO: 3716665 - RNA, 20 nt, Human
gcuauugucaccagggcugg

SEQ ID NO: 3716666 - RNA, 21 nt, Human
gcuauugucaccagggcugga

SEQ ID NO: 3716667 - RNA, 13 nt, Human
gcuauuuaaaacu

SEQ ID NO: 3716668 - RNA, 15 nt, Human
gcuauuuauuuuccu

SEQ ID NO: 3716669 - RNA, 14 nt, Human
gcuauuucaucuau

SEQ ID NO: 3716670 - RNA, 17 nt, Human
gcuauuuccauuccaga

SEQ ID NO: 3716671 - RNA, 16 nt, Human
gcuauuucccaagcug

SEQ ID NO: 3716672 - RNA, 11 nt, Human
gcuauuucuau

SEQ ID NO: 3716673 - RNA, 15 nt, Human
gcuauuucuauauuu

SEQ ID NO: 3716674 - RNA, 18 nt, Human
gcuauuucuauauuuuca

SEQ ID NO: 3716675 - RNA, 19 nt, Human
gcuauuugauguaauacuu

SEQ ID NO: 3716676 - RNA, 17 nt, Human
gcuauuugcaauuccug

SEQ ID NO: 3716677 - RNA, 17 nt, Human
gcuauuuguaaaucugc

SEQ ID NO: 3716678 - RNA, 14 nt, Human
gcuauuugucaucu

SEQ ID NO: 3716679 - RNA, 16 nt, Human
gcuauuuuacugucuu

SEQ ID NO: 3716680 - RNA, 18 nt, Human
gcuauuuuacugucuuaa

SEQ ID NO: 3716681 - RNA, 18 nt, Human
gcuauuuucuaaagacuu

SEQ ID NO: 3716682 - RNA, 22 nt, Human
gcuauuuucuaaagacuuguau

SEQ ID NO: 3716683 - RNA, 22 nt, Human
gcuauuuuuauuuguuugugca

SEQ ID NO: 3716684 - RNA, 16 nt, Human
gcuauuuuuguaaagu

SEQ ID NO: 3716685 - RNA, 20 nt, Human
gcuauuuuuguaaaguuucc

SEQ ID NO: 3716686 - RNA, 23 nt, Human
gcucaaacaaugacaaagcagau

SEQ ID NO: 3716687 - RNA, 21 nt, Human
gcucaaaggcacagugaaggc

SEQ ID NO: 3716688 - RNA, 15 nt, Human
gcucaaaugaaaugu

SEQ ID NO: 3716689 - RNA, 19 nt, Human
gcucaagcaggaaguucaa

SEQ ID NO: 3716690 - RNA, 22 nt, Human
gcucaagcagucuacccaccuc

SEQ ID NO: 3716691 - RNA, 16 nt, Human
gcucaagcccaggagg

SEQ ID NO: 3716692 - RNA, 13 nt, Human
gcucaaggaaagg

SEQ ID NO: 3716693 - RNA, 15 nt, Human
gcucaagggacaagg

SEQ ID NO: 3716694 - RNA, 14 nt, Human
gcucaauaaagauu

SEQ ID NO: 3716695 - RNA, 23 nt, Human
gcucaauagauugcucaaaucag

SEQ ID NO: 3716696 - RNA, 19 nt, Human
gcucaauauuccugaauga

SEQ ID NO: 3716697 - RNA, 21 nt, Human
gcucaauauuccugaaugaaa

SEQ ID NO: 3716698 - RNA, 14 nt, Human
gcucaauccucuaa

SEQ ID NO: 3716699 - RNA, 16 nt, Human
gcucaauccucuaagc

SEQ ID NO: 3716700 - RNA, 14 nt, Human
gcucacaaaccaug

SEQ ID NO: 3716701 - RNA, 13 nt, Human
gcucacaaggcag

SEQ ID NO: 3716702 - RNA, 15 nt, Human
gcucacacaugagau

SEQ ID NO: 3716703 - RNA, 13 nt, Human
gcucacaccugua

SEQ ID NO: 3716704 - RNA, 21 nt, Human
gcucacacgggguauuuuagg

SEQ ID NO: 3716705 - RNA, 13 nt, Human
gcucacacugaga

SEQ ID NO: 3716706 - RNA, 15 nt, Human
gcucacaguacagca

SEQ ID NO: 3716707 - RNA, 16 nt, Human
gcucacaguuccucgc

SEQ ID NO: 3716708 - RNA, 16 nt, Human
gcucacauaucuguca

SEQ ID NO: 3716709 - RNA, 12 nt, Human
gcucaccagccc

SEQ ID NO: 3716710 - RNA, 18 nt, Human
gcucaccagccccagugc

SEQ ID NO: 3716711 - RNA, 20 nt, Human
gcucaccagccccagugccc

SEQ ID NO: 3716712 - RNA, 18 nt, Human
gcucacccagccccaggg

SEQ ID NO: 3716713 - RNA, 17 nt, Human
gcucaccccaucauccc

SEQ ID NO: 3716714 - RNA, 16 nt, Human
gcucaccccccacacu

SEQ ID NO: 3716715 - RNA, 18 nt, Human
gcucacccccuucuccau

SEQ ID NO: 3716716 - RNA, 20 nt, Human
gcucacccccuucuccaucc

SEQ ID NO: 3716717 - RNA, 15 nt, Human
gcucaccgcccauca

SEQ ID NO: 3716718 - RNA, 17 nt, Human
gcucaccgcccaucagg

SEQ ID NO: 3716719 - RNA, 15 nt, Human
gcucaccuagagcca

SEQ ID NO: 3716720 - RNA, 20 nt, Human
gcucaccuagagccagacca

SEQ ID NO: 3716721 - RNA, 14 nt, Human
gcucaccucucccu

SEQ ID NO: 3716722 - RNA, 16 nt, Human
gcucaccucucccuug

SEQ ID NO: 3716723 - RNA, 18 nt, Human
gcucaccucucccuugga

SEQ ID NO: 3716724 - RNA, 12 nt, Human
gcucaccugggg

SEQ ID NO: 3716725 - RNA, 23 nt, Human
gcucaccuguugcuuacaauuuu

SEQ ID NO: 3716726 - RNA, 13 nt, Human
gcucaccuuuguu

SEQ ID NO: 3716727 - RNA, 22 nt, Human
gcucacgccuguaaucccagca

SEQ ID NO: 3716728 - RNA, 14 nt, Human
gcucacgucacacu

SEQ ID NO: 3716729 - RNA, 15 nt, Human
gcucacgucacacuu

SEQ ID NO: 3716730 - RNA, 22 nt, Human
gcucacgugagagugucuucac

SEQ ID NO: 3716731 - RNA, 16 nt, Human
gcucacuaccuccuca

SEQ ID NO: 3716732 - RNA, 14 nt, Human
gcucacuaugaauc

SEQ ID NO: 3716733 - RNA, 17 nt, Human
gcucacucacagaguca

SEQ ID NO: 3716734 - RNA, 14 nt, Human
gcucacucagcacu

SEQ ID NO: 3716735 - RNA, 15 nt, Human
gcucacucagccacc

SEQ ID NO: 3716736 - RNA, 14 nt, Human
gcucacugcagccu

SEQ ID NO: 3716737 - RNA, 17 nt, Human
gcucacugcagccucaa

SEQ ID NO: 3716738 - RNA, 17 nt, Human
gcucacugcagccucga

SEQ ID NO: 3716739 - RNA, 20 nt, Human
gcucacugcauccuccgccu

SEQ ID NO: 3716740 - RNA, 13 nt, Human
gcucacugccagg

SEQ ID NO: 3716741 - RNA, 21 nt, Human
gcucacugccaggccagccuc

SEQ ID NO: 3716742 - RNA, 18 nt, Human
gcucacuguggugucugu

SEQ ID NO: 3716743 - RNA, 15 nt, Human
gcucacuucugggcu

SEQ ID NO: 3716744 - RNA, 14 nt, Human
gcucagaacacauu

SEQ ID NO: 3716745 - RNA, 23 nt, Human
gcucagaacccagggcucugccc

SEQ ID NO: 3716746 - RNA, 19 nt, Human
gcucagaacuugcugcugu

SEQ ID NO: 3716747 - RNA, 22 nt, Human
gcucagaauccaagugaacacu

SEQ ID NO: 3716748 - RNA, 16 nt, Human
gcucagacauguuuuc

SEQ ID NO: 3716749 - RNA, 23 nt, Human
gcucagacccccacucucauucc

SEQ ID NO: 3716750 - RNA, 16 nt, Human
gcucagagagggcagg

SEQ ID NO: 3716751 - RNA, 14 nt, Human
gcucagagagggug

SEQ ID NO: 3716752 - RNA, 16 nt, Human
gcucagagcaguguuu

SEQ ID NO: 3716753 - RNA, 21 nt, Human
gcucagaggcgcacugugacc

SEQ ID NO: 3716754 - RNA, 18 nt, Human
gcucagaggguguccugc

SEQ ID NO: 3716755 - RNA, 19 nt, Human
gcucagaggguguccugca

SEQ ID NO: 3716756 - RNA, 18 nt, Human
gcucagaugaagagaaau

SEQ ID NO: 3716757 - RNA, 17 nt, Human
gcucagcaaaagaugcu

SEQ ID NO: 3716758 - RNA, 23 nt, Human
gcucagcaaaagaugcuucucac

SEQ ID NO: 3716759 - RNA, 19 nt, Human
gcucagcaaggccaccucu

SEQ ID NO: 3716760 - RNA, 22 nt, Human
gcucagcacugccugcucccau

SEQ ID NO: 3716761 - RNA, 15 nt, Human
gcucagccagcacuu

SEQ ID NO: 3716762 - RNA, 17 nt, Human
gcucagccagccccauc

SEQ ID NO: 3716763 - RNA, 18 nt, Human
gcucagcccaccccccuc

SEQ ID NO: 3716764 - RNA, 16 nt, Human
gcucagccccagccca

SEQ ID NO: 3716765 - RNA, 18 nt, Human
gcucagccccgagcuguc

SEQ ID NO: 3716766 - RNA, 15 nt, Human
gcucagcccucccug

SEQ ID NO: 3716767 - RNA, 16 nt, Human
gcucagcccucccugc

SEQ ID NO: 3716768 - RNA, 12 nt, Human
gcucagcccuga

SEQ ID NO: 3716769 - RNA, 19 nt, Human
gcucagcccugacuggugc

SEQ ID NO: 3716770 - RNA, 21 nt, Human
gcucagcccugacuggugcua

SEQ ID NO: 3716771 - RNA, 15 nt, Human
gcucagccugguggg

SEQ ID NO: 3716772 - RNA, 17 nt, Human
gcucagcggggacagcu

SEQ ID NO: 3716773 - RNA, 20 nt, Human
gcucagcucuggcucacaga

SEQ ID NO: 3716774 - RNA, 16 nt, Human
gcucagcucugggcca

SEQ ID NO: 3716775 - RNA, 12 nt, Human
gcucagcugcau

SEQ ID NO: 3716776 - RNA, 21 nt, Human
gcucagcugucaaggcucagu

SEQ ID NO: 3716777 - RNA, 13 nt, Human
gcucagcuucucc

SEQ ID NO: 3716778 - RNA, 16 nt, Human
gcucaggaaccgaggc

SEQ ID NO: 3716779 - RNA, 14 nt, Human
gcucaggaccaggc

SEQ ID NO: 3716780 - RNA, 16 nt, Human
gcucaggaccaggcaa

SEQ ID NO: 3716781 - RNA, 16 nt, Human
gcucaggacucagaag

SEQ ID NO: 3716782 - RNA, 18 nt, Human
gcucaggacucagaagcc

SEQ ID NO: 3716783 - RNA, 15 nt, Human
gcucaggagcccugg

SEQ ID NO: 3716784 - RNA, 23 nt, Human
gcucaggagcccugggaggcucu

SEQ ID NO: 3716785 - RNA, 15 nt, Human
gcucaggaggcgccc

SEQ ID NO: 3716786 - RNA, 15 nt, Human
gcucaggaggcuugg

SEQ ID NO: 3716787 - RNA, 17 nt, Human
gcucaggaggcuuggaa

SEQ ID NO: 3716788 - RNA, 13 nt, Human
gcucaggaguuug

SEQ ID NO: 3716789 - RNA, 14 nt, Human
gcucaggaucucuu

SEQ ID NO: 3716790 - RNA, 24 nt, Human
gcucaggcaggggccuccaugggc

SEQ ID NO: 3716791 - RNA, 19 nt, Human
gcucaggcgauccaccugu

SEQ ID NO: 3716792 - RNA, 12 nt, Human
gcucaggcugca

SEQ ID NO: 3716793 - RNA, 14 nt, Human
gcucaggcugcagc

SEQ ID NO: 3716794 - RNA, 17 nt, Human
gcucaggcugcagcugg

SEQ ID NO: 3716795 - RNA, 18 nt, Human
gcucagggaccacagcaa

SEQ ID NO: 3716796 - RNA, 16 nt, Human
gcucagggccuggcuc

SEQ ID NO: 3716797 - RNA, 20 nt, Human
gcucagggccuggcucaggu

SEQ ID NO: 3716798 - RNA, 19 nt, Human
gcucaggggcagcucauag

SEQ ID NO: 3716799 - RNA, 16 nt, Human
gcucaggggcccugga

SEQ ID NO: 3716800 - RNA, 17 nt, Human
gcucaggggcccuggag

SEQ ID NO: 3716801 - RNA, 19 nt, Human
gcucaggggcccuggagca

SEQ ID NO: 3716802 - RNA, 22 nt, Human
gcucagggugcuagaggauuag

SEQ ID NO: 3716803 - RNA, 12 nt, Human
gcucaggguggu

SEQ ID NO: 3716804 - RNA, 19 nt, Human
gcucagguacagagaagga

SEQ ID NO: 3716805 - RNA, 20 nt, Human
gcucagguacagagaaggaa

SEQ ID NO: 3716806 - RNA, 17 nt, Human
ucacauagaugucccuu

SEQ ID NO: 3716807 - RNA, 14 nt, Human
ucacauagcccacu

SEQ ID NO: 3716808 - RNA, 16 nt, Human
ucacauagugaaaguu

SEQ ID NO: 3716809 - RNA, 14 nt, Human
ucacauaucuagua

SEQ ID NO: 3716810 - RNA, 14 nt, Human
ucacauauuuuaaa

SEQ ID NO: 3716811 - RNA, 20 nt, Human
ucacaucagagugacaucca

SEQ ID NO: 3716812 - RNA, 10 nt, Human
ucacauccug

SEQ ID NO: 3716813 - RNA, 15 nt, Human
ucacauccuggccug

SEQ ID NO: 3716814 - RNA, 18 nt, Human
ucacauccuggccuggca

SEQ ID NO: 3716815 - RNA, 19 nt, Human
ucacauccuguguuucuag

SEQ ID NO: 3716816 - RNA, 15 nt, Human
ucacaucuuggcaca

SEQ ID NO: 3716817 - RNA, 14 nt, Human
ucacaucuuucaca

SEQ ID NO: 3716818 - RNA, 17 nt, Human
ucacaucuuucacacuu

SEQ ID NO: 3716819 - RNA, 20 nt, Human
ucacaucuuucacacuucca

SEQ ID NO: 3716820 - RNA, 13 nt, Human
ucacaucuuuuaa

SEQ ID NO: 3716821 - RNA, 18 nt, Human
ucacaucuuuuaagacaa

SEQ ID NO: 3716822 - RNA, 17 nt, Human
ucacaugaauuauuaca

SEQ ID NO: 3716823 - RNA, 21 nt, Human
ucacaugaauuauuacagugu

SEQ ID NO: 3716824 - RNA, 13 nt, Human
ucacaugaccaca

SEQ ID NO: 3716825 - RNA, 12 nt, Human
ucacaugcugga

SEQ ID NO: 3716826 - RNA, 19 nt, Human
ucacauggaaugaggguuu

SEQ ID NO: 3716827 - RNA, 16 nt, Human
ucacauggccuaugca

SEQ ID NO: 3716828 - RNA, 16 nt, Human
ucacauggugccccua

SEQ ID NO: 3716829 - RNA, 13 nt, Human
ucacauguauguu

SEQ ID NO: 3716830 - RNA, 15 nt, Human
ucacauguauguuuu

SEQ ID NO: 3716831 - RNA, 15 nt, Human
ucacauguuuucaaa

SEQ ID NO: 3716832 - RNA, 17 nt, Human
ucacauguuuucaaaug

SEQ ID NO: 3716833 - RNA, 20 nt, Human
ucacauguuuucaaauggag

SEQ ID NO: 3716834 - RNA, 21 nt, Human
ucacauuaaaaaaugaaauau

SEQ ID NO: 3716835 - RNA, 19 nt, Human
ucacauuacuguauauacu

SEQ ID NO: 3716836 - RNA, 12 nt, Human
ucacauuagaag

SEQ ID NO: 3716837 - RNA, 15 nt, Human
ucacauuagaagaca

SEQ ID NO: 3716838 - RNA, 13 nt, Human
ucacauucaggaa

SEQ ID NO: 3716839 - RNA, 20 nt, Human
ucacauuccugaacaggaua

SEQ ID NO: 3716840 - RNA, 20 nt, Human
ucacauugcauucuauugcc

SEQ ID NO: 3716841 - RNA, 21 nt, Human
ucacauugcauucuauugccu

SEQ ID NO: 3716842 - RNA, 17 nt, Human
ucacauuggaaacaagu

SEQ ID NO: 3716843 - RNA, 18 nt, Human
ucacauugguguuguacu

SEQ ID NO: 3716844 - RNA, 22 nt, Human
ucacauuguauucagaguugau

SEQ ID NO: 3716845 - RNA, 11 nt, Human
ucacauuuucc

SEQ ID NO: 3716846 - RNA, 14 nt, Human
ucacauuuuccuuu

SEQ ID NO: 3716847 - RNA, 18 nt, Human
ucacauuuuccuuuucaa

SEQ ID NO: 3716848 - RNA, 16 nt, Human
ucaccaaaagacacug

SEQ ID NO: 3716849 - RNA, 20 nt, Human
ucaccaaaucagcugcuacu

SEQ ID NO: 3716850 - RNA, 13 nt, Human
ucaccaagcccag

SEQ ID NO: 3716851 - RNA, 13 nt, Human
ucaccaaggaaac

SEQ ID NO: 3716852 - RNA, 23 nt, Human
ucaccacaccaaaccucucuuau

SEQ ID NO: 3716853 - RNA, 14 nt, Human
ucaccacagacuuu

SEQ ID NO: 3716854 - RNA, 18 nt, Human
ucaccacaguaaguuccu

SEQ ID NO: 3716855 - RNA, 13 nt, Human
ucaccaccacccc

SEQ ID NO: 3716856 - RNA, 14 nt, Human
ucaccaccuuccca

SEQ ID NO: 3716857 - RNA, 16 nt, Human
ucaccaccuucccagc

SEQ ID NO: 3716858 - RNA, 20 nt, Human
ucaccacgacuggccagggc

SEQ ID NO: 3716859 - RNA, 16 nt, Human
ucaccacuccauuccc

SEQ ID NO: 3716860 - RNA, 13 nt, Human
ucaccagaauaaa

SEQ ID NO: 3716861 - RNA, 19 nt, Human
ucaccagacggggcuggag

SEQ ID NO: 3716862 - RNA, 14 nt, Human
ucaccagagacuuu

SEQ ID NO: 3716863 - RNA, 15 nt, Human
ucaccagagacuuua

SEQ ID NO: 3716864 - RNA, 19 nt, Human
ucaccagagacuuuagggg

SEQ ID NO: 3716865 - RNA, 13 nt, Human
ucaccagcaccaa

SEQ ID NO: 3716866 - RNA, 22 nt, Human
ucaccagccccacugccagcag

SEQ ID NO: 3716867 - RNA, 24 nt, Human
ucaccagccccacugccagcagca

SEQ ID NO: 3716868 - RNA, 13 nt, Human
ucaccagccccag

SEQ ID NO: 3716869 - RNA, 12 nt, Human
ucaccagcugca

SEQ ID NO: 3716870 - RNA, 13 nt, Human
ucaccagcugcaa

SEQ ID NO: 3716871 - RNA, 17 nt, Human
ucaccagcugcaaagug

SEQ ID NO: 3716872 - RNA, 15 nt, Human
ucaccagcugccucu

SEQ ID NO: 3716873 - RNA, 15 nt, Human
ucaccaggggcaggc

SEQ ID NO: 3716874 - RNA, 19 nt, Human
ucaccaggggcaggcacag

SEQ ID NO: 3716875 - RNA, 21 nt, Human
ucaccaggggcaggcacagca

SEQ ID NO: 3716876 - RNA, 22 nt, Human
ucaccaggggcaggcacagcac

SEQ ID NO: 3716877 - RNA, 19 nt, Human
ucaccagugaccuggaagg

SEQ ID NO: 3716878 - RNA, 22 nt, Human
ucaccaguggccuuaccccugc

SEQ ID NO: 3716879 - RNA, 13 nt, Human
ucaccaguguccc

SEQ ID NO: 3716880 - RNA, 23 nt, Human
ucaccaguguguggcuuucagag

SEQ ID NO: 3716881 - RNA, 15 nt, Human
ucaccaucaauccug

SEQ ID NO: 3716882 - RNA, 15 nt, Human
ucaccaucucaggcc

SEQ ID NO: 3716883 - RNA, 16 nt, Human
ucaccaucucaggcca

SEQ ID NO: 3716884 - RNA, 21 nt, Human
ucaccaugauggccaggcuga

SEQ ID NO: 3716885 - RNA, 20 nt, Human
ucaccauguaaaacaaaaaa

SEQ ID NO: 3716886 - RNA, 16 nt, Human
ucaccauguaagcacu

SEQ ID NO: 3716887 - RNA, 20 nt, Human
ucaccauuauaaugaauuua

SEQ ID NO: 3716888 - RNA, 13 nt, Human
ucaccauucccag

SEQ ID NO: 3716889 - RNA, 17 nt, Human
ucaccauuuccccaggg

SEQ ID NO: 3716890 - RNA, 19 nt, Human
ucaccauuuccccagggca

SEQ ID NO: 3716891 - RNA, 20 nt, Human
ucaccauuuccccagggcac

SEQ ID NO: 3716892 - RNA, 19 nt, Human
ucacccaagagauuguugu

SEQ ID NO: 3716893 - RNA, 15 nt, Human
ucacccacagaaaga

SEQ ID NO: 3716894 - RNA, 11 nt, Human
ucacccacagg

SEQ ID NO: 3716895 - RNA, 22 nt, Human
ucacccacagggcuaagagcua

SEQ ID NO: 3716896 - RNA, 19 nt, Human
ucacccaggcuggagugca

SEQ ID NO: 3716897 - RNA, 21 nt, Human
ucacccaugcaagcagaggac

SEQ ID NO: 3716898 - RNA, 12 nt, Human
ucaccccacccu

SEQ ID NO: 3716899 - RNA, 22 nt, Human
ucaccccacuuaucccucucca

SEQ ID NO: 3716900 - RNA, 14 nt, Human
ucaccccagagcca

SEQ ID NO: 3716901 - RNA, 13 nt, Human
ucaccccagcccc

SEQ ID NO: 3716902 - RNA, 20 nt, Human
ucaccccagggccugagccu

SEQ ID NO: 3716903 - RNA, 21 nt, Human
ucaccccagggccugagccug

SEQ ID NO: 3716904 - RNA, 13 nt, Human
ucaccccauccca

SEQ ID NO: 3716905 - RNA, 19 nt, Human
ucaccccaucccacacccu

SEQ ID NO: 3716906 - RNA, 13 nt, Human
ucacccccagcuu

SEQ ID NO: 3716907 - RNA, 18 nt, Human
ucacccccagcuuugcua

SEQ ID NO: 3716908 - RNA, 18 nt, Human
ucaccccccacacucacu

SEQ ID NO: 3716909 - RNA, 14 nt, Human
ucaccccccacuca

SEQ ID NO: 3716910 - RNA, 22 nt, Human
ucacccccucccacccccagcc

SEQ ID NO: 3716911 - RNA, 23 nt, Human
ucacccccucccacccccagccc

SEQ ID NO: 3716912 - RNA, 19 nt, Human
ucacccccucgggucuccu

SEQ ID NO: 3716913 - RNA, 13 nt, Human
ucacccccuucuc

SEQ ID NO: 3716914 - RNA, 16 nt, Human
ucacccccuucuccau

SEQ ID NO: 3716915 - RNA, 17 nt, Human
ucaccccgaggcccugc

SEQ ID NO: 3716916 - RNA, 20 nt, Human
ucaccccgaggcccugcaug

SEQ ID NO: 3716917 - RNA, 23 nt, Human
ucaccccgcuguaagcuccuuug

SEQ ID NO: 3716918 - RNA, 15 nt, Human
ucaccccggccaccu

SEQ ID NO: 3716919 - RNA, 18 nt, Human
ucaccccucccuuucucc

SEQ ID NO: 3716920 - RNA, 13 nt, Human
ucaccccugcccu

SEQ ID NO: 3716921 - RNA, 16 nt, Human
ucaccccugcccuggg

SEQ ID NO: 3716922 - RNA, 17 nt, Human
ucaccccugcccuggga

SEQ ID NO: 3716923 - RNA, 15 nt, Human
ucaccccugguucuc

SEQ ID NO: 3716924 - RNA, 21 nt, Human
ucaccccugguucucaucuuu

SEQ ID NO: 3716925 - RNA, 16 nt, Human
ucaccccuguccucac

SEQ ID NO: 3716926 - RNA, 19 nt, Human
ucacccgaggcugcccacu

SEQ ID NO: 3716927 - RNA, 19 nt, Human
ucacccgcuaagagggagg

SEQ ID NO: 3716928 - RNA, 20 nt, Human
ucacccguacaggcaauucc

SEQ ID NO: 3716929 - RNA, 18 nt, Human
ucacccguccagaccuug

SEQ ID NO: 3716930 - RNA, 15 nt, Human
ucacccuaccugugc

SEQ ID NO: 3716931 - RNA, 17 nt, Human
ucacccuagcccucucc

SEQ ID NO: 3716932 - RNA, 18 nt, Human
ucacccucuuccugugau

SEQ ID NO: 3716933 - RNA, 13 nt, Human
ucacccugagccc

SEQ ID NO: 3716934 - RNA, 13 nt, Human
ucacccugccuua

SEQ ID NO: 3716935 - RNA, 15 nt, Human
ucacccugccuuauc

SEQ ID NO: 3716936 - RNA, 18 nt, Human
ucacccuggaggcaccug

SEQ ID NO: 3716937 - RNA, 20 nt, Human
ucacccuggggcuaggaaau

SEQ ID NO: 3716938 - RNA, 13 nt, Human
ucacccuguccaa

SEQ ID NO: 3716939 - RNA, 21 nt, Human
ucacccuguccaaacugccua

SEQ ID NO: 3716940 - RNA, 18 nt, Human
ucacccuuaacccaagga

SEQ ID NO: 3716941 - RNA, 22 nt, Human
ucacccuuaacccaaggagcac

SEQ ID NO: 3716942 - RNA, 23 nt, Human
ucacccuuaacccaaggagcaca

SEQ ID NO: 3716943 - RNA, 18 nt, Human
ucacccuuaccaugugcc

SEQ ID NO: 3716944 - RNA, 13 nt, Human
ucacccuuugcug

SEQ ID NO: 3716945 - RNA, 14 nt, Human
ucaccgaaaacgug

SEQ ID NO: 3716946 - RNA, 15 nt, Human
ucaccgaaaacgugg

SEQ ID NO: 3716947 - RNA, 22 nt, Human
ucaccgaaaacguggcugcuuc

SEQ ID NO: 3716948 - RNA, 15 nt, Human
ucaccgaagccacuu

SEQ ID NO: 3716949 - RNA, 23 nt, Human
ucaccgagaguagccgagagccu

SEQ ID NO: 3716950 - RNA, 20 nt, Human
ucaccgcagucgucgcacag

SEQ ID NO: 3716951 - RNA, 22 nt, Human
ucaccgcagucgucgcacaguc

SEQ ID NO: 3716952 - RNA, 13 nt, Human
ucaccgcccauca

SEQ ID NO: 3716953 - RNA, 20 nt, Human
ucaccgcccaucaggguucu

SEQ ID NO: 3716954 - RNA, 23 nt, Human
ucaccggagcuuucaaagaagga

SEQ ID NO: 3716955 - RNA, 15 nt, Human
ucaccggcucucacc

SEQ ID NO: 3716956 - RNA, 18 nt, Human
ucaccguggaccuuccug

SEQ ID NO: 3716957 - RNA, 14 nt, Human
aacugggcugaaca

SEQ ID NO: 3716958 - RNA, 16 nt, Human
aacuggggcuccucca

SEQ ID NO: 3716959 - RNA, 16 nt, Human
aacugggguugagggc

SEQ ID NO: 3716960 - RNA, 23 nt, Human
aacuggguaaaugcaaaguucug

SEQ ID NO: 3716961 - RNA, 18 nt, Human
aacuggguaaugaaacaa

SEQ ID NO: 3716962 - RNA, 22 nt, Human
aacugguauucuguucuggagg

SEQ ID NO: 3716963 - RNA, 17 nt, Human
aacuggucuuccuuuuu

SEQ ID NO: 3716964 - RNA, 19 nt, Human
aacuggucuuccuuuuugg

SEQ ID NO: 3716965 - RNA, 14 nt, Human
aacuggugauauau

SEQ ID NO: 3716966 - RNA, 21 nt, Human
aacugguuuguugcagccaaa

SEQ ID NO: 3716967 - RNA, 13 nt, Human
aacuguaaauaaa

SEQ ID NO: 3716968 - RNA, 11 nt, Human
aacuguaaauc

SEQ ID NO: 3716969 - RNA, 17 nt, Human
aacuguaacguuuucuu

SEQ ID NO: 3716970 - RNA, 15 nt, Human
aacuguaauuauuug

SEQ ID NO: 3716971 - RNA, 10 nt, Human
aacuguacag

SEQ ID NO: 3716972 - RNA, 18 nt, Human
aacuguacagugucuuuu

SEQ ID NO: 3716973 - RNA, 13 nt, Human
aacuguacauuuc

SEQ ID NO: 3716974 - RNA, 22 nt, Human
aacuguacuuugauucacaugu

SEQ ID NO: 3716975 - RNA, 15 nt, Human
aacuguagaaaugau

SEQ ID NO: 3716976 - RNA, 20 nt, Human
aacuguagauaaagugguuu

SEQ ID NO: 3716977 - RNA, 20 nt, Human
aacuguagaugauguauuuu

SEQ ID NO: 3716978 - RNA, 16 nt, Human
aacuguauauuuguau

SEQ ID NO: 3716979 - RNA, 11 nt, Human
aacuguaucuu

SEQ ID NO: 3716980 - RNA, 14 nt, Human
aacuguaugucaga

SEQ ID NO: 3716981 - RNA, 14 nt, Human
aacuguccagagag

SEQ ID NO: 3716982 - RNA, 18 nt, Human
aacuguccguaagcagua

SEQ ID NO: 3716983 - RNA, 19 nt, Human
aacuguccguaagcaguau

SEQ ID NO: 3716984 - RNA, 20 nt, Human
aacuguccucuuucagaaaa

SEQ ID NO: 3716985 - RNA, 21 nt, Human
aacuguccucuuucagaaaac

SEQ ID NO: 3716986 - RNA, 16 nt, Human
aacuguccuguccugc

SEQ ID NO: 3716987 - RNA, 17 nt, Human
aacuguccuguccugcu

SEQ ID NO: 3716988 - RNA, 17 nt, Human
aacugucggaggaaaga

SEQ ID NO: 3716989 - RNA, 20 nt, Human
aacugucgugucauacucga

SEQ ID NO: 3716990 - RNA, 16 nt, Human
aacugucuauuucugc

SEQ ID NO: 3716991 - RNA, 22 nt, Human
aacugucucucuucucagagug

SEQ ID NO: 3716992 - RNA, 15 nt, Human
aacugucuuccucaa

SEQ ID NO: 3716993 - RNA, 22 nt, Human
aacuguggauacccuuacccuu

SEQ ID NO: 3716994 - RNA, 20 nt, Human
aacuguguacauaacugaaa

SEQ ID NO: 3716995 - RNA, 21 nt, Human
aacuguguacauaacugaaaa

SEQ ID NO: 3716996 - RNA, 15 nt, Human
aacuguguauguaca

SEQ ID NO: 3716997 - RNA, 15 nt, Human
aacugugugauuaaa

SEQ ID NO: 3716998 - RNA, 22 nt, Human
aacuguguguaauuguuccuuu

SEQ ID NO: 3716999 - RNA, 23 nt, Human
aacuguguuguauuaacaaaagu

SEQ ID NO: 3717000 - RNA, 22 nt, Human
aacuguguuucaaguucaaucc

SEQ ID NO: 3717001 - RNA, 19 nt, Human
aacuguuaccauuggaaau

SEQ ID NO: 3717002 - RNA, 23 nt, Human
aacuguuaccauuggaaauuuca

SEQ ID NO: 3717003 - RNA, 14 nt, Human
aacuguuagcacug

SEQ ID NO: 3717004 - RNA, 15 nt, Human
aacuguuagcacugu

SEQ ID NO: 3717005 - RNA, 22 nt, Human
aacuguuagcacuguugaugua

SEQ ID NO: 3717006 - RNA, 14 nt, Human
aacuguuaugaaau

SEQ ID NO: 3717007 - RNA, 15 nt, Human
aacuguuguauaaau

SEQ ID NO: 3717008 - RNA, 13 nt, Human
aacuguuuagaug

SEQ ID NO: 3717009 - RNA, 13 nt, Human
aacuguuuauaug

SEQ ID NO: 3717010 - RNA, 14 nt, Human
aacuguuuccuuca

SEQ ID NO: 3717011 - RNA, 15 nt, Human
aacuguuuuggguag

SEQ ID NO: 3717012 - RNA, 13 nt, Human
aacuuaaaaaugu

SEQ ID NO: 3717013 - RNA, 11 nt, Human
aacuuaaaaua

SEQ ID NO: 3717014 - RNA, 14 nt, Human
aacuuaaaauauuu

SEQ ID NO: 3717015 - RNA, 15 nt, Human
aacuuaaauaaaugu

SEQ ID NO: 3717016 - RNA, 19 nt, Human
aacuuaaauaaaugucauu

SEQ ID NO: 3717017 - RNA, 17 nt, Human
aacuuaaauaaugugaa

SEQ ID NO: 3717018 - RNA, 19 nt, Human
aacuuaaauguuauuaucu

SEQ ID NO: 3717019 - RNA, 19 nt, Human
aacuuaaauuuuaguucuu

SEQ ID NO: 3717020 - RNA, 12 nt, Human
aacuuaacaugc

SEQ ID NO: 3717021 - RNA, 13 nt, Human
aacuuaacaugcu

SEQ ID NO: 3717022 - RNA, 16 nt, Human
aacuuaacauucugua

SEQ ID NO: 3717023 - RNA, 17 nt, Human
aacuuaacauucuguaa

SEQ ID NO: 3717024 - RNA, 21 nt, Human
aacuuaacauucuguaaaaug

SEQ ID NO: 3717025 - RNA, 13 nt, Human
aacuuaacugaaa

SEQ ID NO: 3717026 - RNA, 13 nt, Human
aacuuaagccaau

SEQ ID NO: 3717027 - RNA, 17 nt, Human
aacuuaaggcauuuguu

SEQ ID NO: 3717028 - RNA, 17 nt, Human
aacuuaaguuaaacaua

SEQ ID NO: 3717029 - RNA, 18 nt, Human
aacuuaauaguauuuaug

SEQ ID NO: 3717030 - RNA, 18 nt, Human
aacuuaaucuaaauggaa

SEQ ID NO: 3717031 - RNA, 22 nt, Human
aacuuaauguucuuaugcaaaa

SEQ ID NO: 3717032 - RNA, 17 nt, Human
aacuuaauuuaauauuu

SEQ ID NO: 3717033 - RNA, 22 nt, Human
aacuuacaggugauuaacuugg

SEQ ID NO: 3717034 - RNA, 23 nt, Human
aacuuacauugugaaacuucugu

SEQ ID NO: 3717035 - RNA, 19 nt, Human
aacuuacauuguucaauua

SEQ ID NO: 3717036 - RNA, 20 nt, Human
aacuuacauuguucaauuag

SEQ ID NO: 3717037 - RNA, 21 nt, Human
aacuuaccaggcaccaaaaga

SEQ ID NO: 3717038 - RNA, 23 nt, Human
aacuuaccgugagcgacaaagau

SEQ ID NO: 3717039 - RNA, 19 nt, Human
aacuuaccugggcauucuu

SEQ ID NO: 3717040 - RNA, 23 nt, Human
aacuuacuauucauuaaauguuu

SEQ ID NO: 3717041 - RNA, 19 nt, Human
aacuuagcauguguugaaa

SEQ ID NO: 3717042 - RNA, 21 nt, Human
aacuuagcauuuucugcaucu

SEQ ID NO: 3717043 - RNA, 16 nt, Human
aacuuagguggcaagc

SEQ ID NO: 3717044 - RNA, 22 nt, Human
aacuuagugcggacaaguuuua

SEQ ID NO: 3717045 - RNA, 23 nt, Human
aacuuaguuugugaauugauuuu

SEQ ID NO: 3717046 - RNA, 16 nt, Human
aacuuaguuuugcaua

SEQ ID NO: 3717047 - RNA, 19 nt, Human
aacuuauaaaucauauuga

SEQ ID NO: 3717048 - RNA, 15 nt, Human
aacuuauauuguaag

SEQ ID NO: 3717049 - RNA, 19 nt, Human
aacuuauauuguaagaaau

SEQ ID NO: 3717050 - RNA, 15 nt, Human
aacuuaugaauguuu

SEQ ID NO: 3717051 - RNA, 15 nt, Human
aacuuauggccacag

SEQ ID NO: 3717052 - RNA, 19 nt, Human
aacuuauggggccaaaaua

SEQ ID NO: 3717053 - RNA, 19 nt, Human
aacuuauguagauauuugg

SEQ ID NO: 3717054 - RNA, 20 nt, Human
aacuuauguagauauuuggc

SEQ ID NO: 3717055 - RNA, 14 nt, Human
aacuuauucaaaga

SEQ ID NO: 3717056 - RNA, 13 nt, Human
aacuuauucugua

SEQ ID NO: 3717057 - RNA, 14 nt, Human
aacuuauucuguag

SEQ ID NO: 3717058 - RNA, 23 nt, Human
aacuuauucuguagauucugugg

SEQ ID NO: 3717059 - RNA, 13 nt, Human
aacuuauuugagu

SEQ ID NO: 3717060 - RNA, 21 nt, Human
aacuuauuuuuuucugauugu

SEQ ID NO: 3717061 - RNA, 13 nt, Human
aacuucaaauuuu

SEQ ID NO: 3717062 - RNA, 19 nt, Human
aacuucaacauuuacaugu

SEQ ID NO: 3717063 - RNA, 22 nt, Human
aacuucaagugcaugcucucug

SEQ ID NO: 3717064 - RNA, 17 nt, Human
aacuucacauuaaaaaa

SEQ ID NO: 3717065 - RNA, 22 nt, Human
aacuucagagggaaaguaaaua

SEQ ID NO: 3717066 - RNA, 12 nt, Human
aacuucagcacc

SEQ ID NO: 3717067 - RNA, 18 nt, Human
aacuucagcgguuuauau

SEQ ID NO: 3717068 - RNA, 20 nt, Human
aacuucagcuagagcuucaa

SEQ ID NO: 3717069 - RNA, 20 nt, Human
aacuucauauaugaggacuu

SEQ ID NO: 3717070 - RNA, 14 nt, Human
aacuucauguaacu

SEQ ID NO: 3717071 - RNA, 16 nt, Human
aacuucauguaauuuu

SEQ ID NO: 3717072 - RNA, 16 nt, Human
aacuucauuucagagu

SEQ ID NO: 3717073 - RNA, 12 nt, Human
aacuucauuuga

SEQ ID NO: 3717074 - RNA, 14 nt, Human
aacuucauuugaug

SEQ ID NO: 3717075 - RNA, 18 nt, Human
aacuuccagauccuggaa

SEQ ID NO: 3717076 - RNA, 18 nt, Human
aacuucccagugaauucu

SEQ ID NO: 3717077 - RNA, 16 nt, Human
aacuuccccauacaaa

SEQ ID NO: 3717078 - RNA, 23 nt, Human
aacuuccugcagguaaacaguuc

SEQ ID NO: 3717079 - RNA, 22 nt, Human
aacuuccuuggacucauuuuaa

SEQ ID NO: 3717080 - RNA, 22 nt, Human
aacuucuccccugguagaaaga

SEQ ID NO: 3717081 - RNA, 15 nt, Human
aacuucucuggaaag

SEQ ID NO: 3717082 - RNA, 19 nt, Human
aacuucucuugcuuucuau

SEQ ID NO: 3717083 - RNA, 19 nt, Human
aacuucugcaacaagcaug

SEQ ID NO: 3717084 - RNA, 13 nt, Human
aacuucugccugu

SEQ ID NO: 3717085 - RNA, 17 nt, Human
aacuucuuaaauaucuu

SEQ ID NO: 3717086 - RNA, 18 nt, Human
aacuucuuaaauaucuuu

SEQ ID NO: 3717087 - RNA, 20 nt, Human
aacuucuuaaauaucuuuua

SEQ ID NO: 3717088 - RNA, 22 nt, Human
aacuucuuauaggaaagcuuga

SEQ ID NO: 3717089 - RNA, 21 nt, Human
aacuucuucuccaucccucua

SEQ ID NO: 3717090 - RNA, 23 nt, Human
aacuucuugucagacauaaagcc

SEQ ID NO: 3717091 - RNA, 22 nt, Human
aacuucuuucuauuugacuugu

SEQ ID NO: 3717092 - RNA, 24 nt, Human
aacuucuuuguaaucguuaugugu

SEQ ID NO: 3717093 - RNA, 12 nt, Human
aacuugaaaaau

SEQ ID NO: 3717094 - RNA, 13 nt, Human
aacuugaaauuug

SEQ ID NO: 3717095 - RNA, 21 nt, Human
aacuugaacugauucacaucu

SEQ ID NO: 3717096 - RNA, 16 nt, Human
aacuugaaugugucag

SEQ ID NO: 3717097 - RNA, 20 nt, Human
aacuugagauguaugaaggc

SEQ ID NO: 3717098 - RNA, 20 nt, Human
aacuugaggacacaugucca

SEQ ID NO: 3717099 - RNA, 19 nt, Human
aacuugagggcccagagca

SEQ ID NO: 3717100 - RNA, 19 nt, Human
aacuugauccauuucuaau

SEQ ID NO: 3717101 - RNA, 14 nt, Human
aacuugaugcaugu

SEQ ID NO: 3717102 - RNA, 15 nt, Human
aacuugaugcaugug

SEQ ID NO: 3717103 - RNA, 15 nt, Human
aacuugcauggagca

SEQ ID NO: 3717104 - RNA, 18 nt, Human
aacuugccucuuuuaccu

SEQ ID NO: 3717105 - RNA, 16 nt, Human
aacuugccugccuuuc

SEQ ID NO: 3717106 - RNA, 14 nt, Human
ucaugaauaugaug

SEQ ID NO: 3717107 - RNA, 16 nt, Human
ucaugaaucugcaaug

SEQ ID NO: 3717108 - RNA, 15 nt, Human
ucaugaaugcuuuua

SEQ ID NO: 3717109 - RNA, 20 nt, Human
ucaugaauguaaauuuguac

SEQ ID NO: 3717110 - RNA, 21 nt, Human
ucaugaauuaguuuuauaugc

SEQ ID NO: 3717111 - RNA, 19 nt, Human
ucaugaauuuuacauggua

SEQ ID NO: 3717112 - RNA, 14 nt, Human
ucaugacagccucc

SEQ ID NO: 3717113 - RNA, 15 nt, Human
ucaugaccaguaaag

SEQ ID NO: 3717114 - RNA, 18 nt, Human
ucaugacuuuuccaugua

SEQ ID NO: 3717115 - RNA, 23 nt, Human
ucaugagaaauuaccaaaauguc

SEQ ID NO: 3717116 - RNA, 14 nt, Human
ucaugagccugcug

SEQ ID NO: 3717117 - RNA, 16 nt, Human
ucaugaggagauucug

SEQ ID NO: 3717118 - RNA, 21 nt, Human
ucaugaggagauucugccuuu

SEQ ID NO: 3717119 - RNA, 15 nt, Human
ucaugaguucugcug

SEQ ID NO: 3717120 - RNA, 17 nt, Human
ucaugauaaugaacaga

SEQ ID NO: 3717121 - RNA, 17 nt, Human
ucaugauaauucagcag

SEQ ID NO: 3717122 - RNA, 20 nt, Human
ucaugaugcagucuccucuu

SEQ ID NO: 3717123 - RNA, 22 nt, Human
ucaugaugcagucuccucuuua

SEQ ID NO: 3717124 - RNA, 15 nt, Human
ucaugaugcuagcca

SEQ ID NO: 3717125 - RNA, 16 nt, Human
ucaugaugcucuuucc

SEQ ID NO: 3717126 - RNA, 18 nt, Human
ucaugaugcucuuuccca

SEQ ID NO: 3717127 - RNA, 13 nt, Human
ucaugauguuuuu

SEQ ID NO: 3717128 - RNA, 13 nt, Human
ucaugauuagcaa

SEQ ID NO: 3717129 - RNA, 13 nt, Human
ucaugauuuauaa

SEQ ID NO: 3717130 - RNA, 17 nt, Human
ucaugauuucauuucaa

SEQ ID NO: 3717131 - RNA, 11 nt, Human
ucaugauuuuu

SEQ ID NO: 3717132 - RNA, 13 nt, Human
ucaugcaaaauau

SEQ ID NO: 3717133 - RNA, 14 nt, Human
ucaugcaaacuuua

SEQ ID NO: 3717134 - RNA, 23 nt, Human
ucaugcaaacuuuauuuuguguu

SEQ ID NO: 3717135 - RNA, 15 nt, Human
ucaugcaaugacauc

SEQ ID NO: 3717136 - RNA, 17 nt, Human
ucaugcacaguauuugu

SEQ ID NO: 3717137 - RNA, 20 nt, Human
ucaugcacaguauuuguaau

SEQ ID NO: 3717138 - RNA, 16 nt, Human
ucaugcacuuaaagaa

SEQ ID NO: 3717139 - RNA, 22 nt, Human
ucaugcacuuaaagaaguauuu

SEQ ID NO: 3717140 - RNA, 17 nt, Human
ucaugcagaguauuucu

SEQ ID NO: 3717141 - RNA, 13 nt, Human
ucaugcagccgug

SEQ ID NO: 3717142 - RNA, 16 nt, Human
ucaugcaucuccaccu

SEQ ID NO: 3717143 - RNA, 20 nt, Human
ucaugcaucuccaccugcuc

SEQ ID NO: 3717144 - RNA, 22 nt, Human
ucaugcaucuccaccugcuccc

SEQ ID NO: 3717145 - RNA, 18 nt, Human
ucaugcauguccuguaaa

SEQ ID NO: 3717146 - RNA, 12 nt, Human
ucaugcauuguu

SEQ ID NO: 3717147 - RNA, 16 nt, Human
ucaugccaagcauuua

SEQ ID NO: 3717148 - RNA, 22 nt, Human
ucaugccaccauggccagccaa

SEQ ID NO: 3717149 - RNA, 12 nt, Human
ucaugccagcua

SEQ ID NO: 3717150 - RNA, 13 nt, Human
ucaugcccacccc

SEQ ID NO: 3717151 - RNA, 19 nt, Human
ucaugcccacccccugccc

SEQ ID NO: 3717152 - RNA, 21 nt, Human
ucaugcccccuuucagauguc

SEQ ID NO: 3717153 - RNA, 16 nt, Human
ucaugccccuggcugg

SEQ ID NO: 3717154 - RNA, 15 nt, Human
ucaugcccugugcaa

SEQ ID NO: 3717155 - RNA, 23 nt, Human
ucaugccuggaagcuuugucccc

SEQ ID NO: 3717156 - RNA, 16 nt, Human
ucaugccuuuguaagu

SEQ ID NO: 3717157 - RNA, 14 nt, Human
ucaugcuccuuaau

SEQ ID NO: 3717158 - RNA, 13 nt, Human
ucaugcugccaau

SEQ ID NO: 3717159 - RNA, 19 nt, Human
ucaugcugccaauauccua

SEQ ID NO: 3717160 - RNA, 13 nt, Human
ucaugcugccccu

SEQ ID NO: 3717161 - RNA, 12 nt, Human
ucaugcugccuu

SEQ ID NO: 3717162 - RNA, 20 nt, Human
ucaugcuggaaccugcaaaa

SEQ ID NO: 3717163 - RNA, 22 nt, Human
ucaugcuggaaccugcaaaaaa

SEQ ID NO: 3717164 - RNA, 20 nt, Human
ucaugcugggauuuccaacu

SEQ ID NO: 3717165 - RNA, 17 nt, Human
ucaugcuguucaugaaa

SEQ ID NO: 3717166 - RNA, 17 nt, Human
ucaugcuucuuccuuac

SEQ ID NO: 3717167 - RNA, 13 nt, Human
ucaugcuuuaaag

SEQ ID NO: 3717168 - RNA, 19 nt, Human
ucaugcuuuaaaguguaau

SEQ ID NO: 3717169 - RNA, 20 nt, Human
ucaugcuuuaaaguguaaua

SEQ ID NO: 3717170 - RNA, 19 nt, Human
ucauggaacacaaacacau

SEQ ID NO: 3717171 - RNA, 23 nt, Human
ucauggaacacaaacacauuguu

SEQ ID NO: 3717172 - RNA, 18 nt, Human
ucauggaauggacauccu

SEQ ID NO: 3717173 - RNA, 20 nt, Human
ucauggaauggacauccugu

SEQ ID NO: 3717174 - RNA, 12 nt, Human
ucauggaauggu

SEQ ID NO: 3717175 - RNA, 21 nt, Human
ucauggaauuggagcucgugg

SEQ ID NO: 3717176 - RNA, 16 nt, Human
ucauggaccacuguuu

SEQ ID NO: 3717177 - RNA, 21 nt, Human
ucauggaccacuguuucuugc

SEQ ID NO: 3717178 - RNA, 22 nt, Human
ucauggaccacuguuucuugcu

SEQ ID NO: 3717179 - RNA, 21 nt, Human
ucauggagaaccaccuacccc

SEQ ID NO: 3717180 - RNA, 20 nt, Human
ucauggagaagcagaaauac

SEQ ID NO: 3717181 - RNA, 13 nt, Human
ucauggauuacuu

SEQ ID NO: 3717182 - RNA, 20 nt, Human
ucauggauucauuacagcuu

SEQ ID NO: 3717183 - RNA, 22 nt, Human
ucauggcagaaggcaaacccau

SEQ ID NO: 3717184 - RNA, 21 nt, Human
ucauggcagauguaggaggga

SEQ ID NO: 3717185 - RNA, 14 nt, Human
ucauggccacacug

SEQ ID NO: 3717186 - RNA, 17 nt, Human
ucauggccacacuguga

SEQ ID NO: 3717187 - RNA, 19 nt, Human
ucauggccacacugugaca

SEQ ID NO: 3717188 - RNA, 16 nt, Human
ucauggccagcuggag

SEQ ID NO: 3717189 - RNA, 18 nt, Human
ucauggccccucugaccu

SEQ ID NO: 3717190 - RNA, 15 nt, Human
ucauggccuugucua

SEQ ID NO: 3717191 - RNA, 21 nt, Human
ucauggcuaagcuuaaaaaaa

SEQ ID NO: 3717192 - RNA, 23 nt, Human
ucauggcuaagcuuaaaaaaaac

SEQ ID NO: 3717193 - RNA, 16 nt, Human
ucauggcugcuguugc

SEQ ID NO: 3717194 - RNA, 14 nt, Human
ucauggcuuaaugu

SEQ ID NO: 3717195 - RNA, 15 nt, Human
ucauggcuuaauguu

SEQ ID NO: 3717196 - RNA, 18 nt, Human
ucauggcuuaauguuuau

SEQ ID NO: 3717197 - RNA, 23 nt, Human
ucaugggagggggcuugaagcca

SEQ ID NO: 3717198 - RNA, 14 nt, Human
ucaugggguccaag

SEQ ID NO: 3717199 - RNA, 22 nt, Human
ucauggguuauguguaugugcc

SEQ ID NO: 3717200 - RNA, 23 nt, Human
ucaugguggguucaggggacuca

SEQ ID NO: 3717201 - RNA, 13 nt, Human
ucaugguguaaua

SEQ ID NO: 3717202 - RNA, 18 nt, Human
ucaugguguaauaagaca

SEQ ID NO: 3717203 - RNA, 13 nt, Human
ucauguaaaacag

SEQ ID NO: 3717204 - RNA, 18 nt, Human
ucauguaaaacagaaaaa

SEQ ID NO: 3717205 - RNA, 13 nt, Human
ucauguaaacugu

SEQ ID NO: 3717206 - RNA, 14 nt, Human
ucauguaaauaaau

SEQ ID NO: 3717207 - RNA, 19 nt, Human
ucauguaaauaauacauua

SEQ ID NO: 3717208 - RNA, 18 nt, Human
ucauguaaauacuguugg

SEQ ID NO: 3717209 - RNA, 13 nt, Human
ucauguaaauuga

SEQ ID NO: 3717210 - RNA, 20 nt, Human
ucauguaacuucccugaaaa

SEQ ID NO: 3717211 - RNA, 19 nt, Human
ucauguaagcugaaaauau

SEQ ID NO: 3717212 - RNA, 17 nt, Human
ucauguacaagaugaag

SEQ ID NO: 3717213 - RNA, 14 nt, Human
ucauguacauuucu

SEQ ID NO: 3717214 - RNA, 19 nt, Human
ucauguacugcauuauuug

SEQ ID NO: 3717215 - RNA, 13 nt, Human
ucauguacuuuuu

SEQ ID NO: 3717216 - RNA, 19 nt, Human
ucauguauguucagaagaa

SEQ ID NO: 3717217 - RNA, 14 nt, Human
ucauguauguuucu

SEQ ID NO: 3717218 - RNA, 18 nt, Human
ucaugucaacuucuggcu

SEQ ID NO: 3717219 - RNA, 21 nt, Human
ucaugucaacuucuggcuccu

SEQ ID NO: 3717220 - RNA, 14 nt, Human
ucaugucaggccug

SEQ ID NO: 3717221 - RNA, 19 nt, Human
ucaugucaggccugugugu

SEQ ID NO: 3717222 - RNA, 21 nt, Human
ucauguccaaacguccucuuu

SEQ ID NO: 3717223 - RNA, 21 nt, Human
ucauguccccaaaccugcaag

SEQ ID NO: 3717224 - RNA, 15 nt, Human
ucauguccuguguca

SEQ ID NO: 3717225 - RNA, 19 nt, Human
ucagacucuaagaaagaac

SEQ ID NO: 3717226 - RNA, 16 nt, Human
ucagacucucagccca

SEQ ID NO: 3717227 - RNA, 18 nt, Human
ucagacucucagcccaga

SEQ ID NO: 3717228 - RNA, 17 nt, Human
ucagacugcacccagga

SEQ ID NO: 3717229 - RNA, 18 nt, Human
ucagacugcacccaggag

SEQ ID NO: 3717230 - RNA, 19 nt, Human
ucagacugcacccaggagg

SEQ ID NO: 3717231 - RNA, 13 nt, Human
ucagacuggcugg

SEQ ID NO: 3717232 - RNA, 20 nt, Human
ucagacuggcuggcugcagu

SEQ ID NO: 3717233 - RNA, 12 nt, Human
ucagacuguaua

SEQ ID NO: 3717234 - RNA, 14 nt, Human
ucagacuguuuagu

SEQ ID NO: 3717235 - RNA, 15 nt, Human
ucagacuuaccagga

SEQ ID NO: 3717236 - RNA, 15 nt, Human
ucagacuugucaagc

SEQ ID NO: 3717237 - RNA, 16 nt, Human
ucagacuuuaaagaau

SEQ ID NO: 3717238 - RNA, 15 nt, Human
ucagacuuuggaaaa

SEQ ID NO: 3717239 - RNA, 16 nt, Human
ucagacuuuggaaaau

SEQ ID NO: 3717240 - RNA, 19 nt, Human
ucagacuuuggaaaaugca

SEQ ID NO: 3717241 - RNA, 14 nt, Human
ucagacuuuuguac

SEQ ID NO: 3717242 - RNA, 16 nt, Human
ucagacuuuuguacau

SEQ ID NO: 3717243 - RNA, 23 nt, Human
ucagagaauuucuaccauuucag

SEQ ID NO: 3717244 - RNA, 12 nt, Human
ucagagacacug

SEQ ID NO: 3717245 - RNA, 21 nt, Human
ucagagaccaggcccuggcua

SEQ ID NO: 3717246 - RNA, 15 nt, Human
ucagagaccagggcu

SEQ ID NO: 3717247 - RNA, 17 nt, Human
ucagagaccugaagugu

SEQ ID NO: 3717248 - RNA, 20 nt, Human
ucagagacuccugcaggcag

SEQ ID NO: 3717249 - RNA, 23 nt, Human
ucagagacuccugcaggcagcca

SEQ ID NO: 3717250 - RNA, 15 nt, Human
ucagagagcagugcu

SEQ ID NO: 3717251 - RNA, 14 nt, Human
ucagagagcuggua

SEQ ID NO: 3717252 - RNA, 16 nt, Human
ucagagagcugguagu

SEQ ID NO: 3717253 - RNA, 16 nt, Human
ucagagaggccuuuug

SEQ ID NO: 3717254 - RNA, 11 nt, Human
ucagagagggu

SEQ ID NO: 3717255 - RNA, 21 nt, Human
ucagagagggugggagugggc

SEQ ID NO: 3717256 - RNA, 23 nt, Human
ucagagagggugggagugggccc

SEQ ID NO: 3717257 - RNA, 21 nt, Human
ucagagaucguguauugagau

SEQ ID NO: 3717258 - RNA, 16 nt, Human
ucagagaugcaccacc

SEQ ID NO: 3717259 - RNA, 21 nt, Human
ucagagaugcaccaccaagcc

SEQ ID NO: 3717260 - RNA, 19 nt, Human
ucagagauuuauauaaaug

SEQ ID NO: 3717261 - RNA, 14 nt, Human
ucagagcaggaccu

SEQ ID NO: 3717262 - RNA, 20 nt, Human
ucagagccccuacagcauug

SEQ ID NO: 3717263 - RNA, 13 nt, Human
ucagagccugcag

SEQ ID NO: 3717264 - RNA, 14 nt, Human
ucagagccugcagu

SEQ ID NO: 3717265 - RNA, 15 nt, Human
ucagagccugcaguu

SEQ ID NO: 3717266 - RNA, 14 nt, Human
ucagagcgcacagg

SEQ ID NO: 3717267 - RNA, 18 nt, Human
ucagagcuaaacuccuuc

SEQ ID NO: 3717268 - RNA, 14 nt, Human
ucagagcucucucu

SEQ ID NO: 3717269 - RNA, 14 nt, Human
ucagagcugcccuc

SEQ ID NO: 3717270 - RNA, 20 nt, Human
ucagagcugcccucuccugg

SEQ ID NO: 3717271 - RNA, 21 nt, Human
ucagagcugcccucuccuggg

SEQ ID NO: 3717272 - RNA, 17 nt, Human
ucagaggaccuguauuu

SEQ ID NO: 3717273 - RNA, 14 nt, Human
ucagaggauggcca

SEQ ID NO: 3717274 - RNA, 19 nt, Human
ucagaggauggccaguguc

SEQ ID NO: 3717275 - RNA, 18 nt, Human
ucagaggcacaaaagggu

SEQ ID NO: 3717276 - RNA, 21 nt, Human
ucagaggcccucgcugccagc

SEQ ID NO: 3717277 - RNA, 22 nt, Human
ucagaggccuuaugaggguccu

SEQ ID NO: 3717278 - RNA, 21 nt, Human
ucagagggaaaguaaauauuu

SEQ ID NO: 3717279 - RNA, 22 nt, Human
ucagagggggacugcugcugcc

SEQ ID NO: 3717280 - RNA, 19 nt, Human
ucagaggguguccugcacc

SEQ ID NO: 3717281 - RNA, 18 nt, Human
ucagaguaagcugcuuuu

SEQ ID NO: 3717282 - RNA, 17 nt, Human
ucagaguccaggcccca

SEQ ID NO: 3717283 - RNA, 17 nt, Human
ucagaguccuuaaaaug

SEQ ID NO: 3717284 - RNA, 20 nt, Human
ucagagugacuacacacagu

SEQ ID NO: 3717285 - RNA, 20 nt, Human
ucagaguucuauacuguaaa

SEQ ID NO: 3717286 - RNA, 22 nt, Human
ucagauaacuguuauuuauaau

SEQ ID NO: 3717287 - RNA, 12 nt, Human
ucagauacauca

SEQ ID NO: 3717288 - RNA, 16 nt, Human
ucagauacaucacugc

SEQ ID NO: 3717289 - RNA, 17 nt, Human
ucagauacaucacugcu

SEQ ID NO: 3717290 - RNA, 21 nt, Human
ucagauacaucacugcuugau

SEQ ID NO: 3717291 - RNA, 14 nt, Human
ucagauauaaaaga

SEQ ID NO: 3717292 - RNA, 18 nt, Human
ucagauauaaaagacuga

SEQ ID NO: 3717293 - RNA, 16 nt, Human
ucagauauauuuuuca

SEQ ID NO: 3717294 - RNA, 23 nt, Human
ucagauaucuuggacaaaucaca

SEQ ID NO: 3717295 - RNA, 17 nt, Human
ucagauaugauucaaau

SEQ ID NO: 3717296 - RNA, 13 nt, Human
ucagauauuuaua

SEQ ID NO: 3717297 - RNA, 21 nt, Human
ucagauauuuauauuuuuauu

SEQ ID NO: 3717298 - RNA, 21 nt, Human
gcucuacuggucuuguggaau

SEQ ID NO: 3717299 - RNA, 22 nt, Human
gcucuagaucauaaggcuucaa

SEQ ID NO: 3717300 - RNA, 14 nt, Human
gcucuagccugggc

SEQ ID NO: 3717301 - RNA, 22 nt, Human
gcucuaggguugcuggagccug

SEQ ID NO: 3717302 - RNA, 15 nt, Human
gcucuagugccuucu

SEQ ID NO: 3717303 - RNA, 14 nt, Human
gcucuagugggaca

SEQ ID NO: 3717304 - RNA, 21 nt, Human
gcucuagugggacagcccaga

SEQ ID NO: 3717305 - RNA, 21 nt, Human
gcucuaucuugcucuguaauc

SEQ ID NO: 3717306 - RNA, 22 nt, Human
gcucuaucuugcucuguaaucu

SEQ ID NO: 3717307 - RNA, 14 nt, Human
gcucuaugagucua

SEQ ID NO: 3717308 - RNA, 21 nt, Human
gcucuaugagucuagauguuu

SEQ ID NO: 3717309 - RNA, 15 nt, Human
gcucuauguuuacaa

SEQ ID NO: 3717310 - RNA, 21 nt, Human
gcucuauuaugaaugugaagc

SEQ ID NO: 3717311 - RNA, 23 nt, Human
gcucuauuaugaaugugaagccu

SEQ ID NO: 3717312 - RNA, 17 nt, Human
gcucuauuguagcauuu

SEQ ID NO: 3717313 - RNA, 19 nt, Human
gcucucaacccaggagcau

SEQ ID NO: 3717314 - RNA, 17 nt, Human
gcucucaccuggcccug

SEQ ID NO: 3717315 - RNA, 17 nt, Human
gcucucagccaacgagu

SEQ ID NO: 3717316 - RNA, 18 nt, Human
gcucucagcucagcgcca

SEQ ID NO: 3717317 - RNA, 17 nt, Human
gcucucaggccagcugc

SEQ ID NO: 3717318 - RNA, 22 nt, Human
gcucucaguuccgauuucccag

SEQ ID NO: 3717319 - RNA, 12 nt, Human
gcucucaguucu

SEQ ID NO: 3717320 - RNA, 14 nt, Human
gcucucaucugagg

SEQ ID NO: 3717321 - RNA, 22 nt, Human
gcucucaucugaggcauccagc

SEQ ID NO: 3717322 - RNA, 19 nt, Human
gcucuccaagugccagagg

SEQ ID NO: 3717323 - RNA, 20 nt, Human
gcucuccaagugccagaggu

SEQ ID NO: 3717324 - RNA, 13 nt, Human
gcucuccaccuca

SEQ ID NO: 3717325 - RNA, 16 nt, Human
gcucuccaccucagcc

SEQ ID NO: 3717326 - RNA, 17 nt, Human
gcucuccagccugggag

SEQ ID NO: 3717327 - RNA, 13 nt, Human
gcucuccagcucc

SEQ ID NO: 3717328 - RNA, 15 nt, Human
gcucuccagcuccaa

SEQ ID NO: 3717329 - RNA, 19 nt, Human
gcucuccagucaggaggca

SEQ ID NO: 3717330 - RNA, 12 nt, Human
gcucuccauucu

SEQ ID NO: 3717331 - RNA, 19 nt, Human
gcucuccauucugcuccuu

SEQ ID NO: 3717332 - RNA, 19 nt, Human
gcucuccccugcccugcug

SEQ ID NO: 3717333 - RNA, 20 nt, Human
gcucucccucuggcccugcc

SEQ ID NO: 3717334 - RNA, 13 nt, Human
gcucuccgaccag

SEQ ID NO: 3717335 - RNA, 19 nt, Human
gcucuccggggccauuugc

SEQ ID NO: 3717336 - RNA, 19 nt, Human
gcucuccucagaagaaaga

SEQ ID NO: 3717337 - RNA, 23 nt, Human
gcucuccucuucuacucacuuuu

SEQ ID NO: 3717338 - RNA, 14 nt, Human
gcucuccugacuuu

SEQ ID NO: 3717339 - RNA, 14 nt, Human
gcucuccuggcccu

SEQ ID NO: 3717340 - RNA, 13 nt, Human
gcucuccuggcuu

SEQ ID NO: 3717341 - RNA, 12 nt, Human
gcucuccuuccu

SEQ ID NO: 3717342 - RNA, 16 nt, Human
gcucucgcggccucuu

SEQ ID NO: 3717343 - RNA, 19 nt, Human
gcucucggaacugcaugcu

SEQ ID NO: 3717344 - RNA, 18 nt, Human
gcucucuaggccucucca

SEQ ID NO: 3717345 - RNA, 19 nt, Human
gcucucucauugucugugu

SEQ ID NO: 3717346 - RNA, 13 nt, Human
gcucucuccagga

SEQ ID NO: 3717347 - RNA, 21 nt, Human
gcucucugaguccuggcccaa

SEQ ID NO: 3717348 - RNA, 13 nt, Human
gcucucugcagcc

SEQ ID NO: 3717349 - RNA, 18 nt, Human
gcucucugcagccagccc

SEQ ID NO: 3717350 - RNA, 22 nt, Human
gcucucugcagccagcccagcc

SEQ ID NO: 3717351 - RNA, 14 nt, Human
gcucucugcccugu

SEQ ID NO: 3717352 - RNA, 13 nt, Human
gcucucugcugua

SEQ ID NO: 3717353 - RNA, 12 nt, Human
gcucucuggccu

SEQ ID NO: 3717354 - RNA, 14 nt, Human
gcucucuggccuuc

SEQ ID NO: 3717355 - RNA, 17 nt, Human
gcucucuggccuucggc

SEQ ID NO: 3717356 - RNA, 19 nt, Human
gcucucugugggcuggcag

SEQ ID NO: 3717357 - RNA, 12 nt, Human
gcucucuuccug

SEQ ID NO: 3717358 - RNA, 15 nt, Human
gcucucuuccugccc

SEQ ID NO: 3717359 - RNA, 19 nt, Human
gcucucuuccugccccucu

SEQ ID NO: 3717360 - RNA, 22 nt, Human
gcucucuuccugccccucuuuc

SEQ ID NO: 3717361 - RNA, 15 nt, Human
gcucucuuucugucu

SEQ ID NO: 3717362 - RNA, 18 nt, Human
gcucucuuuucuguacuu

SEQ ID NO: 3717363 - RNA, 19 nt, Human
gcucucuuuucuguacuuc

SEQ ID NO: 3717364 - RNA, 17 nt, Human
gcucugaaagagaaaca

SEQ ID NO: 3717365 - RNA, 15 nt, Human
gcucugaaagccagc

SEQ ID NO: 3717366 - RNA, 23 nt, Human
gcucugaagucacaucacaggac

SEQ ID NO: 3717367 - RNA, 22 nt, Human
gcucugaccacuugaggccuga

SEQ ID NO: 3717368 - RNA, 17 nt, Human
gcucugacccagugaga

SEQ ID NO: 3717369 - RNA, 11 nt, Human
gcucugagaac

SEQ ID NO: 3717370 - RNA, 16 nt, Human
gcucugagaggcccug

SEQ ID NO: 3717371 - RNA, 17 nt, Human
gcucugagaggcccugg

SEQ ID NO: 3717372 - RNA, 21 nt, Human
gcucugagcaaauguggcucc

SEQ ID NO: 3717373 - RNA, 17 nt, Human
gcucugagcgccuccau

SEQ ID NO: 3717374 - RNA, 11 nt, Human
gcucugaggga

SEQ ID NO: 3717375 - RNA, 20 nt, Human
gcucugaucauccacugugc

SEQ ID NO: 3717376 - RNA, 22 nt, Human
gcucugaucauccacugugcca

SEQ ID NO: 3717377 - RNA, 13 nt, Human
gcucugaucccuc

SEQ ID NO: 3717378 - RNA, 23 nt, Human
gcucugaugaaaaauugcugacu

SEQ ID NO: 3717379 - RNA, 19 nt, Human
gcucugaugcaucagaaag

SEQ ID NO: 3717380 - RNA, 15 nt, Human
gcucugcaaaaggag

SEQ ID NO: 3717381 - RNA, 23 nt, Human
gcucugcaauuccccucugcugc

SEQ ID NO: 3717382 - RNA, 13 nt, Human
gcucugcacagau

SEQ ID NO: 3717383 - RNA, 14 nt, Human
gcucugcacagaug

SEQ ID NO: 3717384 - RNA, 15 nt, Human
gcucugcaccccucu

SEQ ID NO: 3717385 - RNA, 14 nt, Human
gcucugcaggcacc

SEQ ID NO: 3717386 - RNA, 18 nt, Human
gcucugcaggcaccuuag

SEQ ID NO: 3717387 - RNA, 18 nt, Human
gcucugcaguccuacuca

SEQ ID NO: 3717388 - RNA, 17 nt, Human
gcucugcaugcggccca

SEQ ID NO: 3717389 - RNA, 21 nt, Human
gcucugcaugcggcccagccc

SEQ ID NO: 3717390 - RNA, 23 nt, Human
gcucugccaacuucuucagagcu

SEQ ID NO: 3717391 - RNA, 17 nt, Human
gcucugccaguccuguc

SEQ ID NO: 3717392 - RNA, 12 nt, Human
gcucugcccaga

SEQ ID NO: 3717393 - RNA, 16 nt, Human
gcucugcccagagcug

SEQ ID NO: 3717394 - RNA, 18 nt, Human
gcucugcccagagcuggg

SEQ ID NO: 3717395 - RNA, 21 nt, Human
gcucugccccagaggccucuc

SEQ ID NO: 3717396 - RNA, 15 nt, Human
gcucugccccagcuc

SEQ ID NO: 3717397 - RNA, 23 nt, Human
gcucugcccuugguuaggcauug

SEQ ID NO: 3717398 - RNA, 17 nt, Human
gcucugccgucucugga

SEQ ID NO: 3717399 - RNA, 15 nt, Human
gcucugccucccauc

SEQ ID NO: 3717400 - RNA, 22 nt, Human
gcucugccucccaucacccgcu

SEQ ID NO: 3717401 - RNA, 22 nt, Human
gcucugccuucgaggucagagg

SEQ ID NO: 3717402 - RNA, 16 nt, Human
gcucugccuuugcucu

SEQ ID NO: 3717403 - RNA, 20 nt, Human
gcucugcgucgguccuggug

SEQ ID NO: 3717404 - RNA, 21 nt, Human
gcucugcgucgguccuggugc

SEQ ID NO: 3717405 - RNA, 21 nt, Human
gcucugcuccucuccccagca

SEQ ID NO: 3717406 - RNA, 19 nt, Human
gcucugcugacagacacag

SEQ ID NO: 3717407 - RNA, 23 nt, Human
gcucugcugacagacacaggccc

SEQ ID NO: 3717408 - RNA, 15 nt, Human
gcucugcuggccugg

SEQ ID NO: 3717409 - RNA, 18 nt, Human
gcucugcuggccuggccg

SEQ ID NO: 3717410 - RNA, 23 nt, Human
gcucugcugugggcacaggucag

SEQ ID NO: 3717411 - RNA, 21 nt, Human
gcucugcuugacaacaucuga

SEQ ID NO: 3717412 - RNA, 19 nt, Human
gcucugcuugccgaaacug

SEQ ID NO: 3717413 - RNA, 20 nt, Human
gcucugcuugccgaaacugg

SEQ ID NO: 3717414 - RNA, 22 nt, Human
gcucuggaaaaugugacccaga

SEQ ID NO: 3717415 - RNA, 20 nt, Human
gcucuggacagccccacccu

SEQ ID NO: 3717416 - RNA, 11 nt, Human
gcucuggacca

SEQ ID NO: 3717417 - RNA, 17 nt, Human
gcucuggaccagccugu

SEQ ID NO: 3717418 - RNA, 13 nt, Human
gcucuggaccugc

SEQ ID NO: 3717419 - RNA, 17 nt, Human
gcucuggaccugccccc

SEQ ID NO: 3717420 - RNA, 18 nt, Human
gcucuggagccaccuguc

SEQ ID NO: 3717421 - RNA, 16 nt, Human
gcucuggagcccacug

SEQ ID NO: 3717422 - RNA, 18 nt, Human
gcucuggauaacaagacu

SEQ ID NO: 3717423 - RNA, 21 nt, Human
gcucuggcucuccccaauauc

SEQ ID NO: 3717424 - RNA, 16 nt, Human
gcucuggcugaacccu

SEQ ID NO: 3717425 - RNA, 22 nt, Human
gcucuggcugaacccugugcug

SEQ ID NO: 3717426 - RNA, 15 nt, Human
gcucugggagaggau

SEQ ID NO: 3717427 - RNA, 21 nt, Human
gcucugggauagcugacccag

SEQ ID NO: 3717428 - RNA, 15 nt, Human
gcucugguccauaga

SEQ ID NO: 3717429 - RNA, 23 nt, Human
gcucuguaaguagaugcauuugg

SEQ ID NO: 3717430 - RNA, 14 nt, Human
gcucuguccccagc

SEQ ID NO: 3717431 - RNA, 17 nt, Human
gcucuguccccagccug

SEQ ID NO: 3717432 - RNA, 19 nt, Human
gcucugucuacuugcucag

SEQ ID NO: 3717433 - RNA, 21 nt, Human
gcucugucuacuugcucaggu

SEQ ID NO: 3717434 - RNA, 19 nt, Human
gcucugucuugguagguuu

SEQ ID NO: 3717435 - RNA, 17 nt, Human
gcucugugcccacccuc

SEQ ID NO: 3717436 - RNA, 16 nt, Human
gcucugugcugacccu

SEQ ID NO: 3717437 - RNA, 20 nt, Human
gcucuguggcgagccauuug

SEQ ID NO: 3717438 - RNA, 14 nt, Human
gcucugugggcugc

SEQ ID NO: 3717439 - RNA, 13 nt, Human
gcucuguggguga

SEQ ID NO: 3717440 - RNA, 17 nt, Human
gcucuguuacccagggu

SEQ ID NO: 3717441 - RNA, 18 nt, Human
gcucuguucuuccucagc

SEQ ID NO: 3717442 - RNA, 21 nt, Human
gcucuguucuuccucagccag

SEQ ID NO: 3717443 - RNA, 22 nt, Human
gcucuguucuuccucagccagc

SEQ ID NO: 3717444 - RNA, 18 nt, Human
gcucuguugcccaggcug

SEQ ID NO: 3717445 - RNA, 21 nt, Human
gcucuguuuguggggugacgg

SEQ ID NO: 3717446 - RNA, 13 nt, Human
gcucuuaaaugua

SEQ ID NO: 3717447 - RNA, 20 nt, Human
aacuugcugcaguaugaaaa

SEQ ID NO: 3717448 - RNA, 12 nt, Human
aacuugcugccu

SEQ ID NO: 3717449 - RNA, 14 nt, Human
aacuugcuuaaaug

SEQ ID NO: 3717450 - RNA, 16 nt, Human
aacuugcuuaaaugug

SEQ ID NO: 3717451 - RNA, 18 nt, Human
aacuugcuuaaaugugaa

SEQ ID NO: 3717452 - RNA, 20 nt, Human
aacuugcuuaaaugugaauu

SEQ ID NO: 3717453 - RNA, 21 nt, Human
aacuugcuuaaaugugaauua

SEQ ID NO: 3717454 - RNA, 14 nt, Human
aacuugcuuaaauu

SEQ ID NO: 3717455 - RNA, 20 nt, Human
aacuugcuuaaauuucuuau

SEQ ID NO: 3717456 - RNA, 14 nt, Human
aacuuggaaauagu

SEQ ID NO: 3717457 - RNA, 14 nt, Human
aacuuggauucucu

SEQ ID NO: 3717458 - RNA, 17 nt, Human
aacuuggcgcugccccu

SEQ ID NO: 3717459 - RNA, 21 nt, Human
aacuuggcucgaaucucugug

SEQ ID NO: 3717460 - RNA, 23 nt, Human
aacuugggagugugguuucuuuu

SEQ ID NO: 3717461 - RNA, 16 nt, Human
aacuugggcacaugcu

SEQ ID NO: 3717462 - RNA, 13 nt, Human
aacuuggggaaca

SEQ ID NO: 3717463 - RNA, 21 nt, Human
aacuuggggaguuaagaccug

SEQ ID NO: 3717464 - RNA, 23 nt, Human
aacuuggggaguuaagaccuggc

SEQ ID NO: 3717465 - RNA, 16 nt, Human
aacuugguucugcuuc

SEQ ID NO: 3717466 - RNA, 16 nt, Human
aacuugguuuugcuac

SEQ ID NO: 3717467 - RNA, 15 nt, Human
aacuuguaaaugugg

SEQ ID NO: 3717468 - RNA, 14 nt, Human
aacuuguagcugua

SEQ ID NO: 3717469 - RNA, 17 nt, Human
aacuuguagcuguaaaa

SEQ ID NO: 3717470 - RNA, 18 nt, Human
aacuuguagcuguaaaac

SEQ ID NO: 3717471 - RNA, 17 nt, Human
aacuugucacuugcaug

SEQ ID NO: 3717472 - RNA, 19 nt, Human
aacuuguccuagcacagau

SEQ ID NO: 3717473 - RNA, 19 nt, Human
aacuugucuaaauaaguuu

SEQ ID NO: 3717474 - RNA, 15 nt, Human
aacuugucucuucau

SEQ ID NO: 3717475 - RNA, 13 nt, Human
aacuugucuuaaa

SEQ ID NO: 3717476 - RNA, 17 nt, Human
aacuugucuuaaauaaa

SEQ ID NO: 3717477 - RNA, 18 nt, Human
aacuugucuuuggacccu

SEQ ID NO: 3717478 - RNA, 14 nt, Human
aacuugucuuuuca

SEQ ID NO: 3717479 - RNA, 11 nt, Human
aacuugugaau

SEQ ID NO: 3717480 - RNA, 13 nt, Human
aacuugugaaugc

SEQ ID NO: 3717481 - RNA, 16 nt, Human
aacuugugcccucccu

SEQ ID NO: 3717482 - RNA, 18 nt, Human
aacuuguuacuaaagaaa

SEQ ID NO: 3717483 - RNA, 15 nt, Human
aacuuguuauuguga

SEQ ID NO: 3717484 - RNA, 17 nt, Human
aacuuguuauugugaau

SEQ ID NO: 3717485 - RNA, 19 nt, Human
aacuuguuauugugaauga

SEQ ID NO: 3717486 - RNA, 16 nt, Human
aacuuguugaauuuau

SEQ ID NO: 3717487 - RNA, 17 nt, Human
aacuuguuugcugugaa

SEQ ID NO: 3717488 - RNA, 21 nt, Human
aacuuuaaaccuguagaauca

SEQ ID NO: 3717489 - RNA, 20 nt, Human
aacuuuaaaggauucuguau

SEQ ID NO: 3717490 - RNA, 18 nt, Human
aacuuuaaguuucaggau

SEQ ID NO: 3717491 - RNA, 12 nt, Human
aacuuuaaucaa

SEQ ID NO: 3717492 - RNA, 14 nt, Human
aacuuuaauguuuu

SEQ ID NO: 3717493 - RNA, 12 nt, Human
aacuuuaccaug

SEQ ID NO: 3717494 - RNA, 21 nt, Human
aacuuuagaagugcauuucug

SEQ ID NO: 3717495 - RNA, 21 nt, Human
aacuuuauacauuaguaaaug

SEQ ID NO: 3717496 - RNA, 23 nt, Human
aacuuuauacccagaaaguuauu

SEQ ID NO: 3717497 - RNA, 14 nt, Human
aacuuuauuaaaua

SEQ ID NO: 3717498 - RNA, 17 nt, Human
aacuuuauuaaauacaa

SEQ ID NO: 3717499 - RNA, 19 nt, Human
aacuuucaagaacuuguuu

SEQ ID NO: 3717500 - RNA, 17 nt, Human
aacuuucauuuuuuucc

SEQ ID NO: 3717501 - RNA, 16 nt, Human
aacuuuccaaacacca

SEQ ID NO: 3717502 - RNA, 19 nt, Human
aacuuuccuggaugucuga

SEQ ID NO: 3717503 - RNA, 14 nt, Human
aacuuugaaauaua

SEQ ID NO: 3717504 - RNA, 14 nt, Human
aacuuugaauaaag

SEQ ID NO: 3717505 - RNA, 23 nt, Human
aacuuugaauaaagaauacuuga

SEQ ID NO: 3717506 - RNA, 13 nt, Human
aacuuugaccucu

SEQ ID NO: 3717507 - RNA, 19 nt, Human
aacuuugaccucugcagca

SEQ ID NO: 3717508 - RNA, 20 nt, Human
aacuuugaccucugcagcaa

SEQ ID NO: 3717509 - RNA, 15 nt, Human
aacuuugcugagccu

SEQ ID NO: 3717510 - RNA, 15 nt, Human
aacuuuggaaccaga

SEQ ID NO: 3717511 - RNA, 24 nt, Human
aacuuuggaaccagacucuugccu

SEQ ID NO: 3717512 - RNA, 18 nt, Human
aacuuuguaaaaaucuuu

SEQ ID NO: 3717513 - RNA, 21 nt, Human
aacuuuguaaaaaucuuuuga

SEQ ID NO: 3717514 - RNA, 20 nt, Human
aacuuuguauaguuauguaa

SEQ ID NO: 3717515 - RNA, 11 nt, Human
aacuuuuaauu

SEQ ID NO: 3717516 - RNA, 22 nt, Human
aacuuuuaauuaaaugcucauc

SEQ ID NO: 3717517 - RNA, 16 nt, Human
aacuuuuauaaauuaa

SEQ ID NO: 3717518 - RNA, 20 nt, Human
aacuuuuauaaauuaaauau

SEQ ID NO: 3717519 - RNA, 14 nt, Human
aacuuuuaucuauu

SEQ ID NO: 3717520 - RNA, 20 nt, Human
aacuuuucaaggcuuauauu

SEQ ID NO: 3717521 - RNA, 18 nt, Human
aacuuuuccccuguccug

SEQ ID NO: 3717522 - RNA, 12 nt, Human
aacuuuucucag

SEQ ID NO: 3717523 - RNA, 12 nt, Human
aacuuuucugau

SEQ ID NO: 3717524 - RNA, 13 nt, Human
aacuuuucugaua

SEQ ID NO: 3717525 - RNA, 14 nt, Human
aacuuuucugauag

SEQ ID NO: 3717526 - RNA, 21 nt, Human
aacuuuucuuaaaaaguuaua

SEQ ID NO: 3717527 - RNA, 15 nt, Human
aacuuuuguaaagaa

SEQ ID NO: 3717528 - RNA, 11 nt, Human
aacuuuuguac

SEQ ID NO: 3717529 - RNA, 18 nt, Human
aacuuuuguacugaauuu

SEQ ID NO: 3717530 - RNA, 19 nt, Human
aacuuuuguacugaauuuu

SEQ ID NO: 3717531 - RNA, 20 nt, Human
aacuuuuguacugaauuuuu

SEQ ID NO: 3717532 - RNA, 15 nt, Human
aacuuuugugugaaa

SEQ ID NO: 3717533 - RNA, 15 nt, Human
aacuuuuuaaagagu

SEQ ID NO: 3717534 - RNA, 16 nt, Human
aacuuuuuauauucuc

SEQ ID NO: 3717535 - RNA, 14 nt, Human
aacuuuuuauugcc

SEQ ID NO: 3717536 - RNA, 21 nt, Human
aacuuuuucuuuucccucaau

SEQ ID NO: 3717537 - RNA, 17 nt, Human
aacuuuuuuaaauaaac

SEQ ID NO: 3717538 - RNA, 17 nt, Human
aacuuuuuuucaaugug

SEQ ID NO: 3717539 - RNA, 14 nt, Human
aacuuuuuuuuaag

SEQ ID NO: 3717540 - RNA, 20 nt, Human
aacuuuuuuuuaaguuacac

SEQ ID NO: 3717541 - RNA, 16 nt, Human
aacuuuuuuuugagaa

SEQ ID NO: 3717542 - RNA, 18 nt, Human
aacuuuuuuuuuucuuua

SEQ ID NO: 3717543 - RNA, 20 nt, Human
aagaaaaaaaaaaagaaaga

SEQ ID NO: 3717544 - RNA, 21 nt, Human
aagaaaaaaaaaaagaaagaa

SEQ ID NO: 3717545 - RNA, 19 nt, Human
aagaaaaaaaaaagaagaa

SEQ ID NO: 3717546 - RNA, 20 nt, Human
aagaaaaaaaaaagaagaag

SEQ ID NO: 3717547 - RNA, 15 nt, Human
aagaaaaaaaaaugc

SEQ ID NO: 3717548 - RNA, 20 nt, Human
aagaaaaaaaauaacacaga

SEQ ID NO: 3717549 - RNA, 20 nt, Human
aagaaaaaaauaauuuuaug

SEQ ID NO: 3717550 - RNA, 22 nt, Human
aagaaaaaaauacuauuuaaga

SEQ ID NO: 3717551 - RNA, 15 nt, Human
aagaaaaaaauguau

SEQ ID NO: 3717552 - RNA, 16 nt, Human
aagaaaaaaauguauu

SEQ ID NO: 3717553 - RNA, 23 nt, Human
aagaaaaaaauguauuuuauguu

SEQ ID NO: 3717554 - RNA, 18 nt, Human
aagaaaaaaauugaaaug

SEQ ID NO: 3717555 - RNA, 23 nt, Human
aagaaaaaaccguguuugucucu

SEQ ID NO: 3717556 - RNA, 18 nt, Human
aagaaaaaagagaaaaga

SEQ ID NO: 3717557 - RNA, 20 nt, Human
aagaaaaacaaacucguuuu

SEQ ID NO: 3717558 - RNA, 12 nt, Human
aagaaaaacuuu

SEQ ID NO: 3717559 - RNA, 17 nt, Human
aagaaaaagcaaaaggc

SEQ ID NO: 3717560 - RNA, 19 nt, Human
aagaaaaaggaugcacaga

SEQ ID NO: 3717561 - RNA, 20 nt, Human
aagaaaaaggaugcacagag

SEQ ID NO: 3717562 - RNA, 22 nt, Human
aagaaaaaggaugcacagaguu

SEQ ID NO: 3717563 - RNA, 16 nt, Human
aagaaaaauaaagaaa

SEQ ID NO: 3717564 - RNA, 14 nt, Human
aagaaaaaucaugu

SEQ ID NO: 3717565 - RNA, 19 nt, Human
aagaaaaaucauguuugcu

SEQ ID NO: 3717566 - RNA, 12 nt, Human
aagaaaaaugug

SEQ ID NO: 3717567 - RNA, 11 nt, Human
aagaaaacacu

SEQ ID NO: 3717568 - RNA, 16 nt, Human
aagaaaacaucuauuc

SEQ ID NO: 3717569 - RNA, 17 nt, Human
aagaaaacaucuuuaag

SEQ ID NO: 3717570 - RNA, 13 nt, Human
aagaaaaguauuu

SEQ ID NO: 3717571 - RNA, 22 nt, Human
aagaaaaguauuuugaaguuua

SEQ ID NO: 3717572 - RNA, 23 nt, Human
aagaaaaguauuuugaaguuuac

SEQ ID NO: 3717573 - RNA, 19 nt, Human
aagaaaagugaaugcucaa

SEQ ID NO: 3717574 - RNA, 15 nt, Human
aagaaaagugcauau

SEQ ID NO: 3717575 - RNA, 15 nt, Human
aagaaaagugggcca

SEQ ID NO: 3717576 - RNA, 16 nt, Human
aagaaaagugggccag

SEQ ID NO: 3717577 - RNA, 13 nt, Human
aagaaaauaaaaa

SEQ ID NO: 3717578 - RNA, 14 nt, Human
aagaaaauaaaauu

SEQ ID NO: 3717579 - RNA, 15 nt, Human
aagaaaauaaaauua

SEQ ID NO: 3717580 - RNA, 16 nt, Human
aagaaaauacaauaaa

SEQ ID NO: 3717581 - RNA, 18 nt, Human
aagaaaauacaauaaacu

SEQ ID NO: 3717582 - RNA, 13 nt, Human
aagaaaauaugca

SEQ ID NO: 3717583 - RNA, 11 nt, Human
aagaaaauauu

SEQ ID NO: 3717584 - RNA, 13 nt, Human
aagaaaauauuuu

SEQ ID NO: 3717585 - RNA, 14 nt, Human
aagaaaauauuuug

SEQ ID NO: 3717586 - RNA, 15 nt, Human
aagaaaauauuuugu

SEQ ID NO: 3717587 - RNA, 20 nt, Human
aagaaaauauuuugucuaaa

SEQ ID NO: 3717588 - RNA, 20 nt, Human
aagaaaaucauauugcuucu

SEQ ID NO: 3717589 - RNA, 15 nt, Human
aagaaaauuccuaua

SEQ ID NO: 3717590 - RNA, 16 nt, Human
aagaaaauugcugugc

SEQ ID NO: 3717591 - RNA, 16 nt, Human
aagaaacaaacccguu

SEQ ID NO: 3717592 - RNA, 14 nt, Human
aagaaacaaagaug

SEQ ID NO: 3717593 - RNA, 16 nt, Human
aagaaacaagguuuuc

SEQ ID NO: 3717594 - RNA, 19 nt, Human
aagaaacagcuaugagagg

SEQ ID NO: 3717595 - RNA, 11 nt, Human
aagaaacauuu

SEQ ID NO: 3717596 - RNA, 14 nt, Human
aagaaacauuuaua

SEQ ID NO: 3717597 - RNA, 18 nt, Human
aagaaacccgacagaggg

SEQ ID NO: 3717598 - RNA, 20 nt, Human
uccacucaggccuccaucuu

SEQ ID NO: 3717599 - RNA, 14 nt, Human
uccacucaugugac

SEQ ID NO: 3717600 - RNA, 13 nt, Human
uccacucccacuu

SEQ ID NO: 3717601 - RNA, 14 nt, Human
uccacucguguguu

SEQ ID NO: 3717602 - RNA, 16 nt, Human
uccacucguguguuuc

SEQ ID NO: 3717603 - RNA, 17 nt, Human
uccacucuacccuccca

SEQ ID NO: 3717604 - RNA, 14 nt, Human
uccacucuccccca

SEQ ID NO: 3717605 - RNA, 16 nt, Human
uccacucucccccacc

SEQ ID NO: 3717606 - RNA, 22 nt, Human
uccacucucccccacccccucc

SEQ ID NO: 3717607 - RNA, 21 nt, Human
uccacucugcuucucugacuu

SEQ ID NO: 3717608 - RNA, 19 nt, Human
uccacucuggauucagccu

SEQ ID NO: 3717609 - RNA, 12 nt, Human
uccacugcccuc

SEQ ID NO: 3717610 - RNA, 13 nt, Human
uccacugccucug

SEQ ID NO: 3717611 - RNA, 10 nt, Human
uccacuggac

SEQ ID NO: 3717612 - RNA, 12 nt, Human
uccacuggacuu

SEQ ID NO: 3717613 - RNA, 16 nt, Human
uccacugggcacaacu

SEQ ID NO: 3717614 - RNA, 18 nt, Human
uccacugggguggccuga

SEQ ID NO: 3717615 - RNA, 17 nt, Human
uccacuggguguaaaca

SEQ ID NO: 3717616 - RNA, 22 nt, Human
uccacugguucuucuuggucuc

SEQ ID NO: 3717617 - RNA, 17 nt, Human
uccacugucacccucca

SEQ ID NO: 3717618 - RNA, 19 nt, Human
uccacugucacuguuucuc

SEQ ID NO: 3717619 - RNA, 23 nt, Human
uccacuuagaaauugcauuuccu

SEQ ID NO: 3717620 - RNA, 17 nt, Human
uccacuucugacagccu

SEQ ID NO: 3717621 - RNA, 14 nt, Human
uccacuucuuccuu

SEQ ID NO: 3717622 - RNA, 17 nt, Human
uccacuucuuccuuucu

SEQ ID NO: 3717623 - RNA, 18 nt, Human
uccacuucuuccuuucuc

SEQ ID NO: 3717624 - RNA, 20 nt, Human
uccacuucuuccuuucucuu

SEQ ID NO: 3717625 - RNA, 23 nt, Human
uccacuuggucugugagaugcua

SEQ ID NO: 3717626 - RNA, 14 nt, Human
uccacuuguucagg

SEQ ID NO: 3717627 - RNA, 14 nt, Human
uccacuuucagcug

SEQ ID NO: 3717628 - RNA, 13 nt, Human
uccacuuuguucu

SEQ ID NO: 3717629 - RNA, 14 nt, Human
uccagaaaacaaaa

SEQ ID NO: 3717630 - RNA, 18 nt, Human
uccagaaaaccccagcau

SEQ ID NO: 3717631 - RNA, 14 nt, Human
uccagaaaacugug

SEQ ID NO: 3717632 - RNA, 17 nt, Human
uccagaaacacccacag

SEQ ID NO: 3717633 - RNA, 16 nt, Human
uccagaaacuuguucu

SEQ ID NO: 3717634 - RNA, 11 nt, Human
uccagaaagaa

SEQ ID NO: 3717635 - RNA, 22 nt, Human
uccagaaaggauauuuaagaaa

SEQ ID NO: 3717636 - RNA, 22 nt, Human
uccagaaaugucccuuucuucu

SEQ ID NO: 3717637 - RNA, 23 nt, Human
uccagaaaugucuaaaugcugaa

SEQ ID NO: 3717638 - RNA, 20 nt, Human
uccagaacacggcucacgcu

SEQ ID NO: 3717639 - RNA, 19 nt, Human
uccagaaccacacuugaaa

SEQ ID NO: 3717640 - RNA, 22 nt, Human
uccagaacucacuggggccuac

SEQ ID NO: 3717641 - RNA, 18 nt, Human
uccagaagaagagaagcu

SEQ ID NO: 3717642 - RNA, 19 nt, Human
uccagaagaagagaagcug

SEQ ID NO: 3717643 - RNA, 21 nt, Human
uccagaagaagagaagcugcu

SEQ ID NO: 3717644 - RNA, 22 nt, Human
uccagaagaagagaagcugcug

SEQ ID NO: 3717645 - RNA, 23 nt, Human
uccagaagaagagaagcugcuga

SEQ ID NO: 3717646 - RNA, 16 nt, Human
uccagaagaauauuca

SEQ ID NO: 3717647 - RNA, 17 nt, Human
uccagaagaauauucag

SEQ ID NO: 3717648 - RNA, 20 nt, Human
uccagaagaauauucaggac

SEQ ID NO: 3717649 - RNA, 21 nt, Human
uccagaagaauauucaggacu

SEQ ID NO: 3717650 - RNA, 16 nt, Human
uccagaagccucuggc

SEQ ID NO: 3717651 - RNA, 23 nt, Human
uccagaagggguuuggucuggga

SEQ ID NO: 3717652 - RNA, 20 nt, Human
uccagaagugugacuggcua

SEQ ID NO: 3717653 - RNA, 14 nt, Human
uccagaaucuaaag

SEQ ID NO: 3717654 - RNA, 19 nt, Human
uccagaaugaagaauucag

SEQ ID NO: 3717655 - RNA, 16 nt, Human
uccagaaugcuguaca

SEQ ID NO: 3717656 - RNA, 18 nt, Human
uccagaauggucuuucua

SEQ ID NO: 3717657 - RNA, 16 nt, Human
uccagaauuucccaaa

SEQ ID NO: 3717658 - RNA, 22 nt, Human
uccagaauuuggaaauccuagu

SEQ ID NO: 3717659 - RNA, 13 nt, Human
uccagacacaugu

SEQ ID NO: 3717660 - RNA, 18 nt, Human
uccagacagccuguaucu

SEQ ID NO: 3717661 - RNA, 14 nt, Human
uccagacccccacc

SEQ ID NO: 3717662 - RNA, 16 nt, Human
uccagacccccacccc

SEQ ID NO: 3717663 - RNA, 21 nt, Human
uccagacccccaccccuuccc

SEQ ID NO: 3717664 - RNA, 14 nt, Human
uccagacccccagc

SEQ ID NO: 3717665 - RNA, 15 nt, Human
uccagacccccagca

SEQ ID NO: 3717666 - RNA, 15 nt, Human
uccagaccccuggcu

SEQ ID NO: 3717667 - RNA, 17 nt, Human
uccagaccccuggcuuu

SEQ ID NO: 3717668 - RNA, 15 nt, Human
uccagaccugaagaa

SEQ ID NO: 3717669 - RNA, 22 nt, Human
uccagaccugauccuggaggcc

SEQ ID NO: 3717670 - RNA, 21 nt, Human
uccagaccuuguucacacucu

SEQ ID NO: 3717671 - RNA, 18 nt, Human
uccagacucagagcucuc

SEQ ID NO: 3717672 - RNA, 15 nt, Human
uccagacucucugug

SEQ ID NO: 3717673 - RNA, 19 nt, Human
uccagacuuccuugagaca

SEQ ID NO: 3717674 - RNA, 14 nt, Human
uccagagacaacag

SEQ ID NO: 3717675 - RNA, 14 nt, Human
uccagagagaccga

SEQ ID NO: 3717676 - RNA, 15 nt, Human
uccagagaguccucu

SEQ ID NO: 3717677 - RNA, 15 nt, Human
uccagagaguggcuc

SEQ ID NO: 3717678 - RNA, 22 nt, Human
uccagagaguggcuccucccgg

SEQ ID NO: 3717679 - RNA, 19 nt, Human
uccagagauucauuuucua

SEQ ID NO: 3717680 - RNA, 20 nt, Human
uccagagcauuccagucagg

SEQ ID NO: 3717681 - RNA, 17 nt, Human
uccagagccccacagcc

SEQ ID NO: 3717682 - RNA, 23 nt, Human
uccagagcggaggcugugugccu

SEQ ID NO: 3717683 - RNA, 16 nt, Human
uccagagcugcuuccc

SEQ ID NO: 3717684 - RNA, 17 nt, Human
uccagagggcacucugc

SEQ ID NO: 3717685 - RNA, 23 nt, Human
uccagaucccaggccccuggagg

SEQ ID NO: 3717686 - RNA, 17 nt, Human
uccagaugcagggcagu

SEQ ID NO: 3717687 - RNA, 21 nt, Human
uccagaugccuucuccagaca

SEQ ID NO: 3717688 - RNA, 21 nt, Human
uccagauggucauccagacuc

SEQ ID NO: 3717689 - RNA, 14 nt, Human
uccagaugguggga

SEQ ID NO: 3717690 - RNA, 13 nt, Human
uccagaugugaug

SEQ ID NO: 3717691 - RNA, 19 nt, Human
uccagaugugaugcuugau

SEQ ID NO: 3717692 - RNA, 21 nt, Human
uccagauguggcuacugacau

SEQ ID NO: 3717693 - RNA, 18 nt, Human
uccagauguuuccagacu

SEQ ID NO: 3717694 - RNA, 19 nt, Human
uccagauguuuccagacuu

SEQ ID NO: 3717695 - RNA, 19 nt, Human
uccagauuuacacugggag

SEQ ID NO: 3717696 - RNA, 20 nt, Human
uccagauuuacacugggaga

SEQ ID NO: 3717697 - RNA, 22 nt, Human
uccagauuuuuuacagcugccu

SEQ ID NO: 3717698 - RNA, 18 nt, Human
uccagcaaaucaagcuga

SEQ ID NO: 3717699 - RNA, 18 nt, Human
uccagcaacuucuucucc

SEQ ID NO: 3717700 - RNA, 20 nt, Human
uccagcaauucuccugccuc

SEQ ID NO: 3717701 - RNA, 15 nt, Human
uccagcaauugugug

SEQ ID NO: 3717702 - RNA, 21 nt, Human
uccagcacaaccuucaagcug

SEQ ID NO: 3717703 - RNA, 16 nt, Human
uccagcagauuauuca

SEQ ID NO: 3717704 - RNA, 22 nt, Human
uccagcaggagggacagucuca

SEQ ID NO: 3717705 - RNA, 12 nt, Human
uccagcaggccc

SEQ ID NO: 3717706 - RNA, 22 nt, Human
uccagcaggcccaugggaggcu

SEQ ID NO: 3717707 - RNA, 12 nt, Human
uccagcagggaa

SEQ ID NO: 3717708 - RNA, 17 nt, Human
uccagcagucucugccu

SEQ ID NO: 3717709 - RNA, 18 nt, Human
uccagcagucucugccuu

SEQ ID NO: 3717710 - RNA, 19 nt, Human
uccagcagucucugccuug

SEQ ID NO: 3717711 - RNA, 14 nt, Human
uccagcaguuuuca

SEQ ID NO: 3717712 - RNA, 16 nt, Human
uccagcauucccaggu

SEQ ID NO: 3717713 - RNA, 17 nt, Human
uccagcauugcuggacu

SEQ ID NO: 3717714 - RNA, 23 nt, Human
uccagccaaagccuccuccagcc

SEQ ID NO: 3717715 - RNA, 13 nt, Human
uccagccaacccc

SEQ ID NO: 3717716 - RNA, 20 nt, Human
uccagccaaccccuguggag

SEQ ID NO: 3717717 - RNA, 23 nt, Human
uccagccaaccccuguggagccc

SEQ ID NO: 3717718 - RNA, 17 nt, Human
uccagccacagaaaaga

SEQ ID NO: 3717719 - RNA, 13 nt, Human
uccagccagcgcc

SEQ ID NO: 3717720 - RNA, 20 nt, Human
uccagccagcgccucccucc

SEQ ID NO: 3717721 - RNA, 13 nt, Human
uccagccagggcu

SEQ ID NO: 3717722 - RNA, 19 nt, Human
uccagccaucaagagacug

SEQ ID NO: 3717723 - RNA, 24 nt, Human
uccagccaucaagagacugaguca

SEQ ID NO: 3717724 - RNA, 15 nt, Human
uccagccaucaccuu

SEQ ID NO: 3717725 - RNA, 14 nt, Human
uccagccccucugg

SEQ ID NO: 3717726 - RNA, 16 nt, Human
uccagccccucugguc

SEQ ID NO: 3717727 - RNA, 18 nt, Human
uccagccccucuggucgc

SEQ ID NO: 3717728 - RNA, 18 nt, Human
uccagccccucuuggaga

SEQ ID NO: 3717729 - RNA, 14 nt, Human
uccagccccuggau

SEQ ID NO: 3717730 - RNA, 17 nt, Human
uccagccccuggaugca

SEQ ID NO: 3717731 - RNA, 16 nt, Human
uccagccccuguccca

SEQ ID NO: 3717732 - RNA, 23 nt, Human
uccagccccugucccacccccuu

SEQ ID NO: 3717733 - RNA, 13 nt, Human
uccagcccgggag

SEQ ID NO: 3717734 - RNA, 19 nt, Human
uccagcccuauucugccac

SEQ ID NO: 3717735 - RNA, 15 nt, Human
uccagcccuggcuga

SEQ ID NO: 3717736 - RNA, 22 nt, Human
uccagccgccauugccaccagg

SEQ ID NO: 3717737 - RNA, 11 nt, Human
uccagccucac

SEQ ID NO: 3717738 - RNA, 13 nt, Human
uccagccucagcc

SEQ ID NO: 3717739 - RNA, 15 nt, Human
uccagccucagcccc

SEQ ID NO: 3717740 - RNA, 13 nt, Human
uccagccugccac

SEQ ID NO: 3717741 - RNA, 16 nt, Human
uccagccugccuggca

SEQ ID NO: 3717742 - RNA, 11 nt, Human
uccagccuggg

SEQ ID NO: 3717743 - RNA, 12 nt, Human
uccagccugggc

SEQ ID NO: 3717744 - RNA, 17 nt, Human
uccagccugggcgacag

SEQ ID NO: 3717745 - RNA, 20 nt, Human
uccagccugggcgacagagc

SEQ ID NO: 3717746 - RNA, 22 nt, Human
uccagcgaucucuccacugugc

SEQ ID NO: 3717747 - RNA, 15 nt, Human
uccagcucaccagcc

SEQ ID NO: 3717748 - RNA, 21 nt, Human
ucagaucacugaauuuauaaa

SEQ ID NO: 3717749 - RNA, 21 nt, Human
ucagaucauuucaaaacucau

SEQ ID NO: 3717750 - RNA, 15 nt, Human
ucagauccagggaca

SEQ ID NO: 3717751 - RNA, 16 nt, Human
ucagauccagggacag

SEQ ID NO: 3717752 - RNA, 12 nt, Human
ucagauccuacc

SEQ ID NO: 3717753 - RNA, 15 nt, Human
ucagauccuccucau

SEQ ID NO: 3717754 - RNA, 16 nt, Human
ucagauccuuguuuca

SEQ ID NO: 3717755 - RNA, 15 nt, Human
ucagaucucuaacuu

SEQ ID NO: 3717756 - RNA, 13 nt, Human
ucagaucugccua

SEQ ID NO: 3717757 - RNA, 21 nt, Human
ucagaucugccuaaggacuuc

SEQ ID NO: 3717758 - RNA, 18 nt, Human
ucagaucuuucuccuuga

SEQ ID NO: 3717759 - RNA, 21 nt, Human
ucagaugaacucuuagaaaug

SEQ ID NO: 3717760 - RNA, 13 nt, Human
ucagaugcuucug

SEQ ID NO: 3717761 - RNA, 19 nt, Human
ucagaugcuugcggcaaaa

SEQ ID NO: 3717762 - RNA, 20 nt, Human
ucagauggaaccgcaggaag

SEQ ID NO: 3717763 - RNA, 21 nt, Human
ucagauggaaccgcaggaagc

SEQ ID NO: 3717764 - RNA, 22 nt, Human
ucagauggauugauaauugcau

SEQ ID NO: 3717765 - RNA, 14 nt, Human
ucagauguaauguu

SEQ ID NO: 3717766 - RNA, 15 nt, Human
ucagauguaauguuu

SEQ ID NO: 3717767 - RNA, 17 nt, Human
ucagauguaauguuuuc

SEQ ID NO: 3717768 - RNA, 14 nt, Human
ucagaugucccuug

SEQ ID NO: 3717769 - RNA, 15 nt, Human
ucagaugucuucugc

SEQ ID NO: 3717770 - RNA, 14 nt, Human
ucagauguggagcc

SEQ ID NO: 3717771 - RNA, 18 nt, Human
ucagauguuaaaauaaau

SEQ ID NO: 3717772 - RNA, 15 nt, Human
ucagauguuuaaaac

SEQ ID NO: 3717773 - RNA, 12 nt, Human
ucagauguuuga

SEQ ID NO: 3717774 - RNA, 13 nt, Human
ucagauucaggca

SEQ ID NO: 3717775 - RNA, 21 nt, Human
ucagauucccagagcaaaaua

SEQ ID NO: 3717776 - RNA, 19 nt, Human
ucagauuccuuucccuuua

SEQ ID NO: 3717777 - RNA, 13 nt, Human
ucagauucuugca

SEQ ID NO: 3717778 - RNA, 14 nt, Human
ucagauucuugcau

SEQ ID NO: 3717779 - RNA, 15 nt, Human
ucagauugcauguga

SEQ ID NO: 3717780 - RNA, 18 nt, Human
ucagauuggacauaacug

SEQ ID NO: 3717781 - RNA, 15 nt, Human
ucagauuucucuuug

SEQ ID NO: 3717782 - RNA, 16 nt, Human
ucagauuucucuuuga

SEQ ID NO: 3717783 - RNA, 15 nt, Human
ucagauuucugagga

SEQ ID NO: 3717784 - RNA, 19 nt, Human
ucagauuucugguuguuau

SEQ ID NO: 3717785 - RNA, 14 nt, Human
ucagauuugcacaa

SEQ ID NO: 3717786 - RNA, 19 nt, Human
ucagauuugcacaaaaaga

SEQ ID NO: 3717787 - RNA, 16 nt, Human
ucagauuuuccugugg

SEQ ID NO: 3717788 - RNA, 14 nt, Human
ucagauuuuuuccu

SEQ ID NO: 3717789 - RNA, 20 nt, Human
ucagcaaaaaaguacuuaaa

SEQ ID NO: 3717790 - RNA, 13 nt, Human
ucagcaaaaagca

SEQ ID NO: 3717791 - RNA, 14 nt, Human
ucagcaaaaagcaa

SEQ ID NO: 3717792 - RNA, 15 nt, Human
ucagcaaaaagcaaa

SEQ ID NO: 3717793 - RNA, 20 nt, Human
ucagcaaaaagcaaaaucau

SEQ ID NO: 3717794 - RNA, 21 nt, Human
ucagcaaaaagcaaaaucauu

SEQ ID NO: 3717795 - RNA, 21 nt, Human
ucagcaaacaggaucaguuaa

SEQ ID NO: 3717796 - RNA, 22 nt, Human
ucagcaaaccauuuuuaaagua

SEQ ID NO: 3717797 - RNA, 20 nt, Human
ucagcaaacuuguugaauuu

SEQ ID NO: 3717798 - RNA, 23 nt, Human
ucagcaaauuaauuggcagcaga

SEQ ID NO: 3717799 - RNA, 19 nt, Human
ucagcaagacuucucuuug

SEQ ID NO: 3717800 - RNA, 13 nt, Human
ucagcaaggccac

SEQ ID NO: 3717801 - RNA, 17 nt, Human
ucagcaaggccaccucu

SEQ ID NO: 3717802 - RNA, 23 nt, Human
ucagcaaggcgcuaacuugcuua

SEQ ID NO: 3717803 - RNA, 13 nt, Human
ucagcaauauuua

SEQ ID NO: 3717804 - RNA, 20 nt, Human
ucagcacagauaaaaagugg

SEQ ID NO: 3717805 - RNA, 24 nt, Human
ucagcacauaggguucccacgaag

SEQ ID NO: 3717806 - RNA, 23 nt, Human
ucagcaccacccuagucccuucc

SEQ ID NO: 3717807 - RNA, 13 nt, Human
ucagcaccacuca

SEQ ID NO: 3717808 - RNA, 23 nt, Human
ucagcacccccuucucugcccau

SEQ ID NO: 3717809 - RNA, 13 nt, Human
ucagcaccccuuc

SEQ ID NO: 3717810 - RNA, 21 nt, Human
ucagcaccuacaguguacagu

SEQ ID NO: 3717811 - RNA, 21 nt, Human
ucagcacugaaaauaccauca

SEQ ID NO: 3717812 - RNA, 13 nt, Human
ucagcacuguccc

SEQ ID NO: 3717813 - RNA, 14 nt, Human
ucagcacugucccu

SEQ ID NO: 3717814 - RNA, 21 nt, Human
ucagcacugucccuugccuca

SEQ ID NO: 3717815 - RNA, 14 nt, Human
ucagcacuugucuc

SEQ ID NO: 3717816 - RNA, 17 nt, Human
ucagcacuugucucauu

SEQ ID NO: 3717817 - RNA, 21 nt, Human
ucagcacuuuagaauaugccu

SEQ ID NO: 3717818 - RNA, 23 nt, Human
ucagcagcgaccaccccugccuc

SEQ ID NO: 3717819 - RNA, 18 nt, Human
ucagcagggacuguaaac

SEQ ID NO: 3717820 - RNA, 18 nt, Human
ucagcaguugcugguaaa

SEQ ID NO: 3717821 - RNA, 17 nt, Human
ucagcauaccuuuauug

SEQ ID NO: 3717822 - RNA, 13 nt, Human
ucagcauauuugu

SEQ ID NO: 3717823 - RNA, 16 nt, Human
ucagcauccuggcacc

SEQ ID NO: 3717824 - RNA, 15 nt, Human
ucagcaucugugaug

SEQ ID NO: 3717825 - RNA, 20 nt, Human
ucagcaugaaaauguguguu

SEQ ID NO: 3717826 - RNA, 13 nt, Human
ucagcaugaauuu

SEQ ID NO: 3717827 - RNA, 17 nt, Human
ucagcaugaauuuguaa

SEQ ID NO: 3717828 - RNA, 21 nt, Human
ucagcaugucuauucagcuuc

SEQ ID NO: 3717829 - RNA, 19 nt, Human
ucagcauuaccucuuugga

SEQ ID NO: 3717830 - RNA, 14 nt, Human
ucagcauucccucc

SEQ ID NO: 3717831 - RNA, 17 nt, Human
ucagcauucucacuccu

SEQ ID NO: 3717832 - RNA, 21 nt, Human
ucagcauucuuagccuguggc

SEQ ID NO: 3717833 - RNA, 14 nt, Human
ucagccaaauguaa

SEQ ID NO: 3717834 - RNA, 22 nt, Human
ucagccaagaauucuuaaauau

SEQ ID NO: 3717835 - RNA, 12 nt, Human
ucagccaagcac

SEQ ID NO: 3717836 - RNA, 14 nt, Human
ucagccaagcacag

SEQ ID NO: 3717837 - RNA, 22 nt, Human
ucagccaagguuuuauaaggcu

SEQ ID NO: 3717838 - RNA, 16 nt, Human
ucagccaaguuuuaua

SEQ ID NO: 3717839 - RNA, 19 nt, Human
ucagccacccugaggccuc

SEQ ID NO: 3717840 - RNA, 16 nt, Human
ucagccacccugaguu

SEQ ID NO: 3717841 - RNA, 15 nt, Human
ucagccacugaggga

SEQ ID NO: 3717842 - RNA, 10 nt, Human
ucagccagac

SEQ ID NO: 3717843 - RNA, 14 nt, Human
ucagccagggccug

SEQ ID NO: 3717844 - RNA, 15 nt, Human
ucagccauguacaga

SEQ ID NO: 3717845 - RNA, 19 nt, Human
ucagcccaaucccugaucc

SEQ ID NO: 3717846 - RNA, 21 nt, Human
ucagcccaaucccugaucccu

SEQ ID NO: 3717847 - RNA, 18 nt, Human
ucagccccacccuggccu

SEQ ID NO: 3717848 - RNA, 12 nt, Human
ucagccccagcc

SEQ ID NO: 3717849 - RNA, 14 nt, Human
ucagccccagccca

SEQ ID NO: 3717850 - RNA, 15 nt, Human
ucagccccagcccag

SEQ ID NO: 3717851 - RNA, 17 nt, Human
ucagccccagcccagcc

SEQ ID NO: 3717852 - RNA, 18 nt, Human
ucagcccccagccccucc

SEQ ID NO: 3717853 - RNA, 17 nt, Human
ucagcccccugcuucag

SEQ ID NO: 3717854 - RNA, 14 nt, Human
ucagccccuaggag

SEQ ID NO: 3717855 - RNA, 23 nt, Human
ucagccccuccucugccaccucc

SEQ ID NO: 3717856 - RNA, 14 nt, Human
ucagccccugaucc

SEQ ID NO: 3717857 - RNA, 12 nt, Human
ucagcccucaga

SEQ ID NO: 3717858 - RNA, 14 nt, Human
ucagcccucagaau

SEQ ID NO: 3717859 - RNA, 13 nt, Human
ucagcccugagga

SEQ ID NO: 3717860 - RNA, 14 nt, Human
ucagcccugcacca

SEQ ID NO: 3717861 - RNA, 23 nt, Human
ucagcccugcccuucagcauccu

SEQ ID NO: 3717862 - RNA, 14 nt, Human
ucagcccuggaggu

SEQ ID NO: 3717863 - RNA, 17 nt, Human
ucagcccuggaggugcc

SEQ ID NO: 3717864 - RNA, 18 nt, Human
ucagccgagccgggccug

SEQ ID NO: 3717865 - RNA, 19 nt, Human
ucagccgagccgggccugg

SEQ ID NO: 3717866 - RNA, 22 nt, Human
ucagccggcguggcaaauauaa

SEQ ID NO: 3717867 - RNA, 16 nt, Human
ucagccgggcccugag

SEQ ID NO: 3717868 - RNA, 19 nt, Human
ucagccuacaggccucaca

SEQ ID NO: 3717869 - RNA, 19 nt, Human
ucagccuaguggcuugucc

SEQ ID NO: 3717870 - RNA, 14 nt, Human
ucagccuccagccu

SEQ ID NO: 3717871 - RNA, 19 nt, Human
ucagccuccagccucuguu

SEQ ID NO: 3717872 - RNA, 13 nt, Human
ucagccucccaaa

SEQ ID NO: 3717873 - RNA, 21 nt, Human
ucagccucccaaagugcuggg

SEQ ID NO: 3717874 - RNA, 20 nt, Human
ucagccucccgaguagcugg

SEQ ID NO: 3717875 - RNA, 21 nt, Human
ucagccucccgaguagcuggg

SEQ ID NO: 3717876 - RNA, 22 nt, Human
ucagccucccgaguagcuggga

SEQ ID NO: 3717877 - RNA, 13 nt, Human
ucagccuccucau

SEQ ID NO: 3717878 - RNA, 13 nt, Human
ucagccuccugag

SEQ ID NO: 3717879 - RNA, 20 nt, Human
ucagccuccugaguagcugg

SEQ ID NO: 3717880 - RNA, 13 nt, Human
ucagccucgcagg

SEQ ID NO: 3717881 - RNA, 18 nt, Human
ucagccucucucccaguc

SEQ ID NO: 3717882 - RNA, 20 nt, Human
ucagccucucucccagucua

SEQ ID NO: 3717883 - RNA, 22 nt, Human
ucagccucuuaaagcugccugu

SEQ ID NO: 3717884 - RNA, 13 nt, Human
ucagccugaggcu

SEQ ID NO: 3717885 - RNA, 15 nt, Human
ucagccugagucucc

SEQ ID NO: 3717886 - RNA, 16 nt, Human
ucagccugagucuccu

SEQ ID NO: 3717887 - RNA, 19 nt, Human
ucagccugagucuccugug

SEQ ID NO: 3717888 - RNA, 20 nt, Human
ucagccugcaguuaauuagc

SEQ ID NO: 3717889 - RNA, 16 nt, Human
ucagccugcugcccag

SEQ ID NO: 3717890 - RNA, 14 nt, Human
ucagccuggccaga

SEQ ID NO: 3717891 - RNA, 15 nt, Human
ucagccuggccagac

SEQ ID NO: 3717892 - RNA, 17 nt, Human
ucagccuggccagacac

SEQ ID NO: 3717893 - RNA, 19 nt, Human
ucagccuggccagacacag

SEQ ID NO: 3717894 - RNA, 16 nt, Human
ucagccugggcgcugg

SEQ ID NO: 3717895 - RNA, 18 nt, Human
ucagccugucucuuccau

SEQ ID NO: 3717896 - RNA, 21 nt, Human
ucagccuucccccucccaggg

SEQ ID NO: 3717897 - RNA, 24 nt, Human
ucagccuucccccucccagggcca

SEQ ID NO: 3717898 - RNA, 13 nt, Human
gcucuuaauugcc

SEQ ID NO: 3717899 - RNA, 14 nt, Human
gcucuuaauugcca

SEQ ID NO: 3717900 - RNA, 19 nt, Human
gcucuuaauuguucauuuu

SEQ ID NO: 3717901 - RNA, 16 nt, Human
gcucuuagcagcuucc

SEQ ID NO: 3717902 - RNA, 19 nt, Human
gcucuuagcagcuuccaga

SEQ ID NO: 3717903 - RNA, 13 nt, Human
gcucuucaucugc

SEQ ID NO: 3717904 - RNA, 17 nt, Human
gcucuucaucugcccaa

SEQ ID NO: 3717905 - RNA, 14 nt, Human
gcucuucauguuuc

SEQ ID NO: 3717906 - RNA, 20 nt, Human
gcucuuccuaucccucuccu

SEQ ID NO: 3717907 - RNA, 19 nt, Human
gcucuuccuggacaggcca

SEQ ID NO: 3717908 - RNA, 15 nt, Human
gcucuuccuuacucc

SEQ ID NO: 3717909 - RNA, 13 nt, Human
gcucuucgcgccc

SEQ ID NO: 3717910 - RNA, 12 nt, Human
gcucuucucauu

SEQ ID NO: 3717911 - RNA, 20 nt, Human
gcucuucucauuucaccccu

SEQ ID NO: 3717912 - RNA, 23 nt, Human
gcucuucucauuucaccccuccc

SEQ ID NO: 3717913 - RNA, 13 nt, Human
gcucuucuccuuu

SEQ ID NO: 3717914 - RNA, 17 nt, Human
gcucuucuccuuucaca

SEQ ID NO: 3717915 - RNA, 14 nt, Human
gcucuucugccggc

SEQ ID NO: 3717916 - RNA, 12 nt, Human
gcucuucuuaaa

SEQ ID NO: 3717917 - RNA, 17 nt, Human
gcucuugaacuccugac

SEQ ID NO: 3717918 - RNA, 18 nt, Human
gcucuugaccuuguagag

SEQ ID NO: 3717919 - RNA, 22 nt, Human
gcucuugauaccccccucuguc

SEQ ID NO: 3717920 - RNA, 23 nt, Human
gcucuugauaccccccucugucu

SEQ ID NO: 3717921 - RNA, 19 nt, Human
gcucuugaugccuggcggg

SEQ ID NO: 3717922 - RNA, 18 nt, Human
gcucuugcagagaagccu

SEQ ID NO: 3717923 - RNA, 16 nt, Human
gcucuugcccuucccu

SEQ ID NO: 3717924 - RNA, 17 nt, Human
gcucuugcccuucccug

SEQ ID NO: 3717925 - RNA, 13 nt, Human
gcucuugcuaauc

SEQ ID NO: 3717926 - RNA, 19 nt, Human
gcucuugcuaaucaguguc

SEQ ID NO: 3717927 - RNA, 23 nt, Human
gcucuugcuaaucagugucucac

SEQ ID NO: 3717928 - RNA, 14 nt, Human
gcucuuggcuggac

SEQ ID NO: 3717929 - RNA, 23 nt, Human
gcucuugggcaauauucucugua

SEQ ID NO: 3717930 - RNA, 14 nt, Human
gcucuugucccacg

SEQ ID NO: 3717931 - RNA, 15 nt, Human
gcucuugucccacgu

SEQ ID NO: 3717932 - RNA, 22 nt, Human
gcucuugucccacgugucuucc

SEQ ID NO: 3717933 - RNA, 21 nt, Human
gcucuuguugagccgugggca

SEQ ID NO: 3717934 - RNA, 14 nt, Human
gcucuuuagccagu

SEQ ID NO: 3717935 - RNA, 21 nt, Human
gcucuuuaugaaugaaaaaac

SEQ ID NO: 3717936 - RNA, 17 nt, Human
gcucuuucgucacccuu

SEQ ID NO: 3717937 - RNA, 16 nt, Human
gcucuuucucugccag

SEQ ID NO: 3717938 - RNA, 18 nt, Human
gcucuuucucugccagug

SEQ ID NO: 3717939 - RNA, 18 nt, Human
gcucuuucugggccaagu

SEQ ID NO: 3717940 - RNA, 23 nt, Human
gcucuuugaaauagucuguguga

SEQ ID NO: 3717941 - RNA, 22 nt, Human
gcucuuuggggucagccagggc

SEQ ID NO: 3717942 - RNA, 15 nt, Human
gcucuuuucaaugaa

SEQ ID NO: 3717943 - RNA, 14 nt, Human
gcucuuuuuuacuc

SEQ ID NO: 3717944 - RNA, 22 nt, Human
gcugaaaaccaucuggccuggc

SEQ ID NO: 3717945 - RNA, 23 nt, Human
gcugaaaaccaucuggccuggcc

SEQ ID NO: 3717946 - RNA, 12 nt, Human
gcugaaaauaua

SEQ ID NO: 3717947 - RNA, 18 nt, Human
gcugaaaauguccuugug

SEQ ID NO: 3717948 - RNA, 16 nt, Human
gcugaaacagaauacu

SEQ ID NO: 3717949 - RNA, 14 nt, Human
gcugaaagagaaaa

SEQ ID NO: 3717950 - RNA, 13 nt, Human
gcugaaagccauu

SEQ ID NO: 3717951 - RNA, 19 nt, Human
gcugaaagcugguggcaga

SEQ ID NO: 3717952 - RNA, 13 nt, Human
gcugaaaguucuu

SEQ ID NO: 3717953 - RNA, 12 nt, Human
gcugaaauacug

SEQ ID NO: 3717954 - RNA, 17 nt, Human
gcugaaauugaaaaguu

SEQ ID NO: 3717955 - RNA, 17 nt, Human
gcugaaauuuuagaaau

SEQ ID NO: 3717956 - RNA, 19 nt, Human
gcugaaauuuuagaaauau

SEQ ID NO: 3717957 - RNA, 15 nt, Human
gcugaaauuuuauau

SEQ ID NO: 3717958 - RNA, 17 nt, Human
gcugaaauuuuauaugc

SEQ ID NO: 3717959 - RNA, 16 nt, Human
gcugaacacauuucuu

SEQ ID NO: 3717960 - RNA, 21 nt, Human
gcugaacacuccaauuaagga

SEQ ID NO: 3717961 - RNA, 23 nt, Human
gcugaacacuccaauuaaggauu

SEQ ID NO: 3717962 - RNA, 17 nt, Human
gcugaacauugcauaua

SEQ ID NO: 3717963 - RNA, 16 nt, Human
gcugaacccugugcug

SEQ ID NO: 3717964 - RNA, 13 nt, Human
gcugaagauggca

SEQ ID NO: 3717965 - RNA, 12 nt, Human
gcugaaggacug

SEQ ID NO: 3717966 - RNA, 22 nt, Human
gcugaaggacugugacaggcag

SEQ ID NO: 3717967 - RNA, 20 nt, Human
gcugaaggcucgagcaugcc

SEQ ID NO: 3717968 - RNA, 20 nt, Human
gcugaagggaccuugaaggg

SEQ ID NO: 3717969 - RNA, 16 nt, Human
gcugaagguugaagag

SEQ ID NO: 3717970 - RNA, 19 nt, Human
gcugaaguugcagauguua

SEQ ID NO: 3717971 - RNA, 13 nt, Human
gcugaauaaaugu

SEQ ID NO: 3717972 - RNA, 14 nt, Human
gcugaauaaauguc

SEQ ID NO: 3717973 - RNA, 17 nt, Human
gcugaauacagaggcaa

SEQ ID NO: 3717974 - RNA, 13 nt, Human
gcugaaugccucc

SEQ ID NO: 3717975 - RNA, 13 nt, Human
gcugaauguuuuu

SEQ ID NO: 3717976 - RNA, 24 nt, Human
gcugaauuucccucucucauaccc

SEQ ID NO: 3717977 - RNA, 21 nt, Human
gcugaauuuucacaugaacau

SEQ ID NO: 3717978 - RNA, 21 nt, Human
gcugacacuucaaggugacag

SEQ ID NO: 3717979 - RNA, 14 nt, Human
gcugacagacacag

SEQ ID NO: 3717980 - RNA, 15 nt, Human
gcugacagacacagg

SEQ ID NO: 3717981 - RNA, 17 nt, Human
gcugacagacagcccuc

SEQ ID NO: 3717982 - RNA, 19 nt, Human
gcugacagcacuaaacuug

SEQ ID NO: 3717983 - RNA, 18 nt, Human
gcugacagcugcuccuag

SEQ ID NO: 3717984 - RNA, 23 nt, Human
gcugacaucuugaauccuuccau

SEQ ID NO: 3717985 - RNA, 19 nt, Human
gcugacauggcucuggacu

SEQ ID NO: 3717986 - RNA, 14 nt, Human
gcugaccaagagag

SEQ ID NO: 3717987 - RNA, 16 nt, Human
gcugaccaagagagaa

SEQ ID NO: 3717988 - RNA, 19 nt, Human
gcugaccaauugugcugcc

SEQ ID NO: 3717989 - RNA, 21 nt, Human
gcugaccacaggcaguuacuu

SEQ ID NO: 3717990 - RNA, 21 nt, Human
gcugaccagccgugagcaugu

SEQ ID NO: 3717991 - RNA, 21 nt, Human
gcugaccaugcucaucugcug

SEQ ID NO: 3717992 - RNA, 22 nt, Human
gcugacccagccccuugagaaa

SEQ ID NO: 3717993 - RNA, 17 nt, Human
gcugacccagucccugg

SEQ ID NO: 3717994 - RNA, 18 nt, Human
gcugaccccaaagagccu

SEQ ID NO: 3717995 - RNA, 19 nt, Human
gcugaccccccucaggacc

SEQ ID NO: 3717996 - RNA, 17 nt, Human
gcugaccuccacagcuu

SEQ ID NO: 3717997 - RNA, 13 nt, Human
gcugaccucuggu

SEQ ID NO: 3717998 - RNA, 18 nt, Human
gcugaccucuguuguccu

SEQ ID NO: 3717999 - RNA, 17 nt, Human
gcugaccugcugaccug

SEQ ID NO: 3718000 - RNA, 18 nt, Human
gcugaccuuccucgcaga

SEQ ID NO: 3718001 - RNA, 23 nt, Human
gcugaccuuccucgcagagaggc

SEQ ID NO: 3718002 - RNA, 23 nt, Human
gcugaccuugaacuccugggcuc

SEQ ID NO: 3718003 - RNA, 19 nt, Human
gcugacgaacuuccauggc

SEQ ID NO: 3718004 - RNA, 17 nt, Human
gcugacgaggcugggcc

SEQ ID NO: 3718005 - RNA, 15 nt, Human
gcugacggccaggga

SEQ ID NO: 3718006 - RNA, 17 nt, Human
gcugacggugcagucug

SEQ ID NO: 3718007 - RNA, 15 nt, Human
gcugacgugugaggg

SEQ ID NO: 3718008 - RNA, 16 nt, Human
gcugacguuccgggca

SEQ ID NO: 3718009 - RNA, 20 nt, Human
gcugacuaaacuuuuuuucu

SEQ ID NO: 3718010 - RNA, 17 nt, Human
gcugacuacagggccgc

SEQ ID NO: 3718011 - RNA, 21 nt, Human
gcugacuccacgauccugcca

SEQ ID NO: 3718012 - RNA, 16 nt, Human
gcugacuccugguccu

SEQ ID NO: 3718013 - RNA, 19 nt, Human
gcugacuguacuccuccca

SEQ ID NO: 3718014 - RNA, 14 nt, Human
gcugacuuggcugg

SEQ ID NO: 3718015 - RNA, 17 nt, Human
gcugacuuggcuggugu

SEQ ID NO: 3718016 - RNA, 22 nt, Human
gcugacuuggcuggugugguac

SEQ ID NO: 3718017 - RNA, 14 nt, Human
gcugagaacacugu

SEQ ID NO: 3718018 - RNA, 23 nt, Human
gcugagaacccugcguggggaca

SEQ ID NO: 3718019 - RNA, 16 nt, Human
gcugagaaccuggccu

SEQ ID NO: 3718020 - RNA, 21 nt, Human
gcugagaaccuggccuucagu

SEQ ID NO: 3718021 - RNA, 14 nt, Human
gcugagaacuccug

SEQ ID NO: 3718022 - RNA, 16 nt, Human
gcugagaacuccugac

SEQ ID NO: 3718023 - RNA, 19 nt, Human
gcugagagaccaggagggc

SEQ ID NO: 3718024 - RNA, 22 nt, Human
gcugagagaccaggagggcacu

SEQ ID NO: 3718025 - RNA, 17 nt, Human
gcugagagacccaagga

SEQ ID NO: 3718026 - RNA, 20 nt, Human
gcugagagacccaaggagga

SEQ ID NO: 3718027 - RNA, 22 nt, Human
gcugagagacccaaggaggaaa

SEQ ID NO: 3718028 - RNA, 14 nt, Human
gcugagagccccag

SEQ ID NO: 3718029 - RNA, 22 nt, Human
gcugagaggcagacuucccuga

SEQ ID NO: 3718030 - RNA, 16 nt, Human
gcugagauccuggacu

SEQ ID NO: 3718031 - RNA, 15 nt, Human
gcugagcaaacaugu

SEQ ID NO: 3718032 - RNA, 14 nt, Human
gcugagcaggccac

SEQ ID NO: 3718033 - RNA, 16 nt, Human
gcugagccaccugccc

SEQ ID NO: 3718034 - RNA, 12 nt, Human
gcugagccaggc

SEQ ID NO: 3718035 - RNA, 13 nt, Human
gcugagcccuggc

SEQ ID NO: 3718036 - RNA, 16 nt, Human
gcugagcccuggcagg

SEQ ID NO: 3718037 - RNA, 21 nt, Human
gcugagccucacagcagugag

SEQ ID NO: 3718038 - RNA, 16 nt, Human
gcugagccugcaggga

SEQ ID NO: 3718039 - RNA, 19 nt, Human
gcugagcucacaaggcagc

SEQ ID NO: 3718040 - RNA, 20 nt, Human
gcugagcucacaaggcagca

SEQ ID NO: 3718041 - RNA, 14 nt, Human
gcugagcucucugu

SEQ ID NO: 3718042 - RNA, 16 nt, Human
gcugagcucugagagg

SEQ ID NO: 3718043 - RNA, 20 nt, Human
gcugagcucugagaggcccu

SEQ ID NO: 3718044 - RNA, 15 nt, Human
gcugaggaaaggcca

SEQ ID NO: 3718045 - RNA, 16 nt, Human
gcugaggaaaggccag

SEQ ID NO: 3718046 - RNA, 18 nt, Human
gcugaggagugaggaaua

SEQ ID NO: 3718047 - RNA, 14 nt, Human
gcugaggcaauucu

SEQ ID NO: 3718048 - RNA, 16 nt, Human
uccagcucaccagccc

SEQ ID NO: 3718049 - RNA, 18 nt, Human
uccagcucagaacccagg

SEQ ID NO: 3718050 - RNA, 20 nt, Human
uccagcucagaacccagggc

SEQ ID NO: 3718051 - RNA, 16 nt, Human
uccagcuccaaccugc

SEQ ID NO: 3718052 - RNA, 20 nt, Human
uccagcucccugugccccca

SEQ ID NO: 3718053 - RNA, 23 nt, Human
uccagcuccucauccagggcucu

SEQ ID NO: 3718054 - RNA, 13 nt, Human
uccagcuccugua

SEQ ID NO: 3718055 - RNA, 14 nt, Human
uccagcuccuuugg

SEQ ID NO: 3718056 - RNA, 15 nt, Human
uccagcuccuuuggg

SEQ ID NO: 3718057 - RNA, 18 nt, Human
uccagcucuaauaaaaca

SEQ ID NO: 3718058 - RNA, 22 nt, Human
uccagcucuaauaaaacagcug

SEQ ID NO: 3718059 - RNA, 12 nt, Human
uccagcucugga

SEQ ID NO: 3718060 - RNA, 16 nt, Human
uccagcugagcgccag

SEQ ID NO: 3718061 - RNA, 17 nt, Human
uccagcugcaccagagc

SEQ ID NO: 3718062 - RNA, 18 nt, Human
uccagcugcugagauccu

SEQ ID NO: 3718063 - RNA, 22 nt, Human
uccagcugcugagauccuggac

SEQ ID NO: 3718064 - RNA, 17 nt, Human
uccagcugcugucuucu

SEQ ID NO: 3718065 - RNA, 11 nt, Human
uccagcuggcc

SEQ ID NO: 3718066 - RNA, 21 nt, Human
uccagcuggccgggagccuga

SEQ ID NO: 3718067 - RNA, 17 nt, Human
uccagcuggccuggaca

SEQ ID NO: 3718068 - RNA, 20 nt, Human
uccagcuguugagccccucc

SEQ ID NO: 3718069 - RNA, 14 nt, Human
uccagcuucccgag

SEQ ID NO: 3718070 - RNA, 21 nt, Human
uccagcuucugguacucuccu

SEQ ID NO: 3718071 - RNA, 13 nt, Human
uccagcuugccag

SEQ ID NO: 3718072 - RNA, 23 nt, Human
uccagcuugccagaugcugcaga

SEQ ID NO: 3718073 - RNA, 17 nt, Human
uccagcuugcucuucag

SEQ ID NO: 3718074 - RNA, 19 nt, Human
uccagcuuucuccccgcua

SEQ ID NO: 3718075 - RNA, 16 nt, Human
uccagcuuucugccau

SEQ ID NO: 3718076 - RNA, 17 nt, Human
uccaggaaaaaggacag

SEQ ID NO: 3718077 - RNA, 21 nt, Human
uccaggaaacuccacaucugc

SEQ ID NO: 3718078 - RNA, 22 nt, Human
uccaggaaaguggccaagaagc

SEQ ID NO: 3718079 - RNA, 17 nt, Human
uccaggaaggggcugga

SEQ ID NO: 3718080 - RNA, 13 nt, Human
uccaggaccccug

SEQ ID NO: 3718081 - RNA, 19 nt, Human
uccaggacuguuucaaaca

SEQ ID NO: 3718082 - RNA, 21 nt, Human
uccaggacuguuucaaacaug

SEQ ID NO: 3718083 - RNA, 20 nt, Human
uccaggagaaggccaauucc

SEQ ID NO: 3718084 - RNA, 13 nt, Human
uccaggagcagcc

SEQ ID NO: 3718085 - RNA, 16 nt, Human
uccaggagcagccaca

SEQ ID NO: 3718086 - RNA, 17 nt, Human
uccaggagcagccacau

SEQ ID NO: 3718087 - RNA, 22 nt, Human
uccaggagcuccaguguccuga

SEQ ID NO: 3718088 - RNA, 23 nt, Human
uccaggagcuccaguguccugag

SEQ ID NO: 3718089 - RNA, 22 nt, Human
uccaggaugguguuacugcagu

SEQ ID NO: 3718090 - RNA, 14 nt, Human
uccaggcaauggcc

SEQ ID NO: 3718091 - RNA, 22 nt, Human
uccaggcaauggccuaaacuuc

SEQ ID NO: 3718092 - RNA, 21 nt, Human
uccaggcaccaggacuagggc

SEQ ID NO: 3718093 - RNA, 16 nt, Human
uccaggcacccuucuu

SEQ ID NO: 3718094 - RNA, 23 nt, Human
uccaggcacccuucuuuccucuu

SEQ ID NO: 3718095 - RNA, 16 nt, Human
uccaggcacugagaua

SEQ ID NO: 3718096 - RNA, 14 nt, Human
uccaggcagaucca

SEQ ID NO: 3718097 - RNA, 18 nt, Human
uccaggcagauccaggac

SEQ ID NO: 3718098 - RNA, 23 nt, Human
uccaggcagucgggggcuggccu

SEQ ID NO: 3718099 - RNA, 16 nt, Human
uccaggccagggggcc

SEQ ID NO: 3718100 - RNA, 18 nt, Human
uccaggccagggggccag

SEQ ID NO: 3718101 - RNA, 21 nt, Human
uccaggccaucagaggccuag

SEQ ID NO: 3718102 - RNA, 17 nt, Human
uccaggcccaaggcucc

SEQ ID NO: 3718103 - RNA, 20 nt, Human
uccaggcccaaggcucccgg

SEQ ID NO: 3718104 - RNA, 17 nt, Human
uccaggccccucccucu

SEQ ID NO: 3718105 - RNA, 18 nt, Human
uccaggcccgucugucca

SEQ ID NO: 3718106 - RNA, 20 nt, Human
uccaggcccgucuguccauc

SEQ ID NO: 3718107 - RNA, 21 nt, Human
uccaggccgcgcccuuucccc

SEQ ID NO: 3718108 - RNA, 16 nt, Human
uccaggccugccuccc

SEQ ID NO: 3718109 - RNA, 18 nt, Human
uccaggccugccucccac

SEQ ID NO: 3718110 - RNA, 19 nt, Human
uccaggccugccucccacu

SEQ ID NO: 3718111 - RNA, 22 nt, Human
uccaggccugugaggugcagag

SEQ ID NO: 3718112 - RNA, 20 nt, Human
uccaggcuaguccggaccca

SEQ ID NO: 3718113 - RNA, 20 nt, Human
uccaggcuauguauaaaaua

SEQ ID NO: 3718114 - RNA, 22 nt, Human
uccaggcuccuuuagcgcccag

SEQ ID NO: 3718115 - RNA, 17 nt, Human
uccaggcugggagagcc

SEQ ID NO: 3718116 - RNA, 21 nt, Human
uccaggcugggagagccuucc

SEQ ID NO: 3718117 - RNA, 11 nt, Human
uccaggcuggu

SEQ ID NO: 3718118 - RNA, 13 nt, Human
uccaggcugguuc

SEQ ID NO: 3718119 - RNA, 18 nt, Human
uccaggcuuucccacuuc

SEQ ID NO: 3718120 - RNA, 16 nt, Human
uccagggaagcuggcc

SEQ ID NO: 3718121 - RNA, 23 nt, Human
uccagggaagcuggccgaggguc

SEQ ID NO: 3718122 - RNA, 14 nt, Human
uccagggaauccaa

SEQ ID NO: 3718123 - RNA, 12 nt, Human
uccagggacagc

SEQ ID NO: 3718124 - RNA, 13 nt, Human
uccagggacagca

SEQ ID NO: 3718125 - RNA, 21 nt, Human
uccagggacgaagaagagcca

SEQ ID NO: 3718126 - RNA, 14 nt, Human
uccagggacugaag

SEQ ID NO: 3718127 - RNA, 21 nt, Human
uccagggagccuagaagcugg

SEQ ID NO: 3718128 - RNA, 14 nt, Human
uccagggaggcugg

SEQ ID NO: 3718129 - RNA, 22 nt, Human
uccagggaggcugguccuaugg

SEQ ID NO: 3718130 - RNA, 23 nt, Human
uccagggaugauucaagccauuc

SEQ ID NO: 3718131 - RNA, 22 nt, Human
uccagggccacgugccaggccc

SEQ ID NO: 3718132 - RNA, 17 nt, Human
uccagggcccugagcuc

SEQ ID NO: 3718133 - RNA, 20 nt, Human
uccagggcucaacacuguga

SEQ ID NO: 3718134 - RNA, 22 nt, Human
uccagggcuggacugaggccug

SEQ ID NO: 3718135 - RNA, 23 nt, Human
uccagggcuggacugaggccuga

SEQ ID NO: 3718136 - RNA, 14 nt, Human
uccaggggaaccug

SEQ ID NO: 3718137 - RNA, 13 nt, Human
uccaggggccccu

SEQ ID NO: 3718138 - RNA, 18 nt, Human
uccaggggccccuccagc

SEQ ID NO: 3718139 - RNA, 21 nt, Human
uccaggggcugcuuccuccug

SEQ ID NO: 3718140 - RNA, 17 nt, Human
uccagggugugugcucg

SEQ ID NO: 3718141 - RNA, 23 nt, Human
uccagguaccuugaccuuuguac

SEQ ID NO: 3718142 - RNA, 15 nt, Human
uccagguacgcacag

SEQ ID NO: 3718143 - RNA, 16 nt, Human
uccagguacgcacaga

SEQ ID NO: 3718144 - RNA, 19 nt, Human
uccagguacgcacagacag

SEQ ID NO: 3718145 - RNA, 21 nt, Human
uccagguauucguuaucuaau

SEQ ID NO: 3718146 - RNA, 15 nt, Human
uccaggucaacagaa

SEQ ID NO: 3718147 - RNA, 21 nt, Human
uccaggucaacagaaugaaaa

SEQ ID NO: 3718148 - RNA, 15 nt, Human
uccagguccuggugg

SEQ ID NO: 3718149 - RNA, 22 nt, Human
uccaggucgggcucagcucugg

SEQ ID NO: 3718150 - RNA, 20 nt, Human
uccaggugcacaagcuccaa

SEQ ID NO: 3718151 - RNA, 15 nt, Human
uccaggugcagaggu

SEQ ID NO: 3718152 - RNA, 16 nt, Human
uccagguggggugagg

SEQ ID NO: 3718153 - RNA, 17 nt, Human
uccaggugugcacgugg

SEQ ID NO: 3718154 - RNA, 16 nt, Human
uccagguguuacugua

SEQ ID NO: 3718155 - RNA, 18 nt, Human
uccagguuuaagcuguua

SEQ ID NO: 3718156 - RNA, 14 nt, Human
uccagguuuuucaa

SEQ ID NO: 3718157 - RNA, 15 nt, Human
uccagguuuuucaau

SEQ ID NO: 3718158 - RNA, 20 nt, Human
uccagguuuuucaauuaaac

SEQ ID NO: 3718159 - RNA, 21 nt, Human
uccagguuuuucaauuaaacg

SEQ ID NO: 3718160 - RNA, 24 nt, Human
uccagguuuuucaauuaaacggau

SEQ ID NO: 3718161 - RNA, 14 nt, Human
uccaguaaaauaau

SEQ ID NO: 3718162 - RNA, 23 nt, Human
uccaguaagaucacuguuuagau

SEQ ID NO: 3718163 - RNA, 19 nt, Human
uccaguaaucuaauauggc

SEQ ID NO: 3718164 - RNA, 17 nt, Human
uccaguaccuuugucac

SEQ ID NO: 3718165 - RNA, 14 nt, Human
uccaguauaaccag

SEQ ID NO: 3718166 - RNA, 18 nt, Human
uccaguaucuugaagacu

SEQ ID NO: 3718167 - RNA, 13 nt, Human
uccagucaacaaa

SEQ ID NO: 3718168 - RNA, 22 nt, Human
uccagucaacaaacuauuucuu

SEQ ID NO: 3718169 - RNA, 13 nt, Human
uccagucaggaug

SEQ ID NO: 3718170 - RNA, 17 nt, Human
uccaguccaaucucaug

SEQ ID NO: 3718171 - RNA, 12 nt, Human
uccaguccccag

SEQ ID NO: 3718172 - RNA, 22 nt, Human
uccagucccccuauccuuggca

SEQ ID NO: 3718173 - RNA, 23 nt, Human
uccagucccccuauccuuggcac

SEQ ID NO: 3718174 - RNA, 19 nt, Human
uccaguccuaucugggcuu

SEQ ID NO: 3718175 - RNA, 16 nt, Human
uccaguccugcucucu

SEQ ID NO: 3718176 - RNA, 13 nt, Human
uccagucuauuca

SEQ ID NO: 3718177 - RNA, 15 nt, Human
uccagucuccaccag

SEQ ID NO: 3718178 - RNA, 19 nt, Human
uccagucuccaccaggaac

SEQ ID NO: 3718179 - RNA, 14 nt, Human
uccagucugcugcc

SEQ ID NO: 3718180 - RNA, 20 nt, Human
uccagucuuccaccuggaag

SEQ ID NO: 3718181 - RNA, 19 nt, Human
uccagucuuccugacacuu

SEQ ID NO: 3718182 - RNA, 21 nt, Human
uccagucuuccugacacuuua

SEQ ID NO: 3718183 - RNA, 19 nt, Human
uccagugaaaauaagccau

SEQ ID NO: 3718184 - RNA, 18 nt, Human
uccagugaaacuugggca

SEQ ID NO: 3718185 - RNA, 20 nt, Human
uccagugacaaaccauccag

SEQ ID NO: 3718186 - RNA, 20 nt, Human
uccagugaggcucugcccuu

SEQ ID NO: 3718187 - RNA, 15 nt, Human
uccagugcaaccaca

SEQ ID NO: 3718188 - RNA, 19 nt, Human
uccagugccaacaauccua

SEQ ID NO: 3718189 - RNA, 23 nt, Human
uccaguggacuucgcaguccacu

SEQ ID NO: 3718190 - RNA, 16 nt, Human
uccaguggccuggcuc

SEQ ID NO: 3718191 - RNA, 23 nt, Human
uccaguggccuggcuccgcugug

SEQ ID NO: 3718192 - RNA, 20 nt, Human
uccaguggggcaagauuuuc

SEQ ID NO: 3718193 - RNA, 13 nt, Human
uccaguguacaua

SEQ ID NO: 3718194 - RNA, 20 nt, Human
uccaguguacauaguguaau

SEQ ID NO: 3718195 - RNA, 17 nt, Human
uccaguguccugagcuc

SEQ ID NO: 3718196 - RNA, 20 nt, Human
uccaguguccugagcucagc

SEQ ID NO: 3718197 - RNA, 21 nt, Human
uccaguguccugagcucagcg

SEQ ID NO: 3718198 - RNA, 18 nt, Human
uccaguguccuuagaaca

SEQ ID NO: 3718199 - RNA, 23 nt, Human
uccagugucuauaaaagaaacac

SEQ ID NO: 3718200 - RNA, 16 nt, Human
uccagugucucacagc

SEQ ID NO: 3718201 - RNA, 17 nt, Human
uccaguguucuaugaac

SEQ ID NO: 3718202 - RNA, 17 nt, Human
uccaguuaaccaaguca

SEQ ID NO: 3718203 - RNA, 16 nt, Human
uccaguuacuuuccaa

SEQ ID NO: 3718204 - RNA, 20 nt, Human
uccaguucaucgauuuucua

SEQ ID NO: 3718205 - RNA, 16 nt, Human
uccaguucaugagaau

SEQ ID NO: 3718206 - RNA, 18 nt, Human
uccaguucccagaaggca

SEQ ID NO: 3718207 - RNA, 19 nt, Human
uccaguucuucgacuguug

SEQ ID NO: 3718208 - RNA, 21 nt, Human
uccaguucuucgacuguuguu

SEQ ID NO: 3718209 - RNA, 13 nt, Human
uccauaaacauga

SEQ ID NO: 3718210 - RNA, 16 nt, Human
uccauaaacaugaaaa

SEQ ID NO: 3718211 - RNA, 12 nt, Human
uccauaaucacu

SEQ ID NO: 3718212 - RNA, 18 nt, Human
uccauaaugcauucuucu

SEQ ID NO: 3718213 - RNA, 16 nt, Human
uccauaaugcuacugu

SEQ ID NO: 3718214 - RNA, 15 nt, Human
uccauaauguucugc

SEQ ID NO: 3718215 - RNA, 13 nt, Human
uccauacagcucu

SEQ ID NO: 3718216 - RNA, 14 nt, Human
uccauacagcucua

SEQ ID NO: 3718217 - RNA, 12 nt, Human
uccauaccagcu

SEQ ID NO: 3718218 - RNA, 14 nt, Human
uccauagagagcaa

SEQ ID NO: 3718219 - RNA, 20 nt, Human
uccauagagagcaagacgcu

SEQ ID NO: 3718220 - RNA, 15 nt, Human
uccauagcaacagga

SEQ ID NO: 3718221 - RNA, 22 nt, Human
uccauagccuaaucccugggca

SEQ ID NO: 3718222 - RNA, 17 nt, Human
uccauagcugcugcccu

SEQ ID NO: 3718223 - RNA, 16 nt, Human
uccauaguaacugaca

SEQ ID NO: 3718224 - RNA, 17 nt, Human
uccauaguauauuaaaa

SEQ ID NO: 3718225 - RNA, 20 nt, Human
uccauaguauauuaaaaaug

SEQ ID NO: 3718226 - RNA, 21 nt, Human
uccauaguauauuaaaaaugg

SEQ ID NO: 3718227 - RNA, 19 nt, Human
uccauaguuuggcauuugc

SEQ ID NO: 3718228 - RNA, 20 nt, Human
uccauaguuuggcauuugca

SEQ ID NO: 3718229 - RNA, 13 nt, Human
uccauaguuuuga

SEQ ID NO: 3718230 - RNA, 23 nt, Human
uccauaguuuugaugacuggcau

SEQ ID NO: 3718231 - RNA, 12 nt, Human
uccauauaaaua

SEQ ID NO: 3718232 - RNA, 19 nt, Human
uccauauaagcccuugauu

SEQ ID NO: 3718233 - RNA, 12 nt, Human
uccauauccaua

SEQ ID NO: 3718234 - RNA, 13 nt, Human
uccauauccuggu

SEQ ID NO: 3718235 - RNA, 17 nt, Human
uccauaugaccucaugc

SEQ ID NO: 3718236 - RNA, 14 nt, Human
uccauauucaugua

SEQ ID NO: 3718237 - RNA, 13 nt, Human
uccauauuuggaa

SEQ ID NO: 3718238 - RNA, 17 nt, Human
uccauauuuggaagaaa

SEQ ID NO: 3718239 - RNA, 18 nt, Human
uccauauuuucacaggug

SEQ ID NO: 3718240 - RNA, 23 nt, Human
uccauauuuuuuuccuuacauaa

SEQ ID NO: 3718241 - RNA, 15 nt, Human
uccaucagaaugaaa

SEQ ID NO: 3718242 - RNA, 13 nt, Human
uccaucagccagg

SEQ ID NO: 3718243 - RNA, 18 nt, Human
uccaucagguuccauccc

SEQ ID NO: 3718244 - RNA, 16 nt, Human
uccaucauguccccaa

SEQ ID NO: 3718245 - RNA, 13 nt, Human
uccauccaaggcc

SEQ ID NO: 3718246 - RNA, 16 nt, Human
uccauccaggccauuc

SEQ ID NO: 3718247 - RNA, 16 nt, Human
uccauccauggccagc

SEQ ID NO: 3718248 - RNA, 19 nt, Human
uccauccauggccagcagc

SEQ ID NO: 3718249 - RNA, 18 nt, Human
uccaucccaaccagugcc

SEQ ID NO: 3718250 - RNA, 21 nt, Human
uccaucccaaccagugccaag

SEQ ID NO: 3718251 - RNA, 23 nt, Human
uccaucccaaccagugccaagga

SEQ ID NO: 3718252 - RNA, 13 nt, Human
uccaucccagagg

SEQ ID NO: 3718253 - RNA, 15 nt, Human
uccaucccagcggcu

SEQ ID NO: 3718254 - RNA, 15 nt, Human
uccaucccaggacac

SEQ ID NO: 3718255 - RNA, 20 nt, Human
uccaucccgaaaaucucucg

SEQ ID NO: 3718256 - RNA, 14 nt, Human
uccaucccuacccc

SEQ ID NO: 3718257 - RNA, 22 nt, Human
uccaucccuacccccuaagagc

SEQ ID NO: 3718258 - RNA, 15 nt, Human
uccaucccucuaaug

SEQ ID NO: 3718259 - RNA, 23 nt, Human
uccaucccucuaaugagacugac

SEQ ID NO: 3718260 - RNA, 15 nt, Human
uccaucccuggcccc

SEQ ID NO: 3718261 - RNA, 15 nt, Human
uccauccugaggcuc

SEQ ID NO: 3718262 - RNA, 19 nt, Human
uccauccugaggcuccacu

SEQ ID NO: 3718263 - RNA, 20 nt, Human
uccauccugaggcuccacuu

SEQ ID NO: 3718264 - RNA, 15 nt, Human
uccauccuuucuccu

SEQ ID NO: 3718265 - RNA, 15 nt, Human
uccaucuaaaaauau

SEQ ID NO: 3718266 - RNA, 16 nt, Human
uccaucuaaacugccc

SEQ ID NO: 3718267 - RNA, 21 nt, Human
uccaucuaaauaccugcccug

SEQ ID NO: 3718268 - RNA, 21 nt, Human
uccaucuccaagaaugcugaa

SEQ ID NO: 3718269 - RNA, 20 nt, Human
uccaucuccuauaaucuguc

SEQ ID NO: 3718270 - RNA, 18 nt, Human
uccaucucucauccucca

SEQ ID NO: 3718271 - RNA, 20 nt, Human
uccaucucuuguuuaaauuc

SEQ ID NO: 3718272 - RNA, 16 nt, Human
uccaucugauuccagc

SEQ ID NO: 3718273 - RNA, 21 nt, Human
uccaucugcccgccugcccac

SEQ ID NO: 3718274 - RNA, 21 nt, Human
uccaucugguagaagggaaag

SEQ ID NO: 3718275 - RNA, 19 nt, Human
uccaucuguacuuggucca

SEQ ID NO: 3718276 - RNA, 16 nt, Human
uccaucuucagcuucu

SEQ ID NO: 3718277 - RNA, 22 nt, Human
uccaugaaaacguuuuauugug

SEQ ID NO: 3718278 - RNA, 15 nt, Human
uccaugaaaaugcaa

SEQ ID NO: 3718279 - RNA, 20 nt, Human
uccaugaagaccacauccac

SEQ ID NO: 3718280 - RNA, 21 nt, Human
uccaugaagaccacauccaca

SEQ ID NO: 3718281 - RNA, 21 nt, Human
uccaugaagauguagaggaga

SEQ ID NO: 3718282 - RNA, 16 nt, Human
uccaugaauguaucag

SEQ ID NO: 3718283 - RNA, 21 nt, Human
uccaugaauguaucaggaaau

SEQ ID NO: 3718284 - RNA, 15 nt, Human
uccaugaauguuccu

SEQ ID NO: 3718285 - RNA, 19 nt, Human
uccaugaauguuccugccu

SEQ ID NO: 3718286 - RNA, 13 nt, Human
uccaugagcaccc

SEQ ID NO: 3718287 - RNA, 19 nt, Human
uccaugagcaccccaaggc

SEQ ID NO: 3718288 - RNA, 23 nt, Human
uccaugaguuuuuucucuugggc

SEQ ID NO: 3718289 - RNA, 14 nt, Human
uccaugaugcuggg

SEQ ID NO: 3718290 - RNA, 14 nt, Human
uccaugauggaaua

SEQ ID NO: 3718291 - RNA, 12 nt, Human
uccaugauggag

SEQ ID NO: 3718292 - RNA, 14 nt, Human
uccaugcaccaaac

SEQ ID NO: 3718293 - RNA, 12 nt, Human
uccaugccugag

SEQ ID NO: 3718294 - RNA, 14 nt, Human
uccaugccugaggg

SEQ ID NO: 3718295 - RNA, 21 nt, Human
uccaugccuuaaaccuaccuc

SEQ ID NO: 3718296 - RNA, 15 nt, Human
uccaugcgcucaggg

SEQ ID NO: 3718297 - RNA, 16 nt, Human
uccaugcgcucagggc

SEQ ID NO: 3718298 - RNA, 18 nt, Human
uccaugcguguuucugac

SEQ ID NO: 3718299 - RNA, 22 nt, Human
uccaugcguguuucugacucug

SEQ ID NO: 3718300 - RNA, 15 nt, Human
uccaugcugccucca

SEQ ID NO: 3718301 - RNA, 21 nt, Human
uccaugcugugcgcccagggc

SEQ ID NO: 3718302 - RNA, 22 nt, Human
uccaugcugugcgcccagggcu

SEQ ID NO: 3718303 - RNA, 22 nt, Human
uccaugcuuagucacugccugc

SEQ ID NO: 3718304 - RNA, 17 nt, Human
uccauggaaugcuugaa

SEQ ID NO: 3718305 - RNA, 21 nt, Human
uccauggaaugcuugaaaaau

SEQ ID NO: 3718306 - RNA, 13 nt, Human
uccauggacuuug

SEQ ID NO: 3718307 - RNA, 14 nt, Human
uccauggacuuugu

SEQ ID NO: 3718308 - RNA, 18 nt, Human
uccauggcaggaaggcuu

SEQ ID NO: 3718309 - RNA, 15 nt, Human
uccauggccagcagc

SEQ ID NO: 3718310 - RNA, 17 nt, Human
uccaugggaaagauggu

SEQ ID NO: 3718311 - RNA, 18 nt, Human
uccaugggagaaaauaga

SEQ ID NO: 3718312 - RNA, 22 nt, Human
uccaugggcagagcccaaggga

SEQ ID NO: 3718313 - RNA, 22 nt, Human
uccauggggucucucacagaca

SEQ ID NO: 3718314 - RNA, 13 nt, Human
uccauggugccuc

SEQ ID NO: 3718315 - RNA, 12 nt, Human
uccauguaacug

SEQ ID NO: 3718316 - RNA, 14 nt, Human
uccauguaacugcc

SEQ ID NO: 3718317 - RNA, 14 nt, Human
uccauguacuguag

SEQ ID NO: 3718318 - RNA, 14 nt, Human
uccauguacuuguu

SEQ ID NO: 3718319 - RNA, 18 nt, Human
uccauguacuuguuugca

SEQ ID NO: 3718320 - RNA, 14 nt, Human
uccauguagcagga

SEQ ID NO: 3718321 - RNA, 20 nt, Human
uccauguaugcauaauaauc

SEQ ID NO: 3718322 - RNA, 16 nt, Human
uccauguccccuccca

SEQ ID NO: 3718323 - RNA, 17 nt, Human
uccauguccccucccag

SEQ ID NO: 3718324 - RNA, 18 nt, Human
uccauguccuauguguga

SEQ ID NO: 3718325 - RNA, 16 nt, Human
uccaugucgccucugc

SEQ ID NO: 3718326 - RNA, 17 nt, Human
uccaugucgccucugca

SEQ ID NO: 3718327 - RNA, 19 nt, Human
uccaugucgccucugcauu

SEQ ID NO: 3718328 - RNA, 15 nt, Human
uccaugucggccucu

SEQ ID NO: 3718329 - RNA, 21 nt, Human
uccaugucggccucuaacccc

SEQ ID NO: 3718330 - RNA, 14 nt, Human
uccaugugcccccu

SEQ ID NO: 3718331 - RNA, 13 nt, Human
uccauguggagaa

SEQ ID NO: 3718332 - RNA, 20 nt, Human
uccaugugggcuaguugggc

SEQ ID NO: 3718333 - RNA, 17 nt, Human
uccauguguggacucaa

SEQ ID NO: 3718334 - RNA, 14 nt, Human
uccaugugugugca

SEQ ID NO: 3718335 - RNA, 18 nt, Human
uccauguuaguuuuuacu

SEQ ID NO: 3718336 - RNA, 12 nt, Human
uccauguugcug

SEQ ID NO: 3718337 - RNA, 15 nt, Human
uccauguugcugcca

SEQ ID NO: 3718338 - RNA, 19 nt, Human
uccauuaaacgauuuuuaa

SEQ ID NO: 3718339 - RNA, 15 nt, Human
uccauuaucaugugu

SEQ ID NO: 3718340 - RNA, 15 nt, Human
uccauuaugauucuu

SEQ ID NO: 3718341 - RNA, 15 nt, Human
uccauuccucaggga

SEQ ID NO: 3718342 - RNA, 18 nt, Human
uccauuccuggagcccga

SEQ ID NO: 3718343 - RNA, 23 nt, Human
uccauucuccagggguuuacagu

SEQ ID NO: 3718344 - RNA, 12 nt, Human
uccauucuggaa

SEQ ID NO: 3718345 - RNA, 12 nt, Human
uccauucuuucu

SEQ ID NO: 3718346 - RNA, 18 nt, Human
uccauucuuucugauaac

SEQ ID NO: 3718347 - RNA, 21 nt, Human
ucagccuuccccuugcccagg

SEQ ID NO: 3718348 - RNA, 12 nt, Human
ucagccuucuuu

SEQ ID NO: 3718349 - RNA, 15 nt, Human
ucagccuugccagag

SEQ ID NO: 3718350 - RNA, 16 nt, Human
ucagccuugccagaga

SEQ ID NO: 3718351 - RNA, 21 nt, Human
ucagcgauguaugcagcuauc

SEQ ID NO: 3718352 - RNA, 20 nt, Human
ucagcgcugucaggauugcg

SEQ ID NO: 3718353 - RNA, 19 nt, Human
ucagcggcgaccgcccucc

SEQ ID NO: 3718354 - RNA, 14 nt, Human
ucagcggggacagc

SEQ ID NO: 3718355 - RNA, 19 nt, Human
ucagcggggacagcuccuu

SEQ ID NO: 3718356 - RNA, 15 nt, Human
ucagcguaaaauggu

SEQ ID NO: 3718357 - RNA, 16 nt, Human
ucagcguaaaauggug

SEQ ID NO: 3718358 - RNA, 13 nt, Human
ucagcguugcaug

SEQ ID NO: 3718359 - RNA, 23 nt, Human
ucagcuaaagaaguuugaacauu

SEQ ID NO: 3718360 - RNA, 20 nt, Human
ucagcuacuaaugauguuuu

SEQ ID NO: 3718361 - RNA, 17 nt, Human
ucagcuagcaaaagaag

SEQ ID NO: 3718362 - RNA, 22 nt, Human
ucagcuagcaaaagaaguaaca

SEQ ID NO: 3718363 - RNA, 18 nt, Human
ucagcuagcuuuuaggaa

SEQ ID NO: 3718364 - RNA, 20 nt, Human
ucagcuaggaacaaaucuuc

SEQ ID NO: 3718365 - RNA, 21 nt, Human
ucagcuaggaacaaaucuucc

SEQ ID NO: 3718366 - RNA, 20 nt, Human
ucagcuaucaguaggcuaau

SEQ ID NO: 3718367 - RNA, 22 nt, Human
ucagcuauuuaaaaaaaaaaga

SEQ ID NO: 3718368 - RNA, 18 nt, Human
ucagcuccacuuucagug

SEQ ID NO: 3718369 - RNA, 23 nt, Human
ucagcuccagacguaggggaggg

SEQ ID NO: 3718370 - RNA, 21 nt, Human
ucagcuccagccccuuuccaa

SEQ ID NO: 3718371 - RNA, 21 nt, Human
ucagcuccagcucaccagccc

SEQ ID NO: 3718372 - RNA, 22 nt, Human
ucagcuccagcucaccagcccc

SEQ ID NO: 3718373 - RNA, 14 nt, Human
ucagcuccaggugg

SEQ ID NO: 3718374 - RNA, 15 nt, Human
ucagcucccauuucu

SEQ ID NO: 3718375 - RNA, 20 nt, Human
ucagcucccauuucuacucu

SEQ ID NO: 3718376 - RNA, 20 nt, Human
ucagcucccccuguccccuc

SEQ ID NO: 3718377 - RNA, 22 nt, Human
ucagcucccccuguccccucag

SEQ ID NO: 3718378 - RNA, 18 nt, Human
ucagcuccccucggagaa

SEQ ID NO: 3718379 - RNA, 11 nt, Human
ucagcuccuga

SEQ ID NO: 3718380 - RNA, 12 nt, Human
ucccaugaagcc

SEQ ID NO: 3718381 - RNA, 13 nt, Human
ucccaugaagccu

SEQ ID NO: 3718382 - RNA, 17 nt, Human
ucccaugacccaccccu

SEQ ID NO: 3718383 - RNA, 24 nt, Human
ucccaugacccaccccugugcucc

SEQ ID NO: 3718384 - RNA, 15 nt, Human
ucccaugacccaggc

SEQ ID NO: 3718385 - RNA, 16 nt, Human
ucccaugacccaggcu

SEQ ID NO: 3718386 - RNA, 16 nt, Human
ucccaugagccucagc

SEQ ID NO: 3718387 - RNA, 19 nt, Human
ucccaugagggagaugcca

SEQ ID NO: 3718388 - RNA, 15 nt, Human
ucauacugaagaugc

SEQ ID NO: 3718389 - RNA, 18 nt, Human
ucauacugugcuggagcc

SEQ ID NO: 3718390 - RNA, 13 nt, Human
ucauacuuaaaaa

SEQ ID NO: 3718391 - RNA, 16 nt, Human
ucauacuuaagcaaaa

SEQ ID NO: 3718392 - RNA, 14 nt, Human
ucauacuugaacgu

SEQ ID NO: 3718393 - RNA, 21 nt, Human
ucauacuugaacguuuucuaa

SEQ ID NO: 3718394 - RNA, 23 nt, Human
ucauacuugaacguuuucuaauu

SEQ ID NO: 3718395 - RNA, 19 nt, Human
ucauagaaagugccagaaa

SEQ ID NO: 3718396 - RNA, 17 nt, Human
ucauagaaauucuuuau

SEQ ID NO: 3718397 - RNA, 15 nt, Human
ucauagauguuuccu

SEQ ID NO: 3718398 - RNA, 16 nt, Human
ucauagauuucugauu

SEQ ID NO: 3718399 - RNA, 18 nt, Human
ucauagcagauuuuaauu

SEQ ID NO: 3718400 - RNA, 12 nt, Human
ucauagcagcuu

SEQ ID NO: 3718401 - RNA, 16 nt, Human
ucauagcauugucuau

SEQ ID NO: 3718402 - RNA, 21 nt, Human
ucauagcccagaucagcuccu

SEQ ID NO: 3718403 - RNA, 14 nt, Human
ucauagcuaaaaaa

SEQ ID NO: 3718404 - RNA, 13 nt, Human
ucauagcuaagaa

SEQ ID NO: 3718405 - RNA, 16 nt, Human
ucauagcuaagaaaua

SEQ ID NO: 3718406 - RNA, 12 nt, Human
ucauagcugaga

SEQ ID NO: 3718407 - RNA, 19 nt, Human
ucauaggaaaguauuuuuu

SEQ ID NO: 3718408 - RNA, 16 nt, Human
ucauaggaaguuagcc

SEQ ID NO: 3718409 - RNA, 23 nt, Human
ucauaggucacuggcucuccaag

SEQ ID NO: 3718410 - RNA, 16 nt, Human
ucauaggucugaaauu

SEQ ID NO: 3718411 - RNA, 20 nt, Human
ucauagguuaaaaaaaaaag

SEQ ID NO: 3718412 - RNA, 20 nt, Human
ucauagguugccaauaauac

SEQ ID NO: 3718413 - RNA, 15 nt, Human
ucauaguaacuucuu

SEQ ID NO: 3718414 - RNA, 21 nt, Human
ucauaguaacuucuuauggaa

SEQ ID NO: 3718415 - RNA, 18 nt, Human
ucauaguaguuuuuacag

SEQ ID NO: 3718416 - RNA, 18 nt, Human
ucauaguaugguggcugg

SEQ ID NO: 3718417 - RNA, 19 nt, Human
ucauaguaugguggcuggg

SEQ ID NO: 3718418 - RNA, 13 nt, Human
ucauaguuaacau

SEQ ID NO: 3718419 - RNA, 14 nt, Human
ucauaguuaacaua

SEQ ID NO: 3718420 - RNA, 14 nt, Human
ucauaguuacugug

SEQ ID NO: 3718421 - RNA, 22 nt, Human
ucauaguuacuguguaaacuca

SEQ ID NO: 3718422 - RNA, 16 nt, Human
ucauaguuauuguuuc

SEQ ID NO: 3718423 - RNA, 17 nt, Human
ucauaguuauuguuucu

SEQ ID NO: 3718424 - RNA, 16 nt, Human
ucauaguuuuauuuau

SEQ ID NO: 3718425 - RNA, 17 nt, Human
ucauaguuuuauuuaua

SEQ ID NO: 3718426 - RNA, 16 nt, Human
ucauauaaaagcuaug

SEQ ID NO: 3718427 - RNA, 20 nt, Human
ucauauaaaagcuaugguga

SEQ ID NO: 3718428 - RNA, 16 nt, Human
ucauauaaauagaaug

SEQ ID NO: 3718429 - RNA, 21 nt, Human
ucauauaaauagaauguaaau

SEQ ID NO: 3718430 - RNA, 22 nt, Human
ucauauaaauagaauguaaaug

SEQ ID NO: 3718431 - RNA, 12 nt, Human
ucauauaagaca

SEQ ID NO: 3718432 - RNA, 16 nt, Human
ucauauaccagcaaua

SEQ ID NO: 3718433 - RNA, 14 nt, Human
ucauauacgugaaa

SEQ ID NO: 3718434 - RNA, 18 nt, Human
ucauauauggggggccaa

SEQ ID NO: 3718435 - RNA, 15 nt, Human
ucauauauuaaacau

SEQ ID NO: 3718436 - RNA, 16 nt, Human
ucauauauuuuaugaa

SEQ ID NO: 3718437 - RNA, 22 nt, Human
ucauauauuuuaugaaucagaa

SEQ ID NO: 3718438 - RNA, 21 nt, Human
ucauaucaucacauugagcug

SEQ ID NO: 3718439 - RNA, 13 nt, Human
ucauaucauccac

SEQ ID NO: 3718440 - RNA, 14 nt, Human
ucauaucauuucuu

SEQ ID NO: 3718441 - RNA, 18 nt, Human
ucauauccccuauuuaac

SEQ ID NO: 3718442 - RNA, 22 nt, Human
ucauauccuucuuacacgacua

SEQ ID NO: 3718443 - RNA, 21 nt, Human
ucauaugaaaaaaaugcauuu

SEQ ID NO: 3718444 - RNA, 20 nt, Human
ucauaugcaaagcauauuaa

SEQ ID NO: 3718445 - RNA, 18 nt, Human
ucauauggcccaguguca

SEQ ID NO: 3718446 - RNA, 17 nt, Human
ucauaugugaucugucu

SEQ ID NO: 3718447 - RNA, 14 nt, Human
ucauauguugcuca

SEQ ID NO: 3718448 - RNA, 17 nt, Human
ucauauuaagaaugauc

SEQ ID NO: 3718449 - RNA, 18 nt, Human
ucauauuaagaaugaucu

SEQ ID NO: 3718450 - RNA, 20 nt, Human
ucauauuagacuucuguuuu

SEQ ID NO: 3718451 - RNA, 21 nt, Human
ucauauucaugcaaguauucu

SEQ ID NO: 3718452 - RNA, 17 nt, Human
ucauauuccugcagccu

SEQ ID NO: 3718453 - RNA, 12 nt, Human
ucauauugaaua

SEQ ID NO: 3718454 - RNA, 13 nt, Human
ucauauugaugaa

SEQ ID NO: 3718455 - RNA, 16 nt, Human
ucauauugaugaaaag

SEQ ID NO: 3718456 - RNA, 22 nt, Human
ucauauugguauauccuuuucu

SEQ ID NO: 3718457 - RNA, 15 nt, Human
ucauauugugccaau

SEQ ID NO: 3718458 - RNA, 19 nt, Human
ucauauuuaaagacaggga

SEQ ID NO: 3718459 - RNA, 20 nt, Human
ucauauuuacuucuuauaca

SEQ ID NO: 3718460 - RNA, 22 nt, Human
ucauauuuacuucuuauacauu

SEQ ID NO: 3718461 - RNA, 22 nt, Human
ucauauuuaguauugaauacuu

SEQ ID NO: 3718462 - RNA, 13 nt, Human
ucauauuugcacu

SEQ ID NO: 3718463 - RNA, 14 nt, Human
ucauauuugcacua

SEQ ID NO: 3718464 - RNA, 22 nt, Human
ucauauuuguacuuucuguuaa

SEQ ID NO: 3718465 - RNA, 20 nt, Human
ucauauuuuaaacagaggau

SEQ ID NO: 3718466 - RNA, 15 nt, Human
ucauauuuucuuuca

SEQ ID NO: 3718467 - RNA, 18 nt, Human
ucauauuuucuuucaaaa

SEQ ID NO: 3718468 - RNA, 16 nt, Human
ucauauuuugauuauu

SEQ ID NO: 3718469 - RNA, 16 nt, Human
ucaucaacaaagaaau

SEQ ID NO: 3718470 - RNA, 17 nt, Human
ucaucaacccuaaaaag

SEQ ID NO: 3718471 - RNA, 11 nt, Human
ucaucaagaag

SEQ ID NO: 3718472 - RNA, 16 nt, Human
ucaucaagaagggcug

SEQ ID NO: 3718473 - RNA, 18 nt, Human
ucaucaagaagggcugca

SEQ ID NO: 3718474 - RNA, 18 nt, Human
ucaucaaggcacugccug

SEQ ID NO: 3718475 - RNA, 19 nt, Human
ucaucaaggcacugccuga

SEQ ID NO: 3718476 - RNA, 21 nt, Human
ucaucaauaguguccuaugca

SEQ ID NO: 3718477 - RNA, 13 nt, Human
ucaucaaucaaau

SEQ ID NO: 3718478 - RNA, 15 nt, Human
ucaucaaucauugua

SEQ ID NO: 3718479 - RNA, 17 nt, Human
ucaucaaugaaugaaug

SEQ ID NO: 3718480 - RNA, 15 nt, Human
ucaucacacacaugg

SEQ ID NO: 3718481 - RNA, 21 nt, Human
ucaucaccaacgucugugcca

SEQ ID NO: 3718482 - RNA, 18 nt, Human
ucaucacuacaguauuac

SEQ ID NO: 3718483 - RNA, 14 nt, Human
ucaucacuguggcu

SEQ ID NO: 3718484 - RNA, 17 nt, Human
ucaucacuuuucaguga

SEQ ID NO: 3718485 - RNA, 13 nt, Human
ucaucagaacagc

SEQ ID NO: 3718486 - RNA, 16 nt, Human
ucaucagaacagcugu

SEQ ID NO: 3718487 - RNA, 21 nt, Human
ucaucagaacagcuguugacu

SEQ ID NO: 3718488 - RNA, 15 nt, Human
ucaucagaagauaac

SEQ ID NO: 3718489 - RNA, 15 nt, Human
ucaucagagccuuuc

SEQ ID NO: 3718490 - RNA, 17 nt, Human
ucaucagagcuccucug

SEQ ID NO: 3718491 - RNA, 21 nt, Human
ucaucagagcuccucuguccu

SEQ ID NO: 3718492 - RNA, 18 nt, Human
ucaucagauggaaauauu

SEQ ID NO: 3718493 - RNA, 14 nt, Human
ucaucagcauaccu

SEQ ID NO: 3718494 - RNA, 21 nt, Human
ucaucagcauaccuuuauugu

SEQ ID NO: 3718495 - RNA, 19 nt, Human
ucaucaggacccuggaccu

SEQ ID NO: 3718496 - RNA, 11 nt, Human
ucaucaggaug

SEQ ID NO: 3718497 - RNA, 13 nt, Human
ucaucaggaugaa

SEQ ID NO: 3718498 - RNA, 22 nt, Human
ucaucaggaugaacccaggacg

SEQ ID NO: 3718499 - RNA, 21 nt, Human
ucaucagggccuggggccuga

SEQ ID NO: 3718500 - RNA, 20 nt, Human
ucaucaguauugaagcauuu

SEQ ID NO: 3718501 - RNA, 12 nt, Human
ucaucaguguua

SEQ ID NO: 3718502 - RNA, 19 nt, Human
ucaucaguguuaaaaaauu

SEQ ID NO: 3718503 - RNA, 19 nt, Human
ucaucauaaaauaaaguau

SEQ ID NO: 3718504 - RNA, 15 nt, Human
ucaucauacaugacu

SEQ ID NO: 3718505 - RNA, 16 nt, Human
ucaucaucagggccug

SEQ ID NO: 3718506 - RNA, 12 nt, Human
ucaucaugcagc

SEQ ID NO: 3718507 - RNA, 20 nt, Human
ucaucauggaggucauacau

SEQ ID NO: 3718508 - RNA, 18 nt, Human
ucaucauggccagcugga

SEQ ID NO: 3718509 - RNA, 22 nt, Human
ucaucauguaucgcuucaugua

SEQ ID NO: 3718510 - RNA, 13 nt, Human
ucaucaugucuau

SEQ ID NO: 3718511 - RNA, 16 nt, Human
ucaucaugucuauugu

SEQ ID NO: 3718512 - RNA, 17 nt, Human
ucaucauucacuucacu

SEQ ID NO: 3718513 - RNA, 21 nt, Human
ucaucauucacuucacugugc

SEQ ID NO: 3718514 - RNA, 23 nt, Human
ucaucauucacuucacugugcug

SEQ ID NO: 3718515 - RNA, 14 nt, Human
ucaucauuccuuga

SEQ ID NO: 3718516 - RNA, 20 nt, Human
ucaucauuguauauaugugu

SEQ ID NO: 3718517 - RNA, 14 nt, Human
ucaucauuuuuccu

SEQ ID NO: 3718518 - RNA, 17 nt, Human
ucauccaaguuaaaugu

SEQ ID NO: 3718519 - RNA, 14 nt, Human
ucauccacauuguu

SEQ ID NO: 3718520 - RNA, 17 nt, Human
ucauccacauuguuuua

SEQ ID NO: 3718521 - RNA, 22 nt, Human
ucauccacauuguuuuaaaaag

SEQ ID NO: 3718522 - RNA, 12 nt, Human
ucauccacccca

SEQ ID NO: 3718523 - RNA, 19 nt, Human
ucauccacuagugcaaauc

SEQ ID NO: 3718524 - RNA, 17 nt, Human
ucauccacugugccaug

SEQ ID NO: 3718525 - RNA, 18 nt, Human
ucauccacugugccaugu

SEQ ID NO: 3718526 - RNA, 23 nt, Human
ucauccacugugccaugugccag

SEQ ID NO: 3718527 - RNA, 20 nt, Human
ucauccagacucagagcucu

SEQ ID NO: 3718528 - RNA, 20 nt, Human
ucauccagauguggcuacug

SEQ ID NO: 3718529 - RNA, 14 nt, Human
ucauccagggcucu

SEQ ID NO: 3718530 - RNA, 19 nt, Human
ucauccauucuauuguuaa

SEQ ID NO: 3718531 - RNA, 13 nt, Human
ucaucccagcccc

SEQ ID NO: 3718532 - RNA, 14 nt, Human
ucaucccagcccca

SEQ ID NO: 3718533 - RNA, 21 nt, Human
ucaucccaucuaagcugcagc

SEQ ID NO: 3718534 - RNA, 14 nt, Human
ucaucccauguaca

SEQ ID NO: 3718535 - RNA, 20 nt, Human
ucaucccauuaaucauuucc

SEQ ID NO: 3718536 - RNA, 21 nt, Human
ucaucccauuaaucauuuccc

SEQ ID NO: 3718537 - RNA, 16 nt, Human
ucaucccauuccaggc

SEQ ID NO: 3718538 - RNA, 12 nt, Human
gcugcugccugg

SEQ ID NO: 3718539 - RNA, 23 nt, Human
gcugcugccuuuagucgcugagg

SEQ ID NO: 3718540 - RNA, 17 nt, Human
gcugcugcgcccugggc

SEQ ID NO: 3718541 - RNA, 13 nt, Human
gcugcugcugcug

SEQ ID NO: 3718542 - RNA, 17 nt, Human
gcugcugcugggcucag

SEQ ID NO: 3718543 - RNA, 12 nt, Human
gcugcuggagga

SEQ ID NO: 3718544 - RNA, 14 nt, Human
gcugcuggaggaaa

SEQ ID NO: 3718545 - RNA, 20 nt, Human
gcugcuggaucacagcugcu

SEQ ID NO: 3718546 - RNA, 14 nt, Human
gcugcuggcgccuc

SEQ ID NO: 3718547 - RNA, 16 nt, Human
gcugcuggcgccucug

SEQ ID NO: 3718548 - RNA, 18 nt, Human
gcugcuggcgccucugca

SEQ ID NO: 3718549 - RNA, 15 nt, Human
gcugcuggcuugcag

SEQ ID NO: 3718550 - RNA, 15 nt, Human
gcugcugggauggug

SEQ ID NO: 3718551 - RNA, 23 nt, Human
gcugcugggauggugggcuucag

SEQ ID NO: 3718552 - RNA, 20 nt, Human
gcugcugggcucagugaagu

SEQ ID NO: 3718553 - RNA, 20 nt, Human
gcugcuggggaagacagugg

SEQ ID NO: 3718554 - RNA, 21 nt, Human
gcugcuggggaagacaguggc

SEQ ID NO: 3718555 - RNA, 17 nt, Human
gcugcugucaccucucc

SEQ ID NO: 3718556 - RNA, 15 nt, Human
gcugcugucccuccc

SEQ ID NO: 3718557 - RNA, 16 nt, Human
gcugcugucccucccc

SEQ ID NO: 3718558 - RNA, 13 nt, Human
gcugcugucuggg

SEQ ID NO: 3718559 - RNA, 21 nt, Human
gcugcugucugggugcuacug

SEQ ID NO: 3718560 - RNA, 14 nt, Human
gcugcugucuuguu

SEQ ID NO: 3718561 - RNA, 12 nt, Human
gcugcugugaag

SEQ ID NO: 3718562 - RNA, 22 nt, Human
gcugcugugcaacggucuccug

SEQ ID NO: 3718563 - RNA, 16 nt, Human
gcugcuguggcgugag

SEQ ID NO: 3718564 - RNA, 21 nt, Human
gcugcuuaauaccaaacaugc

SEQ ID NO: 3718565 - RNA, 15 nt, Human
gcugcuucauguuug

SEQ ID NO: 3718566 - RNA, 20 nt, Human
gcugcuucccucugccuguc

SEQ ID NO: 3718567 - RNA, 23 nt, Human
gcugcuuccgguagggaggcagc

SEQ ID NO: 3718568 - RNA, 14 nt, Human
gcugcuuccuccug

SEQ ID NO: 3718569 - RNA, 19 nt, Human
gcugcuucucccaggcaag

SEQ ID NO: 3718570 - RNA, 22 nt, Human
gcugcuugcccccaugcuggcg

SEQ ID NO: 3718571 - RNA, 19 nt, Human
gcugcuugugucccuccug

SEQ ID NO: 3718572 - RNA, 23 nt, Human
gcugcuuuaauugugaauugaua

SEQ ID NO: 3718573 - RNA, 15 nt, Human
gcugcuuuccccugu

SEQ ID NO: 3718574 - RNA, 16 nt, Human
gcugcuuuccccugug

SEQ ID NO: 3718575 - RNA, 13 nt, Human
gcugcuuucuucu

SEQ ID NO: 3718576 - RNA, 12 nt, Human
gcugcuuuguua

SEQ ID NO: 3718577 - RNA, 14 nt, Human
gcugcuuuuauauc

SEQ ID NO: 3718578 - RNA, 18 nt, Human
gcugcuuuuauaucugua

SEQ ID NO: 3718579 - RNA, 18 nt, Human
gcugcuuuuugagguggc

SEQ ID NO: 3718580 - RNA, 22 nt, Human
gcuggaaaauaauacugcugag

SEQ ID NO: 3718581 - RNA, 14 nt, Human
gcuggaacucuuga

SEQ ID NO: 3718582 - RNA, 21 nt, Human
gcuggaacucuugacagcuau

SEQ ID NO: 3718583 - RNA, 14 nt, Human
gcuggaagauccug

SEQ ID NO: 3718584 - RNA, 15 nt, Human
gcuggaagauccugc

SEQ ID NO: 3718585 - RNA, 13 nt, Human
gcuggaagcccag

SEQ ID NO: 3718586 - RNA, 17 nt, Human
gcuggaagcugggaggu

SEQ ID NO: 3718587 - RNA, 13 nt, Human
gcuggaaggguca

SEQ ID NO: 3718588 - RNA, 19 nt, Human
gcuggaaucuggagagcua

SEQ ID NO: 3718589 - RNA, 21 nt, Human
gcuggaaucuggagagcuaga

SEQ ID NO: 3718590 - RNA, 23 nt, Human
gcuggaaugauuucagcucacug

SEQ ID NO: 3718591 - RNA, 18 nt, Human
gcuggaauuuuuuauucu

SEQ ID NO: 3718592 - RNA, 19 nt, Human
gcuggacaaacugcaccag

SEQ ID NO: 3718593 - RNA, 13 nt, Human
gcuggacagaggg

SEQ ID NO: 3718594 - RNA, 14 nt, Human
gcuggacaggucug

SEQ ID NO: 3718595 - RNA, 22 nt, Human
gcuggaccaaagcagcugcagc

SEQ ID NO: 3718596 - RNA, 20 nt, Human
gcuggaccaguggugccuug

SEQ ID NO: 3718597 - RNA, 14 nt, Human
gcuggacccagcca

SEQ ID NO: 3718598 - RNA, 20 nt, Human
gcuggacccagccaggccca

SEQ ID NO: 3718599 - RNA, 20 nt, Human
gcuggacccugaccagcucc

SEQ ID NO: 3718600 - RNA, 23 nt, Human
gcuggacccugaccagcuccccc

SEQ ID NO: 3718601 - RNA, 21 nt, Human
gcuggacggggacuggggaug

SEQ ID NO: 3718602 - RNA, 15 nt, Human
gcuggacgucuuucu

SEQ ID NO: 3718603 - RNA, 17 nt, Human
gcuggacuccagaucug

SEQ ID NO: 3718604 - RNA, 18 nt, Human
gcuggacuccagaucugc

SEQ ID NO: 3718605 - RNA, 22 nt, Human
gcuggacuccagaucugcaccg

SEQ ID NO: 3718606 - RNA, 13 nt, Human
gcuggacugaggc

SEQ ID NO: 3718607 - RNA, 16 nt, Human
gcuggacugaggccug

SEQ ID NO: 3718608 - RNA, 16 nt, Human
gcuggagaagagagga

SEQ ID NO: 3718609 - RNA, 21 nt, Human
gcuggagaagagaggagagga

SEQ ID NO: 3718610 - RNA, 20 nt, Human
gcuggagaccaugcagagcg

SEQ ID NO: 3718611 - RNA, 21 nt, Human
gcuggagaccaugcagagcgc

SEQ ID NO: 3718612 - RNA, 22 nt, Human
gcuggagaccaugcagagcgcc

SEQ ID NO: 3718613 - RNA, 18 nt, Human
gcuggagacgggugggcg

SEQ ID NO: 3718614 - RNA, 21 nt, Human
gcuggagacuccuaggcagga

SEQ ID NO: 3718615 - RNA, 17 nt, Human
gcuggagaggagcccug

SEQ ID NO: 3718616 - RNA, 18 nt, Human
gcuggagaggagcccugc

SEQ ID NO: 3718617 - RNA, 12 nt, Human
gcuggagagguu

SEQ ID NO: 3718618 - RNA, 13 nt, Human
gcuggagagguua

SEQ ID NO: 3718619 - RNA, 18 nt, Human
gcuggagaugaggccaga

SEQ ID NO: 3718620 - RNA, 21 nt, Human
gcuggagaugaggccagacca

SEQ ID NO: 3718621 - RNA, 21 nt, Human
gcuggagcacugggcucccgg

SEQ ID NO: 3718622 - RNA, 15 nt, Human
gcuggagccacuaac

SEQ ID NO: 3718623 - RNA, 19 nt, Human
gcuggagccacuaacuaga

SEQ ID NO: 3718624 - RNA, 17 nt, Human
gcuggagccuggugccc

SEQ ID NO: 3718625 - RNA, 13 nt, Human
gcuggagccugug

SEQ ID NO: 3718626 - RNA, 14 nt, Human
gcuggagcucugcc

SEQ ID NO: 3718627 - RNA, 12 nt, Human
gcuggagcuggc

SEQ ID NO: 3718628 - RNA, 17 nt, Human
gcuggaggagcccaggc

SEQ ID NO: 3718629 - RNA, 20 nt, Human
gcuggaggaugugggcagcu

SEQ ID NO: 3718630 - RNA, 13 nt, Human
gcuggaggcaggg

SEQ ID NO: 3718631 - RNA, 15 nt, Human
gcuggaggcagggcc

SEQ ID NO: 3718632 - RNA, 16 nt, Human
gcuggaggcagggccu

SEQ ID NO: 3718633 - RNA, 14 nt, Human
gcuggaggcccagg

SEQ ID NO: 3718634 - RNA, 23 nt, Human
gcuggagggaggcgggggcugcc

SEQ ID NO: 3718635 - RNA, 16 nt, Human
gcuggagguaaggccu

SEQ ID NO: 3718636 - RNA, 16 nt, Human
gcuggaggugggagca

SEQ ID NO: 3718637 - RNA, 19 nt, Human
gcuggaggugggagcagga

SEQ ID NO: 3718638 - RNA, 21 nt, Human
gcuggaggugggagcaggaga

SEQ ID NO: 3718639 - RNA, 22 nt, Human
gcuggaggugggagcaggagau

SEQ ID NO: 3718640 - RNA, 15 nt, Human
gcuggagucuccuga

SEQ ID NO: 3718641 - RNA, 16 nt, Human
gcuggagucuccugag

SEQ ID NO: 3718642 - RNA, 12 nt, Human
gcuggagugcag

SEQ ID NO: 3718643 - RNA, 14 nt, Human
gcuggagugcagug

SEQ ID NO: 3718644 - RNA, 18 nt, Human
gcuggagugcagugagcc

SEQ ID NO: 3718645 - RNA, 19 nt, Human
gcuggagugcaguggcgaa

SEQ ID NO: 3718646 - RNA, 20 nt, Human
gcuggagugcaguggcgcga

SEQ ID NO: 3718647 - RNA, 19 nt, Human
gcuggagugcaguggugca

SEQ ID NO: 3718648 - RNA, 20 nt, Human
gcuggagugcagugguguga

SEQ ID NO: 3718649 - RNA, 17 nt, Human
gcuggaguuagggacug

SEQ ID NO: 3718650 - RNA, 14 nt, Human
gcuggaucucccag

SEQ ID NO: 3718651 - RNA, 21 nt, Human
gcuggaugcuccuuccaacag

SEQ ID NO: 3718652 - RNA, 22 nt, Human
gcuggaugcuccuuccaacagg

SEQ ID NO: 3718653 - RNA, 18 nt, Human
gcuggauggagcccaggc

SEQ ID NO: 3718654 - RNA, 18 nt, Human
gcuggaugucugccaauu

SEQ ID NO: 3718655 - RNA, 21 nt, Human
gcuggaugucugccaauuuuu

SEQ ID NO: 3718656 - RNA, 16 nt, Human
gcuggauuacaggcau

SEQ ID NO: 3718657 - RNA, 15 nt, Human
gcuggcaaagacaga

SEQ ID NO: 3718658 - RNA, 15 nt, Human
gcuggcaaagguggc

SEQ ID NO: 3718659 - RNA, 20 nt, Human
gcuggcaaagguggcucucc

SEQ ID NO: 3718660 - RNA, 16 nt, Human
gcuggcacccaccgug

SEQ ID NO: 3718661 - RNA, 18 nt, Human
gcuggcaccgccuucucu

SEQ ID NO: 3718662 - RNA, 14 nt, Human
gcuggcagcucucc

SEQ ID NO: 3718663 - RNA, 15 nt, Human
gcuggcagcucucca

SEQ ID NO: 3718664 - RNA, 16 nt, Human
gcuggcagcucuccag

SEQ ID NO: 3718665 - RNA, 17 nt, Human
gcuggcagcucuccagu

SEQ ID NO: 3718666 - RNA, 16 nt, Human
gcuggcauagagcagc

SEQ ID NO: 3718667 - RNA, 16 nt, Human
gcuggcauuacaggug

SEQ ID NO: 3718668 - RNA, 12 nt, Human
gcuggccacugc

SEQ ID NO: 3718669 - RNA, 20 nt, Human
gcuggccacugcacagagcu

SEQ ID NO: 3718670 - RNA, 14 nt, Human
gcuggccagcccca

SEQ ID NO: 3718671 - RNA, 22 nt, Human
gcuggccagccccacagcccac

SEQ ID NO: 3718672 - RNA, 21 nt, Human
gcuggccagccgcucuccugc

SEQ ID NO: 3718673 - RNA, 22 nt, Human
gcuggccagccuggggccuggc

SEQ ID NO: 3718674 - RNA, 14 nt, Human
gcuggccaguccag

SEQ ID NO: 3718675 - RNA, 16 nt, Human
gcuggccauggagaaa

SEQ ID NO: 3718676 - RNA, 17 nt, Human
gcuggccauggagaaag

SEQ ID NO: 3718677 - RNA, 14 nt, Human
gcuggcccagcccu

SEQ ID NO: 3718678 - RNA, 16 nt, Human
gcuggcccagcccugc

SEQ ID NO: 3718679 - RNA, 19 nt, Human
gcuggcccagcccugcugg

SEQ ID NO: 3718680 - RNA, 13 nt, Human
gcuggcccagccg

SEQ ID NO: 3718681 - RNA, 17 nt, Human
gcuggcccagccggccu

SEQ ID NO: 3718682 - RNA, 18 nt, Human
gcuggcccagccggccuc

SEQ ID NO: 3718683 - RNA, 20 nt, Human
gcuggcccagccggccucuc

SEQ ID NO: 3718684 - RNA, 17 nt, Human
gcuggcccagggcccag

SEQ ID NO: 3718685 - RNA, 18 nt, Human
gcuggcccagggcccaga

SEQ ID NO: 3718686 - RNA, 14 nt, Human
gcuggccccagccc

SEQ ID NO: 3718687 - RNA, 23 nt, Human
gcuggccccgccgccugguacuc

SEQ ID NO: 3718688 - RNA, 19 nt, Human
ucccaugaucccuguguug

SEQ ID NO: 3718689 - RNA, 12 nt, Human
ucccaugaugua

SEQ ID NO: 3718690 - RNA, 14 nt, Human
ucccauggacacuc

SEQ ID NO: 3718691 - RNA, 15 nt, Human
ucccauggacacucc

SEQ ID NO: 3718692 - RNA, 20 nt, Human
ucccauggacacuccagugc

SEQ ID NO: 3718693 - RNA, 14 nt, Human
ucccauggggaggg

SEQ ID NO: 3718694 - RNA, 17 nt, Human
ucccauguaacagaaag

SEQ ID NO: 3718695 - RNA, 13 nt, Human
ucccauguagccc

SEQ ID NO: 3718696 - RNA, 13 nt, Human
ucccauuauucaa

SEQ ID NO: 3718697 - RNA, 14 nt, Human
ucccauucaagauu

SEQ ID NO: 3718698 - RNA, 19 nt, Human
ucccauucacucuuccaga

SEQ ID NO: 3718699 - RNA, 13 nt, Human
ucccauuccaggc

SEQ ID NO: 3718700 - RNA, 15 nt, Human
ucccauuccugaaga

SEQ ID NO: 3718701 - RNA, 13 nt, Human
ucccauucuaugu

SEQ ID NO: 3718702 - RNA, 14 nt, Human
ucccauucuaugug

SEQ ID NO: 3718703 - RNA, 18 nt, Human
ucccauucuaugugucau

SEQ ID NO: 3718704 - RNA, 19 nt, Human
ucccauucuccauuuguua

SEQ ID NO: 3718705 - RNA, 20 nt, Human
ucccauugaaaauguaagua

SEQ ID NO: 3718706 - RNA, 22 nt, Human
ucccauugcaucaccucuguaa

SEQ ID NO: 3718707 - RNA, 13 nt, Human
ucccauugucccu

SEQ ID NO: 3718708 - RNA, 15 nt, Human
ucccauugucuucug

SEQ ID NO: 3718709 - RNA, 18 nt, Human
ucccauuucucacugaga

SEQ ID NO: 3718710 - RNA, 22 nt, Human
uccccaaaaaccucacccgagg

SEQ ID NO: 3718711 - RNA, 23 nt, Human
uccccaaaucaauacacuaguug

SEQ ID NO: 3718712 - RNA, 23 nt, Human
uccccaacagcgacauagcccau

SEQ ID NO: 3718713 - RNA, 16 nt, Human
uccccaacagcgccca

SEQ ID NO: 3718714 - RNA, 18 nt, Human
uccccaacagugugaagu

SEQ ID NO: 3718715 - RNA, 19 nt, Human
uccccaacagugugaaguu

SEQ ID NO: 3718716 - RNA, 18 nt, Human
uccccaacauguaauaag

SEQ ID NO: 3718717 - RNA, 20 nt, Human
uccccaacccuagguucccu

SEQ ID NO: 3718718 - RNA, 16 nt, Human
uccccaacccugcccc

SEQ ID NO: 3718719 - RNA, 18 nt, Human
uccccaacccugccccug

SEQ ID NO: 3718720 - RNA, 14 nt, Human
uccccaacugacca

SEQ ID NO: 3718721 - RNA, 20 nt, Human
uccccaaggcccccugccug

SEQ ID NO: 3718722 - RNA, 21 nt, Human
uccccaaggcccccugccugc

SEQ ID NO: 3718723 - RNA, 23 nt, Human
uccccaagugguuuccacaugcu

SEQ ID NO: 3718724 - RNA, 21 nt, Human
uccccaauaauugcagaacua

SEQ ID NO: 3718725 - RNA, 18 nt, Human
uccccacagcgucccugg

SEQ ID NO: 3718726 - RNA, 18 nt, Human
uccccacaggagcccugc

SEQ ID NO: 3718727 - RNA, 13 nt, Human
uccccaccaguga

SEQ ID NO: 3718728 - RNA, 14 nt, Human
uccccaccaucugc

SEQ ID NO: 3718729 - RNA, 23 nt, Human
uccccaccaucugcugucuuuuc

SEQ ID NO: 3718730 - RNA, 21 nt, Human
uccccacccaccaacccucag

SEQ ID NO: 3718731 - RNA, 23 nt, Human
uccccacccaccaacccucaggg

SEQ ID NO: 3718732 - RNA, 14 nt, Human
uccccaccccuacc

SEQ ID NO: 3718733 - RNA, 15 nt, Human
uccccaccccuaccc

SEQ ID NO: 3718734 - RNA, 14 nt, Human
uccccaccccugcc

SEQ ID NO: 3718735 - RNA, 13 nt, Human
uccccacccucca

SEQ ID NO: 3718736 - RNA, 15 nt, Human
uccccacccuccacu

SEQ ID NO: 3718737 - RNA, 19 nt, Human
uccccacccuccacucagc

SEQ ID NO: 3718738 - RNA, 15 nt, Human
uccccacccuccugg

SEQ ID NO: 3718739 - RNA, 15 nt, Human
uccccaccgcagaca

SEQ ID NO: 3718740 - RNA, 17 nt, Human
uccccaccgcagacagg

SEQ ID NO: 3718741 - RNA, 18 nt, Human
uccccaccuucaauuccu

SEQ ID NO: 3718742 - RNA, 22 nt, Human
uccccaccuucaauuccugggc

SEQ ID NO: 3718743 - RNA, 16 nt, Human
uccccacgagggcugg

SEQ ID NO: 3718744 - RNA, 17 nt, Human
uccccacgagggcuggc

SEQ ID NO: 3718745 - RNA, 17 nt, Human
uccccacgccacagccc

SEQ ID NO: 3718746 - RNA, 18 nt, Human
uccccacggccgcuccag

SEQ ID NO: 3718747 - RNA, 22 nt, Human
uccccacggggccucgggaccu

SEQ ID NO: 3718748 - RNA, 22 nt, Human
uccccacucccuggcucucaga

SEQ ID NO: 3718749 - RNA, 16 nt, Human
uccccacucugcucug

SEQ ID NO: 3718750 - RNA, 17 nt, Human
uccccacucugcucuga

SEQ ID NO: 3718751 - RNA, 16 nt, Human
uccccacugacagccu

SEQ ID NO: 3718752 - RNA, 19 nt, Human
uccccacuguaucuaggca

SEQ ID NO: 3718753 - RNA, 19 nt, Human
uccccacuugcagcccugu

SEQ ID NO: 3718754 - RNA, 21 nt, Human
uccccacuuguccgcugggug

SEQ ID NO: 3718755 - RNA, 17 nt, Human
uccccagaaaggagacu

SEQ ID NO: 3718756 - RNA, 18 nt, Human
uccccagacgccuggcug

SEQ ID NO: 3718757 - RNA, 21 nt, Human
uccccagacgccuggcugcug

SEQ ID NO: 3718758 - RNA, 10 nt, Human
uccccagaga

SEQ ID NO: 3718759 - RNA, 17 nt, Human
uccccagagaaagcgca

SEQ ID NO: 3718760 - RNA, 23 nt, Human
uccccagagaaagcgcagaugcu

SEQ ID NO: 3718761 - RNA, 22 nt, Human
uccccagagaaaggggagccca

SEQ ID NO: 3718762 - RNA, 19 nt, Human
uccccagaguccucuauga

SEQ ID NO: 3718763 - RNA, 17 nt, Human
uccccagaguuccccau

SEQ ID NO: 3718764 - RNA, 18 nt, Human
uccccagaguuccccaug

SEQ ID NO: 3718765 - RNA, 22 nt, Human
uccccagauugcaacaggcugg

SEQ ID NO: 3718766 - RNA, 22 nt, Human
uccccagcagggucuuuucauc

SEQ ID NO: 3718767 - RNA, 18 nt, Human
uccccagcaucacucccc

SEQ ID NO: 3718768 - RNA, 21 nt, Human
uccccagcaugcaccacgggc

SEQ ID NO: 3718769 - RNA, 16 nt, Human
uccccagccagccugg

SEQ ID NO: 3718770 - RNA, 13 nt, Human
uccccagcccaga

SEQ ID NO: 3718771 - RNA, 16 nt, Human
uccccagcccagagac

SEQ ID NO: 3718772 - RNA, 15 nt, Human
uccccagcccagggu

SEQ ID NO: 3718773 - RNA, 22 nt, Human
uccccagcccaggguuccccca

SEQ ID NO: 3718774 - RNA, 16 nt, Human
uccccagccccuagcc

SEQ ID NO: 3718775 - RNA, 20 nt, Human
uccccagcccuuccucugcu

SEQ ID NO: 3718776 - RNA, 17 nt, Human
uccccagccucucuucc

SEQ ID NO: 3718777 - RNA, 11 nt, Human
uccccagccug

SEQ ID NO: 3718778 - RNA, 19 nt, Human
uccccagccugcgccugcu

SEQ ID NO: 3718779 - RNA, 14 nt, Human
uccccagccugggc

SEQ ID NO: 3718780 - RNA, 23 nt, Human
uccccagccuuugaucagguggg

SEQ ID NO: 3718781 - RNA, 13 nt, Human
uccccagcuccca

SEQ ID NO: 3718782 - RNA, 16 nt, Human
uccccagcucccagga

SEQ ID NO: 3718783 - RNA, 13 nt, Human
uccccaggaggcc

SEQ ID NO: 3718784 - RNA, 18 nt, Human
uccccaggaggccagccu

SEQ ID NO: 3718785 - RNA, 23 nt, Human
uccccaggaggccagccuugacc

SEQ ID NO: 3718786 - RNA, 19 nt, Human
uccccaggccaggccacca

SEQ ID NO: 3718787 - RNA, 23 nt, Human
uccccaggccaggccaccaggau

SEQ ID NO: 3718788 - RNA, 11 nt, Human
uccccaggccc

SEQ ID NO: 3718789 - RNA, 23 nt, Human
uccccaggccguggcugcccaca

SEQ ID NO: 3718790 - RNA, 21 nt, Human
uccccagggaagcagcagccu

SEQ ID NO: 3718791 - RNA, 12 nt, Human
uccccagggcac

SEQ ID NO: 3718792 - RNA, 15 nt, Human
uccccagguccagcu

SEQ ID NO: 3718793 - RNA, 17 nt, Human
uccccagguccagcucu

SEQ ID NO: 3718794 - RNA, 23 nt, Human
uccccauacuccuaugaucugag

SEQ ID NO: 3718795 - RNA, 16 nt, Human
uccccauacucugucu

SEQ ID NO: 3718796 - RNA, 17 nt, Human
uccccauacucugucuc

SEQ ID NO: 3718797 - RNA, 18 nt, Human
uccccauacucugucucc

SEQ ID NO: 3718798 - RNA, 16 nt, Human
uccccaucaucccagc

SEQ ID NO: 3718799 - RNA, 19 nt, Human
uccccaucaucccagcugc

SEQ ID NO: 3718800 - RNA, 16 nt, Human
uccccauccuccagcu

SEQ ID NO: 3718801 - RNA, 19 nt, Human
uccccauccuccagcuucu

SEQ ID NO: 3718802 - RNA, 22 nt, Human
uccccaucguugcccccauuuc

SEQ ID NO: 3718803 - RNA, 13 nt, Human
uccccaucucagg

SEQ ID NO: 3718804 - RNA, 19 nt, Human
uccccaucucccugccugg

SEQ ID NO: 3718805 - RNA, 17 nt, Human
uccccaucugucggccu

SEQ ID NO: 3718806 - RNA, 16 nt, Human
uccccaugcagacaug

SEQ ID NO: 3718807 - RNA, 20 nt, Human
uccccaugccacguuccaca

SEQ ID NO: 3718808 - RNA, 20 nt, Human
uccccaugccuguggcugcg

SEQ ID NO: 3718809 - RNA, 11 nt, Human
uccccauggga

SEQ ID NO: 3718810 - RNA, 22 nt, Human
uccccaugugccugcaccagga

SEQ ID NO: 3718811 - RNA, 19 nt, Human
uccccauuagagucagccu

SEQ ID NO: 3718812 - RNA, 21 nt, Human
uccccauuagagucagccuuc

SEQ ID NO: 3718813 - RNA, 14 nt, Human
uccccauuccuacc

SEQ ID NO: 3718814 - RNA, 14 nt, Human
uccccauucuuccu

SEQ ID NO: 3718815 - RNA, 17 nt, Human
uccccauucuuccuagu

SEQ ID NO: 3718816 - RNA, 22 nt, Human
uccccauucuuccuaguuuucu

SEQ ID NO: 3718817 - RNA, 18 nt, Human
uccccauugccuccuccu

SEQ ID NO: 3718818 - RNA, 13 nt, Human
ucccccaaagugg

SEQ ID NO: 3718819 - RNA, 14 nt, Human
ucccccaaccccca

SEQ ID NO: 3718820 - RNA, 22 nt, Human
ucccccaacuucaucuggaagu

SEQ ID NO: 3718821 - RNA, 10 nt, Human
ucccccaaga

SEQ ID NO: 3718822 - RNA, 19 nt, Human
ucccccacaguuugauguc

SEQ ID NO: 3718823 - RNA, 22 nt, Human
ucccccaccagcuaaggacauu

SEQ ID NO: 3718824 - RNA, 19 nt, Human
ucccccacccccuccccag

SEQ ID NO: 3718825 - RNA, 20 nt, Human
ucccccacccccuccccagg

SEQ ID NO: 3718826 - RNA, 19 nt, Human
ucccccacccccuccccgc

SEQ ID NO: 3718827 - RNA, 19 nt, Human
ucccccaccgguccagcug

SEQ ID NO: 3718828 - RNA, 23 nt, Human
ucccccaccgguccagcuggccu

SEQ ID NO: 3718829 - RNA, 20 nt, Human
ucccccaccucggucacucc

SEQ ID NO: 3718830 - RNA, 22 nt, Human
ucccccacuccucuuauuugcu

SEQ ID NO: 3718831 - RNA, 13 nt, Human
ucccccagccacu

SEQ ID NO: 3718832 - RNA, 20 nt, Human
ucccccagccccauccucug

SEQ ID NO: 3718833 - RNA, 22 nt, Human
ucccccagccccauccucugua

SEQ ID NO: 3718834 - RNA, 13 nt, Human
ucccccagcccug

SEQ ID NO: 3718835 - RNA, 16 nt, Human
ucccccagcccugugg

SEQ ID NO: 3718836 - RNA, 16 nt, Human
ucccccaguccccuuc

SEQ ID NO: 3718837 - RNA, 17 nt, Human
ucaucccauuccaggca

SEQ ID NO: 3718838 - RNA, 15 nt, Human
ucaucccauugucuu

SEQ ID NO: 3718839 - RNA, 12 nt, Human
ucauccccaggg

SEQ ID NO: 3718840 - RNA, 20 nt, Human
ucauccccaggggucccagc

SEQ ID NO: 3718841 - RNA, 14 nt, Human
ucauccccaguccc

SEQ ID NO: 3718842 - RNA, 15 nt, Human
ucauccccaguccca

SEQ ID NO: 3718843 - RNA, 17 nt, Human
ucauccccucacuugcc

SEQ ID NO: 3718844 - RNA, 20 nt, Human
ucauccccucagaaggucug

SEQ ID NO: 3718845 - RNA, 11 nt, Human
ucauccccuua

SEQ ID NO: 3718846 - RNA, 21 nt, Human
ucaucccgagcaccuccacau

SEQ ID NO: 3718847 - RNA, 18 nt, Human
ucaucccuaaugcugcag

SEQ ID NO: 3718848 - RNA, 16 nt, Human
ucaucccuucucuucc

SEQ ID NO: 3718849 - RNA, 17 nt, Human
ucauccucaaagaaagu

SEQ ID NO: 3718850 - RNA, 18 nt, Human
ucauccucaaagaaagug

SEQ ID NO: 3718851 - RNA, 22 nt, Human
ucauccucaaagaaaguguauu

SEQ ID NO: 3718852 - RNA, 23 nt, Human
ucauccucaaagaaaguguauug

SEQ ID NO: 3718853 - RNA, 14 nt, Human
ucauccuccuggaa

SEQ ID NO: 3718854 - RNA, 22 nt, Human
ucauccuccuggaaccuugcug

SEQ ID NO: 3718855 - RNA, 22 nt, Human
ucauccucuccacagcugccuc

SEQ ID NO: 3718856 - RNA, 11 nt, Human
ucauccucugg

SEQ ID NO: 3718857 - RNA, 20 nt, Human
ucauccugacucugcccccu

SEQ ID NO: 3718858 - RNA, 12 nt, Human
ucauccugcagg

SEQ ID NO: 3718859 - RNA, 23 nt, Human
ucauccugccuucauggaacuca

SEQ ID NO: 3718860 - RNA, 15 nt, Human
ucauccugugcucgg

SEQ ID NO: 3718861 - RNA, 13 nt, Human
ucauccuucccac

SEQ ID NO: 3718862 - RNA, 14 nt, Human
ucauccuucuggaa

SEQ ID NO: 3718863 - RNA, 22 nt, Human
ucauccuucuggaauaaggaga

SEQ ID NO: 3718864 - RNA, 20 nt, Human
ucauccuuggucuuuguauc

SEQ ID NO: 3718865 - RNA, 20 nt, Human
ucauccuuucacuucuuucc

SEQ ID NO: 3718866 - RNA, 22 nt, Human
ucauccuuuucuccuaucuuca

SEQ ID NO: 3718867 - RNA, 18 nt, Human
ucaucgaaaauucauuuc

SEQ ID NO: 3718868 - RNA, 22 nt, Human
ucaucgaaaauucauuucacau

SEQ ID NO: 3718869 - RNA, 21 nt, Human
ucaucgaaucuacuaauucca

SEQ ID NO: 3718870 - RNA, 20 nt, Human
ucaucuaccuagauuuaaua

SEQ ID NO: 3718871 - RNA, 14 nt, Human
ucaucuaggauuuu

SEQ ID NO: 3718872 - RNA, 22 nt, Human
ucaucuauaguugauauguuuu

SEQ ID NO: 3718873 - RNA, 11 nt, Human
ucaucuauuuc

SEQ ID NO: 3718874 - RNA, 14 nt, Human
ucaucuauuucuga

SEQ ID NO: 3718875 - RNA, 18 nt, Human
ucaucuauuucugagaag

SEQ ID NO: 3718876 - RNA, 17 nt, Human
ucaucuauuuugaugca

SEQ ID NO: 3718877 - RNA, 18 nt, Human
ucaucuauuuugaugcag

SEQ ID NO: 3718878 - RNA, 23 nt, Human
ucaucuauuuugaugcagcauuu

SEQ ID NO: 3718879 - RNA, 19 nt, Human
ucaucucagcucacugcaa

SEQ ID NO: 3718880 - RNA, 20 nt, Human
ucaucucaggccucccucaa

SEQ ID NO: 3718881 - RNA, 16 nt, Human
ucaucucauucaaacc

SEQ ID NO: 3718882 - RNA, 16 nt, Human
ucaucuccccaucauu

SEQ ID NO: 3718883 - RNA, 22 nt, Human
ucaucuccugccuuccuccugg

SEQ ID NO: 3718884 - RNA, 21 nt, Human
ucaucucuagggaccagaacc

SEQ ID NO: 3718885 - RNA, 11 nt, Human
ucaucugagag

SEQ ID NO: 3718886 - RNA, 20 nt, Human
ucaucugcacccuucuuuuc

SEQ ID NO: 3718887 - RNA, 12 nt, Human
ucaucugcucuc

SEQ ID NO: 3718888 - RNA, 15 nt, Human
ucaucugcucuccuu

SEQ ID NO: 3718889 - RNA, 18 nt, Human
ucaucugcucuccuuccu

SEQ ID NO: 3718890 - RNA, 19 nt, Human
ucaucugcugguccguggg

SEQ ID NO: 3718891 - RNA, 14 nt, Human
ucaucuggaguucu

SEQ ID NO: 3718892 - RNA, 17 nt, Human
ucaucuggauuccagag

SEQ ID NO: 3718893 - RNA, 19 nt, Human
ucaucuggcaacaucuuua

SEQ ID NO: 3718894 - RNA, 14 nt, Human
ucaucugggaaaga

SEQ ID NO: 3718895 - RNA, 16 nt, Human
ucaucugggaaagaca

SEQ ID NO: 3718896 - RNA, 23 nt, Human
ucaucugggaacuugucacagau

SEQ ID NO: 3718897 - RNA, 19 nt, Human
ucaucugggggaguggaau

SEQ ID NO: 3718898 - RNA, 13 nt, Human
ucaucuguaacuc

SEQ ID NO: 3718899 - RNA, 17 nt, Human
ucaucuguagauacuag

SEQ ID NO: 3718900 - RNA, 15 nt, Human
ucaucugucaagugg

SEQ ID NO: 3718901 - RNA, 20 nt, Human
ucaucugucuauauuuuauu

SEQ ID NO: 3718902 - RNA, 12 nt, Human
ucaucuguguga

SEQ ID NO: 3718903 - RNA, 16 nt, Human
ucaucuuauucagcac

SEQ ID NO: 3718904 - RNA, 18 nt, Human
ucaucuucaguugucucu

SEQ ID NO: 3718905 - RNA, 14 nt, Human
ucaucuuccugugu

SEQ ID NO: 3718906 - RNA, 13 nt, Human
ucaucuucucagc

SEQ ID NO: 3718907 - RNA, 14 nt, Human
ucaucuugugaaau

SEQ ID NO: 3718908 - RNA, 22 nt, Human
ucaucuuucauuaaaggcuucu

SEQ ID NO: 3718909 - RNA, 12 nt, Human
ucaucuuucuuc

SEQ ID NO: 3718910 - RNA, 16 nt, Human
ucaucuuuuaaagaaa

SEQ ID NO: 3718911 - RNA, 16 nt, Human
ucaugaaaauccuacc

SEQ ID NO: 3718912 - RNA, 22 nt, Human
ucaugaaaauccuaccaaccuc

SEQ ID NO: 3718913 - RNA, 11 nt, Human
ucaugaaaauu

SEQ ID NO: 3718914 - RNA, 20 nt, Human
ucaugaaacuuguuucacug

SEQ ID NO: 3718915 - RNA, 22 nt, Human
ucaugaacacaucagcuagcaa

SEQ ID NO: 3718916 - RNA, 11 nt, Human
ucaugaaccuc

SEQ ID NO: 3718917 - RNA, 18 nt, Human
ucaugaacuucgcaucaa

SEQ ID NO: 3718918 - RNA, 22 nt, Human
ucaugaacuucgcaucaaaaga

SEQ ID NO: 3718919 - RNA, 12 nt, Human
ucaugaagccug

SEQ ID NO: 3718920 - RNA, 16 nt, Human
ucaugaagccugugga

SEQ ID NO: 3718921 - RNA, 21 nt, Human
ucaugaauguaaauuuguacu

SEQ ID NO: 3718922 - RNA, 15 nt, Human
ucaugaauuuuaaag

SEQ ID NO: 3718923 - RNA, 16 nt, Human
ucaugaauuuuaaagu

SEQ ID NO: 3718924 - RNA, 13 nt, Human
ucaugaauuuuac

SEQ ID NO: 3718925 - RNA, 17 nt, Human
ucaugacauguuauaua

SEQ ID NO: 3718926 - RNA, 17 nt, Human
ucaugacuuuuccaugu

SEQ ID NO: 3718927 - RNA, 13 nt, Human
ucaugagccugcu

SEQ ID NO: 3718928 - RNA, 20 nt, Human
ucaugaggaaagcaguugaa

SEQ ID NO: 3718929 - RNA, 20 nt, Human
ucaugaggagauucugccuu

SEQ ID NO: 3718930 - RNA, 23 nt, Human
ucaugaggagauucugccuuugc

SEQ ID NO: 3718931 - RNA, 19 nt, Human
ucaugaggaggguggggga

SEQ ID NO: 3718932 - RNA, 18 nt, Human
ucaugagugaauaaaugu

SEQ ID NO: 3718933 - RNA, 13 nt, Human
ucaugaucucccu

SEQ ID NO: 3718934 - RNA, 18 nt, Human
ucaugaucuugugacaua

SEQ ID NO: 3718935 - RNA, 13 nt, Human
ucaugaugcaguc

SEQ ID NO: 3718936 - RNA, 15 nt, Human
ucaugaugcagucuc

SEQ ID NO: 3718937 - RNA, 17 nt, Human
ucaugaugcagucuccu

SEQ ID NO: 3718938 - RNA, 21 nt, Human
ucaugaugcagucuccucuuu

SEQ ID NO: 3718939 - RNA, 17 nt, Human
ucaugaugcucuuuccc

SEQ ID NO: 3718940 - RNA, 16 nt, Human
ucaugauuagcaaguu

SEQ ID NO: 3718941 - RNA, 23 nt, Human
ucaugauuucauuucaacuguuu

SEQ ID NO: 3718942 - RNA, 21 nt, Human
ucaugauuuugaaaucaugaa

SEQ ID NO: 3718943 - RNA, 13 nt, Human
ucaugcaaacucu

SEQ ID NO: 3718944 - RNA, 17 nt, Human
ucaugcaaaggcuggga

SEQ ID NO: 3718945 - RNA, 21 nt, Human
ucaugcacacaauuagauuuc

SEQ ID NO: 3718946 - RNA, 17 nt, Human
ucaugcacuuaaagaag

SEQ ID NO: 3718947 - RNA, 14 nt, Human
ucaugcagccguga

SEQ ID NO: 3718948 - RNA, 18 nt, Human
ucaugccaaccccgcccu

SEQ ID NO: 3718949 - RNA, 21 nt, Human
ucaugccaagcauuuaaugua

SEQ ID NO: 3718950 - RNA, 16 nt, Human
ucaugcccacccccug

SEQ ID NO: 3718951 - RNA, 23 nt, Human
ucaugcccacccccugcccugca

SEQ ID NO: 3718952 - RNA, 13 nt, Human
ucaugccccccuc

SEQ ID NO: 3718953 - RNA, 22 nt, Human
ucaugccccccucaaaccuccu

SEQ ID NO: 3718954 - RNA, 14 nt, Human
ucaugccucugagg

SEQ ID NO: 3718955 - RNA, 21 nt, Human
ucaugccucugaggccagccu

SEQ ID NO: 3718956 - RNA, 17 nt, Human
ucaugccuggcuucgca

SEQ ID NO: 3718957 - RNA, 14 nt, Human
ucaugccuguaauc

SEQ ID NO: 3718958 - RNA, 18 nt, Human
ucaugcuacccagccauu

SEQ ID NO: 3718959 - RNA, 24 nt, Human
ucaugcuccccugugccagcccag

SEQ ID NO: 3718960 - RNA, 14 nt, Human
ucaugcugaaagcc

SEQ ID NO: 3718961 - RNA, 23 nt, Human
ucaugcugccaauauccuaauaa

SEQ ID NO: 3718962 - RNA, 17 nt, Human
ucaugcugccccugccu

SEQ ID NO: 3718963 - RNA, 18 nt, Human
ucaugcugccccugccuu

SEQ ID NO: 3718964 - RNA, 19 nt, Human
ucaugcuggaaccugcaaa

SEQ ID NO: 3718965 - RNA, 22 nt, Human
ucaugcuuuaaaguguaauaau

SEQ ID NO: 3718966 - RNA, 21 nt, Human
ucauggaaugguuauaaaagu

SEQ ID NO: 3718967 - RNA, 22 nt, Human
ucauggaaugguuauaaaagug

SEQ ID NO: 3718968 - RNA, 24 nt, Human
ucauggacuucugccagcauaaua

SEQ ID NO: 3718969 - RNA, 17 nt, Human
ucauggagaaccaccua

SEQ ID NO: 3718970 - RNA, 23 nt, Human
ucauggagugacggucccacacu

SEQ ID NO: 3718971 - RNA, 18 nt, Human
ucauggcagauguaggag

SEQ ID NO: 3718972 - RNA, 22 nt, Human
ucauggcagauguaggagggac

SEQ ID NO: 3718973 - RNA, 13 nt, Human
ucauggccccucu

SEQ ID NO: 3718974 - RNA, 19 nt, Human
ucauggcucacugcagccu

SEQ ID NO: 3718975 - RNA, 18 nt, Human
ucaugggcaccaaccugc

SEQ ID NO: 3718976 - RNA, 22 nt, Human
ucauggggggagcacccugagg

SEQ ID NO: 3718977 - RNA, 13 nt, Human
ucauggucucagu

SEQ ID NO: 3718978 - RNA, 22 nt, Human
ucauggugaggcuuaacaaugu

SEQ ID NO: 3718979 - RNA, 17 nt, Human
ucaugguguaauaagac

SEQ ID NO: 3718980 - RNA, 20 nt, Human
ucaugguguaauaagacaua

SEQ ID NO: 3718981 - RNA, 22 nt, Human
ucaugguguaauaagacauaac

SEQ ID NO: 3718982 - RNA, 14 nt, Human
ucauguaaacauac

SEQ ID NO: 3718983 - RNA, 22 nt, Human
ucauguaaacauaccaacaugu

SEQ ID NO: 3718984 - RNA, 14 nt, Human
ucauguaaacugug

SEQ ID NO: 3718985 - RNA, 13 nt, Human
ucauguaaauaau

SEQ ID NO: 3718986 - RNA, 13 nt, Human
ucauguaaauuac

SEQ ID NO: 3718987 - RNA, 18 nt, Human
ucauguaagcugaaaaua

SEQ ID NO: 3718988 - RNA, 16 nt, Human
ucauguacaagaugaa

SEQ ID NO: 3718989 - RNA, 16 nt, Human
ucauguagagaaaagc

SEQ ID NO: 3718990 - RNA, 20 nt, Human
ucauguagagaaaagcacac

SEQ ID NO: 3718991 - RNA, 19 nt, Human
ucauguagcaaucagauuu

SEQ ID NO: 3718992 - RNA, 18 nt, Human
ucauguauuugagcauau

SEQ ID NO: 3718993 - RNA, 16 nt, Human
ucaugucaggccugug

SEQ ID NO: 3718994 - RNA, 17 nt, Human
ucaugucaggccugugu

SEQ ID NO: 3718995 - RNA, 17 nt, Human
ucauguccccaaaccug

SEQ ID NO: 3718996 - RNA, 19 nt, Human
ucauguccugugucaguuu

SEQ ID NO: 3718997 - RNA, 13 nt, Human
ucaugucuauugu

SEQ ID NO: 3718998 - RNA, 19 nt, Human
ucaugugacucuuuccaac

SEQ ID NO: 3718999 - RNA, 20 nt, Human
ucaugugauccuuuuauguu

SEQ ID NO: 3719000 - RNA, 13 nt, Human
ucauguggcugga

SEQ ID NO: 3719001 - RNA, 22 nt, Human
ucaugugggccacacaagugca

SEQ ID NO: 3719002 - RNA, 19 nt, Human
ucauguguaaucaauaaac

SEQ ID NO: 3719003 - RNA, 22 nt, Human
ucauguguaaucaauaaacgau

SEQ ID NO: 3719004 - RNA, 23 nt, Human
ucauguguaaucaauaaacgauu

SEQ ID NO: 3719005 - RNA, 20 nt, Human
ucauguguacaaaaguuuca

SEQ ID NO: 3719006 - RNA, 19 nt, Human
ucauguguaugggcaaaaa

SEQ ID NO: 3719007 - RNA, 20 nt, Human
ucaugugugcaacaggguau

SEQ ID NO: 3719008 - RNA, 16 nt, Human
ucaugugugcucuucu

SEQ ID NO: 3719009 - RNA, 16 nt, Human
ucauguguguccacga

SEQ ID NO: 3719010 - RNA, 21 nt, Human
ucauguguguccacgacuguc

SEQ ID NO: 3719011 - RNA, 12 nt, Human
ucauguguguua

SEQ ID NO: 3719012 - RNA, 17 nt, Human
ucauguguucccuuugu

SEQ ID NO: 3719013 - RNA, 22 nt, Human
ucauguuaaauaggcggggcuu

SEQ ID NO: 3719014 - RNA, 18 nt, Human
ucauguuaauccuagcug

SEQ ID NO: 3719015 - RNA, 21 nt, Human
ucauguuaguaauaccucuaa

SEQ ID NO: 3719016 - RNA, 19 nt, Human
ucauguuaguuaccuuaua

SEQ ID NO: 3719017 - RNA, 22 nt, Human
ucauguuauauuuaaugcauua

SEQ ID NO: 3719018 - RNA, 19 nt, Human
ucauguucccacuucaaaa

SEQ ID NO: 3719019 - RNA, 13 nt, Human
ucauguuccucaa

SEQ ID NO: 3719020 - RNA, 19 nt, Human
ucauguugaucauguacuu

SEQ ID NO: 3719021 - RNA, 13 nt, Human
ucauguuggucaa

SEQ ID NO: 3719022 - RNA, 19 nt, Human
ucauguuguuaaaauuaug

SEQ ID NO: 3719023 - RNA, 14 nt, Human
ucauguuuaugaaa

SEQ ID NO: 3719024 - RNA, 16 nt, Human
ucauguuuaugaaaau

SEQ ID NO: 3719025 - RNA, 16 nt, Human
ucauguuucuuaaaug

SEQ ID NO: 3719026 - RNA, 15 nt, Human
ucauguuucuuugau

SEQ ID NO: 3719027 - RNA, 21 nt, Human
ucauguuucuuugaucaugaa

SEQ ID NO: 3719028 - RNA, 21 nt, Human
ucauguuugcuucauaaauga

SEQ ID NO: 3719029 - RNA, 22 nt, Human
ucauguuuuaaauguacaguuu

SEQ ID NO: 3719030 - RNA, 15 nt, Human
ucauguuuuaacaaa

SEQ ID NO: 3719031 - RNA, 22 nt, Human
ucauguuuuccauuguuugaaa

SEQ ID NO: 3719032 - RNA, 15 nt, Human
ucauuaaauggggcu

SEQ ID NO: 3719033 - RNA, 13 nt, Human
ucauuaaauuacu

SEQ ID NO: 3719034 - RNA, 19 nt, Human
ucauuaaccgaugcuuuac

SEQ ID NO: 3719035 - RNA, 23 nt, Human
ucauuaaccgaugcuuuaccaaa

SEQ ID NO: 3719036 - RNA, 22 nt, Human
ucauuaagcccucuuccaucau

SEQ ID NO: 3719037 - RNA, 14 nt, Human
ucauuaaugacacu

SEQ ID NO: 3719038 - RNA, 13 nt, Human
ucauuaauucuau

SEQ ID NO: 3719039 - RNA, 14 nt, Human
ucauuaauucuaua

SEQ ID NO: 3719040 - RNA, 13 nt, Human
ucauuaccacagg

SEQ ID NO: 3719041 - RNA, 12 nt, Human
ucauuacuauaa

SEQ ID NO: 3719042 - RNA, 13 nt, Human
ucauuacuugauu

SEQ ID NO: 3719043 - RNA, 15 nt, Human
ucauuagaaauauuu

SEQ ID NO: 3719044 - RNA, 10 nt, Human
ucauuagaac

SEQ ID NO: 3719045 - RNA, 13 nt, Human
ucauuagacuccu

SEQ ID NO: 3719046 - RNA, 18 nt, Human
ucauuagcaaaaaaaguu

SEQ ID NO: 3719047 - RNA, 20 nt, Human
ucauuagcaaaaaaaguugu

SEQ ID NO: 3719048 - RNA, 22 nt, Human
ucauuagcaaaaaaaguuguau

SEQ ID NO: 3719049 - RNA, 16 nt, Human
ucauuaggugugacug

SEQ ID NO: 3719050 - RNA, 22 nt, Human
ucauuaggugugacugaauuuc

SEQ ID NO: 3719051 - RNA, 14 nt, Human
ucauuaguuuugaa

SEQ ID NO: 3719052 - RNA, 18 nt, Human
ucauuauagaucccccag

SEQ ID NO: 3719053 - RNA, 20 nt, Human
ucauuauaucauuggaacaa

SEQ ID NO: 3719054 - RNA, 20 nt, Human
ucauuauguaaaauguuuua

SEQ ID NO: 3719055 - RNA, 17 nt, Human
ucauuauguuaauauuu

SEQ ID NO: 3719056 - RNA, 19 nt, Human
ucauuauuacuuuugcugu

SEQ ID NO: 3719057 - RNA, 23 nt, Human
ucauuauucguagauauuggaca

SEQ ID NO: 3719058 - RNA, 17 nt, Human
ucauuauuuauguauug

SEQ ID NO: 3719059 - RNA, 14 nt, Human
ucauuauuuauuaa

SEQ ID NO: 3719060 - RNA, 14 nt, Human
ucauuauuugucaa

SEQ ID NO: 3719061 - RNA, 19 nt, Human
ucauuauuugucaaauugu

SEQ ID NO: 3719062 - RNA, 22 nt, Human
ucauucaaguguaaaauauuuu

SEQ ID NO: 3719063 - RNA, 22 nt, Human
ucauucaccaguacauucucag

SEQ ID NO: 3719064 - RNA, 20 nt, Human
ucauucacuucacugugcug

SEQ ID NO: 3719065 - RNA, 13 nt, Human
ucauucagaaaug

SEQ ID NO: 3719066 - RNA, 10 nt, Human
ucauucagca

SEQ ID NO: 3719067 - RNA, 13 nt, Human
ucauucaggaaaa

SEQ ID NO: 3719068 - RNA, 17 nt, Human
ucauucaguauuaaagg

SEQ ID NO: 3719069 - RNA, 19 nt, Human
ucauucauauuacaauauu

SEQ ID NO: 3719070 - RNA, 15 nt, Human
ucauucaugcuacug

SEQ ID NO: 3719071 - RNA, 20 nt, Human
ucauucauggaccacuguuu

SEQ ID NO: 3719072 - RNA, 22 nt, Human
ucauucauuuuauauugaaaaa

SEQ ID NO: 3719073 - RNA, 14 nt, Human
ucauucauuuuugu

SEQ ID NO: 3719074 - RNA, 23 nt, Human
ucauuccaccuucccaugcccug

SEQ ID NO: 3719075 - RNA, 18 nt, Human
ucauuccagaucccaggc

SEQ ID NO: 3719076 - RNA, 15 nt, Human
ucauuccauucugga

SEQ ID NO: 3719077 - RNA, 19 nt, Human
ucauuccauucuggaagug

SEQ ID NO: 3719078 - RNA, 12 nt, Human
ucauuccccagg

SEQ ID NO: 3719079 - RNA, 18 nt, Human
ucauuccuaacacagcau

SEQ ID NO: 3719080 - RNA, 16 nt, Human
ucauuccugaaagaaa

SEQ ID NO: 3719081 - RNA, 22 nt, Human
ucauuccugaaagaaacaguua

SEQ ID NO: 3719082 - RNA, 19 nt, Human
ucauuccugccugucuccu

SEQ ID NO: 3719083 - RNA, 15 nt, Human
ucauuccuuccacua

SEQ ID NO: 3719084 - RNA, 15 nt, Human
ucauucgggaugauu

SEQ ID NO: 3719085 - RNA, 21 nt, Human
ucauucgggccccaccugcag

SEQ ID NO: 3719086 - RNA, 15 nt, Human
ucauucguucugugg

SEQ ID NO: 3719087 - RNA, 12 nt, Human
ucauucuaaaga

SEQ ID NO: 3719088 - RNA, 22 nt, Human
ucauucuaaagauagaguaaaa

SEQ ID NO: 3719089 - RNA, 18 nt, Human
ucauucuaaugauggccc

SEQ ID NO: 3719090 - RNA, 16 nt, Human
ucauucucgugaguca

SEQ ID NO: 3719091 - RNA, 14 nt, Human
ucauucucugucuc

SEQ ID NO: 3719092 - RNA, 15 nt, Human
ucauucucugucuca

SEQ ID NO: 3719093 - RNA, 19 nt, Human
ucauucucugucucaucca

SEQ ID NO: 3719094 - RNA, 18 nt, Human
ucauucugaaggagcccc

SEQ ID NO: 3719095 - RNA, 14 nt, Human
ucauucuuauuuca

SEQ ID NO: 3719096 - RNA, 18 nt, Human
ucauucuugaaagcugug

SEQ ID NO: 3719097 - RNA, 14 nt, Human
ucauucuuugcagg

SEQ ID NO: 3719098 - RNA, 17 nt, Human
ucauugaaaugucacgu

SEQ ID NO: 3719099 - RNA, 15 nt, Human
ucauugaccugaggc

SEQ ID NO: 3719100 - RNA, 19 nt, Human
ucauugaccugaggcccuu

SEQ ID NO: 3719101 - RNA, 12 nt, Human
ucauugacuuuu

SEQ ID NO: 3719102 - RNA, 14 nt, Human
ucauugcaucauuu

SEQ ID NO: 3719103 - RNA, 19 nt, Human
ucauugccaagggcccaaa

SEQ ID NO: 3719104 - RNA, 15 nt, Human
ucauugccagugucu

SEQ ID NO: 3719105 - RNA, 18 nt, Human
ucauugccagugucuuuc

SEQ ID NO: 3719106 - RNA, 20 nt, Human
ucauugccagugucuuucuu

SEQ ID NO: 3719107 - RNA, 18 nt, Human
ucauugcccccagggcac

SEQ ID NO: 3719108 - RNA, 16 nt, Human
ucauugccuguguaug

SEQ ID NO: 3719109 - RNA, 22 nt, Human
ucauugccuguguauggaaaaa

SEQ ID NO: 3719110 - RNA, 16 nt, Human
ucauugcgaaucuuuu

SEQ ID NO: 3719111 - RNA, 14 nt, Human
ucauugcugaaaau

SEQ ID NO: 3719112 - RNA, 14 nt, Human
ucauugcuguagga

SEQ ID NO: 3719113 - RNA, 14 nt, Human
ucauugcuucuucu

SEQ ID NO: 3719114 - RNA, 16 nt, Human
ucauugcuucuucuga

SEQ ID NO: 3719115 - RNA, 21 nt, Human
ucauugcuuugaagcaguugu

SEQ ID NO: 3719116 - RNA, 11 nt, Human
ucauuggcuuu

SEQ ID NO: 3719117 - RNA, 16 nt, Human
ucauuggcuuuauccu

SEQ ID NO: 3719118 - RNA, 22 nt, Human
ucauugggccauguuuaagugu

SEQ ID NO: 3719119 - RNA, 23 nt, Human
ucauugggcuguuuucucaacaa

SEQ ID NO: 3719120 - RNA, 14 nt, Human
ucauuguaaacaaa

SEQ ID NO: 3719121 - RNA, 16 nt, Human
ucauuguaaacaaacu

SEQ ID NO: 3719122 - RNA, 24 nt, Human
ucauuguaacacuguuuauugaaa

SEQ ID NO: 3719123 - RNA, 16 nt, Human
ucauuguaauguuacu

SEQ ID NO: 3719124 - RNA, 20 nt, Human
ucauuguaauguuacugauc

SEQ ID NO: 3719125 - RNA, 15 nt, Human
ucauuguauaaaaau

SEQ ID NO: 3719126 - RNA, 16 nt, Human
ucauuguauauaugug

SEQ ID NO: 3719127 - RNA, 17 nt, Human
ucauuguauauaugugu

SEQ ID NO: 3719128 - RNA, 21 nt, Human
ucauuguauauauguguguuu

SEQ ID NO: 3719129 - RNA, 14 nt, Human
ucauuguaugaugu

SEQ ID NO: 3719130 - RNA, 17 nt, Human
ucauuguaugauguguu

SEQ ID NO: 3719131 - RNA, 22 nt, Human
ucauuguccagagcugcuuccc

SEQ ID NO: 3719132 - RNA, 13 nt, Human
ucauugucccucu

SEQ ID NO: 3719133 - RNA, 21 nt, Human
ucauugucccucuucacuccc

SEQ ID NO: 3719134 - RNA, 13 nt, Human
ucauugugguuau

SEQ ID NO: 3719135 - RNA, 15 nt, Human
ucauuguuauuuaua

SEQ ID NO: 3719136 - RNA, 22 nt, Human
gcuggcccgugacagacuccug

SEQ ID NO: 3719137 - RNA, 14 nt, Human
gcuggcccugcccu

SEQ ID NO: 3719138 - RNA, 19 nt, Human
gcuggcccuggcucccaca

SEQ ID NO: 3719139 - RNA, 20 nt, Human
gcuggccgaggguccuggcu

SEQ ID NO: 3719140 - RNA, 14 nt, Human
gcuggccggacacc

SEQ ID NO: 3719141 - RNA, 13 nt, Human
gcuggccgggacc

SEQ ID NO: 3719142 - RNA, 21 nt, Human
gcuggccgggcacagcugugg

SEQ ID NO: 3719143 - RNA, 22 nt, Human
gcuggccucccaaaugagccau

SEQ ID NO: 3719144 - RNA, 14 nt, Human
gcuggccucuacca

SEQ ID NO: 3719145 - RNA, 14 nt, Human
gcuggccucugcga

SEQ ID NO: 3719146 - RNA, 18 nt, Human
gcuggccucuggcucuca

SEQ ID NO: 3719147 - RNA, 19 nt, Human
gcuggccuggccccucagg

SEQ ID NO: 3719148 - RNA, 18 nt, Human
gcuggccuugugguccaa

SEQ ID NO: 3719149 - RNA, 17 nt, Human
gcuggcgcagccaaggc

SEQ ID NO: 3719150 - RNA, 16 nt, Human
gcuggcggccugcagc

SEQ ID NO: 3719151 - RNA, 20 nt, Human
gcuggcggcuacucagcagc

SEQ ID NO: 3719152 - RNA, 15 nt, Human
gcuggcuacgccucu

SEQ ID NO: 3719153 - RNA, 14 nt, Human
gcuggcuccagaug

SEQ ID NO: 3719154 - RNA, 14 nt, Human
gcuggcuccagccu

SEQ ID NO: 3719155 - RNA, 17 nt, Human
gcuggcuccccugcagc

SEQ ID NO: 3719156 - RNA, 21 nt, Human
gcuggcuccugauccacuuug

SEQ ID NO: 3719157 - RNA, 13 nt, Human
gcuggcucugagc

SEQ ID NO: 3719158 - RNA, 19 nt, Human
gcuggcucugugagggugc

SEQ ID NO: 3719159 - RNA, 18 nt, Human
gcuggcucuucugcccaa

SEQ ID NO: 3719160 - RNA, 13 nt, Human
gcuggcugcagug

SEQ ID NO: 3719161 - RNA, 22 nt, Human
gcuggcuggccuugugguccaa

SEQ ID NO: 3719162 - RNA, 15 nt, Human
gcuggcugggcaugg

SEQ ID NO: 3719163 - RNA, 17 nt, Human
gcuggcugggcauggac

SEQ ID NO: 3719164 - RNA, 20 nt, Human
gcuggcuguuggcugggggc

SEQ ID NO: 3719165 - RNA, 11 nt, Human
gcugggaaaca

SEQ ID NO: 3719166 - RNA, 21 nt, Human
gcugggaacucaccuggggcu

SEQ ID NO: 3719167 - RNA, 20 nt, Human
gcugggaauaagugccagga

SEQ ID NO: 3719168 - RNA, 21 nt, Human
gcugggaauggaggggcagag

SEQ ID NO: 3719169 - RNA, 20 nt, Human
gcugggacguggcucagcca

SEQ ID NO: 3719170 - RNA, 18 nt, Human
gcugggacuacaggcacc

SEQ ID NO: 3719171 - RNA, 16 nt, Human
gcugggacucagccuu

SEQ ID NO: 3719172 - RNA, 14 nt, Human
gcugggacugagcc

SEQ ID NO: 3719173 - RNA, 15 nt, Human
gcugggacugagcca

SEQ ID NO: 3719174 - RNA, 14 nt, Human
gcugggacuggcca

SEQ ID NO: 3719175 - RNA, 17 nt, Human
gcugggagagccuucca

SEQ ID NO: 3719176 - RNA, 22 nt, Human
gcugggagagccuuccaggggu

SEQ ID NO: 3719177 - RNA, 23 nt, Human
gcugggagaggcagcccaggaag

SEQ ID NO: 3719178 - RNA, 18 nt, Human
gcugggagcuccacucug

SEQ ID NO: 3719179 - RNA, 20 nt, Human
gcugggagcuccacucugcu

SEQ ID NO: 3719180 - RNA, 14 nt, Human
gcugggagcucugc

SEQ ID NO: 3719181 - RNA, 16 nt, Human
gcugggagcucugcag

SEQ ID NO: 3719182 - RNA, 14 nt, Human
gcugggaggcaugg

SEQ ID NO: 3719183 - RNA, 19 nt, Human
gcugggagggauagagggg

SEQ ID NO: 3719184 - RNA, 18 nt, Human
gcugggauagagggguca

SEQ ID NO: 3719185 - RNA, 22 nt, Human
gcugggaucugacugcacgugg

SEQ ID NO: 3719186 - RNA, 18 nt, Human
gcugggauggugggcuuc

SEQ ID NO: 3719187 - RNA, 20 nt, Human
gcugggauggugggcuucag

SEQ ID NO: 3719188 - RNA, 19 nt, Human
gcugggauuacaggcuccu

SEQ ID NO: 3719189 - RNA, 20 nt, Human
gcugggauuacaggcuccug

SEQ ID NO: 3719190 - RNA, 18 nt, Human
gcugggauuacaggugug

SEQ ID NO: 3719191 - RNA, 19 nt, Human
gcugggauuacagguguga

SEQ ID NO: 3719192 - RNA, 19 nt, Human
gcugggcacugcucucacc

SEQ ID NO: 3719193 - RNA, 19 nt, Human
gcugggcacuucccugcug

SEQ ID NO: 3719194 - RNA, 15 nt, Human
gcugggcagaggaaa

SEQ ID NO: 3719195 - RNA, 14 nt, Human
gcugggcagguugg

SEQ ID NO: 3719196 - RNA, 19 nt, Human
gcugggcaguuuuucugua

SEQ ID NO: 3719197 - RNA, 15 nt, Human
gcugggcccagaggc

SEQ ID NO: 3719198 - RNA, 17 nt, Human
gcugggccccagcccac

SEQ ID NO: 3719199 - RNA, 19 nt, Human
gcugggccccagcccaccc

SEQ ID NO: 3719200 - RNA, 21 nt, Human
gcugggccccagcccacccuc

SEQ ID NO: 3719201 - RNA, 17 nt, Human
gcugggccccccagcuc

SEQ ID NO: 3719202 - RNA, 12 nt, Human
gcugggccccug

SEQ ID NO: 3719203 - RNA, 20 nt, Human
gcugggccccugccucucug

SEQ ID NO: 3719204 - RNA, 13 nt, Human
gcugggccugguc

SEQ ID NO: 3719205 - RNA, 17 nt, Human
gcugggcggcugugcuu

SEQ ID NO: 3719206 - RNA, 12 nt, Human
gcugggcucccu

SEQ ID NO: 3719207 - RNA, 22 nt, Human
gcugggcucuccaccucagccu

SEQ ID NO: 3719208 - RNA, 13 nt, Human
gcugggcucugca

SEQ ID NO: 3719209 - RNA, 14 nt, Human
gcugggcucugcca

SEQ ID NO: 3719210 - RNA, 12 nt, Human
gcugggcugagc

SEQ ID NO: 3719211 - RNA, 13 nt, Human
gcugggcugagcc

SEQ ID NO: 3719212 - RNA, 20 nt, Human
gcugggcugagccccuaccc

SEQ ID NO: 3719213 - RNA, 13 nt, Human
gcugggcugggca

SEQ ID NO: 3719214 - RNA, 14 nt, Human
gcugggcugggcac

SEQ ID NO: 3719215 - RNA, 14 nt, Human
gcugggcugggcgc

SEQ ID NO: 3719216 - RNA, 12 nt, Human
gcugggcugggu

SEQ ID NO: 3719217 - RNA, 22 nt, Human
gcugggcuuggcagcccggguc

SEQ ID NO: 3719218 - RNA, 23 nt, Human
gcuggggaaaucaaaagggccaa

SEQ ID NO: 3719219 - RNA, 23 nt, Human
gcuggggaagaauuuacuuugga

SEQ ID NO: 3719220 - RNA, 15 nt, Human
gcuggggaaggaagc

SEQ ID NO: 3719221 - RNA, 15 nt, Human
gcuggggcagccucu

SEQ ID NO: 3719222 - RNA, 21 nt, Human
gcuggggcauggaaggcaaga

SEQ ID NO: 3719223 - RNA, 12 nt, Human
gcuggggccagu

SEQ ID NO: 3719224 - RNA, 12 nt, Human
gcuggggccuga

SEQ ID NO: 3719225 - RNA, 17 nt, Human
gcuggggcguggggagg

SEQ ID NO: 3719226 - RNA, 18 nt, Human
gcuggggcguggggaggg

SEQ ID NO: 3719227 - RNA, 19 nt, Human
gcuggggcguggggagggc

SEQ ID NO: 3719228 - RNA, 20 nt, Human
gcugggggaaugagcccaga

SEQ ID NO: 3719229 - RNA, 13 nt, Human
gcugggggcagga

SEQ ID NO: 3719230 - RNA, 20 nt, Human
gcugggggccucacuccagg

SEQ ID NO: 3719231 - RNA, 14 nt, Human
gcugggggccucag

SEQ ID NO: 3719232 - RNA, 19 nt, Human
gcugggggccucagugcca

SEQ ID NO: 3719233 - RNA, 19 nt, Human
gcuggggucccagcagcug

SEQ ID NO: 3719234 - RNA, 19 nt, Human
gcugggguggccugugugg

SEQ ID NO: 3719235 - RNA, 23 nt, Human
gcugggguggggaccucaggccu

SEQ ID NO: 3719236 - RNA, 16 nt, Human
gcugggucaggcaggg

SEQ ID NO: 3719237 - RNA, 12 nt, Human
gcugggucgccc

SEQ ID NO: 3719238 - RNA, 16 nt, Human
gcugggucgcccugga

SEQ ID NO: 3719239 - RNA, 17 nt, Human
gcugggucgcccuggac

SEQ ID NO: 3719240 - RNA, 19 nt, Human
gcugggugacagagcgaga

SEQ ID NO: 3719241 - RNA, 13 nt, Human
gcugggugcccac

SEQ ID NO: 3719242 - RNA, 16 nt, Human
gcugggugcccacagc

SEQ ID NO: 3719243 - RNA, 18 nt, Human
gcugggugcgaccccauc

SEQ ID NO: 3719244 - RNA, 14 nt, Human
gcuggguggcacug

SEQ ID NO: 3719245 - RNA, 16 nt, Human
gcuggguggcccaucc

SEQ ID NO: 3719246 - RNA, 20 nt, Human
gcuggguggcccaucccccc

SEQ ID NO: 3719247 - RNA, 22 nt, Human
gcuggguguauuaggacuggcu

SEQ ID NO: 3719248 - RNA, 21 nt, Human
gcuggguucuacccaggugcu

SEQ ID NO: 3719249 - RNA, 22 nt, Human
gcuggguuggcgcacccucccc

SEQ ID NO: 3719250 - RNA, 14 nt, Human
gcugguaaaaugaa

SEQ ID NO: 3719251 - RNA, 16 nt, Human
gcugguaaaaugaaga

SEQ ID NO: 3719252 - RNA, 14 nt, Human
gcugguaaacuauu

SEQ ID NO: 3719253 - RNA, 13 nt, Human
gcugguaacaguu

SEQ ID NO: 3719254 - RNA, 18 nt, Human
gcugguaagggccaaguc

SEQ ID NO: 3719255 - RNA, 14 nt, Human
gcugguagagaugg

SEQ ID NO: 3719256 - RNA, 15 nt, Human
gcugguagagaugga

SEQ ID NO: 3719257 - RNA, 15 nt, Human
gcugguagcucaggu

SEQ ID NO: 3719258 - RNA, 16 nt, Human
gcugguagcucaggug

SEQ ID NO: 3719259 - RNA, 19 nt, Human
gcugguagcucaggugggc

SEQ ID NO: 3719260 - RNA, 24 nt, Human
gcugguaucucagaaagugccuga

SEQ ID NO: 3719261 - RNA, 20 nt, Human
gcuggucacagccuccucug

SEQ ID NO: 3719262 - RNA, 22 nt, Human
gcuggucacagccuccucuguc

SEQ ID NO: 3719263 - RNA, 15 nt, Human
gcuggucacugccau

SEQ ID NO: 3719264 - RNA, 20 nt, Human
gcuggucacuucuucugucc

SEQ ID NO: 3719265 - RNA, 14 nt, Human
gcugguccagggcu

SEQ ID NO: 3719266 - RNA, 19 nt, Human
gcuggucccacucagucca

SEQ ID NO: 3719267 - RNA, 16 nt, Human
gcugguccgugggacg

SEQ ID NO: 3719268 - RNA, 20 nt, Human
gcuggucucaaacuccugac

SEQ ID NO: 3719269 - RNA, 20 nt, Human
gcuggugagugaugcggcag

SEQ ID NO: 3719270 - RNA, 21 nt, Human
gcuggugauggagguuucaua

SEQ ID NO: 3719271 - RNA, 20 nt, Human
gcuggugcacagccacuccc

SEQ ID NO: 3719272 - RNA, 14 nt, Human
gcuggugccagccu

SEQ ID NO: 3719273 - RNA, 23 nt, Human
gcuggugccagccuuccucugca

SEQ ID NO: 3719274 - RNA, 14 nt, Human
gcuggugcccggag

SEQ ID NO: 3719275 - RNA, 15 nt, Human
gcuggugcggcuggc

SEQ ID NO: 3719276 - RNA, 15 nt, Human
gcuggugcuguggcc

SEQ ID NO: 3719277 - RNA, 14 nt, Human
gcugguggcccagg

SEQ ID NO: 3719278 - RNA, 13 nt, Human
gcuggugggcacc

SEQ ID NO: 3719279 - RNA, 13 nt, Human
gcuggugguuuca

SEQ ID NO: 3719280 - RNA, 19 nt, Human
gcugguguagcuacagaga

SEQ ID NO: 3719281 - RNA, 14 nt, Human
gcuggugucaccug

SEQ ID NO: 3719282 - RNA, 21 nt, Human
gcugguguuaacagaagggag

SEQ ID NO: 3719283 - RNA, 14 nt, Human
gcugguuagaaaug

SEQ ID NO: 3719284 - RNA, 21 nt, Human
gcugguuagagguucccuuug

SEQ ID NO: 3719285 - RNA, 15 nt, Human
gcugguucaggguug

SEQ ID NO: 3719286 - RNA, 12 nt, Human
ucccccauagcc

SEQ ID NO: 3719287 - RNA, 19 nt, Human
ucccccauccuccccuucc

SEQ ID NO: 3719288 - RNA, 15 nt, Human
ucccccaucucccac

SEQ ID NO: 3719289 - RNA, 17 nt, Human
ucccccaucucccaccc

SEQ ID NO: 3719290 - RNA, 17 nt, Human
ucccccauuuuucccag

SEQ ID NO: 3719291 - RNA, 12 nt, Human
uccccccacucu

SEQ ID NO: 3719292 - RNA, 21 nt, Human
uccccccacucuccccacacu

SEQ ID NO: 3719293 - RNA, 12 nt, Human
uccccccaucuu

SEQ ID NO: 3719294 - RNA, 17 nt, Human
ucccccccaugcacugu

SEQ ID NO: 3719295 - RNA, 18 nt, Human
ucccccccaugcacugug

SEQ ID NO: 3719296 - RNA, 16 nt, Human
uccccccccuguauag

SEQ ID NO: 3719297 - RNA, 14 nt, Human
uccccccucaccag

SEQ ID NO: 3719298 - RNA, 21 nt, Human
ucccccgcaaugugcccccag

SEQ ID NO: 3719299 - RNA, 15 nt, Human
ucccccuauccuugg

SEQ ID NO: 3719300 - RNA, 16 nt, Human
ucccccucagcaagcc

SEQ ID NO: 3719301 - RNA, 19 nt, Human
ucccccucccagggccagg

SEQ ID NO: 3719302 - RNA, 21 nt, Human
ucccccucccccagccacucc

SEQ ID NO: 3719303 - RNA, 11 nt, Human
ucccccuccuu

SEQ ID NO: 3719304 - RNA, 18 nt, Human
ucccccuccuucccagcu

SEQ ID NO: 3719305 - RNA, 13 nt, Human
ucccccucuggcu

SEQ ID NO: 3719306 - RNA, 12 nt, Human
ucccccugcagc

SEQ ID NO: 3719307 - RNA, 16 nt, Human
ucccccugccagugcc

SEQ ID NO: 3719308 - RNA, 17 nt, Human
ucccccugccagugccu

SEQ ID NO: 3719309 - RNA, 20 nt, Human
ucccccugcccucguggcca

SEQ ID NO: 3719310 - RNA, 17 nt, Human
ucccccugcuuccaccu

SEQ ID NO: 3719311 - RNA, 17 nt, Human
ucccccuggcacugguu

SEQ ID NO: 3719312 - RNA, 12 nt, Human
ucccccugggcu

SEQ ID NO: 3719313 - RNA, 20 nt, Human
ucccccugggcucugcccca

SEQ ID NO: 3719314 - RNA, 16 nt, Human
ucccccugguugggug

SEQ ID NO: 3719315 - RNA, 16 nt, Human
ucccccuguccccuca

SEQ ID NO: 3719316 - RNA, 14 nt, Human
ucccccuucacaaa

SEQ ID NO: 3719317 - RNA, 20 nt, Human
ucccccuuccaaauaauaaa

SEQ ID NO: 3719318 - RNA, 12 nt, Human
ucccccuucucc

SEQ ID NO: 3719319 - RNA, 13 nt, Human
ucccccuucuccc

SEQ ID NO: 3719320 - RNA, 17 nt, Human
ucccccuugccacccca

SEQ ID NO: 3719321 - RNA, 23 nt, Human
ucccccuugccaccccacccucc

SEQ ID NO: 3719322 - RNA, 14 nt, Human
ucccccuuuuuugu

SEQ ID NO: 3719323 - RNA, 18 nt, Human
uccccgacgcccacccaa

SEQ ID NO: 3719324 - RNA, 18 nt, Human
uccccgaguuuccccaga

SEQ ID NO: 3719325 - RNA, 21 nt, Human
uccccgcaccccccaagcugu

SEQ ID NO: 3719326 - RNA, 19 nt, Human
uccccgcagugugcacuaa

SEQ ID NO: 3719327 - RNA, 20 nt, Human
uccccgcagugugcacuaag

SEQ ID NO: 3719328 - RNA, 16 nt, Human
uccccgcauuccaggc

SEQ ID NO: 3719329 - RNA, 13 nt, Human
uccccgccuggcc

SEQ ID NO: 3719330 - RNA, 18 nt, Human
uccccgccuggccaggag

SEQ ID NO: 3719331 - RNA, 13 nt, Human
uccccgccuguuc

SEQ ID NO: 3719332 - RNA, 15 nt, Human
uccccgcugcugugc

SEQ ID NO: 3719333 - RNA, 16 nt, Human
uccccgcuggcugggg

SEQ ID NO: 3719334 - RNA, 15 nt, Human
uccccggagggcugc

SEQ ID NO: 3719335 - RNA, 20 nt, Human
uccccggcacccucuggccg

SEQ ID NO: 3719336 - RNA, 22 nt, Human
uccccggcaugagacucagugc

SEQ ID NO: 3719337 - RNA, 17 nt, Human
uccccggcccuaccagc

SEQ ID NO: 3719338 - RNA, 16 nt, Human
uccccgggcaucuuug

SEQ ID NO: 3719339 - RNA, 13 nt, Human
uccccggggccca

SEQ ID NO: 3719340 - RNA, 17 nt, Human
uccccggggcccagggg

SEQ ID NO: 3719341 - RNA, 22 nt, Human
uccccggucccuugagaccuca

SEQ ID NO: 3719342 - RNA, 20 nt, Human
uccccgugccccgccucccc

SEQ ID NO: 3719343 - RNA, 13 nt, Human
uccccguggucuc

SEQ ID NO: 3719344 - RNA, 17 nt, Human
uccccguuccugacauc

SEQ ID NO: 3719345 - RNA, 20 nt, Human
uccccguuccugacaucaca

SEQ ID NO: 3719346 - RNA, 22 nt, Human
uccccuaaagccucaaaacaaa

SEQ ID NO: 3719347 - RNA, 16 nt, Human
uccccuaaucuuuucu

SEQ ID NO: 3719348 - RNA, 17 nt, Human
uccccuaccacugucuu

SEQ ID NO: 3719349 - RNA, 23 nt, Human
uccccuacccccuccucucugcc

SEQ ID NO: 3719350 - RNA, 15 nt, Human
uccccuacggaccag

SEQ ID NO: 3719351 - RNA, 16 nt, Human
uccccuacggaccagg

SEQ ID NO: 3719352 - RNA, 17 nt, Human
uccccuaguaagugccu

SEQ ID NO: 3719353 - RNA, 15 nt, Human
uccccuauccaccca

SEQ ID NO: 3719354 - RNA, 14 nt, Human
uccccucaaagucu

SEQ ID NO: 3719355 - RNA, 21 nt, Human
uccccucaaagucugcaacuu

SEQ ID NO: 3719356 - RNA, 16 nt, Human
uccccucacagccucu

SEQ ID NO: 3719357 - RNA, 12 nt, Human
uccccucacugg

SEQ ID NO: 3719358 - RNA, 18 nt, Human
uccccucagaaggucugu

SEQ ID NO: 3719359 - RNA, 21 nt, Human
uccccucagccacacccaggc

SEQ ID NO: 3719360 - RNA, 14 nt, Human
uccccucagcucca

SEQ ID NO: 3719361 - RNA, 15 nt, Human
uccccucagcuccag

SEQ ID NO: 3719362 - RNA, 19 nt, Human
uccccuccaaaaugugccu

SEQ ID NO: 3719363 - RNA, 12 nt, Human
uccccuccacug

SEQ ID NO: 3719364 - RNA, 14 nt, Human
uccccucccaggga

SEQ ID NO: 3719365 - RNA, 17 nt, Human
uccccucccagggagca

SEQ ID NO: 3719366 - RNA, 11 nt, Human
uccccucccau

SEQ ID NO: 3719367 - RNA, 14 nt, Human
uccccucccaucug

SEQ ID NO: 3719368 - RNA, 11 nt, Human
uccccuccccc

SEQ ID NO: 3719369 - RNA, 21 nt, Human
uccccucccccaccccugcug

SEQ ID NO: 3719370 - RNA, 16 nt, Human
uccccuccccugcugc

SEQ ID NO: 3719371 - RNA, 16 nt, Human
uccccucccuccucug

SEQ ID NO: 3719372 - RNA, 15 nt, Human
uccccucccuggcuc

SEQ ID NO: 3719373 - RNA, 21 nt, Human
uccccucccuggcucccauga

SEQ ID NO: 3719374 - RNA, 14 nt, Human
uccccucccugggu

SEQ ID NO: 3719375 - RNA, 14 nt, Human
uccccucccuguca

SEQ ID NO: 3719376 - RNA, 16 nt, Human
uccccuccggacuggu

SEQ ID NO: 3719377 - RNA, 21 nt, Human
uccccuccggacuggugcccu

SEQ ID NO: 3719378 - RNA, 13 nt, Human
uccccuccuaccc

SEQ ID NO: 3719379 - RNA, 14 nt, Human
uccccuccucacuc

SEQ ID NO: 3719380 - RNA, 12 nt, Human
uccccuccucca

SEQ ID NO: 3719381 - RNA, 14 nt, Human
uccccuccucuccc

SEQ ID NO: 3719382 - RNA, 15 nt, Human
uccccuccuucccaa

SEQ ID NO: 3719383 - RNA, 14 nt, Human
uccccuccuucucc

SEQ ID NO: 3719384 - RNA, 18 nt, Human
uccccuccuugccuccug

SEQ ID NO: 3719385 - RNA, 12 nt, Human
uccccuccuugg

SEQ ID NO: 3719386 - RNA, 17 nt, Human
uccccucggagaagagc

SEQ ID NO: 3719387 - RNA, 14 nt, Human
uccccucucugcac

SEQ ID NO: 3719388 - RNA, 13 nt, Human
uccccucugcugg

SEQ ID NO: 3719389 - RNA, 15 nt, Human
uccccucugcuggcc

SEQ ID NO: 3719390 - RNA, 15 nt, Human
uccccucuuccucuu

SEQ ID NO: 3719391 - RNA, 19 nt, Human
uccccucuugucuccccug

SEQ ID NO: 3719392 - RNA, 23 nt, Human
uccccucuuuuguuaaauaauau

SEQ ID NO: 3719393 - RNA, 15 nt, Human
uccccugacagggcc

SEQ ID NO: 3719394 - RNA, 21 nt, Human
uccccugauuacaccagccuc

SEQ ID NO: 3719395 - RNA, 17 nt, Human
uccccugcacuguaaaa

SEQ ID NO: 3719396 - RNA, 18 nt, Human
uccccugcacuguaaaau

SEQ ID NO: 3719397 - RNA, 13 nt, Human
uccccugcagccc

SEQ ID NO: 3719398 - RNA, 19 nt, Human
uccccugccaccaggccac

SEQ ID NO: 3719399 - RNA, 20 nt, Human
uccccugccagggcagggcc

SEQ ID NO: 3719400 - RNA, 22 nt, Human
uccccugccccuuuacggacac

SEQ ID NO: 3719401 - RNA, 23 nt, Human
uccccugcccugcugccgccucc

SEQ ID NO: 3719402 - RNA, 24 nt, Human
uccccugcccugguccagggaagc

SEQ ID NO: 3719403 - RNA, 12 nt, Human
uccccugccucc

SEQ ID NO: 3719404 - RNA, 17 nt, Human
uccccugccuccauccu

SEQ ID NO: 3719405 - RNA, 13 nt, Human
uccccugcuccug

SEQ ID NO: 3719406 - RNA, 17 nt, Human
uccccugcugcaggggc

SEQ ID NO: 3719407 - RNA, 15 nt, Human
uccccugcugggugu

SEQ ID NO: 3719408 - RNA, 21 nt, Human
uccccugcuggguguggcgca

SEQ ID NO: 3719409 - RNA, 11 nt, Human
uccccugcuuc

SEQ ID NO: 3719410 - RNA, 14 nt, Human
uccccugcuucaga

SEQ ID NO: 3719411 - RNA, 21 nt, Human
uccccuggaagcagugcccag

SEQ ID NO: 3719412 - RNA, 15 nt, Human
uccccugggcccuga

SEQ ID NO: 3719413 - RNA, 19 nt, Human
uccccuggggacagcaagg

SEQ ID NO: 3719414 - RNA, 18 nt, Human
uccccuggggugcaggcg

SEQ ID NO: 3719415 - RNA, 20 nt, Human
uccccuggggugcaggcgcc

SEQ ID NO: 3719416 - RNA, 19 nt, Human
uccccuguagagugggagc

SEQ ID NO: 3719417 - RNA, 15 nt, Human
uccccuguucacucu

SEQ ID NO: 3719418 - RNA, 13 nt, Human
uccccuguuucaa

SEQ ID NO: 3719419 - RNA, 18 nt, Human
uccccuuacccuuagaau

SEQ ID NO: 3719420 - RNA, 17 nt, Human
uccccuuauccucccug

SEQ ID NO: 3719421 - RNA, 18 nt, Human
uccccuuccccuuccuuc

SEQ ID NO: 3719422 - RNA, 13 nt, Human
uccccuucccugc

SEQ ID NO: 3719423 - RNA, 16 nt, Human
uccccuuccucacugc

SEQ ID NO: 3719424 - RNA, 18 nt, Human
uccccuuccucuugucug

SEQ ID NO: 3719425 - RNA, 13 nt, Human
uccccuucucuca

SEQ ID NO: 3719426 - RNA, 15 nt, Human
uccccuucucucauc

SEQ ID NO: 3719427 - RNA, 18 nt, Human
uccccuucucucaucucu

SEQ ID NO: 3719428 - RNA, 16 nt, Human
uccccuugagcugaga

SEQ ID NO: 3719429 - RNA, 19 nt, Human
uccccuugaggucucagcc

SEQ ID NO: 3719430 - RNA, 23 nt, Human
uccccuugauuuaaacacacaga

SEQ ID NO: 3719431 - RNA, 14 nt, Human
uccccuugcagccg

SEQ ID NO: 3719432 - RNA, 15 nt, Human
uccccuugccagcug

SEQ ID NO: 3719433 - RNA, 16 nt, Human
uccccuugccagcugc

SEQ ID NO: 3719434 - RNA, 22 nt, Human
uccccuugccagcugcugagcc

SEQ ID NO: 3719435 - RNA, 14 nt, Human
uccccuugcccuug

SEQ ID NO: 3719436 - RNA, 19 nt, Human
uccccuugcccuugcccug

SEQ ID NO: 3719437 - RNA, 18 nt, Human
uccccuugggcccacacc

SEQ ID NO: 3719438 - RNA, 22 nt, Human
ucauuguuauuuauacaagauu

SEQ ID NO: 3719439 - RNA, 18 nt, Human
ucauuguuggacauuugg

SEQ ID NO: 3719440 - RNA, 17 nt, Human
ucauuguuuugaauauu

SEQ ID NO: 3719441 - RNA, 15 nt, Human
ucauuuaaaaugauu

SEQ ID NO: 3719442 - RNA, 22 nt, Human
ucauuuaacugaagauguugag

SEQ ID NO: 3719443 - RNA, 15 nt, Human
ucauuuaagggaaaa

SEQ ID NO: 3719444 - RNA, 23 nt, Human
ucauuuaagggaaaaauauauau

SEQ ID NO: 3719445 - RNA, 14 nt, Human
ucauuuaauaauau

SEQ ID NO: 3719446 - RNA, 21 nt, Human
ucauuuaauaauauacuugug

SEQ ID NO: 3719447 - RNA, 15 nt, Human
ucauuuacuguggcu

SEQ ID NO: 3719448 - RNA, 23 nt, Human
ucauuuagcauguuguugaaagg

SEQ ID NO: 3719449 - RNA, 18 nt, Human
ucauuuagucaugugacc

SEQ ID NO: 3719450 - RNA, 22 nt, Human
ucauuuauaaagcuaaaauaac

SEQ ID NO: 3719451 - RNA, 14 nt, Human
ucauuuaugaaaag

SEQ ID NO: 3719452 - RNA, 11 nt, Human
ucauuuaugau

SEQ ID NO: 3719453 - RNA, 22 nt, Human
ucauuuauuguuuauguaaaug

SEQ ID NO: 3719454 - RNA, 18 nt, Human
ucauuucaaaaugcuuca

SEQ ID NO: 3719455 - RNA, 14 nt, Human
ucauuucacauuaa

SEQ ID NO: 3719456 - RNA, 14 nt, Human
ucauuucaccccuc

SEQ ID NO: 3719457 - RNA, 21 nt, Human
ucauuucaccccucccuuucu

SEQ ID NO: 3719458 - RNA, 13 nt, Human
ucauuucacugua

SEQ ID NO: 3719459 - RNA, 13 nt, Human
ucauuucagaagu

SEQ ID NO: 3719460 - RNA, 15 nt, Human
ucauuucauguccug

SEQ ID NO: 3719461 - RNA, 14 nt, Human
ucauuucauuccau

SEQ ID NO: 3719462 - RNA, 16 nt, Human
ucauuuccaagcaagu

SEQ ID NO: 3719463 - RNA, 16 nt, Human
ucauuuccauguaugc

SEQ ID NO: 3719464 - RNA, 17 nt, Human
ucauuuccauguaugca

SEQ ID NO: 3719465 - RNA, 18 nt, Human
ucauuuccccauaacuca

SEQ ID NO: 3719466 - RNA, 22 nt, Human
ucauuuccuauguaacugcauu

SEQ ID NO: 3719467 - RNA, 13 nt, Human
ucauuuccucaaa

SEQ ID NO: 3719468 - RNA, 16 nt, Human
ucauuuccugugucuu

SEQ ID NO: 3719469 - RNA, 21 nt, Human
ucauuuccuucaaggcaucau

SEQ ID NO: 3719470 - RNA, 13 nt, Human
ucauuucuaaaag

SEQ ID NO: 3719471 - RNA, 15 nt, Human
ucauuucuaaaagaa

SEQ ID NO: 3719472 - RNA, 19 nt, Human
ucauuucuacugugacuga

SEQ ID NO: 3719473 - RNA, 21 nt, Human
ucauuucuauuucuccuccau

SEQ ID NO: 3719474 - RNA, 24 nt, Human
ucauuucucacuguguacauaaug

SEQ ID NO: 3719475 - RNA, 15 nt, Human
ucauuucuuaugaau

SEQ ID NO: 3719476 - RNA, 19 nt, Human
ucauuugagcagggcucag

SEQ ID NO: 3719477 - RNA, 21 nt, Human
ucauuugagcagggcucagcg

SEQ ID NO: 3719478 - RNA, 16 nt, Human
ucauuugaugcuaaau

SEQ ID NO: 3719479 - RNA, 15 nt, Human
ucauuugcuuuggaa

SEQ ID NO: 3719480 - RNA, 18 nt, Human
ucauuugguucauuaauu

SEQ ID NO: 3719481 - RNA, 17 nt, Human
ucauuugguuggcacua

SEQ ID NO: 3719482 - RNA, 21 nt, Human
ucauuuguggcagucccuuau

SEQ ID NO: 3719483 - RNA, 12 nt, Human
ucauuuguguca

SEQ ID NO: 3719484 - RNA, 13 nt, Human
ucauuugugucaa

SEQ ID NO: 3719485 - RNA, 15 nt, Human
ucauuugugucaaug

SEQ ID NO: 3719486 - RNA, 16 nt, Human
ucauuugugugcucau

SEQ ID NO: 3719487 - RNA, 16 nt, Human
ucauuuguuauucuua

SEQ ID NO: 3719488 - RNA, 15 nt, Human
ucauuuguuuacauu

SEQ ID NO: 3719489 - RNA, 18 nt, Human
ucauuuguuuacauuuga

SEQ ID NO: 3719490 - RNA, 13 nt, Human
ucauuuuaaugua

SEQ ID NO: 3719491 - RNA, 20 nt, Human
ucauuuuagggguagcauuu

SEQ ID NO: 3719492 - RNA, 16 nt, Human
ucauuuuauaugucaa

SEQ ID NO: 3719493 - RNA, 14 nt, Human
ucauuuuaugucaa

SEQ ID NO: 3719494 - RNA, 17 nt, Human
ucauuuucauuagcaaa

SEQ ID NO: 3719495 - RNA, 14 nt, Human
ucauuuuccaauac

SEQ ID NO: 3719496 - RNA, 15 nt, Human
ucauuuuccccccac

SEQ ID NO: 3719497 - RNA, 21 nt, Human
ucauuuucuagauacaauaaa

SEQ ID NO: 3719498 - RNA, 14 nt, Human
ucauuuucuauaac

SEQ ID NO: 3719499 - RNA, 15 nt, Human
ucauuuucuauaaca

SEQ ID NO: 3719500 - RNA, 12 nt, Human
ucauuuucucua

SEQ ID NO: 3719501 - RNA, 16 nt, Human
ucauuuucucuaauau

SEQ ID NO: 3719502 - RNA, 14 nt, Human
ucauuuucucucag

SEQ ID NO: 3719503 - RNA, 15 nt, Human
ucauuuucucucagg

SEQ ID NO: 3719504 - RNA, 13 nt, Human
ucauuuucugcaa

SEQ ID NO: 3719505 - RNA, 16 nt, Human
ucauuuucugcaagcc

SEQ ID NO: 3719506 - RNA, 11 nt, Human
ucauuuugaag

SEQ ID NO: 3719507 - RNA, 14 nt, Human
ucauuuugcauuca

SEQ ID NO: 3719508 - RNA, 16 nt, Human
ucauuuugcauucaaa

SEQ ID NO: 3719509 - RNA, 17 nt, Human
ucauuuugcuucauagc

SEQ ID NO: 3719510 - RNA, 22 nt, Human
ucauuuugguaaaauacuucuu

SEQ ID NO: 3719511 - RNA, 14 nt, Human
ucauuuugguacuu

SEQ ID NO: 3719512 - RNA, 14 nt, Human
ucauuuuuaaaugu

SEQ ID NO: 3719513 - RNA, 15 nt, Human
ucauuuuuaaaugug

SEQ ID NO: 3719514 - RNA, 12 nt, Human
ucauuuuuaauc

SEQ ID NO: 3719515 - RNA, 20 nt, Human
ucauuuuuacaauguaauua

SEQ ID NO: 3719516 - RNA, 14 nt, Human
ucauuuuuauagca

SEQ ID NO: 3719517 - RNA, 19 nt, Human
ucauuuuucaauagcacau

SEQ ID NO: 3719518 - RNA, 12 nt, Human
ucauuuuuguac

SEQ ID NO: 3719519 - RNA, 15 nt, Human
ucauuuuuguacagu

SEQ ID NO: 3719520 - RNA, 12 nt, Human
ucauuuuuuccu

SEQ ID NO: 3719521 - RNA, 17 nt, Human
ucauuuuuuuaauuuau

SEQ ID NO: 3719522 - RNA, 15 nt, Human
ucauuuuuuuccuug

SEQ ID NO: 3719523 - RNA, 18 nt, Human
ucauuuuuuuccuugcaa

SEQ ID NO: 3719524 - RNA, 18 nt, Human
ucauuuuuuuuaagaaaa

SEQ ID NO: 3719525 - RNA, 23 nt, Human
ucauuuuuuuucuuugaauaaau

SEQ ID NO: 3719526 - RNA, 18 nt, Human
ucauuuuuuuuuuaucag

SEQ ID NO: 3719527 - RNA, 18 nt, Human
uccaaaaaaaaaaaaaau

SEQ ID NO: 3719528 - RNA, 19 nt, Human
uccaaaaaaaaaaaaaaua

SEQ ID NO: 3719529 - RNA, 22 nt, Human
uccaaaaaaaaaaaaaauacaa

SEQ ID NO: 3719530 - RNA, 23 nt, Human
uccaaaaaaaaaaaaaauacaau

SEQ ID NO: 3719531 - RNA, 19 nt, Human
uccaaaaagcuccuggggc

SEQ ID NO: 3719532 - RNA, 18 nt, Human
uccaaaaaucugccuggg

SEQ ID NO: 3719533 - RNA, 14 nt, Human
uccaaaaauuauua

SEQ ID NO: 3719534 - RNA, 18 nt, Human
uccaaaaccgccagcucu

SEQ ID NO: 3719535 - RNA, 13 nt, Human
uccaaaacugccu

SEQ ID NO: 3719536 - RNA, 13 nt, Human
uccaaaagaaaaa

SEQ ID NO: 3719537 - RNA, 13 nt, Human
uccaaaagcuuuu

SEQ ID NO: 3719538 - RNA, 23 nt, Human
uccaaaaguggccucuuugucua

SEQ ID NO: 3719539 - RNA, 19 nt, Human
uccaaaauaauuuuaagaa

SEQ ID NO: 3719540 - RNA, 23 nt, Human
uccaaaauuugaaauauuaaaau

SEQ ID NO: 3719541 - RNA, 19 nt, Human
uccagccugccuggcaggc

SEQ ID NO: 3719542 - RNA, 12 nt, Human
uccagccuggac

SEQ ID NO: 3719543 - RNA, 14 nt, Human
uccagccuggaccc

SEQ ID NO: 3719544 - RNA, 17 nt, Human
uccagccuggaccccca

SEQ ID NO: 3719545 - RNA, 18 nt, Human
uccagccuggacccccag

SEQ ID NO: 3719546 - RNA, 22 nt, Human
uccagccuggacccccagcuuu

SEQ ID NO: 3719547 - RNA, 19 nt, Human
uccagccugggaggcacag

SEQ ID NO: 3719548 - RNA, 13 nt, Human
uccagccugggca

SEQ ID NO: 3719549 - RNA, 20 nt, Human
uccagccugggcaacagagc

SEQ ID NO: 3719550 - RNA, 23 nt, Human
uccagccugggcagccaggcugc

SEQ ID NO: 3719551 - RNA, 19 nt, Human
uccagccuggggcugaggc

SEQ ID NO: 3719552 - RNA, 17 nt, Human
uccagccuggggucugg

SEQ ID NO: 3719553 - RNA, 12 nt, Human
uccagccugggu

SEQ ID NO: 3719554 - RNA, 24 nt, Human
uccagccugggugacagagcaagu

SEQ ID NO: 3719555 - RNA, 14 nt, Human
uccagcggcccugu

SEQ ID NO: 3719556 - RNA, 15 nt, Human
uccagcuagugaccc

SEQ ID NO: 3719557 - RNA, 17 nt, Human
uccagcucaccagcccc

SEQ ID NO: 3719558 - RNA, 23 nt, Human
uccagcucaccagccccagugcc

SEQ ID NO: 3719559 - RNA, 18 nt, Human
uccagcucauucauuuua

SEQ ID NO: 3719560 - RNA, 19 nt, Human
uccagcucauucauuuuau

SEQ ID NO: 3719561 - RNA, 17 nt, Human
uccagcucccugugccc

SEQ ID NO: 3719562 - RNA, 19 nt, Human
uccagcucccugugccccc

SEQ ID NO: 3719563 - RNA, 23 nt, Human
uccagcucccugugcccccaggg

SEQ ID NO: 3719564 - RNA, 19 nt, Human
uccagcuccuuugggcuuc

SEQ ID NO: 3719565 - RNA, 13 nt, Human
uccagcucuggag

SEQ ID NO: 3719566 - RNA, 18 nt, Human
uccagcucuuuccuccuu

SEQ ID NO: 3719567 - RNA, 23 nt, Human
uccagcugacccugguucucucu

SEQ ID NO: 3719568 - RNA, 13 nt, Human
uccagcugccccg

SEQ ID NO: 3719569 - RNA, 16 nt, Human
uccagcugccccgggg

SEQ ID NO: 3719570 - RNA, 21 nt, Human
uccagcugcccuuccgcagug

SEQ ID NO: 3719571 - RNA, 21 nt, Human
uccagcugcugagauccugga

SEQ ID NO: 3719572 - RNA, 19 nt, Human
uccagcugggcucugcaau

SEQ ID NO: 3719573 - RNA, 13 nt, Human
uccagcuggugag

SEQ ID NO: 3719574 - RNA, 17 nt, Human
uccagcuguccccccac

SEQ ID NO: 3719575 - RNA, 23 nt, Human
uccagcuucugguacucuccuag

SEQ ID NO: 3719576 - RNA, 16 nt, Human
uccagcuugcucuuca

SEQ ID NO: 3719577 - RNA, 16 nt, Human
uccagcuuguggagcc

SEQ ID NO: 3719578 - RNA, 19 nt, Human
uccagcuuguggagcccca

SEQ ID NO: 3719579 - RNA, 16 nt, Human
uccaggaaaaaggaca

SEQ ID NO: 3719580 - RNA, 23 nt, Human
uccaggaaacuccacaucugccu

SEQ ID NO: 3719581 - RNA, 18 nt, Human
uccaggaaccacaccaca

SEQ ID NO: 3719582 - RNA, 22 nt, Human
uccaggaaugccuccucccugg

SEQ ID NO: 3719583 - RNA, 18 nt, Human
uccaggacaggagaugcu

SEQ ID NO: 3719584 - RNA, 22 nt, Human
uccaggacaggagaugcugugc

SEQ ID NO: 3719585 - RNA, 17 nt, Human
uccaggacccugccagg

SEQ ID NO: 3719586 - RNA, 19 nt, Human
uccaggacccugccaggca

SEQ ID NO: 3719587 - RNA, 15 nt, Human
uccaggacuguuuca

SEQ ID NO: 3719588 - RNA, 20 nt, Human
uccaggacuguuucaaacau

SEQ ID NO: 3719589 - RNA, 23 nt, Human
uccaggagaaggccaauuccuau

SEQ ID NO: 3719590 - RNA, 12 nt, Human
uccaggagcagc

SEQ ID NO: 3719591 - RNA, 15 nt, Human
uccaggagcagccac

SEQ ID NO: 3719592 - RNA, 23 nt, Human
uccaggagccuggcuccguccag

SEQ ID NO: 3719593 - RNA, 21 nt, Human
uccaggagcuccaguguccug

SEQ ID NO: 3719594 - RNA, 16 nt, Human
uccaggagcuucuugu

SEQ ID NO: 3719595 - RNA, 19 nt, Human
uccaggaugcuaacaucua

SEQ ID NO: 3719596 - RNA, 22 nt, Human
uccaggauuccucuuuucucug

SEQ ID NO: 3719597 - RNA, 15 nt, Human
uccaggcacagcuga

SEQ ID NO: 3719598 - RNA, 17 nt, Human
uccaggcacagcugagu

SEQ ID NO: 3719599 - RNA, 12 nt, Human
uccaggcacagg

SEQ ID NO: 3719600 - RNA, 18 nt, Human
uccaggcacaggaugcug

SEQ ID NO: 3719601 - RNA, 22 nt, Human
uccaggcacaggaugcuguguu

SEQ ID NO: 3719602 - RNA, 13 nt, Human
uccaggcaccagg

SEQ ID NO: 3719603 - RNA, 20 nt, Human
uccaggcacccuucuuuccu

SEQ ID NO: 3719604 - RNA, 14 nt, Human
uccaggcacugaga

SEQ ID NO: 3719605 - RNA, 15 nt, Human
uccaggcagauccag

SEQ ID NO: 3719606 - RNA, 17 nt, Human
uccaggcagauccagga

SEQ ID NO: 3719607 - RNA, 20 nt, Human
uccaggcagauccaggacua

SEQ ID NO: 3719608 - RNA, 18 nt, Human
uccaggcagcagacacau

SEQ ID NO: 3719609 - RNA, 11 nt, Human
uccaggcagcc

SEQ ID NO: 3719610 - RNA, 15 nt, Human
uccaggcagccucug

SEQ ID NO: 3719611 - RNA, 22 nt, Human
uccaggcagucgggggcuggcc

SEQ ID NO: 3719612 - RNA, 17 nt, Human
uccaggccauggaggca

SEQ ID NO: 3719613 - RNA, 17 nt, Human
uccaggcccaacuguga

SEQ ID NO: 3719614 - RNA, 18 nt, Human
uccaggcccaaggcuccc

SEQ ID NO: 3719615 - RNA, 18 nt, Human
uccaggccgcgcccuuuc

SEQ ID NO: 3719616 - RNA, 20 nt, Human
uccaggccgcgcccuuuccc

SEQ ID NO: 3719617 - RNA, 18 nt, Human
uccaggccuacuccuguc

SEQ ID NO: 3719618 - RNA, 14 nt, Human
uccaggccugcagc

SEQ ID NO: 3719619 - RNA, 20 nt, Human
uccaggccugcagcaggagu

SEQ ID NO: 3719620 - RNA, 13 nt, Human
uccaggccugccu

SEQ ID NO: 3719621 - RNA, 17 nt, Human
uccaggccugccuccca

SEQ ID NO: 3719622 - RNA, 19 nt, Human
uccaggcgaugugcaagug

SEQ ID NO: 3719623 - RNA, 13 nt, Human
uccaggcuagucc

SEQ ID NO: 3719624 - RNA, 19 nt, Human
uccaggcuauguauaaaau

SEQ ID NO: 3719625 - RNA, 12 nt, Human
uccaggcuccuu

SEQ ID NO: 3719626 - RNA, 14 nt, Human
uccaggcuguaucc

SEQ ID NO: 3719627 - RNA, 20 nt, Human
uccguggguugcuaacugaa

SEQ ID NO: 3719628 - RNA, 16 nt, Human
uccguguccaccccca

SEQ ID NO: 3719629 - RNA, 16 nt, Human
uccguguggauccaau

SEQ ID NO: 3719630 - RNA, 17 nt, Human
uccguuagcuccugugg

SEQ ID NO: 3719631 - RNA, 15 nt, Human
uccguuggccacucc

SEQ ID NO: 3719632 - RNA, 21 nt, Human
uccguuuauuauaaacuguau

SEQ ID NO: 3719633 - RNA, 20 nt, Human
uccguuugauuugucacugc

SEQ ID NO: 3719634 - RNA, 21 nt, Human
uccguuugauuugucacugcu

SEQ ID NO: 3719635 - RNA, 16 nt, Human
uccuaaaagcaaaaua

SEQ ID NO: 3719636 - RNA, 23 nt, Human
uccuaaaauaagggcagagucac

SEQ ID NO: 3719637 - RNA, 19 nt, Human
uccuaaauuuuccuguccu

SEQ ID NO: 3719638 - RNA, 22 nt, Human
uccuaagaaagaggagugcuug

SEQ ID NO: 3719639 - RNA, 15 nt, Human
uccuaagaaauaugu

SEQ ID NO: 3719640 - RNA, 18 nt, Human
uccuaagaaauaugugag

SEQ ID NO: 3719641 - RNA, 15 nt, Human
uccuaagaagcuucu

SEQ ID NO: 3719642 - RNA, 16 nt, Human
uccuaagacacaaaug

SEQ ID NO: 3719643 - RNA, 18 nt, Human
uccuaagaccugggguug

SEQ ID NO: 3719644 - RNA, 20 nt, Human
uccuaagauguguucuuauu

SEQ ID NO: 3719645 - RNA, 13 nt, Human
uccuaagcaucua

SEQ ID NO: 3719646 - RNA, 14 nt, Human
uccuaagccuaaaa

SEQ ID NO: 3719647 - RNA, 17 nt, Human
uccuaagccuguggcug

SEQ ID NO: 3719648 - RNA, 20 nt, Human
uccuaagcuauucaguaaua

SEQ ID NO: 3719649 - RNA, 22 nt, Human
uccuaagcuggagugcaguggc

SEQ ID NO: 3719650 - RNA, 18 nt, Human
uccuaaggacacacuaau

SEQ ID NO: 3719651 - RNA, 16 nt, Human
uccuaagggucgaaag

SEQ ID NO: 3719652 - RNA, 23 nt, Human
uccuaagggucgaaagcucuaga

SEQ ID NO: 3719653 - RNA, 15 nt, Human
uccuaauaaaaaggu

SEQ ID NO: 3719654 - RNA, 18 nt, Human
uccuaauaaaaaggugac

SEQ ID NO: 3719655 - RNA, 18 nt, Human
uccuaauaaaguucugua

SEQ ID NO: 3719656 - RNA, 20 nt, Human
uccuaauaaucauuggauuc

SEQ ID NO: 3719657 - RNA, 22 nt, Human
uccuaaucagaaauuuuuauca

SEQ ID NO: 3719658 - RNA, 17 nt, Human
uccuaauggugaugcag

SEQ ID NO: 3719659 - RNA, 20 nt, Human
uccuaauggugaugcagucu

SEQ ID NO: 3719660 - RNA, 15 nt, Human
uccuaauuccacagc

SEQ ID NO: 3719661 - RNA, 18 nt, Human
uccuaauuucccuucuug

SEQ ID NO: 3719662 - RNA, 15 nt, Human
uccuaauuucuccuc

SEQ ID NO: 3719663 - RNA, 16 nt, Human
uccuaauuuugagaaa

SEQ ID NO: 3719664 - RNA, 15 nt, Human
uccuacaaagauguu

SEQ ID NO: 3719665 - RNA, 18 nt, Human
uccuacaagagcagccug

SEQ ID NO: 3719666 - RNA, 20 nt, Human
uccuacaagagcagccugug

SEQ ID NO: 3719667 - RNA, 23 nt, Human
uccuacaagagcagccuguggca

SEQ ID NO: 3719668 - RNA, 20 nt, Human
uccuacaagauuuagaaaaa

SEQ ID NO: 3719669 - RNA, 15 nt, Human
uccuacaauauauau

SEQ ID NO: 3719670 - RNA, 14 nt, Human
uccuacacaggaca

SEQ ID NO: 3719671 - RNA, 15 nt, Human
uccuacacaggacag

SEQ ID NO: 3719672 - RNA, 15 nt, Human
uccuacaccuaacuc

SEQ ID NO: 3719673 - RNA, 19 nt, Human
uccuacagaaaaaccuugg

SEQ ID NO: 3719674 - RNA, 13 nt, Human
uccuacagcacua

SEQ ID NO: 3719675 - RNA, 13 nt, Human
uccuacagccccu

SEQ ID NO: 3719676 - RNA, 23 nt, Human
uccuacaguuggaaauccaucca

SEQ ID NO: 3719677 - RNA, 19 nt, Human
uccuacauaucccuuccag

SEQ ID NO: 3719678 - RNA, 14 nt, Human
uccuaccaagucaa

SEQ ID NO: 3719679 - RNA, 15 nt, Human
uccuaccaaugcaug

SEQ ID NO: 3719680 - RNA, 21 nt, Human
uccuaccacccgguccccacu

SEQ ID NO: 3719681 - RNA, 16 nt, Human
uccuacccaaccacuc

SEQ ID NO: 3719682 - RNA, 21 nt, Human
uccuaccccaauuccuuguag

SEQ ID NO: 3719683 - RNA, 17 nt, Human
uccuaccccucccagcu

SEQ ID NO: 3719684 - RNA, 15 nt, Human
uccuacccugccucc

SEQ ID NO: 3719685 - RNA, 20 nt, Human
uccuacccugcgcccagucc

SEQ ID NO: 3719686 - RNA, 13 nt, Human
uccuaccgucuuu

SEQ ID NO: 3719687 - RNA, 15 nt, Human
uccuaccucaaaauu

SEQ ID NO: 3719688 - RNA, 14 nt, Human
uccuaccucagccu

SEQ ID NO: 3719689 - RNA, 14 nt, Human
uccuaccugcccug

SEQ ID NO: 3719690 - RNA, 16 nt, Human
uccuaccugcccugga

SEQ ID NO: 3719691 - RNA, 17 nt, Human
uccuacucccagacacc

SEQ ID NO: 3719692 - RNA, 19 nt, Human
uccuacucggcucugcagu

SEQ ID NO: 3719693 - RNA, 12 nt, Human
uccuacucugug

SEQ ID NO: 3719694 - RNA, 15 nt, Human
uccuacucuguguca

SEQ ID NO: 3719695 - RNA, 13 nt, Human
uccuacucuucuc

SEQ ID NO: 3719696 - RNA, 18 nt, Human
uccuacucuucucucugc

SEQ ID NO: 3719697 - RNA, 16 nt, Human
uccuacuuuuaaagaa

SEQ ID NO: 3719698 - RNA, 17 nt, Human
uccuacuuuuaaagaau

SEQ ID NO: 3719699 - RNA, 19 nt, Human
uccuagaaguuacugaaug

SEQ ID NO: 3719700 - RNA, 18 nt, Human
uccuagagaacgcagccc

SEQ ID NO: 3719701 - RNA, 23 nt, Human
uccuagagaacgcagcccuagag

SEQ ID NO: 3719702 - RNA, 15 nt, Human
uccuagaggaccuga

SEQ ID NO: 3719703 - RNA, 18 nt, Human
uccuagaggcccuuugcu

SEQ ID NO: 3719704 - RNA, 21 nt, Human
uccuagagggaggggccuagg

SEQ ID NO: 3719705 - RNA, 14 nt, Human
uccuagaguagagu

SEQ ID NO: 3719706 - RNA, 14 nt, Human
uccuagauaaaaag

SEQ ID NO: 3719707 - RNA, 21 nt, Human
uccuagauggcagucacugaa

SEQ ID NO: 3719708 - RNA, 22 nt, Human
uccuagauggcagucacugaau

SEQ ID NO: 3719709 - RNA, 20 nt, Human
uccuagauuauaucaaagua

SEQ ID NO: 3719710 - RNA, 19 nt, Human
uccuagcacacacuuuugg

SEQ ID NO: 3719711 - RNA, 15 nt, Human
uccuagcacagaugg

SEQ ID NO: 3719712 - RNA, 21 nt, Human
uccuagcacagauggccagcc

SEQ ID NO: 3719713 - RNA, 17 nt, Human
uccuagcacaugcuuca

SEQ ID NO: 3719714 - RNA, 20 nt, Human
uccuagcacuuugggaggcc

SEQ ID NO: 3719715 - RNA, 12 nt, Human
uccuagcagaga

SEQ ID NO: 3719716 - RNA, 13 nt, Human
uccuagccacuca

SEQ ID NO: 3719717 - RNA, 17 nt, Human
uccuagccuguuucuuc

SEQ ID NO: 3719718 - RNA, 19 nt, Human
uccuagccuuauccucuga

SEQ ID NO: 3719719 - RNA, 21 nt, Human
uccuagccuuauccucugauc

SEQ ID NO: 3719720 - RNA, 16 nt, Human
uccuagcugcacaggg

SEQ ID NO: 3719721 - RNA, 20 nt, Human
uccuagcugcacagggcagc

SEQ ID NO: 3719722 - RNA, 18 nt, Human
uccuagcuguccuuuuuc

SEQ ID NO: 3719723 - RNA, 14 nt, Human
uccuagcugugugc

SEQ ID NO: 3719724 - RNA, 21 nt, Human
uccuagcuugggaggcuuccc

SEQ ID NO: 3719725 - RNA, 20 nt, Human
uccuaggacccgucuccagc

SEQ ID NO: 3719726 - RNA, 13 nt, Human
uccuaggccacac

SEQ ID NO: 3719727 - RNA, 22 nt, Human
uccuaggccucaacuccuccca

SEQ ID NO: 3719728 - RNA, 15 nt, Human
uccuaggcuggaagg

SEQ ID NO: 3719729 - RNA, 20 nt, Human
uccuaggcuggaaggaggaa

SEQ ID NO: 3719730 - RNA, 19 nt, Human
uccuagggaaggguggugg

SEQ ID NO: 3719731 - RNA, 23 nt, Human
uccuagucucuaucauuaaaguu

SEQ ID NO: 3719732 - RNA, 14 nt, Human
uccuagugaaagag

SEQ ID NO: 3719733 - RNA, 17 nt, Human
uccuaguuccaccauca

SEQ ID NO: 3719734 - RNA, 18 nt, Human
uccuaguucuagaaaaac

SEQ ID NO: 3719735 - RNA, 18 nt, Human
uccuaguucuguagaaau

SEQ ID NO: 3719736 - RNA, 23 nt, Human
uccuaguucuguagaaaugguug

SEQ ID NO: 3719737 - RNA, 17 nt, Human
uccuaguuuccucuccu

SEQ ID NO: 3719738 - RNA, 21 nt, Human
uccuaguuugaccucacagug

SEQ ID NO: 3719739 - RNA, 17 nt, Human
uccuaguuuuccuacuu

SEQ ID NO: 3719740 - RNA, 13 nt, Human
uccuaguuuucuc

SEQ ID NO: 3719741 - RNA, 20 nt, Human
uccuauaacuugaugcaugu

SEQ ID NO: 3719742 - RNA, 18 nt, Human
uccuauacgcagcgugcu

SEQ ID NO: 3719743 - RNA, 19 nt, Human
uccuauacgcagcgugcuu

SEQ ID NO: 3719744 - RNA, 15 nt, Human
uccuauauaguuuau

SEQ ID NO: 3719745 - RNA, 20 nt, Human
uccuauauauuucuauuauu

SEQ ID NO: 3719746 - RNA, 18 nt, Human
uccuauauccugugacug

SEQ ID NO: 3719747 - RNA, 13 nt, Human
uccuauaugcacu

SEQ ID NO: 3719748 - RNA, 16 nt, Human
uccuaucaccuccccu

SEQ ID NO: 3719749 - RNA, 20 nt, Human
uccuaucaccugucuugccu

SEQ ID NO: 3719750 - RNA, 17 nt, Human
uccuaucagaaguuucu

SEQ ID NO: 3719751 - RNA, 15 nt, Human
uccuaucccauccca

SEQ ID NO: 3719752 - RNA, 16 nt, Human
uccuaucccaucccau

SEQ ID NO: 3719753 - RNA, 18 nt, Human
uccuaucccaucccaucc

SEQ ID NO: 3719754 - RNA, 17 nt, Human
uccuaucuccagcggcc

SEQ ID NO: 3719755 - RNA, 14 nt, Human
uccuaucuguguuu

SEQ ID NO: 3719756 - RNA, 16 nt, Human
uccuaugauguauacu

SEQ ID NO: 3719757 - RNA, 12 nt, Human
uccuaugcaugg

SEQ ID NO: 3719758 - RNA, 13 nt, Human
uccuaugcuuuag

SEQ ID NO: 3719759 - RNA, 13 nt, Human
uccuauggaaacc

SEQ ID NO: 3719760 - RNA, 22 nt, Human
uccuaugugauuuuaacucugu

SEQ ID NO: 3719761 - RNA, 19 nt, Human
uccuauguuuuuguucaaa

SEQ ID NO: 3719762 - RNA, 19 nt, Human
uccuauuaguguuauauga

SEQ ID NO: 3719763 - RNA, 16 nt, Human
uccuauucucaccagg

SEQ ID NO: 3719764 - RNA, 18 nt, Human
uccuauucucaccaggaa

SEQ ID NO: 3719765 - RNA, 19 nt, Human
uccuauugugauuugacug

SEQ ID NO: 3719766 - RNA, 21 nt, Human
uccuauugugcaauguaaaua

SEQ ID NO: 3719767 - RNA, 12 nt, Human
uccuauuucaga

SEQ ID NO: 3719768 - RNA, 20 nt, Human
uccuauuucagaaguuuaaa

SEQ ID NO: 3719769 - RNA, 13 nt, Human
uccuauuucagua

SEQ ID NO: 3719770 - RNA, 16 nt, Human
uccuauuugcacugua

SEQ ID NO: 3719771 - RNA, 18 nt, Human
uccuauuugccaugggcu

SEQ ID NO: 3719772 - RNA, 19 nt, Human
uccuauuuugcauaauaaa

SEQ ID NO: 3719773 - RNA, 17 nt, Human
uccucaaaacuggaguc

SEQ ID NO: 3719774 - RNA, 20 nt, Human
uccucaaaacuucagacaua

SEQ ID NO: 3719775 - RNA, 14 nt, Human
uccucaaacaacac

SEQ ID NO: 3719776 - RNA, 14 nt, Human
uccucaaacacugc

SEQ ID NO: 3719777 - RNA, 22 nt, Human
gcuuccaaggggcaaauuuuua

SEQ ID NO: 3719778 - RNA, 15 nt, Human
gcuuccaaggugguc

SEQ ID NO: 3719779 - RNA, 16 nt, Human
gcuuccaagguggucu

SEQ ID NO: 3719780 - RNA, 12 nt, Human
gcuuccaccuca

SEQ ID NO: 3719781 - RNA, 16 nt, Human
gcuuccaccucacccc

SEQ ID NO: 3719782 - RNA, 20 nt, Human
gcuuccaccucaccccacuu

SEQ ID NO: 3719783 - RNA, 13 nt, Human
gcuuccagagagu

SEQ ID NO: 3719784 - RNA, 19 nt, Human
gcuuccagagaguccucug

SEQ ID NO: 3719785 - RNA, 22 nt, Human
gcuuccagagaguccucuggau

SEQ ID NO: 3719786 - RNA, 14 nt, Human
gcuuccaggaaaaa

SEQ ID NO: 3719787 - RNA, 19 nt, Human
gcuuccaggaaacuccaca

SEQ ID NO: 3719788 - RNA, 20 nt, Human
gcuuccagguaucuccagga

SEQ ID NO: 3719789 - RNA, 19 nt, Human
gcuuccagugaggcucugc

SEQ ID NO: 3719790 - RNA, 20 nt, Human
gcuuccauagcugcugcccu

SEQ ID NO: 3719791 - RNA, 15 nt, Human
gcuuccaugauucua

SEQ ID NO: 3719792 - RNA, 18 nt, Human
gcuuccaugauucuauuu

SEQ ID NO: 3719793 - RNA, 17 nt, Human
gcuuccauuugugugug

SEQ ID NO: 3719794 - RNA, 20 nt, Human
gcuuccauuugugugugugc

SEQ ID NO: 3719795 - RNA, 18 nt, Human
gcuucccaagggcugccg

SEQ ID NO: 3719796 - RNA, 13 nt, Human
gcuucccaccucc

SEQ ID NO: 3719797 - RNA, 17 nt, Human
gcuucccaccucccugc

SEQ ID NO: 3719798 - RNA, 23 nt, Human
gcuucccaccucccugcccaggc

SEQ ID NO: 3719799 - RNA, 22 nt, Human
gcuucccaguggcugcugccca

SEQ ID NO: 3719800 - RNA, 16 nt, Human
gcuucccauccccagc

SEQ ID NO: 3719801 - RNA, 22 nt, Human
gcuucccauccuacccucgggc

SEQ ID NO: 3719802 - RNA, 17 nt, Human
gcuucccaugucuuucu

SEQ ID NO: 3719803 - RNA, 22 nt, Human
gcuuccccaacacgcaggagca

SEQ ID NO: 3719804 - RNA, 16 nt, Human
gcuuccccaguagcug

SEQ ID NO: 3719805 - RNA, 12 nt, Human
gcuuccccuccc

SEQ ID NO: 3719806 - RNA, 23 nt, Human
gcuucccgcucagcccucccugc

SEQ ID NO: 3719807 - RNA, 14 nt, Human
gcuucccuaaucua

SEQ ID NO: 3719808 - RNA, 15 nt, Human
gcuucccuccauccc

SEQ ID NO: 3719809 - RNA, 13 nt, Human
gcuucccuccugc

SEQ ID NO: 3719810 - RNA, 12 nt, Human
gcuucccucugc

SEQ ID NO: 3719811 - RNA, 23 nt, Human
gcuucccucugccugucccucuc

SEQ ID NO: 3719812 - RNA, 13 nt, Human
gcuucccugaagc

SEQ ID NO: 3719813 - RNA, 18 nt, Human
gcuucccugacucauucu

SEQ ID NO: 3719814 - RNA, 14 nt, Human
gcuuccgcauccua

SEQ ID NO: 3719815 - RNA, 16 nt, Human
gcuuccggcuccugug

SEQ ID NO: 3719816 - RNA, 20 nt, Human
gcuuccgguagggaggcagc

SEQ ID NO: 3719817 - RNA, 22 nt, Human
gcuuccgguagggaggcagccu

SEQ ID NO: 3719818 - RNA, 22 nt, Human
gcuuccuacccacaccucugcc

SEQ ID NO: 3719819 - RNA, 20 nt, Human
gcuuccucccaacaagcagc

SEQ ID NO: 3719820 - RNA, 14 nt, Human
gcuuccuccucccu

SEQ ID NO: 3719821 - RNA, 11 nt, Human
gcuuccuccug

SEQ ID NO: 3719822 - RNA, 13 nt, Human
gcuuccuccugcg

SEQ ID NO: 3719823 - RNA, 20 nt, Human
gcuuccucuagaagccaagg

SEQ ID NO: 3719824 - RNA, 22 nt, Human
gcuuccucuagaagccaaggga

SEQ ID NO: 3719825 - RNA, 15 nt, Human
gcuuccugaggggag

SEQ ID NO: 3719826 - RNA, 13 nt, Human
gcuuccuggagca

SEQ ID NO: 3719827 - RNA, 18 nt, Human
gcuuccuggagcagaagc

SEQ ID NO: 3719828 - RNA, 11 nt, Human
gcuuccuggug

SEQ ID NO: 3719829 - RNA, 16 nt, Human
gcuuccuguccuccca

SEQ ID NO: 3719830 - RNA, 17 nt, Human
gcuuccuucauuuccuc

SEQ ID NO: 3719831 - RNA, 22 nt, Human
gcuuccuucugugaaaguacau

SEQ ID NO: 3719832 - RNA, 23 nt, Human
gcuuccuuguagcgacuaaacua

SEQ ID NO: 3719833 - RNA, 16 nt, Human
gcuuccuuucccaagc

SEQ ID NO: 3719834 - RNA, 24 nt, Human
gcuuccuuucccaagccuucgggc

SEQ ID NO: 3719835 - RNA, 14 nt, Human
gcuucgacuuuucu

SEQ ID NO: 3719836 - RNA, 14 nt, Human
gcuucguuuauuuu

SEQ ID NO: 3719837 - RNA, 17 nt, Human
gcuucguuuauuuucaa

SEQ ID NO: 3719838 - RNA, 19 nt, Human
gcuucuaaguaaauacaau

SEQ ID NO: 3719839 - RNA, 20 nt, Human
gcuucuaaguaaauacaauu

SEQ ID NO: 3719840 - RNA, 21 nt, Human
gcuucuaaguaaauacaauuu

SEQ ID NO: 3719841 - RNA, 20 nt, Human
gcuucuaauauuuauugcuu

SEQ ID NO: 3719842 - RNA, 17 nt, Human
gcuucuaccaacuggaa

SEQ ID NO: 3719843 - RNA, 19 nt, Human
gcuucuaccaacuggaagc

SEQ ID NO: 3719844 - RNA, 18 nt, Human
gcuucuaguucugccagg

SEQ ID NO: 3719845 - RNA, 20 nt, Human
gcuucuaguucugccaggag

SEQ ID NO: 3719846 - RNA, 18 nt, Human
gcuucuaucccaggaggu

SEQ ID NO: 3719847 - RNA, 22 nt, Human
gcuucucacugccaugccagcu

SEQ ID NO: 3719848 - RNA, 12 nt, Human
gcuucucauccc

SEQ ID NO: 3719849 - RNA, 14 nt, Human
gcuucucaucccca

SEQ ID NO: 3719850 - RNA, 18 nt, Human
gcuucucaucuugugaaa

SEQ ID NO: 3719851 - RNA, 13 nt, Human
gcuucuccagccu

SEQ ID NO: 3719852 - RNA, 14 nt, Human
gcuucuccagccug

SEQ ID NO: 3719853 - RNA, 18 nt, Human
gcuucucccacuuggcca

SEQ ID NO: 3719854 - RNA, 11 nt, Human
gcuucucccag

SEQ ID NO: 3719855 - RNA, 13 nt, Human
gcuucucccaggc

SEQ ID NO: 3719856 - RNA, 16 nt, Human
gcuucucccaggcaag

SEQ ID NO: 3719857 - RNA, 14 nt, Human
gcuucuccccagaa

SEQ ID NO: 3719858 - RNA, 15 nt, Human
gcuucuccgccagcc

SEQ ID NO: 3719859 - RNA, 16 nt, Human
gcuucuccgccagccu

SEQ ID NO: 3719860 - RNA, 21 nt, Human
gcuucuccgccagccuccucu

SEQ ID NO: 3719861 - RNA, 14 nt, Human
gcuucuccugaccc

SEQ ID NO: 3719862 - RNA, 12 nt, Human
gcuucucucuca

SEQ ID NO: 3719863 - RNA, 17 nt, Human
gcuucucugacuucugc

SEQ ID NO: 3719864 - RNA, 20 nt, Human
gcuucucugacuucugccug

SEQ ID NO: 3719865 - RNA, 18 nt, Human
gcuucugagcagcgagcc

SEQ ID NO: 3719866 - RNA, 18 nt, Human
gcuucugaugaaucuugc

SEQ ID NO: 3719867 - RNA, 13 nt, Human
gcuucugcacccu

SEQ ID NO: 3719868 - RNA, 18 nt, Human
gcuucugcacccuccacc

SEQ ID NO: 3719869 - RNA, 16 nt, Human
gcuucugccacauaaa

SEQ ID NO: 3719870 - RNA, 16 nt, Human
gcuucugccacuuccc

SEQ ID NO: 3719871 - RNA, 16 nt, Human
gcuucugcccccugca

SEQ ID NO: 3719872 - RNA, 12 nt, Human
gcuucugccugc

SEQ ID NO: 3719873 - RNA, 22 nt, Human
gcuucugcugggcuggggccug

SEQ ID NO: 3719874 - RNA, 22 nt, Human
gcuucugcuggggccugggaca

SEQ ID NO: 3719875 - RNA, 16 nt, Human
gcuucugcuuuucugc

SEQ ID NO: 3719876 - RNA, 23 nt, Human
gcuucugcuuuucugcccuggcu

SEQ ID NO: 3719877 - RNA, 20 nt, Human
gcuucuggaauuuguucaag

SEQ ID NO: 3719878 - RNA, 23 nt, Human
gcuucuggaauuuguucaaguuu

SEQ ID NO: 3719879 - RNA, 13 nt, Human
gcuucuggagccc

SEQ ID NO: 3719880 - RNA, 14 nt, Human
gcuucuggagcccu

SEQ ID NO: 3719881 - RNA, 16 nt, Human
gcuucuggaugggaca

SEQ ID NO: 3719882 - RNA, 14 nt, Human
gcuucuggccagga

SEQ ID NO: 3719883 - RNA, 17 nt, Human
gcuucugguacucuccu

SEQ ID NO: 3719884 - RNA, 18 nt, Human
gcuucugguacucuccua

SEQ ID NO: 3719885 - RNA, 12 nt, Human
gcuucugucucc

SEQ ID NO: 3719886 - RNA, 16 nt, Human
gcuucugugaugagcu

SEQ ID NO: 3719887 - RNA, 19 nt, Human
gcuucugugaugagcugau

SEQ ID NO: 3719888 - RNA, 16 nt, Human
gcuucugugcaccugg

SEQ ID NO: 3719889 - RNA, 17 nt, Human
gcuucugugcaccuggg

SEQ ID NO: 3719890 - RNA, 19 nt, Human
gcuucuguugcugccucau

SEQ ID NO: 3719891 - RNA, 14 nt, Human
gcuucuuaaaugag

SEQ ID NO: 3719892 - RNA, 21 nt, Human
gcuucuuaauauaacugccuu

SEQ ID NO: 3719893 - RNA, 19 nt, Human
gcuucuuaaucuuuucaca

SEQ ID NO: 3719894 - RNA, 18 nt, Human
gcuucuuacuauuaagca

SEQ ID NO: 3719895 - RNA, 15 nt, Human
gcuucuuccaggugc

SEQ ID NO: 3719896 - RNA, 16 nt, Human
gcuucuuccaggugcc

SEQ ID NO: 3719897 - RNA, 19 nt, Human
gcuucuuccaggugcccag

SEQ ID NO: 3719898 - RNA, 19 nt, Human
gcuucuucccuuaaaauuu

SEQ ID NO: 3719899 - RNA, 21 nt, Human
gcuucuuccuauuugccaugg

SEQ ID NO: 3719900 - RNA, 14 nt, Human
gcuucuucucaggc

SEQ ID NO: 3719901 - RNA, 14 nt, Human
gcuucuugccucug

SEQ ID NO: 3719902 - RNA, 16 nt, Human
gcuucuugccucugug

SEQ ID NO: 3719903 - RNA, 13 nt, Human
gcuucuugugaag

SEQ ID NO: 3719904 - RNA, 18 nt, Human
gcuucuugugaaggccau

SEQ ID NO: 3719905 - RNA, 21 nt, Human
gcuucuuucaagggcuuuccu

SEQ ID NO: 3719906 - RNA, 23 nt, Human
gcuucuuuuaguuguaucucuuu

SEQ ID NO: 3719907 - RNA, 12 nt, Human
gcuugaacacag

SEQ ID NO: 3719908 - RNA, 17 nt, Human
gcuugaacacaguauuu

SEQ ID NO: 3719909 - RNA, 21 nt, Human
gcuugaagaucguuaguaucu

SEQ ID NO: 3719910 - RNA, 22 nt, Human
gcuugaagaucguuaguaucua

SEQ ID NO: 3719911 - RNA, 14 nt, Human
gcuugaagccaaag

SEQ ID NO: 3719912 - RNA, 18 nt, Human
gcuugaagccaaagaaaa

SEQ ID NO: 3719913 - RNA, 14 nt, Human
gcuugaagccaagu

SEQ ID NO: 3719914 - RNA, 15 nt, Human
gcuugacaacaucug

SEQ ID NO: 3719915 - RNA, 15 nt, Human
gcuugacaggacagc

SEQ ID NO: 3719916 - RNA, 16 nt, Human
gcuugaccgugaggcc

SEQ ID NO: 3719917 - RNA, 18 nt, Human
gcuugaccgugaggccag

SEQ ID NO: 3719918 - RNA, 23 nt, Human
gcuugacucaggauuuaaaaacu

SEQ ID NO: 3719919 - RNA, 22 nt, Human
gcuugacuuuuguauagguaga

SEQ ID NO: 3719920 - RNA, 14 nt, Human
gcuugagcccagga

SEQ ID NO: 3719921 - RNA, 22 nt, Human
gcuugagccgggccccugggcu

SEQ ID NO: 3719922 - RNA, 18 nt, Human
gcuugaggguugggcugg

SEQ ID NO: 3719923 - RNA, 19 nt, Human
gcuugaguuaggaaugaga

SEQ ID NO: 3719924 - RNA, 13 nt, Human
gcuugauacagga

SEQ ID NO: 3719925 - RNA, 14 nt, Human
gcuugauauuuucu

SEQ ID NO: 3719926 - RNA, 13 nt, Human
gcuugaugaagca

SEQ ID NO: 3719927 - RNA, 13 nt, Human
aagaauaggacuu

SEQ ID NO: 3719928 - RNA, 17 nt, Human
aagaauaggacuuguuu

SEQ ID NO: 3719929 - RNA, 19 nt, Human
aagaauaggacuuguuuuu

SEQ ID NO: 3719930 - RNA, 21 nt, Human
aagaauaggacuuguuuuugu

SEQ ID NO: 3719931 - RNA, 22 nt, Human
aagaauagggcccaugggaggg

SEQ ID NO: 3719932 - RNA, 18 nt, Human
aagaauauccuuuaaaau

SEQ ID NO: 3719933 - RNA, 20 nt, Human
aagaauauccuuuaaaauuu

SEQ ID NO: 3719934 - RNA, 17 nt, Human
aagaauaucuguaaugg

SEQ ID NO: 3719935 - RNA, 19 nt, Human
aagaauaucuguaauggua

SEQ ID NO: 3719936 - RNA, 14 nt, Human
aagaauaugacuuu

SEQ ID NO: 3719937 - RNA, 17 nt, Human
aagaauauucagagaau

SEQ ID NO: 3719938 - RNA, 15 nt, Human
aagaauauuguuccu

SEQ ID NO: 3719939 - RNA, 13 nt, Human
aagaauauuuuaa

SEQ ID NO: 3719940 - RNA, 21 nt, Human
aagaaucaccuaauuaauuuc

SEQ ID NO: 3719941 - RNA, 14 nt, Human
aagaaucagaguag

SEQ ID NO: 3719942 - RNA, 23 nt, Human
aagaaucagucuauccacagaga

SEQ ID NO: 3719943 - RNA, 23 nt, Human
aagaaucauuguaaacauuaguu

SEQ ID NO: 3719944 - RNA, 18 nt, Human
aagaauccacauuucuaa

SEQ ID NO: 3719945 - RNA, 18 nt, Human
aagaaucccuagacuuua

SEQ ID NO: 3719946 - RNA, 15 nt, Human
aagaaucccuguuca

SEQ ID NO: 3719947 - RNA, 23 nt, Human
aagaaucgaugggggaugcuuca

SEQ ID NO: 3719948 - RNA, 12 nt, Human
aagaaucuacuu

SEQ ID NO: 3719949 - RNA, 16 nt, Human
aagaaucuaucugcuu

SEQ ID NO: 3719950 - RNA, 12 nt, Human
aagaaucucauc

SEQ ID NO: 3719951 - RNA, 20 nt, Human
aagaaucucaucucagugaa

SEQ ID NO: 3719952 - RNA, 15 nt, Human
aagaaucuuuagaga

SEQ ID NO: 3719953 - RNA, 19 nt, Human
aagaaugaaagcuguuccu

SEQ ID NO: 3719954 - RNA, 18 nt, Human
aagaaugacuauauaauu

SEQ ID NO: 3719955 - RNA, 18 nt, Human
aagaaugcacaagaaugg

SEQ ID NO: 3719956 - RNA, 21 nt, Human
aagaaugcacaagaauggauc

SEQ ID NO: 3719957 - RNA, 22 nt, Human
aagaaugcacaagaauggauca

SEQ ID NO: 3719958 - RNA, 21 nt, Human
aagaaugcauugauauuguga

SEQ ID NO: 3719959 - RNA, 12 nt, Human
aagaaugcugaa

SEQ ID NO: 3719960 - RNA, 14 nt, Human
aagaaugcugaaac

SEQ ID NO: 3719961 - RNA, 15 nt, Human
aagaaugcugguuuu

SEQ ID NO: 3719962 - RNA, 15 nt, Human
aagaauggagaggaa

SEQ ID NO: 3719963 - RNA, 18 nt, Human
aagaaugggcaguuacau

SEQ ID NO: 3719964 - RNA, 17 nt, Human
aagaaugucgauuaaaa

SEQ ID NO: 3719965 - RNA, 19 nt, Human
aagaauguuaagacuugac

SEQ ID NO: 3719966 - RNA, 18 nt, Human
aagaauguuacugccuua

SEQ ID NO: 3719967 - RNA, 21 nt, Human
aagaauguuagaguaaugaaa

SEQ ID NO: 3719968 - RNA, 20 nt, Human
aagaauguugguuuacuuuc

SEQ ID NO: 3719969 - RNA, 19 nt, Human
aagaauuaagauacaaauu

SEQ ID NO: 3719970 - RNA, 13 nt, Human
aagaauucaaauu

SEQ ID NO: 3719971 - RNA, 18 nt, Human
aagaauucaaauuuuauc

SEQ ID NO: 3719972 - RNA, 14 nt, Human
aagaauuccaaagc

SEQ ID NO: 3719973 - RNA, 16 nt, Human
aagaauuccaaagcaa

SEQ ID NO: 3719974 - RNA, 19 nt, Human
aagaauucuccaaaacaau

SEQ ID NO: 3719975 - RNA, 20 nt, Human
aagaauucugauugauuuga

SEQ ID NO: 3719976 - RNA, 20 nt, Human
aagaauugaacccaggaggu

SEQ ID NO: 3719977 - RNA, 15 nt, Human
aagaauugaguaaug

SEQ ID NO: 3719978 - RNA, 20 nt, Human
aagaauugccagucuuuugu

SEQ ID NO: 3719979 - RNA, 20 nt, Human
aagaauugucuuucugucuc

SEQ ID NO: 3719980 - RNA, 20 nt, Human
aagaauugugguuuauauau

SEQ ID NO: 3719981 - RNA, 12 nt, Human
aagaauuguugg

SEQ ID NO: 3719982 - RNA, 13 nt, Human
aagaauuuaaaga

SEQ ID NO: 3719983 - RNA, 16 nt, Human
aagaauuuacuuugga

SEQ ID NO: 3719984 - RNA, 14 nt, Human
aagaauuucacaag

SEQ ID NO: 3719985 - RNA, 22 nt, Human
aagaauuucuugguaagaagcc

SEQ ID NO: 3719986 - RNA, 23 nt, Human
aagaauuucuugguaagaagccg

SEQ ID NO: 3719987 - RNA, 19 nt, Human
aagaauuucuuuauaaaau

SEQ ID NO: 3719988 - RNA, 17 nt, Human
aagaauuugaagacuuc

SEQ ID NO: 3719989 - RNA, 12 nt, Human
aagaauuugcau

SEQ ID NO: 3719990 - RNA, 13 nt, Human
aagaauuugcaua

SEQ ID NO: 3719991 - RNA, 13 nt, Human
aagaauuuuuaaa

SEQ ID NO: 3719992 - RNA, 20 nt, Human
aagaauuuuuuauuuuuugg

SEQ ID NO: 3719993 - RNA, 16 nt, Human
aagacaaaaagcuacu

SEQ ID NO: 3719994 - RNA, 16 nt, Human
aagacaaaaauacucu

SEQ ID NO: 3719995 - RNA, 16 nt, Human
aagacaaaagucuguc

SEQ ID NO: 3719996 - RNA, 17 nt, Human
aagacaaagguuuuccu

SEQ ID NO: 3719997 - RNA, 12 nt, Human
aagacaacacaa

SEQ ID NO: 3719998 - RNA, 15 nt, Human
aagacaacauuaaaa

SEQ ID NO: 3719999 - RNA, 14 nt, Human
aagacaacauugua

SEQ ID NO: 3720000 - RNA, 23 nt, Human
aagacaagugaugcuaaaaccug

SEQ ID NO: 3720001 - RNA, 22 nt, Human
aagacaaugacuuacuguacau

SEQ ID NO: 3720002 - RNA, 19 nt, Human
aagacaaugugaaaagaaa

SEQ ID NO: 3720003 - RNA, 20 nt, Human
aagacaauuugauacauaau

SEQ ID NO: 3720004 - RNA, 21 nt, Human
aagacacauuuuuuaggaaau

SEQ ID NO: 3720005 - RNA, 16 nt, Human
aagacaccagagcaga

SEQ ID NO: 3720006 - RNA, 20 nt, Human
aagacaccagagcagaugca

SEQ ID NO: 3720007 - RNA, 19 nt, Human
aagacacugcagaaacccu

SEQ ID NO: 3720008 - RNA, 12 nt, Human
aagacacugccu

SEQ ID NO: 3720009 - RNA, 13 nt, Human
aagacacugccug

SEQ ID NO: 3720010 - RNA, 15 nt, Human
aagacacugccuggg

SEQ ID NO: 3720011 - RNA, 20 nt, Human
aagacagaaccacagggcua

SEQ ID NO: 3720012 - RNA, 12 nt, Human
aagacagaagcc

SEQ ID NO: 3720013 - RNA, 13 nt, Human
aagacagaagccu

SEQ ID NO: 3720014 - RNA, 22 nt, Human
aagacagagccccacccucaga

SEQ ID NO: 3720015 - RNA, 16 nt, Human
aagacagagcugggau

SEQ ID NO: 3720016 - RNA, 22 nt, Human
aagacagcuucucauccugcag

SEQ ID NO: 3720017 - RNA, 20 nt, Human
aagacaggaaaguucagagu

SEQ ID NO: 3720018 - RNA, 23 nt, Human
aagacaggacagugcuucagccu

SEQ ID NO: 3720019 - RNA, 22 nt, Human
aagacaggagagauuauuuaca

SEQ ID NO: 3720020 - RNA, 22 nt, Human
aagacauaacguuuuuccuuua

SEQ ID NO: 3720021 - RNA, 15 nt, Human
aagacauaucucuaa

SEQ ID NO: 3720022 - RNA, 14 nt, Human
aagacaugauuucc

SEQ ID NO: 3720023 - RNA, 15 nt, Human
aagacaugauuuccu

SEQ ID NO: 3720024 - RNA, 16 nt, Human
aagacaugauuuccuu

SEQ ID NO: 3720025 - RNA, 12 nt, Human
aagacaugucug

SEQ ID NO: 3720026 - RNA, 17 nt, Human
aagacaugucuguucua

SEQ ID NO: 3720027 - RNA, 16 nt, Human
aagacauguuguaaau

SEQ ID NO: 3720028 - RNA, 18 nt, Human
aagacauguuguaaauua

SEQ ID NO: 3720029 - RNA, 13 nt, Human
aagacauguuuua

SEQ ID NO: 3720030 - RNA, 14 nt, Human
aagacauguuuuag

SEQ ID NO: 3720031 - RNA, 22 nt, Human
aagacauugggucuauuccagc

SEQ ID NO: 3720032 - RNA, 13 nt, Human
aagacauugucaa

SEQ ID NO: 3720033 - RNA, 14 nt, Human
aagacauugucaau

SEQ ID NO: 3720034 - RNA, 18 nt, Human
aagacauuuauacucuuu

SEQ ID NO: 3720035 - RNA, 14 nt, Human
aagacauuucuuuu

SEQ ID NO: 3720036 - RNA, 15 nt, Human
aagacauuucuuuuc

SEQ ID NO: 3720037 - RNA, 21 nt, Human
aagacauuucuuuucuuuuua

SEQ ID NO: 3720038 - RNA, 19 nt, Human
aagaccaaaaugacaauga

SEQ ID NO: 3720039 - RNA, 16 nt, Human
aagaccaccaccucag

SEQ ID NO: 3720040 - RNA, 19 nt, Human
aagaccaccaccucagagu

SEQ ID NO: 3720041 - RNA, 18 nt, Human
aagaccaccacuucgaaa

SEQ ID NO: 3720042 - RNA, 15 nt, Human
aagaccacguuucua

SEQ ID NO: 3720043 - RNA, 14 nt, Human
aagaccagaaauuc

SEQ ID NO: 3720044 - RNA, 19 nt, Human
aagacccaacacaugggac

SEQ ID NO: 3720045 - RNA, 13 nt, Human
aagaccccaccca

SEQ ID NO: 3720046 - RNA, 13 nt, Human
aagacccccagca

SEQ ID NO: 3720047 - RNA, 15 nt, Human
aagaccccugacuca

SEQ ID NO: 3720048 - RNA, 14 nt, Human
aagaccccugucuu

SEQ ID NO: 3720049 - RNA, 13 nt, Human
aagacccugucuc

SEQ ID NO: 3720050 - RNA, 17 nt, Human
aagacccuuuuggguuu

SEQ ID NO: 3720051 - RNA, 17 nt, Human
aagaccuacuguucuaa

SEQ ID NO: 3720052 - RNA, 18 nt, Human
aagaccuacuguucuaaa

SEQ ID NO: 3720053 - RNA, 16 nt, Human
aagaccucaccuagaa

SEQ ID NO: 3720054 - RNA, 13 nt, Human
aagaccucuguga

SEQ ID NO: 3720055 - RNA, 20 nt, Human
aagaccuucuccccauucug

SEQ ID NO: 3720056 - RNA, 15 nt, Human
aagaccuucuccuuc

SEQ ID NO: 3720057 - RNA, 19 nt, Human
aagaccuucuccuucaccu

SEQ ID NO: 3720058 - RNA, 22 nt, Human
aagaccuuguguguauguguac

SEQ ID NO: 3720059 - RNA, 21 nt, Human
aagaccuuuggagcaaagcug

SEQ ID NO: 3720060 - RNA, 15 nt, Human
aagaccuuuuucugc

SEQ ID NO: 3720061 - RNA, 14 nt, Human
aagacgcccucuau

SEQ ID NO: 3720062 - RNA, 14 nt, Human
aagacgccugagcu

SEQ ID NO: 3720063 - RNA, 17 nt, Human
aagacgcugugcugccc

SEQ ID NO: 3720064 - RNA, 19 nt, Human
aagacgcugugcugcccug

SEQ ID NO: 3720065 - RNA, 18 nt, Human
aagacgucccuuuuuucu

SEQ ID NO: 3720066 - RNA, 22 nt, Human
aagacgugauuuugcuguagaa

SEQ ID NO: 3720067 - RNA, 15 nt, Human
aagacguguuugugu

SEQ ID NO: 3720068 - RNA, 16 nt, Human
aagacuaauuuaaaaa

SEQ ID NO: 3720069 - RNA, 19 nt, Human
aagacuaauuuaaaaaaua

SEQ ID NO: 3720070 - RNA, 20 nt, Human
aagacuagaggcuugcauaa

SEQ ID NO: 3720071 - RNA, 21 nt, Human
aagacuauauauauaaaugua

SEQ ID NO: 3720072 - RNA, 20 nt, Human
aagacuauccaacuuaacau

SEQ ID NO: 3720073 - RNA, 15 nt, Human
aagacuaugaaaaug

SEQ ID NO: 3720074 - RNA, 16 nt, Human
aagacucaaauguucu

SEQ ID NO: 3720075 - RNA, 17 nt, Human
aagacucaaauguucua

SEQ ID NO: 3720076 - RNA, 21 nt, Human
aagacucaagugggaacgacu

SEQ ID NO: 3720077 - RNA, 21 nt, Human
uccaggcuguaucccaugagc

SEQ ID NO: 3720078 - RNA, 22 nt, Human
uccaggcuuucccacuucccac

SEQ ID NO: 3720079 - RNA, 18 nt, Human
uccagggaagcuggccga

SEQ ID NO: 3720080 - RNA, 15 nt, Human
uccagggacagaggc

SEQ ID NO: 3720081 - RNA, 21 nt, Human
uccagggacagaggccccagc

SEQ ID NO: 3720082 - RNA, 14 nt, Human
uccagggacagcaa

SEQ ID NO: 3720083 - RNA, 15 nt, Human
uccagggagccuaga

SEQ ID NO: 3720084 - RNA, 18 nt, Human
uccagggaguccccuccc

SEQ ID NO: 3720085 - RNA, 22 nt, Human
uccagggaugauucaagccauu

SEQ ID NO: 3720086 - RNA, 17 nt, Human
uccagggcccccaucuc

SEQ ID NO: 3720087 - RNA, 13 nt, Human
uccagggcccuga

SEQ ID NO: 3720088 - RNA, 20 nt, Human
uccagggcccugagcucggu

SEQ ID NO: 3720089 - RNA, 14 nt, Human
uccagggcuaguga

SEQ ID NO: 3720090 - RNA, 19 nt, Human
uccagggcuggacugaggc

SEQ ID NO: 3720091 - RNA, 18 nt, Human
uccagggggaaggccaag

SEQ ID NO: 3720092 - RNA, 20 nt, Human
uccaggggugggacacccug

SEQ ID NO: 3720093 - RNA, 22 nt, Human
uccaggggugggacacccugug

SEQ ID NO: 3720094 - RNA, 23 nt, Human
uccaggggugggacacccuguga

SEQ ID NO: 3720095 - RNA, 14 nt, Human
uccaggguggcagc

SEQ ID NO: 3720096 - RNA, 18 nt, Human
uccaggguggcagcaaca

SEQ ID NO: 3720097 - RNA, 20 nt, Human
uccaggguggcagcaacaau

SEQ ID NO: 3720098 - RNA, 21 nt, Human
uccaggguucucuuguuuuga

SEQ ID NO: 3720099 - RNA, 18 nt, Human
uccaggguugaucacacu

SEQ ID NO: 3720100 - RNA, 20 nt, Human
uccagguacgcacagacagg

SEQ ID NO: 3720101 - RNA, 17 nt, Human
uccagguaucuccagga

SEQ ID NO: 3720102 - RNA, 16 nt, Human
uccaggucaacagaau

SEQ ID NO: 3720103 - RNA, 18 nt, Human
uccaggucaacagaauga

SEQ ID NO: 3720104 - RNA, 19 nt, Human
uccaggucaacagaaugaa

SEQ ID NO: 3720105 - RNA, 14 nt, Human
uccaggucgggcuc

SEQ ID NO: 3720106 - RNA, 16 nt, Human
uccaggucucacgggc

SEQ ID NO: 3720107 - RNA, 22 nt, Human
uccaggugcacaagcuccaagc

SEQ ID NO: 3720108 - RNA, 13 nt, Human
uccaggugcccag

SEQ ID NO: 3720109 - RNA, 15 nt, Human
uccagguucagcuug

SEQ ID NO: 3720110 - RNA, 16 nt, Human
uccagguucagcuugu

SEQ ID NO: 3720111 - RNA, 20 nt, Human
uccagguucccucccagagg

SEQ ID NO: 3720112 - RNA, 17 nt, Human
uccagguuuaagcuguu

SEQ ID NO: 3720113 - RNA, 20 nt, Human
uccagguuuaagcuguuacu

SEQ ID NO: 3720114 - RNA, 17 nt, Human
uccagguuuuucaauua

SEQ ID NO: 3720115 - RNA, 23 nt, Human
uccagguuuuucaauuaaacgga

SEQ ID NO: 3720116 - RNA, 15 nt, Human
uccaguaagaucacu

SEQ ID NO: 3720117 - RNA, 20 nt, Human
uccaguaagaucacuguuua

SEQ ID NO: 3720118 - RNA, 21 nt, Human
uccaguaagaucacuguuuag

SEQ ID NO: 3720119 - RNA, 18 nt, Human
uccaguaaggaaugauau

SEQ ID NO: 3720120 - RNA, 15 nt, Human
uccaguaaucuaaua

SEQ ID NO: 3720121 - RNA, 21 nt, Human
uccaguacuggagcuucucuu

SEQ ID NO: 3720122 - RNA, 14 nt, Human
uccaguaucuugaa

SEQ ID NO: 3720123 - RNA, 14 nt, Human
uccaguauuuuagu

SEQ ID NO: 3720124 - RNA, 13 nt, Human
uccagucaggcuc

SEQ ID NO: 3720125 - RNA, 20 nt, Human
uccagucaggcucucugggc

SEQ ID NO: 3720126 - RNA, 14 nt, Human
uccagucauuaugu

SEQ ID NO: 3720127 - RNA, 15 nt, Human
uccagucauuauguu

SEQ ID NO: 3720128 - RNA, 23 nt, Human
uccagucauuauguuaauauuuc

SEQ ID NO: 3720129 - RNA, 23 nt, Human
uccaguccaaggaaaccacagcu

SEQ ID NO: 3720130 - RNA, 16 nt, Human
uccaguccccagaacu

SEQ ID NO: 3720131 - RNA, 18 nt, Human
uccagucccccuauccuu

SEQ ID NO: 3720132 - RNA, 22 nt, Human
uccaguccuaucugggcuuccu

SEQ ID NO: 3720133 - RNA, 23 nt, Human
uccaguccuaucugggcuuccug

SEQ ID NO: 3720134 - RNA, 13 nt, Human
uccaguccugcuc

SEQ ID NO: 3720135 - RNA, 21 nt, Human
uccaguccugcucucuaccca

SEQ ID NO: 3720136 - RNA, 16 nt, Human
uccagucuccaccagg

SEQ ID NO: 3720137 - RNA, 14 nt, Human
uccagucucuugua

SEQ ID NO: 3720138 - RNA, 16 nt, Human
uccagucugcugcccu

SEQ ID NO: 3720139 - RNA, 19 nt, Human
uccagucugcugcccucca

SEQ ID NO: 3720140 - RNA, 20 nt, Human
uccagucugcugcccuccau

SEQ ID NO: 3720141 - RNA, 22 nt, Human
uccagucuuccugacacuuuaa

SEQ ID NO: 3720142 - RNA, 23 nt, Human
uccagucuuccugacacuuuaau

SEQ ID NO: 3720143 - RNA, 12 nt, Human
uccagugacuuu

SEQ ID NO: 3720144 - RNA, 14 nt, Human
uccagugagacagc

SEQ ID NO: 3720145 - RNA, 17 nt, Human
uccagugaggcucugcc

SEQ ID NO: 3720146 - RNA, 14 nt, Human
uccagugcaauugu

SEQ ID NO: 3720147 - RNA, 14 nt, Human
uccagugccagcaa

SEQ ID NO: 3720148 - RNA, 20 nt, Human
uccagugcccauuccucacc

SEQ ID NO: 3720149 - RNA, 19 nt, Human
uccaguggaagaagaaaac

SEQ ID NO: 3720150 - RNA, 17 nt, Human
uccaguggaucauaaga

SEQ ID NO: 3720151 - RNA, 19 nt, Human
uccaguggggcaagauuuu

SEQ ID NO: 3720152 - RNA, 22 nt, Human
uccagugguccauggaaugcuu

SEQ ID NO: 3720153 - RNA, 12 nt, Human
uccaguggugaa

SEQ ID NO: 3720154 - RNA, 19 nt, Human
uccaguggugaagaaaacu

SEQ ID NO: 3720155 - RNA, 13 nt, Human
uccagugguucug

SEQ ID NO: 3720156 - RNA, 19 nt, Human
uccagugguugcuguugau

SEQ ID NO: 3720157 - RNA, 16 nt, Human
uccaguguccugagcu

SEQ ID NO: 3720158 - RNA, 16 nt, Human
uccagugucucggagg

SEQ ID NO: 3720159 - RNA, 19 nt, Human
uccagugugggcuugacca

SEQ ID NO: 3720160 - RNA, 18 nt, Human
uccaguuaauuacauccu

SEQ ID NO: 3720161 - RNA, 13 nt, Human
uccaguuauaaga

SEQ ID NO: 3720162 - RNA, 15 nt, Human
uccaguuauaagaag

SEQ ID NO: 3720163 - RNA, 19 nt, Human
uccaguuucagaguucuca

SEQ ID NO: 3720164 - RNA, 12 nt, Human
uccaguuuguuu

SEQ ID NO: 3720165 - RNA, 15 nt, Human
uccaguuuuguuugg

SEQ ID NO: 3720166 - RNA, 20 nt, Human
uccaguuuuuuguuauauag

SEQ ID NO: 3720167 - RNA, 15 nt, Human
uccauaaaaaaaaau

SEQ ID NO: 3720168 - RNA, 19 nt, Human
uccauaaaaaaaaauagau

SEQ ID NO: 3720169 - RNA, 21 nt, Human
uccauaaagaagauguuuaac

SEQ ID NO: 3720170 - RNA, 13 nt, Human
uccauaaagaagc

SEQ ID NO: 3720171 - RNA, 13 nt, Human
uccauaaagaccc

SEQ ID NO: 3720172 - RNA, 17 nt, Human
uccauaaccccacccuu

SEQ ID NO: 3720173 - RNA, 14 nt, Human
uccauaacugaaca

SEQ ID NO: 3720174 - RNA, 22 nt, Human
uccauaaucuggacuccucugu

SEQ ID NO: 3720175 - RNA, 18 nt, Human
uccauaaugcuacugucu

SEQ ID NO: 3720176 - RNA, 17 nt, Human
uccauaauguucugcua

SEQ ID NO: 3720177 - RNA, 21 nt, Human
uccauaauuaugacaguuaua

SEQ ID NO: 3720178 - RNA, 18 nt, Human
uccauaauuccauaugcu

SEQ ID NO: 3720179 - RNA, 17 nt, Human
uccauagaccuuuucau

SEQ ID NO: 3720180 - RNA, 17 nt, Human
uccauagagagcaagac

SEQ ID NO: 3720181 - RNA, 16 nt, Human
uccauagcaacaggaa

SEQ ID NO: 3720182 - RNA, 21 nt, Human
uccauagccuaaucccugggc

SEQ ID NO: 3720183 - RNA, 15 nt, Human
uccauagcugcugcc

SEQ ID NO: 3720184 - RNA, 15 nt, Human
uccauagcuguggug

SEQ ID NO: 3720185 - RNA, 15 nt, Human
uccauaguaacugac

SEQ ID NO: 3720186 - RNA, 18 nt, Human
uccauaguaguaugauga

SEQ ID NO: 3720187 - RNA, 14 nt, Human
uccauagugacuuu

SEQ ID NO: 3720188 - RNA, 16 nt, Human
uccauaguuuggcauu

SEQ ID NO: 3720189 - RNA, 13 nt, Human
uccauauaaauau

SEQ ID NO: 3720190 - RNA, 19 nt, Human
uccauauaaauauuagaaa

SEQ ID NO: 3720191 - RNA, 20 nt, Human
uccauauauccuuuucuucu

SEQ ID NO: 3720192 - RNA, 17 nt, Human
uccauauauuagcauuu

SEQ ID NO: 3720193 - RNA, 18 nt, Human
uccauauauuagcauuua

SEQ ID NO: 3720194 - RNA, 13 nt, Human
uccauaucacaca

SEQ ID NO: 3720195 - RNA, 14 nt, Human
uccauauccuggug

SEQ ID NO: 3720196 - RNA, 14 nt, Human
uccauaucuaacca

SEQ ID NO: 3720197 - RNA, 19 nt, Human
uccauaucuaaccagugau

SEQ ID NO: 3720198 - RNA, 19 nt, Human
uccauauggauccacuggc

SEQ ID NO: 3720199 - RNA, 21 nt, Human
uccauauggauccacuggcug

SEQ ID NO: 3720200 - RNA, 13 nt, Human
uccauauggauuu

SEQ ID NO: 3720201 - RNA, 18 nt, Human
uccauauggauuuucuau

SEQ ID NO: 3720202 - RNA, 13 nt, Human
uccauauuagaaa

SEQ ID NO: 3720203 - RNA, 14 nt, Human
uccauauuauugug

SEQ ID NO: 3720204 - RNA, 18 nt, Human
uccauauuuuauuacugu

SEQ ID NO: 3720205 - RNA, 23 nt, Human
uccauauuuuauuacuguuuauu

SEQ ID NO: 3720206 - RNA, 12 nt, Human
uccauauuuuca

SEQ ID NO: 3720207 - RNA, 16 nt, Human
uccauauuuuuuuccu

SEQ ID NO: 3720208 - RNA, 16 nt, Human
uccaucacuauaauaa

SEQ ID NO: 3720209 - RNA, 16 nt, Human
uccaucagaugacaag

SEQ ID NO: 3720210 - RNA, 22 nt, Human
uccaucagcuuaggggcugcug

SEQ ID NO: 3720211 - RNA, 14 nt, Human
uccaucaggccacu

SEQ ID NO: 3720212 - RNA, 21 nt, Human
uccaucaggugaggugugcuc

SEQ ID NO: 3720213 - RNA, 12 nt, Human
uccaucaugucc

SEQ ID NO: 3720214 - RNA, 11 nt, Human
uccauccaauc

SEQ ID NO: 3720215 - RNA, 18 nt, Human
uccauccaccuuucccaa

SEQ ID NO: 3720216 - RNA, 19 nt, Human
uccaucccaacagccaugc

SEQ ID NO: 3720217 - RNA, 21 nt, Human
uccaucccaggacaccacacc

SEQ ID NO: 3720218 - RNA, 14 nt, Human
uccaucccaucauc

SEQ ID NO: 3720219 - RNA, 18 nt, Human
uccaucccuacccccuaa

SEQ ID NO: 3720220 - RNA, 22 nt, Human
uccaucccuggcccccucccug

SEQ ID NO: 3720221 - RNA, 24 nt, Human
uccaucccuggcccccucccugga

SEQ ID NO: 3720222 - RNA, 21 nt, Human
uccauccugaggcuccacuug

SEQ ID NO: 3720223 - RNA, 17 nt, Human
uccauccuuucugccuc

SEQ ID NO: 3720224 - RNA, 14 nt, Human
uccaucuaaaaaua

SEQ ID NO: 3720225 - RNA, 16 nt, Human
uccaucuaaaaauaua

SEQ ID NO: 3720226 - RNA, 21 nt, Human
uccaucuaaaaauauacaugu

SEQ ID NO: 3720227 - RNA, 19 nt, Human
gcuugaugggauucuggac

SEQ ID NO: 3720228 - RNA, 20 nt, Human
gcuugaugggauucuggaca

SEQ ID NO: 3720229 - RNA, 14 nt, Human
gcuugauucugcag

SEQ ID NO: 3720230 - RNA, 19 nt, Human
gcuugcacuuuguaacaug

SEQ ID NO: 3720231 - RNA, 21 nt, Human
gcuugcaguagauuuucuuua

SEQ ID NO: 3720232 - RNA, 21 nt, Human
gcuugccaaaguacagaauuu

SEQ ID NO: 3720233 - RNA, 23 nt, Human
gcuugcccaguacauuuaaauuu

SEQ ID NO: 3720234 - RNA, 12 nt, Human
gcuugccccggc

SEQ ID NO: 3720235 - RNA, 17 nt, Human
gcuugccgaaacuggaa

SEQ ID NO: 3720236 - RNA, 13 nt, Human
gcuugccuagggc

SEQ ID NO: 3720237 - RNA, 17 nt, Human
gcuugccuagggccugg

SEQ ID NO: 3720238 - RNA, 21 nt, Human
gcuugccuagggccuggucca

SEQ ID NO: 3720239 - RNA, 20 nt, Human
gcuugccucggcuccugcug

SEQ ID NO: 3720240 - RNA, 22 nt, Human
gcuugccucggcuccugcugca

SEQ ID NO: 3720241 - RNA, 15 nt, Human
gcuugccucucuguu

SEQ ID NO: 3720242 - RNA, 19 nt, Human
gcuugccugauauaaaugc

SEQ ID NO: 3720243 - RNA, 17 nt, Human
gcuugccugcagggcca

SEQ ID NO: 3720244 - RNA, 21 nt, Human
gcuugcgaacuagagaugugc

SEQ ID NO: 3720245 - RNA, 22 nt, Human
gcuugcguuagaaugaggagga

SEQ ID NO: 3720246 - RNA, 22 nt, Human
gcuugcuagcuaugugaccuug

SEQ ID NO: 3720247 - RNA, 20 nt, Human
gcuugcuauucugucccuag

SEQ ID NO: 3720248 - RNA, 14 nt, Human
gcuugcuuuucaug

SEQ ID NO: 3720249 - RNA, 18 nt, Human
gcuuggaaacuggaugag

SEQ ID NO: 3720250 - RNA, 23 nt, Human
gcuuggaagagccugcaggugcu

SEQ ID NO: 3720251 - RNA, 16 nt, Human
gcuuggagcagagggg

SEQ ID NO: 3720252 - RNA, 15 nt, Human
gcuuggagcugagca

SEQ ID NO: 3720253 - RNA, 13 nt, Human
gcuuggaggaagg

SEQ ID NO: 3720254 - RNA, 17 nt, Human
gcuuggccacagccagg

SEQ ID NO: 3720255 - RNA, 13 nt, Human
gcuuggccagaag

SEQ ID NO: 3720256 - RNA, 14 nt, Human
gcuuggcccagggg

SEQ ID NO: 3720257 - RNA, 14 nt, Human
gcuuggcccuggca

SEQ ID NO: 3720258 - RNA, 15 nt, Human
gcuuggccugcugug

SEQ ID NO: 3720259 - RNA, 15 nt, Human
gcuugggaauuuuau

SEQ ID NO: 3720260 - RNA, 14 nt, Human
gcuugggacaaauc

SEQ ID NO: 3720261 - RNA, 15 nt, Human
gcuugggauuugcug

SEQ ID NO: 3720262 - RNA, 15 nt, Human
gcuugggcccagcug

SEQ ID NO: 3720263 - RNA, 14 nt, Human
gcuugggccuaggc

SEQ ID NO: 3720264 - RNA, 19 nt, Human
gcuugggccuaggcugcau

SEQ ID NO: 3720265 - RNA, 21 nt, Human
gcuugggccuaggcugcauug

SEQ ID NO: 3720266 - RNA, 23 nt, Human
gcuugggcuuccauuugugugug

SEQ ID NO: 3720267 - RNA, 17 nt, Human
gcuuggggaccagagcu

SEQ ID NO: 3720268 - RNA, 24 nt, Human
gcuugggggaugacuagaggcagg

SEQ ID NO: 3720269 - RNA, 20 nt, Human
gcuuggguggagaagccauu

SEQ ID NO: 3720270 - RNA, 21 nt, Human
gcuuggguggagaagccauug

SEQ ID NO: 3720271 - RNA, 22 nt, Human
gcuugguggaugaaaugucagu

SEQ ID NO: 3720272 - RNA, 22 nt, Human
gcuugguguuuguaagaaaaug

SEQ ID NO: 3720273 - RNA, 15 nt, Human
gcuugguuccuuccc

SEQ ID NO: 3720274 - RNA, 19 nt, Human
gcuuguaaauagcucaggu

SEQ ID NO: 3720275 - RNA, 15 nt, Human
gcuuguaacaagaaa

SEQ ID NO: 3720276 - RNA, 17 nt, Human
gcuuguaacaagaaaac

SEQ ID NO: 3720277 - RNA, 23 nt, Human
gcuuguaacuaaaauaauuuugu

SEQ ID NO: 3720278 - RNA, 15 nt, Human
gcuuguaacuccacc

SEQ ID NO: 3720279 - RNA, 14 nt, Human
gcuuguacauaaug

SEQ ID NO: 3720280 - RNA, 19 nt, Human
gcuuguacauaaugcgugc

SEQ ID NO: 3720281 - RNA, 16 nt, Human
gcuuguaccucuggcu

SEQ ID NO: 3720282 - RNA, 18 nt, Human
gcuuguagaacucacucu

SEQ ID NO: 3720283 - RNA, 19 nt, Human
gcuuguagaacucacucug

SEQ ID NO: 3720284 - RNA, 13 nt, Human
gcuuguagccagc

SEQ ID NO: 3720285 - RNA, 22 nt, Human
gcuuguagccagccggggcgag

SEQ ID NO: 3720286 - RNA, 22 nt, Human
gcuuguaggggaggggcuccuu

SEQ ID NO: 3720287 - RNA, 16 nt, Human
gcuuguaguucuuuaa

SEQ ID NO: 3720288 - RNA, 17 nt, Human
gcuuguaguucuuuaaa

SEQ ID NO: 3720289 - RNA, 18 nt, Human
gcuuguaugcaauggauu

SEQ ID NO: 3720290 - RNA, 13 nt, Human
gcuugucagagcu

SEQ ID NO: 3720291 - RNA, 14 nt, Human
gcuugucagagcug

SEQ ID NO: 3720292 - RNA, 15 nt, Human
gcuugucagagcugg

SEQ ID NO: 3720293 - RNA, 17 nt, Human
gcuugucauagccagug

SEQ ID NO: 3720294 - RNA, 16 nt, Human
gcuuguccccuccuca

SEQ ID NO: 3720295 - RNA, 16 nt, Human
gcuugucccugcccag

SEQ ID NO: 3720296 - RNA, 20 nt, Human
gcuugucuauacuccuuccc

SEQ ID NO: 3720297 - RNA, 18 nt, Human
gcuugugaaaauguguuc

SEQ ID NO: 3720298 - RNA, 16 nt, Human
gcuugugaucugggaa

SEQ ID NO: 3720299 - RNA, 22 nt, Human
gcuugugcagaaaacauuguuc

SEQ ID NO: 3720300 - RNA, 19 nt, Human
gcuuguggggacccaggcu

SEQ ID NO: 3720301 - RNA, 13 nt, Human
gcuuguggggccu

SEQ ID NO: 3720302 - RNA, 18 nt, Human
gcuuguggggccugggag

SEQ ID NO: 3720303 - RNA, 19 nt, Human
gcuuguggggccugggagg

SEQ ID NO: 3720304 - RNA, 18 nt, Human
gcuuguguauccauuauc

SEQ ID NO: 3720305 - RNA, 15 nt, Human
gcuuguguguuucac

SEQ ID NO: 3720306 - RNA, 21 nt, Human
gcuuguuaaugcuuucugaag

SEQ ID NO: 3720307 - RNA, 17 nt, Human
gcuuguuaucagcuuuc

SEQ ID NO: 3720308 - RNA, 15 nt, Human
gcuuguuauuuauaa

SEQ ID NO: 3720309 - RNA, 18 nt, Human
gcuuguucccucucccug

SEQ ID NO: 3720310 - RNA, 18 nt, Human
gcuuguugggauuccuga

SEQ ID NO: 3720311 - RNA, 22 nt, Human
gcuuguugggauuccugaccca

SEQ ID NO: 3720312 - RNA, 14 nt, Human
gcuuguuguaaagc

SEQ ID NO: 3720313 - RNA, 19 nt, Human
gcuuguuugcucaccuggg

SEQ ID NO: 3720314 - RNA, 21 nt, Human
gcuuguuugcucaccuggggu

SEQ ID NO: 3720315 - RNA, 21 nt, Human
gcuuuaaaaagggaagaaacu

SEQ ID NO: 3720316 - RNA, 14 nt, Human
gcuuuaaaauucuc

SEQ ID NO: 3720317 - RNA, 17 nt, Human
gcuuuaaacaaauucau

SEQ ID NO: 3720318 - RNA, 16 nt, Human
gcuuuaaacacccuuc

SEQ ID NO: 3720319 - RNA, 22 nt, Human
gcuuuaaacucagggacagagc

SEQ ID NO: 3720320 - RNA, 15 nt, Human
gcuuuaaaguguaau

SEQ ID NO: 3720321 - RNA, 19 nt, Human
gcuuuaaccauuaaaacug

SEQ ID NO: 3720322 - RNA, 16 nt, Human
gcuuuaauauaaaugc

SEQ ID NO: 3720323 - RNA, 20 nt, Human
gcuuuaauuccaugaauguu

SEQ ID NO: 3720324 - RNA, 14 nt, Human
gcuuuaccaaacag

SEQ ID NO: 3720325 - RNA, 17 nt, Human
gcuuuaccaaacagcaa

SEQ ID NO: 3720326 - RNA, 20 nt, Human
gcuuuaccuuuucagggcug

SEQ ID NO: 3720327 - RNA, 23 nt, Human
gcuuuacugucaaaauaauuuua

SEQ ID NO: 3720328 - RNA, 21 nt, Human
gcuuuacuuagcuuaucaauu

SEQ ID NO: 3720329 - RNA, 16 nt, Human
gcuuuagaaucccagc

SEQ ID NO: 3720330 - RNA, 20 nt, Human
gcuuuagaauguuuuccuuc

SEQ ID NO: 3720331 - RNA, 21 nt, Human
gcuuuagacacuggcugccag

SEQ ID NO: 3720332 - RNA, 14 nt, Human
gcuuuagacccugg

SEQ ID NO: 3720333 - RNA, 17 nt, Human
gcuuuagacuugaaaag

SEQ ID NO: 3720334 - RNA, 24 nt, Human
gcuuuagacuugaaaagagacagg

SEQ ID NO: 3720335 - RNA, 20 nt, Human
gcuuuaggcauaugcuucuu

SEQ ID NO: 3720336 - RNA, 21 nt, Human
gcuuuaguggccaucauuucu

SEQ ID NO: 3720337 - RNA, 10 nt, Human
gcuuuauaaa

SEQ ID NO: 3720338 - RNA, 20 nt, Human
gcuuuauccucuuuagaguu

SEQ ID NO: 3720339 - RNA, 21 nt, Human
gcuuuaugauaauagauucuc

SEQ ID NO: 3720340 - RNA, 15 nt, Human
gcuuuaugauuuuca

SEQ ID NO: 3720341 - RNA, 17 nt, Human
gcuuuauuccagaaugc

SEQ ID NO: 3720342 - RNA, 22 nt, Human
gcuuuauucuucagauacaaac

SEQ ID NO: 3720343 - RNA, 18 nt, Human
gcuuuauuuugagaugua

SEQ ID NO: 3720344 - RNA, 17 nt, Human
gcuuuauuuuuuaagua

SEQ ID NO: 3720345 - RNA, 20 nt, Human
gcuuucaagaccccugucuu

SEQ ID NO: 3720346 - RNA, 16 nt, Human
gcuuucaauuccguag

SEQ ID NO: 3720347 - RNA, 15 nt, Human
gcuuucagaauaugu

SEQ ID NO: 3720348 - RNA, 14 nt, Human
gcuuucagggccuc

SEQ ID NO: 3720349 - RNA, 22 nt, Human
gcuuucaucacaaauccaaagg

SEQ ID NO: 3720350 - RNA, 21 nt, Human
gcuuucauguaaacugugcac

SEQ ID NO: 3720351 - RNA, 19 nt, Human
gcuuucauuuucucucagg

SEQ ID NO: 3720352 - RNA, 21 nt, Human
gcuuuccccaugucucgacuc

SEQ ID NO: 3720353 - RNA, 12 nt, Human
gcuuuccccugu

SEQ ID NO: 3720354 - RNA, 14 nt, Human
gcuuuccccugugg

SEQ ID NO: 3720355 - RNA, 22 nt, Human
gcuuuccccuguggggaucuca

SEQ ID NO: 3720356 - RNA, 15 nt, Human
gcuuuccuaaaacag

SEQ ID NO: 3720357 - RNA, 19 nt, Human
gcuuuccucaucaggccau

SEQ ID NO: 3720358 - RNA, 12 nt, Human
gcuuuccugaau

SEQ ID NO: 3720359 - RNA, 12 nt, Human
gcuuuccugccc

SEQ ID NO: 3720360 - RNA, 23 nt, Human
gcuuuccuggagagucucacucc

SEQ ID NO: 3720361 - RNA, 13 nt, Human
gcuuuccugugcc

SEQ ID NO: 3720362 - RNA, 17 nt, Human
gcuuuccugugccaggu

SEQ ID NO: 3720363 - RNA, 19 nt, Human
gcuuuccuuguggcagagg

SEQ ID NO: 3720364 - RNA, 22 nt, Human
gcuuuccuuuuucccaauaaau

SEQ ID NO: 3720365 - RNA, 16 nt, Human
gcuuucgaacugcuag

SEQ ID NO: 3720366 - RNA, 20 nt, Human
gcuuucguccacagcuuccu

SEQ ID NO: 3720367 - RNA, 13 nt, Human
gcuuucuacccag

SEQ ID NO: 3720368 - RNA, 19 nt, Human
gcuuucuacccagcgagcc

SEQ ID NO: 3720369 - RNA, 12 nt, Human
gcuuucuagaag

SEQ ID NO: 3720370 - RNA, 15 nt, Human
gcuuucuauuguaca

SEQ ID NO: 3720371 - RNA, 19 nt, Human
gcuuucuccuuuaauugua

SEQ ID NO: 3720372 - RNA, 20 nt, Human
gcuuucucugcuucagcuug

SEQ ID NO: 3720373 - RNA, 14 nt, Human
gcuuucucuucaua

SEQ ID NO: 3720374 - RNA, 14 nt, Human
gcuuucucuuuucu

SEQ ID NO: 3720375 - RNA, 18 nt, Human
gcuuucugaacagcuggu

SEQ ID NO: 3720376 - RNA, 16 nt, Human
uccucaaacacugcag

SEQ ID NO: 3720377 - RNA, 13 nt, Human
uccucaauccagc

SEQ ID NO: 3720378 - RNA, 20 nt, Human
uccucaauuccaacacugau

SEQ ID NO: 3720379 - RNA, 20 nt, Human
uccucacaacauggugucug

SEQ ID NO: 3720380 - RNA, 19 nt, Human
uccucacacacccugaggu

SEQ ID NO: 3720381 - RNA, 15 nt, Human
uccucacacuuacug

SEQ ID NO: 3720382 - RNA, 23 nt, Human
uccucacacuuacuguaagacau

SEQ ID NO: 3720383 - RNA, 16 nt, Human
uccucacccccagcuu

SEQ ID NO: 3720384 - RNA, 20 nt, Human
uccucaccccgucugggguu

SEQ ID NO: 3720385 - RNA, 21 nt, Human
uccucaccccuguccucacug

SEQ ID NO: 3720386 - RNA, 12 nt, Human
uccucaccucug

SEQ ID NO: 3720387 - RNA, 22 nt, Human
uccucaccuuuucccggggagg

SEQ ID NO: 3720388 - RNA, 13 nt, Human
uccucacucccag

SEQ ID NO: 3720389 - RNA, 12 nt, Human
uccucacucccu

SEQ ID NO: 3720390 - RNA, 14 nt, Human
uccucacucccuuc

SEQ ID NO: 3720391 - RNA, 21 nt, Human
uccucacucccuucccauaag

SEQ ID NO: 3720392 - RNA, 16 nt, Human
uccucacucccuucua

SEQ ID NO: 3720393 - RNA, 23 nt, Human
uccucacucggguuucucugugg

SEQ ID NO: 3720394 - RNA, 15 nt, Human
uccucacugcccgca

SEQ ID NO: 3720395 - RNA, 13 nt, Human
uccucacugcucc

SEQ ID NO: 3720396 - RNA, 18 nt, Human
uccucacuggccaucccu

SEQ ID NO: 3720397 - RNA, 14 nt, Human
uccucacuguaucc

SEQ ID NO: 3720398 - RNA, 21 nt, Human
uccucagacucuaagaaagaa

SEQ ID NO: 3720399 - RNA, 11 nt, Human
uccucagacug

SEQ ID NO: 3720400 - RNA, 17 nt, Human
uccucagagaauuucua

SEQ ID NO: 3720401 - RNA, 12 nt, Human
uccucagccagc

SEQ ID NO: 3720402 - RNA, 13 nt, Human
uccucagccagcc

SEQ ID NO: 3720403 - RNA, 16 nt, Human
uccucagccagccucg

SEQ ID NO: 3720404 - RNA, 11 nt, Human
uccucagccuu

SEQ ID NO: 3720405 - RNA, 20 nt, Human
uccucagccuugccagagau

SEQ ID NO: 3720406 - RNA, 21 nt, Human
uccucaggagccgaagcccag

SEQ ID NO: 3720407 - RNA, 17 nt, Human
uccucaggcacacagcu

SEQ ID NO: 3720408 - RNA, 22 nt, Human
uccucaggcacacagcuacucu

SEQ ID NO: 3720409 - RNA, 19 nt, Human
uccucaggcugcuggagga

SEQ ID NO: 3720410 - RNA, 23 nt, Human
uccucagguggccaugccucagc

SEQ ID NO: 3720411 - RNA, 22 nt, Human
uccucaguaaguguuagaggga

SEQ ID NO: 3720412 - RNA, 16 nt, Human
uccucaguccauuuau

SEQ ID NO: 3720413 - RNA, 23 nt, Human
uccucaguccauuuauauaugaa

SEQ ID NO: 3720414 - RNA, 14 nt, Human
uccucauacccacc

SEQ ID NO: 3720415 - RNA, 18 nt, Human
uccucauacccaccccca

SEQ ID NO: 3720416 - RNA, 22 nt, Human
uccucauaguaugguggcuggg

SEQ ID NO: 3720417 - RNA, 15 nt, Human
uccucauauggccca

SEQ ID NO: 3720418 - RNA, 19 nt, Human
uccucaucugggggagugg

SEQ ID NO: 3720419 - RNA, 17 nt, Human
uccucaugaauguaaau

SEQ ID NO: 3720420 - RNA, 23 nt, Human
uccucaugucuucucacaagcca

SEQ ID NO: 3720421 - RNA, 19 nt, Human
uccucauuguaaacaaacu

SEQ ID NO: 3720422 - RNA, 23 nt, Human
uccuccaaaggaagucuaggagc

SEQ ID NO: 3720423 - RNA, 17 nt, Human
uccuccaagaaucuauc

SEQ ID NO: 3720424 - RNA, 16 nt, Human
uccuccacauccuuuc

SEQ ID NO: 3720425 - RNA, 15 nt, Human
uccuccaccaccgcc

SEQ ID NO: 3720426 - RNA, 17 nt, Human
uccuccaccucaacucc

SEQ ID NO: 3720427 - RNA, 22 nt, Human
uccuccacguucugcucaucau

SEQ ID NO: 3720428 - RNA, 12 nt, Human
uccuccagaacu

SEQ ID NO: 3720429 - RNA, 19 nt, Human
uccuccagaagccucuggc

SEQ ID NO: 3720430 - RNA, 20 nt, Human
uccuccagaagccucuggcu

SEQ ID NO: 3720431 - RNA, 10 nt, Human
uccuccagcu

SEQ ID NO: 3720432 - RNA, 21 nt, Human
uccuccagcugcaccagagca

SEQ ID NO: 3720433 - RNA, 13 nt, Human
uccuccaggagcu

SEQ ID NO: 3720434 - RNA, 21 nt, Human
uccuccagggaugaucaacag

SEQ ID NO: 3720435 - RNA, 19 nt, Human
uccuccagggccacgugcc

SEQ ID NO: 3720436 - RNA, 22 nt, Human
uccuccagggugauuuuaugau

SEQ ID NO: 3720437 - RNA, 14 nt, Human
uccuccaggugcac

SEQ ID NO: 3720438 - RNA, 22 nt, Human
uccuccaggugcacaagcucca

SEQ ID NO: 3720439 - RNA, 13 nt, Human
uccuccagguuuu

SEQ ID NO: 3720440 - RNA, 20 nt, Human
uccuccaucccaacagccau

SEQ ID NO: 3720441 - RNA, 17 nt, Human
uccucccaaguggugcc

SEQ ID NO: 3720442 - RNA, 19 nt, Human
uccucccaaguggugccua

SEQ ID NO: 3720443 - RNA, 21 nt, Human
uccucccacccggcugcagag

SEQ ID NO: 3720444 - RNA, 18 nt, Human
uccucccaccucagccuc

SEQ ID NO: 3720445 - RNA, 16 nt, Human
uccucccacugcccac

SEQ ID NO: 3720446 - RNA, 20 nt, Human
uccucccacuucagccuccc

SEQ ID NO: 3720447 - RNA, 12 nt, Human
uccucccagaaa

SEQ ID NO: 3720448 - RNA, 19 nt, Human
uccucccaggaagcccagg

SEQ ID NO: 3720449 - RNA, 23 nt, Human
uccucccaggaagcccaggagcc

SEQ ID NO: 3720450 - RNA, 11 nt, Human
uccucccaggg

SEQ ID NO: 3720451 - RNA, 19 nt, Human
uccucccaugucacugcag

SEQ ID NO: 3720452 - RNA, 21 nt, Human
uccucccauguuaugcccagc

SEQ ID NO: 3720453 - RNA, 19 nt, Human
uccuccccaaggagacaca

SEQ ID NO: 3720454 - RNA, 15 nt, Human
uccucccccugccag

SEQ ID NO: 3720455 - RNA, 17 nt, Human
uccucccccugccagug

SEQ ID NO: 3720456 - RNA, 24 nt, Human
uccucccccugccagugccuuacc

SEQ ID NO: 3720457 - RNA, 18 nt, Human
uccuccccucacagccuc

SEQ ID NO: 3720458 - RNA, 21 nt, Human
uccuccccucacagccucuga

SEQ ID NO: 3720459 - RNA, 20 nt, Human
uccuccccuccuccuggacu

SEQ ID NO: 3720460 - RNA, 14 nt, Human
uccuccccuggagg

SEQ ID NO: 3720461 - RNA, 14 nt, Human
uccuccccuucccu

SEQ ID NO: 3720462 - RNA, 18 nt, Human
uccuccccuucccugcaa

SEQ ID NO: 3720463 - RNA, 14 nt, Human
uccuccccuugggc

SEQ ID NO: 3720464 - RNA, 17 nt, Human
uccucccgagcuccucu

SEQ ID NO: 3720465 - RNA, 16 nt, Human
uccucccgggcccucc

SEQ ID NO: 3720466 - RNA, 13 nt, Human
uccucccucccag

SEQ ID NO: 3720467 - RNA, 15 nt, Human
uccucccucccucuu

SEQ ID NO: 3720468 - RNA, 14 nt, Human
uccucccugcaucu

SEQ ID NO: 3720469 - RNA, 12 nt, Human
uccucccuggcu

SEQ ID NO: 3720470 - RNA, 18 nt, Human
uccucccuggcugcccug

SEQ ID NO: 3720471 - RNA, 19 nt, Human
uccucccugggcagaaagu

SEQ ID NO: 3720472 - RNA, 11 nt, Human
uccucccugua

SEQ ID NO: 3720473 - RNA, 13 nt, Human
uccucccuuccuu

SEQ ID NO: 3720474 - RNA, 17 nt, Human
uccucccuucugcuacu

SEQ ID NO: 3720475 - RNA, 20 nt, Human
uccucccuuggguucugaua

SEQ ID NO: 3720476 - RNA, 18 nt, Human
uccucccuuuccuuccua

SEQ ID NO: 3720477 - RNA, 17 nt, Human
uccuccgguugcauacu

SEQ ID NO: 3720478 - RNA, 18 nt, Human
uccuccguccagccgcca

SEQ ID NO: 3720479 - RNA, 12 nt, Human
uccuccucaccu

SEQ ID NO: 3720480 - RNA, 12 nt, Human
uccuccucaggc

SEQ ID NO: 3720481 - RNA, 15 nt, Human
uccuccuccagggac

SEQ ID NO: 3720482 - RNA, 16 nt, Human
uccuccuccagggaca

SEQ ID NO: 3720483 - RNA, 17 nt, Human
uccuccuccagggacag

SEQ ID NO: 3720484 - RNA, 14 nt, Human
uccuccuccagggu

SEQ ID NO: 3720485 - RNA, 14 nt, Human
uccuccucccugca

SEQ ID NO: 3720486 - RNA, 18 nt, Human
uccuccucccugcaucug

SEQ ID NO: 3720487 - RNA, 13 nt, Human
uccuccucuguga

SEQ ID NO: 3720488 - RNA, 12 nt, Human
uccuccucuuuc

SEQ ID NO: 3720489 - RNA, 15 nt, Human
uccuccucuuucucu

SEQ ID NO: 3720490 - RNA, 19 nt, Human
uccuccucuuucucucccc

SEQ ID NO: 3720491 - RNA, 13 nt, Human
uccuccugacacc

SEQ ID NO: 3720492 - RNA, 22 nt, Human
uccuccugagugaucccauuuc

SEQ ID NO: 3720493 - RNA, 15 nt, Human
uccuccugcagacca

SEQ ID NO: 3720494 - RNA, 16 nt, Human
uccuccugcccaccug

SEQ ID NO: 3720495 - RNA, 12 nt, Human
uccuccugcuca

SEQ ID NO: 3720496 - RNA, 11 nt, Human
uccuccuggaa

SEQ ID NO: 3720497 - RNA, 15 nt, Human
uccuccugggcccuc

SEQ ID NO: 3720498 - RNA, 21 nt, Human
uccuccugguggguccagggg

SEQ ID NO: 3720499 - RNA, 16 nt, Human
uccuccuguauuccug

SEQ ID NO: 3720500 - RNA, 16 nt, Human
uccuccuguguacagg

SEQ ID NO: 3720501 - RNA, 15 nt, Human
uccuccuucacuguu

SEQ ID NO: 3720502 - RNA, 15 nt, Human
uccuccuuccaugga

SEQ ID NO: 3720503 - RNA, 13 nt, Human
uccuccuucuuca

SEQ ID NO: 3720504 - RNA, 16 nt, Human
uccuccuuggugccug

SEQ ID NO: 3720505 - RNA, 17 nt, Human
uccuccuuggugccugg

SEQ ID NO: 3720506 - RNA, 19 nt, Human
uccuccuuggugccuggcc

SEQ ID NO: 3720507 - RNA, 16 nt, Human
uccuccuuuccuccuc

SEQ ID NO: 3720508 - RNA, 16 nt, Human
uccucgagaucccaac

SEQ ID NO: 3720509 - RNA, 17 nt, Human
uccucgagggcagggac

SEQ ID NO: 3720510 - RNA, 15 nt, Human
uccucgcaagcuggg

SEQ ID NO: 3720511 - RNA, 23 nt, Human
uccucgcagagaggccaggugca

SEQ ID NO: 3720512 - RNA, 14 nt, Human
uccucgcagccucu

SEQ ID NO: 3720513 - RNA, 19 nt, Human
uccucgcagccucucagug

SEQ ID NO: 3720514 - RNA, 13 nt, Human
uccucgcccuggg

SEQ ID NO: 3720515 - RNA, 14 nt, Human
uccucgcccugggu

SEQ ID NO: 3720516 - RNA, 15 nt, Human
uccucgccugacaac

SEQ ID NO: 3720517 - RNA, 16 nt, Human
uccucggaucaccgag

SEQ ID NO: 3720518 - RNA, 14 nt, Human
uccucggccuggcu

SEQ ID NO: 3720519 - RNA, 15 nt, Human
uccucggccuggcuc

SEQ ID NO: 3720520 - RNA, 17 nt, Human
uccucguuccuuucucc

SEQ ID NO: 3720521 - RNA, 19 nt, Human
uccucguucucccugggag

SEQ ID NO: 3720522 - RNA, 13 nt, Human
uccucguuugugu

SEQ ID NO: 3720523 - RNA, 16 nt, Human
uccucguuuguguucu

SEQ ID NO: 3720524 - RNA, 21 nt, Human
uccucuaacaggggcuggugg

SEQ ID NO: 3720525 - RNA, 21 nt, Human
uccucuaagccacucuuccaa

SEQ ID NO: 3720526 - RNA, 19 nt, Human
uccucuagaagccaaggga

SEQ ID NO: 3720527 - RNA, 18 nt, Human
uccaucuccaagaaugcu

SEQ ID NO: 3720528 - RNA, 20 nt, Human
uccaucuccaagaaugcuga

SEQ ID NO: 3720529 - RNA, 12 nt, Human
uccaucuccuug

SEQ ID NO: 3720530 - RNA, 16 nt, Human
uccaucucgccacccc

SEQ ID NO: 3720531 - RNA, 23 nt, Human
uccaucucuauauaaaaacaaaa

SEQ ID NO: 3720532 - RNA, 16 nt, Human
uccaucucucuggccc

SEQ ID NO: 3720533 - RNA, 14 nt, Human
uccaucucugacuu

SEQ ID NO: 3720534 - RNA, 22 nt, Human
uccaucugcccgccugcccacc

SEQ ID NO: 3720535 - RNA, 22 nt, Human
uccaucugguagaagggaaagc

SEQ ID NO: 3720536 - RNA, 16 nt, Human
uccaucuucuuugcag

SEQ ID NO: 3720537 - RNA, 13 nt, Human
uccaucuuuacaa

SEQ ID NO: 3720538 - RNA, 15 nt, Human
uccaugaaaacguuu

SEQ ID NO: 3720539 - RNA, 16 nt, Human
uccaugaaaaugcaac

SEQ ID NO: 3720540 - RNA, 22 nt, Human
uccaugaagauguagaggagaa

SEQ ID NO: 3720541 - RNA, 23 nt, Human
uccaugacaauaugcccuuucug

SEQ ID NO: 3720542 - RNA, 20 nt, Human
uccaugaccuaguuuuccau

SEQ ID NO: 3720543 - RNA, 17 nt, Human
uccaugacugcauuuua

SEQ ID NO: 3720544 - RNA, 15 nt, Human
uccaugacugcuugc

SEQ ID NO: 3720545 - RNA, 15 nt, Human
uccaugagcacccca

SEQ ID NO: 3720546 - RNA, 15 nt, Human
uccaugaugcuggga

SEQ ID NO: 3720547 - RNA, 15 nt, Human
uccaugauggaguca

SEQ ID NO: 3720548 - RNA, 12 nt, Human
uccaugauucua

SEQ ID NO: 3720549 - RNA, 13 nt, Human
uccaugccugagg

SEQ ID NO: 3720550 - RNA, 19 nt, Human
uccaugcguguuucugacu

SEQ ID NO: 3720551 - RNA, 20 nt, Human
uccaugcguguuucugacuc

SEQ ID NO: 3720552 - RNA, 21 nt, Human
uccaugcuccucacugcccgc

SEQ ID NO: 3720553 - RNA, 22 nt, Human
uccaugcuccucacugcccgca

SEQ ID NO: 3720554 - RNA, 14 nt, Human
uccaugcugccucc

SEQ ID NO: 3720555 - RNA, 20 nt, Human
uccaugcugugcgcccaggg

SEQ ID NO: 3720556 - RNA, 23 nt, Human
uccaugcuucucaucuugugaaa

SEQ ID NO: 3720557 - RNA, 15 nt, Human
uccauggacuuuguu

SEQ ID NO: 3720558 - RNA, 14 nt, Human
uccauggauuuugg

SEQ ID NO: 3720559 - RNA, 14 nt, Human
uccauggccagcag

SEQ ID NO: 3720560 - RNA, 16 nt, Human
uccauggccagcagca

SEQ ID NO: 3720561 - RNA, 23 nt, Human
uccauggcgaaaacaucuccuua

SEQ ID NO: 3720562 - RNA, 17 nt, Human
uccaugggauacaaccu

SEQ ID NO: 3720563 - RNA, 16 nt, Human
uccaugggcagagccc

SEQ ID NO: 3720564 - RNA, 15 nt, Human
uccaugggggcaggg

SEQ ID NO: 3720565 - RNA, 15 nt, Human
uccaugggguaggag

SEQ ID NO: 3720566 - RNA, 21 nt, Human
uccauggguuccaguuucaga

SEQ ID NO: 3720567 - RNA, 16 nt, Human
uccauggugccucugg

SEQ ID NO: 3720568 - RNA, 17 nt, Human
uccauggugccucugga

SEQ ID NO: 3720569 - RNA, 15 nt, Human
uccauguaacugccu

SEQ ID NO: 3720570 - RNA, 21 nt, Human
uccauguacuguaguuuuucu

SEQ ID NO: 3720571 - RNA, 14 nt, Human
uccaugucaagauu

SEQ ID NO: 3720572 - RNA, 17 nt, Human
uccauguccuaugugug

SEQ ID NO: 3720573 - RNA, 18 nt, Human
uccaugugaucucauugu

SEQ ID NO: 3720574 - RNA, 19 nt, Human
uccauguggacuuaggaag

SEQ ID NO: 3720575 - RNA, 11 nt, Human
uccaugugugu

SEQ ID NO: 3720576 - RNA, 13 nt, Human
uccaugugugugc

SEQ ID NO: 3720577 - RNA, 18 nt, Human
uccaugugugugcaagug

SEQ ID NO: 3720578 - RNA, 17 nt, Human
uccauguugcugccaac

SEQ ID NO: 3720579 - RNA, 19 nt, Human
uccauguuggcuagccucu

SEQ ID NO: 3720580 - RNA, 19 nt, Human
uccauguuggucaggcugg

SEQ ID NO: 3720581 - RNA, 19 nt, Human
uccauuaaagucugaauca

SEQ ID NO: 3720582 - RNA, 14 nt, Human
uccauuaggauuug

SEQ ID NO: 3720583 - RNA, 17 nt, Human
uccauuaggccagcaac

SEQ ID NO: 3720584 - RNA, 20 nt, Human
uccauuaggccagcaacgcu

SEQ ID NO: 3720585 - RNA, 13 nt, Human
uccauuaucaugu

SEQ ID NO: 3720586 - RNA, 16 nt, Human
uccauuaucaugugua

SEQ ID NO: 3720587 - RNA, 17 nt, Human
uccauuaucauguguaa

SEQ ID NO: 3720588 - RNA, 11 nt, Human
uccauuauuua

SEQ ID NO: 3720589 - RNA, 12 nt, Human
uccauuauuuau

SEQ ID NO: 3720590 - RNA, 15 nt, Human
uccauuauuuauauu

SEQ ID NO: 3720591 - RNA, 12 nt, Human
uccauuccagaa

SEQ ID NO: 3720592 - RNA, 10 nt, Human
uccauuccca

SEQ ID NO: 3720593 - RNA, 20 nt, Human
uccauucccaacuagacauu

SEQ ID NO: 3720594 - RNA, 16 nt, Human
uccauucucccaggua

SEQ ID NO: 3720595 - RNA, 14 nt, Human
uccauucuccugag

SEQ ID NO: 3720596 - RNA, 16 nt, Human
uccauugacauguaca

SEQ ID NO: 3720597 - RNA, 17 nt, Human
uccauugacauguacag

SEQ ID NO: 3720598 - RNA, 18 nt, Human
uccauugacauguacaga

SEQ ID NO: 3720599 - RNA, 20 nt, Human
uccauugacauguacagaga

SEQ ID NO: 3720600 - RNA, 16 nt, Human
uccauuggaucucauu

SEQ ID NO: 3720601 - RNA, 22 nt, Human
uccauugguuuaccugugaaau

SEQ ID NO: 3720602 - RNA, 20 nt, Human
uccauuguuugaaacaaaga

SEQ ID NO: 3720603 - RNA, 21 nt, Human
uccauuguuugaaacaaagaa

SEQ ID NO: 3720604 - RNA, 19 nt, Human
uccauuguuuggagacauu

SEQ ID NO: 3720605 - RNA, 14 nt, Human
uccauuuaaacaga

SEQ ID NO: 3720606 - RNA, 21 nt, Human
uccauuuaaacagauguccau

SEQ ID NO: 3720607 - RNA, 17 nt, Human
uccauuuaauaauuaua

SEQ ID NO: 3720608 - RNA, 22 nt, Human
uccauuuacuuaagacuuaaug

SEQ ID NO: 3720609 - RNA, 15 nt, Human
uccauuuauauauga

SEQ ID NO: 3720610 - RNA, 17 nt, Human
uccauuuauauaugaaa

SEQ ID NO: 3720611 - RNA, 18 nt, Human
uccauuuauauaugaaaa

SEQ ID NO: 3720612 - RNA, 23 nt, Human
uccauuuauauaugaaaacuaua

SEQ ID NO: 3720613 - RNA, 15 nt, Human
uccauuuccauugcu

SEQ ID NO: 3720614 - RNA, 12 nt, Human
uccauuucuaau

SEQ ID NO: 3720615 - RNA, 13 nt, Human
uccauuucuaauu

SEQ ID NO: 3720616 - RNA, 17 nt, Human
uccauuucucauguuuu

SEQ ID NO: 3720617 - RNA, 16 nt, Human
uccauuucucucucca

SEQ ID NO: 3720618 - RNA, 18 nt, Human
uccauuucucucuccagu

SEQ ID NO: 3720619 - RNA, 15 nt, Human
uccauuugcauuugu

SEQ ID NO: 3720620 - RNA, 12 nt, Human
uccauuuggaaa

SEQ ID NO: 3720621 - RNA, 21 nt, Human
uccauuuucccccacuacugc

SEQ ID NO: 3720622 - RNA, 18 nt, Human
uccauuuuccuacaggca

SEQ ID NO: 3720623 - RNA, 13 nt, Human
uccauuuugugaa

SEQ ID NO: 3720624 - RNA, 23 nt, Human
ucccaaaaguaucgggggcuggg

SEQ ID NO: 3720625 - RNA, 14 nt, Human
ucccaaaauuguuu

SEQ ID NO: 3720626 - RNA, 15 nt, Human
ucccaaacgccuccc

SEQ ID NO: 3720627 - RNA, 21 nt, Human
ucccaaacuaagcuaugugaa

SEQ ID NO: 3720628 - RNA, 14 nt, Human
ucccaaagcaagca

SEQ ID NO: 3720629 - RNA, 16 nt, Human
ucccaaagcagugcau

SEQ ID NO: 3720630 - RNA, 17 nt, Human
ucccaaagcagugcaug

SEQ ID NO: 3720631 - RNA, 13 nt, Human
ucccaaagugcug

SEQ ID NO: 3720632 - RNA, 19 nt, Human
ucccaaagugcugagauua

SEQ ID NO: 3720633 - RNA, 15 nt, Human
ucccaaagugcuggg

SEQ ID NO: 3720634 - RNA, 20 nt, Human
ucccaaagugcugggauuac

SEQ ID NO: 3720635 - RNA, 16 nt, Human
ucccaaauccuuccca

SEQ ID NO: 3720636 - RNA, 16 nt, Human
ucccaaauuucauacc

SEQ ID NO: 3720637 - RNA, 19 nt, Human
ucccaacacaaggugggca

SEQ ID NO: 3720638 - RNA, 16 nt, Human
ucccaacacugccagc

SEQ ID NO: 3720639 - RNA, 16 nt, Human
ucccaacagccaugcc

SEQ ID NO: 3720640 - RNA, 11 nt, Human
ucccaacagga

SEQ ID NO: 3720641 - RNA, 18 nt, Human
ucccaacaggaggacaau

SEQ ID NO: 3720642 - RNA, 20 nt, Human
ucccaacaggaggacaauuc

SEQ ID NO: 3720643 - RNA, 19 nt, Human
ucccaaccagugccaagga

SEQ ID NO: 3720644 - RNA, 23 nt, Human
ucccaaccagugccaaggaccuc

SEQ ID NO: 3720645 - RNA, 21 nt, Human
ucccaaccccuuaagcccugg

SEQ ID NO: 3720646 - RNA, 22 nt, Human
ucccaaccccuuaagcccuggc

SEQ ID NO: 3720647 - RNA, 19 nt, Human
ucccaacucaccccagccc

SEQ ID NO: 3720648 - RNA, 15 nt, Human
ucccaacucuagcug

SEQ ID NO: 3720649 - RNA, 17 nt, Human
ucccaacucuagcuggg

SEQ ID NO: 3720650 - RNA, 14 nt, Human
ucccaacugcaagu

SEQ ID NO: 3720651 - RNA, 21 nt, Human
ucccaacuucucuugcuuucu

SEQ ID NO: 3720652 - RNA, 20 nt, Human
ucccaagaaaggaaaccuuu

SEQ ID NO: 3720653 - RNA, 13 nt, Human
ucccaagaaaugc

SEQ ID NO: 3720654 - RNA, 16 nt, Human
ucccaagaaugcaaga

SEQ ID NO: 3720655 - RNA, 13 nt, Human
ucccaagagcuac

SEQ ID NO: 3720656 - RNA, 18 nt, Human
ucccaagaucugugcagc

SEQ ID NO: 3720657 - RNA, 16 nt, Human
ucccaagcggugucuc

SEQ ID NO: 3720658 - RNA, 17 nt, Human
ucccaagcggugucucu

SEQ ID NO: 3720659 - RNA, 16 nt, Human
ucccaagcucagaggc

SEQ ID NO: 3720660 - RNA, 15 nt, Human
ucccaagcucugcuc

SEQ ID NO: 3720661 - RNA, 15 nt, Human
ucccaagcuggcugg

SEQ ID NO: 3720662 - RNA, 12 nt, Human
ucccaagcuggg

SEQ ID NO: 3720663 - RNA, 13 nt, Human
ucccaagcugggc

SEQ ID NO: 3720664 - RNA, 15 nt, Human
ucccaagcugggccc

SEQ ID NO: 3720665 - RNA, 21 nt, Human
ucccaagcugggccccagccc

SEQ ID NO: 3720666 - RNA, 18 nt, Human
ucccaaggaaagccccag

SEQ ID NO: 3720667 - RNA, 16 nt, Human
ucccaaggagaacaaa

SEQ ID NO: 3720668 - RNA, 18 nt, Human
ucccaaggggccugagca

SEQ ID NO: 3720669 - RNA, 16 nt, Human
ucccaagguuacuuaa

SEQ ID NO: 3720670 - RNA, 20 nt, Human
ucccaagguuacuuaauuca

SEQ ID NO: 3720671 - RNA, 17 nt, Human
ucccaagguuggagccc

SEQ ID NO: 3720672 - RNA, 17 nt, Human
ucccaaguagaaucuca

SEQ ID NO: 3720673 - RNA, 20 nt, Human
ucccaaguagcugagacuac

SEQ ID NO: 3720674 - RNA, 21 nt, Human
ucccaaguagcugggauuaca

SEQ ID NO: 3720675 - RNA, 13 nt, Human
ucccaaguccaca

SEQ ID NO: 3720676 - RNA, 14 nt, Human
ucccaagucuacag

SEQ ID NO: 3720677 - RNA, 17 nt, Human
ucccaagugagucucuc

SEQ ID NO: 3720678 - RNA, 21 nt, Human
gcuuucugaacagcuggugua

SEQ ID NO: 3720679 - RNA, 17 nt, Human
gcuuucugaucaaggcc

SEQ ID NO: 3720680 - RNA, 21 nt, Human
gcuuucugcucagcuucuccu

SEQ ID NO: 3720681 - RNA, 14 nt, Human
gcuuucuggggccu

SEQ ID NO: 3720682 - RNA, 17 nt, Human
gcuuucuggggccuagc

SEQ ID NO: 3720683 - RNA, 15 nt, Human
gcuuucuguuccaaa

SEQ ID NO: 3720684 - RNA, 16 nt, Human
gcuuucuguuccaaau

SEQ ID NO: 3720685 - RNA, 15 nt, Human
gcuuucuguugucau

SEQ ID NO: 3720686 - RNA, 22 nt, Human
gcuuucuguugucauugcuguu

SEQ ID NO: 3720687 - RNA, 13 nt, Human
gcuuucuugcugg

SEQ ID NO: 3720688 - RNA, 17 nt, Human
gcuuucuugcugguugu

SEQ ID NO: 3720689 - RNA, 17 nt, Human
gcuuucuuugauucucc

SEQ ID NO: 3720690 - RNA, 19 nt, Human
gcuuucuuugauucuccuu

SEQ ID NO: 3720691 - RNA, 18 nt, Human
gcuuucuuuuuaaagcuu

SEQ ID NO: 3720692 - RNA, 14 nt, Human
gcuuugacucaccu

SEQ ID NO: 3720693 - RNA, 16 nt, Human
gcuuugacucaggagc

SEQ ID NO: 3720694 - RNA, 15 nt, Human
gcuuugacugagcag

SEQ ID NO: 3720695 - RNA, 22 nt, Human
gcuuugacugagcagacuggug

SEQ ID NO: 3720696 - RNA, 16 nt, Human
gcuuugagagagaaag

SEQ ID NO: 3720697 - RNA, 12 nt, Human
gcuuugauauau

SEQ ID NO: 3720698 - RNA, 15 nt, Human
gcuuugaucccugac

SEQ ID NO: 3720699 - RNA, 21 nt, Human
gcuuugauguuccuuccagug

SEQ ID NO: 3720700 - RNA, 21 nt, Human
gcuuugauuaauccagaauaa

SEQ ID NO: 3720701 - RNA, 20 nt, Human
uccuuacgcuuugucacaca

SEQ ID NO: 3720702 - RNA, 16 nt, Human
uccuuacucccaggca

SEQ ID NO: 3720703 - RNA, 17 nt, Human
uccuuacuuuuuauaua

SEQ ID NO: 3720704 - RNA, 19 nt, Human
uccuuagaaaaaaaauuau

SEQ ID NO: 3720705 - RNA, 14 nt, Human
uccuuagaagugga

SEQ ID NO: 3720706 - RNA, 20 nt, Human
uccuuagagguccucuggag

SEQ ID NO: 3720707 - RNA, 13 nt, Human
uccuuagccugga

SEQ ID NO: 3720708 - RNA, 14 nt, Human
uccuuagccuggac

SEQ ID NO: 3720709 - RNA, 15 nt, Human
uccuuagccuggacc

SEQ ID NO: 3720710 - RNA, 22 nt, Human
uccuuagccuggaccucugaca

SEQ ID NO: 3720711 - RNA, 16 nt, Human
uccuuagcugccaagc

SEQ ID NO: 3720712 - RNA, 19 nt, Human
uccuuagcuuagaccucag

SEQ ID NO: 3720713 - RNA, 20 nt, Human
uccuuagcuuagaccucagc

SEQ ID NO: 3720714 - RNA, 21 nt, Human
uccuuagcuuagaccucagcc

SEQ ID NO: 3720715 - RNA, 22 nt, Human
uccuuagcuuagaccucagccu

SEQ ID NO: 3720716 - RNA, 23 nt, Human
uccuuagcuuagaccucagccug

SEQ ID NO: 3720717 - RNA, 18 nt, Human
uccccaccgcagacagga

SEQ ID NO: 3720718 - RNA, 21 nt, Human
uccccaccgcagacaggacca

SEQ ID NO: 3720719 - RNA, 14 nt, Human
uccccaccuccagg

SEQ ID NO: 3720720 - RNA, 23 nt, Human
uccccaccuucaauuccugggcc

SEQ ID NO: 3720721 - RNA, 20 nt, Human
uccccaccuucuucagccac

SEQ ID NO: 3720722 - RNA, 14 nt, Human
uccccacgccacag

SEQ ID NO: 3720723 - RNA, 19 nt, Human
uccccacgccacagcccuu

SEQ ID NO: 3720724 - RNA, 22 nt, Human
uccccacgccacagcccuuuug

SEQ ID NO: 3720725 - RNA, 14 nt, Human
uccccacgcccucc

SEQ ID NO: 3720726 - RNA, 18 nt, Human
uccccacucugcucugau

SEQ ID NO: 3720727 - RNA, 20 nt, Human
uccccacucugcucugaugc

SEQ ID NO: 3720728 - RNA, 14 nt, Human
uccccacugccugc

SEQ ID NO: 3720729 - RNA, 18 nt, Human
uccccacugccugcccac

SEQ ID NO: 3720730 - RNA, 22 nt, Human
uccccacugccugcccacccgu

SEQ ID NO: 3720731 - RNA, 12 nt, Human
uccccacuggag

SEQ ID NO: 3720732 - RNA, 14 nt, Human
uccccacuggagca

SEQ ID NO: 3720733 - RNA, 17 nt, Human
uccccagaacucugccu

SEQ ID NO: 3720734 - RNA, 21 nt, Human
uccccagaacucugccugccc

SEQ ID NO: 3720735 - RNA, 13 nt, Human
uccccagaccuga

SEQ ID NO: 3720736 - RNA, 22 nt, Human
uccccagacuccaccaagccug

SEQ ID NO: 3720737 - RNA, 21 nt, Human
uccccagagcacuggguugca

SEQ ID NO: 3720738 - RNA, 20 nt, Human
uccccagaguuccccaugca

SEQ ID NO: 3720739 - RNA, 20 nt, Human
uccccagauugcaacaggcu

SEQ ID NO: 3720740 - RNA, 20 nt, Human
uccccagcaagugagagcug

SEQ ID NO: 3720741 - RNA, 21 nt, Human
uccccagcaagugagagcugg

SEQ ID NO: 3720742 - RNA, 14 nt, Human
uccccagccagccu

SEQ ID NO: 3720743 - RNA, 20 nt, Human
uccccagccagccuggcugg

SEQ ID NO: 3720744 - RNA, 12 nt, Human
uccccagcccag

SEQ ID NO: 3720745 - RNA, 13 nt, Human
uccccagcccagg

SEQ ID NO: 3720746 - RNA, 15 nt, Human
uccccagccccuagc

SEQ ID NO: 3720747 - RNA, 19 nt, Human
uccccagccccuagcccag

SEQ ID NO: 3720748 - RNA, 15 nt, Human
uccccagcccuaaga

SEQ ID NO: 3720749 - RNA, 18 nt, Human
uccccagcccuggcucug

SEQ ID NO: 3720750 - RNA, 12 nt, Human
uccccagccucu

SEQ ID NO: 3720751 - RNA, 14 nt, Human
uccccagccucucu

SEQ ID NO: 3720752 - RNA, 16 nt, Human
uccccagccucucuuc

SEQ ID NO: 3720753 - RNA, 22 nt, Human
uccccagccucucuuccuaucc

SEQ ID NO: 3720754 - RNA, 12 nt, Human
uccccagccugc

SEQ ID NO: 3720755 - RNA, 17 nt, Human
uccccagccugcgccug

SEQ ID NO: 3720756 - RNA, 20 nt, Human
uccccagccugcgccugcug

SEQ ID NO: 3720757 - RNA, 14 nt, Human
uccccagccuggga

SEQ ID NO: 3720758 - RNA, 16 nt, Human
uccccagccugggccc

SEQ ID NO: 3720759 - RNA, 21 nt, Human
uccccagccugggcccaucuc

SEQ ID NO: 3720760 - RNA, 22 nt, Human
uccccagcgucccagucucugg

SEQ ID NO: 3720761 - RNA, 22 nt, Human
uccccagcucaccccuggagga

SEQ ID NO: 3720762 - RNA, 14 nt, Human
uccccagcuguuua

SEQ ID NO: 3720763 - RNA, 21 nt, Human
uccccaggaggccagccuuga

SEQ ID NO: 3720764 - RNA, 16 nt, Human
uccccaggcaccucac

SEQ ID NO: 3720765 - RNA, 16 nt, Human
uccccaggccaggcca

SEQ ID NO: 3720766 - RNA, 19 nt, Human
uccccaggccccaggaagc

SEQ ID NO: 3720767 - RNA, 20 nt, Human
uccccaggccccaggaagcc

SEQ ID NO: 3720768 - RNA, 21 nt, Human
uccccaggccccaggaagccg

SEQ ID NO: 3720769 - RNA, 21 nt, Human
uccccaggccguggcugccca

SEQ ID NO: 3720770 - RNA, 23 nt, Human
uccccagggaagcagcagccucg

SEQ ID NO: 3720771 - RNA, 10 nt, Human
uccccagggg

SEQ ID NO: 3720772 - RNA, 23 nt, Human
uccccaggggagagggucuggag

SEQ ID NO: 3720773 - RNA, 15 nt, Human
uccccaggggaguug

SEQ ID NO: 3720774 - RNA, 23 nt, Human
uccccaggggucccagccacccc

SEQ ID NO: 3720775 - RNA, 16 nt, Human
uccccagguccagcuc

SEQ ID NO: 3720776 - RNA, 14 nt, Human
uccccagugaaaac

SEQ ID NO: 3720777 - RNA, 14 nt, Human
uccccaucauccca

SEQ ID NO: 3720778 - RNA, 17 nt, Human
uccccaucaucccagcu

SEQ ID NO: 3720779 - RNA, 14 nt, Human
uccccauccuccag

SEQ ID NO: 3720780 - RNA, 15 nt, Human
uccccauccuccagc

SEQ ID NO: 3720781 - RNA, 18 nt, Human
uccccauccuccagcuuc

SEQ ID NO: 3720782 - RNA, 18 nt, Human
uccccaucguugccccca

SEQ ID NO: 3720783 - RNA, 22 nt, Human
uccccaucucccugccuggccc

SEQ ID NO: 3720784 - RNA, 14 nt, Human
uccccaucuggguc

SEQ ID NO: 3720785 - RNA, 19 nt, Human
uccccaucuucuaaaccca

SEQ ID NO: 3720786 - RNA, 21 nt, Human
uccccaugcuuaacauacccg

SEQ ID NO: 3720787 - RNA, 23 nt, Human
uccccaugggaagacgaggcccu

SEQ ID NO: 3720788 - RNA, 19 nt, Human
uccccauuuagguuucuga

SEQ ID NO: 3720789 - RNA, 22 nt, Human
ucccccaacauauaaaauaaug

SEQ ID NO: 3720790 - RNA, 19 nt, Human
ucccccaacccccacccca

SEQ ID NO: 3720791 - RNA, 20 nt, Human
ucccccaacccccaccccac

SEQ ID NO: 3720792 - RNA, 21 nt, Human
ucccccaacccccaccccaca

SEQ ID NO: 3720793 - RNA, 22 nt, Human
ucccccaacccccaccccacac

SEQ ID NO: 3720794 - RNA, 17 nt, Human
ucccccaacucugagcc

SEQ ID NO: 3720795 - RNA, 18 nt, Human
ucccccaacucugagccc

SEQ ID NO: 3720796 - RNA, 21 nt, Human
ucccccaacucugagcccaug

SEQ ID NO: 3720797 - RNA, 14 nt, Human
ucccccaacuugag

SEQ ID NO: 3720798 - RNA, 20 nt, Human
ucccccaccgguccagcugg

SEQ ID NO: 3720799 - RNA, 13 nt, Human
ucccccagacuuu

SEQ ID NO: 3720800 - RNA, 21 nt, Human
ucccccagcaaagcccccaga

SEQ ID NO: 3720801 - RNA, 22 nt, Human
ucccccagcaaagcccccagag

SEQ ID NO: 3720802 - RNA, 23 nt, Human
ucccccagcaaagcccccagagc

SEQ ID NO: 3720803 - RNA, 20 nt, Human
ucccccagccaugccagcug

SEQ ID NO: 3720804 - RNA, 23 nt, Human
ucccccagccaugccagcuggcc

SEQ ID NO: 3720805 - RNA, 21 nt, Human
ucccccagccccauccucugu

SEQ ID NO: 3720806 - RNA, 14 nt, Human
ucccccagcccugu

SEQ ID NO: 3720807 - RNA, 15 nt, Human
ucccccagcccugug

SEQ ID NO: 3720808 - RNA, 17 nt, Human
ucccccagcccugugga

SEQ ID NO: 3720809 - RNA, 17 nt, Human
ucccccauccuccccuu

SEQ ID NO: 3720810 - RNA, 18 nt, Human
ucccccauccuccccuuc

SEQ ID NO: 3720811 - RNA, 13 nt, Human
ucccccaucuccc

SEQ ID NO: 3720812 - RNA, 17 nt, Human
ucccccaucucuucugg

SEQ ID NO: 3720813 - RNA, 16 nt, Human
ucccccauguucuguc

SEQ ID NO: 3720814 - RNA, 17 nt, Human
uccccccacaagugccc

SEQ ID NO: 3720815 - RNA, 22 nt, Human
uccccccacaagugcccuccag

SEQ ID NO: 3720816 - RNA, 13 nt, Human
uccccccacugca

SEQ ID NO: 3720817 - RNA, 23 nt, Human
uccccccacugcaggccccgcuu

SEQ ID NO: 3720818 - RNA, 15 nt, Human
uccccccaucuugcu

SEQ ID NO: 3720819 - RNA, 17 nt, Human
uccccccuccucugaaa

SEQ ID NO: 3720820 - RNA, 14 nt, Human
ucccccgccacucc

SEQ ID NO: 3720821 - RNA, 19 nt, Human
ucccccgccgcuuuucucc

SEQ ID NO: 3720822 - RNA, 22 nt, Human
ucccccgggaggggcccgcuug

SEQ ID NO: 3720823 - RNA, 19 nt, Human
ucccccuccuucccagcug

SEQ ID NO: 3720824 - RNA, 21 nt, Human
ucccccuccuucccagcugcc

SEQ ID NO: 3720825 - RNA, 12 nt, Human
ucccccucuguc

SEQ ID NO: 3720826 - RNA, 15 nt, Human
ucccccucuguccag

SEQ ID NO: 3720827 - RNA, 13 nt, Human
ucccccugcagcu

SEQ ID NO: 3720828 - RNA, 14 nt, Human
ucccccugcagcua

SEQ ID NO: 3720829 - RNA, 15 nt, Human
ucccccugcccucgu

SEQ ID NO: 3720830 - RNA, 21 nt, Human
ucccccuggccaccacccccc

SEQ ID NO: 3720831 - RNA, 20 nt, Human
ucccccuggggcuucuccug

SEQ ID NO: 3720832 - RNA, 15 nt, Human
ucccccuguccccuc

SEQ ID NO: 3720833 - RNA, 21 nt, Human
ucccccuguuucagaggcuca

SEQ ID NO: 3720834 - RNA, 15 nt, Human
ucccccuucacaaag

SEQ ID NO: 3720835 - RNA, 15 nt, Human
ucccccuuccaugga

SEQ ID NO: 3720836 - RNA, 21 nt, Human
ucccccuuccauggacuuugu

SEQ ID NO: 3720837 - RNA, 13 nt, Human
ucccccuugccac

SEQ ID NO: 3720838 - RNA, 14 nt, Human
ucccccuugccacc

SEQ ID NO: 3720839 - RNA, 11 nt, Human
ucccccuuucu

SEQ ID NO: 3720840 - RNA, 15 nt, Human
ucccccuuucuuccu

SEQ ID NO: 3720841 - RNA, 19 nt, Human
ucccccuuuuuuguccccc

SEQ ID NO: 3720842 - RNA, 20 nt, Human
uccccgcacugggcuugggg

SEQ ID NO: 3720843 - RNA, 21 nt, Human
uccccgcagugugcacuaagg

SEQ ID NO: 3720844 - RNA, 22 nt, Human
uccccgcagugugcacuaaggg

SEQ ID NO: 3720845 - RNA, 18 nt, Human
uccccgcauuccaggcuc

SEQ ID NO: 3720846 - RNA, 19 nt, Human
uccccgcauuccaggcucc

SEQ ID NO: 3720847 - RNA, 15 nt, Human
uccccgcccuuuuuu

SEQ ID NO: 3720848 - RNA, 19 nt, Human
uccccgccuggccaggagc

SEQ ID NO: 3720849 - RNA, 14 nt, Human
uccccgccuguucc

SEQ ID NO: 3720850 - RNA, 13 nt, Human
uccccgcuggcug

SEQ ID NO: 3720851 - RNA, 15 nt, Human
uccccgcuggcuggg

SEQ ID NO: 3720852 - RNA, 17 nt, Human
uccccgcuggcuggggg

SEQ ID NO: 3720853 - RNA, 18 nt, Human
uccccgcuucugccugca

SEQ ID NO: 3720854 - RNA, 16 nt, Human
uccccggacucaagcc

SEQ ID NO: 3720855 - RNA, 15 nt, Human
uccccggcccuacca

SEQ ID NO: 3720856 - RNA, 21 nt, Human
uccccggcccuaccagcgccc

SEQ ID NO: 3720857 - RNA, 12 nt, Human
uccccggccuca

SEQ ID NO: 3720858 - RNA, 13 nt, Human
uccccggccucag

SEQ ID NO: 3720859 - RNA, 13 nt, Human
uccccggcucgag

SEQ ID NO: 3720860 - RNA, 11 nt, Human
uccccggggcc

SEQ ID NO: 3720861 - RNA, 15 nt, Human
uccccuaaagccuca

SEQ ID NO: 3720862 - RNA, 13 nt, Human
uccccuaaugccu

SEQ ID NO: 3720863 - RNA, 17 nt, Human
uccccuauccacccagc

SEQ ID NO: 3720864 - RNA, 19 nt, Human
uccccuauggggauggucc

SEQ ID NO: 3720865 - RNA, 23 nt, Human
uccccucaaggacaaagucucca

SEQ ID NO: 3720866 - RNA, 12 nt, Human
ggaagugugggu

SEQ ID NO: 3720867 - RNA, 22 nt, Human
ggaagugugggucugugugugu

SEQ ID NO: 3720868 - RNA, 16 nt, Human
ggaaguuaaaagcaca

SEQ ID NO: 3720869 - RNA, 16 nt, Human
ggaaguuuagcucuga

SEQ ID NO: 3720870 - RNA, 18 nt, Human
ggaaguuucauauauugu

SEQ ID NO: 3720871 - RNA, 14 nt, Human
ggaaguuuucaaug

SEQ ID NO: 3720872 - RNA, 21 nt, Human
ggaaguuuuguggaggagcuc

SEQ ID NO: 3720873 - RNA, 18 nt, Human
ggaauaaaaggcuugaag

SEQ ID NO: 3720874 - RNA, 13 nt, Human
ggaauaaauaugc

SEQ ID NO: 3720875 - RNA, 14 nt, Human
ggaauaaccuucca

SEQ ID NO: 3720876 - RNA, 21 nt, Human
ggaauaacuuuuacacgacca

SEQ ID NO: 3720877 - RNA, 20 nt, Human
ggaauaagaagcaaauaaau

SEQ ID NO: 3720878 - RNA, 13 nt, Human
ggaauaagacaga

SEQ ID NO: 3720879 - RNA, 15 nt, Human
ggaauacaauguaau

SEQ ID NO: 3720880 - RNA, 12 nt, Human
ggaauacuuuuu

SEQ ID NO: 3720881 - RNA, 17 nt, Human
ggaauacuuuuuguuau

SEQ ID NO: 3720882 - RNA, 18 nt, Human
ggaauaguauccuccagg

SEQ ID NO: 3720883 - RNA, 21 nt, Human
ggaauaguauccuccagguuu

SEQ ID NO: 3720884 - RNA, 22 nt, Human
ggaauaguauccuccagguuuu

SEQ ID NO: 3720885 - RNA, 15 nt, Human
ggaauauaauuguuu

SEQ ID NO: 3720886 - RNA, 21 nt, Human
ggaauauuauauuuggaugca

SEQ ID NO: 3720887 - RNA, 22 nt, Human
ggaauauuccccuaucucuaga

SEQ ID NO: 3720888 - RNA, 15 nt, Human
ggaauauuuuauuca

SEQ ID NO: 3720889 - RNA, 19 nt, Human
ggaauauuuuauucaaggu

SEQ ID NO: 3720890 - RNA, 16 nt, Human
ggaaucaagagcugcc

SEQ ID NO: 3720891 - RNA, 17 nt, Human
ggaaucaagagcugccc

SEQ ID NO: 3720892 - RNA, 12 nt, Human
ggaaucaagauu

SEQ ID NO: 3720893 - RNA, 15 nt, Human
ggaaucacucuugug

SEQ ID NO: 3720894 - RNA, 16 nt, Human
ggaaucagcaagaaga

SEQ ID NO: 3720895 - RNA, 19 nt, Human
ggaaucaugucaggccugu

SEQ ID NO: 3720896 - RNA, 20 nt, Human
ggaaucauuguccagagcug

SEQ ID NO: 3720897 - RNA, 19 nt, Human
ggaauccacucccaggcag

SEQ ID NO: 3720898 - RNA, 17 nt, Human
ggaauccuauauagaau

SEQ ID NO: 3720899 - RNA, 14 nt, Human
ggaauccuguccuc

SEQ ID NO: 3720900 - RNA, 19 nt, Human
ggaaucgaggaaccagagc

SEQ ID NO: 3720901 - RNA, 17 nt, Human
ggaaucuagaagaaaug

SEQ ID NO: 3720902 - RNA, 21 nt, Human
ggaaucuagccagugaacaua

SEQ ID NO: 3720903 - RNA, 22 nt, Human
ggaaucuagccagugaacauaa

SEQ ID NO: 3720904 - RNA, 18 nt, Human
ggaaugaagcaaugcuuc

SEQ ID NO: 3720905 - RNA, 18 nt, Human
ggaaugaagcuuguguau

SEQ ID NO: 3720906 - RNA, 19 nt, Human
ggaaugaaugucaguguga

SEQ ID NO: 3720907 - RNA, 21 nt, Human
ggaaugagcccagagaacagc

SEQ ID NO: 3720908 - RNA, 16 nt, Human
ggaaugaggaaaauuc

SEQ ID NO: 3720909 - RNA, 15 nt, Human
ggaaugagugugcau

SEQ ID NO: 3720910 - RNA, 14 nt, Human
ggaaugauuaauua

SEQ ID NO: 3720911 - RNA, 14 nt, Human
ggaaugccugagug

SEQ ID NO: 3720912 - RNA, 18 nt, Human
ggaaugccugagugccug

SEQ ID NO: 3720913 - RNA, 23 nt, Human
ggaaugccugagugccuggccaa

SEQ ID NO: 3720914 - RNA, 22 nt, Human
ggaaugcggccgcauucccuga

SEQ ID NO: 3720915 - RNA, 13 nt, Human
ggaaugcuccccc

SEQ ID NO: 3720916 - RNA, 14 nt, Human
ggaaugcuggacug

SEQ ID NO: 3720917 - RNA, 17 nt, Human
ggaauggaggggcagag

SEQ ID NO: 3720918 - RNA, 21 nt, Human
ggaauggaggggcagagccag

SEQ ID NO: 3720919 - RNA, 22 nt, Human
ggaauggauuuuucuuuaacug

SEQ ID NO: 3720920 - RNA, 12 nt, Human
ggaauggcagca

SEQ ID NO: 3720921 - RNA, 16 nt, Human
ggaaugggggccucuu

SEQ ID NO: 3720922 - RNA, 13 nt, Human
ggaauuaaaacaa

SEQ ID NO: 3720923 - RNA, 20 nt, Human
ggaauuaaccuggugcugga

SEQ ID NO: 3720924 - RNA, 16 nt, Human
ggaauuauuuuaaaag

SEQ ID NO: 3720925 - RNA, 17 nt, Human
ggaauuauuuuaaaaga

SEQ ID NO: 3720926 - RNA, 20 nt, Human
ggaauucaucucucuuuaau

SEQ ID NO: 3720927 - RNA, 22 nt, Human
ggaauucucuuggcuggcuucc

SEQ ID NO: 3720928 - RNA, 15 nt, Human
ggaauugauuugcau

SEQ ID NO: 3720929 - RNA, 20 nt, Human
ggaauugcuuaccaaaggau

SEQ ID NO: 3720930 - RNA, 21 nt, Human
ggaauugguggcagauuuuac

SEQ ID NO: 3720931 - RNA, 15 nt, Human
ggaauuucccaggac

SEQ ID NO: 3720932 - RNA, 21 nt, Human
ggaauuugcaagucauggcug

SEQ ID NO: 3720933 - RNA, 17 nt, Human
ggaauuuguaaccucag

SEQ ID NO: 3720934 - RNA, 22 nt, Human
ggacaaaaaugaacugaaguuu

SEQ ID NO: 3720935 - RNA, 15 nt, Human
ggacaaaacccaccu

SEQ ID NO: 3720936 - RNA, 20 nt, Human
ggacaaaaccccccagauau

SEQ ID NO: 3720937 - RNA, 16 nt, Human
ggacaaaauggaauac

SEQ ID NO: 3720938 - RNA, 11 nt, Human
ggacaaacugc

SEQ ID NO: 3720939 - RNA, 22 nt, Human
ggacaaagaauuccaaagcaaa

SEQ ID NO: 3720940 - RNA, 14 nt, Human
ggacaaaggagccu

SEQ ID NO: 3720941 - RNA, 18 nt, Human
ggacaaagucuccagccc

SEQ ID NO: 3720942 - RNA, 21 nt, Human
ggacaaagucuccagcccacg

SEQ ID NO: 3720943 - RNA, 23 nt, Human
ggacaaaucaagcuucaguuucc

SEQ ID NO: 3720944 - RNA, 18 nt, Human
ggacaaaucacauauuuu

SEQ ID NO: 3720945 - RNA, 17 nt, Human
ggacaaccuuggcuugg

SEQ ID NO: 3720946 - RNA, 22 nt, Human
ggacaaccuuggcuuggcccug

SEQ ID NO: 3720947 - RNA, 16 nt, Human
ggacaacgaggaagcc

SEQ ID NO: 3720948 - RNA, 17 nt, Human
ggacaacgaggaagccc

SEQ ID NO: 3720949 - RNA, 20 nt, Human
ggacaagcagagguggccag

SEQ ID NO: 3720950 - RNA, 13 nt, Human
ggacaagcagugg

SEQ ID NO: 3720951 - RNA, 21 nt, Human
ggacaagccaacuuguaaaua

SEQ ID NO: 3720952 - RNA, 23 nt, Human
ggacaagccaacuuguaaauaca

SEQ ID NO: 3720953 - RNA, 19 nt, Human
ggacaaggacuaggguccu

SEQ ID NO: 3720954 - RNA, 22 nt, Human
ggacaaggaugaucuaggaaga

SEQ ID NO: 3720955 - RNA, 22 nt, Human
ggacaaggcuagaucaugaaga

SEQ ID NO: 3720956 - RNA, 20 nt, Human
ggacaaguggacucagggca

SEQ ID NO: 3720957 - RNA, 18 nt, Human
ggacaauacagaacccau

SEQ ID NO: 3720958 - RNA, 22 nt, Human
ggacaaucaguccccucccauc

SEQ ID NO: 3720959 - RNA, 21 nt, Human
ggacaaucaugaaauaugcau

SEQ ID NO: 3720960 - RNA, 16 nt, Human
ggacaauggaccggag

SEQ ID NO: 3720961 - RNA, 18 nt, Human
ggacacaaaacuccgccc

SEQ ID NO: 3720962 - RNA, 21 nt, Human
ggacacaaaacuccgccccca

SEQ ID NO: 3720963 - RNA, 22 nt, Human
ggacacaaaacuccgcccccag

SEQ ID NO: 3720964 - RNA, 21 nt, Human
ggacacacaaggugcaaauca

SEQ ID NO: 3720965 - RNA, 13 nt, Human
ggacacacagccu

SEQ ID NO: 3720966 - RNA, 12 nt, Human
ggacacagcucu

SEQ ID NO: 3720967 - RNA, 18 nt, Human
ggacacagcucuucucca

SEQ ID NO: 3720968 - RNA, 21 nt, Human
ggacacagcucuucuccaggc

SEQ ID NO: 3720969 - RNA, 16 nt, Human
ggacacaggccugugu

SEQ ID NO: 3720970 - RNA, 20 nt, Human
ggacaccacacccagccuca

SEQ ID NO: 3720971 - RNA, 22 nt, Human
ggacaccacacccagccucagu

SEQ ID NO: 3720972 - RNA, 13 nt, Human
ggacaccagccag

SEQ ID NO: 3720973 - RNA, 14 nt, Human
ggacaccagccagg

SEQ ID NO: 3720974 - RNA, 22 nt, Human
ggacaccagccaggcucugugc

SEQ ID NO: 3720975 - RNA, 15 nt, Human
ggacacccccucgcu

SEQ ID NO: 3720976 - RNA, 20 nt, Human
ggacaccccuuauccaggac

SEQ ID NO: 3720977 - RNA, 21 nt, Human
ggacaccccuuauccaggacu

SEQ ID NO: 3720978 - RNA, 23 nt, Human
ggacacccugugauggggcccug

SEQ ID NO: 3720979 - RNA, 12 nt, Human
ggacaccgggca

SEQ ID NO: 3720980 - RNA, 16 nt, Human
ggacaccuaggcuagg

SEQ ID NO: 3720981 - RNA, 14 nt, Human
ggacaccugcccug

SEQ ID NO: 3720982 - RNA, 23 nt, Human
ggacacgcgccccccucccagag

SEQ ID NO: 3720983 - RNA, 23 nt, Human
ggacacgcucaguggggcagagg

SEQ ID NO: 3720984 - RNA, 21 nt, Human
ggacacgggccuguccacagg

SEQ ID NO: 3720985 - RNA, 23 nt, Human
ggacacgggccuguccacaggcu

SEQ ID NO: 3720986 - RNA, 22 nt, Human
ggacacggggcaguggcaaccu

SEQ ID NO: 3720987 - RNA, 22 nt, Human
ggacacuaaccacgcuggaccu

SEQ ID NO: 3720988 - RNA, 16 nt, Human
ggacacuacacccagc

SEQ ID NO: 3720989 - RNA, 22 nt, Human
ggacacuccagggacacacagc

SEQ ID NO: 3720990 - RNA, 23 nt, Human
ggacacuccagggacacacagcc

SEQ ID NO: 3720991 - RNA, 14 nt, Human
ggacacuccagugc

SEQ ID NO: 3720992 - RNA, 21 nt, Human
ggacacuccagugccagcaau

SEQ ID NO: 3720993 - RNA, 19 nt, Human
ggacacuuaauucuguucu

SEQ ID NO: 3720994 - RNA, 15 nt, Human
ggacacuuccugccu

SEQ ID NO: 3720995 - RNA, 16 nt, Human
ggacacuuccugccua

SEQ ID NO: 3720996 - RNA, 17 nt, Human
ggacagaagcagcucuu

SEQ ID NO: 3720997 - RNA, 23 nt, Human
ggacagacucacaaccugaaccu

SEQ ID NO: 3720998 - RNA, 20 nt, Human
ggacagaggccccagccucc

SEQ ID NO: 3720999 - RNA, 14 nt, Human
ggacagaggccugc

SEQ ID NO: 3721000 - RNA, 15 nt, Human
ggacagaggccugcc

SEQ ID NO: 3721001 - RNA, 23 nt, Human
ggacagaggggacucugggcuau

SEQ ID NO: 3721002 - RNA, 16 nt, Human
ggacagaggggguggc

SEQ ID NO: 3721003 - RNA, 13 nt, Human
ggacagaucauag

SEQ ID NO: 3721004 - RNA, 23 nt, Human
ggacagaucauagauuucugauu

SEQ ID NO: 3721005 - RNA, 19 nt, Human
ggacagauccagggacuga

SEQ ID NO: 3721006 - RNA, 15 nt, Human
ggacagaugccuccu

SEQ ID NO: 3721007 - RNA, 21 nt, Human
ggacagaugccuccuuccucu

SEQ ID NO: 3721008 - RNA, 22 nt, Human
ggacagauucagucuugccuua

SEQ ID NO: 3721009 - RNA, 15 nt, Human
ggacagcaaaaccau

SEQ ID NO: 3721010 - RNA, 21 nt, Human
ggacagcaaaaccauugcuuc

SEQ ID NO: 3721011 - RNA, 21 nt, Human
ggacagcagaagggggagacc

SEQ ID NO: 3721012 - RNA, 17 nt, Human
ggacagcauggugcaug

SEQ ID NO: 3721013 - RNA, 24 nt, Human
uccuuaggguuuucucucuauuuc

SEQ ID NO: 3721014 - RNA, 22 nt, Human
uccuuagguuuuuuuccuucug

SEQ ID NO: 3721015 - RNA, 16 nt, Human
uccuuagucuucucau

SEQ ID NO: 3721016 - RNA, 17 nt, Human
uccuuagucuucucaua

SEQ ID NO: 3721017 - RNA, 18 nt, Human
uccuuagucuucucauag

SEQ ID NO: 3721018 - RNA, 14 nt, Human
uccuuaucaaagga

SEQ ID NO: 3721019 - RNA, 14 nt, Human
uccuuaucagagcu

SEQ ID NO: 3721020 - RNA, 22 nt, Human
uccuuaucagagcuaagggugg

SEQ ID NO: 3721021 - RNA, 22 nt, Human
uccuuauguauauuuaaaagaa

SEQ ID NO: 3721022 - RNA, 20 nt, Human
uccuuauuugcuucauugua

SEQ ID NO: 3721023 - RNA, 20 nt, Human
uccuucaaaauccuuccaaa

SEQ ID NO: 3721024 - RNA, 18 nt, Human
uccuucaacaauucuaaa

SEQ ID NO: 3721025 - RNA, 20 nt, Human
uccuucaaguuagcucagga

SEQ ID NO: 3721026 - RNA, 19 nt, Human
uccuucaccucacugaaaa

SEQ ID NO: 3721027 - RNA, 13 nt, Human
uccuucaccucug

SEQ ID NO: 3721028 - RNA, 18 nt, Human
uccuucaccuuugucccc

SEQ ID NO: 3721029 - RNA, 21 nt, Human
uccuucaccuuuguccccacc

SEQ ID NO: 3721030 - RNA, 22 nt, Human
uccuucaccuuuguccccaccg

SEQ ID NO: 3721031 - RNA, 12 nt, Human
uccuucagacac

SEQ ID NO: 3721032 - RNA, 23 nt, Human
uccuucagacacccucaaccucu

SEQ ID NO: 3721033 - RNA, 13 nt, Human
uccuucagagagc

SEQ ID NO: 3721034 - RNA, 22 nt, Human
uccuucagagagcagugcuuuu

SEQ ID NO: 3721035 - RNA, 14 nt, Human
uccuucagauuugg

SEQ ID NO: 3721036 - RNA, 21 nt, Human
uccuucagcccucaccccugg

SEQ ID NO: 3721037 - RNA, 18 nt, Human
uccuucagcuuccauuuc

SEQ ID NO: 3721038 - RNA, 23 nt, Human
uccuucagggugaugccagguuc

SEQ ID NO: 3721039 - RNA, 20 nt, Human
uccuucagugccuuauggaa

SEQ ID NO: 3721040 - RNA, 11 nt, Human
uccuucauuuc

SEQ ID NO: 3721041 - RNA, 15 nt, Human
uccuucauuuccucc

SEQ ID NO: 3721042 - RNA, 18 nt, Human
uccuuccaaaaauuauua

SEQ ID NO: 3721043 - RNA, 15 nt, Human
uccuuccaaagaauu

SEQ ID NO: 3721044 - RNA, 21 nt, Human
uccuuccaacaggagcuggga

SEQ ID NO: 3721045 - RNA, 18 nt, Human
uccuuccaacugcugccc

SEQ ID NO: 3721046 - RNA, 18 nt, Human
uccuuccaaugucuggag

SEQ ID NO: 3721047 - RNA, 16 nt, Human
uccuuccacggacuca

SEQ ID NO: 3721048 - RNA, 13 nt, Human
uccuuccaggccc

SEQ ID NO: 3721049 - RNA, 16 nt, Human
uccuuccaucccuacc

SEQ ID NO: 3721050 - RNA, 14 nt, Human
uccuuccauuccac

SEQ ID NO: 3721051 - RNA, 10 nt, Human
uccuucccaa

SEQ ID NO: 3721052 - RNA, 22 nt, Human
uccuucccagaggggccugcca

SEQ ID NO: 3721053 - RNA, 13 nt, Human
uccuucccagcug

SEQ ID NO: 3721054 - RNA, 14 nt, Human
uccuucccagcugc

SEQ ID NO: 3721055 - RNA, 14 nt, Human
uccuucccuggcuu

SEQ ID NO: 3721056 - RNA, 15 nt, Human
uccuucccuggcuug

SEQ ID NO: 3721057 - RNA, 20 nt, Human
uccuucccugggcugugcua

SEQ ID NO: 3721058 - RNA, 17 nt, Human
uccuucccuugcuacca

SEQ ID NO: 3721059 - RNA, 16 nt, Human
uccuucccuuuucugu

SEQ ID NO: 3721060 - RNA, 23 nt, Human
uccuuccgcuuggagcuauuuuc

SEQ ID NO: 3721061 - RNA, 22 nt, Human
uccuuccuacacccuuggacuu

SEQ ID NO: 3721062 - RNA, 16 nt, Human
uccuuccucugagccu

SEQ ID NO: 3721063 - RNA, 12 nt, Human
uccuuccugccc

SEQ ID NO: 3721064 - RNA, 14 nt, Human
uccuuccugcccca

SEQ ID NO: 3721065 - RNA, 20 nt, Human
uccuuccuggagcccagagg

SEQ ID NO: 3721066 - RNA, 13 nt, Human
uccuuccuggccu

SEQ ID NO: 3721067 - RNA, 14 nt, Human
uccuuccuggccug

SEQ ID NO: 3721068 - RNA, 19 nt, Human
uccuuccugucuuccugca

SEQ ID NO: 3721069 - RNA, 21 nt, Human
uccuuccuguuagugguugug

SEQ ID NO: 3721070 - RNA, 19 nt, Human
uccuuccuguucugaacug

SEQ ID NO: 3721071 - RNA, 14 nt, Human
uccuuccuucccac

SEQ ID NO: 3721072 - RNA, 14 nt, Human
uccuuccuucccug

SEQ ID NO: 3721073 - RNA, 23 nt, Human
uccuuccuuguuacccaugaaaa

SEQ ID NO: 3721074 - RNA, 23 nt, Human
uccuucgugaacauccccuccca

SEQ ID NO: 3721075 - RNA, 17 nt, Human
uccuucuaguuucccac

SEQ ID NO: 3721076 - RNA, 21 nt, Human
uccuucucugaacacaggcag

SEQ ID NO: 3721077 - RNA, 23 nt, Human
uccuucucugaacacaggcagcu

SEQ ID NO: 3721078 - RNA, 15 nt, Human
uccuucugaaguguu

SEQ ID NO: 3721079 - RNA, 17 nt, Human
uccuucugaccacagca

SEQ ID NO: 3721080 - RNA, 12 nt, Human
uccuucugccuu

SEQ ID NO: 3721081 - RNA, 20 nt, Human
uccuucuggcagauucaaau

SEQ ID NO: 3721082 - RNA, 20 nt, Human
uccuucugugaaaguacauu

SEQ ID NO: 3721083 - RNA, 16 nt, Human
uccuucuuguaguagu

SEQ ID NO: 3721084 - RNA, 22 nt, Human
uccuucuuugauaauguuaaau

SEQ ID NO: 3721085 - RNA, 21 nt, Human
uccuucuuugggauagagaau

SEQ ID NO: 3721086 - RNA, 19 nt, Human
uccuugaagaacugcaggc

SEQ ID NO: 3721087 - RNA, 23 nt, Human
uccuugaagaacugcaggcccug

SEQ ID NO: 3721088 - RNA, 17 nt, Human
uccuugaagguauaucu

SEQ ID NO: 3721089 - RNA, 22 nt, Human
uccuugaccuuccucuggggcu

SEQ ID NO: 3721090 - RNA, 20 nt, Human
uccuugagagaccaggcaaa

SEQ ID NO: 3721091 - RNA, 15 nt, Human
uccuugauaacagcu

SEQ ID NO: 3721092 - RNA, 22 nt, Human
uccuugcacacuccccugcacu

SEQ ID NO: 3721093 - RNA, 17 nt, Human
uccuugcaccugcaucc

SEQ ID NO: 3721094 - RNA, 23 nt, Human
uccuugcacgcgcccuuucuacc

SEQ ID NO: 3721095 - RNA, 15 nt, Human
uccuugcaucaauuu

SEQ ID NO: 3721096 - RNA, 18 nt, Human
uccuugccuccuguguaa

SEQ ID NO: 3721097 - RNA, 20 nt, Human
uccuugcucucccucuucuc

SEQ ID NO: 3721098 - RNA, 21 nt, Human
uccuugcucucccucuucuca

SEQ ID NO: 3721099 - RNA, 23 nt, Human
uccuugcugaaacgcaucuaguu

SEQ ID NO: 3721100 - RNA, 22 nt, Human
uccuugcuuaugacaucacuug

SEQ ID NO: 3721101 - RNA, 13 nt, Human
uccuugcuuggcu

SEQ ID NO: 3721102 - RNA, 12 nt, Human
uccuuggaaauc

SEQ ID NO: 3721103 - RNA, 23 nt, Human
uccuuggaaaucaaauguaaagu

SEQ ID NO: 3721104 - RNA, 18 nt, Human
uccuuggagaaaugaaaa

SEQ ID NO: 3721105 - RNA, 14 nt, Human
uccuuggcaccaaa

SEQ ID NO: 3721106 - RNA, 20 nt, Human
uccuuggcaucacagggcag

SEQ ID NO: 3721107 - RNA, 15 nt, Human
uccuuggcaugccuu

SEQ ID NO: 3721108 - RNA, 17 nt, Human
uccuuggcaugccuucc

SEQ ID NO: 3721109 - RNA, 20 nt, Human
uccuuggcccccuuucccgg

SEQ ID NO: 3721110 - RNA, 13 nt, Human
uccuuggccuagc

SEQ ID NO: 3721111 - RNA, 20 nt, Human
uccuuggcuuuaugcacauu

SEQ ID NO: 3721112 - RNA, 23 nt, Human
uccuugggaggaagcagaauaaa

SEQ ID NO: 3721113 - RNA, 22 nt, Human
uccuugggaggccccacugggg

SEQ ID NO: 3721114 - RNA, 13 nt, Human
uccuugggcccuu

SEQ ID NO: 3721115 - RNA, 17 nt, Human
uccuuggggcaggcagu

SEQ ID NO: 3721116 - RNA, 19 nt, Human
uccuugguccuaguaagaa

SEQ ID NO: 3721117 - RNA, 17 nt, Human
uccuuggucuuuguauc

SEQ ID NO: 3721118 - RNA, 16 nt, Human
uccuugguuauauuuu

SEQ ID NO: 3721119 - RNA, 21 nt, Human
uccuugguuauauuuuuuuaa

SEQ ID NO: 3721120 - RNA, 20 nt, Human
uccuuguagcgacuaaacua

SEQ ID NO: 3721121 - RNA, 20 nt, Human
uccuuguccccacacuccua

SEQ ID NO: 3721122 - RNA, 12 nt, Human
uccuugugcaaa

SEQ ID NO: 3721123 - RNA, 15 nt, Human
uccuugugccagaga

SEQ ID NO: 3721124 - RNA, 19 nt, Human
uccuugugguuuaugucau

SEQ ID NO: 3721125 - RNA, 14 nt, Human
uccuuguguuacua

SEQ ID NO: 3721126 - RNA, 19 nt, Human
uccuuguuacccaugaaaa

SEQ ID NO: 3721127 - RNA, 21 nt, Human
uccuuguuguuucuugccuga

SEQ ID NO: 3721128 - RNA, 23 nt, Human
uccuuguuuaucagauacaucac

SEQ ID NO: 3721129 - RNA, 22 nt, Human
uccuuguuucaaacacaaaugc

SEQ ID NO: 3721130 - RNA, 21 nt, Human
uccuuuaaaaaaauuuaagug

SEQ ID NO: 3721131 - RNA, 18 nt, Human
uccuuuaaaaaagaaaag

SEQ ID NO: 3721132 - RNA, 15 nt, Human
uccuuuaauaugaaa

SEQ ID NO: 3721133 - RNA, 21 nt, Human
uccuuuaauuaagacugaaaa

SEQ ID NO: 3721134 - RNA, 21 nt, Human
uccuuuacaaaagaaauaccu

SEQ ID NO: 3721135 - RNA, 22 nt, Human
uccuuuacaaaagaaauaccuu

SEQ ID NO: 3721136 - RNA, 22 nt, Human
uccuuuacacauucggcucccu

SEQ ID NO: 3721137 - RNA, 12 nt, Human
uccuuuagaaac

SEQ ID NO: 3721138 - RNA, 20 nt, Human
uccuuuagauagcagccugg

SEQ ID NO: 3721139 - RNA, 19 nt, Human
uccuuuagcgcccaguugg

SEQ ID NO: 3721140 - RNA, 22 nt, Human
uccuuuagcgcccaguugggug

SEQ ID NO: 3721141 - RNA, 16 nt, Human
uccuuuagguaagaag

SEQ ID NO: 3721142 - RNA, 17 nt, Human
uccuuuaugugaauuuu

SEQ ID NO: 3721143 - RNA, 23 nt, Human
uccuuuaugugaauuuuuaagcu

SEQ ID NO: 3721144 - RNA, 19 nt, Human
uccuuucaaugguuugcaa

SEQ ID NO: 3721145 - RNA, 15 nt, Human
uccuuucaccacaug

SEQ ID NO: 3721146 - RNA, 17 nt, Human
uccuuucaccccagggc

SEQ ID NO: 3721147 - RNA, 18 nt, Human
uccuuucaccccagggcc

SEQ ID NO: 3721148 - RNA, 19 nt, Human
uccuuucaccccagggccu

SEQ ID NO: 3721149 - RNA, 21 nt, Human
uccuuucaccccagggccuga

SEQ ID NO: 3721150 - RNA, 18 nt, Human
uccuuucacuucuuuccc

SEQ ID NO: 3721151 - RNA, 17 nt, Human
uccuuuccaaggcuucu

SEQ ID NO: 3721152 - RNA, 22 nt, Human
uccuuuccaguggccuggcucc

SEQ ID NO: 3721153 - RNA, 16 nt, Human
uccuuucccaagccuu

SEQ ID NO: 3721154 - RNA, 16 nt, Human
uccuuuccccuuccuu

SEQ ID NO: 3721155 - RNA, 14 nt, Human
uccuuucccuccac

SEQ ID NO: 3721156 - RNA, 13 nt, Human
uccuuucccuucc

SEQ ID NO: 3721157 - RNA, 15 nt, Human
uccuuucccuuccuc

SEQ ID NO: 3721158 - RNA, 16 nt, Human
uccuuucccuuccucu

SEQ ID NO: 3721159 - RNA, 15 nt, Human
uccuuucuaaacaag

SEQ ID NO: 3721160 - RNA, 19 nt, Human
uccuuucuagagcacugcc

SEQ ID NO: 3721161 - RNA, 18 nt, Human
uccccucacagccucuga

SEQ ID NO: 3721162 - RNA, 21 nt, Human
uccccucacagccucugaccc

SEQ ID NO: 3721163 - RNA, 16 nt, Human
uccccucaggacugca

SEQ ID NO: 3721164 - RNA, 12 nt, Human
uccccuccaacc

SEQ ID NO: 3721165 - RNA, 15 nt, Human
uccccuccacuguca

SEQ ID NO: 3721166 - RNA, 12 nt, Human
uccccuccagcc

SEQ ID NO: 3721167 - RNA, 13 nt, Human
uccccuccagccu

SEQ ID NO: 3721168 - RNA, 14 nt, Human
uccccuccaucccu

SEQ ID NO: 3721169 - RNA, 20 nt, Human
uccccuccaucccuggcccc

SEQ ID NO: 3721170 - RNA, 15 nt, Human
uccccucccaucugg

SEQ ID NO: 3721171 - RNA, 13 nt, Human
uccccuccccugc

SEQ ID NO: 3721172 - RNA, 14 nt, Human
uccccuccccugcu

SEQ ID NO: 3721173 - RNA, 15 nt, Human
uccccuccccugcug

SEQ ID NO: 3721174 - RNA, 14 nt, Human
uccccucccuccuc

SEQ ID NO: 3721175 - RNA, 13 nt, Human
uccccucccuggg

SEQ ID NO: 3721176 - RNA, 17 nt, Human
uccccuccggacuggug

SEQ ID NO: 3721177 - RNA, 14 nt, Human
uccccuccuacccc

SEQ ID NO: 3721178 - RNA, 19 nt, Human
uccccuccuaccccuccca

SEQ ID NO: 3721179 - RNA, 18 nt, Human
uccccuccucuccccuac

SEQ ID NO: 3721180 - RNA, 12 nt, Human
uccccuccucug

SEQ ID NO: 3721181 - RNA, 18 nt, Human
uccccuccucugcuugcc

SEQ ID NO: 3721182 - RNA, 22 nt, Human
uccccuccuugccuccugugua

SEQ ID NO: 3721183 - RNA, 23 nt, Human
uccccuccuugccuccuguguaa

SEQ ID NO: 3721184 - RNA, 14 nt, Human
uccccuccuugggc

SEQ ID NO: 3721185 - RNA, 15 nt, Human
uccccucucccuucc

SEQ ID NO: 3721186 - RNA, 14 nt, Human
uccccucuccucca

SEQ ID NO: 3721187 - RNA, 15 nt, Human
uccccucuccuuccu

SEQ ID NO: 3721188 - RNA, 17 nt, Human
uccccucucuugcaccc

SEQ ID NO: 3721189 - RNA, 19 nt, Human
uccccucucuugcacccgc

SEQ ID NO: 3721190 - RNA, 20 nt, Human
uccccucucuugcacccgcc

SEQ ID NO: 3721191 - RNA, 22 nt, Human
uccccucugaaaguuguacaug

SEQ ID NO: 3721192 - RNA, 13 nt, Human
uccccucugcugc

SEQ ID NO: 3721193 - RNA, 14 nt, Human
uccccucugcugcu

SEQ ID NO: 3721194 - RNA, 17 nt, Human
uccccucugcugcuguc

SEQ ID NO: 3721195 - RNA, 20 nt, Human
uccccucugcugcugucccu

SEQ ID NO: 3721196 - RNA, 13 nt, Human
uccccucuuccuc

SEQ ID NO: 3721197 - RNA, 15 nt, Human
uccccucuugcccca

SEQ ID NO: 3721198 - RNA, 13 nt, Human
uccccugcacugu

SEQ ID NO: 3721199 - RNA, 14 nt, Human
uccccugcacugua

SEQ ID NO: 3721200 - RNA, 15 nt, Human
uccccugcacuguaa

SEQ ID NO: 3721201 - RNA, 16 nt, Human
uccccugcacuguaaa

SEQ ID NO: 3721202 - RNA, 14 nt, Human
uccccugccagggc

SEQ ID NO: 3721203 - RNA, 14 nt, Human
uccccugcccaugc

SEQ ID NO: 3721204 - RNA, 15 nt, Human
uccccugcccaugcu

SEQ ID NO: 3721205 - RNA, 13 nt, Human
uccccugccccca

SEQ ID NO: 3721206 - RNA, 15 nt, Human
uccccugcccccagg

SEQ ID NO: 3721207 - RNA, 16 nt, Human
uccccugcccccagga

SEQ ID NO: 3721208 - RNA, 22 nt, Human
uccccugcccccaggacugggc

SEQ ID NO: 3721209 - RNA, 15 nt, Human
uccccugcccugcug

SEQ ID NO: 3721210 - RNA, 17 nt, Human
uccccugcccuggucca

SEQ ID NO: 3721211 - RNA, 12 nt, Human
uccccugccuug

SEQ ID NO: 3721212 - RNA, 14 nt, Human
uccccugcuacccu

SEQ ID NO: 3721213 - RNA, 15 nt, Human
uccccugcugcaggg

SEQ ID NO: 3721214 - RNA, 21 nt, Human
uccccugcugcaggggcucug

SEQ ID NO: 3721215 - RNA, 13 nt, Human
uccccugcuggcc

SEQ ID NO: 3721216 - RNA, 20 nt, Human
uccccugcuggguguggcgc

SEQ ID NO: 3721217 - RNA, 24 nt, Human
uccccugcuggguguggcgcagca

SEQ ID NO: 3721218 - RNA, 18 nt, Human
uccccuggaacugucucu

SEQ ID NO: 3721219 - RNA, 17 nt, Human
uccccuggaagcagugc

SEQ ID NO: 3721220 - RNA, 22 nt, Human
uccccuggaagcagugcccagg

SEQ ID NO: 3721221 - RNA, 15 nt, Human
uccccuggacuggga

SEQ ID NO: 3721222 - RNA, 23 nt, Human
uccccuguccccgcacugggcuu

SEQ ID NO: 3721223 - RNA, 17 nt, Human
uccccugugccagccca

SEQ ID NO: 3721224 - RNA, 19 nt, Human
uccccugugccagcccaga

SEQ ID NO: 3721225 - RNA, 13 nt, Human
uccccuuauccuc

SEQ ID NO: 3721226 - RNA, 18 nt, Human
uccccuuauccucccugu

SEQ ID NO: 3721227 - RNA, 23 nt, Human
uccccuuauccucccuguaacuu

SEQ ID NO: 3721228 - RNA, 16 nt, Human
uccccuuccccuuccu

SEQ ID NO: 3721229 - RNA, 22 nt, Human
uccccuuccuaauuccacagcu

SEQ ID NO: 3721230 - RNA, 19 nt, Human
uccccuuccuaccacccgg

SEQ ID NO: 3721231 - RNA, 19 nt, Human
uccccuucgcguauuucag

SEQ ID NO: 3721232 - RNA, 15 nt, Human
uccccuucucaucac

SEQ ID NO: 3721233 - RNA, 14 nt, Human
uccccuucucugua

SEQ ID NO: 3721234 - RNA, 17 nt, Human
uccccuugaggucucag

SEQ ID NO: 3721235 - RNA, 18 nt, Human
uccccuugaggucucagc

SEQ ID NO: 3721236 - RNA, 20 nt, Human
uccccuugaggucucagccc

SEQ ID NO: 3721237 - RNA, 13 nt, Human
uccccuugcccag

SEQ ID NO: 3721238 - RNA, 16 nt, Human
uccccuugcccagggc

SEQ ID NO: 3721239 - RNA, 22 nt, Human
uccccuugcccagggcucagcc

SEQ ID NO: 3721240 - RNA, 21 nt, Human
uccccuugcccuugcccugac

SEQ ID NO: 3721241 - RNA, 16 nt, Human
uccccuugccugugcc

SEQ ID NO: 3721242 - RNA, 23 nt, Human
uccccuuggcagguccuggccag

SEQ ID NO: 3721243 - RNA, 16 nt, Human
uccccuugggcccaca

SEQ ID NO: 3721244 - RNA, 14 nt, Human
uccccuugggcggc

SEQ ID NO: 3721245 - RNA, 22 nt, Human
uccccuugggcggcugagagcc

SEQ ID NO: 3721246 - RNA, 14 nt, Human
uccccuuuccuguc

SEQ ID NO: 3721247 - RNA, 19 nt, Human
uccccuuucgcccacaguc

SEQ ID NO: 3721248 - RNA, 21 nt, Human
uccccuuuguauuccuuaaau

SEQ ID NO: 3721249 - RNA, 17 nt, Human
uccccuuuuauugcugc

SEQ ID NO: 3721250 - RNA, 15 nt, Human
ucccgaauagcuggg

SEQ ID NO: 3721251 - RNA, 16 nt, Human
ucccgaauagcuggga

SEQ ID NO: 3721252 - RNA, 18 nt, Human
ucccgaauagcugggacu

SEQ ID NO: 3721253 - RNA, 19 nt, Human
ucccgagacggcacugaga

SEQ ID NO: 3721254 - RNA, 19 nt, Human
ucccgagcaaagucuaaag

SEQ ID NO: 3721255 - RNA, 20 nt, Human
ucccgaguagcugagauuau

SEQ ID NO: 3721256 - RNA, 19 nt, Human
ucccgcagugggagcaaac

SEQ ID NO: 3721257 - RNA, 20 nt, Human
ucccgcagugggagcaaacu

SEQ ID NO: 3721258 - RNA, 23 nt, Human
ucccgccccccacacuucccugg

SEQ ID NO: 3721259 - RNA, 23 nt, Human
ucccgcggguuccgcaggcagac

SEQ ID NO: 3721260 - RNA, 13 nt, Human
ucccgcugcugcu

SEQ ID NO: 3721261 - RNA, 18 nt, Human
ucccggagguuggguggg

SEQ ID NO: 3721262 - RNA, 14 nt, Human
ucccggcccugccu

SEQ ID NO: 3721263 - RNA, 22 nt, Human
ucccggcugcccuuucugggca

SEQ ID NO: 3721264 - RNA, 21 nt, Human
ucccgggacaccuaggcuagg

SEQ ID NO: 3721265 - RNA, 15 nt, Human
ucccgggacgcagca

SEQ ID NO: 3721266 - RNA, 22 nt, Human
ucccgggacucacuggcagccc

SEQ ID NO: 3721267 - RNA, 16 nt, Human
ucccgggccagggcug

SEQ ID NO: 3721268 - RNA, 21 nt, Human
ucccgggccagggcugccccu

SEQ ID NO: 3721269 - RNA, 15 nt, Human
ucccgggcuguccac

SEQ ID NO: 3721270 - RNA, 14 nt, Human
ucccggggcagggc

SEQ ID NO: 3721271 - RNA, 16 nt, Human
ucccggggcagggcag

SEQ ID NO: 3721272 - RNA, 21 nt, Human
ucccggggcagggcagccguc

SEQ ID NO: 3721273 - RNA, 19 nt, Human
ucccgggguccuguggcag

SEQ ID NO: 3721274 - RNA, 19 nt, Human
ucccggguccuuggccccc

SEQ ID NO: 3721275 - RNA, 14 nt, Human
ucccggucccgagu

SEQ ID NO: 3721276 - RNA, 20 nt, Human
ucccgucaccccuguuucug

SEQ ID NO: 3721277 - RNA, 20 nt, Human
ucccgucccauauccugccu

SEQ ID NO: 3721278 - RNA, 21 nt, Human
ucccgucccauauccugccuc

SEQ ID NO: 3721279 - RNA, 13 nt, Human
ucccgugcagcuu

SEQ ID NO: 3721280 - RNA, 23 nt, Human
ucccguggaacguuuuuccuguu

SEQ ID NO: 3721281 - RNA, 16 nt, Human
ucccguggccccagcc

SEQ ID NO: 3721282 - RNA, 20 nt, Human
ucccguggccccagccuggc

SEQ ID NO: 3721283 - RNA, 17 nt, Human
ucccguuuuccccauga

SEQ ID NO: 3721284 - RNA, 15 nt, Human
ucccuaacacuuacc

SEQ ID NO: 3721285 - RNA, 11 nt, Human
ucccuaagcca

SEQ ID NO: 3721286 - RNA, 15 nt, Human
ucccuaagccaaggg

SEQ ID NO: 3721287 - RNA, 22 nt, Human
ucccuaaggcaugugugaaaca

SEQ ID NO: 3721288 - RNA, 15 nt, Human
ucccuaauaaagcug

SEQ ID NO: 3721289 - RNA, 14 nt, Human
ucccuaaugcugca

SEQ ID NO: 3721290 - RNA, 18 nt, Human
ucccuaccaccuccccag

SEQ ID NO: 3721291 - RNA, 19 nt, Human
ucccuaccgagucucuucu

SEQ ID NO: 3721292 - RNA, 16 nt, Human
ucccuaccucaaccug

SEQ ID NO: 3721293 - RNA, 13 nt, Human
ucccuaccucagg

SEQ ID NO: 3721294 - RNA, 15 nt, Human
ucccuacugaagccc

SEQ ID NO: 3721295 - RNA, 12 nt, Human
ucccuagacuuu

SEQ ID NO: 3721296 - RNA, 19 nt, Human
ucccuagaggguuccugua

SEQ ID NO: 3721297 - RNA, 20 nt, Human
ucccuagaggguuccuguag

SEQ ID NO: 3721298 - RNA, 23 nt, Human
ucccuagaucuuucuauuccaaa

SEQ ID NO: 3721299 - RNA, 15 nt, Human
ucccuagcagcccac

SEQ ID NO: 3721300 - RNA, 17 nt, Human
ucccuagccagcacuug

SEQ ID NO: 3721301 - RNA, 18 nt, Human
ucccuagcugugaccucu

SEQ ID NO: 3721302 - RNA, 19 nt, Human
ucccuagcuuuagacccug

SEQ ID NO: 3721303 - RNA, 15 nt, Human
ucccuaggagaccaa

SEQ ID NO: 3721304 - RNA, 21 nt, Human
ucccuagggcuggcagaaagg

SEQ ID NO: 3721305 - RNA, 22 nt, Human
ucccuagucuauucauuauauu

SEQ ID NO: 3721306 - RNA, 16 nt, Human
ucccuauaaugcugga

SEQ ID NO: 3721307 - RNA, 14 nt, Human
ucccuauggaaaga

SEQ ID NO: 3721308 - RNA, 13 nt, Human
ucccuauguauuu

SEQ ID NO: 3721309 - RNA, 15 nt, Human
ucccuauguauuugc

SEQ ID NO: 3721310 - RNA, 19 nt, Human
ucccucaaaugacccaaag

SEQ ID NO: 3721311 - RNA, 20 nt, Human
ucccucaaaugacccaaaga

SEQ ID NO: 3721312 - RNA, 17 nt, Human
ggacagccccacccugg

SEQ ID NO: 3721313 - RNA, 23 nt, Human
ggacagccuguggcggugccugg

SEQ ID NO: 3721314 - RNA, 17 nt, Human
ggacagcuccuucuguc

SEQ ID NO: 3721315 - RNA, 13 nt, Human
ggacagcuguccu

SEQ ID NO: 3721316 - RNA, 14 nt, Human
ggacagcugugccu

SEQ ID NO: 3721317 - RNA, 22 nt, Human
ggacagcuuguggcaagugaau

SEQ ID NO: 3721318 - RNA, 20 nt, Human
ggacaggaugaccuggauaa

SEQ ID NO: 3721319 - RNA, 17 nt, Human
ggacaggauguguuugc

SEQ ID NO: 3721320 - RNA, 18 nt, Human
ggacaggauguguuugcu

SEQ ID NO: 3721321 - RNA, 13 nt, Human
ggacaggcagaaa

SEQ ID NO: 3721322 - RNA, 15 nt, Human
ggacaggcagaaaga

SEQ ID NO: 3721323 - RNA, 13 nt, Human
ggacaggcaggug

SEQ ID NO: 3721324 - RNA, 23 nt, Human
ggacaggcauguucucugaggac

SEQ ID NO: 3721325 - RNA, 22 nt, Human
ggacaggcccggcgcgguggcu

SEQ ID NO: 3721326 - RNA, 11 nt, Human
ggacaggccuc

SEQ ID NO: 3721327 - RNA, 19 nt, Human
ggacaggcugcggccccuc

SEQ ID NO: 3721328 - RNA, 23 nt, Human
ggacaggcuggcuccagaugcag

SEQ ID NO: 3721329 - RNA, 17 nt, Human
ggacagggaggugaccc

SEQ ID NO: 3721330 - RNA, 22 nt, Human
ggacagggaugagcauggagcu

SEQ ID NO: 3721331 - RNA, 15 nt, Human
ggacagggcauggcc

SEQ ID NO: 3721332 - RNA, 21 nt, Human
ggacagggcuggcccagcccu

SEQ ID NO: 3721333 - RNA, 17 nt, Human
ggacaggggcaggagga

SEQ ID NO: 3721334 - RNA, 13 nt, Human
ggacaggugccag

SEQ ID NO: 3721335 - RNA, 15 nt, Human
ggacaguccugggag

SEQ ID NO: 3721336 - RNA, 19 nt, Human
ggacaguccugggagaacc

SEQ ID NO: 3721337 - RNA, 16 nt, Human
ggacagugcugcagcu

SEQ ID NO: 3721338 - RNA, 20 nt, Human
ggacagugcuucagccugag

SEQ ID NO: 3721339 - RNA, 23 nt, Human
ggacagugcuucagccugaggcu

SEQ ID NO: 3721340 - RNA, 17 nt, Human
ggacaguggcaggacag

SEQ ID NO: 3721341 - RNA, 22 nt, Human
ggacaguuccagaagugugacu

SEQ ID NO: 3721342 - RNA, 20 nt, Human
ggacaguuuaccaguugccu

SEQ ID NO: 3721343 - RNA, 19 nt, Human
ggacaguuuaucaugaagc

SEQ ID NO: 3721344 - RNA, 20 nt, Human
ggacaguuuaucaugaagcc

SEQ ID NO: 3721345 - RNA, 21 nt, Human
ggacaguuuaucaugaagccu

SEQ ID NO: 3721346 - RNA, 19 nt, Human
ggacauaaugggguccugg

SEQ ID NO: 3721347 - RNA, 15 nt, Human
ggacauagagaggga

SEQ ID NO: 3721348 - RNA, 20 nt, Human
ggacauagagagggagaaga

SEQ ID NO: 3721349 - RNA, 23 nt, Human
ggacauagagguauauuggaaga

SEQ ID NO: 3721350 - RNA, 18 nt, Human
ggacauagcgaauacaaa

SEQ ID NO: 3721351 - RNA, 19 nt, Human
ggacauauauuuuuuaaaa

SEQ ID NO: 3721352 - RNA, 14 nt, Human
ggacaucagcaaac

SEQ ID NO: 3721353 - RNA, 14 nt, Human
ggacauccccugcu

SEQ ID NO: 3721354 - RNA, 20 nt, Human
ggacauccccugcuggccgg

SEQ ID NO: 3721355 - RNA, 13 nt, Human
ggacauccuccuc

SEQ ID NO: 3721356 - RNA, 18 nt, Human
ggacauccuguauaagca

SEQ ID NO: 3721357 - RNA, 18 nt, Human
ggacaugcaauaaaauuu

SEQ ID NO: 3721358 - RNA, 22 nt, Human
ggacaugcaauaaaauuuaaaa

SEQ ID NO: 3721359 - RNA, 16 nt, Human
ggacaugcgguagcca

SEQ ID NO: 3721360 - RNA, 13 nt, Human
ggacaugcuuagc

SEQ ID NO: 3721361 - RNA, 21 nt, Human
ggacaugggucgcccaugaga

SEQ ID NO: 3721362 - RNA, 16 nt, Human
ggacauguucccuucu

SEQ ID NO: 3721363 - RNA, 17 nt, Human
ggacauguuuugauaaa

SEQ ID NO: 3721364 - RNA, 21 nt, Human
ggacauguuuuuguuuucuuu

SEQ ID NO: 3721365 - RNA, 17 nt, Human
ggacauuccaagacagu

SEQ ID NO: 3721366 - RNA, 12 nt, Human
ggacauucuugu

SEQ ID NO: 3721367 - RNA, 23 nt, Human
ggacauuuauuaguaucuuccau

SEQ ID NO: 3721368 - RNA, 16 nt, Human
ggaccaaaaaaauaag

SEQ ID NO: 3721369 - RNA, 16 nt, Human
ggaccaacccugggga

SEQ ID NO: 3721370 - RNA, 17 nt, Human
ggaccaacccuggggaa

SEQ ID NO: 3721371 - RNA, 17 nt, Human
ggaccaacccuguuucc

SEQ ID NO: 3721372 - RNA, 22 nt, Human
ggaccacaaaaaugaaagcaug

SEQ ID NO: 3721373 - RNA, 18 nt, Human
ggaccacaggugcccgcc

SEQ ID NO: 3721374 - RNA, 13 nt, Human
ggaccacauuuua

SEQ ID NO: 3721375 - RNA, 15 nt, Human
ggaccacccugagcc

SEQ ID NO: 3721376 - RNA, 13 nt, Human
ggaccacucagcc

SEQ ID NO: 3721377 - RNA, 17 nt, Human
ggaccacucagccccua

SEQ ID NO: 3721378 - RNA, 21 nt, Human
ggaccacugcaugagcuuuua

SEQ ID NO: 3721379 - RNA, 21 nt, Human
ggaccacuguuucuugcuugu

SEQ ID NO: 3721380 - RNA, 19 nt, Human
ggaccagaagccaaagacu

SEQ ID NO: 3721381 - RNA, 12 nt, Human
ggaccagaugcu

SEQ ID NO: 3721382 - RNA, 12 nt, Human
ggaccagcccac

SEQ ID NO: 3721383 - RNA, 15 nt, Human
ggaccagcccacgcu

SEQ ID NO: 3721384 - RNA, 17 nt, Human
ggaccagccuguuggac

SEQ ID NO: 3721385 - RNA, 13 nt, Human
ggaccagcucagg

SEQ ID NO: 3721386 - RNA, 16 nt, Human
ggaccagcucaggaca

SEQ ID NO: 3721387 - RNA, 22 nt, Human
ggaccagcucaggacagaugcc

SEQ ID NO: 3721388 - RNA, 11 nt, Human
ggaccaggacu

SEQ ID NO: 3721389 - RNA, 21 nt, Human
ggaccaggacuauagcccagg

SEQ ID NO: 3721390 - RNA, 21 nt, Human
ggaccaggaguggguggggag

SEQ ID NO: 3721391 - RNA, 23 nt, Human
ggaccaggaguggguggggagug

SEQ ID NO: 3721392 - RNA, 13 nt, Human
ggaccaggcaaug

SEQ ID NO: 3721393 - RNA, 23 nt, Human
ggaccaggcaaugugacuuugca

SEQ ID NO: 3721394 - RNA, 19 nt, Human
ggaccagucaaccugggca

SEQ ID NO: 3721395 - RNA, 23 nt, Human
ggaccaugcgacacugggaggcc

SEQ ID NO: 3721396 - RNA, 16 nt, Human
ggaccaugcugucugg

SEQ ID NO: 3721397 - RNA, 20 nt, Human
ggaccaugcugucuggcaca

SEQ ID NO: 3721398 - RNA, 22 nt, Human
ggaccaugugucacuugugcuu

SEQ ID NO: 3721399 - RNA, 14 nt, Human
ggaccauuuuccug

SEQ ID NO: 3721400 - RNA, 19 nt, Human
ggacccaaggaaaacugca

SEQ ID NO: 3721401 - RNA, 14 nt, Human
ggacccagacccag

SEQ ID NO: 3721402 - RNA, 16 nt, Human
ggacccagacccagug

SEQ ID NO: 3721403 - RNA, 23 nt, Human
ggacccagccgccaucagcccaa

SEQ ID NO: 3721404 - RNA, 13 nt, Human
ggacccaggacag

SEQ ID NO: 3721405 - RNA, 12 nt, Human
ggacccaggcuc

SEQ ID NO: 3721406 - RNA, 16 nt, Human
ggacccagggaacagc

SEQ ID NO: 3721407 - RNA, 22 nt, Human
ggacccagggaacagccacucc

SEQ ID NO: 3721408 - RNA, 11 nt, Human
ggacccagugc

SEQ ID NO: 3721409 - RNA, 14 nt, Human
ggacccaguggcag

SEQ ID NO: 3721410 - RNA, 21 nt, Human
ggaccccagcaagugguccua

SEQ ID NO: 3721411 - RNA, 15 nt, Human
ggaccccagccucaa

SEQ ID NO: 3721412 - RNA, 13 nt, Human
ggaccccagcugg

SEQ ID NO: 3721413 - RNA, 14 nt, Human
ggaccccagcuggg

SEQ ID NO: 3721414 - RNA, 18 nt, Human
ggaccccagcugggaggc

SEQ ID NO: 3721415 - RNA, 20 nt, Human
ggaccccagcugggaggcaa

SEQ ID NO: 3721416 - RNA, 18 nt, Human
ggaccccagcugugagcc

SEQ ID NO: 3721417 - RNA, 13 nt, Human
ggaccccaggccc

SEQ ID NO: 3721418 - RNA, 14 nt, Human
ggaccccaggccca

SEQ ID NO: 3721419 - RNA, 17 nt, Human
ggaccccaucugugaau

SEQ ID NO: 3721420 - RNA, 18 nt, Human
ggaccccccuuucacagg

SEQ ID NO: 3721421 - RNA, 20 nt, Human
ggacccccgcccccugcccu

SEQ ID NO: 3721422 - RNA, 23 nt, Human
ggacccccgcccccugcccuccc

SEQ ID NO: 3721423 - RNA, 22 nt, Human
ggacccccguggggcagggagc

SEQ ID NO: 3721424 - RNA, 12 nt, Human
ggacccccugaa

SEQ ID NO: 3721425 - RNA, 21 nt, Human
ggaccccgagccuggcuccaa

SEQ ID NO: 3721426 - RNA, 13 nt, Human
ggaccccucaccu

SEQ ID NO: 3721427 - RNA, 18 nt, Human
ggaccccuggugguucac

SEQ ID NO: 3721428 - RNA, 17 nt, Human
ggacccgcucuggacca

SEQ ID NO: 3721429 - RNA, 21 nt, Human
ggacccggaggggccuggcag

SEQ ID NO: 3721430 - RNA, 19 nt, Human
ggacccguucaugggggag

SEQ ID NO: 3721431 - RNA, 17 nt, Human
ggacccuccaaggccag

SEQ ID NO: 3721432 - RNA, 18 nt, Human
ggacccuccaaggccagg

SEQ ID NO: 3721433 - RNA, 20 nt, Human
ggacccucgcuggcccccac

SEQ ID NO: 3721434 - RNA, 11 nt, Human
ggacccugagg

SEQ ID NO: 3721435 - RNA, 12 nt, Human
ggacccugaggc

SEQ ID NO: 3721436 - RNA, 17 nt, Human
ggacccugccaggcaca

SEQ ID NO: 3721437 - RNA, 21 nt, Human
ggacccugccaggcacaggca

SEQ ID NO: 3721438 - RNA, 22 nt, Human
ggacccugccaggcacaggcag

SEQ ID NO: 3721439 - RNA, 21 nt, Human
ggacccugcuuuagagcuagg

SEQ ID NO: 3721440 - RNA, 13 nt, Human
ggacccuguccaa

SEQ ID NO: 3721441 - RNA, 22 nt, Human
ggacccugugacauggugccug

SEQ ID NO: 3721442 - RNA, 23 nt, Human
ggacccugugacauggugccuga

SEQ ID NO: 3721443 - RNA, 13 nt, Human
ggacccugugagc

SEQ ID NO: 3721444 - RNA, 23 nt, Human
ggacccuugagaguaucaggucu

SEQ ID NO: 3721445 - RNA, 17 nt, Human
ggacccuuuccuuccuu

SEQ ID NO: 3721446 - RNA, 21 nt, Human
ggacccuuuccuuccuucccu

SEQ ID NO: 3721447 - RNA, 22 nt, Human
ggacccuuuccuuccuucccug

SEQ ID NO: 3721448 - RNA, 17 nt, Human
ggaccgaguagaggcau

SEQ ID NO: 3721449 - RNA, 18 nt, Human
ggaccgcccccugucucu

SEQ ID NO: 3721450 - RNA, 19 nt, Human
ggaccgcuacaccacucug

SEQ ID NO: 3721451 - RNA, 20 nt, Human
ggaccguggcccugcccucu

SEQ ID NO: 3721452 - RNA, 17 nt, Human
ggaccuaaauggccuca

SEQ ID NO: 3721453 - RNA, 22 nt, Human
ggaccuaacauucgaucucauu

SEQ ID NO: 3721454 - RNA, 21 nt, Human
ggaccuauguccuaaggacac

SEQ ID NO: 3721455 - RNA, 20 nt, Human
ggaccucaggccugggggcu

SEQ ID NO: 3721456 - RNA, 11 nt, Human
ggaccucccuu

SEQ ID NO: 3721457 - RNA, 20 nt, Human
ggaccucccuuccgacccuc

SEQ ID NO: 3721458 - RNA, 13 nt, Human
ggaccuccugagc

SEQ ID NO: 3721459 - RNA, 20 nt, Human
ggaccucuacuuuccaggcu

SEQ ID NO: 3721460 - RNA, 15 nt, Human
ggaccucucccaggg

SEQ ID NO: 3721461 - RNA, 15 nt, Human
uccuuucucauccca

SEQ ID NO: 3721462 - RNA, 13 nt, Human
uccuuucuccagg

SEQ ID NO: 3721463 - RNA, 15 nt, Human
uccuuucucuuucuc

SEQ ID NO: 3721464 - RNA, 17 nt, Human
uccuuucugaucuucac

SEQ ID NO: 3721465 - RNA, 20 nt, Human
uccuuucuuccggccccucc

SEQ ID NO: 3721466 - RNA, 14 nt, Human
uccuuugcacugag

SEQ ID NO: 3721467 - RNA, 15 nt, Human
uccuuugcacugagg

SEQ ID NO: 3721468 - RNA, 16 nt, Human
uccuuugcagggcagc

SEQ ID NO: 3721469 - RNA, 13 nt, Human
uccuuugggaaag

SEQ ID NO: 3721470 - RNA, 23 nt, Human
uccuuugggcuucagcugccagu

SEQ ID NO: 3721471 - RNA, 18 nt, Human
uccuuugguccugucccc

SEQ ID NO: 3721472 - RNA, 19 nt, Human
uccuuuguauauuauuucu

SEQ ID NO: 3721473 - RNA, 17 nt, Human
uccuuuguauucugucu

SEQ ID NO: 3721474 - RNA, 21 nt, Human
uccuuuguauucugucuucau

SEQ ID NO: 3721475 - RNA, 21 nt, Human
uccuuugucuucaaacuguga

SEQ ID NO: 3721476 - RNA, 22 nt, Human
uccuuugugaggaagccgcugg

SEQ ID NO: 3721477 - RNA, 22 nt, Human
uccuuugugugugugucagcug

SEQ ID NO: 3721478 - RNA, 20 nt, Human
uccuuuguuuucugacuaau

SEQ ID NO: 3721479 - RNA, 13 nt, Human
uccuuuuagccua

SEQ ID NO: 3721480 - RNA, 12 nt, Human
uccuuuuaugug

SEQ ID NO: 3721481 - RNA, 24 nt, Human
uccuuuuauuucuucaccagauuu

SEQ ID NO: 3721482 - RNA, 14 nt, Human
uccuuuucagaagu

SEQ ID NO: 3721483 - RNA, 15 nt, Human
uccuuuucccugcuu

SEQ ID NO: 3721484 - RNA, 15 nt, Human
uccuuuuccucucuc

SEQ ID NO: 3721485 - RNA, 22 nt, Human
uccuuuucgcaggauucuuccu

SEQ ID NO: 3721486 - RNA, 14 nt, Human
uccuuuucuguguu

SEQ ID NO: 3721487 - RNA, 16 nt, Human
uccuuuucuucuaugu

SEQ ID NO: 3721488 - RNA, 13 nt, Human
uccuuuucuuguu

SEQ ID NO: 3721489 - RNA, 16 nt, Human
uccuuuucuuuuguua

SEQ ID NO: 3721490 - RNA, 22 nt, Human
uccuuuucuuuuguuacuguuc

SEQ ID NO: 3721491 - RNA, 18 nt, Human
uccuuuugacacugcucu

SEQ ID NO: 3721492 - RNA, 14 nt, Human
uccuuuugaccuuc

SEQ ID NO: 3721493 - RNA, 14 nt, Human
uccuuuuggaguca

SEQ ID NO: 3721494 - RNA, 15 nt, Human
uccuuuuguaaagug

SEQ ID NO: 3721495 - RNA, 17 nt, Human
uccuuuuguagaaugaa

SEQ ID NO: 3721496 - RNA, 18 nt, Human
uccuuuuguguacagugu

SEQ ID NO: 3721497 - RNA, 16 nt, Human
uccuuuuguguuccaa

SEQ ID NO: 3721498 - RNA, 19 nt, Human
uccuuuuguguuccaaaca

SEQ ID NO: 3721499 - RNA, 13 nt, Human
uccuuuuuauuua

SEQ ID NO: 3721500 - RNA, 16 nt, Human
uccuuuuuccucucca

SEQ ID NO: 3721501 - RNA, 21 nt, Human
uccuuuuuccucuccacacag

SEQ ID NO: 3721502 - RNA, 14 nt, Human
uccuuuuucuuuau

SEQ ID NO: 3721503 - RNA, 14 nt, Human
uccuuuuugacacu

SEQ ID NO: 3721504 - RNA, 16 nt, Human
uccuuuuugacacuga

SEQ ID NO: 3721505 - RNA, 12 nt, Human
uccuuuuuuccc

SEQ ID NO: 3721506 - RNA, 22 nt, Human
uccuuuuuucccauaagacaau

SEQ ID NO: 3721507 - RNA, 12 nt, Human
uccuuuuuuucc

SEQ ID NO: 3721508 - RNA, 21 nt, Human
uccuuuuuuuccaucuuuaca

SEQ ID NO: 3721509 - RNA, 17 nt, Human
ucgaaaaaauaauuauu

SEQ ID NO: 3721510 - RNA, 18 nt, Human
ucgaaaaaauaauuauuu

SEQ ID NO: 3721511 - RNA, 18 nt, Human
ucgaaacacagaaaccuu

SEQ ID NO: 3721512 - RNA, 16 nt, Human
ucgaaagcucuagaau

SEQ ID NO: 3721513 - RNA, 19 nt, Human
ucgaaagcucuagaaucug

SEQ ID NO: 3721514 - RNA, 18 nt, Human
ucgaaauaacaauguuaa

SEQ ID NO: 3721515 - RNA, 19 nt, Human
ucgaacccacacugcaaca

SEQ ID NO: 3721516 - RNA, 13 nt, Human
ucgaacuggcugc

SEQ ID NO: 3721517 - RNA, 14 nt, Human
ucgaacuggcugca

SEQ ID NO: 3721518 - RNA, 14 nt, Human
ucgaacuucacaac

SEQ ID NO: 3721519 - RNA, 14 nt, Human
ucgaagcucagccc

SEQ ID NO: 3721520 - RNA, 12 nt, Human
ucgaagucauua

SEQ ID NO: 3721521 - RNA, 17 nt, Human
ucgaagucauuaaacug

SEQ ID NO: 3721522 - RNA, 12 nt, Human
ucgaagugcuga

SEQ ID NO: 3721523 - RNA, 14 nt, Human
ucgaaucucugugc

SEQ ID NO: 3721524 - RNA, 16 nt, Human
ucgaaucucugugccu

SEQ ID NO: 3721525 - RNA, 17 nt, Human
ucgaaucucugugccuu

SEQ ID NO: 3721526 - RNA, 15 nt, Human
ucgaauuaauagcuu

SEQ ID NO: 3721527 - RNA, 23 nt, Human
ucgaauuuugucuuuaaaauuca

SEQ ID NO: 3721528 - RNA, 15 nt, Human
ucgaauuuuuauuau

SEQ ID NO: 3721529 - RNA, 22 nt, Human
ucgacacuguucuuagcucaau

SEQ ID NO: 3721530 - RNA, 14 nt, Human
ucgaccccaaagcc

SEQ ID NO: 3721531 - RNA, 14 nt, Human
ucgacucagccuca

SEQ ID NO: 3721532 - RNA, 16 nt, Human
ucgacucagccucagg

SEQ ID NO: 3721533 - RNA, 21 nt, Human
ucgacucaggauccagucccu

SEQ ID NO: 3721534 - RNA, 20 nt, Human
ucgacucugugcuggccagc

SEQ ID NO: 3721535 - RNA, 16 nt, Human
ucgacugugaccugug

SEQ ID NO: 3721536 - RNA, 14 nt, Human
ucgacuuuucuuaa

SEQ ID NO: 3721537 - RNA, 20 nt, Human
ucgagaaagaggcaccagga

SEQ ID NO: 3721538 - RNA, 21 nt, Human
ucgagaaagaggcaccaggaa

SEQ ID NO: 3721539 - RNA, 15 nt, Human
ucgagaacuuucauu

SEQ ID NO: 3721540 - RNA, 16 nt, Human
ucgagaacuuucauuu

SEQ ID NO: 3721541 - RNA, 14 nt, Human
ucgagacagaaccu

SEQ ID NO: 3721542 - RNA, 14 nt, Human
ucgagaccagccug

SEQ ID NO: 3721543 - RNA, 15 nt, Human
ucgagaccagccugg

SEQ ID NO: 3721544 - RNA, 17 nt, Human
ucgagaccagccuggcc

SEQ ID NO: 3721545 - RNA, 14 nt, Human
ucgagaccagucug

SEQ ID NO: 3721546 - RNA, 16 nt, Human
ucgagaccauccuggc

SEQ ID NO: 3721547 - RNA, 23 nt, Human
ucgagaggggccgaugcccagag

SEQ ID NO: 3721548 - RNA, 18 nt, Human
ucgagaucccaacacugc

SEQ ID NO: 3721549 - RNA, 19 nt, Human
ucgagauuaucguuuucuu

SEQ ID NO: 3721550 - RNA, 21 nt, Human
ucgagcaguccugccucagcc

SEQ ID NO: 3721551 - RNA, 22 nt, Human
ucgagcaguccugccucagccu

SEQ ID NO: 3721552 - RNA, 14 nt, Human
ucgagcaugccugg

SEQ ID NO: 3721553 - RNA, 16 nt, Human
ucgagcaugccuggau

SEQ ID NO: 3721554 - RNA, 18 nt, Human
ucgagcaugccuggaugg

SEQ ID NO: 3721555 - RNA, 19 nt, Human
ucgagcgcccugcagaccc

SEQ ID NO: 3721556 - RNA, 14 nt, Human
ucgagcuuggggca

SEQ ID NO: 3721557 - RNA, 14 nt, Human
ucgaggacagggag

SEQ ID NO: 3721558 - RNA, 17 nt, Human
ucgaggaguaacaauac

SEQ ID NO: 3721559 - RNA, 15 nt, Human
ucgaggccugaagcc

SEQ ID NO: 3721560 - RNA, 22 nt, Human
ucgaggcggaucuuuggacaga

SEQ ID NO: 3721561 - RNA, 16 nt, Human
ucgaggcugcagucag

SEQ ID NO: 3721562 - RNA, 14 nt, Human
ucgaggggcucuca

SEQ ID NO: 3721563 - RNA, 16 nt, Human
ucgaggggcucucagc

SEQ ID NO: 3721564 - RNA, 20 nt, Human
ucgaggggugggcugguauc

SEQ ID NO: 3721565 - RNA, 21 nt, Human
ucgagguagaguuugaaggag

SEQ ID NO: 3721566 - RNA, 17 nt, Human
ucgaggugccuucuuca

SEQ ID NO: 3721567 - RNA, 22 nt, Human
ucgagguuucucaaagaaauuu

SEQ ID NO: 3721568 - RNA, 17 nt, Human
ucgaguacugugggcaa

SEQ ID NO: 3721569 - RNA, 14 nt, Human
ucgagucaaaaugu

SEQ ID NO: 3721570 - RNA, 22 nt, Human
ucgagugccgcaucucacagcu

SEQ ID NO: 3721571 - RNA, 18 nt, Human
ucgaguucggcucugggu

SEQ ID NO: 3721572 - RNA, 22 nt, Human
ucgauacugcgacuuucugccu

SEQ ID NO: 3721573 - RNA, 16 nt, Human
ucgauaucuucuuuuu

SEQ ID NO: 3721574 - RNA, 14 nt, Human
ucgauauuuccauc

SEQ ID NO: 3721575 - RNA, 19 nt, Human
ucgauauuuccaucauuaa

SEQ ID NO: 3721576 - RNA, 19 nt, Human
ucgaugaagcccaauaaac

SEQ ID NO: 3721577 - RNA, 15 nt, Human
ucgaugaaggcugcc

SEQ ID NO: 3721578 - RNA, 14 nt, Human
ucgaugcaaugaac

SEQ ID NO: 3721579 - RNA, 18 nt, Human
ucgaugcguucacuccaa

SEQ ID NO: 3721580 - RNA, 22 nt, Human
ucgaugggggaugcuucaugug

SEQ ID NO: 3721581 - RNA, 23 nt, Human
ucgaugguacgugacccucugcu

SEQ ID NO: 3721582 - RNA, 20 nt, Human
ucgauguguacucuaacuua

SEQ ID NO: 3721583 - RNA, 22 nt, Human
ucgauuagacuggacagcuugu

SEQ ID NO: 3721584 - RNA, 20 nt, Human
ucgauuauucccuguacaau

SEQ ID NO: 3721585 - RNA, 15 nt, Human
ucgauucauauugaa

SEQ ID NO: 3721586 - RNA, 13 nt, Human
ucgcaagcugggu

SEQ ID NO: 3721587 - RNA, 13 nt, Human
ucgcacagucucu

SEQ ID NO: 3721588 - RNA, 14 nt, Human
ucgcacagucucuc

SEQ ID NO: 3721589 - RNA, 16 nt, Human
ucgcacagucucucuc

SEQ ID NO: 3721590 - RNA, 19 nt, Human
ucgcaccccccuguucuaa

SEQ ID NO: 3721591 - RNA, 13 nt, Human
ucgcaccggagug

SEQ ID NO: 3721592 - RNA, 14 nt, Human
ucgcagagaggcca

SEQ ID NO: 3721593 - RNA, 17 nt, Human
ucgcagagcuuuucaga

SEQ ID NO: 3721594 - RNA, 12 nt, Human
ucgcagccaccc

SEQ ID NO: 3721595 - RNA, 16 nt, Human
ucgcagccacccugag

SEQ ID NO: 3721596 - RNA, 17 nt, Human
ucgcagccacccugagg

SEQ ID NO: 3721597 - RNA, 18 nt, Human
ucgcagccacccugagga

SEQ ID NO: 3721598 - RNA, 23 nt, Human
ucgcagccacccugaggagucug

SEQ ID NO: 3721599 - RNA, 13 nt, Human
ucgcagccugagu

SEQ ID NO: 3721600 - RNA, 15 nt, Human
ucgcaggccucccug

SEQ ID NO: 3721601 - RNA, 20 nt, Human
ucgcaggccucccugccagu

SEQ ID NO: 3721602 - RNA, 22 nt, Human
ucgcauagaaaucaauaauuug

SEQ ID NO: 3721603 - RNA, 15 nt, Human
ucgcaucaaaagaca

SEQ ID NO: 3721604 - RNA, 13 nt, Human
ucgcaucauugca

SEQ ID NO: 3721605 - RNA, 16 nt, Human
ucgccacacaguauuu

SEQ ID NO: 3721606 - RNA, 21 nt, Human
ucgccaccuggcauuccuucu

SEQ ID NO: 3721607 - RNA, 18 nt, Human
ucgcccaaagccagacag

SEQ ID NO: 3721608 - RNA, 21 nt, Human
ucgcccagcggcaucaggcuu

SEQ ID NO: 3721609 - RNA, 12 nt, Human
ucgcccaggaga

SEQ ID NO: 3721610 - RNA, 19 nt, Human
ucgcccagucuggaaugca

SEQ ID NO: 3721611 - RNA, 23 nt, Human
ucgcccagucuggaaugcagugg

SEQ ID NO: 3721612 - RNA, 23 nt, Human
ucccucaacaagggagagaccuc

SEQ ID NO: 3721613 - RNA, 16 nt, Human
ucccucaaccccacca

SEQ ID NO: 3721614 - RNA, 14 nt, Human
ucccucacccaucc

SEQ ID NO: 3721615 - RNA, 18 nt, Human
ucccucacccauccuaga

SEQ ID NO: 3721616 - RNA, 17 nt, Human
ucccucacccccuccca

SEQ ID NO: 3721617 - RNA, 15 nt, Human
ucccucacccugagc

SEQ ID NO: 3721618 - RNA, 20 nt, Human
ucccucacccugagccccuu

SEQ ID NO: 3721619 - RNA, 22 nt, Human
ucccucacccugagccccuucc

SEQ ID NO: 3721620 - RNA, 22 nt, Human
ucccucaccuuggcaccagaca

SEQ ID NO: 3721621 - RNA, 14 nt, Human
ucccucacucucag

SEQ ID NO: 3721622 - RNA, 18 nt, Human
ucccucagucuggcccuu

SEQ ID NO: 3721623 - RNA, 13 nt, Human
ucccucaucucuc

SEQ ID NO: 3721624 - RNA, 21 nt, Human
ucccucaucugucccuccggg

SEQ ID NO: 3721625 - RNA, 11 nt, Human
ucccuccaccc

SEQ ID NO: 3721626 - RNA, 19 nt, Human
ucccuccaccucccugcaa

SEQ ID NO: 3721627 - RNA, 17 nt, Human
ucccuccagcacaaaca

SEQ ID NO: 3721628 - RNA, 19 nt, Human
ucccucccaccucugugac

SEQ ID NO: 3721629 - RNA, 21 nt, Human
ucccucccaccucugugaccu

SEQ ID NO: 3721630 - RNA, 16 nt, Human
ucccuccccugccauu

SEQ ID NO: 3721631 - RNA, 22 nt, Human
ucccuccccuggggacagcaag

SEQ ID NO: 3721632 - RNA, 14 nt, Human
ucccucccucuccg

SEQ ID NO: 3721633 - RNA, 14 nt, Human
ucccucccucugcc

SEQ ID NO: 3721634 - RNA, 16 nt, Human
ucccucccucugccgg

SEQ ID NO: 3721635 - RNA, 10 nt, Human
ucccucccuu

SEQ ID NO: 3721636 - RNA, 15 nt, Human
ucccuccgauccuuc

SEQ ID NO: 3721637 - RNA, 19 nt, Human
ucccuccgauccuuccucc

SEQ ID NO: 3721638 - RNA, 13 nt, Human
ucccuccucaccu

SEQ ID NO: 3721639 - RNA, 17 nt, Human
ucccuccucaccucugg

SEQ ID NO: 3721640 - RNA, 19 nt, Human
ucccuccugggaaugaagc

SEQ ID NO: 3721641 - RNA, 18 nt, Human
ucccuccugggaucugcu

SEQ ID NO: 3721642 - RNA, 19 nt, Human
ucccuccugggaucugcuc

SEQ ID NO: 3721643 - RNA, 20 nt, Human
ucccuccuggugucacccca

SEQ ID NO: 3721644 - RNA, 14 nt, Human
ucccuccuguuggg

SEQ ID NO: 3721645 - RNA, 22 nt, Human
ucccucgcugcacaaauacucc

SEQ ID NO: 3721646 - RNA, 19 nt, Human
ucccucuaaugagacugac

SEQ ID NO: 3721647 - RNA, 21 nt, Human
ucccucuacagagcuucccug

SEQ ID NO: 3721648 - RNA, 22 nt, Human
ucccucuacagagcuucccuga

SEQ ID NO: 3721649 - RNA, 18 nt, Human
ucccucuaggcucugccu

SEQ ID NO: 3721650 - RNA, 13 nt, Human
ucccucuauuuau

SEQ ID NO: 3721651 - RNA, 19 nt, Human
ucccucuauuuauguuugc

SEQ ID NO: 3721652 - RNA, 14 nt, Human
ucccucucaucuca

SEQ ID NO: 3721653 - RNA, 13 nt, Human
ucccucucccagg

SEQ ID NO: 3721654 - RNA, 15 nt, Human
ucccucucccaggcc

SEQ ID NO: 3721655 - RNA, 21 nt, Human
ucccucucccaggccccauga

SEQ ID NO: 3721656 - RNA, 12 nt, Human
ucccucucccug

SEQ ID NO: 3721657 - RNA, 17 nt, Human
ucccucucucugacucu

SEQ ID NO: 3721658 - RNA, 22 nt, Human
ucccucucucugacucucaaau

SEQ ID NO: 3721659 - RNA, 12 nt, Human
ucccucucucuu

SEQ ID NO: 3721660 - RNA, 18 nt, Human
ucccucucucuucugcuc

SEQ ID NO: 3721661 - RNA, 21 nt, Human
ucccucucucuucugcuccac

SEQ ID NO: 3721662 - RNA, 16 nt, Human
ucccucucugcuggac

SEQ ID NO: 3721663 - RNA, 15 nt, Human
ucccucucuggagaa

SEQ ID NO: 3721664 - RNA, 18 nt, Human
ucccucugaccugcaggc

SEQ ID NO: 3721665 - RNA, 22 nt, Human
ucccucugagaauuccaaggag

SEQ ID NO: 3721666 - RNA, 22 nt, Human
ucccucugcagucucuauacca

SEQ ID NO: 3721667 - RNA, 11 nt, Human
ucccucugccu

SEQ ID NO: 3721668 - RNA, 18 nt, Human
ucccucugccugucccuc

SEQ ID NO: 3721669 - RNA, 15 nt, Human
ucccucugcucagcc

SEQ ID NO: 3721670 - RNA, 20 nt, Human
ucccucugcuccuggagccu

SEQ ID NO: 3721671 - RNA, 13 nt, Human
ucccucuguuucu

SEQ ID NO: 3721672 - RNA, 14 nt, Human
ucccucuguuucuc

SEQ ID NO: 3721673 - RNA, 22 nt, Human
ucccucuuccuucccugcugug

SEQ ID NO: 3721674 - RNA, 23 nt, Human
ucccucuuccuucccugcuguga

SEQ ID NO: 3721675 - RNA, 15 nt, Human
ucccucuuguuuugu

SEQ ID NO: 3721676 - RNA, 16 nt, Human
ucccucuuguuuuguu

SEQ ID NO: 3721677 - RNA, 19 nt, Human
ucccucuuguuuuguuugu

SEQ ID NO: 3721678 - RNA, 14 nt, Human
ucccucuuucccuc

SEQ ID NO: 3721679 - RNA, 20 nt, Human
ucccucuuucccucccuucc

SEQ ID NO: 3721680 - RNA, 18 nt, Human
ucccucuuuggcuccccu

SEQ ID NO: 3721681 - RNA, 17 nt, Human
ucccugaaaacccagag

SEQ ID NO: 3721682 - RNA, 22 nt, Human
ucccugaaacacgaaacuuguu

SEQ ID NO: 3721683 - RNA, 12 nt, Human
ucccugaagcca

SEQ ID NO: 3721684 - RNA, 16 nt, Human
ucccugaagccagccu

SEQ ID NO: 3721685 - RNA, 18 nt, Human
ucccugaagccagccuuc

SEQ ID NO: 3721686 - RNA, 11 nt, Human
ucccugaaggc

SEQ ID NO: 3721687 - RNA, 21 nt, Human
ucccugaaucccccuugccac

SEQ ID NO: 3721688 - RNA, 22 nt, Human
ucccugacucauucugaaggag

SEQ ID NO: 3721689 - RNA, 16 nt, Human
ucccugacucucugug

SEQ ID NO: 3721690 - RNA, 17 nt, Human
ucccugacucucuguga

SEQ ID NO: 3721691 - RNA, 18 nt, Human
ucccugacucucugugac

SEQ ID NO: 3721692 - RNA, 20 nt, Human
ucccugacucucugugaccu

SEQ ID NO: 3721693 - RNA, 16 nt, Human
ucccugacuuuucugu

SEQ ID NO: 3721694 - RNA, 20 nt, Human
ucccugagagugucucugau

SEQ ID NO: 3721695 - RNA, 23 nt, Human
ucccugagaugggcuucccaagg

SEQ ID NO: 3721696 - RNA, 20 nt, Human
ucccugaggcagguccccag

SEQ ID NO: 3721697 - RNA, 14 nt, Human
ucccugagucacca

SEQ ID NO: 3721698 - RNA, 17 nt, Human
ucccugagucaccagga

SEQ ID NO: 3721699 - RNA, 21 nt, Human
ucccugauaacaaccuggaga

SEQ ID NO: 3721700 - RNA, 14 nt, Human
ucccugaucccuuc

SEQ ID NO: 3721701 - RNA, 12 nt, Human
ucccugauguac

SEQ ID NO: 3721702 - RNA, 16 nt, Human
ucccugauguacaguu

SEQ ID NO: 3721703 - RNA, 17 nt, Human
ucccugauugaccugcu

SEQ ID NO: 3721704 - RNA, 23 nt, Human
ucccugauugaccugcuccgcug

SEQ ID NO: 3721705 - RNA, 13 nt, Human
ucccugauuuaau

SEQ ID NO: 3721706 - RNA, 16 nt, Human
ucccugcaaccaacua

SEQ ID NO: 3721707 - RNA, 16 nt, Human
ucccugcaauaaaaug

SEQ ID NO: 3721708 - RNA, 15 nt, Human
ucccugcacaagcca

SEQ ID NO: 3721709 - RNA, 16 nt, Human
ucccugcacaagccag

SEQ ID NO: 3721710 - RNA, 20 nt, Human
ucccugcacuaaagccagcc

SEQ ID NO: 3721711 - RNA, 14 nt, Human
ucccugcacuugca

SEQ ID NO: 3721712 - RNA, 16 nt, Human
ucccugcagaugccac

SEQ ID NO: 3721713 - RNA, 22 nt, Human
ucccugcaucugaccagcagcg

SEQ ID NO: 3721714 - RNA, 13 nt, Human
ucccugcauggca

SEQ ID NO: 3721715 - RNA, 20 nt, Human
ucccugcauggcauccucca

SEQ ID NO: 3721716 - RNA, 22 nt, Human
ucccugcauggcauccuccagc

SEQ ID NO: 3721717 - RNA, 14 nt, Human
ucccugcauuucug

SEQ ID NO: 3721718 - RNA, 14 nt, Human
ucccugccaaugga

SEQ ID NO: 3721719 - RNA, 16 nt, Human
ucccugccaauggacu

SEQ ID NO: 3721720 - RNA, 23 nt, Human
ucccugcccagaauucccagcug

SEQ ID NO: 3721721 - RNA, 18 nt, Human
ucccugccccucccuuca

SEQ ID NO: 3721722 - RNA, 19 nt, Human
ucccugccccucccuucaa

SEQ ID NO: 3721723 - RNA, 14 nt, Human
ucccugccgccuca

SEQ ID NO: 3721724 - RNA, 11 nt, Human
ucccugccuca

SEQ ID NO: 3721725 - RNA, 17 nt, Human
ucccugccucaggccuc

SEQ ID NO: 3721726 - RNA, 20 nt, Human
ucccugccucaggccucugu

SEQ ID NO: 3721727 - RNA, 13 nt, Human
ucccugccuggac

SEQ ID NO: 3721728 - RNA, 20 nt, Human
ucccugccuuaggccuaccu

SEQ ID NO: 3721729 - RNA, 16 nt, Human
ucccugcgccugugau

SEQ ID NO: 3721730 - RNA, 17 nt, Human
ucccugcgccugugaug

SEQ ID NO: 3721731 - RNA, 22 nt, Human
ucccugcugucauugcuucuuc

SEQ ID NO: 3721732 - RNA, 23 nt, Human
ucccugcugucauugcuucuucu

SEQ ID NO: 3721733 - RNA, 14 nt, Human
ucccugcugucccc

SEQ ID NO: 3721734 - RNA, 12 nt, Human
ucccugcuucca

SEQ ID NO: 3721735 - RNA, 18 nt, Human
ucccugcuuuggucuugc

SEQ ID NO: 3721736 - RNA, 19 nt, Human
ucccugcuuuuuguguuuu

SEQ ID NO: 3721737 - RNA, 20 nt, Human
ucccuggaaugaguugaggc

SEQ ID NO: 3721738 - RNA, 22 nt, Human
ucccuggagccagacucugguc

SEQ ID NO: 3721739 - RNA, 18 nt, Human
ucccuggaugacauuaaa

SEQ ID NO: 3721740 - RNA, 17 nt, Human
ucccuggauuuuuacca

SEQ ID NO: 3721741 - RNA, 19 nt, Human
ucccuggauuuuuaccagu

SEQ ID NO: 3721742 - RNA, 15 nt, Human
ucccuggccaucucu

SEQ ID NO: 3721743 - RNA, 14 nt, Human
ucccuggccuguuc

SEQ ID NO: 3721744 - RNA, 18 nt, Human
ucccuggccuguucuguu

SEQ ID NO: 3721745 - RNA, 11 nt, Human
ucccuggccuu

SEQ ID NO: 3721746 - RNA, 16 nt, Human
ucccuggccuuucaua

SEQ ID NO: 3721747 - RNA, 14 nt, Human
ucccuggcucccau

SEQ ID NO: 3721748 - RNA, 14 nt, Human
ucccuggcugcccu

SEQ ID NO: 3721749 - RNA, 15 nt, Human
ucccuggcugcccug

SEQ ID NO: 3721750 - RNA, 18 nt, Human
ucccuggcugcccuggcc

SEQ ID NO: 3721751 - RNA, 15 nt, Human
ucccuggcuuccuua

SEQ ID NO: 3721752 - RNA, 16 nt, Human
ucccuggcuuccuuac

SEQ ID NO: 3721753 - RNA, 19 nt, Human
ucccuggcuuguaacucca

SEQ ID NO: 3721754 - RNA, 15 nt, Human
ucccugggaucuggu

SEQ ID NO: 3721755 - RNA, 12 nt, Human
ucccugggcauu

SEQ ID NO: 3721756 - RNA, 18 nt, Human
ucccugggcauugcuuuc

SEQ ID NO: 3721757 - RNA, 16 nt, Human
ucccugggccaggguc

SEQ ID NO: 3721758 - RNA, 13 nt, Human
ucccugggccugc

SEQ ID NO: 3721759 - RNA, 16 nt, Human
ucccugggccugcugc

SEQ ID NO: 3721760 - RNA, 21 nt, Human
ucccugggccugcugcugaga

SEQ ID NO: 3721761 - RNA, 19 nt, Human
ucccugggcugugcuaccu

SEQ ID NO: 3721762 - RNA, 13 nt, Human
ggaccucugacag

SEQ ID NO: 3721763 - RNA, 14 nt, Human
ggaccucugcucug

SEQ ID NO: 3721764 - RNA, 19 nt, Human
ggaccugaaauuccaaagu

SEQ ID NO: 3721765 - RNA, 13 nt, Human
ggaccugagccug

SEQ ID NO: 3721766 - RNA, 19 nt, Human
ggaccugagccugccgagc

SEQ ID NO: 3721767 - RNA, 20 nt, Human
ggaccugagccugccgagca

SEQ ID NO: 3721768 - RNA, 17 nt, Human
ggaccugccaggcaggg

SEQ ID NO: 3721769 - RNA, 10 nt, Human
ggaccugccc

SEQ ID NO: 3721770 - RNA, 23 nt, Human
ggaccugcccccgcauccccugc

SEQ ID NO: 3721771 - RNA, 19 nt, Human
ggaccugccuccugccugc

SEQ ID NO: 3721772 - RNA, 23 nt, Human
ggaccugccuccugccugccccu

SEQ ID NO: 3721773 - RNA, 21 nt, Human
ggaccuggggcacaguccagg

SEQ ID NO: 3721774 - RNA, 17 nt, Human
ggaccuggugcugccuc

SEQ ID NO: 3721775 - RNA, 18 nt, Human
ggaccuguauuuaagcaa

SEQ ID NO: 3721776 - RNA, 21 nt, Human
ggaccuuacgaucaggcacag

SEQ ID NO: 3721777 - RNA, 19 nt, Human
ggaccuucgggcugugccc

SEQ ID NO: 3721778 - RNA, 18 nt, Human
ggaccuuuccaccacagc

SEQ ID NO: 3721779 - RNA, 19 nt, Human
ggaccuuuccaccacagcc

SEQ ID NO: 3721780 - RNA, 22 nt, Human
ggaccuuuccaccacagccagc

SEQ ID NO: 3721781 - RNA, 13 nt, Human
ggaccuuuuaaag

SEQ ID NO: 3721782 - RNA, 16 nt, Human
ggaccuuuugggggag

SEQ ID NO: 3721783 - RNA, 14 nt, Human
ggacgacucugacc

SEQ ID NO: 3721784 - RNA, 24 nt, Human
ggacgccgggccggcccuagccca

SEQ ID NO: 3721785 - RNA, 14 nt, Human
ggacgccugggggu

SEQ ID NO: 3721786 - RNA, 20 nt, Human
ggacgcuacccgggaagggg

SEQ ID NO: 3721787 - RNA, 13 nt, Human
ggacgcucucugg

SEQ ID NO: 3721788 - RNA, 15 nt, Human
ggacgcucucuggcc

SEQ ID NO: 3721789 - RNA, 13 nt, Human
ggacgcuucugaa

SEQ ID NO: 3721790 - RNA, 14 nt, Human
ggacggcggcagua

SEQ ID NO: 3721791 - RNA, 16 nt, Human
ggacggggccggccag

SEQ ID NO: 3721792 - RNA, 15 nt, Human
ggacggucaguuugg

SEQ ID NO: 3721793 - RNA, 16 nt, Human
ggacgucccugcccau

SEQ ID NO: 3721794 - RNA, 16 nt, Human
ggacguggcaccuccu

SEQ ID NO: 3721795 - RNA, 18 nt, Human
ggacguggcucagccagc

SEQ ID NO: 3721796 - RNA, 13 nt, Human
ggacguuccagcc

SEQ ID NO: 3721797 - RNA, 14 nt, Human
ggacuaaaagauau

SEQ ID NO: 3721798 - RNA, 23 nt, Human
ggacuaacacucagaagccuggg

SEQ ID NO: 3721799 - RNA, 20 nt, Human
ggacuaacuugucuuuggac

SEQ ID NO: 3721800 - RNA, 19 nt, Human
ggacuaagccuaccugcuc

SEQ ID NO: 3721801 - RNA, 20 nt, Human
ggacuacaggugugagucac

SEQ ID NO: 3721802 - RNA, 13 nt, Human
ggacuacugaagc

SEQ ID NO: 3721803 - RNA, 16 nt, Human
ggacuagagcuuucuu

SEQ ID NO: 3721804 - RNA, 18 nt, Human
ggacuagagggaccucuc

SEQ ID NO: 3721805 - RNA, 19 nt, Human
ggacuagagggaccucucc

SEQ ID NO: 3721806 - RNA, 20 nt, Human
ggacuauauuugggccugcu

SEQ ID NO: 3721807 - RNA, 14 nt, Human
ggacuauuauaauu

SEQ ID NO: 3721808 - RNA, 18 nt, Human
ggacucaagccccggacu

SEQ ID NO: 3721809 - RNA, 15 nt, Human
ggacucaaugcacug

SEQ ID NO: 3721810 - RNA, 19 nt, Human
ggacucaauuucuccccag

SEQ ID NO: 3721811 - RNA, 17 nt, Human
ggacucagaaacuccau

SEQ ID NO: 3721812 - RNA, 14 nt, Human
ggacucagagaaaa

SEQ ID NO: 3721813 - RNA, 13 nt, Human
ggacucagcccug

SEQ ID NO: 3721814 - RNA, 16 nt, Human
ggacucagcccugagg

SEQ ID NO: 3721815 - RNA, 17 nt, Human
ggacucagcccugaggu

SEQ ID NO: 3721816 - RNA, 17 nt, Human
ggacucaggaugcccag

SEQ ID NO: 3721817 - RNA, 20 nt, Human
ggacucaggaugcccagggc

SEQ ID NO: 3721818 - RNA, 22 nt, Human
ggacucaggcgggacagugcug

SEQ ID NO: 3721819 - RNA, 20 nt, Human
ggacucagguggcccuacug

SEQ ID NO: 3721820 - RNA, 21 nt, Human
ggacucaucuuucccuccuug

SEQ ID NO: 3721821 - RNA, 22 nt, Human
ggacuccaggcagcagacacau

SEQ ID NO: 3721822 - RNA, 14 nt, Human
ggacuccccaggcc

SEQ ID NO: 3721823 - RNA, 19 nt, Human
ggacuccccaggccaggcc

SEQ ID NO: 3721824 - RNA, 22 nt, Human
ggacucccuccucaccucugga

SEQ ID NO: 3721825 - RNA, 17 nt, Human
ggacuccggcugugcug

SEQ ID NO: 3721826 - RNA, 11 nt, Human
ggacucucccc

SEQ ID NO: 3721827 - RNA, 17 nt, Human
ggacucugaagccucug

SEQ ID NO: 3721828 - RNA, 13 nt, Human
ggacucugcacau

SEQ ID NO: 3721829 - RNA, 15 nt, Human
ggacucugcacauga

SEQ ID NO: 3721830 - RNA, 16 nt, Human
ggacucuguccugaag

SEQ ID NO: 3721831 - RNA, 23 nt, Human
ggacucuguccugaaggccugag

SEQ ID NO: 3721832 - RNA, 18 nt, Human
ggacucuugcucuuucua

SEQ ID NO: 3721833 - RNA, 16 nt, Human
ggacugaaaaccucuc

SEQ ID NO: 3721834 - RNA, 17 nt, Human
ggacugaaaaccucucc

SEQ ID NO: 3721835 - RNA, 14 nt, Human
ggacugaagccugc

SEQ ID NO: 3721836 - RNA, 16 nt, Human
ggacugaagccugcag

SEQ ID NO: 3721837 - RNA, 14 nt, Human
ggacugaccagcag

SEQ ID NO: 3721838 - RNA, 11 nt, Human
ggacugacuga

SEQ ID NO: 3721839 - RNA, 16 nt, Human
ggacugacugaggcag

SEQ ID NO: 3721840 - RNA, 14 nt, Human
ggacugaggccuga

SEQ ID NO: 3721841 - RNA, 17 nt, Human
ggacugagggacucuga

SEQ ID NO: 3721842 - RNA, 20 nt, Human
ggacugagggggccuggaug

SEQ ID NO: 3721843 - RNA, 15 nt, Human
ggacugaugucuccu

SEQ ID NO: 3721844 - RNA, 19 nt, Human
ggacugcaugguaauuuau

SEQ ID NO: 3721845 - RNA, 18 nt, Human
ggacugccccgugcagac

SEQ ID NO: 3721846 - RNA, 13 nt, Human
ggacugccucugc

SEQ ID NO: 3721847 - RNA, 22 nt, Human
ggacugccucugccacacucug

SEQ ID NO: 3721848 - RNA, 16 nt, Human
ggacugcugcugccug

SEQ ID NO: 3721849 - RNA, 18 nt, Human
ggacugcugcugccuggc

SEQ ID NO: 3721850 - RNA, 21 nt, Human
ggacuggaggccccuggagcc

SEQ ID NO: 3721851 - RNA, 17 nt, Human
ggacuggccccuggguc

SEQ ID NO: 3721852 - RNA, 13 nt, Human
ggacuggccucug

SEQ ID NO: 3721853 - RNA, 22 nt, Human
ggacuggcgaguccagagagga

SEQ ID NO: 3721854 - RNA, 22 nt, Human
ggacuggcuagaguccucacuc

SEQ ID NO: 3721855 - RNA, 21 nt, Human
ggacugggagcccccagccug

SEQ ID NO: 3721856 - RNA, 17 nt, Human
uccucaagaaauaaaag

SEQ ID NO: 3721857 - RNA, 23 nt, Human
uccucaagaaauaaaaggaagcc

SEQ ID NO: 3721858 - RNA, 14 nt, Human
uccucaaggggcca

SEQ ID NO: 3721859 - RNA, 21 nt, Human
uccucaaggggccauccuguc

SEQ ID NO: 3721860 - RNA, 18 nt, Human
uccucaaguccccaagau

SEQ ID NO: 3721861 - RNA, 15 nt, Human
uccucacacacagac

SEQ ID NO: 3721862 - RNA, 14 nt, Human
uccucacaguccca

SEQ ID NO: 3721863 - RNA, 20 nt, Human
uccucacaucuuucacacuu

SEQ ID NO: 3721864 - RNA, 12 nt, Human
uccucaccccug

SEQ ID NO: 3721865 - RNA, 14 nt, Human
uccucaccccuguc

SEQ ID NO: 3721866 - RNA, 19 nt, Human
uccucaccccuguccucac

SEQ ID NO: 3721867 - RNA, 20 nt, Human
uccucaccccuguccucacu

SEQ ID NO: 3721868 - RNA, 15 nt, Human
uccucaccucaugcc

SEQ ID NO: 3721869 - RNA, 16 nt, Human
uccucaccucaugccc

SEQ ID NO: 3721870 - RNA, 21 nt, Human
uccucaccucaugcccacccc

SEQ ID NO: 3721871 - RNA, 13 nt, Human
uccucaccucugg

SEQ ID NO: 3721872 - RNA, 15 nt, Human
uccucaccucuggac

SEQ ID NO: 3721873 - RNA, 15 nt, Human
uccucaccuuuuccc

SEQ ID NO: 3721874 - RNA, 17 nt, Human
uccucacucccagucca

SEQ ID NO: 3721875 - RNA, 22 nt, Human
uccucacuggccaucccucgug

SEQ ID NO: 3721876 - RNA, 13 nt, Human
uccucacugggug

SEQ ID NO: 3721877 - RNA, 22 nt, Human
uccucacugugguaaaugccac

SEQ ID NO: 3721878 - RNA, 15 nt, Human
uccucagccagccuc

SEQ ID NO: 3721879 - RNA, 12 nt, Human
uccucagccagu

SEQ ID NO: 3721880 - RNA, 15 nt, Human
uccucaggcacacag

SEQ ID NO: 3721881 - RNA, 18 nt, Human
uccucagggacagagaca

SEQ ID NO: 3721882 - RNA, 22 nt, Human
uccucagggacagagacaccug

SEQ ID NO: 3721883 - RNA, 24 nt, Human
uccucagggacagagacaccugca

SEQ ID NO: 3721884 - RNA, 12 nt, Human
uccucagggcag

SEQ ID NO: 3721885 - RNA, 16 nt, Human
uccucagguggccaug

SEQ ID NO: 3721886 - RNA, 18 nt, Human
uccucaguccauuuauau

SEQ ID NO: 3721887 - RNA, 19 nt, Human
uccucaguccauuuauaua

SEQ ID NO: 3721888 - RNA, 21 nt, Human
uccucaguccauuuauauaug

SEQ ID NO: 3721889 - RNA, 23 nt, Human
uccucauaaaaagcaaaacaaaa

SEQ ID NO: 3721890 - RNA, 22 nt, Human
uccucauacccacccccaccca

SEQ ID NO: 3721891 - RNA, 16 nt, Human
uccucauccagggcuc

SEQ ID NO: 3721892 - RNA, 12 nt, Human
uccucaucucua

SEQ ID NO: 3721893 - RNA, 20 nt, Human
uccucaucucuaacagcuca

SEQ ID NO: 3721894 - RNA, 22 nt, Human
uccucaucucuaacagcucagg

SEQ ID NO: 3721895 - RNA, 21 nt, Human
uccucaucugggggaguggaa

SEQ ID NO: 3721896 - RNA, 22 nt, Human
uccucauggcagccuacucucc

SEQ ID NO: 3721897 - RNA, 20 nt, Human
uccucaugucuucucacaag

SEQ ID NO: 3721898 - RNA, 17 nt, Human
uccucauuaaauuaccu

SEQ ID NO: 3721899 - RNA, 14 nt, Human
uccucauuccugaa

SEQ ID NO: 3721900 - RNA, 16 nt, Human
uccucauuucuccaga

SEQ ID NO: 3721901 - RNA, 19 nt, Human
uccucauuugggguagcua

SEQ ID NO: 3721902 - RNA, 21 nt, Human
uccucauuugggguagcuaga

SEQ ID NO: 3721903 - RNA, 22 nt, Human
uccucauuuuuauaaugucccu

SEQ ID NO: 3721904 - RNA, 17 nt, Human
uccuccaaaggcccccu

SEQ ID NO: 3721905 - RNA, 22 nt, Human
uccuccaacaccaagcacagca

SEQ ID NO: 3721906 - RNA, 13 nt, Human
uccuccaacagcu

SEQ ID NO: 3721907 - RNA, 14 nt, Human
uccuccaaggacag

SEQ ID NO: 3721908 - RNA, 15 nt, Human
uccuccacauccuuu

SEQ ID NO: 3721909 - RNA, 16 nt, Human
uccuccacauuuguuu

SEQ ID NO: 3721910 - RNA, 21 nt, Human
uccuccaccaccgcccgucug

SEQ ID NO: 3721911 - RNA, 22 nt, Human
uccuccaccaccgcccgucugu

SEQ ID NO: 3721912 - RNA, 23 nt, Human
uccuccacguucugcucaucauu

SEQ ID NO: 3721913 - RNA, 21 nt, Human
uccuccagaacucuuccucca

SEQ ID NO: 3721914 - RNA, 16 nt, Human
uccuccagaagccucu

SEQ ID NO: 3721915 - RNA, 18 nt, Human
uccuccagaagccucugg

SEQ ID NO: 3721916 - RNA, 14 nt, Human
uccuccagcaggga

SEQ ID NO: 3721917 - RNA, 14 nt, Human
uccuccagccccug

SEQ ID NO: 3721918 - RNA, 17 nt, Human
uccuccagccccuguag

SEQ ID NO: 3721919 - RNA, 13 nt, Human
uccuccagcugca

SEQ ID NO: 3721920 - RNA, 14 nt, Human
uccuccagggacag

SEQ ID NO: 3721921 - RNA, 16 nt, Human
uccuccagggacagca

SEQ ID NO: 3721922 - RNA, 13 nt, Human
uccuccagggcca

SEQ ID NO: 3721923 - RNA, 20 nt, Human
uccuccagggccacgugcca

SEQ ID NO: 3721924 - RNA, 23 nt, Human
uccuccagggccacgugccaggc

SEQ ID NO: 3721925 - RNA, 17 nt, Human
uccuccagggugauuuu

SEQ ID NO: 3721926 - RNA, 11 nt, Human
uccuccagguu

SEQ ID NO: 3721927 - RNA, 15 nt, Human
uccuccagguuuuuc

SEQ ID NO: 3721928 - RNA, 16 nt, Human
uccuccagguuuuuca

SEQ ID NO: 3721929 - RNA, 17 nt, Human
uccuccagguuuuucaa

SEQ ID NO: 3721930 - RNA, 21 nt, Human
uccuccagguuuuucaauuaa

SEQ ID NO: 3721931 - RNA, 23 nt, Human
uccuccagguuuuucaauuaaac

SEQ ID NO: 3721932 - RNA, 17 nt, Human
uccuccaguaccuugcu

SEQ ID NO: 3721933 - RNA, 17 nt, Human
uccuccaucgcaguguu

SEQ ID NO: 3721934 - RNA, 16 nt, Human
uccuccaucuccaaga

SEQ ID NO: 3721935 - RNA, 12 nt, Human
uccuccauggga

SEQ ID NO: 3721936 - RNA, 21 nt, Human
uccucccaauuucagacuccc

SEQ ID NO: 3721937 - RNA, 14 nt, Human
uccucccaccucag

SEQ ID NO: 3721938 - RNA, 16 nt, Human
uccucccaccucagcc

SEQ ID NO: 3721939 - RNA, 20 nt, Human
uccucccaccucagccuccc

SEQ ID NO: 3721940 - RNA, 23 nt, Human
uccucccaggguuuuaacuuugu

SEQ ID NO: 3721941 - RNA, 20 nt, Human
uccucccauagauacucucu

SEQ ID NO: 3721942 - RNA, 13 nt, Human
uccucccaucccc

SEQ ID NO: 3721943 - RNA, 15 nt, Human
uccucccauccccug

SEQ ID NO: 3721944 - RNA, 18 nt, Human
uccucccauccccuggac

SEQ ID NO: 3721945 - RNA, 16 nt, Human
uccuccccaaaucaau

SEQ ID NO: 3721946 - RNA, 21 nt, Human
uccuccccccuccucugaaac

SEQ ID NO: 3721947 - RNA, 14 nt, Human
uccucccccugcca

SEQ ID NO: 3721948 - RNA, 20 nt, Human
uccucccccugccagugccu

SEQ ID NO: 3721949 - RNA, 16 nt, Human
uccuccccucacagcc

SEQ ID NO: 3721950 - RNA, 17 nt, Human
uccuccccucacagccu

SEQ ID NO: 3721951 - RNA, 18 nt, Human
uccuccccuccuccugga

SEQ ID NO: 3721952 - RNA, 17 nt, Human
ucuagaauuauuuuuca

SEQ ID NO: 3721953 - RNA, 19 nt, Human
ucuagaauuauuuuucacu

SEQ ID NO: 3721954 - RNA, 13 nt, Human
ucuagacaagaua

SEQ ID NO: 3721955 - RNA, 17 nt, Human
ucuagacaagauauugu

SEQ ID NO: 3721956 - RNA, 23 nt, Human
ucuagacacuuuuucuuuacaaa

SEQ ID NO: 3721957 - RNA, 18 nt, Human
ucuagacauggagguucu

SEQ ID NO: 3721958 - RNA, 19 nt, Human
ucuagacauggagguucua

SEQ ID NO: 3721959 - RNA, 22 nt, Human
ucuagacauggagguucuaagg

SEQ ID NO: 3721960 - RNA, 16 nt, Human
ucuagacuauaaaugu

SEQ ID NO: 3721961 - RNA, 24 nt, Human
ucuagacucaagguucccagagau

SEQ ID NO: 3721962 - RNA, 14 nt, Human
ucuagagagggaau

SEQ ID NO: 3721963 - RNA, 22 nt, Human
ucuagagagggaauucucuugg

SEQ ID NO: 3721964 - RNA, 13 nt, Human
ucuagagagggag

SEQ ID NO: 3721965 - RNA, 15 nt, Human
ucuagagcacugcca

SEQ ID NO: 3721966 - RNA, 19 nt, Human
ucuagagccugcuggaucu

SEQ ID NO: 3721967 - RNA, 12 nt, Human
ucuagagccuuc

SEQ ID NO: 3721968 - RNA, 23 nt, Human
ucuagaggccugaaauccugguu

SEQ ID NO: 3721969 - RNA, 21 nt, Human
ucuagaggcuuccuucauuuc

SEQ ID NO: 3721970 - RNA, 13 nt, Human
ucuagaguccaag

SEQ ID NO: 3721971 - RNA, 15 nt, Human
ucuagaguccaaggu

SEQ ID NO: 3721972 - RNA, 14 nt, Human
ucuagaguucagag

SEQ ID NO: 3721973 - RNA, 16 nt, Human
ucuagauacaauaaau

SEQ ID NO: 3721974 - RNA, 20 nt, Human
ucuagauacaauaaauugcu

SEQ ID NO: 3721975 - RNA, 24 nt, Human
ucuagauacuguaucaugacaaag

SEQ ID NO: 3721976 - RNA, 21 nt, Human
ucuagaucagaugcuccaaga

SEQ ID NO: 3721977 - RNA, 14 nt, Human
ucuagaucauaagg

SEQ ID NO: 3721978 - RNA, 20 nt, Human
ucuagaugaaguuuuacauu

SEQ ID NO: 3721979 - RNA, 16 nt, Human
ucuagaugagcugggc

SEQ ID NO: 3721980 - RNA, 22 nt, Human
ucuagaugauuuuuugaaaguu

SEQ ID NO: 3721981 - RNA, 11 nt, Human
ucuagauguaa

SEQ ID NO: 3721982 - RNA, 17 nt, Human
ucuagauucaaagguuc

SEQ ID NO: 3721983 - RNA, 20 nt, Human
ucuagauucaaagguucuag

SEQ ID NO: 3721984 - RNA, 14 nt, Human
ucuagcacuggccu

SEQ ID NO: 3721985 - RNA, 15 nt, Human
ucuagcacuuccuug

SEQ ID NO: 3721986 - RNA, 17 nt, Human
ucuagcacuuccuugcc

SEQ ID NO: 3721987 - RNA, 17 nt, Human
ucuagcauggcauauuu

SEQ ID NO: 3721988 - RNA, 23 nt, Human
ucuagcauggcauauuuuucaca

SEQ ID NO: 3721989 - RNA, 18 nt, Human
ucuagcauggcugccaau

SEQ ID NO: 3721990 - RNA, 23 nt, Human
ucuagccacuuuggucccgugca

SEQ ID NO: 3721991 - RNA, 14 nt, Human
ucuagccugcacuu

SEQ ID NO: 3721992 - RNA, 13 nt, Human
ucuagccuggcua

SEQ ID NO: 3721993 - RNA, 16 nt, Human
ucuagcuagaaauaug

SEQ ID NO: 3721994 - RNA, 19 nt, Human
ucuagcuaugcuguaucug

SEQ ID NO: 3721995 - RNA, 17 nt, Human
ucuagcuggugguuuca

SEQ ID NO: 3721996 - RNA, 19 nt, Human
ucuagcuguugagcuguuu

SEQ ID NO: 3721997 - RNA, 16 nt, Human
ucuagcuuuguuuagu

SEQ ID NO: 3721998 - RNA, 14 nt, Human
ucuaggaaaauuau

SEQ ID NO: 3721999 - RNA, 15 nt, Human
ucuaggaaauauacu

SEQ ID NO: 3722000 - RNA, 17 nt, Human
ucuaggaaauauuuauu

SEQ ID NO: 3722001 - RNA, 20 nt, Human
ucuaggaagaauuuuaaaaa

SEQ ID NO: 3722002 - RNA, 22 nt, Human
ucuaggaagaauuuuaaaaaug

SEQ ID NO: 3722003 - RNA, 15 nt, Human
ucuaggaagacauuu

SEQ ID NO: 3722004 - RNA, 12 nt, Human
ucuaggaagacu

SEQ ID NO: 3722005 - RNA, 13 nt, Human
ucuaggacacagu

SEQ ID NO: 3722006 - RNA, 16 nt, Human
ucuaggacugaauuau

SEQ ID NO: 3722007 - RNA, 14 nt, Human
ucuaggauagcuaa

SEQ ID NO: 3722008 - RNA, 22 nt, Human
ucuaggcacuguaguucuaaga

SEQ ID NO: 3722009 - RNA, 21 nt, Human
ucuaggcaguucaaagcagga

SEQ ID NO: 3722010 - RNA, 18 nt, Human
ucuaggcaucccagggga

SEQ ID NO: 3722011 - RNA, 15 nt, Human
ucuaggccucuccag

SEQ ID NO: 3722012 - RNA, 12 nt, Human
ucuaggcucugc

SEQ ID NO: 3722013 - RNA, 14 nt, Human
ucuaggcucugccu

SEQ ID NO: 3722014 - RNA, 22 nt, Human
ucuagggaaaaaccagcgugug

SEQ ID NO: 3722015 - RNA, 17 nt, Human
ucuagggaaaugaaaga

SEQ ID NO: 3722016 - RNA, 23 nt, Human
ucuagggaaggccaccugcaggu

SEQ ID NO: 3722017 - RNA, 17 nt, Human
ucuagggaccagaacca

SEQ ID NO: 3722018 - RNA, 18 nt, Human
ucuagggaccccuccucc

SEQ ID NO: 3722019 - RNA, 13 nt, Human
ucuagggcuggga

SEQ ID NO: 3722020 - RNA, 17 nt, Human
ucuaggguugcuggagc

SEQ ID NO: 3722021 - RNA, 13 nt, Human
ucuagguaauuuu

SEQ ID NO: 3722022 - RNA, 20 nt, Human
ucuagguaggggcccacuuc

SEQ ID NO: 3722023 - RNA, 17 nt, Human
ucuagguagugcccuau

SEQ ID NO: 3722024 - RNA, 16 nt, Human
ucuaggucaaggccug

SEQ ID NO: 3722025 - RNA, 20 nt, Human
ucuaggucaguacccaccug

SEQ ID NO: 3722026 - RNA, 15 nt, Human
ucuagguccccauac

SEQ ID NO: 3722027 - RNA, 19 nt, Human
ucuagguggaguugaaaga

SEQ ID NO: 3722028 - RNA, 17 nt, Human
ucuagguggcaaggcug

SEQ ID NO: 3722029 - RNA, 17 nt, Human
ucuagguuuaugacagu

SEQ ID NO: 3722030 - RNA, 15 nt, Human
ucuaguaauaaagac

SEQ ID NO: 3722031 - RNA, 13 nt, Human
ucuaguacuguga

SEQ ID NO: 3722032 - RNA, 22 nt, Human
ucuaguacuugggagaccugua

SEQ ID NO: 3722033 - RNA, 20 nt, Human
ucuagucaaugacaugaauu

SEQ ID NO: 3722034 - RNA, 22 nt, Human
ucuagucaaugacaugaauuuu

SEQ ID NO: 3722035 - RNA, 20 nt, Human
ucuagugcagcugaaauuga

SEQ ID NO: 3722036 - RNA, 16 nt, Human
ucuagugcagcugauu

SEQ ID NO: 3722037 - RNA, 23 nt, Human
ucuagugcagcugauuuuaacaa

SEQ ID NO: 3722038 - RNA, 14 nt, Human
ucuagugcccucca

SEQ ID NO: 3722039 - RNA, 20 nt, Human
ucuagugcccuccacagccg

SEQ ID NO: 3722040 - RNA, 14 nt, Human
ucuagugccuucua

SEQ ID NO: 3722041 - RNA, 23 nt, Human
ucuagugccuucuaaagguguug

SEQ ID NO: 3722042 - RNA, 13 nt, Human
ucuagugcuguga

SEQ ID NO: 3722043 - RNA, 14 nt, Human
ucuagugcugugaa

SEQ ID NO: 3722044 - RNA, 16 nt, Human
ucuagugcugugaaaa

SEQ ID NO: 3722045 - RNA, 19 nt, Human
ucuagugcugugaaaaaaa

SEQ ID NO: 3722046 - RNA, 12 nt, Human
ucuagugggaag

SEQ ID NO: 3722047 - RNA, 13 nt, Human
ucuagugggacag

SEQ ID NO: 3722048 - RNA, 15 nt, Human
ucuagugggacagcc

SEQ ID NO: 3722049 - RNA, 24 nt, Human
ucuagugggacagcccagagccug

SEQ ID NO: 3722050 - RNA, 15 nt, Human
ucuaguggucuuugu

SEQ ID NO: 3722051 - RNA, 23 nt, Human
ucuaguggucuuuguaagagugu

SEQ ID NO: 3722052 - RNA, 14 nt, Human
ucuaguguaucaaa

SEQ ID NO: 3722053 - RNA, 16 nt, Human
ucuaguguaucaaaau

SEQ ID NO: 3722054 - RNA, 22 nt, Human
ucuaguguaucaaaaugcucuu

SEQ ID NO: 3722055 - RNA, 16 nt, Human
ucuaguuauuuauucu

SEQ ID NO: 3722056 - RNA, 12 nt, Human
ucuaguucacuc

SEQ ID NO: 3722057 - RNA, 19 nt, Human
ucuaguucacucuccauuu

SEQ ID NO: 3722058 - RNA, 21 nt, Human
ucuaguuccccuguuuauuca

SEQ ID NO: 3722059 - RNA, 17 nt, Human
ucuaguucugccaggag

SEQ ID NO: 3722060 - RNA, 14 nt, Human
ucuaguugaggagu

SEQ ID NO: 3722061 - RNA, 20 nt, Human
ucuaguugaggaguuuccua

SEQ ID NO: 3722062 - RNA, 21 nt, Human
ucuaguugaggaguuuccuaa

SEQ ID NO: 3722063 - RNA, 14 nt, Human
ucuaguuuacagaa

SEQ ID NO: 3722064 - RNA, 13 nt, Human
ucuaguuucccac

SEQ ID NO: 3722065 - RNA, 15 nt, Human
ucuaguuugcauucc

SEQ ID NO: 3722066 - RNA, 12 nt, Human
ucuaguuuucag

SEQ ID NO: 3722067 - RNA, 17 nt, Human
ucuaguuuucaguuugu

SEQ ID NO: 3722068 - RNA, 13 nt, Human
ucuaguuuuguca

SEQ ID NO: 3722069 - RNA, 20 nt, Human
ucuaguuuuuucuuccuuuu

SEQ ID NO: 3722070 - RNA, 22 nt, Human
ucuaguuuuuucuuccuuuuca

SEQ ID NO: 3722071 - RNA, 15 nt, Human
ucuauaaaaaauaug

SEQ ID NO: 3722072 - RNA, 15 nt, Human
ucuauaaacacuguu

SEQ ID NO: 3722073 - RNA, 20 nt, Human
ucuauaaagaagaacuugca

SEQ ID NO: 3722074 - RNA, 20 nt, Human
ucuauaaagcgauauacaga

SEQ ID NO: 3722075 - RNA, 13 nt, Human
ucuauaaauaacc

SEQ ID NO: 3722076 - RNA, 23 nt, Human
ucuauaacaaaggauacuuauuu

SEQ ID NO: 3722077 - RNA, 15 nt, Human
ucuauaacaugcauu

SEQ ID NO: 3722078 - RNA, 21 nt, Human
ucuauaagcaaauugcuuuuu

SEQ ID NO: 3722079 - RNA, 16 nt, Human
ucuauaaggccauaaa

SEQ ID NO: 3722080 - RNA, 21 nt, Human
ucuauaauauuuguguguuca

SEQ ID NO: 3722081 - RNA, 13 nt, Human
ucuauaauuuaaa

SEQ ID NO: 3722082 - RNA, 12 nt, Human
ucuauaauuuac

SEQ ID NO: 3722083 - RNA, 19 nt, Human
ucuauaauuuccauuuacu

SEQ ID NO: 3722084 - RNA, 22 nt, Human
ucuauaauuuccauuuacuuaa

SEQ ID NO: 3722085 - RNA, 18 nt, Human
ucuauacaucucucccca

SEQ ID NO: 3722086 - RNA, 16 nt, Human
ucuauaccaauaaagu

SEQ ID NO: 3722087 - RNA, 17 nt, Human
ucuauacccacccagaa

SEQ ID NO: 3722088 - RNA, 20 nt, Human
ucuauaccugucuccuuucu

SEQ ID NO: 3722089 - RNA, 15 nt, Human
ucuauacuugcuuug

SEQ ID NO: 3722090 - RNA, 12 nt, Human
ucuauagaaagu

SEQ ID NO: 3722091 - RNA, 19 nt, Human
ucuauagaaaguguucugu

SEQ ID NO: 3722092 - RNA, 22 nt, Human
ucuauagaaaguguucuguuac

SEQ ID NO: 3722093 - RNA, 13 nt, Human
ucuauagacucua

SEQ ID NO: 3722094 - RNA, 17 nt, Human
ucuauagcaccagggcu

SEQ ID NO: 3722095 - RNA, 19 nt, Human
ucuauagcaucacuuaaaa

SEQ ID NO: 3722096 - RNA, 21 nt, Human
ucuauaggaacauaugaaaau

SEQ ID NO: 3722097 - RNA, 18 nt, Human
ucuauaguagacacacua

SEQ ID NO: 3722098 - RNA, 16 nt, Human
ucuauauauguguaug

SEQ ID NO: 3722099 - RNA, 13 nt, Human
ucuauauguacuu

SEQ ID NO: 3722100 - RNA, 20 nt, Human
ucuauauguacuugucaaag

SEQ ID NO: 3722101 - RNA, 18 nt, Human
ucuauauguuuaaaagua

SEQ ID NO: 3722102 - RNA, 16 nt, Human
ggaggcccuccugugc

SEQ ID NO: 3722103 - RNA, 18 nt, Human
ggaggccgggugcucagg

SEQ ID NO: 3722104 - RNA, 13 nt, Human
ggaggccucaggu

SEQ ID NO: 3722105 - RNA, 16 nt, Human
ggaggccucaggugcu

SEQ ID NO: 3722106 - RNA, 17 nt, Human
ggaggccucaggugcug

SEQ ID NO: 3722107 - RNA, 19 nt, Human
ggaggccugcgacccuggg

SEQ ID NO: 3722108 - RNA, 21 nt, Human
ggaggccugcgacccuggggg

SEQ ID NO: 3722109 - RNA, 17 nt, Human
ggaggccuuccagcugc

SEQ ID NO: 3722110 - RNA, 21 nt, Human
ggaggccuuccagcugcuguc

SEQ ID NO: 3722111 - RNA, 17 nt, Human
ggaggccuuccagggac

SEQ ID NO: 3722112 - RNA, 20 nt, Human
ggaggccuugggcucugcug

SEQ ID NO: 3722113 - RNA, 23 nt, Human
ggaggcgcccuuggcuucuguga

SEQ ID NO: 3722114 - RNA, 12 nt, Human
ggaggcgcgagc

SEQ ID NO: 3722115 - RNA, 20 nt, Human
ggaggcggaccuuguaguga

SEQ ID NO: 3722116 - RNA, 20 nt, Human
ggaggcggcacuccaaccua

SEQ ID NO: 3722117 - RNA, 16 nt, Human
ggaggcggugcggcag

SEQ ID NO: 3722118 - RNA, 15 nt, Human
ggaggcuccaggcag

SEQ ID NO: 3722119 - RNA, 21 nt, Human
ggaggcucuggagcccacugu

SEQ ID NO: 3722120 - RNA, 14 nt, Human
ggaggcugagacag

SEQ ID NO: 3722121 - RNA, 18 nt, Human
ggaggcugaggcagaaga

SEQ ID NO: 3722122 - RNA, 17 nt, Human
ggaggcugcgugccagu

SEQ ID NO: 3722123 - RNA, 11 nt, Human
ggaggcugcuc

SEQ ID NO: 3722124 - RNA, 14 nt, Human
ggaggcugcucggg

SEQ ID NO: 3722125 - RNA, 22 nt, Human
ggaggcugcucggggugcacag

SEQ ID NO: 3722126 - RNA, 13 nt, Human
ggaggcuggcagg

SEQ ID NO: 3722127 - RNA, 16 nt, Human
ggaggcuggcuggggc

SEQ ID NO: 3722128 - RNA, 15 nt, Human
ggaggcuuccugcgu

SEQ ID NO: 3722129 - RNA, 20 nt, Human
ggaggcuugucagagcuggg

SEQ ID NO: 3722130 - RNA, 22 nt, Human
ggaggcuugucagagcugggag

SEQ ID NO: 3722131 - RNA, 19 nt, Human
ggagggaaaagggaaguag

SEQ ID NO: 3722132 - RNA, 15 nt, Human
ggagggaagagugga

SEQ ID NO: 3722133 - RNA, 20 nt, Human
ggagggaagaguggaggugg

SEQ ID NO: 3722134 - RNA, 16 nt, Human
ggagggaagggagcca

SEQ ID NO: 3722135 - RNA, 17 nt, Human
ggagggaagggagccaa

SEQ ID NO: 3722136 - RNA, 15 nt, Human
ggagggaauugaggu

SEQ ID NO: 3722137 - RNA, 17 nt, Human
ggagggaauugaggucu

SEQ ID NO: 3722138 - RNA, 13 nt, Human
ggagggagaggga

SEQ ID NO: 3722139 - RNA, 13 nt, Human
ggagggagaugga

SEQ ID NO: 3722140 - RNA, 16 nt, Human
ggagggaggcucaggu

SEQ ID NO: 3722141 - RNA, 20 nt, Human
ggagggauagaggggggcug

SEQ ID NO: 3722142 - RNA, 17 nt, Human
ggagggauucugguucc

SEQ ID NO: 3722143 - RNA, 21 nt, Human
ggagggcacaggugucugccc

SEQ ID NO: 3722144 - RNA, 14 nt, Human
ggagggcagagcug

SEQ ID NO: 3722145 - RNA, 16 nt, Human
ggagggcagcagggcu

SEQ ID NO: 3722146 - RNA, 21 nt, Human
ggagggccguaccccacccuc

SEQ ID NO: 3722147 - RNA, 13 nt, Human
ggagggccugggc

SEQ ID NO: 3722148 - RNA, 16 nt, Human
ggagggccugggccug

SEQ ID NO: 3722149 - RNA, 21 nt, Human
ggagggcggcaggggccugga

SEQ ID NO: 3722150 - RNA, 19 nt, Human
ggagggcuagaaccuggag

SEQ ID NO: 3722151 - RNA, 20 nt, Human
ggagggcuagaaccuggaga

SEQ ID NO: 3722152 - RNA, 13 nt, Human
ggagggcuccaga

SEQ ID NO: 3722153 - RNA, 15 nt, Human
ggagggcuccagaca

SEQ ID NO: 3722154 - RNA, 12 nt, Human
ggagggcucuga

SEQ ID NO: 3722155 - RNA, 14 nt, Human
ggagggcucugagg

SEQ ID NO: 3722156 - RNA, 15 nt, Human
ggagggcucugaggc

SEQ ID NO: 3722157 - RNA, 14 nt, Human
ggagggcuggaauc

SEQ ID NO: 3722158 - RNA, 16 nt, Human
ggagggcuggaaucug

SEQ ID NO: 3722159 - RNA, 22 nt, Human
ggagggcugucaucugugcacu

SEQ ID NO: 3722160 - RNA, 17 nt, Human
ggaggggaaaaaaaugu

SEQ ID NO: 3722161 - RNA, 13 nt, Human
ggaggggacgcug

SEQ ID NO: 3722162 - RNA, 21 nt, Human
ggaggggacuauuuaugaagg

SEQ ID NO: 3722163 - RNA, 16 nt, Human
ggaggggagacuuuga

SEQ ID NO: 3722164 - RNA, 19 nt, Human
ggaggggagcaugggaagu

SEQ ID NO: 3722165 - RNA, 11 nt, Human
ggaggggagcu

SEQ ID NO: 3722166 - RNA, 13 nt, Human
ggaggggaggggg

SEQ ID NO: 3722167 - RNA, 12 nt, Human
ggaggggcagag

SEQ ID NO: 3722168 - RNA, 13 nt, Human
ggaggggcagagc

SEQ ID NO: 3722169 - RNA, 16 nt, Human
ggaggggcagagccag

SEQ ID NO: 3722170 - RNA, 13 nt, Human
ggaggggccccug

SEQ ID NO: 3722171 - RNA, 13 nt, Human
ggaggggcccgcu

SEQ ID NO: 3722172 - RNA, 23 nt, Human
ggaggggcccgcuugccucggcu

SEQ ID NO: 3722173 - RNA, 21 nt, Human
ggaggggccuggcagccgugc

SEQ ID NO: 3722174 - RNA, 16 nt, Human
ggaggggcgcuggccc

SEQ ID NO: 3722175 - RNA, 18 nt, Human
ggaggggcuccuuuccau

SEQ ID NO: 3722176 - RNA, 14 nt, Human
ggagggggaauggc

SEQ ID NO: 3722177 - RNA, 19 nt, Human
ggagggggaauggcagcag

SEQ ID NO: 3722178 - RNA, 18 nt, Human
ggagggggaauguaguga

SEQ ID NO: 3722179 - RNA, 15 nt, Human
ggagggggagggggu

SEQ ID NO: 3722180 - RNA, 18 nt, Human
ggagggggcuugaagcca

SEQ ID NO: 3722181 - RNA, 18 nt, Human
ggaggggguugggguggu

SEQ ID NO: 3722182 - RNA, 18 nt, Human
ggaggggguuugggggcu

SEQ ID NO: 3722183 - RNA, 15 nt, Human
ggagggguaggggcu

SEQ ID NO: 3722184 - RNA, 16 nt, Human
ggagggguaggggcug

SEQ ID NO: 3722185 - RNA, 17 nt, Human
ggaggggugguccugac

SEQ ID NO: 3722186 - RNA, 14 nt, Human
ggagggucaggaag

SEQ ID NO: 3722187 - RNA, 14 nt, Human
ggagggucccaagc

SEQ ID NO: 3722188 - RNA, 21 nt, Human
ggagggucccaagcugggccc

SEQ ID NO: 3722189 - RNA, 14 nt, Human
ggagggugggaagg

SEQ ID NO: 3722190 - RNA, 20 nt, Human
ggagggugggggccaccugc

SEQ ID NO: 3722191 - RNA, 17 nt, Human
ggaggucacuggaaagg

SEQ ID NO: 3722192 - RNA, 21 nt, Human
ggaggucacuggaaaggggag

SEQ ID NO: 3722193 - RNA, 20 nt, Human
ggagguccuuaggccucuga

SEQ ID NO: 3722194 - RNA, 16 nt, Human
ggaggucgaggcagga

SEQ ID NO: 3722195 - RNA, 14 nt, Human
ggaggugaccccag

SEQ ID NO: 3722196 - RNA, 13 nt, Human
ggaggugccugga

SEQ ID NO: 3722197 - RNA, 22 nt, Human
ggaggugcuuaagcagaagcau

SEQ ID NO: 3722198 - RNA, 20 nt, Human
ggagguggaagaagggagaa

SEQ ID NO: 3722199 - RNA, 20 nt, Human
ggagguggaggcugcaguga

SEQ ID NO: 3722200 - RNA, 20 nt, Human
ggagguggagguugcaguga

SEQ ID NO: 3722201 - RNA, 20 nt, Human
ggagguggagguugcauuga

SEQ ID NO: 3722202 - RNA, 15 nt, Human
ggagguggcagcccu

SEQ ID NO: 3722203 - RNA, 13 nt, Human
ggagguggcuggg

SEQ ID NO: 3722204 - RNA, 19 nt, Human
ggaggugggagcaggagau

SEQ ID NO: 3722205 - RNA, 23 nt, Human
ggaggugggauccuccaggugca

SEQ ID NO: 3722206 - RNA, 19 nt, Human
ggagguggggcgaggcagg

SEQ ID NO: 3722207 - RNA, 16 nt, Human
ggaggugucaggcugc

SEQ ID NO: 3722208 - RNA, 20 nt, Human
ggaggugucucaggcugccu

SEQ ID NO: 3722209 - RNA, 22 nt, Human
ggaggugucucaggcugccuga

SEQ ID NO: 3722210 - RNA, 16 nt, Human
ggaggugucuguauca

SEQ ID NO: 3722211 - RNA, 17 nt, Human
ggaggugugaggcagga

SEQ ID NO: 3722212 - RNA, 18 nt, Human
ggagguguggagccgagg

SEQ ID NO: 3722213 - RNA, 9 nt, Human
ggagguucc

SEQ ID NO: 3722214 - RNA, 12 nt, Human
ggagguucuaag

SEQ ID NO: 3722215 - RNA, 16 nt, Human
ggagguugaagccaag

SEQ ID NO: 3722216 - RNA, 14 nt, Human
ggagguugcaguga

SEQ ID NO: 3722217 - RNA, 14 nt, Human
ggagguuugucggg

SEQ ID NO: 3722218 - RNA, 17 nt, Human
ggaguaaccgcuccagg

SEQ ID NO: 3722219 - RNA, 21 nt, Human
ggaguaauaguaaacacaggg

SEQ ID NO: 3722220 - RNA, 18 nt, Human
ggaguaaucuguguacaa

SEQ ID NO: 3722221 - RNA, 15 nt, Human
ggaguagcugagcuc

SEQ ID NO: 3722222 - RNA, 16 nt, Human
ggaguagcugagcuca

SEQ ID NO: 3722223 - RNA, 20 nt, Human
ggaguagugaagacuccaga

SEQ ID NO: 3722224 - RNA, 13 nt, Human
ggaguaucuggga

SEQ ID NO: 3722225 - RNA, 15 nt, Human
ggaguaucugggaac

SEQ ID NO: 3722226 - RNA, 17 nt, Human
ggaguaugucugaugga

SEQ ID NO: 3722227 - RNA, 21 nt, Human
ggagucacacaguguuggagg

SEQ ID NO: 3722228 - RNA, 14 nt, Human
ggagucacugagac

SEQ ID NO: 3722229 - RNA, 15 nt, Human
ggagucagccaggag

SEQ ID NO: 3722230 - RNA, 18 nt, Human
ggagucagccaggagcug

SEQ ID NO: 3722231 - RNA, 17 nt, Human
ggagucaucucaaccau

SEQ ID NO: 3722232 - RNA, 16 nt, Human
ggagucauuucugauu

SEQ ID NO: 3722233 - RNA, 21 nt, Human
ggagucauuugagucucuuaa

SEQ ID NO: 3722234 - RNA, 17 nt, Human
ggaguccaggcacagga

SEQ ID NO: 3722235 - RNA, 21 nt, Human
ggagucccaccuuggcugcag

SEQ ID NO: 3722236 - RNA, 23 nt, Human
ggagucccaccuuggcugcaggg

SEQ ID NO: 3722237 - RNA, 15 nt, Human
ggagucccgucagga

SEQ ID NO: 3722238 - RNA, 21 nt, Human
ggagucuccagugguugcugu

SEQ ID NO: 3722239 - RNA, 21 nt, Human
ggagugaaaccuuuagggcag

SEQ ID NO: 3722240 - RNA, 22 nt, Human
ggagugaaaccuuuagggcagc

SEQ ID NO: 3722241 - RNA, 17 nt, Human
ggagugaagaggggcag

SEQ ID NO: 3722242 - RNA, 19 nt, Human
ggagugaagaggggcagcc

SEQ ID NO: 3722243 - RNA, 17 nt, Human
ggagugacagaggcagc

SEQ ID NO: 3722244 - RNA, 19 nt, Human
ggagugagaggucucucuu

SEQ ID NO: 3722245 - RNA, 15 nt, Human
ggagugagaugccug

SEQ ID NO: 3722246 - RNA, 14 nt, Human
ggagugagcugguu

SEQ ID NO: 3722247 - RNA, 21 nt, Human
ggagugaggaaggcaggaaga

SEQ ID NO: 3722248 - RNA, 21 nt, Human
ggagugaggaauaguugagcc

SEQ ID NO: 3722249 - RNA, 15 nt, Human
ggagugaguggcccu

SEQ ID NO: 3722250 - RNA, 21 nt, Human
ggagugaguguggcuccccuc

SEQ ID NO: 3722251 - RNA, 15 nt, Human
ggagugcagggagga

SEQ ID NO: 3722252 - RNA, 15 nt, Human
ggagugcagugagcc

SEQ ID NO: 3722253 - RNA, 14 nt, Human
aagacucaguguuc

SEQ ID NO: 3722254 - RNA, 17 nt, Human
aagacucauucuucugu

SEQ ID NO: 3722255 - RNA, 14 nt, Human
aagacuccaaagaa

SEQ ID NO: 3722256 - RNA, 16 nt, Human
aagacuccaaagaaau

SEQ ID NO: 3722257 - RNA, 14 nt, Human
aagacuccagaaau

SEQ ID NO: 3722258 - RNA, 14 nt, Human
aagacuccuagcug

SEQ ID NO: 3722259 - RNA, 17 nt, Human
aagacucuauucucaaa

SEQ ID NO: 3722260 - RNA, 22 nt, Human
aagacucuugggagggaguuac

SEQ ID NO: 3722261 - RNA, 19 nt, Human
aagacugagcaccugcuuc

SEQ ID NO: 3722262 - RNA, 21 nt, Human
aagacugcuguggccaggagg

SEQ ID NO: 3722263 - RNA, 22 nt, Human
aagacugcuguggccaggaggu

SEQ ID NO: 3722264 - RNA, 20 nt, Human
aagacuggaagcuaauuugc

SEQ ID NO: 3722265 - RNA, 22 nt, Human
aagacuggaagcuaauuugcau

SEQ ID NO: 3722266 - RNA, 21 nt, Human
aagacuggaagguggggacag

SEQ ID NO: 3722267 - RNA, 16 nt, Human
aagacugguuuucugc

SEQ ID NO: 3722268 - RNA, 20 nt, Human
aagacugguuuucugccaau

SEQ ID NO: 3722269 - RNA, 16 nt, Human
aagacuguagauaugu

SEQ ID NO: 3722270 - RNA, 17 nt, Human
aagacuguagauaugua

SEQ ID NO: 3722271 - RNA, 16 nt, Human
aagacuguugcucaaa

SEQ ID NO: 3722272 - RNA, 14 nt, Human
aagacuuacucuaa

SEQ ID NO: 3722273 - RNA, 15 nt, Human
aagacuuacucuaag

SEQ ID NO: 3722274 - RNA, 17 nt, Human
aagacuuacucuaagau

SEQ ID NO: 3722275 - RNA, 12 nt, Human
aagacuucaaaa

SEQ ID NO: 3722276 - RNA, 21 nt, Human
aagacuucaaaauauugagca

SEQ ID NO: 3722277 - RNA, 18 nt, Human
aagacuucaguauguugu

SEQ ID NO: 3722278 - RNA, 22 nt, Human
aagacuucaguauguugucaaa

SEQ ID NO: 3722279 - RNA, 16 nt, Human
aagacuuggcaacaga

SEQ ID NO: 3722280 - RNA, 21 nt, Human
aagacuuuccccauacucugu

SEQ ID NO: 3722281 - RNA, 23 nt, Human
aagacuuuccccauacucugucu

SEQ ID NO: 3722282 - RNA, 16 nt, Human
aagacuuuggaaagac

SEQ ID NO: 3722283 - RNA, 20 nt, Human
aagacuuugggauaggaaaa

SEQ ID NO: 3722284 - RNA, 13 nt, Human
aagacuuugguua

SEQ ID NO: 3722285 - RNA, 23 nt, Human
aagacuuugguuauuuuacuuuu

SEQ ID NO: 3722286 - RNA, 17 nt, Human
aagacuuuuccaacccu

SEQ ID NO: 3722287 - RNA, 12 nt, Human
aagacuuuucuu

SEQ ID NO: 3722288 - RNA, 17 nt, Human
aagagaaaaagaaaugc

SEQ ID NO: 3722289 - RNA, 18 nt, Human
aagagaaaaagaaaugca

SEQ ID NO: 3722290 - RNA, 11 nt, Human
aagagaaaaga

SEQ ID NO: 3722291 - RNA, 13 nt, Human
aagagaaaauuga

SEQ ID NO: 3722292 - RNA, 15 nt, Human
aagagaaaauugaau

SEQ ID NO: 3722293 - RNA, 21 nt, Human
aagagaaacaggguguuguca

SEQ ID NO: 3722294 - RNA, 20 nt, Human
aagagaaacaguugguaacu

SEQ ID NO: 3722295 - RNA, 13 nt, Human
aagagaaacuucc

SEQ ID NO: 3722296 - RNA, 20 nt, Human
aagagaaacuuuauacauua

SEQ ID NO: 3722297 - RNA, 18 nt, Human
aagagaaagugauuucua

SEQ ID NO: 3722298 - RNA, 14 nt, Human
aagagaaaucucau

SEQ ID NO: 3722299 - RNA, 15 nt, Human
aagagaaaugagcug

SEQ ID NO: 3722300 - RNA, 20 nt, Human
aagagaacucgcgcucagua

SEQ ID NO: 3722301 - RNA, 21 nt, Human
aagagaacugaugacacugag

SEQ ID NO: 3722302 - RNA, 11 nt, Human
aagagaagaag

SEQ ID NO: 3722303 - RNA, 16 nt, Human
aagagaagaagaaaaa

SEQ ID NO: 3722304 - RNA, 17 nt, Human
aagagaagaagaaaaaa

SEQ ID NO: 3722305 - RNA, 18 nt, Human
aagagaagggcagggcug

SEQ ID NO: 3722306 - RNA, 21 nt, Human
aagagaaguuauuuucuacag

SEQ ID NO: 3722307 - RNA, 21 nt, Human
aagagaaguuguaaaguaugu

SEQ ID NO: 3722308 - RNA, 20 nt, Human
aagagaaugaugcucaaaau

SEQ ID NO: 3722309 - RNA, 14 nt, Human
aagagaauguuaua

SEQ ID NO: 3722310 - RNA, 15 nt, Human
aagagacagcccagg

SEQ ID NO: 3722311 - RNA, 16 nt, Human
aagagacagcccagga

SEQ ID NO: 3722312 - RNA, 22 nt, Human
aagagacaggagggcaagggcc

SEQ ID NO: 3722313 - RNA, 14 nt, Human
aagagacagucacc

SEQ ID NO: 3722314 - RNA, 17 nt, Human
aagagacaguuauuuau

SEQ ID NO: 3722315 - RNA, 18 nt, Human
aagagaccuaccucaggu

SEQ ID NO: 3722316 - RNA, 14 nt, Human
aagagacucagccu

SEQ ID NO: 3722317 - RNA, 15 nt, Human
aagagacucuggccu

SEQ ID NO: 3722318 - RNA, 18 nt, Human
aagagacuggagcaucug

SEQ ID NO: 3722319 - RNA, 13 nt, Human
aagagagaaaaua

SEQ ID NO: 3722320 - RNA, 17 nt, Human
aagagagaaaauaaaaa

SEQ ID NO: 3722321 - RNA, 20 nt, Human
aagagagaaaauaaaaaguu

SEQ ID NO: 3722322 - RNA, 13 nt, Human
aagagagaaacaa

SEQ ID NO: 3722323 - RNA, 14 nt, Human
aagagagaaagaag

SEQ ID NO: 3722324 - RNA, 21 nt, Human
aagagagaaagaaguaggcau

SEQ ID NO: 3722325 - RNA, 11 nt, Human
aagagagaaau

SEQ ID NO: 3722326 - RNA, 20 nt, Human
aagagagaaccuaacuguau

SEQ ID NO: 3722327 - RNA, 12 nt, Human
aagagagaaugu

SEQ ID NO: 3722328 - RNA, 19 nt, Human
aagagagagaaacaaacuu

SEQ ID NO: 3722329 - RNA, 20 nt, Human
aagagagagagagaaaaaaa

SEQ ID NO: 3722330 - RNA, 18 nt, Human
aagagagccugcaggauc

SEQ ID NO: 3722331 - RNA, 16 nt, Human
aagagagccuugguuc

SEQ ID NO: 3722332 - RNA, 19 nt, Human
aagagaggaugugcaagcg

SEQ ID NO: 3722333 - RNA, 21 nt, Human
aagagagggccaugcaauuca

SEQ ID NO: 3722334 - RNA, 11 nt, Human
aagagagguua

SEQ ID NO: 3722335 - RNA, 14 nt, Human
aagagagucauaaa

SEQ ID NO: 3722336 - RNA, 20 nt, Human
aagagagucauaaaccuuaa

SEQ ID NO: 3722337 - RNA, 21 nt, Human
aagagauauguagaaggcaca

SEQ ID NO: 3722338 - RNA, 16 nt, Human
aagagaucaggaagag

SEQ ID NO: 3722339 - RNA, 17 nt, Human
aagagauccaaagacuc

SEQ ID NO: 3722340 - RNA, 20 nt, Human
aagagaugaugaaaauauuu

SEQ ID NO: 3722341 - RNA, 15 nt, Human
aagagauuccugagc

SEQ ID NO: 3722342 - RNA, 19 nt, Human
aagagauugcuaauugcug

SEQ ID NO: 3722343 - RNA, 13 nt, Human
aagagauuucaag

SEQ ID NO: 3722344 - RNA, 14 nt, Human
aagagauuucaaga

SEQ ID NO: 3722345 - RNA, 15 nt, Human
aagagauuuuucaug

SEQ ID NO: 3722346 - RNA, 20 nt, Human
aagagcaaaagaauggcaga

SEQ ID NO: 3722347 - RNA, 12 nt, Human
aagagcacagcc

SEQ ID NO: 3722348 - RNA, 16 nt, Human
aagagcagccuguggc

SEQ ID NO: 3722349 - RNA, 18 nt, Human
aagagcagccuguggcau

SEQ ID NO: 3722350 - RNA, 17 nt, Human
aagagcaggacuccagg

SEQ ID NO: 3722351 - RNA, 14 nt, Human
aagagccaauggag

SEQ ID NO: 3722352 - RNA, 11 nt, Human
aagagccacag

SEQ ID NO: 3722353 - RNA, 9 nt, Human
aagagccau

SEQ ID NO: 3722354 - RNA, 19 nt, Human
aagagccauauaaguuuga

SEQ ID NO: 3722355 - RNA, 12 nt, Human
aagagcccaggc

SEQ ID NO: 3722356 - RNA, 14 nt, Human
aagagcccaggccu

SEQ ID NO: 3722357 - RNA, 12 nt, Human
aagagccccacu

SEQ ID NO: 3722358 - RNA, 13 nt, Human
aagagccccacuc

SEQ ID NO: 3722359 - RNA, 19 nt, Human
aagagccccacucucagag

SEQ ID NO: 3722360 - RNA, 14 nt, Human
aagagcccuugccu

SEQ ID NO: 3722361 - RNA, 19 nt, Human
aagagccggagccuccagc

SEQ ID NO: 3722362 - RNA, 20 nt, Human
aagagccugaucucuuccug

SEQ ID NO: 3722363 - RNA, 11 nt, Human
aagagccugga

SEQ ID NO: 3722364 - RNA, 21 nt, Human
aagagccuggagaagcugaug

SEQ ID NO: 3722365 - RNA, 14 nt, Human
aagagccuuaaaac

SEQ ID NO: 3722366 - RNA, 22 nt, Human
aagagccuugguguccaccugg

SEQ ID NO: 3722367 - RNA, 18 nt, Human
aagagcgagagaucaaag

SEQ ID NO: 3722368 - RNA, 16 nt, Human
aagagcuagcgcugcc

SEQ ID NO: 3722369 - RNA, 20 nt, Human
aagagcuagcgcugccgcac

SEQ ID NO: 3722370 - RNA, 16 nt, Human
aagagcuaggcagggu

SEQ ID NO: 3722371 - RNA, 20 nt, Human
aagagcuauugccaaccagu

SEQ ID NO: 3722372 - RNA, 13 nt, Human
aagagcucaggau

SEQ ID NO: 3722373 - RNA, 12 nt, Human
aagagcucuggu

SEQ ID NO: 3722374 - RNA, 18 nt, Human
aagagcugaggcaauucu

SEQ ID NO: 3722375 - RNA, 18 nt, Human
aagagcuguucacagcca

SEQ ID NO: 3722376 - RNA, 13 nt, Human
aagagcuuagaaa

SEQ ID NO: 3722377 - RNA, 13 nt, Human
aagagcuugcuuu

SEQ ID NO: 3722378 - RNA, 16 nt, Human
aagagcuugcuuugau

SEQ ID NO: 3722379 - RNA, 12 nt, Human
aagagcuuuccu

SEQ ID NO: 3722380 - RNA, 23 nt, Human
aagaggaaaacccucaagggcau

SEQ ID NO: 3722381 - RNA, 13 nt, Human
aagaggaaaauga

SEQ ID NO: 3722382 - RNA, 14 nt, Human
aagaggaaaaugaa

SEQ ID NO: 3722383 - RNA, 14 nt, Human
aagaggaaagaaug

SEQ ID NO: 3722384 - RNA, 15 nt, Human
aagaggaacugggcc

SEQ ID NO: 3722385 - RNA, 16 nt, Human
aagaggaacugggccu

SEQ ID NO: 3722386 - RNA, 22 nt, Human
aagaggacauaaugggguccug

SEQ ID NO: 3722387 - RNA, 22 nt, Human
aagaggacucgcuuguaaauac

SEQ ID NO: 3722388 - RNA, 16 nt, Human
aagaggaggaggaggg

SEQ ID NO: 3722389 - RNA, 21 nt, Human
aagaggaguuucgagguagag

SEQ ID NO: 3722390 - RNA, 19 nt, Human
aagaggaucuccuguccau

SEQ ID NO: 3722391 - RNA, 14 nt, Human
aagaggaugcugug

SEQ ID NO: 3722392 - RNA, 15 nt, Human
aagaggcaccaggaa

SEQ ID NO: 3722393 - RNA, 19 nt, Human
aagaggcagaaaauugcac

SEQ ID NO: 3722394 - RNA, 19 nt, Human
aagaggcaguugcccagcc

SEQ ID NO: 3722395 - RNA, 15 nt, Human
aagaggccaaugccc

SEQ ID NO: 3722396 - RNA, 18 nt, Human
aagaggccguggcugcug

SEQ ID NO: 3722397 - RNA, 18 nt, Human
aagaggcgggccagccag

SEQ ID NO: 3722398 - RNA, 21 nt, Human
aagaggcgggccagccaggcg

SEQ ID NO: 3722399 - RNA, 22 nt, Human
aagaggcgggccagccaggcgg

SEQ ID NO: 3722400 - RNA, 15 nt, Human
aagaggcugaggccu

SEQ ID NO: 3722401 - RNA, 17 nt, Human
aagaggcugcccuccug

SEQ ID NO: 3722402 - RNA, 12 nt, Human
aagaggcugcug

SEQ ID NO: 3722403 - RNA, 11 nt, Human
aagaggcuggu

SEQ ID NO: 3722404 - RNA, 17 nt, Human
aagaggcuggugcugug

SEQ ID NO: 3722405 - RNA, 13 nt, Human
uccuccccuuggg

SEQ ID NO: 3722406 - RNA, 19 nt, Human
uccucccgggcccucccuu

SEQ ID NO: 3722407 - RNA, 21 nt, Human
uccucccgggcccucccuugg

SEQ ID NO: 3722408 - RNA, 22 nt, Human
uccucccgggcccucccuugga

SEQ ID NO: 3722409 - RNA, 15 nt, Human
uccucccucagugcc

SEQ ID NO: 3722410 - RNA, 11 nt, Human
uccucccuccc

SEQ ID NO: 3722411 - RNA, 15 nt, Human
uccucccucccagcu

SEQ ID NO: 3722412 - RNA, 17 nt, Human
uccucccucccucuccg

SEQ ID NO: 3722413 - RNA, 19 nt, Human
uccucccuggcugcccugg

SEQ ID NO: 3722414 - RNA, 12 nt, Human
uccucccuguaa

SEQ ID NO: 3722415 - RNA, 15 nt, Human
uccucccuguaacuu

SEQ ID NO: 3722416 - RNA, 18 nt, Human
uccucccuuccuuuuccc

SEQ ID NO: 3722417 - RNA, 19 nt, Human
uccucccuuccuuuucccu

SEQ ID NO: 3722418 - RNA, 15 nt, Human
uccucccuucugcua

SEQ ID NO: 3722419 - RNA, 19 nt, Human
uccucccuuggguucugau

SEQ ID NO: 3722420 - RNA, 15 nt, Human
uccuccgaggccagu

SEQ ID NO: 3722421 - RNA, 18 nt, Human
uccuccgccuuaccagga

SEQ ID NO: 3722422 - RNA, 20 nt, Human
uccuccgguugcauacugga

SEQ ID NO: 3722423 - RNA, 17 nt, Human
uccuccgucaccucaga

SEQ ID NO: 3722424 - RNA, 16 nt, Human
uccuccguccagccgc

SEQ ID NO: 3722425 - RNA, 18 nt, Human
uccuccuccaccaccgcc

SEQ ID NO: 3722426 - RNA, 15 nt, Human
uccuccuccagggug

SEQ ID NO: 3722427 - RNA, 22 nt, Human
uccuccucggaaccgcucaccu

SEQ ID NO: 3722428 - RNA, 23 nt, Human
uccuccucggaaccgcucaccua

SEQ ID NO: 3722429 - RNA, 14 nt, Human
uccuccucuuucuc

SEQ ID NO: 3722430 - RNA, 16 nt, Human
uccuccucuuucucuc

SEQ ID NO: 3722431 - RNA, 16 nt, Human
uccuccugacacccca

SEQ ID NO: 3722432 - RNA, 23 nt, Human
uccuccugagugaucccauuucu

SEQ ID NO: 3722433 - RNA, 12 nt, Human
uccuccugccca

SEQ ID NO: 3722434 - RNA, 20 nt, Human
uccuccuggaaccuugcugu

SEQ ID NO: 3722435 - RNA, 22 nt, Human
uccuccuggaaccuugcugucc

SEQ ID NO: 3722436 - RNA, 13 nt, Human
uccuccuggacuc

SEQ ID NO: 3722437 - RNA, 13 nt, Human
uccuccuggcaga

SEQ ID NO: 3722438 - RNA, 16 nt, Human
uccuccugggcccucu

SEQ ID NO: 3722439 - RNA, 22 nt, Human
uccuccugggcccucucugcuc

SEQ ID NO: 3722440 - RNA, 16 nt, Human
uccuccuucacuguuu

SEQ ID NO: 3722441 - RNA, 19 nt, Human
uccuccuugucuuggcagc

SEQ ID NO: 3722442 - RNA, 17 nt, Human
uccuccuuuccuccucu

SEQ ID NO: 3722443 - RNA, 17 nt, Human
uccucgacaucacuguu

SEQ ID NO: 3722444 - RNA, 21 nt, Human
uccucgacaucacuguucaug

SEQ ID NO: 3722445 - RNA, 13 nt, Human
uccucgcaagcug

SEQ ID NO: 3722446 - RNA, 16 nt, Human
uccucgcaagcugggu

SEQ ID NO: 3722447 - RNA, 24 nt, Human
uccucgcagagaggccaggugcag

SEQ ID NO: 3722448 - RNA, 19 nt, Human
uccucggcccccuccaucg

SEQ ID NO: 3722449 - RNA, 20 nt, Human
uccucggcuggcuguccacc

SEQ ID NO: 3722450 - RNA, 15 nt, Human
uccucgguacuccca

SEQ ID NO: 3722451 - RNA, 15 nt, Human
uccucguuccuuucu

SEQ ID NO: 3722452 - RNA, 15 nt, Human
uccucguucucccug

SEQ ID NO: 3722453 - RNA, 16 nt, Human
uccucguucucccugg

SEQ ID NO: 3722454 - RNA, 18 nt, Human
uccucuacuaacaaucag

SEQ ID NO: 3722455 - RNA, 14 nt, Human
uccucuagaagcca

SEQ ID NO: 3722456 - RNA, 15 nt, Human
uccucuagcuguggg

SEQ ID NO: 3722457 - RNA, 22 nt, Human
uccucuagugaauguaggcugg

SEQ ID NO: 3722458 - RNA, 17 nt, Human
uccucuauacaucucuc

SEQ ID NO: 3722459 - RNA, 18 nt, Human
uccucucaaccaccuuuc

SEQ ID NO: 3722460 - RNA, 21 nt, Human
uccucucaaccaccuuucaga

SEQ ID NO: 3722461 - RNA, 13 nt, Human
uccucucacuccc

SEQ ID NO: 3722462 - RNA, 15 nt, Human
uccucucacucccca

SEQ ID NO: 3722463 - RNA, 14 nt, Human
uccucucaguguuu

SEQ ID NO: 3722464 - RNA, 19 nt, Human
uccucucauccuuuucucc

SEQ ID NO: 3722465 - RNA, 16 nt, Human
uccucuccacccuccc

SEQ ID NO: 3722466 - RNA, 13 nt, Human
uccucuccacugc

SEQ ID NO: 3722467 - RNA, 14 nt, Human
uccucuccacugcc

SEQ ID NO: 3722468 - RNA, 14 nt, Human
uccucuccaggcac

SEQ ID NO: 3722469 - RNA, 17 nt, Human
uccucucccaaguccac

SEQ ID NO: 3722470 - RNA, 20 nt, Human
uccucucccaucccccugcc

SEQ ID NO: 3722471 - RNA, 17 nt, Human
uccucucccauccuuga

SEQ ID NO: 3722472 - RNA, 19 nt, Human
uccucucccauugucccuc

SEQ ID NO: 3722473 - RNA, 14 nt, Human
uccucuccccagcc

SEQ ID NO: 3722474 - RNA, 16 nt, Human
uccucuccccagccca

SEQ ID NO: 3722475 - RNA, 18 nt, Human
uccucuccccagcccaga

SEQ ID NO: 3722476 - RNA, 11 nt, Human
uccucuccccu

SEQ ID NO: 3722477 - RNA, 13 nt, Human
uccucuccccucc

SEQ ID NO: 3722478 - RNA, 17 nt, Human
uccucuccccuccagcc

SEQ ID NO: 3722479 - RNA, 18 nt, Human
uccucuccccuccagccu

SEQ ID NO: 3722480 - RNA, 17 nt, Human
uccucuccuagccccug

SEQ ID NO: 3722481 - RNA, 14 nt, Human
uccucuccuggagg

SEQ ID NO: 3722482 - RNA, 16 nt, Human
uccucuccuggaggau

SEQ ID NO: 3722483 - RNA, 15 nt, Human
uccucuccuuccuug

SEQ ID NO: 3722484 - RNA, 17 nt, Human
uccucuccuuugaaacc

SEQ ID NO: 3722485 - RNA, 19 nt, Human
uccucucgcggcccucagu

SEQ ID NO: 3722486 - RNA, 14 nt, Human
uccucucuccagau

SEQ ID NO: 3722487 - RNA, 19 nt, Human
uccucucuccagauguuuc

SEQ ID NO: 3722488 - RNA, 16 nt, Human
uccucucucuguguua

SEQ ID NO: 3722489 - RNA, 14 nt, Human
uccucucugcccua

SEQ ID NO: 3722490 - RNA, 23 nt, Human
uccucucuggggcuguguuuuga

SEQ ID NO: 3722491 - RNA, 23 nt, Human
uccucucuuuguucucagcuccc

SEQ ID NO: 3722492 - RNA, 13 nt, Human
uccucugaaacag

SEQ ID NO: 3722493 - RNA, 17 nt, Human
uccucugaaacagcugc

SEQ ID NO: 3722494 - RNA, 18 nt, Human
uccucugacucagggcuc

SEQ ID NO: 3722495 - RNA, 17 nt, Human
uccucugagccuuggga

SEQ ID NO: 3722496 - RNA, 17 nt, Human
uccucugaucuccaugg

SEQ ID NO: 3722497 - RNA, 18 nt, Human
uccucugcagugccuugg

SEQ ID NO: 3722498 - RNA, 12 nt, Human
uccucugccacc

SEQ ID NO: 3722499 - RNA, 18 nt, Human
uccucugccaccuccccu

SEQ ID NO: 3722500 - RNA, 22 nt, Human
uccucugccaccuccccuaucc

SEQ ID NO: 3722501 - RNA, 23 nt, Human
uccucugccaccuccccuaucca

SEQ ID NO: 3722502 - RNA, 10 nt, Human
uccucugccu

SEQ ID NO: 3722503 - RNA, 12 nt, Human
uccucugccugc

SEQ ID NO: 3722504 - RNA, 19 nt, Human
uccucugcuaaauugaugu

SEQ ID NO: 3722505 - RNA, 12 nt, Human
uccucugcuccc

SEQ ID NO: 3722506 - RNA, 19 nt, Human
uccucugcucccccuuuuc

SEQ ID NO: 3722507 - RNA, 12 nt, Human
uccucugcugcu

SEQ ID NO: 3722508 - RNA, 15 nt, Human
uccucugcugcuggc

SEQ ID NO: 3722509 - RNA, 20 nt, Human
uccucugcuugccaucccuc

SEQ ID NO: 3722510 - RNA, 15 nt, Human
uccucugcuuugaaa

SEQ ID NO: 3722511 - RNA, 9 nt, Human
uccucuggc

SEQ ID NO: 3722512 - RNA, 13 nt, Human
uccucuguacaga

SEQ ID NO: 3722513 - RNA, 16 nt, Human
uccucuguacagagcc

SEQ ID NO: 3722514 - RNA, 21 nt, Human
uccucugucagucacagccac

SEQ ID NO: 3722515 - RNA, 13 nt, Human
uccucuguccagg

SEQ ID NO: 3722516 - RNA, 14 nt, Human
uccucuguccaggg

SEQ ID NO: 3722517 - RNA, 16 nt, Human
uccucuguccagggcc

SEQ ID NO: 3722518 - RNA, 17 nt, Human
uccucuguccugcuucu

SEQ ID NO: 3722519 - RNA, 12 nt, Human
uccucugucugc

SEQ ID NO: 3722520 - RNA, 18 nt, Human
uccucuguggugucugcc

SEQ ID NO: 3722521 - RNA, 21 nt, Human
uccucuguggugucugccugu

SEQ ID NO: 3722522 - RNA, 16 nt, Human
uccucuuaacuguggu

SEQ ID NO: 3722523 - RNA, 20 nt, Human
uccucuuagaagaauauugu

SEQ ID NO: 3722524 - RNA, 18 nt, Human
uccucuuccccuugcccu

SEQ ID NO: 3722525 - RNA, 16 nt, Human
uccucuucggcccuca

SEQ ID NO: 3722526 - RNA, 16 nt, Human
uccucuugacccugca

SEQ ID NO: 3722527 - RNA, 14 nt, Human
uccucuugcucaaa

SEQ ID NO: 3722528 - RNA, 19 nt, Human
uccucuuguccuacaauga

SEQ ID NO: 3722529 - RNA, 20 nt, Human
uccucuugugauuucuuuaa

SEQ ID NO: 3722530 - RNA, 15 nt, Human
uccucuuuaaaacaa

SEQ ID NO: 3722531 - RNA, 17 nt, Human
uccucuuuaaaacaaaa

SEQ ID NO: 3722532 - RNA, 21 nt, Human
uccucuuuagaguuagacugu

SEQ ID NO: 3722533 - RNA, 12 nt, Human
uccucuuucagc

SEQ ID NO: 3722534 - RNA, 18 nt, Human
uccucuuucagcuccuga

SEQ ID NO: 3722535 - RNA, 17 nt, Human
uccucuuucucucccca

SEQ ID NO: 3722536 - RNA, 23 nt, Human
uccucuuuuguuguuucuuaauu

SEQ ID NO: 3722537 - RNA, 21 nt, Human
uccucuuuuuccaucauaauu

SEQ ID NO: 3722538 - RNA, 17 nt, Human
uccugaaacgcuccuuu

SEQ ID NO: 3722539 - RNA, 14 nt, Human
uccugaaacuauau

SEQ ID NO: 3722540 - RNA, 15 nt, Human
uccugaacagcaugg

SEQ ID NO: 3722541 - RNA, 18 nt, Human
uccugaacagcauggcac

SEQ ID NO: 3722542 - RNA, 22 nt, Human
uccugaacagcauggcacuccc

SEQ ID NO: 3722543 - RNA, 17 nt, Human
uccugaaccgcacagcu

SEQ ID NO: 3722544 - RNA, 21 nt, Human
uccugaaccgcacagcucagg

SEQ ID NO: 3722545 - RNA, 16 nt, Human
uccugaaccugaugcu

SEQ ID NO: 3722546 - RNA, 19 nt, Human
uccugaacucuucugcaaa

SEQ ID NO: 3722547 - RNA, 13 nt, Human
uccugaagaacca

SEQ ID NO: 3722548 - RNA, 23 nt, Human
uccugaagaaccaguccccccac

SEQ ID NO: 3722549 - RNA, 15 nt, Human
uccugaagaauugaa

SEQ ID NO: 3722550 - RNA, 17 nt, Human
uccugaagaggcgggcc

SEQ ID NO: 3722551 - RNA, 18 nt, Human
uccugaagcugaggcuca

SEQ ID NO: 3722552 - RNA, 15 nt, Human
uccugaauucuauuu

SEQ ID NO: 3722553 - RNA, 21 nt, Human
uccugaauuuauuauuguucu

SEQ ID NO: 3722554 - RNA, 22 nt, Human
uccugaauuuauuauuguucuu

SEQ ID NO: 3722555 - RNA, 20 nt, Human
uccugacaccccacuuagcc

SEQ ID NO: 3722556 - RNA, 15 nt, Human
ucuauauuuucauuc

SEQ ID NO: 3722557 - RNA, 16 nt, Human
ucuauauuuucauucu

SEQ ID NO: 3722558 - RNA, 23 nt, Human
ucuauauuuugggaaaaaaacau

SEQ ID NO: 3722559 - RNA, 22 nt, Human
ucuaucaagucaaucauuucuc

SEQ ID NO: 3722560 - RNA, 23 nt, Human
ucuaucaagucaaucauuucuca

SEQ ID NO: 3722561 - RNA, 14 nt, Human
ucuaucaccaagga

SEQ ID NO: 3722562 - RNA, 16 nt, Human
ucuaucagauuaaguu

SEQ ID NO: 3722563 - RNA, 13 nt, Human
ucuaucauuguug

SEQ ID NO: 3722564 - RNA, 12 nt, Human
ucuaucauuuaa

SEQ ID NO: 3722565 - RNA, 15 nt, Human
ucuaucauuuaauaa

SEQ ID NO: 3722566 - RNA, 15 nt, Human
ucuaucauuuuugua

SEQ ID NO: 3722567 - RNA, 14 nt, Human
ucuaucuaaugaca

SEQ ID NO: 3722568 - RNA, 10 nt, Human
ucuaucuacu

SEQ ID NO: 3722569 - RNA, 14 nt, Human
ucuaucugguauua

SEQ ID NO: 3722570 - RNA, 21 nt, Human
ucuaucugguauuaaaugcca

SEQ ID NO: 3722571 - RNA, 17 nt, Human
ucuaucuugcucuguaa

SEQ ID NO: 3722572 - RNA, 19 nt, Human
ucuaucuugcucuguaauc

SEQ ID NO: 3722573 - RNA, 22 nt, Human
ucuaucuuguuccaaggccagg

SEQ ID NO: 3722574 - RNA, 14 nt, Human
ucuaugaaauauua

SEQ ID NO: 3722575 - RNA, 18 nt, Human
ucuaugaaauauuauguu

SEQ ID NO: 3722576 - RNA, 17 nt, Human
ucuaugacacaugcaag

SEQ ID NO: 3722577 - RNA, 14 nt, Human
ucuaugagucuaga

SEQ ID NO: 3722578 - RNA, 16 nt, Human
ucuaugagucuagaug

SEQ ID NO: 3722579 - RNA, 11 nt, Human
ucuaugauaua

SEQ ID NO: 3722580 - RNA, 15 nt, Human
ucuaugaugcuguug

SEQ ID NO: 3722581 - RNA, 14 nt, Human
ucuaugccagcuca

SEQ ID NO: 3722582 - RNA, 13 nt, Human
ucuaugccugucu

SEQ ID NO: 3722583 - RNA, 20 nt, Human
ucuaugcugaguuugugcug

SEQ ID NO: 3722584 - RNA, 13 nt, Human
ucuaugggacuca

SEQ ID NO: 3722585 - RNA, 23 nt, Human
ucuaugggacucaaugcacugac

SEQ ID NO: 3722586 - RNA, 19 nt, Human
ucuauggggagaggaacuc

SEQ ID NO: 3722587 - RNA, 22 nt, Human
ucuauggguaucaaacagcuca

SEQ ID NO: 3722588 - RNA, 14 nt, Human
ucuaugguuaugaa

SEQ ID NO: 3722589 - RNA, 19 nt, Human
ucuauguaaaugcaucugu

SEQ ID NO: 3722590 - RNA, 12 nt, Human
ucuauguacuag

SEQ ID NO: 3722591 - RNA, 18 nt, Human
ucuauguacuaguacugu

SEQ ID NO: 3722592 - RNA, 19 nt, Human
ucuauguaggaaaaaaaua

SEQ ID NO: 3722593 - RNA, 19 nt, Human
ucuauguauauacauuuau

SEQ ID NO: 3722594 - RNA, 21 nt, Human
ucuauguggcuguaucuuguu

SEQ ID NO: 3722595 - RNA, 16 nt, Human
ucuauguuaauauuuu

SEQ ID NO: 3722596 - RNA, 14 nt, Human
ucuauuaaaagacu

SEQ ID NO: 3722597 - RNA, 20 nt, Human
ucuauuaaaagacucauccg

SEQ ID NO: 3722598 - RNA, 21 nt, Human
ucuauuaaaagacucauccgu

SEQ ID NO: 3722599 - RNA, 23 nt, Human
ucuauuaaauaguuauauaauuc

SEQ ID NO: 3722600 - RNA, 17 nt, Human
ucuauuaagauuuccaa

SEQ ID NO: 3722601 - RNA, 10 nt, Human
ucuauuaaua

SEQ ID NO: 3722602 - RNA, 16 nt, Human
ucuauuaauauaugua

SEQ ID NO: 3722603 - RNA, 21 nt, Human
ucuauuaccacugaagauaga

SEQ ID NO: 3722604 - RNA, 15 nt, Human
ucuauuauacuguau

SEQ ID NO: 3722605 - RNA, 15 nt, Human
ucuauuaugaaugug

SEQ ID NO: 3722606 - RNA, 16 nt, Human
ucuauuauuuuuauaa

SEQ ID NO: 3722607 - RNA, 16 nt, Human
ucuauucagacaagca

SEQ ID NO: 3722608 - RNA, 18 nt, Human
ucuauuccagcucauuca

SEQ ID NO: 3722609 - RNA, 23 nt, Human
ucuauuccagcucauucauuuua

SEQ ID NO: 3722610 - RNA, 16 nt, Human
ucuauucuccagcuga

SEQ ID NO: 3722611 - RNA, 17 nt, Human
ucuauucugaucuuauu

SEQ ID NO: 3722612 - RNA, 17 nt, Human
ucuauucuguguugcau

SEQ ID NO: 3722613 - RNA, 13 nt, Human
ucuauugaaaaau

SEQ ID NO: 3722614 - RNA, 20 nt, Human
ucuauugauguacagucugu

SEQ ID NO: 3722615 - RNA, 19 nt, Human
ucuauugccucugagagca

SEQ ID NO: 3722616 - RNA, 21 nt, Human
ucuauugccuucuuugaagaa

SEQ ID NO: 3722617 - RNA, 16 nt, Human
ucuauugcuucaccau

SEQ ID NO: 3722618 - RNA, 16 nt, Human
ucuauuggguucauua

SEQ ID NO: 3722619 - RNA, 18 nt, Human
ucuauuggguucauuauu

SEQ ID NO: 3722620 - RNA, 19 nt, Human
ucuauuguaagauaaaaaa

SEQ ID NO: 3722621 - RNA, 17 nt, Human
ucuauuguagcauuucu

SEQ ID NO: 3722622 - RNA, 20 nt, Human
ucuauuguagcauuucuuga

SEQ ID NO: 3722623 - RNA, 22 nt, Human
ucuauuguuguacacagaaaua

SEQ ID NO: 3722624 - RNA, 17 nt, Human
ucuauuguuuauucuuu

SEQ ID NO: 3722625 - RNA, 16 nt, Human
ucuauuguuucuuuca

SEQ ID NO: 3722626 - RNA, 17 nt, Human
ucuauuuaaauucuuuu

SEQ ID NO: 3722627 - RNA, 13 nt, Human
ucuauuuaauauu

SEQ ID NO: 3722628 - RNA, 13 nt, Human
ucuauuuagcaug

SEQ ID NO: 3722629 - RNA, 13 nt, Human
ucuauuuauaugu

SEQ ID NO: 3722630 - RNA, 19 nt, Human
ucuauuuaucuucauuuga

SEQ ID NO: 3722631 - RNA, 14 nt, Human
ucuauuuauuuauu

SEQ ID NO: 3722632 - RNA, 17 nt, Human
ucuauuucacuggagca

SEQ ID NO: 3722633 - RNA, 13 nt, Human
ucuauuucacuua

SEQ ID NO: 3722634 - RNA, 16 nt, Human
ucuauuucauaccaug

SEQ ID NO: 3722635 - RNA, 14 nt, Human
ucuauuucauguuu

SEQ ID NO: 3722636 - RNA, 16 nt, Human
ucuauuucauguuuuu

SEQ ID NO: 3722637 - RNA, 18 nt, Human
ucuauuucccccuuucuu

SEQ ID NO: 3722638 - RNA, 14 nt, Human
ucuauuucuccucc

SEQ ID NO: 3722639 - RNA, 15 nt, Human
ucuauuucugagaag

SEQ ID NO: 3722640 - RNA, 11 nt, Human
ucuauuucugc

SEQ ID NO: 3722641 - RNA, 12 nt, Human
ucuauuucugcu

SEQ ID NO: 3722642 - RNA, 21 nt, Human
ucuauuucugcugaauuuuca

SEQ ID NO: 3722643 - RNA, 16 nt, Human
ucuauuuggaauuuau

SEQ ID NO: 3722644 - RNA, 13 nt, Human
ucuauuuggggcu

SEQ ID NO: 3722645 - RNA, 22 nt, Human
ucuauuuguauauauacauaac

SEQ ID NO: 3722646 - RNA, 13 nt, Human
ucuauuuuacaac

SEQ ID NO: 3722647 - RNA, 16 nt, Human
ucuauuuuauuaugaa

SEQ ID NO: 3722648 - RNA, 20 nt, Human
ucuauuuuauuaugaagaag

SEQ ID NO: 3722649 - RNA, 16 nt, Human
ucuauuuucuauguac

SEQ ID NO: 3722650 - RNA, 15 nt, Human
ucuauuuuggauugu

SEQ ID NO: 3722651 - RNA, 16 nt, Human
ucuauuuuuacauuua

SEQ ID NO: 3722652 - RNA, 15 nt, Human
ucuauuuuuaucuga

SEQ ID NO: 3722653 - RNA, 15 nt, Human
ucuauuuuuggaggu

SEQ ID NO: 3722654 - RNA, 22 nt, Human
ucuauuuuuggagguuuauuac

SEQ ID NO: 3722655 - RNA, 16 nt, Human
ucucaaaaaaagaaaa

SEQ ID NO: 3722656 - RNA, 14 nt, Human
ucucaaaaauacaa

SEQ ID NO: 3722657 - RNA, 23 nt, Human
ucucaaaagcauuuaucauucuu

SEQ ID NO: 3722658 - RNA, 13 nt, Human
ucucaaacacagu

SEQ ID NO: 3722659 - RNA, 20 nt, Human
ucucaaaccaagcaaaggaa

SEQ ID NO: 3722660 - RNA, 19 nt, Human
ucucaaaccuguuuaaaua

SEQ ID NO: 3722661 - RNA, 23 nt, Human
ucucaaaccuguuuaaauauuuc

SEQ ID NO: 3722662 - RNA, 14 nt, Human
ucucaaacuccuga

SEQ ID NO: 3722663 - RNA, 16 nt, Human
ucucaaacuccugacc

SEQ ID NO: 3722664 - RNA, 23 nt, Human
ucucaaacuccugaccucaggca

SEQ ID NO: 3722665 - RNA, 22 nt, Human
ucucaaacucuugaccucaggu

SEQ ID NO: 3722666 - RNA, 14 nt, Human
ucucaaacuggggc

SEQ ID NO: 3722667 - RNA, 17 nt, Human
ucucaaagaccuggggc

SEQ ID NO: 3722668 - RNA, 18 nt, Human
ucucaaaggguacuucca

SEQ ID NO: 3722669 - RNA, 22 nt, Human
ucucaaaguuuccuaaucagaa

SEQ ID NO: 3722670 - RNA, 18 nt, Human
ucucaaaguuuugaaaag

SEQ ID NO: 3722671 - RNA, 20 nt, Human
ucucaaauaggcuauuaaaa

SEQ ID NO: 3722672 - RNA, 22 nt, Human
ucucaaauaggcuauuaaaaaa

SEQ ID NO: 3722673 - RNA, 14 nt, Human
ucucaaauuucuaa

SEQ ID NO: 3722674 - RNA, 22 nt, Human
ucucaacaaggcaaaaacaaag

SEQ ID NO: 3722675 - RNA, 21 nt, Human
ucucaacaccaugauuccuuu

SEQ ID NO: 3722676 - RNA, 19 nt, Human
ucucaacacccaguuuccu

SEQ ID NO: 3722677 - RNA, 18 nt, Human
ucucaacaggccucaggg

SEQ ID NO: 3722678 - RNA, 20 nt, Human
ucucaacaggccucagggcu

SEQ ID NO: 3722679 - RNA, 21 nt, Human
ucucaacccuuuugucugccu

SEQ ID NO: 3722680 - RNA, 23 nt, Human
ucucaacccuuuugucugccucu

SEQ ID NO: 3722681 - RNA, 15 nt, Human
ucucaagagcccugu

SEQ ID NO: 3722682 - RNA, 19 nt, Human
ucucaagagggcacuggug

SEQ ID NO: 3722683 - RNA, 13 nt, Human
ucucaagcccugc

SEQ ID NO: 3722684 - RNA, 21 nt, Human
ucucaauaaaauuauagcucu

SEQ ID NO: 3722685 - RNA, 23 nt, Human
ucucaauaaaauuauagcucuaa

SEQ ID NO: 3722686 - RNA, 14 nt, Human
ucucaauaugcuua

SEQ ID NO: 3722687 - RNA, 18 nt, Human
ucucaauauucaauaaag

SEQ ID NO: 3722688 - RNA, 20 nt, Human
ucucaauauucaauaaagcu

SEQ ID NO: 3722689 - RNA, 23 nt, Human
ucucaauccuaauuucuccuccc

SEQ ID NO: 3722690 - RNA, 14 nt, Human
ucucaaugaaaaau

SEQ ID NO: 3722691 - RNA, 19 nt, Human
ucucaaugaaccauaaauu

SEQ ID NO: 3722692 - RNA, 16 nt, Human
ucucaaugaagccagc

SEQ ID NO: 3722693 - RNA, 17 nt, Human
ucucaaugaagccagcu

SEQ ID NO: 3722694 - RNA, 15 nt, Human
ucucaauuccaacag

SEQ ID NO: 3722695 - RNA, 23 nt, Human
ucucaauuccaacaguuuaauga

SEQ ID NO: 3722696 - RNA, 14 nt, Human
ucucacaagccagc

SEQ ID NO: 3722697 - RNA, 14 nt, Human
ucucacacacauag

SEQ ID NO: 3722698 - RNA, 16 nt, Human
ucucacacaugagcau

SEQ ID NO: 3722699 - RNA, 23 nt, Human
ucucacacaugagcaucaggcca

SEQ ID NO: 3722700 - RNA, 22 nt, Human
ucucacacugguucucaaugaa

SEQ ID NO: 3722701 - RNA, 20 nt, Human
ucucacagacaggaccccug

SEQ ID NO: 3722702 - RNA, 22 nt, Human
ucucacagacaggaccccugca

SEQ ID NO: 3722703 - RNA, 17 nt, Human
ucucacagcacaugcug

SEQ ID NO: 3722704 - RNA, 14 nt, Human
ucucacagcuaugc

SEQ ID NO: 3722705 - RNA, 13 nt, Human
ucucaccagcugc

SEQ ID NO: 3722706 - RNA, 12 nt, Human
ggagugcagugg

SEQ ID NO: 3722707 - RNA, 14 nt, Human
ggagugcaguggug

SEQ ID NO: 3722708 - RNA, 16 nt, Human
ggagugcuggcucaca

SEQ ID NO: 3722709 - RNA, 22 nt, Human
ggaguggaauaguauccuccag

SEQ ID NO: 3722710 - RNA, 13 nt, Human
ggaguggagugga

SEQ ID NO: 3722711 - RNA, 17 nt, Human
ggaguggcagcccagcc

SEQ ID NO: 3722712 - RNA, 14 nt, Human
ggaguggccacaga

SEQ ID NO: 3722713 - RNA, 15 nt, Human
ggaguggccacagaa

SEQ ID NO: 3722714 - RNA, 17 nt, Human
ggaguggcucgccaggc

SEQ ID NO: 3722715 - RNA, 18 nt, Human
ggagugggacagagucug

SEQ ID NO: 3722716 - RNA, 12 nt, Human
ggagugggccca

SEQ ID NO: 3722717 - RNA, 19 nt, Human
ggagugggugacaagagcc

SEQ ID NO: 3722718 - RNA, 20 nt, Human
ggagugggugacaagagccu

SEQ ID NO: 3722719 - RNA, 15 nt, Human
ggaguggugcagaca

SEQ ID NO: 3722720 - RNA, 20 nt, Human
ggagugguuuaggcuauuug

SEQ ID NO: 3722721 - RNA, 15 nt, Human
ggaguguacucccag

SEQ ID NO: 3722722 - RNA, 18 nt, Human
ggaguguacucccagggc

SEQ ID NO: 3722723 - RNA, 19 nt, Human
ggaguguacucccagggcu

SEQ ID NO: 3722724 - RNA, 24 nt, Human
ggaguguccucuucccucucugca

SEQ ID NO: 3722725 - RNA, 18 nt, Human
ggagugucuggaauugug

SEQ ID NO: 3722726 - RNA, 22 nt, Human
ggaguguggcugaggaggccuc

SEQ ID NO: 3722727 - RNA, 11 nt, Human
ggaguguguaa

SEQ ID NO: 3722728 - RNA, 22 nt, Human
ggaguguguaauuuaaaauugu

SEQ ID NO: 3722729 - RNA, 17 nt, Human
ggaguguguauuguucc

SEQ ID NO: 3722730 - RNA, 18 nt, Human
ggaguguguauuguuccc

SEQ ID NO: 3722731 - RNA, 15 nt, Human
ggaguguuucauggg

SEQ ID NO: 3722732 - RNA, 19 nt, Human
ggaguguuucuaauaaacu

SEQ ID NO: 3722733 - RNA, 23 nt, Human
ggaguuaagaccuggcagcucug

SEQ ID NO: 3722734 - RNA, 22 nt, Human
ggaguuacauuaauguuaauuc

SEQ ID NO: 3722735 - RNA, 18 nt, Human
ggaguuagaggccagccu

SEQ ID NO: 3722736 - RNA, 17 nt, Human
ggaguucaaugaucuag

SEQ ID NO: 3722737 - RNA, 16 nt, Human
ggaguucaucuugaau

SEQ ID NO: 3722738 - RNA, 14 nt, Human
ggaguuccacagau

SEQ ID NO: 3722739 - RNA, 14 nt, Human
ggaguuccaugaag

SEQ ID NO: 3722740 - RNA, 21 nt, Human
ggaguucgaggcugcagucag

SEQ ID NO: 3722741 - RNA, 12 nt, Human
ggaguucuucuu

SEQ ID NO: 3722742 - RNA, 17 nt, Human
ggaguugaucuggaacc

SEQ ID NO: 3722743 - RNA, 21 nt, Human
ggaguugaucuggaacccaga

SEQ ID NO: 3722744 - RNA, 18 nt, Human
ggaguuucuuuccugccu

SEQ ID NO: 3722745 - RNA, 13 nt, Human
ggaguuuggccag

SEQ ID NO: 3722746 - RNA, 18 nt, Human
ggaguuuuuaugagaaac

SEQ ID NO: 3722747 - RNA, 16 nt, Human
ggaguuuuuuguacca

SEQ ID NO: 3722748 - RNA, 17 nt, Human
ggauaaaaagccagggc

SEQ ID NO: 3722749 - RNA, 19 nt, Human
ggauaaaaagccagggcug

SEQ ID NO: 3722750 - RNA, 14 nt, Human
ggauaaaaugaggu

SEQ ID NO: 3722751 - RNA, 20 nt, Human
ggauaaacuuuuagaaacuu

SEQ ID NO: 3722752 - RNA, 15 nt, Human
ggauaaagccacuga

SEQ ID NO: 3722753 - RNA, 13 nt, Human
ggauaacaaagau

SEQ ID NO: 3722754 - RNA, 20 nt, Human
ggauaacaaagauaucuuuu

SEQ ID NO: 3722755 - RNA, 19 nt, Human
ggauaauuagcaucucagg

SEQ ID NO: 3722756 - RNA, 20 nt, Human
ggauacaggcuggaaaguaa

SEQ ID NO: 3722757 - RNA, 21 nt, Human
ggauacugcagggccaggacu

SEQ ID NO: 3722758 - RNA, 16 nt, Human
ggauacugcccggggc

SEQ ID NO: 3722759 - RNA, 15 nt, Human
ggauacuggcacaga

SEQ ID NO: 3722760 - RNA, 13 nt, Human
ggauacuuauuua

SEQ ID NO: 3722761 - RNA, 19 nt, Human
ggauagagaauguuccaga

SEQ ID NO: 3722762 - RNA, 12 nt, Human
ggauagaggggu

SEQ ID NO: 3722763 - RNA, 19 nt, Human
ggauagauaacucuuugga

SEQ ID NO: 3722764 - RNA, 20 nt, Human
ggauagauaacucuuuggau

SEQ ID NO: 3722765 - RNA, 15 nt, Human
ggauagaugcccugc

SEQ ID NO: 3722766 - RNA, 14 nt, Human
ggauagaugugugg

SEQ ID NO: 3722767 - RNA, 19 nt, Human
ggauagcuaacuguaaauc

SEQ ID NO: 3722768 - RNA, 17 nt, Human
ggauaggagccugcugg

SEQ ID NO: 3722769 - RNA, 15 nt, Human
ggauaggccagccgc

SEQ ID NO: 3722770 - RNA, 14 nt, Human
ggauaggggcagag

SEQ ID NO: 3722771 - RNA, 16 nt, Human
ggauaguaugagcccu

SEQ ID NO: 3722772 - RNA, 18 nt, Human
ggauaguauuuuuaucca

SEQ ID NO: 3722773 - RNA, 17 nt, Human
ggauagucaccuuuuaa

SEQ ID NO: 3722774 - RNA, 18 nt, Human
ggauaguugcuccgccuc

SEQ ID NO: 3722775 - RNA, 16 nt, Human
ggauauaguuuuacuu

SEQ ID NO: 3722776 - RNA, 20 nt, Human
ggauauccuuaucagagcua

SEQ ID NO: 3722777 - RNA, 17 nt, Human
ggauaucuguuagaugc

SEQ ID NO: 3722778 - RNA, 22 nt, Human
ggauaucuguuagaugcuacua

SEQ ID NO: 3722779 - RNA, 22 nt, Human
ggaucaaaccccgaccaccugc

SEQ ID NO: 3722780 - RNA, 16 nt, Human
ggaucaaaguucugcu

SEQ ID NO: 3722781 - RNA, 18 nt, Human
ggaucacaagauggaauu

SEQ ID NO: 3722782 - RNA, 14 nt, Human
ggaucacagggccc

SEQ ID NO: 3722783 - RNA, 13 nt, Human
ggaucacuggagc

SEQ ID NO: 3722784 - RNA, 18 nt, Human
ggaucacuggagcccagg

SEQ ID NO: 3722785 - RNA, 17 nt, Human
ggaucacuugagcccag

SEQ ID NO: 3722786 - RNA, 17 nt, Human
ggaucagaacagcagag

SEQ ID NO: 3722787 - RNA, 12 nt, Human
ggaucagaauag

SEQ ID NO: 3722788 - RNA, 15 nt, Human
ggaucagagcaggac

SEQ ID NO: 3722789 - RNA, 18 nt, Human
ggaucagagcaggaccuc

SEQ ID NO: 3722790 - RNA, 16 nt, Human
ggaucagaugaacucu

SEQ ID NO: 3722791 - RNA, 13 nt, Human
ggaucagccagga

SEQ ID NO: 3722792 - RNA, 19 nt, Human
ggaucagcccucauuuugu

SEQ ID NO: 3722793 - RNA, 17 nt, Human
ggaucagcguggccuug

SEQ ID NO: 3722794 - RNA, 18 nt, Human
ggaucagggguaggaaug

SEQ ID NO: 3722795 - RNA, 12 nt, Human
ggaucaguuuuu

SEQ ID NO: 3722796 - RNA, 13 nt, Human
ggaucauaaaguu

SEQ ID NO: 3722797 - RNA, 19 nt, Human
ggaucaucaacaagauuuc

SEQ ID NO: 3722798 - RNA, 19 nt, Human
ggaucaucugccgugccug

SEQ ID NO: 3722799 - RNA, 17 nt, Human
ggauccaaacugaucca

SEQ ID NO: 3722800 - RNA, 20 nt, Human
ggauccacgacgcuuaaaua

SEQ ID NO: 3722801 - RNA, 13 nt, Human
ggauccaggcccc

SEQ ID NO: 3722802 - RNA, 17 nt, Human
ggaucccaugagcuccu

SEQ ID NO: 3722803 - RNA, 20 nt, Human
ggaucccaugagcuccuuaa

SEQ ID NO: 3722804 - RNA, 16 nt, Human
ggauccccgccuggcc

SEQ ID NO: 3722805 - RNA, 22 nt, Human
ggauccccgccuggccaggagc

SEQ ID NO: 3722806 - RNA, 23 nt, Human
ggauccccgccuggccaggagca

SEQ ID NO: 3722807 - RNA, 13 nt, Human
ggauccccuuccu

SEQ ID NO: 3722808 - RNA, 22 nt, Human
ggaucccucauccucauaccca

SEQ ID NO: 3722809 - RNA, 13 nt, Human
ggaucccucaucu

SEQ ID NO: 3722810 - RNA, 21 nt, Human
ggauccgacugcuuuggaccu

SEQ ID NO: 3722811 - RNA, 21 nt, Human
ggauccuauucucaccaggaa

SEQ ID NO: 3722812 - RNA, 12 nt, Human
ggauccuccagg

SEQ ID NO: 3722813 - RNA, 14 nt, Human
ggauccugagccag

SEQ ID NO: 3722814 - RNA, 21 nt, Human
ggauccuggaguucugguucc

SEQ ID NO: 3722815 - RNA, 15 nt, Human
ggaucggccuccucu

SEQ ID NO: 3722816 - RNA, 18 nt, Human
ggaucuaccagcauaaau

SEQ ID NO: 3722817 - RNA, 16 nt, Human
ggaucuaccuggaggg

SEQ ID NO: 3722818 - RNA, 13 nt, Human
ggaucucaggggc

SEQ ID NO: 3722819 - RNA, 21 nt, Human
ggaucuccaaggaccagguua

SEQ ID NO: 3722820 - RNA, 14 nt, Human
ggaucuccccacuc

SEQ ID NO: 3722821 - RNA, 21 nt, Human
ggaucucucaggagcacaggc

SEQ ID NO: 3722822 - RNA, 22 nt, Human
ggaucucucaggagcacaggca

SEQ ID NO: 3722823 - RNA, 17 nt, Human
ggaucucuuaagacagc

SEQ ID NO: 3722824 - RNA, 21 nt, Human
ggaucucuucuuaauguacau

SEQ ID NO: 3722825 - RNA, 21 nt, Human
ggaucugguagggggaaaaug

SEQ ID NO: 3722826 - RNA, 15 nt, Human
ggaucugguggucag

SEQ ID NO: 3722827 - RNA, 18 nt, Human
ggaucuguauguguucua

SEQ ID NO: 3722828 - RNA, 19 nt, Human
ggaucugucacaccagcca

SEQ ID NO: 3722829 - RNA, 22 nt, Human
ggaucugugaggggcucucuca

SEQ ID NO: 3722830 - RNA, 23 nt, Human
ggaucuguuguguacguggagag

SEQ ID NO: 3722831 - RNA, 14 nt, Human
ggaucuugaaugug

SEQ ID NO: 3722832 - RNA, 20 nt, Human
ggaucuugaauguggucuca

SEQ ID NO: 3722833 - RNA, 21 nt, Human
ggaucuugaauguggucucag

SEQ ID NO: 3722834 - RNA, 20 nt, Human
ggaucuuucacccacagaaa

SEQ ID NO: 3722835 - RNA, 21 nt, Human
ggaugaauuccaaauucugcu

SEQ ID NO: 3722836 - RNA, 16 nt, Human
ggaugacaugucccua

SEQ ID NO: 3722837 - RNA, 22 nt, Human
ggaugacgguauuaugcuucuu

SEQ ID NO: 3722838 - RNA, 23 nt, Human
ggaugacgguauuaugcuucuug

SEQ ID NO: 3722839 - RNA, 19 nt, Human
ggaugacuagaggcaggga

SEQ ID NO: 3722840 - RNA, 21 nt, Human
ggaugagaauuugagugcucu

SEQ ID NO: 3722841 - RNA, 23 nt, Human
ggaugagagcccagagguaacag

SEQ ID NO: 3722842 - RNA, 23 nt, Human
ggaugagcucccacaagccugag

SEQ ID NO: 3722843 - RNA, 20 nt, Human
ggaugagggaaaagaaaaag

SEQ ID NO: 3722844 - RNA, 18 nt, Human
ggaugaggugcugggagg

SEQ ID NO: 3722845 - RNA, 15 nt, Human
ggaugaugccucaug

SEQ ID NO: 3722846 - RNA, 16 nt, Human
ggaugauucagaaauu

SEQ ID NO: 3722847 - RNA, 21 nt, Human
ggaugauuggaggggggaggu

SEQ ID NO: 3722848 - RNA, 17 nt, Human
ggaugauuggauuauuc

SEQ ID NO: 3722849 - RNA, 13 nt, Human
ggaugcagcauua

SEQ ID NO: 3722850 - RNA, 18 nt, Human
ggaugcaggcuccccuga

SEQ ID NO: 3722851 - RNA, 12 nt, Human
ggaugccaccuc

SEQ ID NO: 3722852 - RNA, 18 nt, Human
ggaugccacuccucccuc

SEQ ID NO: 3722853 - RNA, 17 nt, Human
ggaugccagggccgacc

SEQ ID NO: 3722854 - RNA, 15 nt, Human
ggaugccauccaagu

SEQ ID NO: 3722855 - RNA, 15 nt, Human
ucucaccagcugcaa

SEQ ID NO: 3722856 - RNA, 15 nt, Human
ucucaccaggaaggg

SEQ ID NO: 3722857 - RNA, 17 nt, Human
ucucaccaggcagccuc

SEQ ID NO: 3722858 - RNA, 21 nt, Human
ucucaccaggcagccucuggg

SEQ ID NO: 3722859 - RNA, 16 nt, Human
ucucaccauuuggauc

SEQ ID NO: 3722860 - RNA, 22 nt, Human
ucucacccaugcaagcagagga

SEQ ID NO: 3722861 - RNA, 13 nt, Human
ucucacccuggag

SEQ ID NO: 3722862 - RNA, 19 nt, Human
ucucacccuggaggcaccu

SEQ ID NO: 3722863 - RNA, 12 nt, Human
ucucaccucagc

SEQ ID NO: 3722864 - RNA, 19 nt, Human
ucucaccuccugcugggca

SEQ ID NO: 3722865 - RNA, 16 nt, Human
ucucaccuggcccugc

SEQ ID NO: 3722866 - RNA, 19 nt, Human
ucucaccuggcccugcuuc

SEQ ID NO: 3722867 - RNA, 17 nt, Human
ucucaccuugguuccug

SEQ ID NO: 3722868 - RNA, 20 nt, Human
ucucacggccacacagcugc

SEQ ID NO: 3722869 - RNA, 21 nt, Human
ucucacgggcaugggcacucc

SEQ ID NO: 3722870 - RNA, 15 nt, Human
ucucacuaaacuuua

SEQ ID NO: 3722871 - RNA, 18 nt, Human
ucucacuaaagcaugaaa

SEQ ID NO: 3722872 - RNA, 23 nt, Human
ucucacuaaagcaugaaauguga

SEQ ID NO: 3722873 - RNA, 19 nt, Human
ucucacuauguugcccagg

SEQ ID NO: 3722874 - RNA, 22 nt, Human
ucucacuauguugcccaggcag

SEQ ID NO: 3722875 - RNA, 14 nt, Human
ucucacuccaccac

SEQ ID NO: 3722876 - RNA, 21 nt, Human
ucucacuccccagccugggcc

SEQ ID NO: 3722877 - RNA, 22 nt, Human
ucucacuccccagccugggccc

SEQ ID NO: 3722878 - RNA, 20 nt, Human
ucucacucccuucuccuuga

SEQ ID NO: 3722879 - RNA, 13 nt, Human
ucucacuccuacc

SEQ ID NO: 3722880 - RNA, 11 nt, Human
ucucacuccuu

SEQ ID NO: 3722881 - RNA, 23 nt, Human
ucucacucugcccccccccccca

SEQ ID NO: 3722882 - RNA, 16 nt, Human
ucucacucugucgccc

SEQ ID NO: 3722883 - RNA, 17 nt, Human
ucucacucugucgccca

SEQ ID NO: 3722884 - RNA, 23 nt, Human
ucucacucugucgcccagucugg

SEQ ID NO: 3722885 - RNA, 21 nt, Human
ucucacugagaagauugugaa

SEQ ID NO: 3722886 - RNA, 18 nt, Human
ucucacugagcacuguuu

SEQ ID NO: 3722887 - RNA, 20 nt, Human
ucucacugccaucaaacugu

SEQ ID NO: 3722888 - RNA, 16 nt, Human
ucucacugcuugaacu

SEQ ID NO: 3722889 - RNA, 17 nt, Human
ucucacuggaugcaaag

SEQ ID NO: 3722890 - RNA, 14 nt, Human
ucucacuguguccc

SEQ ID NO: 3722891 - RNA, 21 nt, Human
ucucacugugucccucucucu

SEQ ID NO: 3722892 - RNA, 19 nt, Human
ucucagaaagugccugaca

SEQ ID NO: 3722893 - RNA, 19 nt, Human
ucucagaaggcaaaugacu

SEQ ID NO: 3722894 - RNA, 21 nt, Human
ucucagaaggcaaaugacuuu

SEQ ID NO: 3722895 - RNA, 14 nt, Human
ucucagaagggagg

SEQ ID NO: 3722896 - RNA, 15 nt, Human
ucucagaagggaggc

SEQ ID NO: 3722897 - RNA, 18 nt, Human
ucucagaagggaggcugg

SEQ ID NO: 3722898 - RNA, 20 nt, Human
ucucagacuuuuguacaucu

SEQ ID NO: 3722899 - RNA, 14 nt, Human
ucucagauauuuau

SEQ ID NO: 3722900 - RNA, 20 nt, Human
ucucagauccuuguuucaaa

SEQ ID NO: 3722901 - RNA, 22 nt, Human
ucucagauccuuguuucaaaca

SEQ ID NO: 3722902 - RNA, 15 nt, Human
ucucagaugcaguuu

SEQ ID NO: 3722903 - RNA, 18 nt, Human
ucucagauuucugaggaa

SEQ ID NO: 3722904 - RNA, 13 nt, Human
ucucagauuuuau

SEQ ID NO: 3722905 - RNA, 18 nt, Human
ucucagauuuuauuaugu

SEQ ID NO: 3722906 - RNA, 19 nt, Human
ucucagauuuuauuaugua

SEQ ID NO: 3722907 - RNA, 21 nt, Human
ucucagcauuaccucuuugga

SEQ ID NO: 3722908 - RNA, 15 nt, Human
ucucagccaacgagu

SEQ ID NO: 3722909 - RNA, 14 nt, Human
ucucagcccagaag

SEQ ID NO: 3722910 - RNA, 16 nt, Human
ucucagcccagaagaa

SEQ ID NO: 3722911 - RNA, 18 nt, Human
ucucagcccagaagaaaa

SEQ ID NO: 3722912 - RNA, 22 nt, Human
ucucagcccagaagaaaauucu

SEQ ID NO: 3722913 - RNA, 15 nt, Human
ucucagccuuacauu

SEQ ID NO: 3722914 - RNA, 15 nt, Human
ucucagcuaagcuca

SEQ ID NO: 3722915 - RNA, 16 nt, Human
ucucagcucacugcaa

SEQ ID NO: 3722916 - RNA, 16 nt, Human
ucucagcucaucuuca

SEQ ID NO: 3722917 - RNA, 11 nt, Human
ucucagcuccc

SEQ ID NO: 3722918 - RNA, 22 nt, Human
ucucagcucccauuucuacucu

SEQ ID NO: 3722919 - RNA, 18 nt, Human
ucucagcucccccugucc

SEQ ID NO: 3722920 - RNA, 22 nt, Human
ucucagcucccccuguccccuc

SEQ ID NO: 3722921 - RNA, 15 nt, Human
ucucaggacacaggc

SEQ ID NO: 3722922 - RNA, 16 nt, Human
ucucaggacacaggcc

SEQ ID NO: 3722923 - RNA, 18 nt, Human
ucucaggagcacaggcag

SEQ ID NO: 3722924 - RNA, 23 nt, Human
ucucaggagcacaggcagcugga

SEQ ID NO: 3722925 - RNA, 14 nt, Human
ucucaggauccaag

SEQ ID NO: 3722926 - RNA, 15 nt, Human
ucucaggauccaagc

SEQ ID NO: 3722927 - RNA, 18 nt, Human
ucucaggcaugccugugu

SEQ ID NO: 3722928 - RNA, 20 nt, Human
ucucaggcaugccuguguga

SEQ ID NO: 3722929 - RNA, 21 nt, Human
ucucaggcaugccugugugac

SEQ ID NO: 3722930 - RNA, 17 nt, Human
ucucaggcugccugagu

SEQ ID NO: 3722931 - RNA, 22 nt, Human
ucucagggaagcccagcuccag

SEQ ID NO: 3722932 - RNA, 12 nt, Human
ucucagggccug

SEQ ID NO: 3722933 - RNA, 13 nt, Human
ucucagggcuccu

SEQ ID NO: 3722934 - RNA, 16 nt, Human
ucucaggggcuguuug

SEQ ID NO: 3722935 - RNA, 17 nt, Human
ucucaggggcuguuuga

SEQ ID NO: 3722936 - RNA, 15 nt, Human
ucucagggucucugc

SEQ ID NO: 3722937 - RNA, 16 nt, Human
ucucagggucucugcu

SEQ ID NO: 3722938 - RNA, 17 nt, Human
ucucagggucucugcug

SEQ ID NO: 3722939 - RNA, 16 nt, Human
ucucagggugucccag

SEQ ID NO: 3722940 - RNA, 22 nt, Human
ucucagguuaagugugaguaau

SEQ ID NO: 3722941 - RNA, 15 nt, Human
ucucagucaguaauu

SEQ ID NO: 3722942 - RNA, 20 nt, Human
ucucagucaugcauaaauau

SEQ ID NO: 3722943 - RNA, 23 nt, Human
ucucagucaugcauaaauaugca

SEQ ID NO: 3722944 - RNA, 13 nt, Human
ucucagucucuga

SEQ ID NO: 3722945 - RNA, 14 nt, Human
ucucagugcccucc

SEQ ID NO: 3722946 - RNA, 23 nt, Human
ucucagugcuucuuacuauuaag

SEQ ID NO: 3722947 - RNA, 13 nt, Human
ucucagugcuuuc

SEQ ID NO: 3722948 - RNA, 14 nt, Human
ucucaguugcagcc

SEQ ID NO: 3722949 - RNA, 21 nt, Human
ucucaguugcagcccugcugc

SEQ ID NO: 3722950 - RNA, 15 nt, Human
ucucaguuggaaaua

SEQ ID NO: 3722951 - RNA, 21 nt, Human
ucucaguuuuucuuaauauau

SEQ ID NO: 3722952 - RNA, 16 nt, Human
ucucauaauuuauaca

SEQ ID NO: 3722953 - RNA, 15 nt, Human
ucucauaccucugac

SEQ ID NO: 3722954 - RNA, 14 nt, Human
ucucauacguccac

SEQ ID NO: 3722955 - RNA, 18 nt, Human
ucucauacucaccucacc

SEQ ID NO: 3722956 - RNA, 13 nt, Human
ucucauagcauua

SEQ ID NO: 3722957 - RNA, 16 nt, Human
ucucauaggaaaagua

SEQ ID NO: 3722958 - RNA, 23 nt, Human
ucucauaggaaaaguacauuuaa

SEQ ID NO: 3722959 - RNA, 22 nt, Human
ucucauauauagacagcuuuga

SEQ ID NO: 3722960 - RNA, 15 nt, Human
ucucaucaacugaau

SEQ ID NO: 3722961 - RNA, 12 nt, Human
ucucaucacaca

SEQ ID NO: 3722962 - RNA, 14 nt, Human
ucucaucacacaca

SEQ ID NO: 3722963 - RNA, 15 nt, Human
ucucaucacacacau

SEQ ID NO: 3722964 - RNA, 16 nt, Human
ucucaucacacacaug

SEQ ID NO: 3722965 - RNA, 14 nt, Human
ucucauccaucauc

SEQ ID NO: 3722966 - RNA, 14 nt, Human
ucucauccccaggg

SEQ ID NO: 3722967 - RNA, 23 nt, Human
ucucauccccagucccaaugcac

SEQ ID NO: 3722968 - RNA, 17 nt, Human
ucucauccuccuggaac

SEQ ID NO: 3722969 - RNA, 21 nt, Human
ucucauccuuuucuccuaucu

SEQ ID NO: 3722970 - RNA, 13 nt, Human
ucucaucugaggc

SEQ ID NO: 3722971 - RNA, 15 nt, Human
ucucaucugcacccu

SEQ ID NO: 3722972 - RNA, 19 nt, Human
ucucaucugcacccuucuu

SEQ ID NO: 3722973 - RNA, 16 nt, Human
ucucaugaggggagag

SEQ ID NO: 3722974 - RNA, 16 nt, Human
ucucaugugauccuuu

SEQ ID NO: 3722975 - RNA, 23 nt, Human
ucucaugugauccuuuuauguua

SEQ ID NO: 3722976 - RNA, 19 nt, Human
ucucauguuuucaacugcc

SEQ ID NO: 3722977 - RNA, 15 nt, Human
ucucauuaaaagaau

SEQ ID NO: 3722978 - RNA, 23 nt, Human
ucucauuaauacucuuuauuuau

SEQ ID NO: 3722979 - RNA, 13 nt, Human
ucucauuccccag

SEQ ID NO: 3722980 - RNA, 12 nt, Human
ucucauucuugu

SEQ ID NO: 3722981 - RNA, 17 nt, Human
ucucauuggaaauuuag

SEQ ID NO: 3722982 - RNA, 19 nt, Human
ucucauuggaaauuuagca

SEQ ID NO: 3722983 - RNA, 20 nt, Human
ucucauuggacccuuccaug

SEQ ID NO: 3722984 - RNA, 19 nt, Human
ucucauuucaccccucccu

SEQ ID NO: 3722985 - RNA, 21 nt, Human
ucucauuuuuccguaaaaaug

SEQ ID NO: 3722986 - RNA, 14 nt, Human
ucuccaaaccacuu

SEQ ID NO: 3722987 - RNA, 22 nt, Human
ucuccaaacugaagcagccucu

SEQ ID NO: 3722988 - RNA, 23 nt, Human
ucuccaaacugaagcagccucuc

SEQ ID NO: 3722989 - RNA, 17 nt, Human
ucuccaacaucacagcc

SEQ ID NO: 3722990 - RNA, 22 nt, Human
ucuccaaccccccagcacugag

SEQ ID NO: 3722991 - RNA, 14 nt, Human
ucuccaagaaugcu

SEQ ID NO: 3722992 - RNA, 15 nt, Human
ucuccaagaaugcug

SEQ ID NO: 3722993 - RNA, 17 nt, Human
ucuccaagaaugcugaa

SEQ ID NO: 3722994 - RNA, 15 nt, Human
ucuccaagcaggaca

SEQ ID NO: 3722995 - RNA, 18 nt, Human
ucuccaagcaggacaugg

SEQ ID NO: 3722996 - RNA, 16 nt, Human
ucuccaagggcuucug

SEQ ID NO: 3722997 - RNA, 20 nt, Human
ucuccaagggcuucugcacc

SEQ ID NO: 3722998 - RNA, 20 nt, Human
ucuccaauuuuuuuuuccuu

SEQ ID NO: 3722999 - RNA, 22 nt, Human
ucuccacacacagcugggcugu

SEQ ID NO: 3723000 - RNA, 17 nt, Human
ucuccacccugcucucc

SEQ ID NO: 3723001 - RNA, 12 nt, Human
ucuccaccucag

SEQ ID NO: 3723002 - RNA, 14 nt, Human
ucuccaccucagcc

SEQ ID NO: 3723003 - RNA, 15 nt, Human
ucuccaccucagccu

SEQ ID NO: 3723004 - RNA, 15 nt, Human
ucuccaccugccagg

SEQ ID NO: 3723005 - RNA, 22 nt, Human
uccugacacccuucucccacuc

SEQ ID NO: 3723006 - RNA, 14 nt, Human
uccugacagaaggu

SEQ ID NO: 3723007 - RNA, 15 nt, Human
uccugacagaaggug

SEQ ID NO: 3723008 - RNA, 16 nt, Human
uccugacagaaggugc

SEQ ID NO: 3723009 - RNA, 15 nt, Human
uccugacauugucuc

SEQ ID NO: 3723010 - RNA, 13 nt, Human
uccugaccacccu

SEQ ID NO: 3723011 - RNA, 15 nt, Human
uccugaccacccucc

SEQ ID NO: 3723012 - RNA, 20 nt, Human
uccugaccacccuccccucu

SEQ ID NO: 3723013 - RNA, 12 nt, Human
uccugacccagg

SEQ ID NO: 3723014 - RNA, 16 nt, Human
uccugacccaggccgc

SEQ ID NO: 3723015 - RNA, 14 nt, Human
uccugacccagucc

SEQ ID NO: 3723016 - RNA, 15 nt, Human
ggcagggcugaggcc

SEQ ID NO: 3723017 - RNA, 21 nt, Human
ggcagggcuggccccagggca

SEQ ID NO: 3723018 - RNA, 20 nt, Human
ggcaggggcccugcagcucu

SEQ ID NO: 3723019 - RNA, 21 nt, Human
ggcaggggcccugcagcucuc

SEQ ID NO: 3723020 - RNA, 17 nt, Human
ggcaggggccuggagau

SEQ ID NO: 3723021 - RNA, 12 nt, Human
ggcaggggcgga

SEQ ID NO: 3723022 - RNA, 13 nt, Human
ggcaggggcuucc

SEQ ID NO: 3723023 - RNA, 12 nt, Human
ggcagggggcug

SEQ ID NO: 3723024 - RNA, 14 nt, Human
ggcagggggcugcu

SEQ ID NO: 3723025 - RNA, 22 nt, Human
ggcagggggcugcugcugggcu

SEQ ID NO: 3723026 - RNA, 23 nt, Human
ggcagggguggaggagagccugg

SEQ ID NO: 3723027 - RNA, 13 nt, Human
ggcaggggugggg

SEQ ID NO: 3723028 - RNA, 18 nt, Human
ggcagggucucacucugu

SEQ ID NO: 3723029 - RNA, 19 nt, Human
ggcagggucucacucuguc

SEQ ID NO: 3723030 - RNA, 19 nt, Human
ggcagggugucugcccccu

SEQ ID NO: 3723031 - RNA, 21 nt, Human
ggcagguaugaucggcaggac

SEQ ID NO: 3723032 - RNA, 17 nt, Human
ggcaggugacagugagg

SEQ ID NO: 3723033 - RNA, 21 nt, Human
ggcaggugacagugagguccu

SEQ ID NO: 3723034 - RNA, 22 nt, Human
ggcaggugccaugucugggaac

SEQ ID NO: 3723035 - RNA, 14 nt, Human
ggcaggugccucca

SEQ ID NO: 3723036 - RNA, 18 nt, Human
ggcaggugccuccaggug

SEQ ID NO: 3723037 - RNA, 20 nt, Human
ggcaggugccuccaggugug

SEQ ID NO: 3723038 - RNA, 23 nt, Human
ggcagguggaggugucaggcugc

SEQ ID NO: 3723039 - RNA, 12 nt, Human
ggcaggugggag

SEQ ID NO: 3723040 - RNA, 22 nt, Human
ggcagguguuuauuaaaauucu

SEQ ID NO: 3723041 - RNA, 15 nt, Human
ggcagguuggugggg

SEQ ID NO: 3723042 - RNA, 17 nt, Human
ggcaguaccugggcaag

SEQ ID NO: 3723043 - RNA, 21 nt, Human
ggcaguagaaggucggaggcu

SEQ ID NO: 3723044 - RNA, 22 nt, Human
ggcaguauccuguuugaggaaa

SEQ ID NO: 3723045 - RNA, 19 nt, Human
ggcaguauuuuguguccuc

SEQ ID NO: 3723046 - RNA, 13 nt, Human
uccuugucaguug

SEQ ID NO: 3723047 - RNA, 16 nt, Human
uccuuguccacccacc

SEQ ID NO: 3723048 - RNA, 16 nt, Human
uccuuguccccacacu

SEQ ID NO: 3723049 - RNA, 17 nt, Human
uccuuguccccacacuc

SEQ ID NO: 3723050 - RNA, 18 nt, Human
uccuuguccccacacucc

SEQ ID NO: 3723051 - RNA, 17 nt, Human
uccuugugaugugcacg

SEQ ID NO: 3723052 - RNA, 14 nt, Human
uccuuguggcagag

SEQ ID NO: 3723053 - RNA, 15 nt, Human
uccuuguggcagagg

SEQ ID NO: 3723054 - RNA, 19 nt, Human
uccuugugggccugggcuc

SEQ ID NO: 3723055 - RNA, 23 nt, Human
uccuugugggccugggcuccugg

SEQ ID NO: 3723056 - RNA, 17 nt, Human
uccuugugguuuauguc

SEQ ID NO: 3723057 - RNA, 16 nt, Human
uccuuuaaaaaaauuu

SEQ ID NO: 3723058 - RNA, 16 nt, Human
uccuuuaaagaugaac

SEQ ID NO: 3723059 - RNA, 12 nt, Human
uccuuuacaaaa

SEQ ID NO: 3723060 - RNA, 12 nt, Human
uccuuuacacau

SEQ ID NO: 3723061 - RNA, 15 nt, Human
uccuuuacccucauc

SEQ ID NO: 3723062 - RNA, 16 nt, Human
uccuuuacccucaucu

SEQ ID NO: 3723063 - RNA, 17 nt, Human
uccuuuacccucaucug

SEQ ID NO: 3723064 - RNA, 16 nt, Human
uccuuuacguguuuaa

SEQ ID NO: 3723065 - RNA, 18 nt, Human
uccuuuacuuucccuugc

SEQ ID NO: 3723066 - RNA, 20 nt, Human
uccuuuacuuucccuugcuu

SEQ ID NO: 3723067 - RNA, 17 nt, Human
uccuuuagcgcccaguu

SEQ ID NO: 3723068 - RNA, 23 nt, Human
uccuuuagcgcccaguugggugg

SEQ ID NO: 3723069 - RNA, 23 nt, Human
uccuuuaggagggaguuaucuaa

SEQ ID NO: 3723070 - RNA, 20 nt, Human
uccuuuaggguucugccucu

SEQ ID NO: 3723071 - RNA, 12 nt, Human
uccuuuauagag

SEQ ID NO: 3723072 - RNA, 15 nt, Human
uccuuuaugugaauu

SEQ ID NO: 3723073 - RNA, 16 nt, Human
uccuuuaugugaauuu

SEQ ID NO: 3723074 - RNA, 17 nt, Human
uccuuuauuauuauuuu

SEQ ID NO: 3723075 - RNA, 16 nt, Human
uccuuucacaaccuuc

SEQ ID NO: 3723076 - RNA, 19 nt, Human
uccuuucacaaccuucugu

SEQ ID NO: 3723077 - RNA, 16 nt, Human
uccuuucacuucuuuc

SEQ ID NO: 3723078 - RNA, 20 nt, Human
uccuuucaguggcuuggacu

SEQ ID NO: 3723079 - RNA, 18 nt, Human
uccuuucauccccaccuu

SEQ ID NO: 3723080 - RNA, 16 nt, Human
uccuuucauuuacugu

SEQ ID NO: 3723081 - RNA, 18 nt, Human
uccuuuccaaggcuucuc

SEQ ID NO: 3723082 - RNA, 13 nt, Human
uccuuucccaagc

SEQ ID NO: 3723083 - RNA, 13 nt, Human
uccuuuccccagc

SEQ ID NO: 3723084 - RNA, 14 nt, Human
uccuuuccccagcc

SEQ ID NO: 3723085 - RNA, 17 nt, Human
uccuuuccccagcccag

SEQ ID NO: 3723086 - RNA, 18 nt, Human
uccuuuccccagcccagg

SEQ ID NO: 3723087 - RNA, 13 nt, Human
uccuuucccucca

SEQ ID NO: 3723088 - RNA, 14 nt, Human
uccuuucccuuccu

SEQ ID NO: 3723089 - RNA, 17 nt, Human
uccuuucccuuccucuu

SEQ ID NO: 3723090 - RNA, 12 nt, Human
uccuuucccuuu

SEQ ID NO: 3723091 - RNA, 14 nt, Human
uccuuuccuccucu

SEQ ID NO: 3723092 - RNA, 21 nt, Human
uccuuucuaucauuuuuguac

SEQ ID NO: 3723093 - RNA, 13 nt, Human
uccuuucucaccg

SEQ ID NO: 3723094 - RNA, 14 nt, Human
uccuuucucagccg

SEQ ID NO: 3723095 - RNA, 23 nt, Human
uccuuucucagccgcuucugacu

SEQ ID NO: 3723096 - RNA, 17 nt, Human
uccuuucuccaggacca

SEQ ID NO: 3723097 - RNA, 16 nt, Human
uccuuucugccgaccc

SEQ ID NO: 3723098 - RNA, 13 nt, Human
uccuuucuggcuu

SEQ ID NO: 3723099 - RNA, 17 nt, Human
uccuuucugugcccuac

SEQ ID NO: 3723100 - RNA, 12 nt, Human
uccuuucuuuuc

SEQ ID NO: 3723101 - RNA, 16 nt, Human
uccuuucuuuuucuuc

SEQ ID NO: 3723102 - RNA, 17 nt, Human
uccuuucuuuuucuucu

SEQ ID NO: 3723103 - RNA, 20 nt, Human
uccuuucuuuuucuucuucc

SEQ ID NO: 3723104 - RNA, 14 nt, Human
uccuuugaagagga

SEQ ID NO: 3723105 - RNA, 15 nt, Human
uccuuugaagaggaa

SEQ ID NO: 3723106 - RNA, 12 nt, Human
uccuuugaagau

SEQ ID NO: 3723107 - RNA, 20 nt, Human
uccuuugauaaaauaaauga

SEQ ID NO: 3723108 - RNA, 15 nt, Human
uccuuugcaggcuca

SEQ ID NO: 3723109 - RNA, 15 nt, Human
uccuuugcagggcag

SEQ ID NO: 3723110 - RNA, 18 nt, Human
uccuuugcagggcagccc

SEQ ID NO: 3723111 - RNA, 13 nt, Human
uccuuuguacuuu

SEQ ID NO: 3723112 - RNA, 11 nt, Human
uccuuuguaua

SEQ ID NO: 3723113 - RNA, 14 nt, Human
uccuuugugaaaaa

SEQ ID NO: 3723114 - RNA, 18 nt, Human
uccuuugugaggaagccg

SEQ ID NO: 3723115 - RNA, 17 nt, Human
uccuuugugcuuaguua

SEQ ID NO: 3723116 - RNA, 17 nt, Human
uccuuugugguuuuaug

SEQ ID NO: 3723117 - RNA, 20 nt, Human
uccuuuguguguacucacug

SEQ ID NO: 3723118 - RNA, 15 nt, Human
uccuuuguguuucua

SEQ ID NO: 3723119 - RNA, 10 nt, Human
uccuuuguuc

SEQ ID NO: 3723120 - RNA, 18 nt, Human
uccuuuguuuucugacua

SEQ ID NO: 3723121 - RNA, 22 nt, Human
uccuuuguuuucugacuaauua

SEQ ID NO: 3723122 - RNA, 15 nt, Human
uccuuuguuuuuaug

SEQ ID NO: 3723123 - RNA, 19 nt, Human
uccuuuuaaaacacuucca

SEQ ID NO: 3723124 - RNA, 12 nt, Human
uccuuuuaaaga

SEQ ID NO: 3723125 - RNA, 14 nt, Human
uccuuuuaaagaaa

SEQ ID NO: 3723126 - RNA, 14 nt, Human
uccuuuuagccuag

SEQ ID NO: 3723127 - RNA, 14 nt, Human
uccuuuuauguuau

SEQ ID NO: 3723128 - RNA, 15 nt, Human
uccuuuuauguuauu

SEQ ID NO: 3723129 - RNA, 20 nt, Human
uccuuuucauaggucugaaa

SEQ ID NO: 3723130 - RNA, 14 nt, Human
uccuuuuccagagc

SEQ ID NO: 3723131 - RNA, 15 nt, Human
uccuuuuccagagca

SEQ ID NO: 3723132 - RNA, 23 nt, Human
uccuuuuccagagcauuccaguc

SEQ ID NO: 3723133 - RNA, 16 nt, Human
uccuuuucuccuaucu

SEQ ID NO: 3723134 - RNA, 19 nt, Human
uccuuuucuccuaucuuca

SEQ ID NO: 3723135 - RNA, 19 nt, Human
uccuuuucuuuuguuacug

SEQ ID NO: 3723136 - RNA, 20 nt, Human
uccuuuugacacugcucuaa

SEQ ID NO: 3723137 - RNA, 23 nt, Human
uccuuuugaccuucauuucaugu

SEQ ID NO: 3723138 - RNA, 15 nt, Human
uccuuuugguguguu

SEQ ID NO: 3723139 - RNA, 14 nt, Human
uccuuuugucuucu

SEQ ID NO: 3723140 - RNA, 22 nt, Human
uccuuuugucuucucugucuca

SEQ ID NO: 3723141 - RNA, 12 nt, Human
uccuuuuuaagg

SEQ ID NO: 3723142 - RNA, 17 nt, Human
uccuuuuuaauaugcuu

SEQ ID NO: 3723143 - RNA, 12 nt, Human
uccuuuuuauga

SEQ ID NO: 3723144 - RNA, 15 nt, Human
uccuuuuuauuuaua

SEQ ID NO: 3723145 - RNA, 22 nt, Human
uccuuuuuauuuauauguaugu

SEQ ID NO: 3723146 - RNA, 18 nt, Human
uccuuuuucccaauaaau

SEQ ID NO: 3723147 - RNA, 12 nt, Human
uccuuuuuccuc

SEQ ID NO: 3723148 - RNA, 20 nt, Human
uccuuuuucucccucuggau

SEQ ID NO: 3723149 - RNA, 14 nt, Human
uccuuuuucugauu

SEQ ID NO: 3723150 - RNA, 15 nt, Human
uccuuuuucugauua

SEQ ID NO: 3723151 - RNA, 22 nt, Human
uccuuuuucugauuagcuuugu

SEQ ID NO: 3723152 - RNA, 23 nt, Human
uccuuuuuggucgaggaguaaca

SEQ ID NO: 3723153 - RNA, 14 nt, Human
uccuuuuuuaaaag

SEQ ID NO: 3723154 - RNA, 16 nt, Human
uccuuuuuuauacaca

SEQ ID NO: 3723155 - RNA, 18 nt, Human
uccuuuuuuauacacaua

SEQ ID NO: 3723156 - RNA, 13 nt, Human
ucgaaaaaauaau

SEQ ID NO: 3723157 - RNA, 14 nt, Human
ucgaaaaucaaaug

SEQ ID NO: 3723158 - RNA, 15 nt, Human
ucgaaaauucauuuc

SEQ ID NO: 3723159 - RNA, 21 nt, Human
ucgaaaauucauuucacauua

SEQ ID NO: 3723160 - RNA, 24 nt, Human
ucgaaaauucauuucacauuaaug

SEQ ID NO: 3723161 - RNA, 13 nt, Human
ucgaaacacagaa

SEQ ID NO: 3723162 - RNA, 20 nt, Human
ucgaaaguuaguaggauaug

SEQ ID NO: 3723163 - RNA, 14 nt, Human
ucgaaauaacaaug

SEQ ID NO: 3723164 - RNA, 13 nt, Human
ucgaacccacacu

SEQ ID NO: 3723165 - RNA, 15 nt, Human
ucgaaccguuuugaa

SEQ ID NO: 3723166 - RNA, 15 nt, Human
ucgaacuccugaccu

SEQ ID NO: 3723167 - RNA, 16 nt, Human
ucgaacuccugggcuc

SEQ ID NO: 3723168 - RNA, 16 nt, Human
ucgaagucauuaaacu

SEQ ID NO: 3723169 - RNA, 18 nt, Human
ucgaagucauuaaacugg

SEQ ID NO: 3723170 - RNA, 13 nt, Human
ucgaagugcugag

SEQ ID NO: 3723171 - RNA, 12 nt, Human
ucgaaugaaauu

SEQ ID NO: 3723172 - RNA, 21 nt, Human
ucgaauuaauagcuuuuauug

SEQ ID NO: 3723173 - RNA, 19 nt, Human
ucgacacucaccaugaagc

SEQ ID NO: 3723174 - RNA, 18 nt, Human
ucgacaucacuguucaug

SEQ ID NO: 3723175 - RNA, 13 nt, Human
ucgaccugccucg

SEQ ID NO: 3723176 - RNA, 20 nt, Human
ucgaccugcggcugcugugu

SEQ ID NO: 3723177 - RNA, 12 nt, Human
ucgacucugugc

SEQ ID NO: 3723178 - RNA, 14 nt, Human
ucgacuguuguuau

SEQ ID NO: 3723179 - RNA, 22 nt, Human
ucgagaacuuucauuuuuuucc

SEQ ID NO: 3723180 - RNA, 19 nt, Human
ucgagaagcugcucuggaa

SEQ ID NO: 3723181 - RNA, 11 nt, Human
ucgagaauugu

SEQ ID NO: 3723182 - RNA, 16 nt, Human
ucgagacacagugaag

SEQ ID NO: 3723183 - RNA, 14 nt, Human
ucgagacacuugcc

SEQ ID NO: 3723184 - RNA, 13 nt, Human
ucgagaccagccu

SEQ ID NO: 3723185 - RNA, 15 nt, Human
ucgagaccauccugg

SEQ ID NO: 3723186 - RNA, 18 nt, Human
ucgagaccauccuggcua

SEQ ID NO: 3723187 - RNA, 14 nt, Human
ucgagacugcaaug

SEQ ID NO: 3723188 - RNA, 17 nt, Human
ucgagaucccaacacug

SEQ ID NO: 3723189 - RNA, 21 nt, Human
ucgagaucccaacacugccag

SEQ ID NO: 3723190 - RNA, 14 nt, Human
ucgagcagggugcu

SEQ ID NO: 3723191 - RNA, 14 nt, Human
ucgagcgcccugca

SEQ ID NO: 3723192 - RNA, 15 nt, Human
ucgagcgcccugcag

SEQ ID NO: 3723193 - RNA, 19 nt, Human
ucgagcuccccccaggucu

SEQ ID NO: 3723194 - RNA, 17 nt, Human
ucgaggaaccagagcca

SEQ ID NO: 3723195 - RNA, 13 nt, Human
ucgaggacaggga

SEQ ID NO: 3723196 - RNA, 19 nt, Human
ucgaggacuguauuuguga

SEQ ID NO: 3723197 - RNA, 11 nt, Human
ucgaggccuga

SEQ ID NO: 3723198 - RNA, 15 nt, Human
ucgagggcagggacu

SEQ ID NO: 3723199 - RNA, 13 nt, Human
ucucugacuucug

SEQ ID NO: 3723200 - RNA, 16 nt, Human
ucucugacuucugccu

SEQ ID NO: 3723201 - RNA, 19 nt, Human
ucucugacuucugccugga

SEQ ID NO: 3723202 - RNA, 15 nt, Human
ucucugagcugugca

SEQ ID NO: 3723203 - RNA, 14 nt, Human
ucucugaggacacu

SEQ ID NO: 3723204 - RNA, 17 nt, Human
ucucugaggacacuaac

SEQ ID NO: 3723205 - RNA, 23 nt, Human
ucucugaggggcuaccaggaaag

SEQ ID NO: 3723206 - RNA, 22 nt, Human
ucucugaguucuguguauuuuc

SEQ ID NO: 3723207 - RNA, 18 nt, Human
ucucugcaccguacugug

SEQ ID NO: 3723208 - RNA, 15 nt, Human
ucucugcagacuucc

SEQ ID NO: 3723209 - RNA, 20 nt, Human
ucucugcagacuucccagcu

SEQ ID NO: 3723210 - RNA, 16 nt, Human
ucucugcagccagccc

SEQ ID NO: 3723211 - RNA, 19 nt, Human
ucucugcagccagcccagc

SEQ ID NO: 3723212 - RNA, 16 nt, Human
ucucugcagcugccgg

SEQ ID NO: 3723213 - RNA, 20 nt, Human
ucucugcaggcagccugccu

SEQ ID NO: 3723214 - RNA, 15 nt, Human
ucucugcaucugacc

SEQ ID NO: 3723215 - RNA, 20 nt, Human
ucucugcauuuuucugcaga

SEQ ID NO: 3723216 - RNA, 14 nt, Human
ucucugccagugac

SEQ ID NO: 3723217 - RNA, 18 nt, Human
ucucugccauaucaguga

SEQ ID NO: 3723218 - RNA, 19 nt, Human
ucucugcccagcuuuucau

SEQ ID NO: 3723219 - RNA, 11 nt, Human
ucucugcccua

SEQ ID NO: 3723220 - RNA, 17 nt, Human
ucucugcccuccaagac

SEQ ID NO: 3723221 - RNA, 19 nt, Human
ucucugccugugagccagu

SEQ ID NO: 3723222 - RNA, 12 nt, Human
ucucugccuugc

SEQ ID NO: 3723223 - RNA, 19 nt, Human
ucucugccuuugacauuua

SEQ ID NO: 3723224 - RNA, 13 nt, Human
ucucugcuauaua

SEQ ID NO: 3723225 - RNA, 19 nt, Human
ucucugcuccaccacaucc

SEQ ID NO: 3723226 - RNA, 22 nt, Human
ucucugcucgcccuccuuucug

SEQ ID NO: 3723227 - RNA, 18 nt, Human
ucucugcucugcguguca

SEQ ID NO: 3723228 - RNA, 23 nt, Human
ucucugcucugcgugucaccugu

SEQ ID NO: 3723229 - RNA, 13 nt, Human
ucucugcugccgc

SEQ ID NO: 3723230 - RNA, 15 nt, Human
ucucugcuggcccag

SEQ ID NO: 3723231 - RNA, 11 nt, Human
ucucugcugua

SEQ ID NO: 3723232 - RNA, 14 nt, Human
ucucugcuucagcu

SEQ ID NO: 3723233 - RNA, 15 nt, Human
ucucuggaauuugaa

SEQ ID NO: 3723234 - RNA, 18 nt, Human
ucucuggagccaagucca

SEQ ID NO: 3723235 - RNA, 15 nt, Human
ucucuggccucccac

SEQ ID NO: 3723236 - RNA, 19 nt, Human
ucucuggcuguaaggcucu

SEQ ID NO: 3723237 - RNA, 13 nt, Human
ucucugggagaaa

SEQ ID NO: 3723238 - RNA, 16 nt, Human
ucucugggagaaaauc

SEQ ID NO: 3723239 - RNA, 15 nt, Human
ucucugggccucaga

SEQ ID NO: 3723240 - RNA, 15 nt, Human
ucucugggcuggaug

SEQ ID NO: 3723241 - RNA, 16 nt, Human
ucucugggcuggauga

SEQ ID NO: 3723242 - RNA, 16 nt, Human
ucucuggggcuguguu

SEQ ID NO: 3723243 - RNA, 18 nt, Human
ucucugggggcugaggag

SEQ ID NO: 3723244 - RNA, 20 nt, Human
ucucugguccggacacuccu

SEQ ID NO: 3723245 - RNA, 17 nt, Human
ucucuggugagcgagga

SEQ ID NO: 3723246 - RNA, 18 nt, Human
ucucuguaauaaacucau

SEQ ID NO: 3723247 - RNA, 19 nt, Human
ucucugucccauucccugg

SEQ ID NO: 3723248 - RNA, 20 nt, Human
ucucugucccuugcuguaug

SEQ ID NO: 3723249 - RNA, 15 nt, Human
ucucugucuaccauc

SEQ ID NO: 3723250 - RNA, 18 nt, Human
ucucugucuaccaucucc

SEQ ID NO: 3723251 - RNA, 16 nt, Human
ucucugugaacgauuu

SEQ ID NO: 3723252 - RNA, 22 nt, Human
ucucugugaacgauuuagaaag

SEQ ID NO: 3723253 - RNA, 13 nt, Human
ucucugugagaag

SEQ ID NO: 3723254 - RNA, 12 nt, Human
ucucugugccuu

SEQ ID NO: 3723255 - RNA, 17 nt, Human
ucucugugccuucgucu

SEQ ID NO: 3723256 - RNA, 16 nt, Human
ucucugugcuuugacu

SEQ ID NO: 3723257 - RNA, 22 nt, Human
ucucugugcuuugacucaccug

SEQ ID NO: 3723258 - RNA, 16 nt, Human
ucucugugucuaagau

SEQ ID NO: 3723259 - RNA, 23 nt, Human
ucucugugucuaagauucuagau

SEQ ID NO: 3723260 - RNA, 20 nt, Human
ucucuguguuuguuccuaca

SEQ ID NO: 3723261 - RNA, 14 nt, Human
ucucuguucauuuc

SEQ ID NO: 3723262 - RNA, 23 nt, Human
ucucuguucuacccguuccaaaa

SEQ ID NO: 3723263 - RNA, 13 nt, Human
ucucuguugucgu

SEQ ID NO: 3723264 - RNA, 18 nt, Human
ucucuuacccuucugugc

SEQ ID NO: 3723265 - RNA, 19 nt, Human
ucucuuacugcaaauguca

SEQ ID NO: 3723266 - RNA, 13 nt, Human
ucucuuaucugug

SEQ ID NO: 3723267 - RNA, 21 nt, Human
ucucuuaucuuacgaaaaaau

SEQ ID NO: 3723268 - RNA, 16 nt, Human
ucucuuauugccucac

SEQ ID NO: 3723269 - RNA, 22 nt, Human
ucucuuauugccucacuucagg

SEQ ID NO: 3723270 - RNA, 17 nt, Human
ucucuucagacucucag

SEQ ID NO: 3723271 - RNA, 22 nt, Human
ucucuucagacucucagcccag

SEQ ID NO: 3723272 - RNA, 15 nt, Human
ucucuucagguucuu

SEQ ID NO: 3723273 - RNA, 16 nt, Human
ucucuucagguucuua

SEQ ID NO: 3723274 - RNA, 17 nt, Human
ucucuucagucucuaua

SEQ ID NO: 3723275 - RNA, 14 nt, Human
ucucuucauacuuu

SEQ ID NO: 3723276 - RNA, 15 nt, Human
ucucuuccaggcagc

SEQ ID NO: 3723277 - RNA, 14 nt, Human
ucucuuccccucuc

SEQ ID NO: 3723278 - RNA, 15 nt, Human
ucucuuccuauccca

SEQ ID NO: 3723279 - RNA, 14 nt, Human
ucucuuccugcccc

SEQ ID NO: 3723280 - RNA, 11 nt, Human
ucucuucucca

SEQ ID NO: 3723281 - RNA, 18 nt, Human
ucucuucuccccuuccau

SEQ ID NO: 3723282 - RNA, 13 nt, Human
ucucuucugcucc

SEQ ID NO: 3723283 - RNA, 17 nt, Human
ucucuucugcuccaccc

SEQ ID NO: 3723284 - RNA, 14 nt, Human
ucucuucuuaaugu

SEQ ID NO: 3723285 - RNA, 15 nt, Human
ucucuucuuguuucu

SEQ ID NO: 3723286 - RNA, 13 nt, Human
ucucuucuuuaaa

SEQ ID NO: 3723287 - RNA, 16 nt, Human
ucucuucuuuuggcuu

SEQ ID NO: 3723288 - RNA, 13 nt, Human
ucucuugagccug

SEQ ID NO: 3723289 - RNA, 14 nt, Human
ucucuugagcuggc

SEQ ID NO: 3723290 - RNA, 18 nt, Human
ucucuugaggccaggagu

SEQ ID NO: 3723291 - RNA, 13 nt, Human
ucucuugagggag

SEQ ID NO: 3723292 - RNA, 14 nt, Human
ucucuugauucaua

SEQ ID NO: 3723293 - RNA, 22 nt, Human
ucucuugcaccaaauuaucuug

SEQ ID NO: 3723294 - RNA, 14 nt, Human
ucucuugcacccgc

SEQ ID NO: 3723295 - RNA, 22 nt, Human
ucucuugcacccgccucucccg

SEQ ID NO: 3723296 - RNA, 12 nt, Human
ucucuugccuca

SEQ ID NO: 3723297 - RNA, 13 nt, Human
ucucuugguguua

SEQ ID NO: 3723298 - RNA, 16 nt, Human
ucucuugguuuccuuc

SEQ ID NO: 3723299 - RNA, 18 nt, Human
ucucuugguuuccuuccu

SEQ ID NO: 3723300 - RNA, 19 nt, Human
ucucuugguuuccuuccuu

SEQ ID NO: 3723301 - RNA, 18 nt, Human
ucucuuguaauuuggauc

SEQ ID NO: 3723302 - RNA, 22 nt, Human
ucucuuguauaagauccuagau

SEQ ID NO: 3723303 - RNA, 20 nt, Human
ucucuuuaaugucacaggca

SEQ ID NO: 3723304 - RNA, 22 nt, Human
ucucuuuaaugucacaggcagg

SEQ ID NO: 3723305 - RNA, 16 nt, Human
ucucuuuauacagcug

SEQ ID NO: 3723306 - RNA, 17 nt, Human
ucucuuuauacagcugu

SEQ ID NO: 3723307 - RNA, 13 nt, Human
ucucuuuauuccu

SEQ ID NO: 3723308 - RNA, 22 nt, Human
ucucuuucacauuguuugcugc

SEQ ID NO: 3723309 - RNA, 12 nt, Human
ucucuuuccaug

SEQ ID NO: 3723310 - RNA, 14 nt, Human
ucucuuucccuggu

SEQ ID NO: 3723311 - RNA, 18 nt, Human
ucucuuuccuucuugccu

SEQ ID NO: 3723312 - RNA, 12 nt, Human
ucucuuuccuug

SEQ ID NO: 3723313 - RNA, 14 nt, Human
ucucuuucucuccu

SEQ ID NO: 3723314 - RNA, 13 nt, Human
ucucuuucucucu

SEQ ID NO: 3723315 - RNA, 15 nt, Human
ucucuuucucucuuc

SEQ ID NO: 3723316 - RNA, 19 nt, Human
ucucuuucucucuucccuc

SEQ ID NO: 3723317 - RNA, 12 nt, Human
ucucuuucuguc

SEQ ID NO: 3723318 - RNA, 19 nt, Human
ucucuuugauuauuugcau

SEQ ID NO: 3723319 - RNA, 16 nt, Human
ucucuuugggaauguu

SEQ ID NO: 3723320 - RNA, 13 nt, Human
ucucuuuguucuc

SEQ ID NO: 3723321 - RNA, 23 nt, Human
ucucuuuguucucagcucccccu

SEQ ID NO: 3723322 - RNA, 20 nt, Human
ucucuuuuccccuuuccugu

SEQ ID NO: 3723323 - RNA, 14 nt, Human
ucucuuuucuaguu

SEQ ID NO: 3723324 - RNA, 17 nt, Human
ucucuuuucucuuuuua

SEQ ID NO: 3723325 - RNA, 20 nt, Human
ucucuuuucuuuagagcauu

SEQ ID NO: 3723326 - RNA, 20 nt, Human
ucucuuuugaauccaugcuu

SEQ ID NO: 3723327 - RNA, 21 nt, Human
ucucuuuuugcccccucuccu

SEQ ID NO: 3723328 - RNA, 17 nt, Human
ucucuuuuuggaggugc

SEQ ID NO: 3723329 - RNA, 19 nt, Human
ucucuuuuuggaggugcuu

SEQ ID NO: 3723330 - RNA, 15 nt, Human
ucucuuuuuuacaaa

SEQ ID NO: 3723331 - RNA, 15 nt, Human
ucugaaaacggcccu

SEQ ID NO: 3723332 - RNA, 15 nt, Human
ucugaaaagugugua

SEQ ID NO: 3723333 - RNA, 23 nt, Human
ucugaaaaguguguauauauuuu

SEQ ID NO: 3723334 - RNA, 18 nt, Human
ucugaaaauauaaccagc

SEQ ID NO: 3723335 - RNA, 14 nt, Human
ucugaaaauguaug

SEQ ID NO: 3723336 - RNA, 23 nt, Human
ucugaaaauguauguguaaguau

SEQ ID NO: 3723337 - RNA, 22 nt, Human
ucugaaaauuccagaaaggaua

SEQ ID NO: 3723338 - RNA, 18 nt, Human
ucugaaacacacugaaag

SEQ ID NO: 3723339 - RNA, 10 nt, Human
ucugaaacag

SEQ ID NO: 3723340 - RNA, 11 nt, Human
ucugaaacagc

SEQ ID NO: 3723341 - RNA, 18 nt, Human
ucugaaacagcugccuua

SEQ ID NO: 3723342 - RNA, 12 nt, Human
ucugaaagcaca

SEQ ID NO: 3723343 - RNA, 12 nt, Human
ucugaaagccac

SEQ ID NO: 3723344 - RNA, 15 nt, Human
ucugaaaguuguaca

SEQ ID NO: 3723345 - RNA, 12 nt, Human
ucugaaaucuga

SEQ ID NO: 3723346 - RNA, 15 nt, Human
ucugaaaucugaaga

SEQ ID NO: 3723347 - RNA, 22 nt, Human
ucugaaaucuucccaugcauuc

SEQ ID NO: 3723348 - RNA, 22 nt, Human
ucugaaauguuacaaaaauaaa

SEQ ID NO: 3723349 - RNA, 12 nt, Human
ucugaaauucua

SEQ ID NO: 3723350 - RNA, 18 nt, Human
ucugaaauuuccugggag

SEQ ID NO: 3723351 - RNA, 20 nt, Human
ucgaggggcucucagcucag

SEQ ID NO: 3723352 - RNA, 16 nt, Human
ucgagguuucucaaag

SEQ ID NO: 3723353 - RNA, 16 nt, Human
ucgaguacugugggca

SEQ ID NO: 3723354 - RNA, 20 nt, Human
ucgaguacugugggcaauuu

SEQ ID NO: 3723355 - RNA, 23 nt, Human
ucgaguacugugggcaauuuaga

SEQ ID NO: 3723356 - RNA, 13 nt, Human
ucgagucugaggc

SEQ ID NO: 3723357 - RNA, 14 nt, Human
ucgagucugaggcc

SEQ ID NO: 3723358 - RNA, 23 nt, Human
ucgagugccgcaucucacagcua

SEQ ID NO: 3723359 - RNA, 21 nt, Human
ucgauacccaggaccaagcca

SEQ ID NO: 3723360 - RNA, 14 nt, Human
ucgauccaaauugu

SEQ ID NO: 3723361 - RNA, 15 nt, Human
ucgauccaaauugug

SEQ ID NO: 3723362 - RNA, 23 nt, Human
ucgaugaagcccaauaaaccucu

SEQ ID NO: 3723363 - RNA, 15 nt, Human
ucgaugauucaggug

SEQ ID NO: 3723364 - RNA, 22 nt, Human
ucgauguuuuauuauuucuauu

SEQ ID NO: 3723365 - RNA, 14 nt, Human
ucgauuagacugga

SEQ ID NO: 3723366 - RNA, 21 nt, Human
ucgauuagacuggacagcuug

SEQ ID NO: 3723367 - RNA, 17 nt, Human
ucgauucauauugaaua

SEQ ID NO: 3723368 - RNA, 15 nt, Human
ucgauuucuccagga

SEQ ID NO: 3723369 - RNA, 20 nt, Human
ucgcaacccgugccaagucc

SEQ ID NO: 3723370 - RNA, 16 nt, Human
ucgcaccauucugacu

SEQ ID NO: 3723371 - RNA, 15 nt, Human
ucgcaccccccuguu

SEQ ID NO: 3723372 - RNA, 17 nt, Human
ucgcaccccccuguucu

SEQ ID NO: 3723373 - RNA, 22 nt, Human
ucgcaccccccuguucuaaggg

SEQ ID NO: 3723374 - RNA, 22 nt, Human
ucgcaccggagugucuggaauu

SEQ ID NO: 3723375 - RNA, 19 nt, Human
ucgcagagaggccaggugc

SEQ ID NO: 3723376 - RNA, 21 nt, Human
ucgcagagaggccaggugcag

SEQ ID NO: 3723377 - RNA, 10 nt, Human
ucgcagccac

SEQ ID NO: 3723378 - RNA, 14 nt, Human
ucgcagccacccug

SEQ ID NO: 3723379 - RNA, 20 nt, Human
ucgcagccacccugaggagu

SEQ ID NO: 3723380 - RNA, 11 nt, Human
ucgcagccuga

SEQ ID NO: 3723381 - RNA, 17 nt, Human
ucgcaggauucuuccuc

SEQ ID NO: 3723382 - RNA, 23 nt, Human
ucgcaggauucuuccucccuccc

SEQ ID NO: 3723383 - RNA, 19 nt, Human
ucgcaggccucccugccag

SEQ ID NO: 3723384 - RNA, 20 nt, Human
ucgcaucaaaagacaauucu

SEQ ID NO: 3723385 - RNA, 22 nt, Human
ucgcaucaaaagacaauucuuu

SEQ ID NO: 3723386 - RNA, 20 nt, Human
ucgcauggucacacacugau

SEQ ID NO: 3723387 - RNA, 16 nt, Human
ucgccagcugaugacu

SEQ ID NO: 3723388 - RNA, 19 nt, Human
ucgccagcugaugacucaa

SEQ ID NO: 3723389 - RNA, 21 nt, Human
ucgcccaccgcaugcccccuc

SEQ ID NO: 3723390 - RNA, 12 nt, Human
ucgcccaggcug

SEQ ID NO: 3723391 - RNA, 19 nt, Human
ucgcccagucccagcagcc

SEQ ID NO: 3723392 - RNA, 21 nt, Human
ucgcccagucccagcagccag

SEQ ID NO: 3723393 - RNA, 14 nt, Human
ucgcccagucugga

SEQ ID NO: 3723394 - RNA, 16 nt, Human
ucgcccagugcccugg

SEQ ID NO: 3723395 - RNA, 19 nt, Human
ucgcccagugcccuggggc

SEQ ID NO: 3723396 - RNA, 16 nt, Human
ucgcccauccccuuga

SEQ ID NO: 3723397 - RNA, 22 nt, Human
ucgcccaugagagcgcagcccg

SEQ ID NO: 3723398 - RNA, 18 nt, Human
ucgccccagaucaccagc

SEQ ID NO: 3723399 - RNA, 20 nt, Human
ucgccccagcaggugcugac

SEQ ID NO: 3723400 - RNA, 13 nt, Human
ucgcccgcccacu

SEQ ID NO: 3723401 - RNA, 21 nt, Human
ucgcccgcccacuguccuggg

SEQ ID NO: 3723402 - RNA, 23 nt, Human
ucgcccgcccacuguccugggcg

SEQ ID NO: 3723403 - RNA, 19 nt, Human
ucgcccuuacuucuugccc

SEQ ID NO: 3723404 - RNA, 20 nt, Human
ucgcccuuacuucuugcccu

SEQ ID NO: 3723405 - RNA, 16 nt, Human
ucgccggaucugaggg

SEQ ID NO: 3723406 - RNA, 17 nt, Human
ucgccguugaagaggaa

SEQ ID NO: 3723407 - RNA, 12 nt, Human
ucgccucagccu

SEQ ID NO: 3723408 - RNA, 23 nt, Human
ucgccucggaucagcugagccuu

SEQ ID NO: 3723409 - RNA, 13 nt, Human
ucgccuggagccc

SEQ ID NO: 3723410 - RNA, 20 nt, Human
ucgccuguggagcucagccc

SEQ ID NO: 3723411 - RNA, 21 nt, Human
ucgccuguggagcucagcccc

SEQ ID NO: 3723412 - RNA, 20 nt, Human
ucgccuuagcauguuugcug

SEQ ID NO: 3723413 - RNA, 19 nt, Human
ucgccuuucagcaggcagc

SEQ ID NO: 3723414 - RNA, 22 nt, Human
ucgcgaugggaaccgauggugg

SEQ ID NO: 3723415 - RNA, 14 nt, Human
ucgcgcucagcaug

SEQ ID NO: 3723416 - RNA, 15 nt, Human
ucgcgcucaguaaac

SEQ ID NO: 3723417 - RNA, 15 nt, Human
ucgcgcugccugugu

SEQ ID NO: 3723418 - RNA, 18 nt, Human
ucgcggcggagcuggccc

SEQ ID NO: 3723419 - RNA, 19 nt, Human
ucgcggcggagcuggcccc

SEQ ID NO: 3723420 - RNA, 20 nt, Human
ucgcggcggagcuggccccg

SEQ ID NO: 3723421 - RNA, 18 nt, Human
ucgcgugcccucgcugcu

SEQ ID NO: 3723422 - RNA, 13 nt, Human
ucgcuaugugcac

SEQ ID NO: 3723423 - RNA, 18 nt, Human
ucgcuauugucaccaggg

SEQ ID NO: 3723424 - RNA, 14 nt, Human
ucgcuccaacucca

SEQ ID NO: 3723425 - RNA, 18 nt, Human
ucgcuccaccuugcagcu

SEQ ID NO: 3723426 - RNA, 21 nt, Human
ucgcucccacauucugaugag

SEQ ID NO: 3723427 - RNA, 15 nt, Human
ucgcuccccacucug

SEQ ID NO: 3723428 - RNA, 13 nt, Human
ucgcucccuccca

SEQ ID NO: 3723429 - RNA, 19 nt, Human
ucgcuccucaaccccuccc

SEQ ID NO: 3723430 - RNA, 12 nt, Human
ucgcuccugugu

SEQ ID NO: 3723431 - RNA, 13 nt, Human
ucgcuccuguguc

SEQ ID NO: 3723432 - RNA, 20 nt, Human
ucgcucugcuggccuggccg

SEQ ID NO: 3723433 - RNA, 21 nt, Human
ucgcucugcuggccuggccgg

SEQ ID NO: 3723434 - RNA, 22 nt, Human
ucgcucugucacccaggcugga

SEQ ID NO: 3723435 - RNA, 16 nt, Human
ucgcugacuucaugga

SEQ ID NO: 3723436 - RNA, 17 nt, Human
ucgcugaugcugggcug

SEQ ID NO: 3723437 - RNA, 16 nt, Human
ucgcugcuucguggga

SEQ ID NO: 3723438 - RNA, 11 nt, Human
ucgcuggcccc

SEQ ID NO: 3723439 - RNA, 14 nt, Human
ucgcuggcccccac

SEQ ID NO: 3723440 - RNA, 17 nt, Human
ucgcuggcccccacugg

SEQ ID NO: 3723441 - RNA, 14 nt, Human
ucgcuguugcugaa

SEQ ID NO: 3723442 - RNA, 15 nt, Human
ucgcuucccccauag

SEQ ID NO: 3723443 - RNA, 19 nt, Human
ucgcuucccccauagccac

SEQ ID NO: 3723444 - RNA, 22 nt, Human
ucgcuucuuagaacaguggaaa

SEQ ID NO: 3723445 - RNA, 17 nt, Human
ucgcuucuugccucugu

SEQ ID NO: 3723446 - RNA, 19 nt, Human
ucgcuucuugccucugugc

SEQ ID NO: 3723447 - RNA, 22 nt, Human
ucgcuuggcuccaugcuccuca

SEQ ID NO: 3723448 - RNA, 17 nt, Human
ucgcuuguaaauaccag

SEQ ID NO: 3723449 - RNA, 13 nt, Human
ucggaaaaauaau

SEQ ID NO: 3723450 - RNA, 18 nt, Human
ucggaaaacaugcuacac

SEQ ID NO: 3723451 - RNA, 21 nt, Human
ucggaaaccuugguguaguug

SEQ ID NO: 3723452 - RNA, 15 nt, Human
ucggaaaucuuaaac

SEQ ID NO: 3723453 - RNA, 17 nt, Human
ucggaaccgcucaccua

SEQ ID NO: 3723454 - RNA, 19 nt, Human
ucggacaagacccccagca

SEQ ID NO: 3723455 - RNA, 10 nt, Human
ucggaccagc

SEQ ID NO: 3723456 - RNA, 17 nt, Human
ucggaccuuucagcugu

SEQ ID NO: 3723457 - RNA, 19 nt, Human
ucggacuaagccuaccugc

SEQ ID NO: 3723458 - RNA, 12 nt, Human
ucggagaagagc

SEQ ID NO: 3723459 - RNA, 16 nt, Human
ucggagaagagcgcag

SEQ ID NO: 3723460 - RNA, 16 nt, Human
ucggagaagagcuguu

SEQ ID NO: 3723461 - RNA, 23 nt, Human
ucggagacagugaucuccauaug

SEQ ID NO: 3723462 - RNA, 16 nt, Human
ucggagcaucccggag

SEQ ID NO: 3723463 - RNA, 22 nt, Human
ucggagccucauccgaggcagg

SEQ ID NO: 3723464 - RNA, 13 nt, Human
ucggaggccccac

SEQ ID NO: 3723465 - RNA, 17 nt, Human
ucggaggccccacugau

SEQ ID NO: 3723466 - RNA, 18 nt, Human
ucggaggccccacugaug

SEQ ID NO: 3723467 - RNA, 14 nt, Human
ucggaggcugcccc

SEQ ID NO: 3723468 - RNA, 22 nt, Human
ucggagggaauugaggucugcu

SEQ ID NO: 3723469 - RNA, 19 nt, Human
ucggauaugauuguuucuc

SEQ ID NO: 3723470 - RNA, 18 nt, Human
ucggauccagggaggcug

SEQ ID NO: 3723471 - RNA, 14 nt, Human
ucggauuuuuucca

SEQ ID NO: 3723472 - RNA, 13 nt, Human
ucggcacagccug

SEQ ID NO: 3723473 - RNA, 14 nt, Human
ucggcacagccugg

SEQ ID NO: 3723474 - RNA, 15 nt, Human
ucggcacuguacaaa

SEQ ID NO: 3723475 - RNA, 16 nt, Human
ucggcagauacugucu

SEQ ID NO: 3723476 - RNA, 22 nt, Human
ucggcauugguucccuuugcuc

SEQ ID NO: 3723477 - RNA, 15 nt, Human
ucggccuagggcccc

SEQ ID NO: 3723478 - RNA, 13 nt, Human
ucggccuccaucc

SEQ ID NO: 3723479 - RNA, 15 nt, Human
ucggccugcccccac

SEQ ID NO: 3723480 - RNA, 19 nt, Human
ucggccugcccccacccca

SEQ ID NO: 3723481 - RNA, 19 nt, Human
ucggcuccccauguguccu

SEQ ID NO: 3723482 - RNA, 12 nt, Human
ucggcuccugcu

SEQ ID NO: 3723483 - RNA, 17 nt, Human
ucggcuggcuccccugc

SEQ ID NO: 3723484 - RNA, 18 nt, Human
ucggcuggcuccccugca

SEQ ID NO: 3723485 - RNA, 20 nt, Human
ucggcuggcuccccugcagc

SEQ ID NO: 3723486 - RNA, 14 nt, Human
ucgggaacaguguu

SEQ ID NO: 3723487 - RNA, 24 nt, Human
ucgggaagagaggaguucaaugau

SEQ ID NO: 3723488 - RNA, 16 nt, Human
ucgggacaccugcccu

SEQ ID NO: 3723489 - RNA, 19 nt, Human
ucgggacaccugcccugcc

SEQ ID NO: 3723490 - RNA, 19 nt, Human
ucgggaggcugaggcacaa

SEQ ID NO: 3723491 - RNA, 21 nt, Human
ucgggaggucgaggcaggagg

SEQ ID NO: 3723492 - RNA, 11 nt, Human
ucgggcaugac

SEQ ID NO: 3723493 - RNA, 18 nt, Human
ucgggcccuucuugcugc

SEQ ID NO: 3723494 - RNA, 20 nt, Human
ucgggcccuucuugcugccc

SEQ ID NO: 3723495 - RNA, 23 nt, Human
ucgggcccuucuugcugcccugc

SEQ ID NO: 3723496 - RNA, 13 nt, Human
ucgggcugugccc

SEQ ID NO: 3723497 - RNA, 13 nt, Human
ucggggagccuua

SEQ ID NO: 3723498 - RNA, 17 nt, Human
ucggggcaugcuggggc

SEQ ID NO: 3723499 - RNA, 14 nt, Human
ucggggccagaggc

SEQ ID NO: 3723500 - RNA, 13 nt, Human
ucgggggcuggcc

SEQ ID NO: 3723501 - RNA, 19 nt, Human
ggcagucaccugcccagau

SEQ ID NO: 3723502 - RNA, 23 nt, Human
ggcagucauucagcaccagagca

SEQ ID NO: 3723503 - RNA, 11 nt, Human
ggcagucccuu

SEQ ID NO: 3723504 - RNA, 19 nt, Human
ggcagucugaauuuuuaaa

SEQ ID NO: 3723505 - RNA, 20 nt, Human
ggcagucugagagaggccau

SEQ ID NO: 3723506 - RNA, 13 nt, Human
ggcagucuggagg

SEQ ID NO: 3723507 - RNA, 21 nt, Human
ggcagucuggaggggcauggc

SEQ ID NO: 3723508 - RNA, 16 nt, Human
ggcagugcagcaacca

SEQ ID NO: 3723509 - RNA, 21 nt, Human
ggcagugcagcaaccagagca

SEQ ID NO: 3723510 - RNA, 14 nt, Human
ggcagugccagggc

SEQ ID NO: 3723511 - RNA, 14 nt, Human
ggcagugggagcug

SEQ ID NO: 3723512 - RNA, 17 nt, Human
ggcagugggagcugccu

SEQ ID NO: 3723513 - RNA, 19 nt, Human
ggcagugggagcugccugu

SEQ ID NO: 3723514 - RNA, 23 nt, Human
ggcagugggucccacuuccccuc

SEQ ID NO: 3723515 - RNA, 16 nt, Human
ggcaguucgcagccac

SEQ ID NO: 3723516 - RNA, 17 nt, Human
ggcaguucgcagccacc

SEQ ID NO: 3723517 - RNA, 16 nt, Human
ggcaguugcccagccu

SEQ ID NO: 3723518 - RNA, 18 nt, Human
ggcaguuuaaagcacaau

SEQ ID NO: 3723519 - RNA, 16 nt, Human
ggcaguuuuucuguau

SEQ ID NO: 3723520 - RNA, 16 nt, Human
ggcauaaaacagcuuu

SEQ ID NO: 3723521 - RNA, 13 nt, Human
ggcauaaacuguu

SEQ ID NO: 3723522 - RNA, 12 nt, Human
ggcauaaaguaa

SEQ ID NO: 3723523 - RNA, 16 nt, Human
ggcauaacauaaaucu

SEQ ID NO: 3723524 - RNA, 19 nt, Human
ggcauagaugcaggugagc

SEQ ID NO: 3723525 - RNA, 19 nt, Human
ggcauagcccagacacaga

SEQ ID NO: 3723526 - RNA, 13 nt, Human
ggcauagcuacgu

SEQ ID NO: 3723527 - RNA, 16 nt, Human
ggcaucacagggcaga

SEQ ID NO: 3723528 - RNA, 22 nt, Human
ggcaucacagggcagagccggg

SEQ ID NO: 3723529 - RNA, 23 nt, Human
ggcaucacagggcagagccggga

SEQ ID NO: 3723530 - RNA, 16 nt, Human
ggcaucagcuggcguc

SEQ ID NO: 3723531 - RNA, 18 nt, Human
ggcauccagagucccugc

SEQ ID NO: 3723532 - RNA, 13 nt, Human
ggcauccaugggg

SEQ ID NO: 3723533 - RNA, 22 nt, Human
ggcauccauggggucucucaca

SEQ ID NO: 3723534 - RNA, 13 nt, Human
ggcaucccugggc

SEQ ID NO: 3723535 - RNA, 22 nt, Human
ggcaucccuuuuucauaaauua

SEQ ID NO: 3723536 - RNA, 16 nt, Human
ggcauccuccagcccc

SEQ ID NO: 3723537 - RNA, 17 nt, Human
ggcauccucuuuuucca

SEQ ID NO: 3723538 - RNA, 20 nt, Human
ggcauccuuccucacaccag

SEQ ID NO: 3723539 - RNA, 20 nt, Human
ggcaucgcaauguaagacuc

SEQ ID NO: 3723540 - RNA, 23 nt, Human
ggcaucggggagccgggagccug

SEQ ID NO: 3723541 - RNA, 13 nt, Human
ggcaucuccagga

SEQ ID NO: 3723542 - RNA, 14 nt, Human
ggcaucuccaggaa

SEQ ID NO: 3723543 - RNA, 15 nt, Human
ggcaucuccaggaag

SEQ ID NO: 3723544 - RNA, 14 nt, Human
ggcaucuccugugc

SEQ ID NO: 3723545 - RNA, 16 nt, Human
ggcaucugacacaaaa

SEQ ID NO: 3723546 - RNA, 20 nt, Human
ggcaucugacacaaaaaaag

SEQ ID NO: 3723547 - RNA, 15 nt, Human
ggcaucugcacccuc

SEQ ID NO: 3723548 - RNA, 16 nt, Human
ggcaucugccccuccc

SEQ ID NO: 3723549 - RNA, 18 nt, Human
ggcaucuggccuggccag

SEQ ID NO: 3723550 - RNA, 21 nt, Human
ggcaucuggccuggccagugc

SEQ ID NO: 3723551 - RNA, 17 nt, Human
ggcaucuugcuggcuac

SEQ ID NO: 3723552 - RNA, 16 nt, Human
ggcaucuuugccuugg

SEQ ID NO: 3723553 - RNA, 21 nt, Human
ggcaucuuugccuugggcugc

SEQ ID NO: 3723554 - RNA, 16 nt, Human
ggcaucuuuggggagg

SEQ ID NO: 3723555 - RNA, 11 nt, Human
ggcaucuuuug

SEQ ID NO: 3723556 - RNA, 14 nt, Human
ggcaucuuuuguau

SEQ ID NO: 3723557 - RNA, 16 nt, Human
ggcaucuuuuguauua

SEQ ID NO: 3723558 - RNA, 14 nt, Human
ggcaugaacaugua

SEQ ID NO: 3723559 - RNA, 20 nt, Human
ggcaugaagagcaaaaauau

SEQ ID NO: 3723560 - RNA, 22 nt, Human
ggcaugaaguuuccuuggcugg

SEQ ID NO: 3723561 - RNA, 22 nt, Human
ggcaugacacgaauauugcuga

SEQ ID NO: 3723562 - RNA, 20 nt, Human
ggcaugagggguuccucccc

SEQ ID NO: 3723563 - RNA, 15 nt, Human
ggcaugauccaagca

SEQ ID NO: 3723564 - RNA, 15 nt, Human
ggcaugcacagcugu

SEQ ID NO: 3723565 - RNA, 19 nt, Human
ggcaugccccggccaccuc

SEQ ID NO: 3723566 - RNA, 21 nt, Human
ggcaugccccggccaccucug

SEQ ID NO: 3723567 - RNA, 15 nt, Human
ggcaugccuggacaa

SEQ ID NO: 3723568 - RNA, 14 nt, Human
ggcaugccuugugc

SEQ ID NO: 3723569 - RNA, 16 nt, Human
ggcaugcggucgggca

SEQ ID NO: 3723570 - RNA, 17 nt, Human
ggcaugcuaaagccuuc

SEQ ID NO: 3723571 - RNA, 22 nt, Human
ggcaugcuggcucccagggcca

SEQ ID NO: 3723572 - RNA, 14 nt, Human
ggcauggacuucug

SEQ ID NO: 3723573 - RNA, 13 nt, Human
ggcauggcagccc

SEQ ID NO: 3723574 - RNA, 18 nt, Human
ggcauggccagguggcca

SEQ ID NO: 3723575 - RNA, 12 nt, Human
ggcauggcccug

SEQ ID NO: 3723576 - RNA, 17 nt, Human
ggcauggcccugggguc

SEQ ID NO: 3723577 - RNA, 16 nt, Human
ggcauggcuccagucu

SEQ ID NO: 3723578 - RNA, 19 nt, Human
ggcaugggggccucagggc

SEQ ID NO: 3723579 - RNA, 19 nt, Human
ggcauggggugggccucug

SEQ ID NO: 3723580 - RNA, 21 nt, Human
ggcauggggugggccucuggu

SEQ ID NO: 3723581 - RNA, 16 nt, Human
ggcaugguaccagccc

SEQ ID NO: 3723582 - RNA, 17 nt, Human
ggcaugguaccagcccu

SEQ ID NO: 3723583 - RNA, 18 nt, Human
ggcaugguaccagcccug

SEQ ID NO: 3723584 - RNA, 19 nt, Human
ggcaugguggcgcaagccu

SEQ ID NO: 3723585 - RNA, 22 nt, Human
ggcaugguguucuccugcugcu

SEQ ID NO: 3723586 - RNA, 22 nt, Human
ggcaugguuuugugccaucugu

SEQ ID NO: 3723587 - RNA, 21 nt, Human
ggcauguaaauguaaacucag

SEQ ID NO: 3723588 - RNA, 15 nt, Human
ggcauguauuggccu

SEQ ID NO: 3723589 - RNA, 16 nt, Human
ggcauguauuggccug

SEQ ID NO: 3723590 - RNA, 13 nt, Human
ggcaugugaaggg

SEQ ID NO: 3723591 - RNA, 23 nt, Human
ggcaugugaugagaggaaaucac

SEQ ID NO: 3723592 - RNA, 16 nt, Human
ggcauguggccugugg

SEQ ID NO: 3723593 - RNA, 17 nt, Human
ggcauguguauguuccc

SEQ ID NO: 3723594 - RNA, 20 nt, Human
ggcauguucucugaggacac

SEQ ID NO: 3723595 - RNA, 16 nt, Human
ggcauguuuccagcag

SEQ ID NO: 3723596 - RNA, 17 nt, Human
ggcauuaauguuucuau

SEQ ID NO: 3723597 - RNA, 19 nt, Human
ggcauuagaauuauuuaaa

SEQ ID NO: 3723598 - RNA, 20 nt, Human
ggcauuauguccacugugua

SEQ ID NO: 3723599 - RNA, 16 nt, Human
ggcauuccccaggagg

SEQ ID NO: 3723600 - RNA, 19 nt, Human
ggcauuccccaggaggcca

SEQ ID NO: 3723601 - RNA, 12 nt, Human
ggcauucucucu

SEQ ID NO: 3723602 - RNA, 16 nt, Human
ggcauucuuguacagu

SEQ ID NO: 3723603 - RNA, 19 nt, Human
ggcauugccucggcuggcu

SEQ ID NO: 3723604 - RNA, 19 nt, Human
ggcauuggcagcaggugcu

SEQ ID NO: 3723605 - RNA, 13 nt, Human
ggcauuucacaaa

SEQ ID NO: 3723606 - RNA, 12 nt, Human
ggcauuuccugg

SEQ ID NO: 3723607 - RNA, 15 nt, Human
ggcauuugcaauaaa

SEQ ID NO: 3723608 - RNA, 21 nt, Human
ggcauuugcaggguccucuuc

SEQ ID NO: 3723609 - RNA, 23 nt, Human
ggcauuuguuucuuucucugagg

SEQ ID NO: 3723610 - RNA, 17 nt, Human
ggccaaaagcaguaaau

SEQ ID NO: 3723611 - RNA, 14 nt, Human
ggccaaacaagugu

SEQ ID NO: 3723612 - RNA, 15 nt, Human
ggccaaaccucuguu

SEQ ID NO: 3723613 - RNA, 12 nt, Human
ggccaaacugcu

SEQ ID NO: 3723614 - RNA, 17 nt, Human
ggccaaagaaccaaaga

SEQ ID NO: 3723615 - RNA, 15 nt, Human
ggccaaagacaaaua

SEQ ID NO: 3723616 - RNA, 16 nt, Human
ggccaaagacaaauag

SEQ ID NO: 3723617 - RNA, 14 nt, Human
ggccaaaggaagca

SEQ ID NO: 3723618 - RNA, 22 nt, Human
ggccaaaggagggucaggaagg

SEQ ID NO: 3723619 - RNA, 21 nt, Human
ggccaaauauauucucuuugg

SEQ ID NO: 3723620 - RNA, 13 nt, Human
ggccaaauucccu

SEQ ID NO: 3723621 - RNA, 15 nt, Human
ggccaacaccaggga

SEQ ID NO: 3723622 - RNA, 13 nt, Human
ggccaacauggua

SEQ ID NO: 3723623 - RNA, 20 nt, Human
ggccaacccuucuccucuug

SEQ ID NO: 3723624 - RNA, 15 nt, Human
ggccaagaagcagug

SEQ ID NO: 3723625 - RNA, 22 nt, Human
ggccaagaauauugcaaaauac

SEQ ID NO: 3723626 - RNA, 21 nt, Human
ggccaagaauguacguccagc

SEQ ID NO: 3723627 - RNA, 19 nt, Human
ggccaagagaaacuuccua

SEQ ID NO: 3723628 - RNA, 22 nt, Human
ggccaagagaugcagugccagg

SEQ ID NO: 3723629 - RNA, 14 nt, Human
ggccaagaguggcc

SEQ ID NO: 3723630 - RNA, 17 nt, Human
ggccaagaguggcccca

SEQ ID NO: 3723631 - RNA, 19 nt, Human
ggccaagaguggccccacc

SEQ ID NO: 3723632 - RNA, 22 nt, Human
ggccaagaguggccccaccugg

SEQ ID NO: 3723633 - RNA, 17 nt, Human
ggccaagauaggaccuu

SEQ ID NO: 3723634 - RNA, 22 nt, Human
ggccaagcugaggugcccagga

SEQ ID NO: 3723635 - RNA, 15 nt, Human
ggccaaggaccugag

SEQ ID NO: 3723636 - RNA, 16 nt, Human
ggccaaggaccugaga

SEQ ID NO: 3723637 - RNA, 19 nt, Human
ggccaaggaccugagaccu

SEQ ID NO: 3723638 - RNA, 11 nt, Human
ggccaaggacu

SEQ ID NO: 3723639 - RNA, 13 nt, Human
ggccaaggacugc

SEQ ID NO: 3723640 - RNA, 17 nt, Human
ggccaaggacugccgac

SEQ ID NO: 3723641 - RNA, 16 nt, Human
ggccaaggagcugcua

SEQ ID NO: 3723642 - RNA, 21 nt, Human
ggccaaggaugccccgucccc

SEQ ID NO: 3723643 - RNA, 21 nt, Human
ggccaaggggagucaccuucc

SEQ ID NO: 3723644 - RNA, 14 nt, Human
ggccaagucccacc

SEQ ID NO: 3723645 - RNA, 16 nt, Human
ggccaagugcaggcug

SEQ ID NO: 3723646 - RNA, 16 nt, Human
ggccaaucagaagcua

SEQ ID NO: 3723647 - RNA, 17 nt, Human
ggccaauggaaaccuca

SEQ ID NO: 3723648 - RNA, 22 nt, Human
ggccaauggaaaccucacgcug

SEQ ID NO: 3723649 - RNA, 16 nt, Human
ggccacaagacccuug

SEQ ID NO: 3723650 - RNA, 17 nt, Human
ggccacaagacccuugu

SEQ ID NO: 3723651 - RNA, 16 nt, Human
ucggggggacagcucc

SEQ ID NO: 3723652 - RNA, 23 nt, Human
ucgggggggacccuccaaggcca

SEQ ID NO: 3723653 - RNA, 18 nt, Human
ucggguuucucuguggcu

SEQ ID NO: 3723654 - RNA, 21 nt, Human
ucgguacccggggcccagggc

SEQ ID NO: 3723655 - RNA, 22 nt, Human
ucgguacccggggcccagggca

SEQ ID NO: 3723656 - RNA, 13 nt, Human
ucgguacucccau

SEQ ID NO: 3723657 - RNA, 14 nt, Human
ucgguccugucucc

SEQ ID NO: 3723658 - RNA, 18 nt, Human
ucgguccugucuccccuc

SEQ ID NO: 3723659 - RNA, 12 nt, Human
ucggugaagaaa

SEQ ID NO: 3723660 - RNA, 22 nt, Human
ucgguggagacuaucagcccaa

SEQ ID NO: 3723661 - RNA, 22 nt, Human
ucgguguccauuuauagaauaa

SEQ ID NO: 3723662 - RNA, 13 nt, Human
ucguaaaauuaag

SEQ ID NO: 3723663 - RNA, 17 nt, Human
ucguaaacaucucagag

SEQ ID NO: 3723664 - RNA, 13 nt, Human
ucguaaagauuug

SEQ ID NO: 3723665 - RNA, 15 nt, Human
ucguaaagauuuggg

SEQ ID NO: 3723666 - RNA, 15 nt, Human
ucguacagaaagcug

SEQ ID NO: 3723667 - RNA, 16 nt, Human
ucguacagaaagcugc

SEQ ID NO: 3723668 - RNA, 14 nt, Human
ucguacauaauacu

SEQ ID NO: 3723669 - RNA, 13 nt, Human
ucguaugaaaaug

SEQ ID NO: 3723670 - RNA, 15 nt, Human
ucguaugaaaaugag

SEQ ID NO: 3723671 - RNA, 18 nt, Human
ucguaugauacuucgaca

SEQ ID NO: 3723672 - RNA, 22 nt, Human
ucguaugauacuucgacacugu

SEQ ID NO: 3723673 - RNA, 15 nt, Human
ucguauucaccuuca

SEQ ID NO: 3723674 - RNA, 23 nt, Human
ucgucaucauuuuuccuucccuu

SEQ ID NO: 3723675 - RNA, 15 nt, Human
ucguccacagcuucc

SEQ ID NO: 3723676 - RNA, 16 nt, Human
ucguccacagcuuccu

SEQ ID NO: 3723677 - RNA, 17 nt, Human
ucguccacagcuuccug

SEQ ID NO: 3723678 - RNA, 14 nt, Human
ucguccccaaguga

SEQ ID NO: 3723679 - RNA, 14 nt, Human
ucguccucccccug

SEQ ID NO: 3723680 - RNA, 16 nt, Human
ucguccucccccugcc

SEQ ID NO: 3723681 - RNA, 23 nt, Human
ucguccucccccugccagugccu

SEQ ID NO: 3723682 - RNA, 19 nt, Human
ucguccucguuuguguucu

SEQ ID NO: 3723683 - RNA, 19 nt, Human
ucguccuuacuccuguggg

SEQ ID NO: 3723684 - RNA, 18 nt, Human
ucgucgagcuccccccag

SEQ ID NO: 3723685 - RNA, 16 nt, Human
ucgucgcacagucucu

SEQ ID NO: 3723686 - RNA, 21 nt, Human
ucgucucggccuucacaaucu

SEQ ID NO: 3723687 - RNA, 23 nt, Human
ucgucucuuuuacccuggccccu

SEQ ID NO: 3723688 - RNA, 14 nt, Human
ucgucuucacucuu

SEQ ID NO: 3723689 - RNA, 15 nt, Human
ucgucuuucccaaag

SEQ ID NO: 3723690 - RNA, 15 nt, Human
ucgucuuucccaugg

SEQ ID NO: 3723691 - RNA, 20 nt, Human
ucgucuuucccauggggagg

SEQ ID NO: 3723692 - RNA, 16 nt, Human
ucgugagcucuuguga

SEQ ID NO: 3723693 - RNA, 22 nt, Human
ucgugagcucuugugaggaaag

SEQ ID NO: 3723694 - RNA, 14 nt, Human
ucgugagucauuua

SEQ ID NO: 3723695 - RNA, 21 nt, Human
ucgugaugcuaugauguuagu

SEQ ID NO: 3723696 - RNA, 13 nt, Human
ucgugauggggca

SEQ ID NO: 3723697 - RNA, 20 nt, Human
ucgugauuuucaagcagcau

SEQ ID NO: 3723698 - RNA, 19 nt, Human
ucgugcagcauaugaggau

SEQ ID NO: 3723699 - RNA, 20 nt, Human
ucgugcauuggaagacccca

SEQ ID NO: 3723700 - RNA, 20 nt, Human
ucgugccagucgcgcugccu

SEQ ID NO: 3723701 - RNA, 21 nt, Human
ucgugccagucgcgcugccug

SEQ ID NO: 3723702 - RNA, 23 nt, Human
ucgugccuccuuccaccucccuc

SEQ ID NO: 3723703 - RNA, 12 nt, Human
ucgugccugugu

SEQ ID NO: 3723704 - RNA, 21 nt, Human
ucgugccuguguccaugcgcu

SEQ ID NO: 3723705 - RNA, 22 nt, Human
ucguggacacacacagacuauu

SEQ ID NO: 3723706 - RNA, 19 nt, Human
ucguggacaccugcccugc

SEQ ID NO: 3723707 - RNA, 22 nt, Human
ucguggacugagugggaagccc

SEQ ID NO: 3723708 - RNA, 19 nt, Human
ucguggccuuccccagccu

SEQ ID NO: 3723709 - RNA, 12 nt, Human
ucguggcuguca

SEQ ID NO: 3723710 - RNA, 12 nt, Human
ucguggggaggu

SEQ ID NO: 3723711 - RNA, 15 nt, Human
ucguggggugugcug

SEQ ID NO: 3723712 - RNA, 15 nt, Human
ucguguaaauuaugu

SEQ ID NO: 3723713 - RNA, 13 nt, Human
ucguguauccugg

SEQ ID NO: 3723714 - RNA, 16 nt, Human
ucguguccccuauccu

SEQ ID NO: 3723715 - RNA, 21 nt, Human
ucgugucuggcacagccuggc

SEQ ID NO: 3723716 - RNA, 19 nt, Human
ucgugugcaacagacaagu

SEQ ID NO: 3723717 - RNA, 16 nt, Human
ucguuaaaaaguuguu

SEQ ID NO: 3723718 - RNA, 15 nt, Human
ucguuagaccgcucu

SEQ ID NO: 3723719 - RNA, 20 nt, Human
ucguuagggaagagaaacag

SEQ ID NO: 3723720 - RNA, 19 nt, Human
ucguuaguaucuaacaugu

SEQ ID NO: 3723721 - RNA, 15 nt, Human
ucguuauguguguau

SEQ ID NO: 3723722 - RNA, 15 nt, Human
ucguucaaagcauga

SEQ ID NO: 3723723 - RNA, 12 nt, Human
ucguuccuuucu

SEQ ID NO: 3723724 - RNA, 17 nt, Human
ucguucuuguucuguuu

SEQ ID NO: 3723725 - RNA, 14 nt, Human
ucguucuuucuagc

SEQ ID NO: 3723726 - RNA, 14 nt, Human
ucguucuuuuuaag

SEQ ID NO: 3723727 - RNA, 17 nt, Human
ucguugacuuuagggac

SEQ ID NO: 3723728 - RNA, 12 nt, Human
ucguugugaggg

SEQ ID NO: 3723729 - RNA, 19 nt, Human
ucguuuauuuucaagaaua

SEQ ID NO: 3723730 - RNA, 13 nt, Human
ucguuuuccaaac

SEQ ID NO: 3723731 - RNA, 11 nt, Human
ucguuuuugua

SEQ ID NO: 3723732 - RNA, 18 nt, Human
ucuaaaaaacagaggcca

SEQ ID NO: 3723733 - RNA, 14 nt, Human
ucuaaaaacaccaa

SEQ ID NO: 3723734 - RNA, 14 nt, Human
ucuaaaaagucaga

SEQ ID NO: 3723735 - RNA, 15 nt, Human
ucuaaaaauauacau

SEQ ID NO: 3723736 - RNA, 11 nt, Human
ucuaaaacucc

SEQ ID NO: 3723737 - RNA, 15 nt, Human
ucuaaaacuguacuu

SEQ ID NO: 3723738 - RNA, 22 nt, Human
ucuaaaacuguacuuugauuca

SEQ ID NO: 3723739 - RNA, 18 nt, Human
ucuaaaagaaaaaggcau

SEQ ID NO: 3723740 - RNA, 22 nt, Human
ucuaaaagaauauucagagaau

SEQ ID NO: 3723741 - RNA, 13 nt, Human
ucuaaaagacuuc

SEQ ID NO: 3723742 - RNA, 17 nt, Human
ucuaaaagguaaugugu

SEQ ID NO: 3723743 - RNA, 18 nt, Human
ucuaaaagguaaugugug

SEQ ID NO: 3723744 - RNA, 16 nt, Human
ucuaaaagguucaggg

SEQ ID NO: 3723745 - RNA, 23 nt, Human
ucuaaaagguucagggaaccguu

SEQ ID NO: 3723746 - RNA, 22 nt, Human
ucuaaaauauuuaugaagaaaa

SEQ ID NO: 3723747 - RNA, 15 nt, Human
ucuaaaauccugcuu

SEQ ID NO: 3723748 - RNA, 15 nt, Human
ucuaaaaucuuauag

SEQ ID NO: 3723749 - RNA, 18 nt, Human
ucuaaaaucuuauaguuc

SEQ ID NO: 3723750 - RNA, 22 nt, Human
ucuaaaaugugauguucuaagg

SEQ ID NO: 3723751 - RNA, 22 nt, Human
ucuaaaauugaguucuuccugu

SEQ ID NO: 3723752 - RNA, 23 nt, Human
ucuaaaauugaguucuuccugua

SEQ ID NO: 3723753 - RNA, 20 nt, Human
ucuaaacaaugcugauuugg

SEQ ID NO: 3723754 - RNA, 14 nt, Human
ucuaaacauuaauc

SEQ ID NO: 3723755 - RNA, 14 nt, Human
ucuaaacugcauua

SEQ ID NO: 3723756 - RNA, 14 nt, Human
ucuaaacugccccc

SEQ ID NO: 3723757 - RNA, 17 nt, Human
ucuaaacuuccccaucu

SEQ ID NO: 3723758 - RNA, 21 nt, Human
ucuaaacuuuauuccaaguca

SEQ ID NO: 3723759 - RNA, 20 nt, Human
ucuaaagaccaaacuucacu

SEQ ID NO: 3723760 - RNA, 15 nt, Human
ucuaaagagcacuua

SEQ ID NO: 3723761 - RNA, 21 nt, Human
ucuaaagaguuuauuuuaaga

SEQ ID NO: 3723762 - RNA, 19 nt, Human
ucuaaagauggaguuucua

SEQ ID NO: 3723763 - RNA, 20 nt, Human
ucuaaagauggaguuucuaa

SEQ ID NO: 3723764 - RNA, 22 nt, Human
ucuaaagauggaguuucuaagg

SEQ ID NO: 3723765 - RNA, 23 nt, Human
ucuaaagauggaguuucuaaggu

SEQ ID NO: 3723766 - RNA, 20 nt, Human
ucuaaagauucuauaguucu

SEQ ID NO: 3723767 - RNA, 14 nt, Human
ucuaaagcucugac

SEQ ID NO: 3723768 - RNA, 17 nt, Human
ucuaaagcugccagccg

SEQ ID NO: 3723769 - RNA, 19 nt, Human
ucuaaagcugguuuaaugu

SEQ ID NO: 3723770 - RNA, 13 nt, Human
ucuaaaggcuacc

SEQ ID NO: 3723771 - RNA, 16 nt, Human
ucuaaaggcuaccuuu

SEQ ID NO: 3723772 - RNA, 14 nt, Human
ucuaaaguaaaaag

SEQ ID NO: 3723773 - RNA, 19 nt, Human
ucuaaaguguguuguugcu

SEQ ID NO: 3723774 - RNA, 14 nt, Human
ucuaaaguuauauu

SEQ ID NO: 3723775 - RNA, 11 nt, Human
ucuaaaguucu

SEQ ID NO: 3723776 - RNA, 14 nt, Human
ucuaaaguucuaag

SEQ ID NO: 3723777 - RNA, 17 nt, Human
ucuaaaguucuaagauu

SEQ ID NO: 3723778 - RNA, 18 nt, Human
ucuaaaguucuaagauuc

SEQ ID NO: 3723779 - RNA, 16 nt, Human
ucuaaaguuuacagua

SEQ ID NO: 3723780 - RNA, 22 nt, Human
ucuaaaguuuacaguaaauaaa

SEQ ID NO: 3723781 - RNA, 16 nt, Human
ucuaaauaaaagaagu

SEQ ID NO: 3723782 - RNA, 15 nt, Human
ucuaaauaaaaugcu

SEQ ID NO: 3723783 - RNA, 16 nt, Human
ucuaaauauggacugc

SEQ ID NO: 3723784 - RNA, 19 nt, Human
ucuaaaucuauuuauuaau

SEQ ID NO: 3723785 - RNA, 13 nt, Human
ucuaaaugaagug

SEQ ID NO: 3723786 - RNA, 23 nt, Human
ucuaaaugcauauccugagccau

SEQ ID NO: 3723787 - RNA, 21 nt, Human
ucuaaauguaguucugcucca

SEQ ID NO: 3723788 - RNA, 18 nt, Human
ucuaaauuaaagccuuua

SEQ ID NO: 3723789 - RNA, 19 nt, Human
ucuaacaauguauuuucuu

SEQ ID NO: 3723790 - RNA, 20 nt, Human
ucuaacacuagucugugugc

SEQ ID NO: 3723791 - RNA, 23 nt, Human
ucuaacagcccuccucugcacuc

SEQ ID NO: 3723792 - RNA, 14 nt, Human
ucuaaccaaaugca

SEQ ID NO: 3723793 - RNA, 16 nt, Human
ucuaaccaaaugcauc

SEQ ID NO: 3723794 - RNA, 17 nt, Human
ucuaaccaagaggcugg

SEQ ID NO: 3723795 - RNA, 16 nt, Human
ucuaaccacacagccu

SEQ ID NO: 3723796 - RNA, 18 nt, Human
ucuaaccacacagccuac

SEQ ID NO: 3723797 - RNA, 22 nt, Human
ucuaaccacagcuccuuuucca

SEQ ID NO: 3723798 - RNA, 17 nt, Human
ucuaaccacaucaauau

SEQ ID NO: 3723799 - RNA, 19 nt, Human
ucuaaccagagcaagcuuu

SEQ ID NO: 3723800 - RNA, 21 nt, Human
ucuaaccagagcaagcuuuuu

SEQ ID NO: 3723801 - RNA, 14 nt, Human
ucugaaauuuuucu

SEQ ID NO: 3723802 - RNA, 17 nt, Human
ucugaaauuuuucuucu

SEQ ID NO: 3723803 - RNA, 15 nt, Human
ucugaacacaggcag

SEQ ID NO: 3723804 - RNA, 17 nt, Human
ucugaacacaggcagcu

SEQ ID NO: 3723805 - RNA, 12 nt, Human
ucugaacagcug

SEQ ID NO: 3723806 - RNA, 14 nt, Human
ucugaacucaaacu

SEQ ID NO: 3723807 - RNA, 17 nt, Human
ucugaacucaaacugag

SEQ ID NO: 3723808 - RNA, 21 nt, Human
ucugaacuuggcgcugccccu

SEQ ID NO: 3723809 - RNA, 17 nt, Human
ucugaacuuuggagagu

SEQ ID NO: 3723810 - RNA, 13 nt, Human
ucugaagcaaggc

SEQ ID NO: 3723811 - RNA, 14 nt, Human
ucugaagcauguuu

SEQ ID NO: 3723812 - RNA, 15 nt, Human
ucugaagcauguuuc

SEQ ID NO: 3723813 - RNA, 17 nt, Human
ucugaagcccucccagg

SEQ ID NO: 3723814 - RNA, 13 nt, Human
ucugaagccucac

SEQ ID NO: 3723815 - RNA, 20 nt, Human
ucugaagcugacgaacuucc

SEQ ID NO: 3723816 - RNA, 16 nt, Human
ucugaagcuugacucc

SEQ ID NO: 3723817 - RNA, 22 nt, Human
ucugaagcuugacucccaaguu

SEQ ID NO: 3723818 - RNA, 21 nt, Human
ucugaaggacacuuccugccu

SEQ ID NO: 3723819 - RNA, 22 nt, Human
ucugaaggacauugcggacagc

SEQ ID NO: 3723820 - RNA, 21 nt, Human
ucugaaggagccccauuccug

SEQ ID NO: 3723821 - RNA, 20 nt, Human
ucugaaggaggccaccuccu

SEQ ID NO: 3723822 - RNA, 12 nt, Human
ucugaagggagg

SEQ ID NO: 3723823 - RNA, 20 nt, Human
ucugaagucacaucacagga

SEQ ID NO: 3723824 - RNA, 22 nt, Human
ucugaagucacaucacaggaca

SEQ ID NO: 3723825 - RNA, 15 nt, Human
ucugaagucacugca

SEQ ID NO: 3723826 - RNA, 18 nt, Human
ucugaagugaaacugcuu

SEQ ID NO: 3723827 - RNA, 17 nt, Human
ucugaaguuauauuucc

SEQ ID NO: 3723828 - RNA, 15 nt, Human
ucugaaguuggacag

SEQ ID NO: 3723829 - RNA, 16 nt, Human
ucugaaguuucauuua

SEQ ID NO: 3723830 - RNA, 18 nt, Human
ucugaaguuucauuuaug

SEQ ID NO: 3723831 - RNA, 15 nt, Human
ucugaauaauuucuu

SEQ ID NO: 3723832 - RNA, 16 nt, Human
ucugaauaauuucuua

SEQ ID NO: 3723833 - RNA, 17 nt, Human
ucugaauaccucuuuga

SEQ ID NO: 3723834 - RNA, 19 nt, Human
ucugaauaccucuuugaaa

SEQ ID NO: 3723835 - RNA, 13 nt, Human
ucugaauccuaag

SEQ ID NO: 3723836 - RNA, 22 nt, Human
ucugaaucgagugagacaaaau

SEQ ID NO: 3723837 - RNA, 17 nt, Human
ucugaaucuucugaaac

SEQ ID NO: 3723838 - RNA, 16 nt, Human
ucugaaugcugcuacu

SEQ ID NO: 3723839 - RNA, 22 nt, Human
ucugaaugcuucuaaguaaaua

SEQ ID NO: 3723840 - RNA, 12 nt, Human
ucugaauguucu

SEQ ID NO: 3723841 - RNA, 17 nt, Human
ucugaauguucugacau

SEQ ID NO: 3723842 - RNA, 10 nt, Human
ucugaauuau

SEQ ID NO: 3723843 - RNA, 13 nt, Human
ucugaauuugcaa

SEQ ID NO: 3723844 - RNA, 14 nt, Human
ucugaauuugcaaa

SEQ ID NO: 3723845 - RNA, 22 nt, Human
ucugaauuugcaaaguacugua

SEQ ID NO: 3723846 - RNA, 20 nt, Human
ucugaauuugcccugggaaa

SEQ ID NO: 3723847 - RNA, 21 nt, Human
ucugaauuuuggggauuuuca

SEQ ID NO: 3723848 - RNA, 16 nt, Human
ucugaauuuuuaaaca

SEQ ID NO: 3723849 - RNA, 16 nt, Human
ucugacaacagacuuc

SEQ ID NO: 3723850 - RNA, 13 nt, Human
ucugacaagggcu

SEQ ID NO: 3723851 - RNA, 14 nt, Human
ucugacacacagcu

SEQ ID NO: 3723852 - RNA, 17 nt, Human
ucugacacacagcucug

SEQ ID NO: 3723853 - RNA, 20 nt, Human
ucugacaccuauuuuagaca

SEQ ID NO: 3723854 - RNA, 22 nt, Human
ucugacagcagcaucucuaccu

SEQ ID NO: 3723855 - RNA, 12 nt, Human
ucugacagccuc

SEQ ID NO: 3723856 - RNA, 14 nt, Human
ucugacagccucag

SEQ ID NO: 3723857 - RNA, 22 nt, Human
ucugacaggcaaugcuggcugu

SEQ ID NO: 3723858 - RNA, 17 nt, Human
ucugacaguuuuucugu

SEQ ID NO: 3723859 - RNA, 13 nt, Human
ucugacauaaucc

SEQ ID NO: 3723860 - RNA, 14 nt, Human
ucugacaucucugc

SEQ ID NO: 3723861 - RNA, 19 nt, Human
ucugacauuaacaguuuuc

SEQ ID NO: 3723862 - RNA, 13 nt, Human
ucugacauucuca

SEQ ID NO: 3723863 - RNA, 21 nt, Human
ucugacauucucaggaagccc

SEQ ID NO: 3723864 - RNA, 12 nt, Human
ucugaccacacu

SEQ ID NO: 3723865 - RNA, 20 nt, Human
ucugaccacuugaggccuga

SEQ ID NO: 3723866 - RNA, 18 nt, Human
ucugaccagcagcgccuu

SEQ ID NO: 3723867 - RNA, 15 nt, Human
ucugacccacugcuu

SEQ ID NO: 3723868 - RNA, 15 nt, Human
ucugacccagugccc

SEQ ID NO: 3723869 - RNA, 22 nt, Human
ucugacccagugcccccacuga

SEQ ID NO: 3723870 - RNA, 18 nt, Human
ucugacccaugcugcccu

SEQ ID NO: 3723871 - RNA, 19 nt, Human
ucugacccaugcugcccug

SEQ ID NO: 3723872 - RNA, 16 nt, Human
ucugaccccuccucac

SEQ ID NO: 3723873 - RNA, 13 nt, Human
ucugaccucagca

SEQ ID NO: 3723874 - RNA, 18 nt, Human
ucugaccucuuggccaca

SEQ ID NO: 3723875 - RNA, 12 nt, Human
ucugaccugcag

SEQ ID NO: 3723876 - RNA, 14 nt, Human
ucugaccugcaggc

SEQ ID NO: 3723877 - RNA, 21 nt, Human
ucugaccugcaggccaagagc

SEQ ID NO: 3723878 - RNA, 14 nt, Human
ucugaccuuaaaug

SEQ ID NO: 3723879 - RNA, 16 nt, Human
ucugacggcccugcaa

SEQ ID NO: 3723880 - RNA, 14 nt, Human
ucugacuaugacau

SEQ ID NO: 3723881 - RNA, 14 nt, Human
ucugacucacaaga

SEQ ID NO: 3723882 - RNA, 15 nt, Human
ucugacucagggcuc

SEQ ID NO: 3723883 - RNA, 19 nt, Human
ucugacucauauccccuau

SEQ ID NO: 3723884 - RNA, 23 nt, Human
ucugacuccaguggggcaagauu

SEQ ID NO: 3723885 - RNA, 19 nt, Human
ucugacucgguuucuccaa

SEQ ID NO: 3723886 - RNA, 12 nt, Human
ucugacucucaa

SEQ ID NO: 3723887 - RNA, 22 nt, Human
ucugacucuccgcggugguugu

SEQ ID NO: 3723888 - RNA, 13 nt, Human
ucugacugacaug

SEQ ID NO: 3723889 - RNA, 12 nt, Human
ucugacugugug

SEQ ID NO: 3723890 - RNA, 20 nt, Human
ucugacuuaagcaaaagaaa

SEQ ID NO: 3723891 - RNA, 17 nt, Human
ucugacuucugccugga

SEQ ID NO: 3723892 - RNA, 19 nt, Human
ucugacuucugccuggaga

SEQ ID NO: 3723893 - RNA, 20 nt, Human
ucugacuucugccuggagac

SEQ ID NO: 3723894 - RNA, 14 nt, Human
ucugagaaaacaag

SEQ ID NO: 3723895 - RNA, 22 nt, Human
ucugagaaaagcuuugaacccu

SEQ ID NO: 3723896 - RNA, 15 nt, Human
ucugagaaagacuau

SEQ ID NO: 3723897 - RNA, 19 nt, Human
ucugagaaagacuauucaa

SEQ ID NO: 3723898 - RNA, 20 nt, Human
ucugagaaagacuauucaaa

SEQ ID NO: 3723899 - RNA, 21 nt, Human
ucugagaaagacuauucaaac

SEQ ID NO: 3723900 - RNA, 19 nt, Human
ucugagaagaggagcccuc

SEQ ID NO: 3723901 - RNA, 23 nt, Human
ucugagaaucuuuauugagaaag

SEQ ID NO: 3723902 - RNA, 16 nt, Human
ucugagaaugaacaaa

SEQ ID NO: 3723903 - RNA, 22 nt, Human
ucugagaauuguugagauacuu

SEQ ID NO: 3723904 - RNA, 19 nt, Human
ucugagacaaagcaaugga

SEQ ID NO: 3723905 - RNA, 21 nt, Human
ucugagacucgcgacaaugca

SEQ ID NO: 3723906 - RNA, 22 nt, Human
ucugagacucucuuaggagcag

SEQ ID NO: 3723907 - RNA, 20 nt, Human
ucugagagaggccauucuuu

SEQ ID NO: 3723908 - RNA, 21 nt, Human
ucugagagaggcuaaaauguu

SEQ ID NO: 3723909 - RNA, 14 nt, Human
ucugagagauuugg

SEQ ID NO: 3723910 - RNA, 18 nt, Human
ucugagaggacuuuucuu

SEQ ID NO: 3723911 - RNA, 18 nt, Human
ucugagaggcccuggauc

SEQ ID NO: 3723912 - RNA, 14 nt, Human
ucugagagucuaga

SEQ ID NO: 3723913 - RNA, 16 nt, Human
ucugagagucuagauu

SEQ ID NO: 3723914 - RNA, 18 nt, Human
ucugagagucuagauucu

SEQ ID NO: 3723915 - RNA, 22 nt, Human
ucugagaucuguugauugauga

SEQ ID NO: 3723916 - RNA, 22 nt, Human
ucugagauggcucccaggggcu

SEQ ID NO: 3723917 - RNA, 20 nt, Human
ucugagauuauuuuaaucua

SEQ ID NO: 3723918 - RNA, 12 nt, Human
ucugagcacaga

SEQ ID NO: 3723919 - RNA, 22 nt, Human
ucugagcacuguuuauacacug

SEQ ID NO: 3723920 - RNA, 19 nt, Human
ucugagccacagcagcauu

SEQ ID NO: 3723921 - RNA, 12 nt, Human
ucugagcccaug

SEQ ID NO: 3723922 - RNA, 23 nt, Human
ucugagcccauguucugccccca

SEQ ID NO: 3723923 - RNA, 16 nt, Human
ucugagcccgggcugc

SEQ ID NO: 3723924 - RNA, 17 nt, Human
ucugagcccgggcugcc

SEQ ID NO: 3723925 - RNA, 20 nt, Human
ucugagcuauuucaucuauu

SEQ ID NO: 3723926 - RNA, 14 nt, Human
ucugagcugccagu

SEQ ID NO: 3723927 - RNA, 19 nt, Human
ucugagcugucaacgagac

SEQ ID NO: 3723928 - RNA, 17 nt, Human
ucugagcuuacguaguu

SEQ ID NO: 3723929 - RNA, 19 nt, Human
ucugagcuuacguaguucu

SEQ ID NO: 3723930 - RNA, 17 nt, Human
ucugaggaauccagacc

SEQ ID NO: 3723931 - RNA, 22 nt, Human
ucugaggaauccagacccggcu

SEQ ID NO: 3723932 - RNA, 16 nt, Human
ucugaggaauucugua

SEQ ID NO: 3723933 - RNA, 20 nt, Human
ucugaggacauuccaagaca

SEQ ID NO: 3723934 - RNA, 19 nt, Human
ucugaggagccugcaacau

SEQ ID NO: 3723935 - RNA, 12 nt, Human
ucugaggccagc

SEQ ID NO: 3723936 - RNA, 14 nt, Human
ucugaggccagccu

SEQ ID NO: 3723937 - RNA, 14 nt, Human
ucugaggcccugcc

SEQ ID NO: 3723938 - RNA, 17 nt, Human
ucugaggccguugcuga

SEQ ID NO: 3723939 - RNA, 22 nt, Human
ucugaggccguugcugacuuag

SEQ ID NO: 3723940 - RNA, 23 nt, Human
ucugaggccuccucucucaguuu

SEQ ID NO: 3723941 - RNA, 21 nt, Human
ucugaggcgccccaacccgug

SEQ ID NO: 3723942 - RNA, 15 nt, Human
ucugaggcuuccaga

SEQ ID NO: 3723943 - RNA, 16 nt, Human
ucugaggcuuccagag

SEQ ID NO: 3723944 - RNA, 16 nt, Human
ucugagggaaagugca

SEQ ID NO: 3723945 - RNA, 17 nt, Human
ucugagggaggaggcca

SEQ ID NO: 3723946 - RNA, 23 nt, Human
ucugagggaggaggccaccucuc

SEQ ID NO: 3723947 - RNA, 17 nt, Human
ucugagggcuuguaguu

SEQ ID NO: 3723948 - RNA, 19 nt, Human
ucugagggcuuguaguucu

SEQ ID NO: 3723949 - RNA, 14 nt, Human
ucugagguccugag

SEQ ID NO: 3723950 - RNA, 15 nt, Human
ucugagguccugagc

SEQ ID NO: 3723951 - RNA, 21 nt, Human
ucuaacccucccauggcaccu

SEQ ID NO: 3723952 - RNA, 20 nt, Human
ucuaaccucaucuucuucac

SEQ ID NO: 3723953 - RNA, 13 nt, Human
ucuaaccuccuuu

SEQ ID NO: 3723954 - RNA, 15 nt, Human
ucuaaccugauggca

SEQ ID NO: 3723955 - RNA, 13 nt, Human
ucuaaccuggagg

SEQ ID NO: 3723956 - RNA, 18 nt, Human
ucuaaccuugaaugcugc

SEQ ID NO: 3723957 - RNA, 16 nt, Human
ucuaacgccugagccc

SEQ ID NO: 3723958 - RNA, 21 nt, Human
ucuaacgccugagcccaggga

SEQ ID NO: 3723959 - RNA, 23 nt, Human
ucuaacgccugagcccagggagg

SEQ ID NO: 3723960 - RNA, 17 nt, Human
ucuaacggucuguucug

SEQ ID NO: 3723961 - RNA, 15 nt, Human
ucuaacucagaaaca

SEQ ID NO: 3723962 - RNA, 21 nt, Human
ucuaacucugauguaaaugaa

SEQ ID NO: 3723963 - RNA, 17 nt, Human
ucuaacuguauauuugu

SEQ ID NO: 3723964 - RNA, 21 nt, Human
ucuaacugugcucaagagguu

SEQ ID NO: 3723965 - RNA, 15 nt, Human
ucuaacuucaccaua

SEQ ID NO: 3723966 - RNA, 22 nt, Human
ucuaacuucaccauauuaccac

SEQ ID NO: 3723967 - RNA, 19 nt, Human
ucuaacuuggcucacacuc

SEQ ID NO: 3723968 - RNA, 13 nt, Human
ucuaacuuuagaa

SEQ ID NO: 3723969 - RNA, 14 nt, Human
ucuaagaaacauug

SEQ ID NO: 3723970 - RNA, 18 nt, Human
ucuaagaaacauuggaag

SEQ ID NO: 3723971 - RNA, 15 nt, Human
ucuaagaaacauuua

SEQ ID NO: 3723972 - RNA, 23 nt, Human
ucuaagaaauaucugugaaauau

SEQ ID NO: 3723973 - RNA, 12 nt, Human
ucuaagaaauug

SEQ ID NO: 3723974 - RNA, 19 nt, Human
ucuaagaauaauaaaauca

SEQ ID NO: 3723975 - RNA, 16 nt, Human
ucuaagaauacagcuu

SEQ ID NO: 3723976 - RNA, 20 nt, Human
ucuaagacuuacucuaagau

SEQ ID NO: 3723977 - RNA, 21 nt, Human
ucuaagauaguaacaaugaag

SEQ ID NO: 3723978 - RNA, 21 nt, Human
ucuaagaucuuagauucucug

SEQ ID NO: 3723979 - RNA, 12 nt, Human
ucuaagauguga

SEQ ID NO: 3723980 - RNA, 13 nt, Human
ucuaagaugugau

SEQ ID NO: 3723981 - RNA, 14 nt, Human
ucuaagauguuaua

SEQ ID NO: 3723982 - RNA, 18 nt, Human
ucuaagauguuauauuuu

SEQ ID NO: 3723983 - RNA, 14 nt, Human
ucuaagauucuaaa

SEQ ID NO: 3723984 - RNA, 17 nt, Human
ucuaagauucuaaaggu

SEQ ID NO: 3723985 - RNA, 19 nt, Human
ucuaagauucuaaaggucc

SEQ ID NO: 3723986 - RNA, 14 nt, Human
ucuaagauucuaau

SEQ ID NO: 3723987 - RNA, 16 nt, Human
ucuaagauucuaauga

SEQ ID NO: 3723988 - RNA, 13 nt, Human
ucuaagauucuag

SEQ ID NO: 3723989 - RNA, 14 nt, Human
ucuaagauucuaga

SEQ ID NO: 3723990 - RNA, 12 nt, Human
ucuaagauucug

SEQ ID NO: 3723991 - RNA, 19 nt, Human
ucuaagauucugauuuuag

SEQ ID NO: 3723992 - RNA, 16 nt, Human
ucuaagcaauuucuug

SEQ ID NO: 3723993 - RNA, 18 nt, Human
ucuaagcagcuuauuguu

SEQ ID NO: 3723994 - RNA, 18 nt, Human
ucuaagccuuuccauaag

SEQ ID NO: 3723995 - RNA, 12 nt, Human
ucuaagcugcag

SEQ ID NO: 3723996 - RNA, 17 nt, Human
ucuaagcugcagcuucc

SEQ ID NO: 3723997 - RNA, 18 nt, Human
ucuaagcugcagcuuccu

SEQ ID NO: 3723998 - RNA, 19 nt, Human
ucuaagcugcagcuuccug

SEQ ID NO: 3723999 - RNA, 22 nt, Human
ucuaaggccuaggauucuaaaa

SEQ ID NO: 3724000 - RNA, 16 nt, Human
ucuaaggcucugagag

SEQ ID NO: 3724001 - RNA, 14 nt, Human
ucuaagggggaggg

SEQ ID NO: 3724002 - RNA, 22 nt, Human
ucuaagguccgguguucuaaga

SEQ ID NO: 3724003 - RNA, 23 nt, Human
ucuaagguccgguguucuaagau

SEQ ID NO: 3724004 - RNA, 14 nt, Human
ucuaagguucucau

SEQ ID NO: 3724005 - RNA, 20 nt, Human
ucuaaguaaaaccacagcag

SEQ ID NO: 3724006 - RNA, 14 nt, Human
ucuaaguaaauaca

SEQ ID NO: 3724007 - RNA, 16 nt, Human
ucuaaguaaauacaau

SEQ ID NO: 3724008 - RNA, 22 nt, Human
ucuaagucaaacacuugugacu

SEQ ID NO: 3724009 - RNA, 19 nt, Human
ucuaagucauguauguuuc

SEQ ID NO: 3724010 - RNA, 18 nt, Human
ucuaagugggcauugcca

SEQ ID NO: 3724011 - RNA, 14 nt, Human
ucuaaguuauaaga

SEQ ID NO: 3724012 - RNA, 16 nt, Human
ucuaaguuauaagacu

SEQ ID NO: 3724013 - RNA, 20 nt, Human
ucuaaguuauaagacucuca

SEQ ID NO: 3724014 - RNA, 14 nt, Human
ucuaaguuucuaag

SEQ ID NO: 3724015 - RNA, 16 nt, Human
ucuaaguuucuaagau

SEQ ID NO: 3724016 - RNA, 23 nt, Human
ucuaaguuucuaagauucuaaag

SEQ ID NO: 3724017 - RNA, 16 nt, Human
ucuaauaaacuuggau

SEQ ID NO: 3724018 - RNA, 22 nt, Human
ucuaauaaacuuggauucucua

SEQ ID NO: 3724019 - RNA, 22 nt, Human
ucuaauaauaaauaguucuucu

SEQ ID NO: 3724020 - RNA, 18 nt, Human
ucuaauaauuucuaaugu

SEQ ID NO: 3724021 - RNA, 19 nt, Human
ucuaauagaacucaguuuu

SEQ ID NO: 3724022 - RNA, 22 nt, Human
ucuaauagaacucaguuuuaac

SEQ ID NO: 3724023 - RNA, 22 nt, Human
ucuaauagggcaauuaauuccu

SEQ ID NO: 3724024 - RNA, 14 nt, Human
ucuaauaguauaaa

SEQ ID NO: 3724025 - RNA, 14 nt, Human
ucuaauaucagcaa

SEQ ID NO: 3724026 - RNA, 14 nt, Human
ucuaauaucauuca

SEQ ID NO: 3724027 - RNA, 19 nt, Human
ucuaauauccccaaauuag

SEQ ID NO: 3724028 - RNA, 20 nt, Human
ucuaauauccccaaauuagg

SEQ ID NO: 3724029 - RNA, 20 nt, Human
ucuaauauggcaaaaauggc

SEQ ID NO: 3724030 - RNA, 14 nt, Human
ucuaauauggccac

SEQ ID NO: 3724031 - RNA, 20 nt, Human
ucuaauauuuauugcuuuau

SEQ ID NO: 3724032 - RNA, 19 nt, Human
ucuaaucuagauaucgacu

SEQ ID NO: 3724033 - RNA, 20 nt, Human
ucuaaucuagauaucgacuu

SEQ ID NO: 3724034 - RNA, 21 nt, Human
ucuaaugacaugccuauauga

SEQ ID NO: 3724035 - RNA, 16 nt, Human
ucuaauguuugcauau

SEQ ID NO: 3724036 - RNA, 19 nt, Human
ucuaauguuugcauauaag

SEQ ID NO: 3724037 - RNA, 23 nt, Human
ucuaauuaaccuuacuaauuaua

SEQ ID NO: 3724038 - RNA, 19 nt, Human
ucuaauuauguagcucuuu

SEQ ID NO: 3724039 - RNA, 16 nt, Human
ucuaauucacagugcu

SEQ ID NO: 3724040 - RNA, 21 nt, Human
ucuaauuccauccauaaaucc

SEQ ID NO: 3724041 - RNA, 18 nt, Human
ucuaauucccauuuugca

SEQ ID NO: 3724042 - RNA, 22 nt, Human
ucuaauucccauuuugcaaaau

SEQ ID NO: 3724043 - RNA, 13 nt, Human
ucuaauuccuguu

SEQ ID NO: 3724044 - RNA, 19 nt, Human
ucuaauucuauuaaagugc

SEQ ID NO: 3724045 - RNA, 21 nt, Human
ucuaauucuauuaaagugcua

SEQ ID NO: 3724046 - RNA, 13 nt, Human
ucuaauucuuuaa

SEQ ID NO: 3724047 - RNA, 13 nt, Human
ucuaauugccaug

SEQ ID NO: 3724048 - RNA, 14 nt, Human
ucuaauugccaugu

SEQ ID NO: 3724049 - RNA, 12 nt, Human
ucuaauugcuua

SEQ ID NO: 3724050 - RNA, 13 nt, Human
ucuaauugcuuau

SEQ ID NO: 3724051 - RNA, 18 nt, Human
ucuaauugcuuauuuauu

SEQ ID NO: 3724052 - RNA, 21 nt, Human
ucuaauuggcuuuacuauuuu

SEQ ID NO: 3724053 - RNA, 14 nt, Human
ucuaauuugcugcu

SEQ ID NO: 3724054 - RNA, 18 nt, Human
ucuaauuuuuauucauaa

SEQ ID NO: 3724055 - RNA, 13 nt, Human
ucuacaaaacauu

SEQ ID NO: 3724056 - RNA, 13 nt, Human
ucuacaaagcacu

SEQ ID NO: 3724057 - RNA, 23 nt, Human
ucuacaaagcacuagagaaugca

SEQ ID NO: 3724058 - RNA, 19 nt, Human
ucuacaaauaauuuuagug

SEQ ID NO: 3724059 - RNA, 19 nt, Human
ucuacaaguauucugccuu

SEQ ID NO: 3724060 - RNA, 23 nt, Human
ucuacaaucucccuucacaaguu

SEQ ID NO: 3724061 - RNA, 14 nt, Human
ucuacacagagcag

SEQ ID NO: 3724062 - RNA, 16 nt, Human
ucuacacauacaugua

SEQ ID NO: 3724063 - RNA, 15 nt, Human
ucuacacucaucuua

SEQ ID NO: 3724064 - RNA, 15 nt, Human
ucuacacucuccugg

SEQ ID NO: 3724065 - RNA, 18 nt, Human
ucuacacucuccugggcc

SEQ ID NO: 3724066 - RNA, 21 nt, Human
ucuacacugggugcugauccu

SEQ ID NO: 3724067 - RNA, 14 nt, Human
ucuacacugugaac

SEQ ID NO: 3724068 - RNA, 15 nt, Human
ucuacagaggccaug

SEQ ID NO: 3724069 - RNA, 16 nt, Human
ucuacagaugucccau

SEQ ID NO: 3724070 - RNA, 19 nt, Human
ucuacagccuugucccccu

SEQ ID NO: 3724071 - RNA, 12 nt, Human
ucuacagcuccc

SEQ ID NO: 3724072 - RNA, 21 nt, Human
ucuacagugguuuuauacuga

SEQ ID NO: 3724073 - RNA, 17 nt, Human
ucuacauaaguaauuca

SEQ ID NO: 3724074 - RNA, 21 nt, Human
ucuacauaugaucugucugug

SEQ ID NO: 3724075 - RNA, 15 nt, Human
ucuacauauucuuua

SEQ ID NO: 3724076 - RNA, 16 nt, Human
ucuacauauucuuuaa

SEQ ID NO: 3724077 - RNA, 15 nt, Human
ucuacaucuucugcc

SEQ ID NO: 3724078 - RNA, 19 nt, Human
ucuacaucuuuuuucacaa

SEQ ID NO: 3724079 - RNA, 11 nt, Human
ucuacaugaau

SEQ ID NO: 3724080 - RNA, 21 nt, Human
ucuacaugaggaacuguagau

SEQ ID NO: 3724081 - RNA, 15 nt, Human
ucuacauuauugcuu

SEQ ID NO: 3724082 - RNA, 11 nt, Human
ucuacauuuca

SEQ ID NO: 3724083 - RNA, 13 nt, Human
ucuacauuucaca

SEQ ID NO: 3724084 - RNA, 16 nt, Human
ucuacauuucacauua

SEQ ID NO: 3724085 - RNA, 23 nt, Human
ucuacauuucaccuacuuuguaa

SEQ ID NO: 3724086 - RNA, 20 nt, Human
ucuaccaacuggaagcacag

SEQ ID NO: 3724087 - RNA, 16 nt, Human
ucuaccagacugugua

SEQ ID NO: 3724088 - RNA, 22 nt, Human
ucuaccagccucccuauuuuuu

SEQ ID NO: 3724089 - RNA, 20 nt, Human
ucuaccagugcaggcuggcc

SEQ ID NO: 3724090 - RNA, 22 nt, Human
ucuaccagugcaggcuggccag

SEQ ID NO: 3724091 - RNA, 18 nt, Human
ucuaccauuucagagagg

SEQ ID NO: 3724092 - RNA, 20 nt, Human
ucuaccauuuucugguucuu

SEQ ID NO: 3724093 - RNA, 13 nt, Human
ucuacccaaagga

SEQ ID NO: 3724094 - RNA, 22 nt, Human
ucuacccagagaagccccuucc

SEQ ID NO: 3724095 - RNA, 14 nt, Human
ucuacccagcccau

SEQ ID NO: 3724096 - RNA, 16 nt, Human
ucuacccagggccugc

SEQ ID NO: 3724097 - RNA, 15 nt, Human
ucuacccguuccaaa

SEQ ID NO: 3724098 - RNA, 16 nt, Human
ucuacccguuccaaaa

SEQ ID NO: 3724099 - RNA, 18 nt, Human
ucuacccucccacccccu

SEQ ID NO: 3724100 - RNA, 19 nt, Human
ucuacccuggcacuauaau

SEQ ID NO: 3724101 - RNA, 13 nt, Human
ggccacacagcug

SEQ ID NO: 3724102 - RNA, 21 nt, Human
ggccacacuauuaccaugaga

SEQ ID NO: 3724103 - RNA, 22 nt, Human
ggccacacuauuaccaugagaa

SEQ ID NO: 3724104 - RNA, 16 nt, Human
ggccacacucagcaca

SEQ ID NO: 3724105 - RNA, 22 nt, Human
ggccacagaaaauucuucucca

SEQ ID NO: 3724106 - RNA, 12 nt, Human
ggccacagccag

SEQ ID NO: 3724107 - RNA, 13 nt, Human
ggccacagccagg

SEQ ID NO: 3724108 - RNA, 19 nt, Human
ggccacaucaaagaggcug

SEQ ID NO: 3724109 - RNA, 12 nt, Human
ggccacauggcg

SEQ ID NO: 3724110 - RNA, 16 nt, Human
ggccacauggcggaga

SEQ ID NO: 3724111 - RNA, 15 nt, Human
ggccaccaaagcugc

SEQ ID NO: 3724112 - RNA, 16 nt, Human
ggccaccaaagcugcc

SEQ ID NO: 3724113 - RNA, 17 nt, Human
ggccaccaaagcugccc

SEQ ID NO: 3724114 - RNA, 13 nt, Human
ggccaccaggcug

SEQ ID NO: 3724115 - RNA, 14 nt, Human
ggccaccaggcugg

SEQ ID NO: 3724116 - RNA, 16 nt, Human
ggccaccaggcuggcg

SEQ ID NO: 3724117 - RNA, 19 nt, Human
ggccaccaggcuggcgcag

SEQ ID NO: 3724118 - RNA, 21 nt, Human
ggccaccaggcuggcgcagcc

SEQ ID NO: 3724119 - RNA, 16 nt, Human
ggccaccgccuugccc

SEQ ID NO: 3724120 - RNA, 20 nt, Human
ggccaccgccuugcccagcc

SEQ ID NO: 3724121 - RNA, 21 nt, Human
ggccaccuccuaaaaggccca

SEQ ID NO: 3724122 - RNA, 11 nt, Human
ggccaccucuc

SEQ ID NO: 3724123 - RNA, 19 nt, Human
ggccaccucuuccuggccg

SEQ ID NO: 3724124 - RNA, 20 nt, Human
ggccaccucuuccuggccgg

SEQ ID NO: 3724125 - RNA, 22 nt, Human
ggccaccugaggugggcccagg

SEQ ID NO: 3724126 - RNA, 23 nt, Human
ggccaccugaggugggcccagga

SEQ ID NO: 3724127 - RNA, 10 nt, Human
ggccaccugc

SEQ ID NO: 3724128 - RNA, 11 nt, Human
ggccaccugcc

SEQ ID NO: 3724129 - RNA, 13 nt, Human
ggccaccugccug

SEQ ID NO: 3724130 - RNA, 15 nt, Human
ggccaccugccugcg

SEQ ID NO: 3724131 - RNA, 21 nt, Human
ggccaccugccugcgucuucc

SEQ ID NO: 3724132 - RNA, 22 nt, Human
ggccaccuggcucucaccucua

SEQ ID NO: 3724133 - RNA, 16 nt, Human
ggccacgcagccagga

SEQ ID NO: 3724134 - RNA, 14 nt, Human
ggccacgcuccagc

SEQ ID NO: 3724135 - RNA, 18 nt, Human
ggccacgcuccagcugcc

SEQ ID NO: 3724136 - RNA, 19 nt, Human
ggccacgucuuccuucugc

SEQ ID NO: 3724137 - RNA, 16 nt, Human
ggccacgugccaggcc

SEQ ID NO: 3724138 - RNA, 11 nt, Human
ggccacuaagc

SEQ ID NO: 3724139 - RNA, 20 nt, Human
ggccacuaagcagaggaggg

SEQ ID NO: 3724140 - RNA, 21 nt, Human
ggccacuaagcagaggagggg

SEQ ID NO: 3724141 - RNA, 16 nt, Human
ggccacuccuuccugc

SEQ ID NO: 3724142 - RNA, 20 nt, Human
ggccacucugccucugccug

SEQ ID NO: 3724143 - RNA, 12 nt, Human
ggccacugaaga

SEQ ID NO: 3724144 - RNA, 16 nt, Human
ggccacugugaagaga

SEQ ID NO: 3724145 - RNA, 16 nt, Human
ggccacuguguuccuu

SEQ ID NO: 3724146 - RNA, 20 nt, Human
ggccacuguuuggaaauaaa

SEQ ID NO: 3724147 - RNA, 21 nt, Human
ggccacuucuggguggggcag

SEQ ID NO: 3724148 - RNA, 19 nt, Human
ggccagaaguagcuuugca

SEQ ID NO: 3724149 - RNA, 16 nt, Human
ggccagacacaggccc

SEQ ID NO: 3724150 - RNA, 18 nt, Human
ggccagacacaggcccuc

SEQ ID NO: 3724151 - RNA, 23 nt, Human
ggccagaccagagcucuggagcc

SEQ ID NO: 3724152 - RNA, 18 nt, Human
ggccagaccugcagacgc

SEQ ID NO: 3724153 - RNA, 22 nt, Human
ggccagaccugcagacgcccag

SEQ ID NO: 3724154 - RNA, 17 nt, Human
ggccagagacacaagcc

SEQ ID NO: 3724155 - RNA, 18 nt, Human
ggccagagacacaagccu

SEQ ID NO: 3724156 - RNA, 22 nt, Human
ggccagagagccuggugcugcu

SEQ ID NO: 3724157 - RNA, 23 nt, Human
ggccagagagccuggugcugcug

SEQ ID NO: 3724158 - RNA, 12 nt, Human
ggccagagccag

SEQ ID NO: 3724159 - RNA, 14 nt, Human
ggccagagccaggg

SEQ ID NO: 3724160 - RNA, 17 nt, Human
ggccagagcccacucca

SEQ ID NO: 3724161 - RNA, 16 nt, Human
ggccagagcugggagg

SEQ ID NO: 3724162 - RNA, 19 nt, Human
ggccagaggcagaacccug

SEQ ID NO: 3724163 - RNA, 19 nt, Human
ggccagagggagugacaga

SEQ ID NO: 3724164 - RNA, 22 nt, Human
ggccagagggagugacagaggc

SEQ ID NO: 3724165 - RNA, 19 nt, Human
ggccagaguauuggucucc

SEQ ID NO: 3724166 - RNA, 12 nt, Human
ggccagauccag

SEQ ID NO: 3724167 - RNA, 13 nt, Human
ggccagauccagc

SEQ ID NO: 3724168 - RNA, 21 nt, Human
ggccagaugcacaucccugga

SEQ ID NO: 3724169 - RNA, 17 nt, Human
ggccagaugcaccagcc

SEQ ID NO: 3724170 - RNA, 20 nt, Human
ggccagaugcaccagcccuu

SEQ ID NO: 3724171 - RNA, 23 nt, Human
ggccagauggcccggaugcugcu

SEQ ID NO: 3724172 - RNA, 19 nt, Human
ggccagcaccaucucuuua

SEQ ID NO: 3724173 - RNA, 12 nt, Human
ggccagcagcac

SEQ ID NO: 3724174 - RNA, 18 nt, Human
ggccagcagcaccugccc

SEQ ID NO: 3724175 - RNA, 16 nt, Human
ggccagccagccacuc

SEQ ID NO: 3724176 - RNA, 21 nt, Human
ggccagccagccacucuacca

SEQ ID NO: 3724177 - RNA, 11 nt, Human
ggccagccagg

SEQ ID NO: 3724178 - RNA, 14 nt, Human
ggccagccaugucu

SEQ ID NO: 3724179 - RNA, 21 nt, Human
ucuggucaaccuccuggacau

SEQ ID NO: 3724180 - RNA, 20 nt, Human
ucuggucaagggcugucauu

SEQ ID NO: 3724181 - RNA, 18 nt, Human
ucugguccggacacuccu

SEQ ID NO: 3724182 - RNA, 14 nt, Human
ucugguccuaccca

SEQ ID NO: 3724183 - RNA, 17 nt, Human
ucuggucuccucagccu

SEQ ID NO: 3724184 - RNA, 17 nt, Human
ucuggucuccucuuugu

SEQ ID NO: 3724185 - RNA, 14 nt, Human
ucuggucucgaacu

SEQ ID NO: 3724186 - RNA, 21 nt, Human
ucuggucucuaggcuggggaa

SEQ ID NO: 3724187 - RNA, 14 nt, Human
ucuggucugggugc

SEQ ID NO: 3724188 - RNA, 22 nt, Human
ucuggugagcgaggacauucuc

SEQ ID NO: 3724189 - RNA, 17 nt, Human
ucuggugaggccuugcu

SEQ ID NO: 3724190 - RNA, 18 nt, Human
ucuggugaggccuugcuc

SEQ ID NO: 3724191 - RNA, 17 nt, Human
ucuggugauaaggacau

SEQ ID NO: 3724192 - RNA, 17 nt, Human
ucuggugaucucccaag

SEQ ID NO: 3724193 - RNA, 15 nt, Human
ucuggugccuccaga

SEQ ID NO: 3724194 - RNA, 21 nt, Human
ucugguggccgaucggggcac

SEQ ID NO: 3724195 - RNA, 23 nt, Human
ucuggugggguguguuccaacug

SEQ ID NO: 3724196 - RNA, 16 nt, Human
ucugguggucagcccu

SEQ ID NO: 3724197 - RNA, 21 nt, Human
ucugguuccagggucccucug

SEQ ID NO: 3724198 - RNA, 23 nt, Human
ucugguuccagggucccucugug

SEQ ID NO: 3724199 - RNA, 21 nt, Human
ucugguuccuccccuccuccu

SEQ ID NO: 3724200 - RNA, 11 nt, Human
ucugguucuaa

SEQ ID NO: 3724201 - RNA, 14 nt, Human
ucugguucucaauu

SEQ ID NO: 3724202 - RNA, 18 nt, Human
ucugguucucaauuccaa

SEQ ID NO: 3724203 - RNA, 16 nt, Human
ucugguuguuucuguu

SEQ ID NO: 3724204 - RNA, 18 nt, Human
ucugguuugacuccgcug

SEQ ID NO: 3724205 - RNA, 13 nt, Human
ucugguuuggggc

SEQ ID NO: 3724206 - RNA, 14 nt, Human
ucugguuuugcuau

SEQ ID NO: 3724207 - RNA, 17 nt, Human
ucuguaaaaucuuucuu

SEQ ID NO: 3724208 - RNA, 23 nt, Human
ucuguaaaaucuuucuuucuuag

SEQ ID NO: 3724209 - RNA, 15 nt, Human
ucuguaaacucaaaa

SEQ ID NO: 3724210 - RNA, 15 nt, Human
ucuguaaacugugua

SEQ ID NO: 3724211 - RNA, 19 nt, Human
ucuguaaacuguguauucc

SEQ ID NO: 3724212 - RNA, 22 nt, Human
ucuguaaacuguguauuccaag

SEQ ID NO: 3724213 - RNA, 13 nt, Human
ucuguaaauacca

SEQ ID NO: 3724214 - RNA, 21 nt, Human
ucuguaaauaccauugacaca

SEQ ID NO: 3724215 - RNA, 22 nt, Human
ucuguaaauaccauugacacau

SEQ ID NO: 3724216 - RNA, 16 nt, Human
ucuguaaaucuacaca

SEQ ID NO: 3724217 - RNA, 23 nt, Human
ucuguaacagguauuuuguuucu

SEQ ID NO: 3724218 - RNA, 23 nt, Human
ucuguaacaucacuauccaugca

SEQ ID NO: 3724219 - RNA, 14 nt, Human
ucuguaagaaaccu

SEQ ID NO: 3724220 - RNA, 20 nt, Human
ucuguaagaaaccuacugcc

SEQ ID NO: 3724221 - RNA, 22 nt, Human
ucuguaagaaaccuacugccca

SEQ ID NO: 3724222 - RNA, 19 nt, Human
ucuguaauaauagacugua

SEQ ID NO: 3724223 - RNA, 20 nt, Human
ucuguaauauuuacaaugua

SEQ ID NO: 3724224 - RNA, 22 nt, Human
ucuguaauauuuacaauguauu

SEQ ID NO: 3724225 - RNA, 14 nt, Human
ucuguaaucccagc

SEQ ID NO: 3724226 - RNA, 20 nt, Human
ucuguaaucucguuucaaaa

SEQ ID NO: 3724227 - RNA, 20 nt, Human
ucuguaauuauaucuaaaau

SEQ ID NO: 3724228 - RNA, 20 nt, Human
ucuguaauucagguuuuucc

SEQ ID NO: 3724229 - RNA, 13 nt, Human
ucuguaauugugu

SEQ ID NO: 3724230 - RNA, 12 nt, Human
ucuguacaaagg

SEQ ID NO: 3724231 - RNA, 23 nt, Human
ucuguacaaaggggaaagaacau

SEQ ID NO: 3724232 - RNA, 23 nt, Human
ucuguacaaugaacccccaugau

SEQ ID NO: 3724233 - RNA, 13 nt, Human
ucuguacacgugu

SEQ ID NO: 3724234 - RNA, 17 nt, Human
ucuguacacguguccug

SEQ ID NO: 3724235 - RNA, 14 nt, Human
ucuguacagagccc

SEQ ID NO: 3724236 - RNA, 13 nt, Human
ucuguacauuuug

SEQ ID NO: 3724237 - RNA, 19 nt, Human
ucuguacauuuuguuguaa

SEQ ID NO: 3724238 - RNA, 22 nt, Human
ucuguacauuuuguuguaaaaa

SEQ ID NO: 3724239 - RNA, 13 nt, Human
ucuguaccaguua

SEQ ID NO: 3724240 - RNA, 18 nt, Human
ucuguaccccaugaccuu

SEQ ID NO: 3724241 - RNA, 23 nt, Human
ucuguaccccaugaccuuauccu

SEQ ID NO: 3724242 - RNA, 16 nt, Human
ucuguacugauucaau

SEQ ID NO: 3724243 - RNA, 14 nt, Human
ucuguacuuuucau

SEQ ID NO: 3724244 - RNA, 20 nt, Human
ucuguacuuuucauucucuu

SEQ ID NO: 3724245 - RNA, 17 nt, Human
ucuguacuuuuuggcau

SEQ ID NO: 3724246 - RNA, 17 nt, Human
ucuguagaaaugguugu

SEQ ID NO: 3724247 - RNA, 16 nt, Human
ucuguagagcagggca

SEQ ID NO: 3724248 - RNA, 18 nt, Human
ucuguagagccuucugau

SEQ ID NO: 3724249 - RNA, 19 nt, Human
ucuguagauucuguggaac

SEQ ID NO: 3724250 - RNA, 15 nt, Human
ucuguagccacuagu

SEQ ID NO: 3724251 - RNA, 14 nt, Human
ucuguagcuccuca

SEQ ID NO: 3724252 - RNA, 19 nt, Human
ucuguagggaacucugggg

SEQ ID NO: 3724253 - RNA, 14 nt, Human
ucuguagggcugga

SEQ ID NO: 3724254 - RNA, 15 nt, Human
ucuguagggcuggac

SEQ ID NO: 3724255 - RNA, 17 nt, Human
ucuguagggcuggaccu

SEQ ID NO: 3724256 - RNA, 20 nt, Human
ucuguaggguaauuaguaac

SEQ ID NO: 3724257 - RNA, 17 nt, Human
ucuguagguugcacacu

SEQ ID NO: 3724258 - RNA, 19 nt, Human
ucuguagguugcacacuuu

SEQ ID NO: 3724259 - RNA, 18 nt, Human
ucuguagucauuuacuaa

SEQ ID NO: 3724260 - RNA, 14 nt, Human
ucuguagugagaua

SEQ ID NO: 3724261 - RNA, 17 nt, Human
ucuguagugagauagca

SEQ ID NO: 3724262 - RNA, 21 nt, Human
ucuguaguuuuaucacaugua

SEQ ID NO: 3724263 - RNA, 21 nt, Human
ucuguauaaacauuaaauguc

SEQ ID NO: 3724264 - RNA, 15 nt, Human
ucuguauacaacccu

SEQ ID NO: 3724265 - RNA, 14 nt, Human
ucuguauacugugg

SEQ ID NO: 3724266 - RNA, 17 nt, Human
ucuguauagauuagaau

SEQ ID NO: 3724267 - RNA, 16 nt, Human
ucuguauagauuagag

SEQ ID NO: 3724268 - RNA, 16 nt, Human
ucuguauauaaauggg

SEQ ID NO: 3724269 - RNA, 23 nt, Human
ucuguauauaaaugggaacauuu

SEQ ID NO: 3724270 - RNA, 15 nt, Human
ucuguauauacaaua

SEQ ID NO: 3724271 - RNA, 20 nt, Human
ucuguaucaggacccagagg

SEQ ID NO: 3724272 - RNA, 20 nt, Human
ucuguauccuggaacaauau

SEQ ID NO: 3724273 - RNA, 14 nt, Human
ucuguauguauuag

SEQ ID NO: 3724274 - RNA, 15 nt, Human
ucuguauuucaugug

SEQ ID NO: 3724275 - RNA, 18 nt, Human
ucuguauuucauguggcu

SEQ ID NO: 3724276 - RNA, 12 nt, Human
ucuguauuugaa

SEQ ID NO: 3724277 - RNA, 14 nt, Human
ucuguauuugaaag

SEQ ID NO: 3724278 - RNA, 23 nt, Human
ucuguauuugaaucagccuacag

SEQ ID NO: 3724279 - RNA, 15 nt, Human
ucugucaaaacacug

SEQ ID NO: 3724280 - RNA, 18 nt, Human
ucugucaaaacacugugg

SEQ ID NO: 3724281 - RNA, 14 nt, Human
ucugucaaugaaaa

SEQ ID NO: 3724282 - RNA, 15 nt, Human
ucugucacaccagcc

SEQ ID NO: 3724283 - RNA, 18 nt, Human
ucugucacaguaaaaaua

SEQ ID NO: 3724284 - RNA, 14 nt, Human
ucugucacucaggc

SEQ ID NO: 3724285 - RNA, 15 nt, Human
ucugucagaugagaa

SEQ ID NO: 3724286 - RNA, 20 nt, Human
ucugucagaugagaacaaag

SEQ ID NO: 3724287 - RNA, 23 nt, Human
ucugucagaugagaacaaagcug

SEQ ID NO: 3724288 - RNA, 18 nt, Human
ucugucagaugggaagac

SEQ ID NO: 3724289 - RNA, 17 nt, Human
ucucaaccaccuuucag

SEQ ID NO: 3724290 - RNA, 13 nt, Human
ucucaaccauccc

SEQ ID NO: 3724291 - RNA, 21 nt, Human
ucucaaccuaccaccccuucc

SEQ ID NO: 3724292 - RNA, 17 nt, Human
ucucaagagggcacugg

SEQ ID NO: 3724293 - RNA, 23 nt, Human
ucucaagggcuagcaucccugag

SEQ ID NO: 3724294 - RNA, 12 nt, Human
ucucaaguucua

SEQ ID NO: 3724295 - RNA, 13 nt, Human
ucucaaguucuaa

SEQ ID NO: 3724296 - RNA, 14 nt, Human
ucucaaguucuaag

SEQ ID NO: 3724297 - RNA, 16 nt, Human
ucucaaguucuaagau

SEQ ID NO: 3724298 - RNA, 17 nt, Human
ucucaaguucuaagauu

SEQ ID NO: 3724299 - RNA, 18 nt, Human
ucucaaguucuaagauuc

SEQ ID NO: 3724300 - RNA, 20 nt, Human
ucucaaguucuaagauucua

SEQ ID NO: 3724301 - RNA, 22 nt, Human
ucucaaguucuaagauucuaau

SEQ ID NO: 3724302 - RNA, 18 nt, Human
ucucaaguuuaugucuca

SEQ ID NO: 3724303 - RNA, 22 nt, Human
ucucaauccuaauuucuccucc

SEQ ID NO: 3724304 - RNA, 18 nt, Human
ucucaauccugcaguggg

SEQ ID NO: 3724305 - RNA, 19 nt, Human
ucucaauccugcagugggg

SEQ ID NO: 3724306 - RNA, 13 nt, Human
ucucaaugaaaaa

SEQ ID NO: 3724307 - RNA, 14 nt, Human
ucucaaugaaauag

SEQ ID NO: 3724308 - RNA, 13 nt, Human
ucucaaugcucau

SEQ ID NO: 3724309 - RNA, 22 nt, Human
ucucaauuccaacaguuuaaug

SEQ ID NO: 3724310 - RNA, 12 nt, Human
ucucacaaacau

SEQ ID NO: 3724311 - RNA, 15 nt, Human
ucucacacacauaga

SEQ ID NO: 3724312 - RNA, 23 nt, Human
ucucacacccaccguccgcccug

SEQ ID NO: 3724313 - RNA, 21 nt, Human
ucucacacuggcguagaaguu

SEQ ID NO: 3724314 - RNA, 19 nt, Human
ucucacacuggucugcugu

SEQ ID NO: 3724315 - RNA, 21 nt, Human
ucucacacugguucucaauga

SEQ ID NO: 3724316 - RNA, 23 nt, Human
ucucacacugguucucaaugaaa

SEQ ID NO: 3724317 - RNA, 16 nt, Human
ucucacagcacaugcu

SEQ ID NO: 3724318 - RNA, 17 nt, Human
ucucacagcuaugcaaa

SEQ ID NO: 3724319 - RNA, 21 nt, Human
ucucacagugggagccagggc

SEQ ID NO: 3724320 - RNA, 17 nt, Human
ucucacauauacaagua

SEQ ID NO: 3724321 - RNA, 22 nt, Human
ucucacaugauuccagccauca

SEQ ID NO: 3724322 - RNA, 20 nt, Human
ucucacauggaaugaggguu

SEQ ID NO: 3724323 - RNA, 14 nt, Human
ucucaccagcugca

SEQ ID NO: 3724324 - RNA, 18 nt, Human
ucucaccagcugcaaagu

SEQ ID NO: 3724325 - RNA, 17 nt, Human
ucucaccagcugcugcu

SEQ ID NO: 3724326 - RNA, 16 nt, Human
ucucaccaggcagccu

SEQ ID NO: 3724327 - RNA, 22 nt, Human
ucucaccaggcagccucugggg

SEQ ID NO: 3724328 - RNA, 15 nt, Human
ucucaccccauccca

SEQ ID NO: 3724329 - RNA, 16 nt, Human
ucucaccgcagucguc

SEQ ID NO: 3724330 - RNA, 14 nt, Human
ucucaccggcucuc

SEQ ID NO: 3724331 - RNA, 18 nt, Human
ucucaccggcucucaccu

SEQ ID NO: 3724332 - RNA, 19 nt, Human
ucucaccuaaaaaaagaga

SEQ ID NO: 3724333 - RNA, 14 nt, Human
ucucaccuccugcu

SEQ ID NO: 3724334 - RNA, 17 nt, Human
ucucaccuccugcuggg

SEQ ID NO: 3724335 - RNA, 14 nt, Human
ucucaccucugugc

SEQ ID NO: 3724336 - RNA, 19 nt, Human
ucucaccucugugccucug

SEQ ID NO: 3724337 - RNA, 13 nt, Human
ucucaccuggacu

SEQ ID NO: 3724338 - RNA, 24 nt, Human
ucucaccuggacuuaagcaucugg

SEQ ID NO: 3724339 - RNA, 12 nt, Human
ucucaccuggcc

SEQ ID NO: 3724340 - RNA, 22 nt, Human
ucucacgggcaugggcacuccc

SEQ ID NO: 3724341 - RNA, 17 nt, Human
ucucacuaaacuuuacc

SEQ ID NO: 3724342 - RNA, 20 nt, Human
ucucacuauguugcccaggc

SEQ ID NO: 3724343 - RNA, 18 nt, Human
ucucacuccccagccugg

SEQ ID NO: 3724344 - RNA, 12 nt, Human
ucucacuccccu

SEQ ID NO: 3724345 - RNA, 13 nt, Human
ucucacuccccuc

SEQ ID NO: 3724346 - RNA, 18 nt, Human
ucucacucccuucuccuu

SEQ ID NO: 3724347 - RNA, 13 nt, Human
ucucacuccuuga

SEQ ID NO: 3724348 - RNA, 20 nt, Human
ucucacucuaggaguucagu

SEQ ID NO: 3724349 - RNA, 22 nt, Human
ucucacugagaagauugugaau

SEQ ID NO: 3724350 - RNA, 20 nt, Human
ucucacugccaugccagcuu

SEQ ID NO: 3724351 - RNA, 18 nt, Human
ucucacugcuugaacuag

SEQ ID NO: 3724352 - RNA, 20 nt, Human
ucucacugugggaaggccag

SEQ ID NO: 3724353 - RNA, 13 nt, Human
ucucacugugucc

SEQ ID NO: 3724354 - RNA, 14 nt, Human
ucucacuguucccu

SEQ ID NO: 3724355 - RNA, 18 nt, Human
ucucacuguugcccaggc

SEQ ID NO: 3724356 - RNA, 15 nt, Human
ucucacuguuuguuu

SEQ ID NO: 3724357 - RNA, 11 nt, Human
ucucagaaagu

SEQ ID NO: 3724358 - RNA, 21 nt, Human
ucucagaaagugccugacaca

SEQ ID NO: 3724359 - RNA, 14 nt, Human
ucucagaagcacag

SEQ ID NO: 3724360 - RNA, 21 nt, Human
ucucagaaucucaaauaacua

SEQ ID NO: 3724361 - RNA, 16 nt, Human
ucucagaaucuuuccu

SEQ ID NO: 3724362 - RNA, 18 nt, Human
ucucagaaugucauuuug

SEQ ID NO: 3724363 - RNA, 17 nt, Human
ucucagacccuuuagcc

SEQ ID NO: 3724364 - RNA, 19 nt, Human
ucucagaccgucuuccucc

SEQ ID NO: 3724365 - RNA, 20 nt, Human
ucucagagcuacuugggcca

SEQ ID NO: 3724366 - RNA, 20 nt, Human
ucucagauauuuauauuuuu

SEQ ID NO: 3724367 - RNA, 14 nt, Human
ucucagauauuugc

SEQ ID NO: 3724368 - RNA, 17 nt, Human
ucucagauauuugcacc

SEQ ID NO: 3724369 - RNA, 14 nt, Human
ucucagauguuaaa

SEQ ID NO: 3724370 - RNA, 20 nt, Human
ucucagauguuaaaauaaau

SEQ ID NO: 3724371 - RNA, 14 nt, Human
ucucagauuucuga

SEQ ID NO: 3724372 - RNA, 17 nt, Human
ucucagauuucugagga

SEQ ID NO: 3724373 - RNA, 15 nt, Human
ucucagauuuuauua

SEQ ID NO: 3724374 - RNA, 14 nt, Human
ucucagcagagugc

SEQ ID NO: 3724375 - RNA, 13 nt, Human
ucucagcccagaa

SEQ ID NO: 3724376 - RNA, 17 nt, Human
ucucagccccuuucccu

SEQ ID NO: 3724377 - RNA, 12 nt, Human
ucucagcccuca

SEQ ID NO: 3724378 - RNA, 21 nt, Human
ucucagccgcuucugacugcu

SEQ ID NO: 3724379 - RNA, 12 nt, Human
ucucagccuccc

SEQ ID NO: 3724380 - RNA, 15 nt, Human
ucucagcucacugca

SEQ ID NO: 3724381 - RNA, 18 nt, Human
ucucagcucacugcaacc

SEQ ID NO: 3724382 - RNA, 16 nt, Human
ucucagcuccaggugg

SEQ ID NO: 3724383 - RNA, 17 nt, Human
ucucagcucccauuucu

SEQ ID NO: 3724384 - RNA, 18 nt, Human
ucucagcucccauuucua

SEQ ID NO: 3724385 - RNA, 21 nt, Human
ucucagcucccccuguccccu

SEQ ID NO: 3724386 - RNA, 19 nt, Human
ucucagcucuucugacuua

SEQ ID NO: 3724387 - RNA, 12 nt, Human
ucucaggaaauc

SEQ ID NO: 3724388 - RNA, 14 nt, Human
ucucaggaaaucaa

SEQ ID NO: 3724389 - RNA, 21 nt, Human
ucucaggaaaucaaauaugca

SEQ ID NO: 3724390 - RNA, 23 nt, Human
ucucaggaccaaagcuuucaugu

SEQ ID NO: 3724391 - RNA, 21 nt, Human
ucucaggaccuagggauguuc

SEQ ID NO: 3724392 - RNA, 20 nt, Human
ucucaggagcacaggcagcu

SEQ ID NO: 3724393 - RNA, 16 nt, Human
ucucaggagucucugg

SEQ ID NO: 3724394 - RNA, 23 nt, Human
ucucaggauauccuuaucagagc

SEQ ID NO: 3724395 - RNA, 16 nt, Human
ucucaggauccaagcu

SEQ ID NO: 3724396 - RNA, 13 nt, Human
ucucaggcaccag

SEQ ID NO: 3724397 - RNA, 12 nt, Human
ucucaggccaaa

SEQ ID NO: 3724398 - RNA, 13 nt, Human
ucucaggccaaac

SEQ ID NO: 3724399 - RNA, 13 nt, Human
ucucaggccaccu

SEQ ID NO: 3724400 - RNA, 12 nt, Human
ucucaggccagc

SEQ ID NO: 3724401 - RNA, 16 nt, Human
ucucaggccaucauca

SEQ ID NO: 3724402 - RNA, 15 nt, Human
ucucaggcucugccc

SEQ ID NO: 3724403 - RNA, 17 nt, Human
ucucaggcucugcccug

SEQ ID NO: 3724404 - RNA, 20 nt, Human
ucucaggcucugcccugccc

SEQ ID NO: 3724405 - RNA, 14 nt, Human
ucucaggcugccug

SEQ ID NO: 3724406 - RNA, 18 nt, Human
ucucaggcuggugggagg

SEQ ID NO: 3724407 - RNA, 19 nt, Human
ucucaggcuggugggaggg

SEQ ID NO: 3724408 - RNA, 18 nt, Human
ucucagggaagcccagcu

SEQ ID NO: 3724409 - RNA, 19 nt, Human
ucucagggaagcccagcuc

SEQ ID NO: 3724410 - RNA, 20 nt, Human
ucucagggaagcccagcucc

SEQ ID NO: 3724411 - RNA, 14 nt, Human
ucucagggccuggu

SEQ ID NO: 3724412 - RNA, 19 nt, Human
ucucagggccuggucguuu

SEQ ID NO: 3724413 - RNA, 17 nt, Human
ucucagggcuccugccu

SEQ ID NO: 3724414 - RNA, 23 nt, Human
ucucagggcuccugccuucuguc

SEQ ID NO: 3724415 - RNA, 20 nt, Human
ucucagggucucugcugccg

SEQ ID NO: 3724416 - RNA, 17 nt, Human
ucucagggugaggugcu

SEQ ID NO: 3724417 - RNA, 18 nt, Human
ucucagggugucccagac

SEQ ID NO: 3724418 - RNA, 15 nt, Human
ucucaggucccugca

SEQ ID NO: 3724419 - RNA, 12 nt, Human
ucucagguucuc

SEQ ID NO: 3724420 - RNA, 20 nt, Human
ucucagguuuguuuugugaa

SEQ ID NO: 3724421 - RNA, 21 nt, Human
ucucagguuuguuuugugaau

SEQ ID NO: 3724422 - RNA, 20 nt, Human
ucucaguaccccauggagcu

SEQ ID NO: 3724423 - RNA, 19 nt, Human
ucucagucaugcauaaaua

SEQ ID NO: 3724424 - RNA, 21 nt, Human
ucucagucaugcauaaauaug

SEQ ID NO: 3724425 - RNA, 23 nt, Human
ucucaguccaugaagauguagag

SEQ ID NO: 3724426 - RNA, 12 nt, Human
ucucagucucac

SEQ ID NO: 3724427 - RNA, 13 nt, Human
ucucagucucaca

SEQ ID NO: 3724428 - RNA, 15 nt, Human
ucucagucugucacc

SEQ ID NO: 3724429 - RNA, 16 nt, Human
ucucagugaagacuau

SEQ ID NO: 3724430 - RNA, 23 nt, Human
ucucagugccaacuguggcuggu

SEQ ID NO: 3724431 - RNA, 20 nt, Human
ucucaguggcuucaucuguc

SEQ ID NO: 3724432 - RNA, 14 nt, Human
ucucagugucaaug

SEQ ID NO: 3724433 - RNA, 21 nt, Human
ucucagugucaaugcagcccc

SEQ ID NO: 3724434 - RNA, 16 nt, Human
ucucaguuuguguguc

SEQ ID NO: 3724435 - RNA, 18 nt, Human
ucucaguuugugugucuu

SEQ ID NO: 3724436 - RNA, 16 nt, Human
ucucaguuuucauaag

SEQ ID NO: 3724437 - RNA, 13 nt, Human
ucucaguuuuucu

SEQ ID NO: 3724438 - RNA, 18 nt, Human
ucucauaauuccuacagc

SEQ ID NO: 3724439 - RNA, 14 nt, Human
ggccguccucccgg

SEQ ID NO: 3724440 - RNA, 21 nt, Human
ggccgugaaugggugcccaca

SEQ ID NO: 3724441 - RNA, 16 nt, Human
ggccgugacgucuggg

SEQ ID NO: 3724442 - RNA, 21 nt, Human
ggccgugacgucuggguggcc

SEQ ID NO: 3724443 - RNA, 14 nt, Human
ggccgugggccugg

SEQ ID NO: 3724444 - RNA, 16 nt, Human
ggccguugcugacuua

SEQ ID NO: 3724445 - RNA, 13 nt, Human
ggccguuggccac

SEQ ID NO: 3724446 - RNA, 16 nt, Human
ggccuaaaaguaaaca

SEQ ID NO: 3724447 - RNA, 15 nt, Human
ggccuaaccugccga

SEQ ID NO: 3724448 - RNA, 22 nt, Human
ggccuaaccugccgagagucca

SEQ ID NO: 3724449 - RNA, 16 nt, Human
ggccuacaaaucagua

SEQ ID NO: 3724450 - RNA, 16 nt, Human
ggccuaccccgcagac

SEQ ID NO: 3724451 - RNA, 24 nt, Human
ggccuacuagagucugaacagcug

SEQ ID NO: 3724452 - RNA, 17 nt, Human
ggccuacuccugucuuc

SEQ ID NO: 3724453 - RNA, 23 nt, Human
ggccuacuccugucuucugcuuu

SEQ ID NO: 3724454 - RNA, 13 nt, Human
ggccuagacucug

SEQ ID NO: 3724455 - RNA, 22 nt, Human
ggccuagcauacguacacauuu

SEQ ID NO: 3724456 - RNA, 16 nt, Human
ggccuagcccacccug

SEQ ID NO: 3724457 - RNA, 22 nt, Human
ggccuagcccacccugcugccu

SEQ ID NO: 3724458 - RNA, 21 nt, Human
ggccuagcgaucucuccuggc

SEQ ID NO: 3724459 - RNA, 23 nt, Human
ggccuaggaggguccucugagac

SEQ ID NO: 3724460 - RNA, 20 nt, Human
ggccuauaaugaagcuuuau

SEQ ID NO: 3724461 - RNA, 16 nt, Human
ggccuaucagugugcc

SEQ ID NO: 3724462 - RNA, 18 nt, Human
ggccuaucagugugcccc

SEQ ID NO: 3724463 - RNA, 20 nt, Human
ggccuaucagugugcccccc

SEQ ID NO: 3724464 - RNA, 16 nt, Human
ggccuaucuaaacugg

SEQ ID NO: 3724465 - RNA, 15 nt, Human
ggccuauggagagcc

SEQ ID NO: 3724466 - RNA, 16 nt, Human
ggccuauggagagccc

SEQ ID NO: 3724467 - RNA, 18 nt, Human
ggccuauggagagcccug

SEQ ID NO: 3724468 - RNA, 21 nt, Human
ggccuauggagagcccuggga

SEQ ID NO: 3724469 - RNA, 19 nt, Human
ggccucaaaggcccgcucu

SEQ ID NO: 3724470 - RNA, 19 nt, Human
ggccucaaaugcaccaugu

SEQ ID NO: 3724471 - RNA, 18 nt, Human
ggccucaacccucccuca

SEQ ID NO: 3724472 - RNA, 22 nt, Human
ggccucaacccucccucagccc

SEQ ID NO: 3724473 - RNA, 19 nt, Human
ggccucacuaggcuucugg

SEQ ID NO: 3724474 - RNA, 15 nt, Human
ggccucacuccagga

SEQ ID NO: 3724475 - RNA, 18 nt, Human
ggccucagacugcaccca

SEQ ID NO: 3724476 - RNA, 19 nt, Human
ggccucagacugcacccag

SEQ ID NO: 3724477 - RNA, 19 nt, Human
ggccucagcucaaugcagu

SEQ ID NO: 3724478 - RNA, 18 nt, Human
ggccucagcucccacaag

SEQ ID NO: 3724479 - RNA, 22 nt, Human
ggccucagcugccucacuuccu

SEQ ID NO: 3724480 - RNA, 13 nt, Human
ggccucaggugcu

SEQ ID NO: 3724481 - RNA, 19 nt, Human
ggccucauguggcuggaag

SEQ ID NO: 3724482 - RNA, 20 nt, Human
ggccuccagcccucucacug

SEQ ID NO: 3724483 - RNA, 12 nt, Human
ggccuccagcuc

SEQ ID NO: 3724484 - RNA, 13 nt, Human
ggccuccagcuca

SEQ ID NO: 3724485 - RNA, 14 nt, Human
ggccuccagcucag

SEQ ID NO: 3724486 - RNA, 16 nt, Human
ggccuccagcucagca

SEQ ID NO: 3724487 - RNA, 13 nt, Human
ggccuccaggccc

SEQ ID NO: 3724488 - RNA, 14 nt, Human
ggccuccaggcccg

SEQ ID NO: 3724489 - RNA, 17 nt, Human
ggccuccaggcccgucu

SEQ ID NO: 3724490 - RNA, 13 nt, Human
ggccuccauccug

SEQ ID NO: 3724491 - RNA, 16 nt, Human
ggccuccauccugagg

SEQ ID NO: 3724492 - RNA, 18 nt, Human
ggccuccaugggccccag

SEQ ID NO: 3724493 - RNA, 19 nt, Human
ggccuccaugggccccagg

SEQ ID NO: 3724494 - RNA, 21 nt, Human
ggccuccauuccuggagcccg

SEQ ID NO: 3724495 - RNA, 22 nt, Human
ggccuccauuccuggagcccga

SEQ ID NO: 3724496 - RNA, 13 nt, Human
ggccucccaacuc

SEQ ID NO: 3724497 - RNA, 14 nt, Human
ggccucccaacuca

SEQ ID NO: 3724498 - RNA, 19 nt, Human
ggccucccaacucacccca

SEQ ID NO: 3724499 - RNA, 16 nt, Human
ggccucccacagacuc

SEQ ID NO: 3724500 - RNA, 13 nt, Human
ggccucccacagu

SEQ ID NO: 3724501 - RNA, 14 nt, Human
ggccucccacccga

SEQ ID NO: 3724502 - RNA, 20 nt, Human
ggccucccacccgaugcugc

SEQ ID NO: 3724503 - RNA, 21 nt, Human
ggccucccacccgaugcugcu

SEQ ID NO: 3724504 - RNA, 23 nt, Human
ggccucccacccgaugcugcuuu

SEQ ID NO: 3724505 - RNA, 14 nt, Human
ggccucccccacuu

SEQ ID NO: 3724506 - RNA, 17 nt, Human
ggccuccccugccacca

SEQ ID NO: 3724507 - RNA, 15 nt, Human
ggccucccucucucu

SEQ ID NO: 3724508 - RNA, 19 nt, Human
ggccucccugccaguaggg

SEQ ID NO: 3724509 - RNA, 23 nt, Human
ggccuccggcgucagccuccagc

SEQ ID NO: 3724510 - RNA, 21 nt, Human
ggccuccguccaggagccugg

SEQ ID NO: 3724511 - RNA, 22 nt, Human
ggccuccucacaacaugguguc

SEQ ID NO: 3724512 - RNA, 17 nt, Human
ggccuccucccuuagcu

SEQ ID NO: 3724513 - RNA, 15 nt, Human
ggccuccucuaacag

SEQ ID NO: 3724514 - RNA, 23 nt, Human
ggccuccucuaacaggggcuggu

SEQ ID NO: 3724515 - RNA, 21 nt, Human
ggccuccucuucaccccggca

SEQ ID NO: 3724516 - RNA, 14 nt, Human
ggccucgccuggcc

SEQ ID NO: 3724517 - RNA, 15 nt, Human
ggccucggagccuca

SEQ ID NO: 3724518 - RNA, 16 nt, Human
ggccucgggaccucag

SEQ ID NO: 3724519 - RNA, 18 nt, Human
ggccucuaaccccaggcc

SEQ ID NO: 3724520 - RNA, 15 nt, Human
ggccucuccagccuc

SEQ ID NO: 3724521 - RNA, 20 nt, Human
ggccucuccauuugcucuuc

SEQ ID NO: 3724522 - RNA, 21 nt, Human
ggccucucuggccucccaccc

SEQ ID NO: 3724523 - RNA, 23 nt, Human
ggccucugccccgucucaugagg

SEQ ID NO: 3724524 - RNA, 20 nt, Human
ggccucugcgagugguuucu

SEQ ID NO: 3724525 - RNA, 14 nt, Human
ggccucuguguccu

SEQ ID NO: 3724526 - RNA, 20 nt, Human
ggccucuguguccuucccug

SEQ ID NO: 3724527 - RNA, 19 nt, Human
ggccucuuccgugacguca

SEQ ID NO: 3724528 - RNA, 18 nt, Human
ggccucuucucucagacc

SEQ ID NO: 3724529 - RNA, 22 nt, Human
ggccucuugagcaguggcuggu

SEQ ID NO: 3724530 - RNA, 21 nt, Human
ggccucuuucagugaauuugu

SEQ ID NO: 3724531 - RNA, 23 nt, Human
ggccugaaagaggcugaggccug

SEQ ID NO: 3724532 - RNA, 16 nt, Human
ggccugaaaggagccc

SEQ ID NO: 3724533 - RNA, 18 nt, Human
ggccugaaccacaggaga

SEQ ID NO: 3724534 - RNA, 15 nt, Human
ggccugaagccagcu

SEQ ID NO: 3724535 - RNA, 18 nt, Human
ggccugaagccagcugcc

SEQ ID NO: 3724536 - RNA, 19 nt, Human
ggccugaagccagcugccc

SEQ ID NO: 3724537 - RNA, 23 nt, Human
ggccugaaucaugagccugcugg

SEQ ID NO: 3724538 - RNA, 23 nt, Human
ggccugaaugcuuauagguggcc

SEQ ID NO: 3724539 - RNA, 17 nt, Human
ggccugacugccaagcc

SEQ ID NO: 3724540 - RNA, 14 nt, Human
ggccugacugcuca

SEQ ID NO: 3724541 - RNA, 20 nt, Human
ggccugagacccaggacucc

SEQ ID NO: 3724542 - RNA, 18 nt, Human
ggccugagaggggaagcg

SEQ ID NO: 3724543 - RNA, 20 nt, Human
ggccugagauuucaucugcu

SEQ ID NO: 3724544 - RNA, 13 nt, Human
ggccugaggauga

SEQ ID NO: 3724545 - RNA, 15 nt, Human
ggccugaucagacca

SEQ ID NO: 3724546 - RNA, 18 nt, Human
ggccugaucagaccacgg

SEQ ID NO: 3724547 - RNA, 18 nt, Human
ggccugaugacagagcga

SEQ ID NO: 3724548 - RNA, 19 nt, Human
ggccugaugggguggaagg

SEQ ID NO: 3724549 - RNA, 14 nt, Human
ggccugcaaacugg

SEQ ID NO: 3724550 - RNA, 18 nt, Human
ggccugcaaacugggaac

SEQ ID NO: 3724551 - RNA, 13 nt, Human
ggccugcacacaa

SEQ ID NO: 3724552 - RNA, 14 nt, Human
ggccugccaccugg

SEQ ID NO: 3724553 - RNA, 17 nt, Human
ggccugcccagugcacu

SEQ ID NO: 3724554 - RNA, 12 nt, Human
ggccugccccca

SEQ ID NO: 3724555 - RNA, 14 nt, Human
ggccugccgggcug

SEQ ID NO: 3724556 - RNA, 15 nt, Human
ggccugcuaaggucu

SEQ ID NO: 3724557 - RNA, 16 nt, Human
ggccugcuccagaccu

SEQ ID NO: 3724558 - RNA, 18 nt, Human
ggccugcuccagaccuga

SEQ ID NO: 3724559 - RNA, 13 nt, Human
ggccugcugcuga

SEQ ID NO: 3724560 - RNA, 16 nt, Human
ggccugcugcugagaa

SEQ ID NO: 3724561 - RNA, 18 nt, Human
ggccugcugcugagaacc

SEQ ID NO: 3724562 - RNA, 16 nt, Human
ggccugcuggaggccu

SEQ ID NO: 3724563 - RNA, 17 nt, Human
ggccugcuggaggccuc

SEQ ID NO: 3724564 - RNA, 21 nt, Human
ggccugcugggcucuccaccu

SEQ ID NO: 3724565 - RNA, 23 nt, Human
ggccugcugggcucuccaccuca

SEQ ID NO: 3724566 - RNA, 22 nt, Human
ggccuggaccugccuccugccu

SEQ ID NO: 3724567 - RNA, 18 nt, Human
ggccuggacuuuccugca

SEQ ID NO: 3724568 - RNA, 15 nt, Human
ggccuggagauccuc

SEQ ID NO: 3724569 - RNA, 17 nt, Human
ggccuggagauccuccu

SEQ ID NO: 3724570 - RNA, 18 nt, Human
ggccuggagauccuccug

SEQ ID NO: 3724571 - RNA, 19 nt, Human
ggccuggagauccuccugc

SEQ ID NO: 3724572 - RNA, 20 nt, Human
ggccuggagauccuccugca

SEQ ID NO: 3724573 - RNA, 22 nt, Human
ggccuggagcacaaagacccug

SEQ ID NO: 3724574 - RNA, 15 nt, Human
ggccuggagcaggcc

SEQ ID NO: 3724575 - RNA, 16 nt, Human
ggccuggagcaggccu

SEQ ID NO: 3724576 - RNA, 15 nt, Human
ggccuggcagccgug

SEQ ID NO: 3724577 - RNA, 15 nt, Human
ggccuggccagaugc

SEQ ID NO: 3724578 - RNA, 16 nt, Human
ggccuggccagaugca

SEQ ID NO: 3724579 - RNA, 21 nt, Human
ggccuggccagaugcaccagc

SEQ ID NO: 3724580 - RNA, 16 nt, Human
ggccuggccaggagcu

SEQ ID NO: 3724581 - RNA, 23 nt, Human
ggccuggccaggagcucuucagg

SEQ ID NO: 3724582 - RNA, 17 nt, Human
ggccuggccagggccug

SEQ ID NO: 3724583 - RNA, 13 nt, Human
ggccuggcccugc

SEQ ID NO: 3724584 - RNA, 14 nt, Human
ggccuggcccugcc

SEQ ID NO: 3724585 - RNA, 18 nt, Human
ggccuggcccugcccuga

SEQ ID NO: 3724586 - RNA, 19 nt, Human
ggccuggcccugcccugag

SEQ ID NO: 3724587 - RNA, 15 nt, Human
ggccuggccugagcu

SEQ ID NO: 3724588 - RNA, 20 nt, Human
ucucauaauuccuacagcac

SEQ ID NO: 3724589 - RNA, 16 nt, Human
ucucauacccucccuc

SEQ ID NO: 3724590 - RNA, 24 nt, Human
ucucauagcauuaacuaaucuauu

SEQ ID NO: 3724591 - RNA, 19 nt, Human
ucucauaggaaaaguacau

SEQ ID NO: 3724592 - RNA, 16 nt, Human
ucucauagguuaaaaa

SEQ ID NO: 3724593 - RNA, 17 nt, Human
ucucauagguuaaaaaa

SEQ ID NO: 3724594 - RNA, 20 nt, Human
ucucauagguugagcaauuu

SEQ ID NO: 3724595 - RNA, 17 nt, Human
ucucaucaacugaauga

SEQ ID NO: 3724596 - RNA, 15 nt, Human
ucucaucacuccccu

SEQ ID NO: 3724597 - RNA, 16 nt, Human
ucucaucacuccccuc

SEQ ID NO: 3724598 - RNA, 10 nt, Human
ucucaucaug

SEQ ID NO: 3724599 - RNA, 10 nt, Human
ucucauccca

SEQ ID NO: 3724600 - RNA, 15 nt, Human
ucucauccccagggg

SEQ ID NO: 3724601 - RNA, 22 nt, Human
ucucauccccaggggucccagc

SEQ ID NO: 3724602 - RNA, 16 nt, Human
ucucauccccaguccc

SEQ ID NO: 3724603 - RNA, 14 nt, Human
ucucauccuccugg

SEQ ID NO: 3724604 - RNA, 15 nt, Human
ucucauccuccugga

SEQ ID NO: 3724605 - RNA, 16 nt, Human
ucucauccuccuggaa

SEQ ID NO: 3724606 - RNA, 16 nt, Human
ucucauccuuuucucc

SEQ ID NO: 3724607 - RNA, 18 nt, Human
ucucauccuuuucuccua

SEQ ID NO: 3724608 - RNA, 13 nt, Human
ucucaucugcacc

SEQ ID NO: 3724609 - RNA, 22 nt, Human
ucucaucugcacccuucuuuuc

SEQ ID NO: 3724610 - RNA, 22 nt, Human
ucucaucuggggagcaggcagc

SEQ ID NO: 3724611 - RNA, 13 nt, Human
ucucaucugugau

SEQ ID NO: 3724612 - RNA, 17 nt, Human
ucucaucuugacagagc

SEQ ID NO: 3724613 - RNA, 22 nt, Human
ucucaucuugacagagccugcc

SEQ ID NO: 3724614 - RNA, 14 nt, Human
ucucaugaaccuca

SEQ ID NO: 3724615 - RNA, 22 nt, Human
ucucaugaaccucaagcugcau

SEQ ID NO: 3724616 - RNA, 18 nt, Human
ucucaugaaucugcaaug

SEQ ID NO: 3724617 - RNA, 20 nt, Human
ucucaugccaguaacaggcu

SEQ ID NO: 3724618 - RNA, 13 nt, Human
ucucaugccucag

SEQ ID NO: 3724619 - RNA, 16 nt, Human
ucucaugcuccuuaau

SEQ ID NO: 3724620 - RNA, 19 nt, Human
ucucaugcugccccugccu

SEQ ID NO: 3724621 - RNA, 22 nt, Human
ucucauggagaagcagaaauac

SEQ ID NO: 3724622 - RNA, 17 nt, Human
ucucauggguggcacuc

SEQ ID NO: 3724623 - RNA, 18 nt, Human
ucucauguaucaucugga

SEQ ID NO: 3724624 - RNA, 15 nt, Human
ucucaugugauccuu

SEQ ID NO: 3724625 - RNA, 19 nt, Human
ucucaugugauccuuuuau

SEQ ID NO: 3724626 - RNA, 21 nt, Human
ucucaugugugcucuucuucu

SEQ ID NO: 3724627 - RNA, 17 nt, Human
ucucauguguuugcaua

SEQ ID NO: 3724628 - RNA, 17 nt, Human
ucucauguuuucaacug

SEQ ID NO: 3724629 - RNA, 16 nt, Human
ucucauuacuuuugaa

SEQ ID NO: 3724630 - RNA, 12 nt, Human
ucucauucagua

SEQ ID NO: 3724631 - RNA, 13 nt, Human
ucucauucaguau

SEQ ID NO: 3724632 - RNA, 17 nt, Human
ucucauucaguauuaaa

SEQ ID NO: 3724633 - RNA, 19 nt, Human
ucucauuccaacagugagu

SEQ ID NO: 3724634 - RNA, 14 nt, Human
ucucauuccguugu

SEQ ID NO: 3724635 - RNA, 20 nt, Human
ucucauuccguugucugugg

SEQ ID NO: 3724636 - RNA, 20 nt, Human
ucucauugaauuauaaaagc

SEQ ID NO: 3724637 - RNA, 23 nt, Human
ucucauuggaaauuuagcauugu

SEQ ID NO: 3724638 - RNA, 24 nt, Human
ucucauuggaaauuuagcauugua

SEQ ID NO: 3724639 - RNA, 19 nt, Human
ucucauuuaagggaaaaau

SEQ ID NO: 3724640 - RNA, 16 nt, Human
ucucauuucaccccuc

SEQ ID NO: 3724641 - RNA, 15 nt, Human
ucucauuuccaagca

SEQ ID NO: 3724642 - RNA, 19 nt, Human
ucucauuugccaauaauaa

SEQ ID NO: 3724643 - RNA, 21 nt, Human
ucuccaaaaaaaaaaaaaaua

SEQ ID NO: 3724644 - RNA, 20 nt, Human
ucuccaaaaaucugccuggg

SEQ ID NO: 3724645 - RNA, 22 nt, Human
ucuccaaaaaucugccuggguu

SEQ ID NO: 3724646 - RNA, 13 nt, Human
ucuccaaaauaaa

SEQ ID NO: 3724647 - RNA, 22 nt, Human
ucuccaaaauaaaacuuuuuaa

SEQ ID NO: 3724648 - RNA, 21 nt, Human
ucuccaaagcuuuccuggaga

SEQ ID NO: 3724649 - RNA, 19 nt, Human
ucuccaaccccccagcacu

SEQ ID NO: 3724650 - RNA, 15 nt, Human
ucuccaaccuggaca

SEQ ID NO: 3724651 - RNA, 17 nt, Human
ucuccaagaccagagau

SEQ ID NO: 3724652 - RNA, 13 nt, Human
ucuccaagcagcu

SEQ ID NO: 3724653 - RNA, 14 nt, Human
ucuccaaggaccag

SEQ ID NO: 3724654 - RNA, 23 nt, Human
ucuccaagggcuucugcacccuc

SEQ ID NO: 3724655 - RNA, 20 nt, Human
ucuccaagugccagaggugg

SEQ ID NO: 3724656 - RNA, 16 nt, Human
ucuccaccaggaaccu

SEQ ID NO: 3724657 - RNA, 23 nt, Human
ucuccaccaucgucuucuuggcc

SEQ ID NO: 3724658 - RNA, 23 nt, Human
ucuccacccucccagaccugccu

SEQ ID NO: 3724659 - RNA, 16 nt, Human
ucuccacccugcucuc

SEQ ID NO: 3724660 - RNA, 16 nt, Human
ucuccaccuaguggcu

SEQ ID NO: 3724661 - RNA, 22 nt, Human
ucuccaccuaguggcuguccag

SEQ ID NO: 3724662 - RNA, 13 nt, Human
ucuccaccucagc

SEQ ID NO: 3724663 - RNA, 18 nt, Human
ucuccaccucagccuugg

SEQ ID NO: 3724664 - RNA, 19 nt, Human
ucuccaccucagccuugga

SEQ ID NO: 3724665 - RNA, 14 nt, Human
ucuccaccugccag

SEQ ID NO: 3724666 - RNA, 16 nt, Human
ucuccaccugccaggg

SEQ ID NO: 3724667 - RNA, 22 nt, Human
ucuccaccugccagggacagag

SEQ ID NO: 3724668 - RNA, 13 nt, Human
ucuccaccugcuc

SEQ ID NO: 3724669 - RNA, 10 nt, Human
ucuccacugu

SEQ ID NO: 3724670 - RNA, 18 nt, Human
ucuccacugugcuuucag

SEQ ID NO: 3724671 - RNA, 15 nt, Human
ucuccacuuucagcu

SEQ ID NO: 3724672 - RNA, 16 nt, Human
ucuccacuuucagcug

SEQ ID NO: 3724673 - RNA, 19 nt, Human
ucuccacuuucagcugucu

SEQ ID NO: 3724674 - RNA, 14 nt, Human
ucuccagauguuuc

SEQ ID NO: 3724675 - RNA, 12 nt, Human
ucuccagccagc

SEQ ID NO: 3724676 - RNA, 16 nt, Human
ucuccagccagcaaug

SEQ ID NO: 3724677 - RNA, 13 nt, Human
ucuccagcccacg

SEQ ID NO: 3724678 - RNA, 16 nt, Human
ucuccagccucagccu

SEQ ID NO: 3724679 - RNA, 18 nt, Human
ucuccagccucagcucuc

SEQ ID NO: 3724680 - RNA, 21 nt, Human
ucuccagccugggaggcacag

SEQ ID NO: 3724681 - RNA, 23 nt, Human
ucuccagccugggaggcacagca

SEQ ID NO: 3724682 - RNA, 16 nt, Human
ucuccagcggcccugu

SEQ ID NO: 3724683 - RNA, 21 nt, Human
ucuccagcgucagcugcuccc

SEQ ID NO: 3724684 - RNA, 22 nt, Human
ucuccagcucagaacccagggc

SEQ ID NO: 3724685 - RNA, 14 nt, Human
ucuccagcuccaag

SEQ ID NO: 3724686 - RNA, 11 nt, Human
ucuccagcugg

SEQ ID NO: 3724687 - RNA, 19 nt, Human
ucuccagcugggcucugca

SEQ ID NO: 3724688 - RNA, 18 nt, Human
ucuccaggaaggcggggc

SEQ ID NO: 3724689 - RNA, 13 nt, Human
ucuccaggaccaa

SEQ ID NO: 3724690 - RNA, 19 nt, Human
ucuccaggauugaagagca

SEQ ID NO: 3724691 - RNA, 16 nt, Human
ucuccaggcuguaucc

SEQ ID NO: 3724692 - RNA, 20 nt, Human
ucuccagggaguccccuccc

SEQ ID NO: 3724693 - RNA, 21 nt, Human
ucuccagggaguccccucccc

SEQ ID NO: 3724694 - RNA, 17 nt, Human
ucuccaggggcugcuuc

SEQ ID NO: 3724695 - RNA, 20 nt, Human
ucuccaggggcugcuuccuc

SEQ ID NO: 3724696 - RNA, 15 nt, Human
ucuccagugcaccug

SEQ ID NO: 3724697 - RNA, 17 nt, Human
ucuccagugguugcugu

SEQ ID NO: 3724698 - RNA, 18 nt, Human
ucuccaguuugcaccugu

SEQ ID NO: 3724699 - RNA, 21 nt, Human
ucuccauaaacaugaaaacac

SEQ ID NO: 3724700 - RNA, 18 nt, Human
ucuccauaaccccacccu

SEQ ID NO: 3724701 - RNA, 20 nt, Human
ucuccaucacccucuuccug

SEQ ID NO: 3724702 - RNA, 13 nt, Human
ucuccaucagcug

SEQ ID NO: 3724703 - RNA, 19 nt, Human
ucuccauccacaugggagc

SEQ ID NO: 3724704 - RNA, 18 nt, Human
ucuccaucucucuggccc

SEQ ID NO: 3724705 - RNA, 15 nt, Human
ucuccauggccaccu

SEQ ID NO: 3724706 - RNA, 14 nt, Human
ucuccauggcccug

SEQ ID NO: 3724707 - RNA, 18 nt, Human
ucuccauggcccugcaaa

SEQ ID NO: 3724708 - RNA, 24 nt, Human
ucuccauggcccugccaugcucuc

SEQ ID NO: 3724709 - RNA, 19 nt, Human
ucuccauggcuuccuccuc

SEQ ID NO: 3724710 - RNA, 16 nt, Human
ucuccauucugcuccu

SEQ ID NO: 3724711 - RNA, 18 nt, Human
ucuccauucugcuccuuc

SEQ ID NO: 3724712 - RNA, 12 nt, Human
ucuccauuuaau

SEQ ID NO: 3724713 - RNA, 16 nt, Human
ucuccauuuaauaauu

SEQ ID NO: 3724714 - RNA, 13 nt, Human
ucuccauuugcuc

SEQ ID NO: 3724715 - RNA, 16 nt, Human
ucuccauuugcucuuc

SEQ ID NO: 3724716 - RNA, 19 nt, Human
ucucccaacucuugcacag

SEQ ID NO: 3724717 - RNA, 22 nt, Human
ucucccaagcuaucuaaaguuu

SEQ ID NO: 3724718 - RNA, 12 nt, Human
ucucccaaggcu

SEQ ID NO: 3724719 - RNA, 14 nt, Human
ucucccacaugcca

SEQ ID NO: 3724720 - RNA, 15 nt, Human
ucucccaccccugcc

SEQ ID NO: 3724721 - RNA, 17 nt, Human
ucucccacccucuuccu

SEQ ID NO: 3724722 - RNA, 14 nt, Human
ucucccacccugua

SEQ ID NO: 3724723 - RNA, 14 nt, Human
ucucccaccuagca

SEQ ID NO: 3724724 - RNA, 14 nt, Human
ucucccacguggga

SEQ ID NO: 3724725 - RNA, 15 nt, Human
ucucccacgugggag

SEQ ID NO: 3724726 - RNA, 16 nt, Human
ucucccacucuccuag

SEQ ID NO: 3724727 - RNA, 18 nt, Human
ucucccagauaaugugaa

SEQ ID NO: 3724728 - RNA, 11 nt, Human
ucucccaggaa

SEQ ID NO: 3724729 - RNA, 13 nt, Human
ucucccaggaagc

SEQ ID NO: 3724730 - RNA, 13 nt, Human
ucucccaggcagg

SEQ ID NO: 3724731 - RNA, 12 nt, Human
ucucccaggggc

SEQ ID NO: 3724732 - RNA, 18 nt, Human
ucucccagguaccagcug

SEQ ID NO: 3724733 - RNA, 19 nt, Human
ucucccagguaccagcugc

SEQ ID NO: 3724734 - RNA, 19 nt, Human
ucucccagucuacccagag

SEQ ID NO: 3724735 - RNA, 12 nt, Human
ucucccaucccc

SEQ ID NO: 3724736 - RNA, 15 nt, Human
ucucccaucccccug

SEQ ID NO: 3724737 - RNA, 21 nt, Human
ucucccaucuuaacucuuugc

SEQ ID NO: 3724738 - RNA, 13 nt, Human
ucugucagucaca

SEQ ID NO: 3724739 - RNA, 18 nt, Human
ucugucauaucuucacaa

SEQ ID NO: 3724740 - RNA, 15 nt, Human
ucugucauuugagca

SEQ ID NO: 3724741 - RNA, 17 nt, Human
ucuguccaaaggaggcu

SEQ ID NO: 3724742 - RNA, 22 nt, Human
ucuguccaaaggaggcuggcag

SEQ ID NO: 3724743 - RNA, 19 nt, Human
ucuguccagggcccugagc

SEQ ID NO: 3724744 - RNA, 15 nt, Human
ucuguccaucugccc

SEQ ID NO: 3724745 - RNA, 21 nt, Human
ucugucccacuuggcaucagc

SEQ ID NO: 3724746 - RNA, 17 nt, Human
ucugucccauucccugg

SEQ ID NO: 3724747 - RNA, 16 nt, Human
ucuguccccagccugg

SEQ ID NO: 3724748 - RNA, 22 nt, Human
ucugucccccuuuagaucucug

SEQ ID NO: 3724749 - RNA, 19 nt, Human
ucugucccgggguccugug

SEQ ID NO: 3724750 - RNA, 14 nt, Human
ucugucccucacag

SEQ ID NO: 3724751 - RNA, 16 nt, Human
ucugucccuugccccc

SEQ ID NO: 3724752 - RNA, 15 nt, Human
ucugucccuuggagc

SEQ ID NO: 3724753 - RNA, 20 nt, Human
ucuguccguucacaugugug

SEQ ID NO: 3724754 - RNA, 23 nt, Human
ucuguccucagccuugccagaga

SEQ ID NO: 3724755 - RNA, 18 nt, Human
ucuguccugaaggccuga

SEQ ID NO: 3724756 - RNA, 14 nt, Human
ucuguccuucagau

SEQ ID NO: 3724757 - RNA, 20 nt, Human
ucuguccuucagauggaaac

SEQ ID NO: 3724758 - RNA, 15 nt, Human
ucuguccuugaagga

SEQ ID NO: 3724759 - RNA, 19 nt, Human
ucuguccuuuuggcacuga

SEQ ID NO: 3724760 - RNA, 14 nt, Human
ucugucgcccaguc

SEQ ID NO: 3724761 - RNA, 17 nt, Human
ucugucgccuuagcaug

SEQ ID NO: 3724762 - RNA, 19 nt, Human
ucugucgccuuagcauguu

SEQ ID NO: 3724763 - RNA, 22 nt, Human
ucugucgccuuagcauguuugc

SEQ ID NO: 3724764 - RNA, 16 nt, Human
ucugucuaaaaaccag

SEQ ID NO: 3724765 - RNA, 23 nt, Human
ucugucuagcaugccaacaagaa

SEQ ID NO: 3724766 - RNA, 21 nt, Human
ucugucucaaaaaauaaaaau

SEQ ID NO: 3724767 - RNA, 19 nt, Human
ucugucucagacuuuugua

SEQ ID NO: 3724768 - RNA, 13 nt, Human
ucugucucaucca

SEQ ID NO: 3724769 - RNA, 18 nt, Human
ucugucucauccuccugg

SEQ ID NO: 3724770 - RNA, 17 nt, Human
ucugucucugccucccu

SEQ ID NO: 3724771 - RNA, 9 nt, Human
ucugucugc

SEQ ID NO: 3724772 - RNA, 13 nt, Human
ucugucugcuggu

SEQ ID NO: 3724773 - RNA, 17 nt, Human
ucugucugguggccccg

SEQ ID NO: 3724774 - RNA, 16 nt, Human
ucugucugucccaaag

SEQ ID NO: 3724775 - RNA, 12 nt, Human
ucugucuucaca

SEQ ID NO: 3724776 - RNA, 12 nt, Human
ucugucuuccuu

SEQ ID NO: 3724777 - RNA, 13 nt, Human
ucugucuucugua

SEQ ID NO: 3724778 - RNA, 14 nt, Human
ucugucuucuguau

SEQ ID NO: 3724779 - RNA, 18 nt, Human
ucugucuucuguauauaa

SEQ ID NO: 3724780 - RNA, 14 nt, Human
ucugucuuguaaua

SEQ ID NO: 3724781 - RNA, 19 nt, Human
ucugucuuguaauauuuug

SEQ ID NO: 3724782 - RNA, 12 nt, Human
ucugucuuucca

SEQ ID NO: 3724783 - RNA, 16 nt, Human
ucugucuuuccacucu

SEQ ID NO: 3724784 - RNA, 14 nt, Human
ucugugaaaccugu

SEQ ID NO: 3724785 - RNA, 22 nt, Human
ucugugaaaggaaagagggagg

SEQ ID NO: 3724786 - RNA, 20 nt, Human
ucugugaaaugcuggcauuu

SEQ ID NO: 3724787 - RNA, 21 nt, Human
ucugugaacgauuuagaaaga

SEQ ID NO: 3724788 - RNA, 14 nt, Human
ucugugaacuugaa

SEQ ID NO: 3724789 - RNA, 18 nt, Human
ucugugaacuugaaauuu

SEQ ID NO: 3724790 - RNA, 20 nt, Human
ucugugaaguaguucuguuu

SEQ ID NO: 3724791 - RNA, 20 nt, Human
ucugugaagugagaccuucc

SEQ ID NO: 3724792 - RNA, 12 nt, Human
ucugugaauaag

SEQ ID NO: 3724793 - RNA, 18 nt, Human
ucugugaauugagcugca

SEQ ID NO: 3724794 - RNA, 23 nt, Human
ucugugacccacuucucaucaca

SEQ ID NO: 3724795 - RNA, 14 nt, Human
ucugugaccucagg

SEQ ID NO: 3724796 - RNA, 15 nt, Human
ucugugaccucaggc

SEQ ID NO: 3724797 - RNA, 20 nt, Human
ucugugagaagguuuauugu

SEQ ID NO: 3724798 - RNA, 23 nt, Human
ucugugagaugcuagaacucccu

SEQ ID NO: 3724799 - RNA, 19 nt, Human
ucugugagauggcuggcug

SEQ ID NO: 3724800 - RNA, 20 nt, Human
ucugugagcaucacaguuuu

SEQ ID NO: 3724801 - RNA, 14 nt, Human
ucugugaucauuua

SEQ ID NO: 3724802 - RNA, 20 nt, Human
ucugugaucugggucucuaa

SEQ ID NO: 3724803 - RNA, 15 nt, Human
ucugugaucuuuuaa

SEQ ID NO: 3724804 - RNA, 13 nt, Human
ucugugcaccugg

SEQ ID NO: 3724805 - RNA, 23 nt, Human
ucugugccagagccuggggcucu

SEQ ID NO: 3724806 - RNA, 16 nt, Human
ucugugcccaugggca

SEQ ID NO: 3724807 - RNA, 17 nt, Human
ucugugccccaugccug

SEQ ID NO: 3724808 - RNA, 17 nt, Human
ucugugccugaauauuu

SEQ ID NO: 3724809 - RNA, 21 nt, Human
ucugugccuggagcuccuggg

SEQ ID NO: 3724810 - RNA, 22 nt, Human
ucugugccuucuuuugauuaug

SEQ ID NO: 3724811 - RNA, 16 nt, Human
ucugugcgugaaacac

SEQ ID NO: 3724812 - RNA, 19 nt, Human
ucugugcugacccuccugu

SEQ ID NO: 3724813 - RNA, 13 nt, Human
ucugugcuggcca

SEQ ID NO: 3724814 - RNA, 12 nt, Human
ucugugcugugu

SEQ ID NO: 3724815 - RNA, 14 nt, Human
ucugugcuguuuca

SEQ ID NO: 3724816 - RNA, 14 nt, Human
ucuguggaaagugu

SEQ ID NO: 3724817 - RNA, 15 nt, Human
ucuguggaaagugua

SEQ ID NO: 3724818 - RNA, 16 nt, Human
ucuguggaaaguguaa

SEQ ID NO: 3724819 - RNA, 22 nt, Human
ucuguggaccacugcaugagcu

SEQ ID NO: 3724820 - RNA, 21 nt, Human
ucuguggcuucccaugucuuu

SEQ ID NO: 3724821 - RNA, 23 nt, Human
ucugugggcuacaugcugggguc

SEQ ID NO: 3724822 - RNA, 19 nt, Human
ucugugggcugcacucugu

SEQ ID NO: 3724823 - RNA, 14 nt, Human
ucuguggggacucc

SEQ ID NO: 3724824 - RNA, 22 nt, Human
ucuguggguccgauaauaucuu

SEQ ID NO: 3724825 - RNA, 22 nt, Human
ucugugggugauggggaggggc

SEQ ID NO: 3724826 - RNA, 18 nt, Human
ucugugguuccucugcuc

SEQ ID NO: 3724827 - RNA, 19 nt, Human
ucugugguuuuccccuccc

SEQ ID NO: 3724828 - RNA, 20 nt, Human
ucugugguuuuccccucccu

SEQ ID NO: 3724829 - RNA, 18 nt, Human
ucuguguauauuauuugg

SEQ ID NO: 3724830 - RNA, 15 nt, Human
ucugugucacuggcu

SEQ ID NO: 3724831 - RNA, 17 nt, Human
ucugugucacuggcugc

SEQ ID NO: 3724832 - RNA, 15 nt, Human
ucugugucagccugu

SEQ ID NO: 3724833 - RNA, 17 nt, Human
ucugugucagguggggc

SEQ ID NO: 3724834 - RNA, 20 nt, Human
ucugugucagguggggcagc

SEQ ID NO: 3724835 - RNA, 17 nt, Human
ucugugucuaagauucu

SEQ ID NO: 3724836 - RNA, 18 nt, Human
ucugugucuaagauucua

SEQ ID NO: 3724837 - RNA, 20 nt, Human
ucugugucuaagauucuaga

SEQ ID NO: 3724838 - RNA, 12 nt, Human
ucugugucucuu

SEQ ID NO: 3724839 - RNA, 21 nt, Human
ucugugucuuucacagcuccu

SEQ ID NO: 3724840 - RNA, 13 nt, Human
ucugugugaaaau

SEQ ID NO: 3724841 - RNA, 15 nt, Human
ucugugugaaugugg

SEQ ID NO: 3724842 - RNA, 18 nt, Human
ucugugugaugaacuuuc

SEQ ID NO: 3724843 - RNA, 20 nt, Human
ucugugugaugaacuuucuc

SEQ ID NO: 3724844 - RNA, 22 nt, Human
ucugugugcaagugugugcaca

SEQ ID NO: 3724845 - RNA, 15 nt, Human
ucugugugucaguuu

SEQ ID NO: 3724846 - RNA, 18 nt, Human
ucugugugugaccccucc

SEQ ID NO: 3724847 - RNA, 11 nt, Human
ucugugugugu

SEQ ID NO: 3724848 - RNA, 18 nt, Human
ucuguguguguguaugug

SEQ ID NO: 3724849 - RNA, 22 nt, Human
ucuguguguguguauguggggg

SEQ ID NO: 3724850 - RNA, 12 nt, Human
ucuguguguucc

SEQ ID NO: 3724851 - RNA, 14 nt, Human
ucuguguguuccug

SEQ ID NO: 3724852 - RNA, 15 nt, Human
ucuguguguuuaugu

SEQ ID NO: 3724853 - RNA, 16 nt, Human
ucuguguguuuaugug

SEQ ID NO: 3724854 - RNA, 14 nt, Human
ucuguguugccaag

SEQ ID NO: 3724855 - RNA, 21 nt, Human
ucuguguuggcccaagcucuu

SEQ ID NO: 3724856 - RNA, 17 nt, Human
ucuguguuuaauuucuu

SEQ ID NO: 3724857 - RNA, 22 nt, Human
ucuguguuuaauuucuucaaaa

SEQ ID NO: 3724858 - RNA, 13 nt, Human
ucuguguuuauaa

SEQ ID NO: 3724859 - RNA, 18 nt, Human
ucuguguuuugaaagaau

SEQ ID NO: 3724860 - RNA, 15 nt, Human
ucuguuaaaaucuau

SEQ ID NO: 3724861 - RNA, 21 nt, Human
ucuguuaacugaauaccacuc

SEQ ID NO: 3724862 - RNA, 12 nt, Human
ucuguuacaaaa

SEQ ID NO: 3724863 - RNA, 13 nt, Human
ucuguuacccagg

SEQ ID NO: 3724864 - RNA, 13 nt, Human
ucuguuagaugcu

SEQ ID NO: 3724865 - RNA, 20 nt, Human
ucuguuagcuggguuuacau

SEQ ID NO: 3724866 - RNA, 22 nt, Human
ucuguuauagguccuuuagaaa

SEQ ID NO: 3724867 - RNA, 15 nt, Human
ucuguuauauaaaug

SEQ ID NO: 3724868 - RNA, 19 nt, Human
ucuguuauauccccugcua

SEQ ID NO: 3724869 - RNA, 18 nt, Human
ucuguuauuuagacucau

SEQ ID NO: 3724870 - RNA, 20 nt, Human
ucuguucagcguuuugcaag

SEQ ID NO: 3724871 - RNA, 22 nt, Human
ucuguucaggaaguccuuaucu

SEQ ID NO: 3724872 - RNA, 17 nt, Human
ucuguuccaaauucagu

SEQ ID NO: 3724873 - RNA, 22 nt, Human
ucuguuccaaauucaguuucau

SEQ ID NO: 3724874 - RNA, 20 nt, Human
ucuguuccccauggccacuu

SEQ ID NO: 3724875 - RNA, 13 nt, Human
ucuguucccccuu

SEQ ID NO: 3724876 - RNA, 21 nt, Human
ucuguucuacccguuccaaaa

SEQ ID NO: 3724877 - RNA, 15 nt, Human
ucuguucuaguuuuu

SEQ ID NO: 3724878 - RNA, 12 nt, Human
ucuguucugugg

SEQ ID NO: 3724879 - RNA, 15 nt, Human
ucuguucuuccucag

SEQ ID NO: 3724880 - RNA, 17 nt, Human
ucuguucuuccucagcc

SEQ ID NO: 3724881 - RNA, 19 nt, Human
ucuguucuuccucagccag

SEQ ID NO: 3724882 - RNA, 14 nt, Human
ucuguucuugcuac

SEQ ID NO: 3724883 - RNA, 17 nt, Human
ucuguugauaaauccau

SEQ ID NO: 3724884 - RNA, 12 nt, Human
ucuguugcaaac

SEQ ID NO: 3724885 - RNA, 22 nt, Human
ucuguugccacccaggugaugu

SEQ ID NO: 3724886 - RNA, 13 nt, Human
ucuguugcccagg

SEQ ID NO: 3724887 - RNA, 15 nt, Human
ucuguugcugccuca

SEQ ID NO: 3724888 - RNA, 20 nt, Human
ucucccauggagccccagcc

SEQ ID NO: 3724889 - RNA, 22 nt, Human
ucucccauggagccccagcccc

SEQ ID NO: 3724890 - RNA, 22 nt, Human
ucucccauggcuuaaugcuucu

SEQ ID NO: 3724891 - RNA, 22 nt, Human
ucuccccaacccuagguucccu

SEQ ID NO: 3724892 - RNA, 11 nt, Human
ucuccccacac

SEQ ID NO: 3724893 - RNA, 14 nt, Human
ucuccccagcccag

SEQ ID NO: 3724894 - RNA, 17 nt, Human
ucuccccagcccagaga

SEQ ID NO: 3724895 - RNA, 19 nt, Human
ucuccccagcccagagaca

SEQ ID NO: 3724896 - RNA, 18 nt, Human
ucuccccagcucccagga

SEQ ID NO: 3724897 - RNA, 15 nt, Human
ucuccccagguccag

SEQ ID NO: 3724898 - RNA, 20 nt, Human
ucuccccagguccagcucug

SEQ ID NO: 3724899 - RNA, 22 nt, Human
ucuccccagguccagcucugga

SEQ ID NO: 3724900 - RNA, 12 nt, Human
ucucccccaaca

SEQ ID NO: 3724901 - RNA, 12 nt, Human
ucucccccaccc

SEQ ID NO: 3724902 - RNA, 13 nt, Human
ucucccccagccc

SEQ ID NO: 3724903 - RNA, 17 nt, Human
ucucccccagccccauc

SEQ ID NO: 3724904 - RNA, 16 nt, Human
ucuccccccccccucc

SEQ ID NO: 3724905 - RNA, 21 nt, Human
ucucccccccggggcuggguu

SEQ ID NO: 3724906 - RNA, 12 nt, Human
ucucccccuggg

SEQ ID NO: 3724907 - RNA, 18 nt, Human
ucucccccuuaccccaca

SEQ ID NO: 3724908 - RNA, 23 nt, Human
ucuccccucaaagucugcaacuu

SEQ ID NO: 3724909 - RNA, 13 nt, Human
ucuccccucagcu

SEQ ID NO: 3724910 - RNA, 12 nt, Human
ucuccccucuua

SEQ ID NO: 3724911 - RNA, 12 nt, Human
ucuccccugcac

SEQ ID NO: 3724912 - RNA, 15 nt, Human
ucuccccugcacugu

SEQ ID NO: 3724913 - RNA, 21 nt, Human
ucuccccugcacuguaaaaug

SEQ ID NO: 3724914 - RNA, 21 nt, Human
ucuccccugcccccaggacug

SEQ ID NO: 3724915 - RNA, 19 nt, Human
ucuccccugcccccugcag

SEQ ID NO: 3724916 - RNA, 15 nt, Human
ucuccccugcccugc

SEQ ID NO: 3724917 - RNA, 17 nt, Human
ucuccccugcccugcug

SEQ ID NO: 3724918 - RNA, 17 nt, Human
ucucccgccccccacac

SEQ ID NO: 3724919 - RNA, 13 nt, Human
ucucccgcugcug

SEQ ID NO: 3724920 - RNA, 14 nt, Human
ucucccgcugcugc

SEQ ID NO: 3724921 - RNA, 16 nt, Human
ucucccgcugcugcug

SEQ ID NO: 3724922 - RNA, 15 nt, Human
ucucccgguucuucc

SEQ ID NO: 3724923 - RNA, 22 nt, Human
ucucccgucagggcccaagucc

SEQ ID NO: 3724924 - RNA, 21 nt, Human
ucucccuauaaugcuggagcg

SEQ ID NO: 3724925 - RNA, 23 nt, Human
ucucccucacagcacagagaaga

SEQ ID NO: 3724926 - RNA, 18 nt, Human
ucucccucuaggcucugc

SEQ ID NO: 3724927 - RNA, 22 nt, Human
ucucccucuaggcucugccuuc

SEQ ID NO: 3724928 - RNA, 14 nt, Human
ucucccucuggccc

SEQ ID NO: 3724929 - RNA, 15 nt, Human
ucucccucuggcccu

SEQ ID NO: 3724930 - RNA, 13 nt, Human
ucucccugcaugg

SEQ ID NO: 3724931 - RNA, 19 nt, Human
ucucccugcauggcauccu

SEQ ID NO: 3724932 - RNA, 13 nt, Human
ucucccugccgcc

SEQ ID NO: 3724933 - RNA, 15 nt, Human
ucucccugccgccuc

SEQ ID NO: 3724934 - RNA, 15 nt, Human
ucucccugccuccug

SEQ ID NO: 3724935 - RNA, 16 nt, Human
ucucccugccuggccc

SEQ ID NO: 3724936 - RNA, 16 nt, Human
ucucccugcuuugguc

SEQ ID NO: 3724937 - RNA, 21 nt, Human
ucucccuggaucuaccuggag

SEQ ID NO: 3724938 - RNA, 14 nt, Human
ucucccuggcuccc

SEQ ID NO: 3724939 - RNA, 20 nt, Human
ucucccuggcucccuccucc

SEQ ID NO: 3724940 - RNA, 23 nt, Human
ucucccuggcucccuccuccagg

SEQ ID NO: 3724941 - RNA, 14 nt, Human
ucucccuguacagu

SEQ ID NO: 3724942 - RNA, 18 nt, Human
ucucccuguacaguguua

SEQ ID NO: 3724943 - RNA, 16 nt, Human
ucucccuucauccuuc

SEQ ID NO: 3724944 - RNA, 17 nt, Human
ucucccuucccuccucc

SEQ ID NO: 3724945 - RNA, 22 nt, Human
ucucccuucgguggaagagcuc

SEQ ID NO: 3724946 - RNA, 18 nt, Human
ucucccuuggauuguccc

SEQ ID NO: 3724947 - RNA, 14 nt, Human
ucucccuugggcuc

SEQ ID NO: 3724948 - RNA, 15 nt, Human
ucucccuugggcucu

SEQ ID NO: 3724949 - RNA, 20 nt, Human
ucucccuugggcucugauga

SEQ ID NO: 3724950 - RNA, 22 nt, Human
ucucccuugggcucugaugaaa

SEQ ID NO: 3724951 - RNA, 15 nt, Human
ucucccuuuuccaug

SEQ ID NO: 3724952 - RNA, 20 nt, Human
ucuccgaaaugcugucuuuc

SEQ ID NO: 3724953 - RNA, 18 nt, Human
ucuccgccccugagccca

SEQ ID NO: 3724954 - RNA, 19 nt, Human
ucuccgccccugagcccac

SEQ ID NO: 3724955 - RNA, 20 nt, Human
ucuccgccccugagcccacu

SEQ ID NO: 3724956 - RNA, 21 nt, Human
ucuccggcucccagccucagc

SEQ ID NO: 3724957 - RNA, 22 nt, Human
ucuccggcucccagccucagcg

SEQ ID NO: 3724958 - RNA, 16 nt, Human
ucuccggggccauuug

SEQ ID NO: 3724959 - RNA, 16 nt, Human
ucuccguuagcuccug

SEQ ID NO: 3724960 - RNA, 18 nt, Human
ucuccguuagcuccugug

SEQ ID NO: 3724961 - RNA, 14 nt, Human
ucuccuacugagga

SEQ ID NO: 3724962 - RNA, 23 nt, Human
ucuccuagacugacccugaucag

SEQ ID NO: 3724963 - RNA, 19 nt, Human
ucuccuauauauuucuauu

SEQ ID NO: 3724964 - RNA, 23 nt, Human
ucuccuauccugguuuuuguagc

SEQ ID NO: 3724965 - RNA, 14 nt, Human
ucuccucagccucc

SEQ ID NO: 3724966 - RNA, 22 nt, Human
ucuccucagccuccucaucugg

SEQ ID NO: 3724967 - RNA, 10 nt, Human
ucuccucagg

SEQ ID NO: 3724968 - RNA, 23 nt, Human
ucuccuccaagacacuguggacu

SEQ ID NO: 3724969 - RNA, 14 nt, Human
ucuccucccuuccu

SEQ ID NO: 3724970 - RNA, 16 nt, Human
ucuccuccugcccacc

SEQ ID NO: 3724971 - RNA, 21 nt, Human
ucuccucggcccccuccaucg

SEQ ID NO: 3724972 - RNA, 16 nt, Human
ucuccucuccccucua

SEQ ID NO: 3724973 - RNA, 13 nt, Human
ucuccucugcugc

SEQ ID NO: 3724974 - RNA, 14 nt, Human
ucuccucuuaaaaa

SEQ ID NO: 3724975 - RNA, 22 nt, Human
ucuccucuugccacugccucuu

SEQ ID NO: 3724976 - RNA, 15 nt, Human
ucuccucuuguaaau

SEQ ID NO: 3724977 - RNA, 21 nt, Human
ucuccucuuguaaauaaagcc

SEQ ID NO: 3724978 - RNA, 17 nt, Human
ucuccucuuuaaaacaa

SEQ ID NO: 3724979 - RNA, 17 nt, Human
ucuccugaagauacuua

SEQ ID NO: 3724980 - RNA, 15 nt, Human
ucuccugacagaagg

SEQ ID NO: 3724981 - RNA, 17 nt, Human
ucuccugacccaguccc

SEQ ID NO: 3724982 - RNA, 18 nt, Human
ucuccugaggaucagaaa

SEQ ID NO: 3724983 - RNA, 16 nt, Human
ucuccugauuauuuau

SEQ ID NO: 3724984 - RNA, 19 nt, Human
ucuccugccacauuagaac

SEQ ID NO: 3724985 - RNA, 16 nt, Human
ucuccugcccccacac

SEQ ID NO: 3724986 - RNA, 21 nt, Human
ucuccugcccccacaccuggc

SEQ ID NO: 3724987 - RNA, 11 nt, Human
ucuccugccua

SEQ ID NO: 3724988 - RNA, 12 nt, Human
ucuccugccuac

SEQ ID NO: 3724989 - RNA, 15 nt, Human
ucuccugccuacuca

SEQ ID NO: 3724990 - RNA, 15 nt, Human
ucuccugccucagcc

SEQ ID NO: 3724991 - RNA, 19 nt, Human
ucuccugccucagccuccc

SEQ ID NO: 3724992 - RNA, 13 nt, Human
ucuccugccugua

SEQ ID NO: 3724993 - RNA, 16 nt, Human
ucuccugccuugaaaa

SEQ ID NO: 3724994 - RNA, 12 nt, Human
ucuccugccuuu

SEQ ID NO: 3724995 - RNA, 15 nt, Human
ucuccugccuuugcc

SEQ ID NO: 3724996 - RNA, 17 nt, Human
ucuccugccuuugccuc

SEQ ID NO: 3724997 - RNA, 19 nt, Human
ucuccugcguguucucaga

SEQ ID NO: 3724998 - RNA, 14 nt, Human
ucuccugcugcucc

SEQ ID NO: 3724999 - RNA, 17 nt, Human
ucuccugcugcucccuc

SEQ ID NO: 3725000 - RNA, 18 nt, Human
ucuccugcugcucccuca

SEQ ID NO: 3725001 - RNA, 21 nt, Human
ucuccuggaaauauuaagaaa

SEQ ID NO: 3725002 - RNA, 19 nt, Human
ucuccuggaguugcauuga

SEQ ID NO: 3725003 - RNA, 19 nt, Human
ucuccuggccuauccgcug

SEQ ID NO: 3725004 - RNA, 15 nt, Human
ucuccugggcagcug

SEQ ID NO: 3725005 - RNA, 19 nt, Human
ucuccugggcagcugccuc

SEQ ID NO: 3725006 - RNA, 20 nt, Human
ucuccugggcagcugccucc

SEQ ID NO: 3725007 - RNA, 19 nt, Human
ucuccuguaccucuugagc

SEQ ID NO: 3725008 - RNA, 17 nt, Human
ucuccugugcaugggug

SEQ ID NO: 3725009 - RNA, 16 nt, Human
ucuccugugcccacau

SEQ ID NO: 3725010 - RNA, 17 nt, Human
ucuccugugcccacauc

SEQ ID NO: 3725011 - RNA, 19 nt, Human
ucuccuuaagagacaauuu

SEQ ID NO: 3725012 - RNA, 12 nt, Human
ucuccuuaagcu

SEQ ID NO: 3725013 - RNA, 20 nt, Human
ucuccuucaccuuugucccc

SEQ ID NO: 3725014 - RNA, 16 nt, Human
ucuccuuccaacugcu

SEQ ID NO: 3725015 - RNA, 23 nt, Human
ucuccuucguaucccgagucugg

SEQ ID NO: 3725016 - RNA, 14 nt, Human
ucuccuucuuagcu

SEQ ID NO: 3725017 - RNA, 17 nt, Human
ucuccuugauaacagcu

SEQ ID NO: 3725018 - RNA, 14 nt, Human
ucuccuugcaguuc

SEQ ID NO: 3725019 - RNA, 17 nt, Human
ucuccuugcaguucuug

SEQ ID NO: 3725020 - RNA, 15 nt, Human
ucuccuugcuaccca

SEQ ID NO: 3725021 - RNA, 18 nt, Human
ucuccuugcuacccagaa

SEQ ID NO: 3725022 - RNA, 13 nt, Human
ucuccuuguucug

SEQ ID NO: 3725023 - RNA, 18 nt, Human
ucuccuuguucugauaau

SEQ ID NO: 3725024 - RNA, 22 nt, Human
ucuccuuuaauuguaaaguaaa

SEQ ID NO: 3725025 - RNA, 14 nt, Human
ucuccuuucaggga

SEQ ID NO: 3725026 - RNA, 23 nt, Human
ucuccuuugauaaaauaaaugag

SEQ ID NO: 3725027 - RNA, 17 nt, Human
ucuccuuugcacugagg

SEQ ID NO: 3725028 - RNA, 21 nt, Human
ucuccuuugcacugagggcca

SEQ ID NO: 3725029 - RNA, 22 nt, Human
ucuccuuuuacuucacuucaaa

SEQ ID NO: 3725030 - RNA, 19 nt, Human
ucuccuuuuccucucuccc

SEQ ID NO: 3725031 - RNA, 21 nt, Human
ucuccuuuucuuuuguuacug

SEQ ID NO: 3725032 - RNA, 23 nt, Human
ucuccuuuucuuuuguuacuguu

SEQ ID NO: 3725033 - RNA, 23 nt, Human
ucucgaacauggaacucauuccu

SEQ ID NO: 3725034 - RNA, 20 nt, Human
ucucgaacuccuaaccucaa

SEQ ID NO: 3725035 - RNA, 18 nt, Human
ucucgagcgcccugcaga

SEQ ID NO: 3725036 - RNA, 13 nt, Human
ucucgagcuuggg

SEQ ID NO: 3725037 - RNA, 13 nt, Human
ucucgaucuccug

SEQ ID NO: 3725038 - RNA, 18 nt, Human
ucuguuggcaggcuggcc

SEQ ID NO: 3725039 - RNA, 17 nt, Human
ucuguuggccaguguga

SEQ ID NO: 3725040 - RNA, 19 nt, Human
ucuguuggccagugugaca

SEQ ID NO: 3725041 - RNA, 12 nt, Human
ucuguuguaacu

SEQ ID NO: 3725042 - RNA, 15 nt, Human
ucuguuguaacuuau

SEQ ID NO: 3725043 - RNA, 21 nt, Human
ucuguuguaacuuauguagau

SEQ ID NO: 3725044 - RNA, 17 nt, Human
ucuguuguacuauggaa

SEQ ID NO: 3725045 - RNA, 18 nt, Human
ucuguugucaccuucacc

SEQ ID NO: 3725046 - RNA, 14 nt, Human
ucuguugucauugc

SEQ ID NO: 3725047 - RNA, 19 nt, Human
ucuguuguccuccccuugg

SEQ ID NO: 3725048 - RNA, 21 nt, Human
ucuguuguccuccccuugggc

SEQ ID NO: 3725049 - RNA, 23 nt, Human
ucuguugucguaaagauuugggu

SEQ ID NO: 3725050 - RNA, 18 nt, Human
ucuguugugugucaugcc

SEQ ID NO: 3725051 - RNA, 19 nt, Human
ucuguuuaaagcauauaga

SEQ ID NO: 3725052 - RNA, 14 nt, Human
ucuguuuaaagugg

SEQ ID NO: 3725053 - RNA, 14 nt, Human
ucuguuuaagaaaa

SEQ ID NO: 3725054 - RNA, 23 nt, Human
ucuguuuaauacucauccuugua

SEQ ID NO: 3725055 - RNA, 14 nt, Human
ucuguuuacagugu

SEQ ID NO: 3725056 - RNA, 20 nt, Human
ucuguuuauggccacauuua

SEQ ID NO: 3725057 - RNA, 16 nt, Human
ucuguuuccugacauu

SEQ ID NO: 3725058 - RNA, 13 nt, Human
ucuguuucuaguu

SEQ ID NO: 3725059 - RNA, 14 nt, Human
ucuguuugacaaac

SEQ ID NO: 3725060 - RNA, 12 nt, Human
ucuguuuguuaa

SEQ ID NO: 3725061 - RNA, 21 nt, Human
ucuguuuguuucaagaaccug

SEQ ID NO: 3725062 - RNA, 22 nt, Human
ucuguuuuauaauuuugugaag

SEQ ID NO: 3725063 - RNA, 15 nt, Human
ucuguuuuaugacuu

SEQ ID NO: 3725064 - RNA, 16 nt, Human
ucuguuuuaugacuuc

SEQ ID NO: 3725065 - RNA, 17 nt, Human
ucuguuuuccuuucuca

SEQ ID NO: 3725066 - RNA, 17 nt, Human
ucuguuuuguaucuuaa

SEQ ID NO: 3725067 - RNA, 18 nt, Human
ucuguuuuguaucuuaaa

SEQ ID NO: 3725068 - RNA, 19 nt, Human
ucuguuuuguguacuuuua

SEQ ID NO: 3725069 - RNA, 16 nt, Human
ucuguuuuuaaaaauc

SEQ ID NO: 3725070 - RNA, 18 nt, Human
ucuuaaaaaauaaaaacu

SEQ ID NO: 3725071 - RNA, 18 nt, Human
ucuuaaaaaguggaaaaa

SEQ ID NO: 3725072 - RNA, 23 nt, Human
ucuuaaaaccugcuuuucaaugu

SEQ ID NO: 3725073 - RNA, 12 nt, Human
ucuuaaaacucc

SEQ ID NO: 3725074 - RNA, 15 nt, Human
ucuuaaaauaacuua

SEQ ID NO: 3725075 - RNA, 16 nt, Human
ucuuaaacacuugcaa

SEQ ID NO: 3725076 - RNA, 16 nt, Human
ucuuaaacuugugaau

SEQ ID NO: 3725077 - RNA, 19 nt, Human
ucuuaaagaaaacccaccc

SEQ ID NO: 3725078 - RNA, 18 nt, Human
ucuuaaagaaacagcuuu

SEQ ID NO: 3725079 - RNA, 23 nt, Human
ucuuaaagaaacagcuuucaagu

SEQ ID NO: 3725080 - RNA, 16 nt, Human
ucuuaaagcugccugu

SEQ ID NO: 3725081 - RNA, 18 nt, Human
ucuuaaaguauucuucuc

SEQ ID NO: 3725082 - RNA, 22 nt, Human
ucuuaaaguauucuucucuucc

SEQ ID NO: 3725083 - RNA, 21 nt, Human
ucuuaaagugccaguauuuua

SEQ ID NO: 3725084 - RNA, 12 nt, Human
ucuuaaaguuga

SEQ ID NO: 3725085 - RNA, 13 nt, Human
ucuuaaaguugaa

SEQ ID NO: 3725086 - RNA, 19 nt, Human
ucuuaaaguugaauuuauu

SEQ ID NO: 3725087 - RNA, 20 nt, Human
ucuuaaaguugaauuuauug

SEQ ID NO: 3725088 - RNA, 22 nt, Human
ucuuaaaguugaauuuauuggc

SEQ ID NO: 3725089 - RNA, 18 nt, Human
ucuuaaauaagaaacuuu

SEQ ID NO: 3725090 - RNA, 19 nt, Human
ucuuaaauaagaaacuuuu

SEQ ID NO: 3725091 - RNA, 19 nt, Human
ucuuaaauaaugcuucaga

SEQ ID NO: 3725092 - RNA, 14 nt, Human
ucuuaaauuuugug

SEQ ID NO: 3725093 - RNA, 16 nt, Human
ucuuaaccagaucauu

SEQ ID NO: 3725094 - RNA, 22 nt, Human
ucuuaaccagaucauugugaaa

SEQ ID NO: 3725095 - RNA, 23 nt, Human
ucuuaacuucuugcuucuuucua

SEQ ID NO: 3725096 - RNA, 13 nt, Human
ucuuaagaaauaa

SEQ ID NO: 3725097 - RNA, 12 nt, Human
ucuuaagaagac

SEQ ID NO: 3725098 - RNA, 16 nt, Human
ucuuaagacagcaugu

SEQ ID NO: 3725099 - RNA, 22 nt, Human
ucuuaagccaucuugguaaauu

SEQ ID NO: 3725100 - RNA, 20 nt, Human
ucuuaagccuaaaugccuua

SEQ ID NO: 3725101 - RNA, 17 nt, Human
ucuuaaguuucucagcu

SEQ ID NO: 3725102 - RNA, 14 nt, Human
ucuuaauacuguua

SEQ ID NO: 3725103 - RNA, 18 nt, Human
ucuuaauacuguuauucu

SEQ ID NO: 3725104 - RNA, 19 nt, Human
ucuuaauauaacugccuua

SEQ ID NO: 3725105 - RNA, 16 nt, Human
ucuuaauauuaaauau

SEQ ID NO: 3725106 - RNA, 20 nt, Human
ucuuaaucauuuuuuauaua

SEQ ID NO: 3725107 - RNA, 22 nt, Human
ucuuaaucauuuuuuauauaua

SEQ ID NO: 3725108 - RNA, 19 nt, Human
ucuuaaucuuuucacaaau

SEQ ID NO: 3725109 - RNA, 14 nt, Human
ucuuaauguacaua

SEQ ID NO: 3725110 - RNA, 18 nt, Human
ucuuaauguaucaaacug

SEQ ID NO: 3725111 - RNA, 14 nt, Human
ucuuaauuaaaaga

SEQ ID NO: 3725112 - RNA, 15 nt, Human
ucuuaauuaauuuga

SEQ ID NO: 3725113 - RNA, 23 nt, Human
ucuuaauuaauuugauuaacaaa

SEQ ID NO: 3725114 - RNA, 20 nt, Human
ucuuaauuauuauaaaaaua

SEQ ID NO: 3725115 - RNA, 11 nt, Human
ucuuaauugcc

SEQ ID NO: 3725116 - RNA, 17 nt, Human
ucuuaauuuggaaacua

SEQ ID NO: 3725117 - RNA, 18 nt, Human
ucuuaauuuggaaacuaa

SEQ ID NO: 3725118 - RNA, 22 nt, Human
ucuuaauuuggaaacuaauaaa

SEQ ID NO: 3725119 - RNA, 19 nt, Human
ucuuaauuuugguuguauu

SEQ ID NO: 3725120 - RNA, 20 nt, Human
ucuuaauuuugguuguauuc

SEQ ID NO: 3725121 - RNA, 14 nt, Human
ucuuacaaacaugu

SEQ ID NO: 3725122 - RNA, 23 nt, Human
ucuuacacauacaguuuuaugcu

SEQ ID NO: 3725123 - RNA, 17 nt, Human
ucuuacacugccuguau

SEQ ID NO: 3725124 - RNA, 22 nt, Human
ucuuacacugccuguauacuuu

SEQ ID NO: 3725125 - RNA, 19 nt, Human
ucuuacauaaaccauuuuu

SEQ ID NO: 3725126 - RNA, 20 nt, Human
ucuuacccuucugugcccag

SEQ ID NO: 3725127 - RNA, 15 nt, Human
ucuuaccgacaagca

SEQ ID NO: 3725128 - RNA, 18 nt, Human
ucuuacgauggcacccag

SEQ ID NO: 3725129 - RNA, 16 nt, Human
ucuuacuaaaaaguau

SEQ ID NO: 3725130 - RNA, 15 nt, Human
ucuuacuccuccucu

SEQ ID NO: 3725131 - RNA, 16 nt, Human
ucuuacuccuccucuu

SEQ ID NO: 3725132 - RNA, 14 nt, Human
ucuuacucuuuccu

SEQ ID NO: 3725133 - RNA, 20 nt, Human
ucuuacuuauuaucuucagg

SEQ ID NO: 3725134 - RNA, 15 nt, Human
ucuuacuuggaacug

SEQ ID NO: 3725135 - RNA, 19 nt, Human
ucuuacuuuccugaaaaua

SEQ ID NO: 3725136 - RNA, 11 nt, Human
ucuuacuuugu

SEQ ID NO: 3725137 - RNA, 15 nt, Human
ucuuacuuuguaaau

SEQ ID NO: 3725138 - RNA, 22 nt, Human
ucuuagaaaaggugauaaaauc

SEQ ID NO: 3725139 - RNA, 15 nt, Human
ucuuagaaauuuauu

SEQ ID NO: 3725140 - RNA, 16 nt, Human
ucuuagacuuuuccaa

SEQ ID NO: 3725141 - RNA, 16 nt, Human
ucuuagaucauaguuu

SEQ ID NO: 3725142 - RNA, 17 nt, Human
ucuuagaucauaguuuu

SEQ ID NO: 3725143 - RNA, 22 nt, Human
ucuuagaugcaguucugaagaa

SEQ ID NO: 3725144 - RNA, 23 nt, Human
ucuuagaugcaguucugaagaag

SEQ ID NO: 3725145 - RNA, 22 nt, Human
ucuuagauggauucuccacuca

SEQ ID NO: 3725146 - RNA, 13 nt, Human
ucuuagauucuua

SEQ ID NO: 3725147 - RNA, 16 nt, Human
ucuuagcagcuuccag

SEQ ID NO: 3725148 - RNA, 18 nt, Human
ucuuagcagugauuuuua

SEQ ID NO: 3725149 - RNA, 22 nt, Human
ucuuagcauagcuuauuauuga

SEQ ID NO: 3725150 - RNA, 17 nt, Human
ucuuagccuguggcagu

SEQ ID NO: 3725151 - RNA, 21 nt, Human
ucuuagcuaucauugcuuccu

SEQ ID NO: 3725152 - RNA, 13 nt, Human
ucuuagcuccccu

SEQ ID NO: 3725153 - RNA, 23 nt, Human
ucuuagcugucugcucagacaga

SEQ ID NO: 3725154 - RNA, 16 nt, Human
ucuuagcuuuuuaauu

SEQ ID NO: 3725155 - RNA, 22 nt, Human
ucuuagcuuuuuaauuguuguu

SEQ ID NO: 3725156 - RNA, 15 nt, Human
ucuuaggaagagaaa

SEQ ID NO: 3725157 - RNA, 19 nt, Human
ucuuaggagcagagcucug

SEQ ID NO: 3725158 - RNA, 16 nt, Human
ucuuaggcaaucacau

SEQ ID NO: 3725159 - RNA, 19 nt, Human
ucuuaggcaaucacauagu

SEQ ID NO: 3725160 - RNA, 17 nt, Human
ucuuaggggagagcuuu

SEQ ID NO: 3725161 - RNA, 14 nt, Human
ucuuaguagauuuu

SEQ ID NO: 3725162 - RNA, 18 nt, Human
ucuuagugccugagagua

SEQ ID NO: 3725163 - RNA, 14 nt, Human
ucuuaguguaugau

SEQ ID NO: 3725164 - RNA, 21 nt, Human
ucuuaguguugcguccugccu

SEQ ID NO: 3725165 - RNA, 14 nt, Human
ucuuaguuauauag

SEQ ID NO: 3725166 - RNA, 16 nt, Human
ucuuaguucucacugu

SEQ ID NO: 3725167 - RNA, 14 nt, Human
ucuuauaaauauga

SEQ ID NO: 3725168 - RNA, 21 nt, Human
ucuuauaaauaugaagcucac

SEQ ID NO: 3725169 - RNA, 21 nt, Human
ucuuauaauuguucucagaau

SEQ ID NO: 3725170 - RNA, 14 nt, Human
ucuuauaauuuaaa

SEQ ID NO: 3725171 - RNA, 16 nt, Human
ucuuauacgcuuuucu

SEQ ID NO: 3725172 - RNA, 20 nt, Human
ucuuauacgcuuuucuuugu

SEQ ID NO: 3725173 - RNA, 18 nt, Human
ucuuauacuguacaauaa

SEQ ID NO: 3725174 - RNA, 18 nt, Human
ucuuauagcacuuugaaa

SEQ ID NO: 3725175 - RNA, 20 nt, Human
ucuuauauauauuucuuugu

SEQ ID NO: 3725176 - RNA, 21 nt, Human
ucuuaucacaaaaaagaaaau

SEQ ID NO: 3725177 - RNA, 20 nt, Human
ucuuaucauggucucaguca

SEQ ID NO: 3725178 - RNA, 22 nt, Human
ucuuauccaacaucaacaucuu

SEQ ID NO: 3725179 - RNA, 22 nt, Human
ucuuaucucagucaugcauaaa

SEQ ID NO: 3725180 - RNA, 18 nt, Human
ucuuaucugagcugagcc

SEQ ID NO: 3725181 - RNA, 21 nt, Human
ucuuaugcucucacuguuugu

SEQ ID NO: 3725182 - RNA, 15 nt, Human
ucuuaugcuguaccc

SEQ ID NO: 3725183 - RNA, 23 nt, Human
ucuuaugcuguacccaguuucua

SEQ ID NO: 3725184 - RNA, 14 nt, Human
ucuuauggaauuga

SEQ ID NO: 3725185 - RNA, 15 nt, Human
ucuuauggaauugau

SEQ ID NO: 3725186 - RNA, 18 nt, Human
ucuuauggaauugauuug

SEQ ID NO: 3725187 - RNA, 14 nt, Human
ucucgauuuuaucu

SEQ ID NO: 3725188 - RNA, 14 nt, Human
ucucgcacaccucu

SEQ ID NO: 3725189 - RNA, 20 nt, Human
ucucgcuauugucaccaggg

SEQ ID NO: 3725190 - RNA, 17 nt, Human
ucucgcucuguugccca

SEQ ID NO: 3725191 - RNA, 18 nt, Human
ucucgcucuguugcccag

SEQ ID NO: 3725192 - RNA, 21 nt, Human
ucucggaccuuucagcuguga

SEQ ID NO: 3725193 - RNA, 19 nt, Human
ucucggacuaagccuaccu

SEQ ID NO: 3725194 - RNA, 18 nt, Human
ucucggauaguugcuauu

SEQ ID NO: 3725195 - RNA, 23 nt, Human
ucucggauaguugcuauuuuugu

SEQ ID NO: 3725196 - RNA, 15 nt, Human
ucucggcucacugca

SEQ ID NO: 3725197 - RNA, 21 nt, Human
ucucggcuccccauguguccu

SEQ ID NO: 3725198 - RNA, 14 nt, Human
ucucgggagaggau

SEQ ID NO: 3725199 - RNA, 15 nt, Human
ucucgugagucauuu

SEQ ID NO: 3725200 - RNA, 19 nt, Human
ucucgugguaggacuguag

SEQ ID NO: 3725201 - RNA, 21 nt, Human
ucucgugguaggacuguagaa

SEQ ID NO: 3725202 - RNA, 21 nt, Human
ucucuaaagaguuuauuuuaa

SEQ ID NO: 3725203 - RNA, 20 nt, Human
ucucuaacaguggacaaagu

SEQ ID NO: 3725204 - RNA, 15 nt, Human
ucucuaaccuccuuu

SEQ ID NO: 3725205 - RNA, 18 nt, Human
ucucuaacuuauuuuauu

SEQ ID NO: 3725206 - RNA, 17 nt, Human
ucucuaagguuuacaau

SEQ ID NO: 3725207 - RNA, 20 nt, Human
ucucuaagugggcauugcca

SEQ ID NO: 3725208 - RNA, 23 nt, Human
ucucuaagugggcauugccaugu

SEQ ID NO: 3725209 - RNA, 16 nt, Human
ucucuaaguuccacug

SEQ ID NO: 3725210 - RNA, 21 nt, Human
ucucuaaguuccacugagcuc

SEQ ID NO: 3725211 - RNA, 16 nt, Human
ucucuaauaagaaaac

SEQ ID NO: 3725212 - RNA, 11 nt, Human
ucucuaauaau

SEQ ID NO: 3725213 - RNA, 12 nt, Human
ucucuaauaaua

SEQ ID NO: 3725214 - RNA, 15 nt, Human
ucucuaauaauaaau

SEQ ID NO: 3725215 - RNA, 22 nt, Human
ucucuaauaauaaauaguucuu

SEQ ID NO: 3725216 - RNA, 11 nt, Human
ucucuaauaug

SEQ ID NO: 3725217 - RNA, 15 nt, Human
ucucuaaucgaaaga

SEQ ID NO: 3725218 - RNA, 18 nt, Human
ucucuaaucugugcuguu

SEQ ID NO: 3725219 - RNA, 20 nt, Human
ucucuaaucugugcuguuuc

SEQ ID NO: 3725220 - RNA, 19 nt, Human
ucucuaauuccauccauaa

SEQ ID NO: 3725221 - RNA, 20 nt, Human
ucucuacagaugucccauuu

SEQ ID NO: 3725222 - RNA, 18 nt, Human
ucucuacagucucgucuc

SEQ ID NO: 3725223 - RNA, 21 nt, Human
ucucuacagucucgucucuuu

SEQ ID NO: 3725224 - RNA, 20 nt, Human
ucucuaccacugcugauauu

SEQ ID NO: 3725225 - RNA, 18 nt, Human
ucucuacccagcccaucu

SEQ ID NO: 3725226 - RNA, 20 nt, Human
ucucuacccagcccaucuug

SEQ ID NO: 3725227 - RNA, 20 nt, Human
ucucuacccaucuuaaaaac

SEQ ID NO: 3725228 - RNA, 23 nt, Human
ucucuaccuucuccccagcuccc

SEQ ID NO: 3725229 - RNA, 14 nt, Human
ucucuacuaaaaau

SEQ ID NO: 3725230 - RNA, 19 nt, Human
ucucuacuccuaccucagc

SEQ ID NO: 3725231 - RNA, 17 nt, Human
ucucuagaauuuuaagu

SEQ ID NO: 3725232 - RNA, 13 nt, Human
ucucuagcacaau

SEQ ID NO: 3725233 - RNA, 19 nt, Human
ucucuaggccucuccaguu

SEQ ID NO: 3725234 - RNA, 18 nt, Human
ucucuaguaguuaaaaaa

SEQ ID NO: 3725235 - RNA, 14 nt, Human
ucucuagugcugug

SEQ ID NO: 3725236 - RNA, 17 nt, Human
ucucuagugcugugaaa

SEQ ID NO: 3725237 - RNA, 19 nt, Human
ucucuagugcugugaaaaa

SEQ ID NO: 3725238 - RNA, 17 nt, Human
ucucuaguuccacgccu

SEQ ID NO: 3725239 - RNA, 16 nt, Human
ucucuaguuugauuaa

SEQ ID NO: 3725240 - RNA, 19 nt, Human
ucucuaguuugauuaaauu

SEQ ID NO: 3725241 - RNA, 19 nt, Human
ucucuauaccaauaaagug

SEQ ID NO: 3725242 - RNA, 22 nt, Human
ucucuauagcaccagggcucac

SEQ ID NO: 3725243 - RNA, 13 nt, Human
ucucuaucauuaa

SEQ ID NO: 3725244 - RNA, 16 nt, Human
ucucuaucauuaaagu

SEQ ID NO: 3725245 - RNA, 17 nt, Human
ucucuaucauuuaauaa

SEQ ID NO: 3725246 - RNA, 20 nt, Human
ucucuaucauuuaauaauau

SEQ ID NO: 3725247 - RNA, 22 nt, Human
ucucuaucauuuaauaauauac

SEQ ID NO: 3725248 - RNA, 13 nt, Human
ucucuaugccucu

SEQ ID NO: 3725249 - RNA, 22 nt, Human
ucucuaugguaaagauauuauu

SEQ ID NO: 3725250 - RNA, 14 nt, Human
ucucuauuaaaaug

SEQ ID NO: 3725251 - RNA, 16 nt, Human
ucucuauuuaaauucu

SEQ ID NO: 3725252 - RNA, 17 nt, Human
ucucuauuuaaauucuu

SEQ ID NO: 3725253 - RNA, 18 nt, Human
ucucuauuuaaauucuuu

SEQ ID NO: 3725254 - RNA, 23 nt, Human
ucucuauuucccccuuucuuccu

SEQ ID NO: 3725255 - RNA, 13 nt, Human
ucucuauuugaga

SEQ ID NO: 3725256 - RNA, 21 nt, Human
ucucucaaaagagaaaaacaa

SEQ ID NO: 3725257 - RNA, 23 nt, Human
ucucucacagacaggaccccugc

SEQ ID NO: 3725258 - RNA, 23 nt, Human
ucucucacucccucccuuucuau

SEQ ID NO: 3725259 - RNA, 16 nt, Human
ucucucagaagggagg

SEQ ID NO: 3725260 - RNA, 14 nt, Human
ucucucaggagcac

SEQ ID NO: 3725261 - RNA, 18 nt, Human
ucucucaggagcacaggc

SEQ ID NO: 3725262 - RNA, 22 nt, Human
ucucucaggagcacaggcagcu

SEQ ID NO: 3725263 - RNA, 21 nt, Human
ucucucaggccaaacucaccu

SEQ ID NO: 3725264 - RNA, 23 nt, Human
ucucucaucucuuagcuccccuc

SEQ ID NO: 3725265 - RNA, 13 nt, Human
ucucuccacugug

SEQ ID NO: 3725266 - RNA, 16 nt, Human
ucucuccacuuucagc

SEQ ID NO: 3725267 - RNA, 22 nt, Human
ucucuccacuuucagcugucuu

SEQ ID NO: 3725268 - RNA, 13 nt, Human
ucucuccagaugu

SEQ ID NO: 3725269 - RNA, 16 nt, Human
ucucuccagccccugg

SEQ ID NO: 3725270 - RNA, 14 nt, Human
ucucuccauucccg

SEQ ID NO: 3725271 - RNA, 19 nt, Human
ucucucccagucuacccag

SEQ ID NO: 3725272 - RNA, 21 nt, Human
ucucucccagucuacccagag

SEQ ID NO: 3725273 - RNA, 22 nt, Human
ucucucccagucuacccagaga

SEQ ID NO: 3725274 - RNA, 13 nt, Human
ucucucccaugga

SEQ ID NO: 3725275 - RNA, 22 nt, Human
ucucuccccucaaagucugcaa

SEQ ID NO: 3725276 - RNA, 18 nt, Human
ucucucccucucccuguc

SEQ ID NO: 3725277 - RNA, 11 nt, Human
ucucucccugc

SEQ ID NO: 3725278 - RNA, 13 nt, Human
ucucuccucccca

SEQ ID NO: 3725279 - RNA, 14 nt, Human
ucucuccugcggga

SEQ ID NO: 3725280 - RNA, 11 nt, Human
ucucuccuggc

SEQ ID NO: 3725281 - RNA, 13 nt, Human
ucucuccuggccu

SEQ ID NO: 3725282 - RNA, 14 nt, Human
ucucuccuguacuu

SEQ ID NO: 3725283 - RNA, 14 nt, Human
ucucuccuuucuuu

SEQ ID NO: 3725284 - RNA, 11 nt, Human
ucucuccuuuu

SEQ ID NO: 3725285 - RNA, 12 nt, Human
ucucuccuuuuc

SEQ ID NO: 3725286 - RNA, 23 nt, Human
ucucucggaguaucugggaacug

SEQ ID NO: 3725287 - RNA, 20 nt, Human
ucucucggcuccccaugugu

SEQ ID NO: 3725288 - RNA, 20 nt, Human
ucucucguaacugguuucau

SEQ ID NO: 3725289 - RNA, 15 nt, Human
ucucucgugaguaua

SEQ ID NO: 3725290 - RNA, 15 nt, Human
ucucucuacagugcc

SEQ ID NO: 3725291 - RNA, 21 nt, Human
ucucucuauuucccccuuucu

SEQ ID NO: 3725292 - RNA, 11 nt, Human
ucucucucacc

SEQ ID NO: 3725293 - RNA, 12 nt, Human
ucucucuccaag

SEQ ID NO: 3725294 - RNA, 18 nt, Human
ucucucucccauggagcc

SEQ ID NO: 3725295 - RNA, 23 nt, Human
ucucucucccauggagccccagc

SEQ ID NO: 3725296 - RNA, 11 nt, Human
ucucucuccug

SEQ ID NO: 3725297 - RNA, 22 nt, Human
ucucucuccuguacuuuuucca

SEQ ID NO: 3725298 - RNA, 12 nt, Human
ucucucugcagc

SEQ ID NO: 3725299 - RNA, 14 nt, Human
ucucucugcagcug

SEQ ID NO: 3725300 - RNA, 16 nt, Human
ucucucugcagcugcc

SEQ ID NO: 3725301 - RNA, 12 nt, Human
ucucucugccca

SEQ ID NO: 3725302 - RNA, 14 nt, Human
ucucucugcccaac

SEQ ID NO: 3725303 - RNA, 16 nt, Human
ucucucugcccaaccc

SEQ ID NO: 3725304 - RNA, 13 nt, Human
ucucucugccugu

SEQ ID NO: 3725305 - RNA, 21 nt, Human
ucucucugugcuguggaagca

SEQ ID NO: 3725306 - RNA, 11 nt, Human
ucucucuucug

SEQ ID NO: 3725307 - RNA, 14 nt, Human
ucucucuucugccu

SEQ ID NO: 3725308 - RNA, 19 nt, Human
ucucucuucugcuccaccc

SEQ ID NO: 3725309 - RNA, 20 nt, Human
ucucucuucugcuccacccu

SEQ ID NO: 3725310 - RNA, 12 nt, Human
ucucucuuugga

SEQ ID NO: 3725311 - RNA, 15 nt, Human
ucucugaacuucagc

SEQ ID NO: 3725312 - RNA, 16 nt, Human
ucucugaacuucagcu

SEQ ID NO: 3725313 - RNA, 22 nt, Human
ucucugaagaguggguuucaca

SEQ ID NO: 3725314 - RNA, 14 nt, Human
ucucugaagcaugu

SEQ ID NO: 3725315 - RNA, 19 nt, Human
ucucugaagcauguuucau

SEQ ID NO: 3725316 - RNA, 21 nt, Human
ucucugaaggaggccaccucc

SEQ ID NO: 3725317 - RNA, 12 nt, Human
ucucugaccuac

SEQ ID NO: 3725318 - RNA, 17 nt, Human
ucucugacucucaaauc

SEQ ID NO: 3725319 - RNA, 14 nt, Human
ucucugagcaguga

SEQ ID NO: 3725320 - RNA, 23 nt, Human
ucucugagcuccaguggaagaag

SEQ ID NO: 3725321 - RNA, 16 nt, Human
ucucugagcucugcau

SEQ ID NO: 3725322 - RNA, 20 nt, Human
ucucugagggcuuccuuugg

SEQ ID NO: 3725323 - RNA, 22 nt, Human
ucucugaggggcuaccaggaaa

SEQ ID NO: 3725324 - RNA, 20 nt, Human
ucucugauuuucaaagcuuu

SEQ ID NO: 3725325 - RNA, 11 nt, Human
ucucugcagcc

SEQ ID NO: 3725326 - RNA, 18 nt, Human
ucucugcagccagcccag

SEQ ID NO: 3725327 - RNA, 14 nt, Human
ucucugcagcugcc

SEQ ID NO: 3725328 - RNA, 11 nt, Human
ucucugcaggu

SEQ ID NO: 3725329 - RNA, 15 nt, Human
ucucugcaggucccu

SEQ ID NO: 3725330 - RNA, 18 nt, Human
ucucugcaggucccuaau

SEQ ID NO: 3725331 - RNA, 21 nt, Human
ucucugcaggucccuaauaaa

SEQ ID NO: 3725332 - RNA, 19 nt, Human
ucucugcaucuacucccaa

SEQ ID NO: 3725333 - RNA, 16 nt, Human
ucucugcaucugacca

SEQ ID NO: 3725334 - RNA, 20 nt, Human
ucucugcauuuaaaaaaauc

SEQ ID NO: 3725335 - RNA, 18 nt, Human
ucucugccauaaaugauu

SEQ ID NO: 3725336 - RNA, 20 nt, Human
ggcugcccuggcccugaggu

SEQ ID NO: 3725337 - RNA, 13 nt, Human
ggcugcccuggug

SEQ ID NO: 3725338 - RNA, 22 nt, Human
ggcugcccuggugcugccacac

SEQ ID NO: 3725339 - RNA, 16 nt, Human
ggcugcccuugggcca

SEQ ID NO: 3725340 - RNA, 20 nt, Human
ggcugccuccacucccacuu

SEQ ID NO: 3725341 - RNA, 13 nt, Human
ggcugccucccaa

SEQ ID NO: 3725342 - RNA, 23 nt, Human
ggcugccugagucgugaccugcu

SEQ ID NO: 3725343 - RNA, 16 nt, Human
ggcugccuggccccca

SEQ ID NO: 3725344 - RNA, 17 nt, Human
ggcugccugggcuguug

SEQ ID NO: 3725345 - RNA, 21 nt, Human
ggcugcggcguacaggcuggc

SEQ ID NO: 3725346 - RNA, 21 nt, Human
ggcugcgucuggaggggcccc

SEQ ID NO: 3725347 - RNA, 15 nt, Human
ggcugcuacccagaa

SEQ ID NO: 3725348 - RNA, 13 nt, Human
ggcugcucccacc

SEQ ID NO: 3725349 - RNA, 15 nt, Human
ggcugcucugccugu

SEQ ID NO: 3725350 - RNA, 16 nt, Human
ggcugcucugccugug

SEQ ID NO: 3725351 - RNA, 17 nt, Human
ggcugcugaaggcucga

SEQ ID NO: 3725352 - RNA, 18 nt, Human
ggcugcugcugggcucag

SEQ ID NO: 3725353 - RNA, 14 nt, Human
ggcugcuggaggaa

SEQ ID NO: 3725354 - RNA, 13 nt, Human
ggcugcuggccug

SEQ ID NO: 3725355 - RNA, 11 nt, Human
ggcugcuggga

SEQ ID NO: 3725356 - RNA, 17 nt, Human
ggcugcugugggaaaug

SEQ ID NO: 3725357 - RNA, 22 nt, Human
ggcugcuucaaggauccugagc

SEQ ID NO: 3725358 - RNA, 18 nt, Human
ggcugcuucccugaagcu

SEQ ID NO: 3725359 - RNA, 19 nt, Human
ggcugcuucccugaagcuc

SEQ ID NO: 3725360 - RNA, 13 nt, Human
ggcugcuuccucc

SEQ ID NO: 3725361 - RNA, 14 nt, Human
ggcugcuuggccuu

SEQ ID NO: 3725362 - RNA, 22 nt, Human
ggcuggaacagauucacacugu

SEQ ID NO: 3725363 - RNA, 15 nt, Human
ggcuggaaggaggaa

SEQ ID NO: 3725364 - RNA, 16 nt, Human
ggcuggaaggaggaag

SEQ ID NO: 3725365 - RNA, 17 nt, Human
ggcuggaaggaggaaga

SEQ ID NO: 3725366 - RNA, 13 nt, Human
ggcuggaaucugg

SEQ ID NO: 3725367 - RNA, 14 nt, Human
ggcuggaaucugga

SEQ ID NO: 3725368 - RNA, 19 nt, Human
ggcuggaaucuggagagcu

SEQ ID NO: 3725369 - RNA, 20 nt, Human
ggcuggaaucuggagagcua

SEQ ID NO: 3725370 - RNA, 15 nt, Human
ggcuggacccagcca

SEQ ID NO: 3725371 - RNA, 20 nt, Human
ggcuggacccagccaggccc

SEQ ID NO: 3725372 - RNA, 23 nt, Human
ggcuggacccagccaggcccagc

SEQ ID NO: 3725373 - RNA, 22 nt, Human
ggcuggaccuauguccuaagga

SEQ ID NO: 3725374 - RNA, 16 nt, Human
ggcuggacugaggccu

SEQ ID NO: 3725375 - RNA, 19 nt, Human
ggcuggagaccaugcagag

SEQ ID NO: 3725376 - RNA, 15 nt, Human
ggcuggaggagccca

SEQ ID NO: 3725377 - RNA, 15 nt, Human
ggcuggaggcagggc

SEQ ID NO: 3725378 - RNA, 23 nt, Human
ggcuggaggcagggccuugccca

SEQ ID NO: 3725379 - RNA, 15 nt, Human
ucugagcugagccag

SEQ ID NO: 3725380 - RNA, 16 nt, Human
ucugagcugagccagg

SEQ ID NO: 3725381 - RNA, 18 nt, Human
ucugagcugagccaggcu

SEQ ID NO: 3725382 - RNA, 17 nt, Human
ucugagcugcucugaau

SEQ ID NO: 3725383 - RNA, 16 nt, Human
ucugaggaauccagac

SEQ ID NO: 3725384 - RNA, 18 nt, Human
ucugaggaauccagaccc

SEQ ID NO: 3725385 - RNA, 23 nt, Human
ucugaggaauccagacccggcug

SEQ ID NO: 3725386 - RNA, 21 nt, Human
ucugaggaauggacauuucua

SEQ ID NO: 3725387 - RNA, 14 nt, Human
ucugaggaauucug

SEQ ID NO: 3725388 - RNA, 20 nt, Human
ucugaggaauucuguauaga

SEQ ID NO: 3725389 - RNA, 17 nt, Human
ucugaggacaagagaaa

SEQ ID NO: 3725390 - RNA, 23 nt, Human
ucugaggacacuaaccacgcugg

SEQ ID NO: 3725391 - RNA, 22 nt, Human
ucugaggagaaacaaauaagac

SEQ ID NO: 3725392 - RNA, 17 nt, Human
ucugaggccagccuggc

SEQ ID NO: 3725393 - RNA, 18 nt, Human
ucugaggccagccuggcc

SEQ ID NO: 3725394 - RNA, 21 nt, Human
ucugaggccguugcugacuua

SEQ ID NO: 3725395 - RNA, 19 nt, Human
ucugaggcucuuucugggc

SEQ ID NO: 3725396 - RNA, 11 nt, Human
ucugaggcuga

SEQ ID NO: 3725397 - RNA, 23 nt, Human
ucugaggcugaaauucagaauau

SEQ ID NO: 3725398 - RNA, 21 nt, Human
ucugaggcuggauccuagccu

SEQ ID NO: 3725399 - RNA, 22 nt, Human
ucugaggcuggauccuagccuu

SEQ ID NO: 3725400 - RNA, 14 nt, Human
ucugaggcuuccag

SEQ ID NO: 3725401 - RNA, 13 nt, Human
ucugagggaggag

SEQ ID NO: 3725402 - RNA, 15 nt, Human
ucugagggcuuccuu

SEQ ID NO: 3725403 - RNA, 18 nt, Human
ucugagggcuuccuuugg

SEQ ID NO: 3725404 - RNA, 19 nt, Human
ucugaggggcaacugaguc

SEQ ID NO: 3725405 - RNA, 19 nt, Human
ucugaggggcuaccaggaa

SEQ ID NO: 3725406 - RNA, 20 nt, Human
ucugaggggcuaccaggaaa

SEQ ID NO: 3725407 - RNA, 12 nt, Human
ucugagggggag

SEQ ID NO: 3725408 - RNA, 18 nt, Human
ucugagguccugagcacu

SEQ ID NO: 3725409 - RNA, 20 nt, Human
ucugagguccugagcacugc

SEQ ID NO: 3725410 - RNA, 16 nt, Human
ucugaggugcacuggg

SEQ ID NO: 3725411 - RNA, 19 nt, Human
ucugaggugcacugggagg

SEQ ID NO: 3725412 - RNA, 18 nt, Human
ucugaguaucuccucgca

SEQ ID NO: 3725413 - RNA, 23 nt, Human
ucugaguaucuccucgcaagcug

SEQ ID NO: 3725414 - RNA, 16 nt, Human
ucugaguccuggccca

SEQ ID NO: 3725415 - RNA, 13 nt, Human
ucugagugaaccu

SEQ ID NO: 3725416 - RNA, 20 nt, Human
ucugagugaaccuguauaag

SEQ ID NO: 3725417 - RNA, 23 nt, Human
ucugagugcaaacuucagaguuc

SEQ ID NO: 3725418 - RNA, 17 nt, Human
ucugaguggcuucacuc

SEQ ID NO: 3725419 - RNA, 21 nt, Human
ucugaguggcuucacuccugc

SEQ ID NO: 3725420 - RNA, 22 nt, Human
ucugaguggcuucacuccugcu

SEQ ID NO: 3725421 - RNA, 19 nt, Human
ucugaguugccaagacaaa

SEQ ID NO: 3725422 - RNA, 19 nt, Human
ucugaguuguuaccccaag

SEQ ID NO: 3725423 - RNA, 20 nt, Human
ucugaguuucauucuccugc

SEQ ID NO: 3725424 - RNA, 16 nt, Human
ucugaguuuuaccaaa

SEQ ID NO: 3725425 - RNA, 21 nt, Human
ucugauaacuagauggugcug

SEQ ID NO: 3725426 - RNA, 13 nt, Human
ucugauacagaaa

SEQ ID NO: 3725427 - RNA, 15 nt, Human
ucugauaggccaagu

SEQ ID NO: 3725428 - RNA, 21 nt, Human
ucugauaggguuugugacagg

SEQ ID NO: 3725429 - RNA, 17 nt, Human
ucugauauuccaugaau

SEQ ID NO: 3725430 - RNA, 19 nt, Human
ucugauauuccaugaaugu

SEQ ID NO: 3725431 - RNA, 22 nt, Human
ucugauauuccaugaauguauc

SEQ ID NO: 3725432 - RNA, 16 nt, Human
ucugaucacugaaaua

SEQ ID NO: 3725433 - RNA, 17 nt, Human
ucugaucagaacaaaug

SEQ ID NO: 3725434 - RNA, 17 nt, Human
ucugaucguucuuucua

SEQ ID NO: 3725435 - RNA, 15 nt, Human
ucugaucuccauggc

SEQ ID NO: 3725436 - RNA, 23 nt, Human
ucugaucugugcuuuccagcuca

SEQ ID NO: 3725437 - RNA, 21 nt, Human
ucugaugaaaaauugcugacu

SEQ ID NO: 3725438 - RNA, 18 nt, Human
ucugaugaaauguuaaca

SEQ ID NO: 3725439 - RNA, 13 nt, Human
ucugaugaaucuu

SEQ ID NO: 3725440 - RNA, 16 nt, Human
ucugaugaugugccug

SEQ ID NO: 3725441 - RNA, 23 nt, Human
ucugaugcaagcaagaaacacug

SEQ ID NO: 3725442 - RNA, 19 nt, Human
ucugauggaccuucuagaa

SEQ ID NO: 3725443 - RNA, 20 nt, Human
ucugauggccuuaauuuccu

SEQ ID NO: 3725444 - RNA, 22 nt, Human
ucugauggccuuaauuuccuuu

SEQ ID NO: 3725445 - RNA, 15 nt, Human
ucugauguauuuugu

SEQ ID NO: 3725446 - RNA, 21 nt, Human
ucugauguauuuugugaguuu

SEQ ID NO: 3725447 - RNA, 20 nt, Human
ucugaugucucuaaagcacu

SEQ ID NO: 3725448 - RNA, 18 nt, Human
ucugauuacacaaaacaa

SEQ ID NO: 3725449 - RNA, 15 nt, Human
ucugauuagcuuugu

SEQ ID NO: 3725450 - RNA, 18 nt, Human
ucugauuagcuuuguguu

SEQ ID NO: 3725451 - RNA, 14 nt, Human
ucugauuccagcac

SEQ ID NO: 3725452 - RNA, 18 nt, Human
ucugauucccaagcucug

SEQ ID NO: 3725453 - RNA, 20 nt, Human
ucugauucccaagcucugcu

SEQ ID NO: 3725454 - RNA, 21 nt, Human
ucugauucccaagcucugcuc

SEQ ID NO: 3725455 - RNA, 23 nt, Human
ucugauucccaagcucugcuccu

SEQ ID NO: 3725456 - RNA, 20 nt, Human
ucugauucgaaugacacugu

SEQ ID NO: 3725457 - RNA, 22 nt, Human
ucugauucgaaugacacuguuc

SEQ ID NO: 3725458 - RNA, 15 nt, Human
ucugauucuucaaag

SEQ ID NO: 3725459 - RNA, 15 nt, Human
ucugauuggacauuu

SEQ ID NO: 3725460 - RNA, 19 nt, Human
ucugauuggacauuuucuu

SEQ ID NO: 3725461 - RNA, 21 nt, Human
ucugauuggcuuguagaauug

SEQ ID NO: 3725462 - RNA, 23 nt, Human
ucugauuggcuuguagaauuguu

SEQ ID NO: 3725463 - RNA, 23 nt, Human
ucugauuguaacguugcuguggg

SEQ ID NO: 3725464 - RNA, 16 nt, Human
ucugauuuauuuugua

SEQ ID NO: 3725465 - RNA, 17 nt, Human
ucugauuugcauauuca

SEQ ID NO: 3725466 - RNA, 17 nt, Human
ucugauuugcugcucuu

SEQ ID NO: 3725467 - RNA, 19 nt, Human
ucugauuugcugcucuuca

SEQ ID NO: 3725468 - RNA, 17 nt, Human
ucugauuuguaacccac

SEQ ID NO: 3725469 - RNA, 22 nt, Human
ucugauuuuaggagcuaaggcu

SEQ ID NO: 3725470 - RNA, 16 nt, Human
ucugcaaacaaacacc

SEQ ID NO: 3725471 - RNA, 22 nt, Human
ucugcaaacaaacaccuucuua

SEQ ID NO: 3725472 - RNA, 18 nt, Human
ucugcaaagaaugagaag

SEQ ID NO: 3725473 - RNA, 21 nt, Human
ucugcaaauagaaaacaggaa

SEQ ID NO: 3725474 - RNA, 14 nt, Human
ucugcaacucugaa

SEQ ID NO: 3725475 - RNA, 14 nt, Human
ucugcaacuuuaag

SEQ ID NO: 3725476 - RNA, 21 nt, Human
ucugcaagauucugaaacauu

SEQ ID NO: 3725477 - RNA, 14 nt, Human
ucugcaagccugcg

SEQ ID NO: 3725478 - RNA, 23 nt, Human
ucugcaagggcagaacacuaacc

SEQ ID NO: 3725479 - RNA, 17 nt, Human
ucugcaagucagaggau

SEQ ID NO: 3725480 - RNA, 17 nt, Human
ucugcaaucuucucaga

SEQ ID NO: 3725481 - RNA, 19 nt, Human
ucugcaaugggcacuggga

SEQ ID NO: 3725482 - RNA, 21 nt, Human
ucugcaauucaaaaguuccaa

SEQ ID NO: 3725483 - RNA, 16 nt, Human
ucugcacacaaauauu

SEQ ID NO: 3725484 - RNA, 17 nt, Human
ucugcacacaaauauua

SEQ ID NO: 3725485 - RNA, 10 nt, Human
ucugcacaga

SEQ ID NO: 3725486 - RNA, 17 nt, Human
ucugcacagcuggccuc

SEQ ID NO: 3725487 - RNA, 19 nt, Human
ucugcacauaaacucuuuu

SEQ ID NO: 3725488 - RNA, 12 nt, Human
ucugcacaugaa

SEQ ID NO: 3725489 - RNA, 23 nt, Human
ucugcacaugaaucccacccaca

SEQ ID NO: 3725490 - RNA, 22 nt, Human
ucugcacaugcagcugcacccu

SEQ ID NO: 3725491 - RNA, 19 nt, Human
ucugcacaugucuuguaca

SEQ ID NO: 3725492 - RNA, 20 nt, Human
ucugcacaugucuuguacau

SEQ ID NO: 3725493 - RNA, 22 nt, Human
ucugcacaugucuuguacaugu

SEQ ID NO: 3725494 - RNA, 13 nt, Human
ucugcacccaggg

SEQ ID NO: 3725495 - RNA, 24 nt, Human
ucugcacccuggggccuggaccug

SEQ ID NO: 3725496 - RNA, 13 nt, Human
ucugcacccuucu

SEQ ID NO: 3725497 - RNA, 19 nt, Human
ucugcacccuucuuuucuc

SEQ ID NO: 3725498 - RNA, 20 nt, Human
ucugcacccuucuuuucuca

SEQ ID NO: 3725499 - RNA, 15 nt, Human
ucugcaccuuaucuu

SEQ ID NO: 3725500 - RNA, 20 nt, Human
ucugcacuacugacaugugg

SEQ ID NO: 3725501 - RNA, 21 nt, Human
ucugcacuacugacauguggg

SEQ ID NO: 3725502 - RNA, 13 nt, Human
ucugcacuccccu

SEQ ID NO: 3725503 - RNA, 17 nt, Human
ucugcacuccccugcug

SEQ ID NO: 3725504 - RNA, 16 nt, Human
ucugcacuuaaauauc

SEQ ID NO: 3725505 - RNA, 15 nt, Human
ucugcagaaacagaa

SEQ ID NO: 3725506 - RNA, 15 nt, Human
ucugcagaaggaaaa

SEQ ID NO: 3725507 - RNA, 23 nt, Human
ucugcagaaggaaaaauguguaa

SEQ ID NO: 3725508 - RNA, 15 nt, Human
ucugcagacugcuag

SEQ ID NO: 3725509 - RNA, 23 nt, Human
ucugcagacugcuaguguucugu

SEQ ID NO: 3725510 - RNA, 16 nt, Human
ucugcagcaugaccug

SEQ ID NO: 3725511 - RNA, 13 nt, Human
ucugcagcccagg

SEQ ID NO: 3725512 - RNA, 15 nt, Human
ucugcagcccaggga

SEQ ID NO: 3725513 - RNA, 23 nt, Human
ucugcagcccggcgccaccaucc

SEQ ID NO: 3725514 - RNA, 14 nt, Human
ucugcagccucaga

SEQ ID NO: 3725515 - RNA, 12 nt, Human
ucugcagcugcc

SEQ ID NO: 3725516 - RNA, 19 nt, Human
ucugcaggaugauuguaca

SEQ ID NO: 3725517 - RNA, 17 nt, Human
ucugcaggcaccuuagu

SEQ ID NO: 3725518 - RNA, 13 nt, Human
ucugcaggcagac

SEQ ID NO: 3725519 - RNA, 14 nt, Human
ucugcaggcuuaau

SEQ ID NO: 3725520 - RNA, 11 nt, Human
ucugcaggucc

SEQ ID NO: 3725521 - RNA, 17 nt, Human
ucugcaggucccuaaua

SEQ ID NO: 3725522 - RNA, 19 nt, Human
ucugcaggucccuaauaaa

SEQ ID NO: 3725523 - RNA, 21 nt, Human
ucugcagguucuucuuccuga

SEQ ID NO: 3725524 - RNA, 18 nt, Human
ucugcagguugaagccau

SEQ ID NO: 3725525 - RNA, 15 nt, Human
ucugcaguaaaucuu

SEQ ID NO: 3725526 - RNA, 20 nt, Human
ucugcagucacuucguggga

SEQ ID NO: 3725527 - RNA, 18 nt, Human
ucuuuauauacaauaaug

SEQ ID NO: 3725528 - RNA, 15 nt, Human
ucuuuauaugaacau

SEQ ID NO: 3725529 - RNA, 15 nt, Human
ucuuuaugacuguuu

SEQ ID NO: 3725530 - RNA, 15 nt, Human
ucuuuaugcuugcaa

SEQ ID NO: 3725531 - RNA, 15 nt, Human
ucuuuauguugaguc

SEQ ID NO: 3725532 - RNA, 15 nt, Human
ucuuuauugaaauuc

SEQ ID NO: 3725533 - RNA, 14 nt, Human
ucuuuauugagaaa

SEQ ID NO: 3725534 - RNA, 15 nt, Human
ucuuuauugagaaag

SEQ ID NO: 3725535 - RNA, 19 nt, Human
ucuuuauugagaaagagca

SEQ ID NO: 3725536 - RNA, 12 nt, Human
ucuuuauugucu

SEQ ID NO: 3725537 - RNA, 17 nt, Human
ucuuuauugucuguaaa

SEQ ID NO: 3725538 - RNA, 12 nt, Human
ucuuuauuuugu

SEQ ID NO: 3725539 - RNA, 17 nt, Human
ucuuuauuuuguguaaa

SEQ ID NO: 3725540 - RNA, 21 nt, Human
ucuuucaaaaccuuuugaaau

SEQ ID NO: 3725541 - RNA, 20 nt, Human
ucuuucaaagguagccauca

SEQ ID NO: 3725542 - RNA, 22 nt, Human
ucuuucaaauugagagaaugga

SEQ ID NO: 3725543 - RNA, 21 nt, Human
ucuuucaagggcuuuccugug

SEQ ID NO: 3725544 - RNA, 20 nt, Human
ucuuucaauaaacuaaagaa

SEQ ID NO: 3725545 - RNA, 19 nt, Human
ucuuucaauacagauauau

SEQ ID NO: 3725546 - RNA, 20 nt, Human
ucuuucaauacagauauauu

SEQ ID NO: 3725547 - RNA, 21 nt, Human
ucuuucacacuuccaccagcc

SEQ ID NO: 3725548 - RNA, 15 nt, Human
ucuuucacagcuccu

SEQ ID NO: 3725549 - RNA, 17 nt, Human
ucuuucacauuuaaaua

SEQ ID NO: 3725550 - RNA, 21 nt, Human
ucuuucagacuugccauguga

SEQ ID NO: 3725551 - RNA, 23 nt, Human
ucuuucagacuugccaugugacu

SEQ ID NO: 3725552 - RNA, 22 nt, Human
ucuuucagauuuuuugaaccau

SEQ ID NO: 3725553 - RNA, 21 nt, Human
ucuuucagccaagaauucuua

SEQ ID NO: 3725554 - RNA, 11 nt, Human
ucuuucagcuc

SEQ ID NO: 3725555 - RNA, 13 nt, Human
ucuuucagcuccu

SEQ ID NO: 3725556 - RNA, 15 nt, Human
ucuuucagcuccuga

SEQ ID NO: 3725557 - RNA, 20 nt, Human
ucuuucagggggguugugag

SEQ ID NO: 3725558 - RNA, 21 nt, Human
ucuuucaguacuuuuuuaaau

SEQ ID NO: 3725559 - RNA, 12 nt, Human
ucuuucaugagu

SEQ ID NO: 3725560 - RNA, 14 nt, Human
ucuuucaugaguuu

SEQ ID NO: 3725561 - RNA, 23 nt, Human
ucuuuccaaaguacacuguuuca

SEQ ID NO: 3725562 - RNA, 18 nt, Human
ucuuuccaaauuauuucu

SEQ ID NO: 3725563 - RNA, 19 nt, Human
ucuuuccaaauuauuucuu

SEQ ID NO: 3725564 - RNA, 19 nt, Human
ucuuuccaaccggcuuugu

SEQ ID NO: 3725565 - RNA, 22 nt, Human
ucuuuccacuccuccuagccac

SEQ ID NO: 3725566 - RNA, 15 nt, Human
ucuuuccacucugga

SEQ ID NO: 3725567 - RNA, 23 nt, Human
ucuuuccaggcuauguauaaaau

SEQ ID NO: 3725568 - RNA, 15 nt, Human
ucuuuccauauccau

SEQ ID NO: 3725569 - RNA, 16 nt, Human
ucuuuccauauccaua

SEQ ID NO: 3725570 - RNA, 20 nt, Human
ucuuuccauuggaucucauu

SEQ ID NO: 3725571 - RNA, 13 nt, Human
ucuuuccauuugc

SEQ ID NO: 3725572 - RNA, 22 nt, Human
ucuuuccauuugcauuuguuua

SEQ ID NO: 3725573 - RNA, 17 nt, Human
ucuuucccaucuccccu

SEQ ID NO: 3725574 - RNA, 23 nt, Human
ucuuucccucccuuccucuuucc

SEQ ID NO: 3725575 - RNA, 14 nt, Human
ucuuucccuuccuc

SEQ ID NO: 3725576 - RNA, 16 nt, Human
ucuuucccuuccucca

SEQ ID NO: 3725577 - RNA, 11 nt, Human
ucuuuccucuu

SEQ ID NO: 3725578 - RNA, 14 nt, Human
ucuuuccugaggcu

SEQ ID NO: 3725579 - RNA, 14 nt, Human
ucuuuccugccuuc

SEQ ID NO: 3725580 - RNA, 15 nt, Human
ucuuuccuucuugcc

SEQ ID NO: 3725581 - RNA, 10 nt, Human
ucuuuccuug

SEQ ID NO: 3725582 - RNA, 17 nt, Human
ucuuucgcacagcaguu

SEQ ID NO: 3725583 - RNA, 14 nt, Human
ucuuucgucacccu

SEQ ID NO: 3725584 - RNA, 21 nt, Human
ucuuucuaacuccagugaagu

SEQ ID NO: 3725585 - RNA, 14 nt, Human
ucuuucuaaugcug

SEQ ID NO: 3725586 - RNA, 19 nt, Human
ucuuucuaaugugugaauc

SEQ ID NO: 3725587 - RNA, 17 nt, Human
ucuuucuccaaaguuau

SEQ ID NO: 3725588 - RNA, 14 nt, Human
ucuuucucucccca

SEQ ID NO: 3725589 - RNA, 14 nt, Human
ucuuucucucuucc

SEQ ID NO: 3725590 - RNA, 17 nt, Human
ucuuucucucuucccuc

SEQ ID NO: 3725591 - RNA, 12 nt, Human
ucuuucucuuuu

SEQ ID NO: 3725592 - RNA, 19 nt, Human
ucuuucugaaggcuuugug

SEQ ID NO: 3725593 - RNA, 16 nt, Human
ucuuucugaugucaaa

SEQ ID NO: 3725594 - RNA, 16 nt, Human
ucuuucuggccugccu

SEQ ID NO: 3725595 - RNA, 19 nt, Human
ucuuucuggcuaugcauuu

SEQ ID NO: 3725596 - RNA, 14 nt, Human
ucuuucugucccuu

SEQ ID NO: 3725597 - RNA, 15 nt, Human
ucuuucuuagaaauu

SEQ ID NO: 3725598 - RNA, 17 nt, Human
ucuuucuuccucugcug

SEQ ID NO: 3725599 - RNA, 22 nt, Human
ucuuucuucuucaaaccuuugu

SEQ ID NO: 3725600 - RNA, 19 nt, Human
ucuuucuuuggugccuuuc

SEQ ID NO: 3725601 - RNA, 22 nt, Human
ucuuucuuuugauucuuccuaa

SEQ ID NO: 3725602 - RNA, 22 nt, Human
ucuuugaaagacuuccaaagaa

SEQ ID NO: 3725603 - RNA, 16 nt, Human
ucuuugaaauuaugua

SEQ ID NO: 3725604 - RNA, 12 nt, Human
ucuuugaauaaa

SEQ ID NO: 3725605 - RNA, 20 nt, Human
ucuuugaauaaaugucacuu

SEQ ID NO: 3725606 - RNA, 15 nt, Human
ucuuugaaugacaaa

SEQ ID NO: 3725607 - RNA, 14 nt, Human
ucuuugaaugcuuu

SEQ ID NO: 3725608 - RNA, 22 nt, Human
ucuuugacaauuccuagauaaa

SEQ ID NO: 3725609 - RNA, 16 nt, Human
ucuuugacacucugca

SEQ ID NO: 3725610 - RNA, 14 nt, Human
ucuuugauguguug

SEQ ID NO: 3725611 - RNA, 19 nt, Human
ucuuugauucuccuucagc

SEQ ID NO: 3725612 - RNA, 20 nt, Human
ucuuugauucuccuucagcc

SEQ ID NO: 3725613 - RNA, 12 nt, Human
ucuuugcaaagu

SEQ ID NO: 3725614 - RNA, 21 nt, Human
ucuuugcaaaguauuguaaau

SEQ ID NO: 3725615 - RNA, 18 nt, Human
ucuuugcacuuuuucuua

SEQ ID NO: 3725616 - RNA, 14 nt, Human
ucuuugcagacagg

SEQ ID NO: 3725617 - RNA, 12 nt, Human
ucuuugcaugga

SEQ ID NO: 3725618 - RNA, 14 nt, Human
ucuuugccacccuc

SEQ ID NO: 3725619 - RNA, 16 nt, Human
ucuuugccacccucau

SEQ ID NO: 3725620 - RNA, 13 nt, Human
ucuuugccaucuc

SEQ ID NO: 3725621 - RNA, 17 nt, Human
ucuuugccaucucugcu

SEQ ID NO: 3725622 - RNA, 19 nt, Human
ucuuugccaucucugcucc

SEQ ID NO: 3725623 - RNA, 13 nt, Human
ucuuugcccuuua

SEQ ID NO: 3725624 - RNA, 12 nt, Human
ucuuugccuggu

SEQ ID NO: 3725625 - RNA, 12 nt, Human
ucuuugccuguu

SEQ ID NO: 3725626 - RNA, 16 nt, Human
ucuuugccuguucagu

SEQ ID NO: 3725627 - RNA, 17 nt, Human
ucuuugccuguucaguu

SEQ ID NO: 3725628 - RNA, 16 nt, Human
ucuuugcuugaacaca

SEQ ID NO: 3725629 - RNA, 19 nt, Human
ucuuugcuugaacacagua

SEQ ID NO: 3725630 - RNA, 13 nt, Human
ucuuugcuugccu

SEQ ID NO: 3725631 - RNA, 13 nt, Human
ucuuugcuuugcu

SEQ ID NO: 3725632 - RNA, 23 nt, Human
ucuuugcuuugcuuucugcucag

SEQ ID NO: 3725633 - RNA, 18 nt, Human
ucuuuggaaaaauguuug

SEQ ID NO: 3725634 - RNA, 21 nt, Human
ucuuuggaaaaggaagguagu

SEQ ID NO: 3725635 - RNA, 19 nt, Human
ucuuuggaaaguacacucu

SEQ ID NO: 3725636 - RNA, 17 nt, Human
ucuuuggaaggagugag

SEQ ID NO: 3725637 - RNA, 24 nt, Human
ucuuuggaaggagugagaucauuu

SEQ ID NO: 3725638 - RNA, 22 nt, Human
ucuuuggacagaagcagcucuu

SEQ ID NO: 3725639 - RNA, 15 nt, Human
ucuuuggacccugag

SEQ ID NO: 3725640 - RNA, 16 nt, Human
ucuuuggacccugagg

SEQ ID NO: 3725641 - RNA, 20 nt, Human
ucuuuggaguuaaaaugcac

SEQ ID NO: 3725642 - RNA, 15 nt, Human
ucuuuggauucuaaa

SEQ ID NO: 3725643 - RNA, 16 nt, Human
ucuuuggauucuaaau

SEQ ID NO: 3725644 - RNA, 14 nt, Human
ucuuugggaauguu

SEQ ID NO: 3725645 - RNA, 15 nt, Human
ucuuugggccagaca

SEQ ID NO: 3725646 - RNA, 20 nt, Human
ucuuuggggagguguucacu

SEQ ID NO: 3725647 - RNA, 10 nt, Human
ucuuuggggu

SEQ ID NO: 3725648 - RNA, 23 nt, Human
ucuuuggggucuacacugcaauc

SEQ ID NO: 3725649 - RNA, 21 nt, Human
ucuuuggucuacacugugcug

SEQ ID NO: 3725650 - RNA, 22 nt, Human
ucuuuggucuacacugugcuga

SEQ ID NO: 3725651 - RNA, 16 nt, Human
ucuuuggugaacauug

SEQ ID NO: 3725652 - RNA, 22 nt, Human
ucuuuggugaacauugcaauag

SEQ ID NO: 3725653 - RNA, 17 nt, Human
ucuuuggugccuuuccu

SEQ ID NO: 3725654 - RNA, 22 nt, Human
ucuuuggugccuuuccuguuca

SEQ ID NO: 3725655 - RNA, 23 nt, Human
ucuuuggugccuuuccuguucag

SEQ ID NO: 3725656 - RNA, 21 nt, Human
ucuuugguucuaaggaccuga

SEQ ID NO: 3725657 - RNA, 13 nt, Human
ucuuuguaagagu

SEQ ID NO: 3725658 - RNA, 14 nt, Human
ucuuuguaagagug

SEQ ID NO: 3725659 - RNA, 19 nt, Human
ucuuuguaagaguguagaa

SEQ ID NO: 3725660 - RNA, 21 nt, Human
ucuuuguaagaguguagaagc

SEQ ID NO: 3725661 - RNA, 17 nt, Human
ucuuuguaagucagugu

SEQ ID NO: 3725662 - RNA, 12 nt, Human
ucuuuguaauga

SEQ ID NO: 3725663 - RNA, 15 nt, Human
ucuuuguaaugaaaa

SEQ ID NO: 3725664 - RNA, 16 nt, Human
ucuuuguaaugaaaac

SEQ ID NO: 3725665 - RNA, 23 nt, Human
ucuuuguaaugucaccaccuucc

SEQ ID NO: 3725666 - RNA, 21 nt, Human
ucuuuguaccaaaauuuuaaa

SEQ ID NO: 3725667 - RNA, 23 nt, Human
ucuuuguaccaaaauuuuaaaaa

SEQ ID NO: 3725668 - RNA, 17 nt, Human
ucuuuguaucauucauc

SEQ ID NO: 3725669 - RNA, 14 nt, Human
ucuuugugauaauu

SEQ ID NO: 3725670 - RNA, 23 nt, Human
ucuuugugauaauuuaagagcua

SEQ ID NO: 3725671 - RNA, 22 nt, Human
ucuuuguggccaaggagcugcu

SEQ ID NO: 3725672 - RNA, 23 nt, Human
ucuuuguggccaaggagcugcua

SEQ ID NO: 3725673 - RNA, 22 nt, Human
ucuuuguggggcuuggcgugga

SEQ ID NO: 3725674 - RNA, 18 nt, Human
ucuuuguguagcuuugcu

SEQ ID NO: 3725675 - RNA, 16 nt, Human
ucuuuguucaagauga

SEQ ID NO: 3725676 - RNA, 23 nt, Human
ucuuuguucauagcccaguagac

SEQ ID NO: 3725677 - RNA, 14 nt, Human
ucugcagucucuau

SEQ ID NO: 3725678 - RNA, 14 nt, Human
ucugcagugccuug

SEQ ID NO: 3725679 - RNA, 15 nt, Human
ucugcauauguugaa

SEQ ID NO: 3725680 - RNA, 19 nt, Human
ucugcauauguugaauacu

SEQ ID NO: 3725681 - RNA, 19 nt, Human
ucugcaucagcugcugaaa

SEQ ID NO: 3725682 - RNA, 18 nt, Human
ucugcaucccagcaccug

SEQ ID NO: 3725683 - RNA, 19 nt, Human
ucugcaucccagcaccugc

SEQ ID NO: 3725684 - RNA, 23 nt, Human
ucugcaucccagcaccugccucc

SEQ ID NO: 3725685 - RNA, 14 nt, Human
ucugcauccucugg

SEQ ID NO: 3725686 - RNA, 17 nt, Human
ucugcaucuacucccaa

SEQ ID NO: 3725687 - RNA, 19 nt, Human
ucugcaucuacucccaagu

SEQ ID NO: 3725688 - RNA, 20 nt, Human
ucugcaucugaccacgugcu

SEQ ID NO: 3725689 - RNA, 17 nt, Human
ucugcaucuuggggaca

SEQ ID NO: 3725690 - RNA, 14 nt, Human
ucugcaugcggccc

SEQ ID NO: 3725691 - RNA, 15 nt, Human
ucugcaugcggccca

SEQ ID NO: 3725692 - RNA, 16 nt, Human
ucugcaugcggcccag

SEQ ID NO: 3725693 - RNA, 18 nt, Human
ucugcaugcggcccagcc

SEQ ID NO: 3725694 - RNA, 20 nt, Human
ucugcaugcggcccagcccg

SEQ ID NO: 3725695 - RNA, 21 nt, Human
ucugcaugcggcccagcccgg

SEQ ID NO: 3725696 - RNA, 17 nt, Human
ucugcauucaggaucaa

SEQ ID NO: 3725697 - RNA, 16 nt, Human
ucugcauucuaguacu

SEQ ID NO: 3725698 - RNA, 21 nt, Human
ucugcauugcuagauaaaagc

SEQ ID NO: 3725699 - RNA, 13 nt, Human
ucugcauuuagca

SEQ ID NO: 3725700 - RNA, 10 nt, Human
ucugcauuuu

SEQ ID NO: 3725701 - RNA, 21 nt, Human
ucugcauuuucugaaacuaau

SEQ ID NO: 3725702 - RNA, 18 nt, Human
ucugcauuuugcuauugu

SEQ ID NO: 3725703 - RNA, 19 nt, Human
ucugcauuuugcuauugua

SEQ ID NO: 3725704 - RNA, 20 nt, Human
ucugccacagggacuugccu

SEQ ID NO: 3725705 - RNA, 13 nt, Human
ucugccacccagg

SEQ ID NO: 3725706 - RNA, 17 nt, Human
ucugccacccugcugag

SEQ ID NO: 3725707 - RNA, 15 nt, Human
ucugccaccuccccu

SEQ ID NO: 3725708 - RNA, 13 nt, Human
ucugccagccaca

SEQ ID NO: 3725709 - RNA, 23 nt, Human
ucugccaggcccccaagccugca

SEQ ID NO: 3725710 - RNA, 13 nt, Human
ucugccagggagc

SEQ ID NO: 3725711 - RNA, 19 nt, Human
ucugccagggccccucucc

SEQ ID NO: 3725712 - RNA, 19 nt, Human
ucugccagugacagacagg

SEQ ID NO: 3725713 - RNA, 18 nt, Human
ucugccauauucuguugg

SEQ ID NO: 3725714 - RNA, 22 nt, Human
ucugccauauucuguuggccag

SEQ ID NO: 3725715 - RNA, 23 nt, Human
ucugccauauucuguuggccagu

SEQ ID NO: 3725716 - RNA, 16 nt, Human
ucugcccacucccugc

SEQ ID NO: 3725717 - RNA, 23 nt, Human
ucugcccacucccugcaaccuga

SEQ ID NO: 3725718 - RNA, 13 nt, Human
ucugcccagagcu

SEQ ID NO: 3725719 - RNA, 19 nt, Human
ucugcccagagcuggguga

SEQ ID NO: 3725720 - RNA, 19 nt, Human
ucugcccagcuugggccca

SEQ ID NO: 3725721 - RNA, 13 nt, Human
ucugcccagcuuu

SEQ ID NO: 3725722 - RNA, 12 nt, Human
ucugcccaggac

SEQ ID NO: 3725723 - RNA, 18 nt, Human
ucugcccauuccccagcc

SEQ ID NO: 3725724 - RNA, 18 nt, Human
ucugccccagaggccucu

SEQ ID NO: 3725725 - RNA, 16 nt, Human
ucugccccagcccaga

SEQ ID NO: 3725726 - RNA, 18 nt, Human
ucugccccagcuugggca

SEQ ID NO: 3725727 - RNA, 11 nt, Human
ucugccccagu

SEQ ID NO: 3725728 - RNA, 19 nt, Human
ucugccccauccuccagca

SEQ ID NO: 3725729 - RNA, 19 nt, Human
ucugcccccagcccaaagg

SEQ ID NO: 3725730 - RNA, 16 nt, Human
ucugcccccugcagaa

SEQ ID NO: 3725731 - RNA, 18 nt, Human
ucugccccucccccaacc

SEQ ID NO: 3725732 - RNA, 22 nt, Human
ucugccccucuccaggcgccgg

SEQ ID NO: 3725733 - RNA, 17 nt, Human
ucugcccgccugcccac

SEQ ID NO: 3725734 - RNA, 14 nt, Human
ucugcccuccaaga

SEQ ID NO: 3725735 - RNA, 21 nt, Human
ucugcccucugcauccucugg

SEQ ID NO: 3725736 - RNA, 14 nt, Human
ucugcccuggcugc

SEQ ID NO: 3725737 - RNA, 17 nt, Human
ucugcccuggcugcugc

SEQ ID NO: 3725738 - RNA, 12 nt, Human
ucugcccugugg

SEQ ID NO: 3725739 - RNA, 15 nt, Human
ucugcccuguguacu

SEQ ID NO: 3725740 - RNA, 16 nt, Human
ucugcccuucacccca

SEQ ID NO: 3725741 - RNA, 18 nt, Human
ucugcccuugccaacgga

SEQ ID NO: 3725742 - RNA, 23 nt, Human
ucugccgcagcccugcagagggc

SEQ ID NO: 3725743 - RNA, 15 nt, Human
ucugccgcuaccucc

SEQ ID NO: 3725744 - RNA, 18 nt, Human
ucugccgcuaccucccuc

SEQ ID NO: 3725745 - RNA, 19 nt, Human
ucugccgcuaccucccucc

SEQ ID NO: 3725746 - RNA, 15 nt, Human
ucugccggcccuggg

SEQ ID NO: 3725747 - RNA, 15 nt, Human
ucugccgucucugga

SEQ ID NO: 3725748 - RNA, 16 nt, Human
ucugccgucucuggag

SEQ ID NO: 3725749 - RNA, 14 nt, Human
ucugccuaaggacu

SEQ ID NO: 3725750 - RNA, 16 nt, Human
ucugccucaaugugaa

SEQ ID NO: 3725751 - RNA, 20 nt, Human
ucugccucacauagcuuaca

SEQ ID NO: 3725752 - RNA, 13 nt, Human
ucugccucccauc

SEQ ID NO: 3725753 - RNA, 15 nt, Human
ucugccucccaucac

SEQ ID NO: 3725754 - RNA, 15 nt, Human
ucugccucucuagga

SEQ ID NO: 3725755 - RNA, 15 nt, Human
ucugccucucuugua

SEQ ID NO: 3725756 - RNA, 21 nt, Human
ucugccucugacacacagcuc

SEQ ID NO: 3725757 - RNA, 23 nt, Human
ucugccucugacacacagcucug

SEQ ID NO: 3725758 - RNA, 18 nt, Human
ucugccucugauguauuu

SEQ ID NO: 3725759 - RNA, 18 nt, Human
ucugccucuucugggagg

SEQ ID NO: 3725760 - RNA, 20 nt, Human
ucugccugaagucacacagu

SEQ ID NO: 3725761 - RNA, 16 nt, Human
ucugccugccagcugc

SEQ ID NO: 3725762 - RNA, 22 nt, Human
ucugccugccagcugcacugau

SEQ ID NO: 3725763 - RNA, 16 nt, Human
ucugccugcccaggcc

SEQ ID NO: 3725764 - RNA, 17 nt, Human
ucugccugcccaggccc

SEQ ID NO: 3725765 - RNA, 18 nt, Human
ucugccugcccaggcccc

SEQ ID NO: 3725766 - RNA, 17 nt, Human
ucugccugucccucuca

SEQ ID NO: 3725767 - RNA, 17 nt, Human
ucugccugugagccagu

SEQ ID NO: 3725768 - RNA, 19 nt, Human
ucugccuuagucucaguuu

SEQ ID NO: 3725769 - RNA, 18 nt, Human
ucugccuuuauuguguuu

SEQ ID NO: 3725770 - RNA, 23 nt, Human
ucugccuuuauuguguuugucau

SEQ ID NO: 3725771 - RNA, 16 nt, Human
ucugccuuugacauuu

SEQ ID NO: 3725772 - RNA, 15 nt, Human
ucugccuuugccagg

SEQ ID NO: 3725773 - RNA, 22 nt, Human
ucugccuuuggggacuuuucuu

SEQ ID NO: 3725774 - RNA, 19 nt, Human
ucugcggaucucagcuuug

SEQ ID NO: 3725775 - RNA, 16 nt, Human
ucugcgucaugcuugu

SEQ ID NO: 3725776 - RNA, 19 nt, Human
ucugcgucuauccugugua

SEQ ID NO: 3725777 - RNA, 16 nt, Human
ucugcgugggucagaa

SEQ ID NO: 3725778 - RNA, 20 nt, Human
ucugcuaaauugauguugau

SEQ ID NO: 3725779 - RNA, 21 nt, Human
ucugcuaaauugauguugaug

SEQ ID NO: 3725780 - RNA, 22 nt, Human
ucugcuaacuuggagccccagu

SEQ ID NO: 3725781 - RNA, 14 nt, Human
ucugcuaauaaaac

SEQ ID NO: 3725782 - RNA, 14 nt, Human
ucugcuaccucacu

SEQ ID NO: 3725783 - RNA, 17 nt, Human
ucugcuaccuugcccca

SEQ ID NO: 3725784 - RNA, 19 nt, Human
ucugcuacguuccuauugu

SEQ ID NO: 3725785 - RNA, 16 nt, Human
ucugcuauauauaaaa

SEQ ID NO: 3725786 - RNA, 13 nt, Human
ucugcuaugcuug

SEQ ID NO: 3725787 - RNA, 16 nt, Human
ucugcuaugugacuug

SEQ ID NO: 3725788 - RNA, 16 nt, Human
ucugcucacauaucug

SEQ ID NO: 3725789 - RNA, 17 nt, Human
ucugcucacauaucugu

SEQ ID NO: 3725790 - RNA, 13 nt, Human
ucugcucacuuua

SEQ ID NO: 3725791 - RNA, 19 nt, Human
ucugcucacuuuaaaccug

SEQ ID NO: 3725792 - RNA, 22 nt, Human
ucugcucagacagaaccccuac

SEQ ID NO: 3725793 - RNA, 14 nt, Human
ucugcucagcccug

SEQ ID NO: 3725794 - RNA, 16 nt, Human
ucugcucagcccugga

SEQ ID NO: 3725795 - RNA, 16 nt, Human
ucugcucagcucuggg

SEQ ID NO: 3725796 - RNA, 14 nt, Human
ucugcucagcuucu

SEQ ID NO: 3725797 - RNA, 15 nt, Human
ucugcucagcuucuc

SEQ ID NO: 3725798 - RNA, 23 nt, Human
ucugcucaucauucucugucuca

SEQ ID NO: 3725799 - RNA, 10 nt, Human
ucugcuccac

SEQ ID NO: 3725800 - RNA, 14 nt, Human
ucugcuccaccaca

SEQ ID NO: 3725801 - RNA, 20 nt, Human
ucugcuccaccacauccucc

SEQ ID NO: 3725802 - RNA, 23 nt, Human
ucugcuccaccuuucagcccacg

SEQ ID NO: 3725803 - RNA, 20 nt, Human
ucugcuccagcucuggcaug

SEQ ID NO: 3725804 - RNA, 11 nt, Human
ucugcucccaa

SEQ ID NO: 3725805 - RNA, 22 nt, Human
ucugcucccaaggggccugagc

SEQ ID NO: 3725806 - RNA, 15 nt, Human
ucugcuccucuccag

SEQ ID NO: 3725807 - RNA, 17 nt, Human
ucugcuccucuccaggc

SEQ ID NO: 3725808 - RNA, 16 nt, Human
ucugcuccuuuccccu

SEQ ID NO: 3725809 - RNA, 17 nt, Human
ucugcucgcccuccuuu

SEQ ID NO: 3725810 - RNA, 19 nt, Human
ucugcucgcccuccuuucu

SEQ ID NO: 3725811 - RNA, 17 nt, Human
ucugcucgggcccaggc

SEQ ID NO: 3725812 - RNA, 14 nt, Human
ucugcucuccuucc

SEQ ID NO: 3725813 - RNA, 19 nt, Human
ucugcucuccuuccuggag

SEQ ID NO: 3725814 - RNA, 12 nt, Human
ucugcucugccc

SEQ ID NO: 3725815 - RNA, 13 nt, Human
ucugcucugcccu

SEQ ID NO: 3725816 - RNA, 18 nt, Human
ucugcucugguuguuucu

SEQ ID NO: 3725817 - RNA, 13 nt, Human
ucugcucuugcau

SEQ ID NO: 3725818 - RNA, 18 nt, Human
ucugcucuuucucugcca

SEQ ID NO: 3725819 - RNA, 20 nt, Human
ucugcucuuucucugccagu

SEQ ID NO: 3725820 - RNA, 16 nt, Human
ucugcugaagacuugc

SEQ ID NO: 3725821 - RNA, 18 nt, Human
ucugcugacagacacagg

SEQ ID NO: 3725822 - RNA, 21 nt, Human
ucugcugacagacacaggccc

SEQ ID NO: 3725823 - RNA, 19 nt, Human
ucugcugaccugcugaccu

SEQ ID NO: 3725824 - RNA, 20 nt, Human
ucugcugaccugcugaccug

SEQ ID NO: 3725825 - RNA, 22 nt, Human
ucugcugaugacccccccagcu

SEQ ID NO: 3725826 - RNA, 21 nt, Human
ucugcugccgccccacccaga

SEQ ID NO: 3725827 - RNA, 17 nt, Human
ucuuuguucucagcucc

SEQ ID NO: 3725828 - RNA, 18 nt, Human
ucuuuguucucagcuccc

SEQ ID NO: 3725829 - RNA, 19 nt, Human
ucuuuguuuugugucucuu

SEQ ID NO: 3725830 - RNA, 18 nt, Human
ucuuuuaaaaauucaaau

SEQ ID NO: 3725831 - RNA, 14 nt, Human
ucuuuuaaaagaca

SEQ ID NO: 3725832 - RNA, 13 nt, Human
ucuuuuaaagacc

SEQ ID NO: 3725833 - RNA, 20 nt, Human
ucuuuuaaauuagaaaauau

SEQ ID NO: 3725834 - RNA, 20 nt, Human
ucuuuuaauuguuucagaau

SEQ ID NO: 3725835 - RNA, 14 nt, Human
ucuuuuacauucug

SEQ ID NO: 3725836 - RNA, 18 nt, Human
ucuuuuacccuggccccu

SEQ ID NO: 3725837 - RNA, 13 nt, Human
ucuuuuaccugcu

SEQ ID NO: 3725838 - RNA, 21 nt, Human
ucuuuuaccugcugcuucucc

SEQ ID NO: 3725839 - RNA, 17 nt, Human
ucuuuuagcugaugaac

SEQ ID NO: 3725840 - RNA, 18 nt, Human
ucuuuuagucauuuugcu

SEQ ID NO: 3725841 - RNA, 24 nt, Human
ucuuuuauaaaaaaaaugaaaugu

SEQ ID NO: 3725842 - RNA, 22 nt, Human
ucuuuuauaacuaguccuuuac

SEQ ID NO: 3725843 - RNA, 13 nt, Human
ucuuuuauaauuc

SEQ ID NO: 3725844 - RNA, 22 nt, Human
ucuuuuauaauucucauuaaaa

SEQ ID NO: 3725845 - RNA, 20 nt, Human
ucuuuuauaguggaaaaaca

SEQ ID NO: 3725846 - RNA, 14 nt, Human
ucuuuuauauuugu

SEQ ID NO: 3725847 - RNA, 17 nt, Human
ucuuuuauauuuguauc

SEQ ID NO: 3725848 - RNA, 22 nt, Human
ucuuuuauauuuguaucgaugu

SEQ ID NO: 3725849 - RNA, 15 nt, Human
ucuuuucacaaauaa

SEQ ID NO: 3725850 - RNA, 13 nt, Human
ucuuuucacauuc

SEQ ID NO: 3725851 - RNA, 14 nt, Human
ucuuuucacauucu

SEQ ID NO: 3725852 - RNA, 13 nt, Human
ucuuuucauacau

SEQ ID NO: 3725853 - RNA, 14 nt, Human
ucuuuucauacauu

SEQ ID NO: 3725854 - RNA, 16 nt, Human
ucuuuucauugaacag

SEQ ID NO: 3725855 - RNA, 19 nt, Human
ucuuuuccaaacacaggca

SEQ ID NO: 3725856 - RNA, 21 nt, Human
ucuuuucccauuuaucuaaau

SEQ ID NO: 3725857 - RNA, 18 nt, Human
ucuuuucccccaaagugg

SEQ ID NO: 3725858 - RNA, 15 nt, Human
ucuuuuccuguugua

SEQ ID NO: 3725859 - RNA, 22 nt, Human
ucuuuuccuguuuuuguuaacu

SEQ ID NO: 3725860 - RNA, 22 nt, Human
ucuuuucgccguggcugcggca

SEQ ID NO: 3725861 - RNA, 16 nt, Human
ucuuuucuacagcaaa

SEQ ID NO: 3725862 - RNA, 14 nt, Human
ucuuuucuauuuuc

SEQ ID NO: 3725863 - RNA, 21 nt, Human
ucuuuucucccuuuuaauccu

SEQ ID NO: 3725864 - RNA, 13 nt, Human
ucuuuucucugug

SEQ ID NO: 3725865 - RNA, 17 nt, Human
ucuuuucucugugcuuc

SEQ ID NO: 3725866 - RNA, 14 nt, Human
ucuuuucugaaucu

SEQ ID NO: 3725867 - RNA, 19 nt, Human
ucuuuucugaaucuucuga

SEQ ID NO: 3725868 - RNA, 16 nt, Human
ucuuuucuguacuucc

SEQ ID NO: 3725869 - RNA, 18 nt, Human
ucuuuucuguacuuccug

SEQ ID NO: 3725870 - RNA, 19 nt, Human
ucuuuucuuacuccuccuc

SEQ ID NO: 3725871 - RNA, 15 nt, Human
ucuuuucuuccuggc

SEQ ID NO: 3725872 - RNA, 13 nt, Human
ucuuuucuuuaga

SEQ ID NO: 3725873 - RNA, 15 nt, Human
ucuuuucuuuagaga

SEQ ID NO: 3725874 - RNA, 18 nt, Human
ucuuuucuuugccaucuc

SEQ ID NO: 3725875 - RNA, 20 nt, Human
ucuuuucuuugccaucucug

SEQ ID NO: 3725876 - RNA, 14 nt, Human
ucuuuucuuuuuac

SEQ ID NO: 3725877 - RNA, 17 nt, Human
ucuuuucuuuuuacaua

SEQ ID NO: 3725878 - RNA, 14 nt, Human
ucuuuugaaacaau

SEQ ID NO: 3725879 - RNA, 23 nt, Human
ucuuuugaauauucccaagccca

SEQ ID NO: 3725880 - RNA, 15 nt, Human
ucuuuugacaugugg

SEQ ID NO: 3725881 - RNA, 11 nt, Human
ucuuuugaccu

SEQ ID NO: 3725882 - RNA, 13 nt, Human
ucuuuugccauga

SEQ ID NO: 3725883 - RNA, 19 nt, Human
ucuuuugccguuauuaaaa

SEQ ID NO: 3725884 - RNA, 20 nt, Human
ucuuuugcuugccaaaguac

SEQ ID NO: 3725885 - RNA, 13 nt, Human
ucuuuuggcuucc

SEQ ID NO: 3725886 - RNA, 16 nt, Human
ucuuuuggggaaguga

SEQ ID NO: 3725887 - RNA, 20 nt, Human
ucuuuuggggaagugaggaa

SEQ ID NO: 3725888 - RNA, 22 nt, Human
ucuuuugguaaagacuggcuuu

SEQ ID NO: 3725889 - RNA, 20 nt, Human
ucuuuugguuaugaauacuu

SEQ ID NO: 3725890 - RNA, 13 nt, Human
ucuuuuguaagug

SEQ ID NO: 3725891 - RNA, 15 nt, Human
ucuuuuguaauuuaa

SEQ ID NO: 3725892 - RNA, 20 nt, Human
ucuuuuguauguaaaugugc

SEQ ID NO: 3725893 - RNA, 22 nt, Human
ucuuuuguauguaaaugugcau

SEQ ID NO: 3725894 - RNA, 21 nt, Human
ucuuuuguccugcaucaucuu

SEQ ID NO: 3725895 - RNA, 15 nt, Human
ucuuuuguuacuguu

SEQ ID NO: 3725896 - RNA, 19 nt, Human
ucuuuuguuacuguucuug

SEQ ID NO: 3725897 - RNA, 16 nt, Human
ucuuuuguuugguaaa

SEQ ID NO: 3725898 - RNA, 21 nt, Human
ucuuuuguuuuuugaaguguu

SEQ ID NO: 3725899 - RNA, 15 nt, Human
ucuuuuuaaaauggu

SEQ ID NO: 3725900 - RNA, 14 nt, Human
ucuuuuuaaaguuc

SEQ ID NO: 3725901 - RNA, 21 nt, Human
ucuuuuuaagcuuauuuaauu

SEQ ID NO: 3725902 - RNA, 12 nt, Human
ucuuuuuacaua

SEQ ID NO: 3725903 - RNA, 20 nt, Human
ucuuuuuacauaacugccuu

SEQ ID NO: 3725904 - RNA, 12 nt, Human
ucuuuuuaguuu

SEQ ID NO: 3725905 - RNA, 15 nt, Human
ucuuuuucuggacuc

SEQ ID NO: 3725906 - RNA, 17 nt, Human
ucuuuuucuguuguaac

SEQ ID NO: 3725907 - RNA, 17 nt, Human
ucuuuuucuucuucccu

SEQ ID NO: 3725908 - RNA, 15 nt, Human
ucuuuuugaaguauu

SEQ ID NO: 3725909 - RNA, 20 nt, Human
ucuuuuugcucuaaaauauu

SEQ ID NO: 3725910 - RNA, 20 nt, Human
ucuuuuuguagcuggggcuu

SEQ ID NO: 3725911 - RNA, 16 nt, Human
ucuuuuuguuguaaaa

SEQ ID NO: 3725912 - RNA, 12 nt, Human
ucuuuuuguuug

SEQ ID NO: 3725913 - RNA, 17 nt, Human
ucuuuuuuaaauuuucu

SEQ ID NO: 3725914 - RNA, 23 nt, Human
ucuuuuuuaaccgguaagaguuu

SEQ ID NO: 3725915 - RNA, 16 nt, Human
ucuuuuuuauuaauca

SEQ ID NO: 3725916 - RNA, 21 nt, Human
ucuuuuuuauuaaucacugug

SEQ ID NO: 3725917 - RNA, 13 nt, Human
ucuuuuuucaaaa

SEQ ID NO: 3725918 - RNA, 13 nt, Human
ucuuuuuucguuu

SEQ ID NO: 3725919 - RNA, 21 nt, Human
ucuuuuuucuaaaguaaaaac

SEQ ID NO: 3725920 - RNA, 23 nt, Human
ucuuuuuuguuuguuucuuugug

SEQ ID NO: 3725921 - RNA, 17 nt, Human
ucuuuuuuuggcccagg

SEQ ID NO: 3725922 - RNA, 22 nt, Human
ucuuuuuuuggugauucaaaug

SEQ ID NO: 3725923 - RNA, 23 nt, Human
ucuuuuuuuguauaguuaacaca

SEQ ID NO: 3725924 - RNA, 14 nt, Human
ucuuuuuuugugau

SEQ ID NO: 3725925 - RNA, 20 nt, Human
ucuuuuuuuuaaugugcugu

SEQ ID NO: 3725926 - RNA, 18 nt, Human
ucuuuuuuuuuaaguucu

SEQ ID NO: 3725927 - RNA, 19 nt, Human
ucuuuuuuuuuuaagugaa

SEQ ID NO: 3725928 - RNA, 21 nt, Human
ugaaaaaaaaaaugcugaaca

SEQ ID NO: 3725929 - RNA, 22 nt, Human
ugaaaaaaaaaaugcugaacau

SEQ ID NO: 3725930 - RNA, 16 nt, Human
ugaaaaaaaacagugg

SEQ ID NO: 3725931 - RNA, 14 nt, Human
ugaaaaaaaaguuu

SEQ ID NO: 3725932 - RNA, 16 nt, Human
ugaaaaaaaauaaauu

SEQ ID NO: 3725933 - RNA, 16 nt, Human
ugaaaaaaacuucauu

SEQ ID NO: 3725934 - RNA, 18 nt, Human
ugaaaaaaauaauuuuaa

SEQ ID NO: 3725935 - RNA, 13 nt, Human
ugaaaaaagcuca

SEQ ID NO: 3725936 - RNA, 22 nt, Human
ugaaaaaauagagccugaggga

SEQ ID NO: 3725937 - RNA, 20 nt, Human
ugaaaaaauuuaaaaguaaa

SEQ ID NO: 3725938 - RNA, 21 nt, Human
ugaaaaaauuuacuuuaaacu

SEQ ID NO: 3725939 - RNA, 12 nt, Human
ugaaaaacauga

SEQ ID NO: 3725940 - RNA, 13 nt, Human
ugaaaaagcagac

SEQ ID NO: 3725941 - RNA, 21 nt, Human
ugaaaaagcagcuaccaggug

SEQ ID NO: 3725942 - RNA, 16 nt, Human
ugaaaaagcauguaca

SEQ ID NO: 3725943 - RNA, 21 nt, Human
ugaaaaagcauguacaguguu

SEQ ID NO: 3725944 - RNA, 13 nt, Human
ugaaaaagcgaaa

SEQ ID NO: 3725945 - RNA, 16 nt, Human
ugaaaaaggaggaaga

SEQ ID NO: 3725946 - RNA, 22 nt, Human
ugaaaaaguauccugcuucuga

SEQ ID NO: 3725947 - RNA, 18 nt, Human
ugaaaaaucggcuuacca

SEQ ID NO: 3725948 - RNA, 23 nt, Human
ugaaaaaucuguugauaaaucca

SEQ ID NO: 3725949 - RNA, 20 nt, Human
ugaaaaauuccuauugugau

SEQ ID NO: 3725950 - RNA, 19 nt, Human
ugaaaaauuccuuuguguu

SEQ ID NO: 3725951 - RNA, 13 nt, Human
ugaaaaauucuca

SEQ ID NO: 3725952 - RNA, 16 nt, Human
ugaaaaauugcugacu

SEQ ID NO: 3725953 - RNA, 23 nt, Human
ugaaaaauugcugacuguagcuu

SEQ ID NO: 3725954 - RNA, 12 nt, Human
ugaaaacaagug

SEQ ID NO: 3725955 - RNA, 13 nt, Human
ugaaaacaagugc

SEQ ID NO: 3725956 - RNA, 15 nt, Human
ugaaaacaagugcug

SEQ ID NO: 3725957 - RNA, 12 nt, Human
ugaaaacacauu

SEQ ID NO: 3725958 - RNA, 15 nt, Human
ugaaaacacauuuuu

SEQ ID NO: 3725959 - RNA, 18 nt, Human
ugaaaacacugugcacau

SEQ ID NO: 3725960 - RNA, 17 nt, Human
ugaaaacacuguucucu

SEQ ID NO: 3725961 - RNA, 20 nt, Human
ugaaaacacuguucucugcc

SEQ ID NO: 3725962 - RNA, 21 nt, Human
ugaaaacacuguucucugccc

SEQ ID NO: 3725963 - RNA, 23 nt, Human
ugaaaacacuguucucugcccuc

SEQ ID NO: 3725964 - RNA, 20 nt, Human
ugaaaacaguguguaaacaa

SEQ ID NO: 3725965 - RNA, 14 nt, Human
ugaaaacauaaaaa

SEQ ID NO: 3725966 - RNA, 13 nt, Human
ugaaaacaucugg

SEQ ID NO: 3725967 - RNA, 19 nt, Human
ugaaaacaugguagaauug

SEQ ID NO: 3725968 - RNA, 23 nt, Human
ugaaaacaugguagaauuggaga

SEQ ID NO: 3725969 - RNA, 18 nt, Human
ugaaaaccaacaccauca

SEQ ID NO: 3725970 - RNA, 18 nt, Human
ugaaaaccacauuggaga

SEQ ID NO: 3725971 - RNA, 18 nt, Human
ugaaaaccaucuggccug

SEQ ID NO: 3725972 - RNA, 20 nt, Human
ugaaaaccaucuggccuggc

SEQ ID NO: 3725973 - RNA, 15 nt, Human
ugaaaacccagagag

SEQ ID NO: 3725974 - RNA, 18 nt, Human
ugaaaaccuaaaagacag

SEQ ID NO: 3725975 - RNA, 16 nt, Human
ugaaaaccuacauauu

SEQ ID NO: 3725976 - RNA, 16 nt, Human
ugaaaacguuuuauug

SEQ ID NO: 3725977 - RNA, 19 nt, Human
ggcuggaggcccaggcugg

SEQ ID NO: 3725978 - RNA, 13 nt, Human
ggcuggaguacag

SEQ ID NO: 3725979 - RNA, 14 nt, Human
ggcuggagugagga

SEQ ID NO: 3725980 - RNA, 16 nt, Human
ggcuggagugaggaaa

SEQ ID NO: 3725981 - RNA, 20 nt, Human
ggcuggagugcaguggcgcg

SEQ ID NO: 3725982 - RNA, 23 nt, Human
ggcuggaguuauugaagcagagu

SEQ ID NO: 3725983 - RNA, 16 nt, Human
ggcuggaguuggggca

SEQ ID NO: 3725984 - RNA, 17 nt, Human
ggcuggaguuggggcag

SEQ ID NO: 3725985 - RNA, 22 nt, Human
ggcuggaguuggggcagaggag

SEQ ID NO: 3725986 - RNA, 14 nt, Human
ggcuggaugagcuc

SEQ ID NO: 3725987 - RNA, 18 nt, Human
ggcuggaugagcucccac

SEQ ID NO: 3725988 - RNA, 19 nt, Human
ggcuggaugagcucccaca

SEQ ID NO: 3725989 - RNA, 21 nt, Human
ggcuggauuuugaauuuucuu

SEQ ID NO: 3725990 - RNA, 14 nt, Human
ggcuggcacaggac

SEQ ID NO: 3725991 - RNA, 19 nt, Human
ggcuggcaccgccuucucu

SEQ ID NO: 3725992 - RNA, 14 nt, Human
ggcuggcagcucuc

SEQ ID NO: 3725993 - RNA, 18 nt, Human
ggcuggcagcucuccagu

SEQ ID NO: 3725994 - RNA, 22 nt, Human
ggcuggcaugauccaagcaaga

SEQ ID NO: 3725995 - RNA, 18 nt, Human
ggcuggccagccccacag

SEQ ID NO: 3725996 - RNA, 23 nt, Human
ggcuggccagccgcucuccugcc

SEQ ID NO: 3725997 - RNA, 21 nt, Human
ggcuggccaguccaggcugcc

SEQ ID NO: 3725998 - RNA, 22 nt, Human
ggcuggccaguccaggcugccg

SEQ ID NO: 3725999 - RNA, 12 nt, Human
ggcuggcccagc

SEQ ID NO: 3726000 - RNA, 13 nt, Human
ggcuggcccagcc

SEQ ID NO: 3726001 - RNA, 15 nt, Human
ggcuggcccagcccu

SEQ ID NO: 3726002 - RNA, 16 nt, Human
ggcuggcccagcccug

SEQ ID NO: 3726003 - RNA, 17 nt, Human
ggcuggcccagcccugc

SEQ ID NO: 3726004 - RNA, 20 nt, Human
ggcuggcccagcccugcugg

SEQ ID NO: 3726005 - RNA, 15 nt, Human
ggcuggcccugcccu

SEQ ID NO: 3726006 - RNA, 16 nt, Human
ggcuggcccugcccug

SEQ ID NO: 3726007 - RNA, 20 nt, Human
ggcuggccucccaaaugagc

SEQ ID NO: 3726008 - RNA, 13 nt, Human
ggcuggccuggcc

SEQ ID NO: 3726009 - RNA, 14 nt, Human
ggcuggccuggccc

SEQ ID NO: 3726010 - RNA, 14 nt, Human
ggcuggccuuccug

SEQ ID NO: 3726011 - RNA, 17 nt, Human
ggcuggcgcagccaagg

SEQ ID NO: 3726012 - RNA, 19 nt, Human
ggcuggcgcagccaaggcc

SEQ ID NO: 3726013 - RNA, 14 nt, Human
ggcuggcgugcagu

SEQ ID NO: 3726014 - RNA, 16 nt, Human
ggcuggcgugcagugg

SEQ ID NO: 3726015 - RNA, 20 nt, Human
ggcuggcgugcaguggugcg

SEQ ID NO: 3726016 - RNA, 24 nt, Human
ggcuggcuccagaugcagggcagu

SEQ ID NO: 3726017 - RNA, 18 nt, Human
ggcuggcuccccugcagc

SEQ ID NO: 3726018 - RNA, 20 nt, Human
ggcuggcuccccugcagccc

SEQ ID NO: 3726019 - RNA, 15 nt, Human
ggcuggcuccugauc

SEQ ID NO: 3726020 - RNA, 12 nt, Human
ggcuggcugagg

SEQ ID NO: 3726021 - RNA, 13 nt, Human
ggcuggcugggca

SEQ ID NO: 3726022 - RNA, 13 nt, Human
ggcuggcuucagg

SEQ ID NO: 3726023 - RNA, 14 nt, Human
ggcuggcuuuucug

SEQ ID NO: 3726024 - RNA, 19 nt, Human
ggcugggacguggcucagc

SEQ ID NO: 3726025 - RNA, 19 nt, Human
ggcugggagagccuuccag

SEQ ID NO: 3726026 - RNA, 19 nt, Human
ggcugggcaaggaaaaaga

SEQ ID NO: 3726027 - RNA, 23 nt, Human
ggcugggcaaggaaaaagaaaau

SEQ ID NO: 3726028 - RNA, 17 nt, Human
ggcugggcaaggaggcc

SEQ ID NO: 3726029 - RNA, 13 nt, Human
ggcugggcagagg

SEQ ID NO: 3726030 - RNA, 15 nt, Human
ggcugggcagaggaa

SEQ ID NO: 3726031 - RNA, 12 nt, Human
ggcugggcagcu

SEQ ID NO: 3726032 - RNA, 19 nt, Human
ggcugggccccccagcuca

SEQ ID NO: 3726033 - RNA, 20 nt, Human
ggcugggcucccuucccacc

SEQ ID NO: 3726034 - RNA, 18 nt, Human
ggcugggcuucaguggca

SEQ ID NO: 3726035 - RNA, 22 nt, Human
ggcugggcuucaguggcagcug

SEQ ID NO: 3726036 - RNA, 12 nt, Human
ggcuggggcagc

SEQ ID NO: 3726037 - RNA, 16 nt, Human
ggcuggggcugaccuu

SEQ ID NO: 3726038 - RNA, 19 nt, Human
ggcugggggaugggccuga

SEQ ID NO: 3726039 - RNA, 18 nt, Human
ggcugggggcaggagggc

SEQ ID NO: 3726040 - RNA, 15 nt, Human
ggcugggggccucac

SEQ ID NO: 3726041 - RNA, 17 nt, Human
ggcuggggucccagcag

SEQ ID NO: 3726042 - RNA, 20 nt, Human
ggcugggguggccugugugg

SEQ ID NO: 3726043 - RNA, 20 nt, Human
ggcugggucgcccuggacug

SEQ ID NO: 3726044 - RNA, 16 nt, Human
ggcugggugcccacag

SEQ ID NO: 3726045 - RNA, 19 nt, Human
ggcuggguucuacccaggu

SEQ ID NO: 3726046 - RNA, 15 nt, Human
ggcugguagcucagg

SEQ ID NO: 3726047 - RNA, 13 nt, Human
ggcuggugcaggg

SEQ ID NO: 3726048 - RNA, 15 nt, Human
ggcuggugccagccu

SEQ ID NO: 3726049 - RNA, 22 nt, Human
ggcugguggagaacucuggcuu

SEQ ID NO: 3726050 - RNA, 13 nt, Human
ggcugguggccca

SEQ ID NO: 3726051 - RNA, 14 nt, Human
ggcugguggcccag

SEQ ID NO: 3726052 - RNA, 21 nt, Human
ggcugguggcucccggagggc

SEQ ID NO: 3726053 - RNA, 13 nt, Human
ggcuggugggagg

SEQ ID NO: 3726054 - RNA, 23 nt, Human
ggcuggugggugccuaggccugg

SEQ ID NO: 3726055 - RNA, 22 nt, Human
ggcuggugugguacagagaagc

SEQ ID NO: 3726056 - RNA, 21 nt, Human
ggcugguguuaacagaaggga

SEQ ID NO: 3726057 - RNA, 18 nt, Human
ggcugguuuggaaugcuu

SEQ ID NO: 3726058 - RNA, 13 nt, Human
ggcugguuuugua

SEQ ID NO: 3726059 - RNA, 16 nt, Human
ggcuguaacugccagg

SEQ ID NO: 3726060 - RNA, 15 nt, Human
ggcuguaaggcucua

SEQ ID NO: 3726061 - RNA, 18 nt, Human
ggcuguaucccaugagcc

SEQ ID NO: 3726062 - RNA, 18 nt, Human
ggcugucagcaggaagca

SEQ ID NO: 3726063 - RNA, 22 nt, Human
ggcugucaguguuuggugcacg

SEQ ID NO: 3726064 - RNA, 13 nt, Human
ggcugucaucuga

SEQ ID NO: 3726065 - RNA, 17 nt, Human
ggcugucaucugugcac

SEQ ID NO: 3726066 - RNA, 14 nt, Human
ggcuguccacccgc

SEQ ID NO: 3726067 - RNA, 15 nt, Human
ggcuguccagugccc

SEQ ID NO: 3726068 - RNA, 19 nt, Human
ggcuguccagugcccauuc

SEQ ID NO: 3726069 - RNA, 18 nt, Human
ggcugucuucucaggcuc

SEQ ID NO: 3726070 - RNA, 11 nt, Human
ggcugugagug

SEQ ID NO: 3726071 - RNA, 16 nt, Human
ggcugugcugcccuga

SEQ ID NO: 3726072 - RNA, 19 nt, Human
ggcugugcuugaaggcccu

SEQ ID NO: 3726073 - RNA, 12 nt, Human
ggcuguggaagg

SEQ ID NO: 3726074 - RNA, 23 nt, Human
ggcuguggaccauggaguggcag

SEQ ID NO: 3726075 - RNA, 13 nt, Human
ggcuguggagaca

SEQ ID NO: 3726076 - RNA, 23 nt, Human
ggcuguggcauccagagucccug

SEQ ID NO: 3726077 - RNA, 14 nt, Human
ggcugugggcuccc

SEQ ID NO: 3726078 - RNA, 15 nt, Human
ggcugugggcucccu

SEQ ID NO: 3726079 - RNA, 16 nt, Human
ggcugugggcucccuu

SEQ ID NO: 3726080 - RNA, 15 nt, Human
ggcugugucuaaacu

SEQ ID NO: 3726081 - RNA, 16 nt, Human
ggcugugucuaaacug

SEQ ID NO: 3726082 - RNA, 14 nt, Human
ggcuguguuggugu

SEQ ID NO: 3726083 - RNA, 18 nt, Human
ggcuguucugugguuccu

SEQ ID NO: 3726084 - RNA, 12 nt, Human
ggcuguuggcac

SEQ ID NO: 3726085 - RNA, 15 nt, Human
ggcuguuggcaguga

SEQ ID NO: 3726086 - RNA, 16 nt, Human
ggcuguuuuugggugc

SEQ ID NO: 3726087 - RNA, 14 nt, Human
ggcuuaaaaaaaac

SEQ ID NO: 3726088 - RNA, 15 nt, Human
ggcuuaaaacaacac

SEQ ID NO: 3726089 - RNA, 19 nt, Human
ggcuuaagaaaucuaguau

SEQ ID NO: 3726090 - RNA, 22 nt, Human
ggcuuaauaaaaaugacagacu

SEQ ID NO: 3726091 - RNA, 12 nt, Human
ggcuuaauguuu

SEQ ID NO: 3726092 - RNA, 19 nt, Human
ggcuuaccugaccucuugc

SEQ ID NO: 3726093 - RNA, 22 nt, Human
ggcuuaccugaccucuugcugu

SEQ ID NO: 3726094 - RNA, 20 nt, Human
ggcuuaccuggcccaucagg

SEQ ID NO: 3726095 - RNA, 17 nt, Human
ggcuuacggcccuggcc

SEQ ID NO: 3726096 - RNA, 18 nt, Human
ggcuuagcuuugcucugc

SEQ ID NO: 3726097 - RNA, 22 nt, Human
ggcuuagggacaggaccccagc

SEQ ID NO: 3726098 - RNA, 17 nt, Human
ggcuuagugauguaauu

SEQ ID NO: 3726099 - RNA, 16 nt, Human
ggcuuauaauucuuuc

SEQ ID NO: 3726100 - RNA, 15 nt, Human
ggcuuauauucaacc

SEQ ID NO: 3726101 - RNA, 21 nt, Human
ggcuuauauucaaccauggac

SEQ ID NO: 3726102 - RNA, 20 nt, Human
ggcuuauuuauuaacaggau

SEQ ID NO: 3726103 - RNA, 21 nt, Human
ggcuucaauuuauugcacaaa

SEQ ID NO: 3726104 - RNA, 12 nt, Human
ggcuucacagau

SEQ ID NO: 3726105 - RNA, 17 nt, Human
ggcuucacuccugcugu

SEQ ID NO: 3726106 - RNA, 15 nt, Human
ggcuucacuguauaa

SEQ ID NO: 3726107 - RNA, 18 nt, Human
ggcuucacuguauaaaua

SEQ ID NO: 3726108 - RNA, 21 nt, Human
ggcuucacuguauaaauagga

SEQ ID NO: 3726109 - RNA, 13 nt, Human
ggcuucagccuag

SEQ ID NO: 3726110 - RNA, 24 nt, Human
ggcuucagccuaguggcuuguccu

SEQ ID NO: 3726111 - RNA, 18 nt, Human
ggcuucaggggagucccg

SEQ ID NO: 3726112 - RNA, 22 nt, Human
ggcuucagggugggaguaguug

SEQ ID NO: 3726113 - RNA, 16 nt, Human
ggcuucagguccaggc

SEQ ID NO: 3726114 - RNA, 15 nt, Human
ggcuucaguggcagc

SEQ ID NO: 3726115 - RNA, 17 nt, Human
ggcuucaguggcagcug

SEQ ID NO: 3726116 - RNA, 18 nt, Human
ggcuucaguggcagcugc

SEQ ID NO: 3726117 - RNA, 20 nt, Human
ggcuucaguggcagcugcuu

SEQ ID NO: 3726118 - RNA, 11 nt, Human
ggcuucauaca

SEQ ID NO: 3726119 - RNA, 18 nt, Human
ggcuucauccuccucaga

SEQ ID NO: 3726120 - RNA, 16 nt, Human
ggcuucaugccagcua

SEQ ID NO: 3726121 - RNA, 14 nt, Human
ggcuuccaaggugg

SEQ ID NO: 3726122 - RNA, 22 nt, Human
ggcuuccagagaguccucugga

SEQ ID NO: 3726123 - RNA, 23 nt, Human
ggcuuccaucccaaccagugcca

SEQ ID NO: 3726124 - RNA, 18 nt, Human
ggcuuccauuugugugug

SEQ ID NO: 3726125 - RNA, 23 nt, Human
ggcuucccaaaugugugcccagc

SEQ ID NO: 3726126 - RNA, 21 nt, Human
ggcuucccaguggcugcugcc

SEQ ID NO: 3726127 - RNA, 11 nt, Human
ucugcugcugg

SEQ ID NO: 3726128 - RNA, 19 nt, Human
ucugcuggaguuucaugua

SEQ ID NO: 3726129 - RNA, 18 nt, Human
ucugcuggauaaaaugag

SEQ ID NO: 3726130 - RNA, 12 nt, Human
ucugcuggccca

SEQ ID NO: 3726131 - RNA, 20 nt, Human
ucugcuggcccagccaaacc

SEQ ID NO: 3726132 - RNA, 18 nt, Human
ucugcuggccuggaucuc

SEQ ID NO: 3726133 - RNA, 24 nt, Human
ucugcugggcuggggccugauggg

SEQ ID NO: 3726134 - RNA, 16 nt, Human
ucugcuggggccuggg

SEQ ID NO: 3726135 - RNA, 15 nt, Human
ucugcuggucuucaa

SEQ ID NO: 3726136 - RNA, 17 nt, Human
ucugcugguuuuaacaa

SEQ ID NO: 3726137 - RNA, 13 nt, Human
ucugcuguagaaa

SEQ ID NO: 3726138 - RNA, 15 nt, Human
ucugcuguccagaca

SEQ ID NO: 3726139 - RNA, 19 nt, Human
ucugcuguccagacagccu

SEQ ID NO: 3726140 - RNA, 15 nt, Human
ucugcuguccccuug

SEQ ID NO: 3726141 - RNA, 22 nt, Human
ucugcuguccccuuggcagguc

SEQ ID NO: 3726142 - RNA, 16 nt, Human
ucugcuguccuugccu

SEQ ID NO: 3726143 - RNA, 15 nt, Human
ucugcugucucagcc

SEQ ID NO: 3726144 - RNA, 12 nt, Human
ucugcuuaaaaa

SEQ ID NO: 3726145 - RNA, 17 nt, Human
ucugcuuacaauucccu

SEQ ID NO: 3726146 - RNA, 20 nt, Human
ucugcuuacaauucccugcu

SEQ ID NO: 3726147 - RNA, 15 nt, Human
ucugcuucagccucc

SEQ ID NO: 3726148 - RNA, 14 nt, Human
ucugcuucagugga

SEQ ID NO: 3726149 - RNA, 14 nt, Human
ucugcuucccaggu

SEQ ID NO: 3726150 - RNA, 22 nt, Human
ucugcuucucugacuucugccu

SEQ ID NO: 3726151 - RNA, 20 nt, Human
ucugcuugagucagguuuga

SEQ ID NO: 3726152 - RNA, 12 nt, Human
ucugcuugccau

SEQ ID NO: 3726153 - RNA, 14 nt, Human
ucugcuugccaucc

SEQ ID NO: 3726154 - RNA, 18 nt, Human
ucugcuugcucuuguccu

SEQ ID NO: 3726155 - RNA, 16 nt, Human
ucugcuugcuuggccc

SEQ ID NO: 3726156 - RNA, 17 nt, Human
ucugcuuuagacuugaa

SEQ ID NO: 3726157 - RNA, 19 nt, Human
ucugcuuuagacuugaaaa

SEQ ID NO: 3726158 - RNA, 18 nt, Human
ucugcuuuguugugugcc

SEQ ID NO: 3726159 - RNA, 22 nt, Human
ucugcuuuuaucucagauguua

SEQ ID NO: 3726160 - RNA, 18 nt, Human
ucugcuuuucugcccugg

SEQ ID NO: 3726161 - RNA, 22 nt, Human
ucugcuuuucugcccuggcugc

SEQ ID NO: 3726162 - RNA, 13 nt, Human
ucuggaaaagagg

SEQ ID NO: 3726163 - RNA, 15 nt, Human
ucuggaaaggaggaa

SEQ ID NO: 3726164 - RNA, 19 nt, Human
ucuggaaaggggggagcug

SEQ ID NO: 3726165 - RNA, 15 nt, Human
ucuggaacccagacu

SEQ ID NO: 3726166 - RNA, 19 nt, Human
ucuggaaccucagccuggc

SEQ ID NO: 3726167 - RNA, 20 nt, Human
ucuggaaccucagccuggcc

SEQ ID NO: 3726168 - RNA, 14 nt, Human
ucuggaagaaaaaa

SEQ ID NO: 3726169 - RNA, 15 nt, Human
ucuggaagaugggga

SEQ ID NO: 3726170 - RNA, 18 nt, Human
ucuggaagcccuggagac

SEQ ID NO: 3726171 - RNA, 18 nt, Human
ucuggaaguuuguuuaaa

SEQ ID NO: 3726172 - RNA, 22 nt, Human
ucuggaauacaugaaauauaga

SEQ ID NO: 3726173 - RNA, 23 nt, Human
ucuggaaucauuguccagagcug

SEQ ID NO: 3726174 - RNA, 15 nt, Human
ucuggaaugcagugg

SEQ ID NO: 3726175 - RNA, 16 nt, Human
ucuggaauguaaucaa

SEQ ID NO: 3726176 - RNA, 18 nt, Human
ucuggaauguaaucaaug

SEQ ID NO: 3726177 - RNA, 18 nt, Human
ucuggacaggcucugcuu

SEQ ID NO: 3726178 - RNA, 17 nt, Human
ucuggacagucagcucu

SEQ ID NO: 3726179 - RNA, 23 nt, Human
ucuggaccaacccuguuuccuga

SEQ ID NO: 3726180 - RNA, 21 nt, Human
ucuggaccccaucugugaaua

SEQ ID NO: 3726181 - RNA, 23 nt, Human
ucuggaccccaucugugaauaag

SEQ ID NO: 3726182 - RNA, 14 nt, Human
ucuggacggcaggc

SEQ ID NO: 3726183 - RNA, 15 nt, Human
ucuggacggcaggcu

SEQ ID NO: 3726184 - RNA, 19 nt, Human
ucuggacggcaggcucacu

SEQ ID NO: 3726185 - RNA, 15 nt, Human
ucuggacuccucugu

SEQ ID NO: 3726186 - RNA, 16 nt, Human
ucuggacuccucuguc

SEQ ID NO: 3726187 - RNA, 22 nt, Human
ucuggacuccucuguccaggca

SEQ ID NO: 3726188 - RNA, 15 nt, Human
ucuggacucuaaaga

SEQ ID NO: 3726189 - RNA, 18 nt, Human
ucuggacucuaaagacca

SEQ ID NO: 3726190 - RNA, 17 nt, Human
ucuggacugaagccugc

SEQ ID NO: 3726191 - RNA, 19 nt, Human
ucuggacugaagccugcag

SEQ ID NO: 3726192 - RNA, 17 nt, Human
ucuggacugacagcaug

SEQ ID NO: 3726193 - RNA, 20 nt, Human
ucuggacuuucucuaauaau

SEQ ID NO: 3726194 - RNA, 16 nt, Human
ucuggagaagcaguga

SEQ ID NO: 3726195 - RNA, 16 nt, Human
ucuggagaauaauucu

SEQ ID NO: 3726196 - RNA, 15 nt, Human
ucuggagacagcccc

SEQ ID NO: 3726197 - RNA, 17 nt, Human
ucuggagacagccccag

SEQ ID NO: 3726198 - RNA, 20 nt, Human
ucuggagacagccccagagc

SEQ ID NO: 3726199 - RNA, 22 nt, Human
ucuggagacagccccagagcag

SEQ ID NO: 3726200 - RNA, 16 nt, Human
ucuggagaccaccagg

SEQ ID NO: 3726201 - RNA, 21 nt, Human
ucuggagaccagggagccuuu

SEQ ID NO: 3726202 - RNA, 23 nt, Human
ucuggagagcuagaaccuggagg

SEQ ID NO: 3726203 - RNA, 15 nt, Human
ucuggagcauuucuc

SEQ ID NO: 3726204 - RNA, 16 nt, Human
ucuggagccaagucca

SEQ ID NO: 3726205 - RNA, 19 nt, Human
ucuggagccaccuguccca

SEQ ID NO: 3726206 - RNA, 16 nt, Human
ucuggagcccacugua

SEQ ID NO: 3726207 - RNA, 22 nt, Human
ucuggagcccacuguacuugcu

SEQ ID NO: 3726208 - RNA, 14 nt, Human
ucuggaggccucug

SEQ ID NO: 3726209 - RNA, 15 nt, Human
ucuggaggccucugg

SEQ ID NO: 3726210 - RNA, 16 nt, Human
ucuggaggccuuccag

SEQ ID NO: 3726211 - RNA, 17 nt, Human
ucuggaggccuuccagc

SEQ ID NO: 3726212 - RNA, 19 nt, Human
ucuggaggccuuccagcug

SEQ ID NO: 3726213 - RNA, 20 nt, Human
ucuggaggccuuccagcugc

SEQ ID NO: 3726214 - RNA, 15 nt, Human
ucuggaggggagcuc

SEQ ID NO: 3726215 - RNA, 23 nt, Human
ucuggaggggccccugcuucucc

SEQ ID NO: 3726216 - RNA, 18 nt, Human
ucuggagguacgaaaaga

SEQ ID NO: 3726217 - RNA, 17 nt, Human
ucuggaguauucuauaa

SEQ ID NO: 3726218 - RNA, 21 nt, Human
ucuggagucucacuugucuca

SEQ ID NO: 3726219 - RNA, 15 nt, Human
ucuggaguggccacu

SEQ ID NO: 3726220 - RNA, 19 nt, Human
ucuggaguggccacuaagc

SEQ ID NO: 3726221 - RNA, 16 nt, Human
ucuggaguugaucugg

SEQ ID NO: 3726222 - RNA, 21 nt, Human
ucuggaguugaucuggaaccc

SEQ ID NO: 3726223 - RNA, 22 nt, Human
ucuggaguuuuuguuuggagag

SEQ ID NO: 3726224 - RNA, 18 nt, Human
ucuggauaacuuccacag

SEQ ID NO: 3726225 - RNA, 16 nt, Human
ucuggauaggagccug

SEQ ID NO: 3726226 - RNA, 13 nt, Human
ucuggaucaguaa

SEQ ID NO: 3726227 - RNA, 15 nt, Human
ucuggaucaguaaaa

SEQ ID NO: 3726228 - RNA, 14 nt, Human
ucuggaucugggac

SEQ ID NO: 3726229 - RNA, 22 nt, Human
ucuggaugccugauugccaagc

SEQ ID NO: 3726230 - RNA, 18 nt, Human
ucuggauuauauuaugaa

SEQ ID NO: 3726231 - RNA, 14 nt, Human
ucuggauucagccu

SEQ ID NO: 3726232 - RNA, 15 nt, Human
ucuggauucagccuu

SEQ ID NO: 3726233 - RNA, 16 nt, Human
ucuggauucagccuuc

SEQ ID NO: 3726234 - RNA, 19 nt, Human
ucuggauucagccuucuuu

SEQ ID NO: 3726235 - RNA, 15 nt, Human
ucuggauucauauuu

SEQ ID NO: 3726236 - RNA, 13 nt, Human
ucuggauucccag

SEQ ID NO: 3726237 - RNA, 22 nt, Human
ucuggauucccaggaugagcau

SEQ ID NO: 3726238 - RNA, 20 nt, Human
ucuggauuccccaucucagg

SEQ ID NO: 3726239 - RNA, 18 nt, Human
ucuggcaaggacuuugua

SEQ ID NO: 3726240 - RNA, 23 nt, Human
ucuggcaaggacuuuguacauuu

SEQ ID NO: 3726241 - RNA, 22 nt, Human
ucuggcaaugccacagcccugu

SEQ ID NO: 3726242 - RNA, 22 nt, Human
ucuggcaauggaugaacugaaa

SEQ ID NO: 3726243 - RNA, 13 nt, Human
ucuggcacagccu

SEQ ID NO: 3726244 - RNA, 15 nt, Human
ucuggcacagccugc

SEQ ID NO: 3726245 - RNA, 20 nt, Human
ucuggcagaguugaagacag

SEQ ID NO: 3726246 - RNA, 21 nt, Human
ucuggcagccacacuucucag

SEQ ID NO: 3726247 - RNA, 23 nt, Human
ucuggcagccacacuucucagga

SEQ ID NO: 3726248 - RNA, 21 nt, Human
ucuggcagccucccauccagg

SEQ ID NO: 3726249 - RNA, 14 nt, Human
ucuggcagcucaga

SEQ ID NO: 3726250 - RNA, 21 nt, Human
ucuggcagcucagagagggug

SEQ ID NO: 3726251 - RNA, 18 nt, Human
ucuggcagguccuccccu

SEQ ID NO: 3726252 - RNA, 22 nt, Human
ucuggcagguccuccccucucu

SEQ ID NO: 3726253 - RNA, 18 nt, Human
ucuggcaguucuggaaug

SEQ ID NO: 3726254 - RNA, 16 nt, Human
ucuggcccaccagggu

SEQ ID NO: 3726255 - RNA, 13 nt, Human
ucuggcccugccu

SEQ ID NO: 3726256 - RNA, 13 nt, Human
ucuggcccuggcc

SEQ ID NO: 3726257 - RNA, 21 nt, Human
ucuggccguccuugucucugg

SEQ ID NO: 3726258 - RNA, 22 nt, Human
ucuggccuaaaaucuuggaagu

SEQ ID NO: 3726259 - RNA, 18 nt, Human
ucuggccuagucccuucc

SEQ ID NO: 3726260 - RNA, 11 nt, Human
ucuggccucca

SEQ ID NO: 3726261 - RNA, 13 nt, Human
ucuggccucccac

SEQ ID NO: 3726262 - RNA, 14 nt, Human
ucuggccucccaca

SEQ ID NO: 3726263 - RNA, 16 nt, Human
ucuggccucccacccg

SEQ ID NO: 3726264 - RNA, 12 nt, Human
ucuggccuggcc

SEQ ID NO: 3726265 - RNA, 14 nt, Human
ucuggccuggccag

SEQ ID NO: 3726266 - RNA, 15 nt, Human
ucuggccuuacaccu

SEQ ID NO: 3726267 - RNA, 22 nt, Human
ucuggcgacaguuuuccuucuc

SEQ ID NO: 3726268 - RNA, 15 nt, Human
ucuggcuccagcugg

SEQ ID NO: 3726269 - RNA, 20 nt, Human
ucuggcucccucuucuuuca

SEQ ID NO: 3726270 - RNA, 17 nt, Human
ucuggcuccuuuacaaa

SEQ ID NO: 3726271 - RNA, 14 nt, Human
ucuggcugaaaaag

SEQ ID NO: 3726272 - RNA, 17 nt, Human
ucuggcugaacccugug

SEQ ID NO: 3726273 - RNA, 21 nt, Human
ucuggcugaacccugugcugg

SEQ ID NO: 3726274 - RNA, 21 nt, Human
ucuggcugagcugaacccauu

SEQ ID NO: 3726275 - RNA, 22 nt, Human
ucuggcugccccaaccugcuga

SEQ ID NO: 3726276 - RNA, 17 nt, Human
ugaaaacucuuugcugc

SEQ ID NO: 3726277 - RNA, 18 nt, Human
ugaaaacucuuugcugcu

SEQ ID NO: 3726278 - RNA, 13 nt, Human
ugaaaacuggaau

SEQ ID NO: 3726279 - RNA, 21 nt, Human
ugaaaacuggaauaagaagca

SEQ ID NO: 3726280 - RNA, 13 nt, Human
ugaaaacuuugua

SEQ ID NO: 3726281 - RNA, 16 nt, Human
ugaaaacuuuguagua

SEQ ID NO: 3726282 - RNA, 15 nt, Human
ugaaaagaaaaauga

SEQ ID NO: 3726283 - RNA, 22 nt, Human
ugaaaagaaaaaugagccuggc

SEQ ID NO: 3726284 - RNA, 13 nt, Human
ugaaaagaaauaa

SEQ ID NO: 3726285 - RNA, 15 nt, Human
ugaaaagaaggaaag

SEQ ID NO: 3726286 - RNA, 15 nt, Human
ugaaaagaaguagug

SEQ ID NO: 3726287 - RNA, 18 nt, Human
ugaaaagacaucaagcac

SEQ ID NO: 3726288 - RNA, 18 nt, Human
ugaaaagagagcagagaa

SEQ ID NO: 3726289 - RNA, 16 nt, Human
ugaaaagauaaauuau

SEQ ID NO: 3726290 - RNA, 14 nt, Human
ugaaaagauucuuc

SEQ ID NO: 3726291 - RNA, 16 nt, Human
ugaaaagcagacauuu

SEQ ID NO: 3726292 - RNA, 22 nt, Human
ugaaaagcagguugauaaauca

SEQ ID NO: 3726293 - RNA, 19 nt, Human
ugaaaagccauguuuaaga

SEQ ID NO: 3726294 - RNA, 20 nt, Human
ugaaaagccauguuuaagau

SEQ ID NO: 3726295 - RNA, 22 nt, Human
ugaaaagccucuguuuugauau

SEQ ID NO: 3726296 - RNA, 17 nt, Human
ugaaaagcuauuagcca

SEQ ID NO: 3726297 - RNA, 20 nt, Human
ugaaaagcuauuagccagga

SEQ ID NO: 3726298 - RNA, 23 nt, Human
ugaaaagcuauuagccaggauca

SEQ ID NO: 3726299 - RNA, 19 nt, Human
ugaaaagcuccaucaauga

SEQ ID NO: 3726300 - RNA, 20 nt, Human
ugaaaagcuccauuuuuagu

SEQ ID NO: 3726301 - RNA, 17 nt, Human
ugaaaagcuucuuaauu

SEQ ID NO: 3726302 - RNA, 17 nt, Human
ugaaaagcuuuguuugu

SEQ ID NO: 3726303 - RNA, 16 nt, Human
ugaaaaggcaaaaagc

SEQ ID NO: 3726304 - RNA, 19 nt, Human
ugaaaagggggugggaugg

SEQ ID NO: 3726305 - RNA, 21 nt, Human
ugaaaaguaauauuuauuaaa

SEQ ID NO: 3726306 - RNA, 12 nt, Human
ugaaaagucguu

SEQ ID NO: 3726307 - RNA, 17 nt, Human
ugaaaagugaagacaga

SEQ ID NO: 3726308 - RNA, 17 nt, Human
ugaaaauaaaguguaua

SEQ ID NO: 3726309 - RNA, 18 nt, Human
ugaaaauaagccaugaga

SEQ ID NO: 3726310 - RNA, 19 nt, Human
ugaaaauaagccaugagaa

SEQ ID NO: 3726311 - RNA, 19 nt, Human
ugaaaauacaacuuaaaua

SEQ ID NO: 3726312 - RNA, 18 nt, Human
ugaaaauaccaucaggcc

SEQ ID NO: 3726313 - RNA, 18 nt, Human
ugaaaauaucugcucaaa

SEQ ID NO: 3726314 - RNA, 20 nt, Human
ugaaaauauuaucuuuguaa

SEQ ID NO: 3726315 - RNA, 16 nt, Human
ugaaaauauuguuuua

SEQ ID NO: 3726316 - RNA, 11 nt, Human
ugaaaauauuu

SEQ ID NO: 3726317 - RNA, 13 nt, Human
ugaaaauauuuaa

SEQ ID NO: 3726318 - RNA, 14 nt, Human
ugaaaauauuuaaa

SEQ ID NO: 3726319 - RNA, 17 nt, Human
ugaaaauauuuguauca

SEQ ID NO: 3726320 - RNA, 23 nt, Human
ugaaaauauuuuuuauauauaca

SEQ ID NO: 3726321 - RNA, 13 nt, Human
ugaaaauccuacc

SEQ ID NO: 3726322 - RNA, 19 nt, Human
ugaaaaucgugacaacacu

SEQ ID NO: 3726323 - RNA, 18 nt, Human
ugaaaaugaguugugaaa

SEQ ID NO: 3726324 - RNA, 21 nt, Human
ugaaaaugcaacaacauguau

SEQ ID NO: 3726325 - RNA, 11 nt, Human
ugaaaauggaa

SEQ ID NO: 3726326 - RNA, 16 nt, Human
ugaaaaugggcucaac

SEQ ID NO: 3726327 - RNA, 21 nt, Human
ugaaaauggguuggugcuucu

SEQ ID NO: 3726328 - RNA, 15 nt, Human
ugaaaaugguauuuu

SEQ ID NO: 3726329 - RNA, 16 nt, Human
ugaaaauguacugaga

SEQ ID NO: 3726330 - RNA, 17 nt, Human
ugaaaauguauguguaa

SEQ ID NO: 3726331 - RNA, 15 nt, Human
ugaaaaugucagaaa

SEQ ID NO: 3726332 - RNA, 18 nt, Human
ugaaaaugucagaaacca

SEQ ID NO: 3726333 - RNA, 16 nt, Human
ugaaaauguccaggaa

SEQ ID NO: 3726334 - RNA, 13 nt, Human
ugaaaauguccuu

SEQ ID NO: 3726335 - RNA, 19 nt, Human
ugaaaauguccuugugaug

SEQ ID NO: 3726336 - RNA, 15 nt, Human
ugaaaaugucuugug

SEQ ID NO: 3726337 - RNA, 17 nt, Human
ugaaaaugugcuauacu

SEQ ID NO: 3726338 - RNA, 19 nt, Human
ugaaaaugugcuauacugc

SEQ ID NO: 3726339 - RNA, 21 nt, Human
ugaaaaugugcuauacugcau

SEQ ID NO: 3726340 - RNA, 13 nt, Human
ugaaaauguuuuu

SEQ ID NO: 3726341 - RNA, 21 nt, Human
ugaaaauuacaguccaaaaua

SEQ ID NO: 3726342 - RNA, 20 nt, Human
ugaaaauuaggauuucauga

SEQ ID NO: 3726343 - RNA, 13 nt, Human
ugaaaauuauuua

SEQ ID NO: 3726344 - RNA, 15 nt, Human
ugaaaauuauuuuaa

SEQ ID NO: 3726345 - RNA, 23 nt, Human
ugaaaauuauuuuguucauacau

SEQ ID NO: 3726346 - RNA, 20 nt, Human
ugaaaauuccagaaaggaua

SEQ ID NO: 3726347 - RNA, 20 nt, Human
ugaaaauucgcccgagcugu

SEQ ID NO: 3726348 - RNA, 21 nt, Human
ugaaaauucgcccgagcuguu

SEQ ID NO: 3726349 - RNA, 17 nt, Human
ugaaaauugaaaaguac

SEQ ID NO: 3726350 - RNA, 22 nt, Human
ugaaaauugccuuucuguguuu

SEQ ID NO: 3726351 - RNA, 17 nt, Human
ugaaaauuguauguuaa

SEQ ID NO: 3726352 - RNA, 13 nt, Human
ugaaaauuguauu

SEQ ID NO: 3726353 - RNA, 19 nt, Human
ugaaaauuuuaaaaauaca

SEQ ID NO: 3726354 - RNA, 21 nt, Human
ugaaaauuuuaaaaauacaua

SEQ ID NO: 3726355 - RNA, 22 nt, Human
ugaaaauuuuaaaaauacauau

SEQ ID NO: 3726356 - RNA, 19 nt, Human
ugaaaauuuugauguuuua

SEQ ID NO: 3726357 - RNA, 14 nt, Human
ugaaacaaagcugc

SEQ ID NO: 3726358 - RNA, 22 nt, Human
ugaaacaaauaaucacauugac

SEQ ID NO: 3726359 - RNA, 16 nt, Human
ugaaacaacuuggaaa

SEQ ID NO: 3726360 - RNA, 13 nt, Human
ugaaacacaaaca

SEQ ID NO: 3726361 - RNA, 16 nt, Human
ugaaacacaccaggcu

SEQ ID NO: 3726362 - RNA, 21 nt, Human
ugaaacacagcuguucuucug

SEQ ID NO: 3726363 - RNA, 21 nt, Human
ugaaacaccaagaugucuguc

SEQ ID NO: 3726364 - RNA, 22 nt, Human
ugaaacaccaagaugucugucu

SEQ ID NO: 3726365 - RNA, 19 nt, Human
ugaaacaccuucucuggag

SEQ ID NO: 3726366 - RNA, 17 nt, Human
ugaaacacgaaacuugu

SEQ ID NO: 3726367 - RNA, 21 nt, Human
ugaaacacugguuuuaaauau

SEQ ID NO: 3726368 - RNA, 15 nt, Human
ugaaacacuuugcau

SEQ ID NO: 3726369 - RNA, 16 nt, Human
ugaaacacuuugcaua

SEQ ID NO: 3726370 - RNA, 15 nt, Human
ugaaacacuuugccu

SEQ ID NO: 3726371 - RNA, 13 nt, Human
ugaaacacuuuuu

SEQ ID NO: 3726372 - RNA, 23 nt, Human
ugaaacagaaaaauauguaccaa

SEQ ID NO: 3726373 - RNA, 14 nt, Human
ugaaacagaaacaa

SEQ ID NO: 3726374 - RNA, 9 nt, Human
ugaaacagc

SEQ ID NO: 3726375 - RNA, 10 nt, Human
ugaaacagcu

SEQ ID NO: 3726376 - RNA, 11 nt, Human
ugaaacagcug

SEQ ID NO: 3726377 - RNA, 13 nt, Human
ugaaacagcugcc

SEQ ID NO: 3726378 - RNA, 22 nt, Human
ugaaacagcugccuuagcuuca

SEQ ID NO: 3726379 - RNA, 20 nt, Human
ugaaacaggagagaaagggg

SEQ ID NO: 3726380 - RNA, 21 nt, Human
ugaaacaggagagaaagggga

SEQ ID NO: 3726381 - RNA, 18 nt, Human
ugaaacauugcuuuuaaa

SEQ ID NO: 3726382 - RNA, 21 nt, Human
ugaaacauugcuuuuaaaacu

SEQ ID NO: 3726383 - RNA, 16 nt, Human
ugaaacauuuucuccc

SEQ ID NO: 3726384 - RNA, 20 nt, Human
ugaaacccagucacugugag

SEQ ID NO: 3726385 - RNA, 17 nt, Human
ugaaaccccaaacagug

SEQ ID NO: 3726386 - RNA, 23 nt, Human
ugaaaccccaaacagugacugua

SEQ ID NO: 3726387 - RNA, 15 nt, Human
ugaaacccuggacca

SEQ ID NO: 3726388 - RNA, 19 nt, Human
ugaaaccuaguacugcccc

SEQ ID NO: 3726389 - RNA, 13 nt, Human
ugaaaccuguaua

SEQ ID NO: 3726390 - RNA, 22 nt, Human
ugaaaccuguauaacccuguua

SEQ ID NO: 3726391 - RNA, 20 nt, Human
ugaaaccuuauuuuuuccca

SEQ ID NO: 3726392 - RNA, 22 nt, Human
ugaaaccuuuagggcagcuugc

SEQ ID NO: 3726393 - RNA, 16 nt, Human
ugaaacgcaaccacca

SEQ ID NO: 3726394 - RNA, 15 nt, Human
ugaaacgcaucuagu

SEQ ID NO: 3726395 - RNA, 15 nt, Human
ugaaacggaugauuu

SEQ ID NO: 3726396 - RNA, 19 nt, Human
ugaaacggaugauuucuau

SEQ ID NO: 3726397 - RNA, 20 nt, Human
ugaaacuaaagcaauagaaa

SEQ ID NO: 3726398 - RNA, 22 nt, Human
ugaaacuaaagcaauagaaaca

SEQ ID NO: 3726399 - RNA, 18 nt, Human
ugaaacucauagacacug

SEQ ID NO: 3726400 - RNA, 21 nt, Human
ugaaacuccaccuugcgggga

SEQ ID NO: 3726401 - RNA, 18 nt, Human
ugaaacuccagaugccac

SEQ ID NO: 3726402 - RNA, 19 nt, Human
ugaaacucguuaauuugua

SEQ ID NO: 3726403 - RNA, 15 nt, Human
ugaaacugcauuugu

SEQ ID NO: 3726404 - RNA, 16 nt, Human
ugaaacugcauuugug

SEQ ID NO: 3726405 - RNA, 18 nt, Human
ugaaacugcuuguuuccu

SEQ ID NO: 3726406 - RNA, 22 nt, Human
ugaaacugcuuguuuccuagca

SEQ ID NO: 3726407 - RNA, 18 nt, Human
ugaaacuggauuaaacuu

SEQ ID NO: 3726408 - RNA, 12 nt, Human
ugaaacuuggau

SEQ ID NO: 3726409 - RNA, 23 nt, Human
ugaaacuuucauuccuucagauu

SEQ ID NO: 3726410 - RNA, 17 nt, Human
ugaaagaaaauugaguu

SEQ ID NO: 3726411 - RNA, 14 nt, Human
ugaaagaaaucaug

SEQ ID NO: 3726412 - RNA, 16 nt, Human
ugaaagaaaucauguu

SEQ ID NO: 3726413 - RNA, 22 nt, Human
ugaaagaaaucauguuaugaua

SEQ ID NO: 3726414 - RNA, 14 nt, Human
ugaaagaauauauu

SEQ ID NO: 3726415 - RNA, 14 nt, Human
ugaaagaauguaaa

SEQ ID NO: 3726416 - RNA, 15 nt, Human
ugaaagaauguaaag

SEQ ID NO: 3726417 - RNA, 16 nt, Human
ugaaagaauguaaagc

SEQ ID NO: 3726418 - RNA, 12 nt, Human
ugaaagaccuuc

SEQ ID NO: 3726419 - RNA, 13 nt, Human
ugaaagacuguac

SEQ ID NO: 3726420 - RNA, 15 nt, Human
ugaaagacuguacaa

SEQ ID NO: 3726421 - RNA, 19 nt, Human
ugaaagacuguacaaagua

SEQ ID NO: 3726422 - RNA, 18 nt, Human
ugaaagacuuccaaagaa

SEQ ID NO: 3726423 - RNA, 13 nt, Human
ugaaagagaacca

SEQ ID NO: 3726424 - RNA, 17 nt, Human
ugaaagaggaaugaagu

SEQ ID NO: 3726425 - RNA, 20 nt, Human
ugaaagaguaaaggaaauga

SEQ ID NO: 3726426 - RNA, 15 nt, Human
ggcuucccgcucagc

SEQ ID NO: 3726427 - RNA, 16 nt, Human
ggcuucccgcucagcc

SEQ ID NO: 3726428 - RNA, 21 nt, Human
ggcuucccgcucagcccuccc

SEQ ID NO: 3726429 - RNA, 17 nt, Human
ggcuuccugaggggaga

SEQ ID NO: 3726430 - RNA, 13 nt, Human
ggcuuccuggagc

SEQ ID NO: 3726431 - RNA, 13 nt, Human
ggcuuccuggugc

SEQ ID NO: 3726432 - RNA, 18 nt, Human
ggcuuccuggugcuggag

SEQ ID NO: 3726433 - RNA, 19 nt, Human
ggcuucguuagaccgcucu

SEQ ID NO: 3726434 - RNA, 18 nt, Human
ggcuucuccgccagccuc

SEQ ID NO: 3726435 - RNA, 21 nt, Human
ggcuucuccgccagccuccuc

SEQ ID NO: 3726436 - RNA, 13 nt, Human
ggcuucuccugac

SEQ ID NO: 3726437 - RNA, 15 nt, Human
ggcuucuccugaccc

SEQ ID NO: 3726438 - RNA, 16 nt, Human
ggcuucucucucacca

SEQ ID NO: 3726439 - RNA, 13 nt, Human
ggcuucugagcag

SEQ ID NO: 3726440 - RNA, 16 nt, Human
ggcuucugaugaaucu

SEQ ID NO: 3726441 - RNA, 16 nt, Human
ggcuucugcacccucc

SEQ ID NO: 3726442 - RNA, 16 nt, Human
ggcuucuggagcccuu

SEQ ID NO: 3726443 - RNA, 12 nt, Human
ggcuugaagcca

SEQ ID NO: 3726444 - RNA, 13 nt, Human
ggcuugaagccaa

SEQ ID NO: 3726445 - RNA, 16 nt, Human
ggcuugaagccaaaga

SEQ ID NO: 3726446 - RNA, 14 nt, Human
ggcuugcaugccaa

SEQ ID NO: 3726447 - RNA, 16 nt, Human
ggcuugccacagcucu

SEQ ID NO: 3726448 - RNA, 14 nt, Human
ggcuugccugcagg

SEQ ID NO: 3726449 - RNA, 15 nt, Human
ggcuugccugcaggc

SEQ ID NO: 3726450 - RNA, 15 nt, Human
ggcuugcugagaggg

SEQ ID NO: 3726451 - RNA, 19 nt, Human
ggcuuggccacagccaggg

SEQ ID NO: 3726452 - RNA, 15 nt, Human
ggcuuggcccuggca

SEQ ID NO: 3726453 - RNA, 16 nt, Human
ggcuuggccuaucucc

SEQ ID NO: 3726454 - RNA, 12 nt, Human
ggcuuggccugc

SEQ ID NO: 3726455 - RNA, 12 nt, Human
ggcuugggauuu

SEQ ID NO: 3726456 - RNA, 17 nt, Human
ggcuugggccuaggcug

SEQ ID NO: 3726457 - RNA, 15 nt, Human
ggcuuguaacuccac

SEQ ID NO: 3726458 - RNA, 18 nt, Human
ggcuuguaacuccaccaa

SEQ ID NO: 3726459 - RNA, 19 nt, Human
ggcuuguagaauuguuaua

SEQ ID NO: 3726460 - RNA, 18 nt, Human
ggcuuguggggccuggga

SEQ ID NO: 3726461 - RNA, 12 nt, Human
ggcuuuaaaauu

SEQ ID NO: 3726462 - RNA, 14 nt, Human
ggcuuuaaaauucu

SEQ ID NO: 3726463 - RNA, 21 nt, Human
ggcuuuauccucuuuagaguu

SEQ ID NO: 3726464 - RNA, 20 nt, Human
ggcuuucauuuucucucagg

SEQ ID NO: 3726465 - RNA, 23 nt, Human
ggcuuucccacuucccacccugc

SEQ ID NO: 3726466 - RNA, 20 nt, Human
ggcuuuccuuguggcagagg

SEQ ID NO: 3726467 - RNA, 19 nt, Human
ggcuuucguccacagcuuc

SEQ ID NO: 3726468 - RNA, 13 nt, Human
ggcuuucuggaga

SEQ ID NO: 3726469 - RNA, 14 nt, Human
ggcuuucuggagag

SEQ ID NO: 3726470 - RNA, 16 nt, Human
ggcuuugauguuccuu

SEQ ID NO: 3726471 - RNA, 22 nt, Human
ggcuuugauuaguuuucuuguu

SEQ ID NO: 3726472 - RNA, 18 nt, Human
ggcuuugauuccaucucc

SEQ ID NO: 3726473 - RNA, 14 nt, Human
ggcuuugccagcuu

SEQ ID NO: 3726474 - RNA, 19 nt, Human
ggcuuugcccaaccucagc

SEQ ID NO: 3726475 - RNA, 20 nt, Human
ggcuuugcccaaccucagca

SEQ ID NO: 3726476 - RNA, 12 nt, Human
ggcuuuggauuu

SEQ ID NO: 3726477 - RNA, 19 nt, Human
ggcuuuuauuaaugcacuu

SEQ ID NO: 3726478 - RNA, 13 nt, Human
ggcuuuucugauc

SEQ ID NO: 3726479 - RNA, 13 nt, Human
ggcuuuucuguuu

SEQ ID NO: 3726480 - RNA, 10 nt, Human
ggcuuuugug

SEQ ID NO: 3726481 - RNA, 19 nt, Human
ggcuuuuuuaaaaaagcaa

SEQ ID NO: 3726482 - RNA, 23 nt, Human
gggaaaaagaggaucuggagaac

SEQ ID NO: 3726483 - RNA, 22 nt, Human
gggaaaacugccaauauagaaa

SEQ ID NO: 3726484 - RNA, 13 nt, Human
gggaaaagcagcu

SEQ ID NO: 3726485 - RNA, 16 nt, Human
gggaaacacuccuugc

SEQ ID NO: 3726486 - RNA, 14 nt, Human
gggaaacuggccau

SEQ ID NO: 3726487 - RNA, 21 nt, Human
gggaaagccuuaagcugcagg

SEQ ID NO: 3726488 - RNA, 22 nt, Human
gggaaaggcucugaaagccagc

SEQ ID NO: 3726489 - RNA, 13 nt, Human
gggaaaggggugc

SEQ ID NO: 3726490 - RNA, 20 nt, Human
gggaaagugcauaugaaauc

SEQ ID NO: 3726491 - RNA, 17 nt, Human
gggaaauacuacuccug

SEQ ID NO: 3726492 - RNA, 15 nt, Human
gggaguggccacaga

SEQ ID NO: 3726493 - RNA, 20 nt, Human
gggagugggacagagucugg

SEQ ID NO: 3726494 - RNA, 11 nt, Human
gggagugugua

SEQ ID NO: 3726495 - RNA, 17 nt, Human
gggaguuaagaccuggc

SEQ ID NO: 3726496 - RNA, 23 nt, Human
gggaguuaagaccuggcagcucu

SEQ ID NO: 3726497 - RNA, 23 nt, Human
gggaguucgagaccaaccugacc

SEQ ID NO: 3726498 - RNA, 15 nt, Human
gggauaaaaugacua

SEQ ID NO: 3726499 - RNA, 22 nt, Human
gggauacuuuagaaguagaauu

SEQ ID NO: 3726500 - RNA, 13 nt, Human
gggauagaugugu

SEQ ID NO: 3726501 - RNA, 14 nt, Human
gggauagaugugug

SEQ ID NO: 3726502 - RNA, 16 nt, Human
gggauagcacugagca

SEQ ID NO: 3726503 - RNA, 16 nt, Human
gggauauaggagagga

SEQ ID NO: 3726504 - RNA, 18 nt, Human
gggauaucacuuccauga

SEQ ID NO: 3726505 - RNA, 22 nt, Human
gggaucaaccagcuaagaaaag

SEQ ID NO: 3726506 - RNA, 13 nt, Human
gggaucacaaggu

SEQ ID NO: 3726507 - RNA, 22 nt, Human
gggaucacagagacauuccucc

SEQ ID NO: 3726508 - RNA, 18 nt, Human
gggaucaucaugcagcuc

SEQ ID NO: 3726509 - RNA, 13 nt, Human
gggaucaugaaag

SEQ ID NO: 3726510 - RNA, 17 nt, Human
gggauccccgccuggcc

SEQ ID NO: 3726511 - RNA, 20 nt, Human
gggauccccgccuggccagg

SEQ ID NO: 3726512 - RNA, 16 nt, Human
gggauccuccaggugc

SEQ ID NO: 3726513 - RNA, 16 nt, Human
gggaucuaggagagga

SEQ ID NO: 3726514 - RNA, 11 nt, Human
gggaugaaaga

SEQ ID NO: 3726515 - RNA, 17 nt, Human
gggaugacuagaggcag

SEQ ID NO: 3726516 - RNA, 16 nt, Human
gggaugagaagagggg

SEQ ID NO: 3726517 - RNA, 21 nt, Human
gggaugagcauggagcuggcc

SEQ ID NO: 3726518 - RNA, 16 nt, Human
gggaugauucaagcca

SEQ ID NO: 3726519 - RNA, 17 nt, Human
gggaugccaucuguggg

SEQ ID NO: 3726520 - RNA, 16 nt, Human
gggauggacaucuugu

SEQ ID NO: 3726521 - RNA, 18 nt, Human
gggauggacugaugcuuu

SEQ ID NO: 3726522 - RNA, 18 nt, Human
gggauggaggagaagaau

SEQ ID NO: 3726523 - RNA, 16 nt, Human
gggaugggagccgggc

SEQ ID NO: 3726524 - RNA, 14 nt, Human
gggaugggccaccg

SEQ ID NO: 3726525 - RNA, 14 nt, Human
gggaugggccugag

SEQ ID NO: 3726526 - RNA, 14 nt, Human
gggauggggcuggg

SEQ ID NO: 3726527 - RNA, 22 nt, Human
gggauguacaaggcgaucccau

SEQ ID NO: 3726528 - RNA, 22 nt, Human
gggaugugaauugccugcagag

SEQ ID NO: 3726529 - RNA, 13 nt, Human
gggauguguccug

SEQ ID NO: 3726530 - RNA, 20 nt, Human
gggauuaauaugaaaacuua

SEQ ID NO: 3726531 - RNA, 14 nt, Human
gggauuacaggcgu

SEQ ID NO: 3726532 - RNA, 13 nt, Human
gggauuacaggcu

SEQ ID NO: 3726533 - RNA, 16 nt, Human
gggauuacccaagcaa

SEQ ID NO: 3726534 - RNA, 23 nt, Human
gggauuauuagaaucaaacauuu

SEQ ID NO: 3726535 - RNA, 21 nt, Human
gggauucaggaaaaggccugg

SEQ ID NO: 3726536 - RNA, 14 nt, Human
gggauuccugaccc

SEQ ID NO: 3726537 - RNA, 19 nt, Human
gggauucugguuccagggu

SEQ ID NO: 3726538 - RNA, 20 nt, Human
gggauuuaauuuccaggguu

SEQ ID NO: 3726539 - RNA, 20 nt, Human
gggauuuccagccagggcug

SEQ ID NO: 3726540 - RNA, 15 nt, Human
gggauuucucccagc

SEQ ID NO: 3726541 - RNA, 13 nt, Human
gggauuucuuagg

SEQ ID NO: 3726542 - RNA, 18 nt, Human
gggcaaaauucccaggga

SEQ ID NO: 3726543 - RNA, 14 nt, Human
gggcaaacaggcag

SEQ ID NO: 3726544 - RNA, 15 nt, Human
gggcaaacaggcagu

SEQ ID NO: 3726545 - RNA, 16 nt, Human
gggcaaaugccagggc

SEQ ID NO: 3726546 - RNA, 18 nt, Human
gggcaacccuggugacca

SEQ ID NO: 3726547 - RNA, 13 nt, Human
gggcaagaggaau

SEQ ID NO: 3726548 - RNA, 21 nt, Human
gggcaagccuaagggauccug

SEQ ID NO: 3726549 - RNA, 16 nt, Human
gggcaaggaaaaagaa

SEQ ID NO: 3726550 - RNA, 13 nt, Human
gggcaagggccau

SEQ ID NO: 3726551 - RNA, 20 nt, Human
gggcaaggguuaaggccuga

SEQ ID NO: 3726552 - RNA, 23 nt, Human
gggcaauauucucuguacauauu

SEQ ID NO: 3726553 - RNA, 13 nt, Human
gggcaauggaaau

SEQ ID NO: 3726554 - RNA, 20 nt, Human
gggcaauuaauuccuucagc

SEQ ID NO: 3726555 - RNA, 23 nt, Human
gggcacaagacugacgccagggu

SEQ ID NO: 3726556 - RNA, 17 nt, Human
gggcacaccuccuccca

SEQ ID NO: 3726557 - RNA, 19 nt, Human
gggcacacgccucccacug

SEQ ID NO: 3726558 - RNA, 16 nt, Human
gggcacacgcugcucu

SEQ ID NO: 3726559 - RNA, 18 nt, Human
gggcacacgcugcucugc

SEQ ID NO: 3726560 - RNA, 22 nt, Human
gggcacacgcugcucugcccca

SEQ ID NO: 3726561 - RNA, 22 nt, Human
gggcacacucugccagcaaaga

SEQ ID NO: 3726562 - RNA, 21 nt, Human
gggcacagaaaauggaagaca

SEQ ID NO: 3726563 - RNA, 16 nt, Human
gggcacagggccuggc

SEQ ID NO: 3726564 - RNA, 23 nt, Human
gggcacaggugucugcccccucu

SEQ ID NO: 3726565 - RNA, 16 nt, Human
gggcacaguccaggaa

SEQ ID NO: 3726566 - RNA, 22 nt, Human
gggcaccacaaaauauacaaaa

SEQ ID NO: 3726567 - RNA, 15 nt, Human
gggcaccagccagcg

SEQ ID NO: 3726568 - RNA, 20 nt, Human
gggcaccagggguuucucgc

SEQ ID NO: 3726569 - RNA, 14 nt, Human
gggcacccccagcc

SEQ ID NO: 3726570 - RNA, 17 nt, Human
gggcacccccagccugg

SEQ ID NO: 3726571 - RNA, 14 nt, Human
gggcacccucccac

SEQ ID NO: 3726572 - RNA, 18 nt, Human
gggcaccuauaauaccag

SEQ ID NO: 3726573 - RNA, 16 nt, Human
gggcacgcacuggguu

SEQ ID NO: 3726574 - RNA, 19 nt, Human
gggcacucagaagacacug

SEQ ID NO: 3726575 - RNA, 16 nt, Human
gggcacugcugggugg

SEQ ID NO: 3726576 - RNA, 14 nt, Human
gggcagaacacuaa

SEQ ID NO: 3726577 - RNA, 22 nt, Human
gggcagaacacuaaccugaccg

SEQ ID NO: 3726578 - RNA, 22 nt, Human
gggcagaacagccgcuccuguc

SEQ ID NO: 3726579 - RNA, 14 nt, Human
gggcagaaggaaga

SEQ ID NO: 3726580 - RNA, 18 nt, Human
gggcagaaggaagacuuc

SEQ ID NO: 3726581 - RNA, 11 nt, Human
gggcagagagg

SEQ ID NO: 3726582 - RNA, 13 nt, Human
gggcagagccagg

SEQ ID NO: 3726583 - RNA, 14 nt, Human
gggcagagccagga

SEQ ID NO: 3726584 - RNA, 16 nt, Human
gggcagagccaggaag

SEQ ID NO: 3726585 - RNA, 14 nt, Human
gggcagagcccaag

SEQ ID NO: 3726586 - RNA, 21 nt, Human
gggcagaggaaagcaaaggag

SEQ ID NO: 3726587 - RNA, 23 nt, Human
gggcagaggagaacuugcugccu

SEQ ID NO: 3726588 - RNA, 23 nt, Human
gggcagaggcuggaggcagggcc

SEQ ID NO: 3726589 - RNA, 15 nt, Human
gggcagagggcugga

SEQ ID NO: 3726590 - RNA, 16 nt, Human
gggcagagggcuggag

SEQ ID NO: 3726591 - RNA, 16 nt, Human
gggcagagucacacgg

SEQ ID NO: 3726592 - RNA, 20 nt, Human
gggcagaucuuggacucaug

SEQ ID NO: 3726593 - RNA, 16 nt, Human
gggcagauuuucagca

SEQ ID NO: 3726594 - RNA, 15 nt, Human
gggcagcacaggagg

SEQ ID NO: 3726595 - RNA, 15 nt, Human
gggcagcagccagcc

SEQ ID NO: 3726596 - RNA, 18 nt, Human
gggcagcagccagcccug

SEQ ID NO: 3726597 - RNA, 19 nt, Human
gggcagcagccagcccugc

SEQ ID NO: 3726598 - RNA, 17 nt, Human
gggcagccaaacccaug

SEQ ID NO: 3726599 - RNA, 15 nt, Human
gggcagccucccccg

SEQ ID NO: 3726600 - RNA, 14 nt, Human
gggcagccugccuu

SEQ ID NO: 3726601 - RNA, 15 nt, Human
gggcagccuggcucc

SEQ ID NO: 3726602 - RNA, 15 nt, Human
gggcagcgccaggcu

SEQ ID NO: 3726603 - RNA, 16 nt, Human
gggcagcgcccuuccu

SEQ ID NO: 3726604 - RNA, 12 nt, Human
gggcagcugcca

SEQ ID NO: 3726605 - RNA, 23 nt, Human
gggcagcugccuccccuccucug

SEQ ID NO: 3726606 - RNA, 17 nt, Human
gggcagcugggcccaac

SEQ ID NO: 3726607 - RNA, 18 nt, Human
gggcaggaaggagagccu

SEQ ID NO: 3726608 - RNA, 21 nt, Human
gggcaggaaggagagccugcu

SEQ ID NO: 3726609 - RNA, 14 nt, Human
gggcaggaccagcc

SEQ ID NO: 3726610 - RNA, 16 nt, Human
gggcaggaccagccca

SEQ ID NO: 3726611 - RNA, 15 nt, Human
gggcaggaguagcug

SEQ ID NO: 3726612 - RNA, 19 nt, Human
gggcaggaguagcugagcu

SEQ ID NO: 3726613 - RNA, 15 nt, Human
gggcaggcaugaagu

SEQ ID NO: 3726614 - RNA, 14 nt, Human
gggcaggcccugca

SEQ ID NO: 3726615 - RNA, 21 nt, Human
gggcaggcccugcacuguccu

SEQ ID NO: 3726616 - RNA, 13 nt, Human
gggcaggcugaca

SEQ ID NO: 3726617 - RNA, 13 nt, Human
gggcaggcugggc

SEQ ID NO: 3726618 - RNA, 14 nt, Human
gggcaggcugggcc

SEQ ID NO: 3726619 - RNA, 12 nt, Human
gggcagggagcg

SEQ ID NO: 3726620 - RNA, 15 nt, Human
ugaaguaguuuguau

SEQ ID NO: 3726621 - RNA, 17 nt, Human
ugaaguauuucucacuc

SEQ ID NO: 3726622 - RNA, 20 nt, Human
ugaaguauuuugcuggaaua

SEQ ID NO: 3726623 - RNA, 21 nt, Human
ugaaguauuuuuucaguauua

SEQ ID NO: 3726624 - RNA, 13 nt, Human
ugaagucacacag

SEQ ID NO: 3726625 - RNA, 18 nt, Human
ugaagucacaucacagga

SEQ ID NO: 3726626 - RNA, 19 nt, Human
ugaagucacccggccccca

SEQ ID NO: 3726627 - RNA, 15 nt, Human
ugaagucacugcaca

SEQ ID NO: 3726628 - RNA, 16 nt, Human
ugaagucagauguggu

SEQ ID NO: 3726629 - RNA, 19 nt, Human
ugaagucucugaagugaaa

SEQ ID NO: 3726630 - RNA, 23 nt, Human
ugaagucuuaaggacaaagugcc

SEQ ID NO: 3726631 - RNA, 12 nt, Human
ugaagucuugua

SEQ ID NO: 3726632 - RNA, 19 nt, Human
ugaagucuuuaauaaauaa

SEQ ID NO: 3726633 - RNA, 20 nt, Human
ugaagucuuuguacagacaa

SEQ ID NO: 3726634 - RNA, 18 nt, Human
ugaagugagcacagccua

SEQ ID NO: 3726635 - RNA, 20 nt, Human
ugaagugauauggugagcag

SEQ ID NO: 3726636 - RNA, 22 nt, Human
ugaaguguaccuguguacauaa

SEQ ID NO: 3726637 - RNA, 17 nt, Human
ugaaguguaggcagaca

SEQ ID NO: 3726638 - RNA, 19 nt, Human
ugaaguguaggcagacaca

SEQ ID NO: 3726639 - RNA, 17 nt, Human
ugaaguguuaauacuag

SEQ ID NO: 3726640 - RNA, 14 nt, Human
ugaaguuaacagag

SEQ ID NO: 3726641 - RNA, 14 nt, Human
ugaaguuagaauuc

SEQ ID NO: 3726642 - RNA, 18 nt, Human
ugaaguuagcuuuaacuu

SEQ ID NO: 3726643 - RNA, 15 nt, Human
ugaaguuaguggaaa

SEQ ID NO: 3726644 - RNA, 21 nt, Human
ugaaguuaguggaaaucugaa

SEQ ID NO: 3726645 - RNA, 16 nt, Human
ugaaguuauauuuccu

SEQ ID NO: 3726646 - RNA, 13 nt, Human
ugaaguugcugcu

SEQ ID NO: 3726647 - RNA, 18 nt, Human
ugaaguuggacagcaaaa

SEQ ID NO: 3726648 - RNA, 15 nt, Human
ugaaguuguuacuaa

SEQ ID NO: 3726649 - RNA, 18 nt, Human
ugaaguuguuacuaacua

SEQ ID NO: 3726650 - RNA, 20 nt, Human
ugaaguuuaaaacaguauuu

SEQ ID NO: 3726651 - RNA, 21 nt, Human
ugaaguuuaaaacaguauuua

SEQ ID NO: 3726652 - RNA, 17 nt, Human
ugaaguuuacaaucaaa

SEQ ID NO: 3726653 - RNA, 14 nt, Human
ugaaguuuacauug

SEQ ID NO: 3726654 - RNA, 20 nt, Human
ugaaguuuacauuguaaaua

SEQ ID NO: 3726655 - RNA, 19 nt, Human
ugaaguuuacauuuuuauu

SEQ ID NO: 3726656 - RNA, 19 nt, Human
ugaaguuuauacaguacag

SEQ ID NO: 3726657 - RNA, 20 nt, Human
ugaaguuuauacaguacagu

SEQ ID NO: 3726658 - RNA, 13 nt, Human
ugaaguuucaagu

SEQ ID NO: 3726659 - RNA, 21 nt, Human
ugaaguuucaaguuuuaaagu

SEQ ID NO: 3726660 - RNA, 23 nt, Human
ugaaguuucaaguuuuaaaguuc

SEQ ID NO: 3726661 - RNA, 14 nt, Human
ugaaguuucacaug

SEQ ID NO: 3726662 - RNA, 19 nt, Human
ugaaguuuccuuggcuggu

SEQ ID NO: 3726663 - RNA, 13 nt, Human
ugaaguuugaaug

SEQ ID NO: 3726664 - RNA, 15 nt, Human
ugaaguuugaaugcu

SEQ ID NO: 3726665 - RNA, 16 nt, Human
ugaaguuugaauguua

SEQ ID NO: 3726666 - RNA, 18 nt, Human
ugaaguuugaauguuaaa

SEQ ID NO: 3726667 - RNA, 15 nt, Human
ugaaguuugauaaau

SEQ ID NO: 3726668 - RNA, 22 nt, Human
ugaaguuugauaaauaguguua

SEQ ID NO: 3726669 - RNA, 17 nt, Human
ugaaguuuuacugucua

SEQ ID NO: 3726670 - RNA, 16 nt, Human
ugaauaaaaacucaag

SEQ ID NO: 3726671 - RNA, 14 nt, Human
ugaauaaaaacuuu

SEQ ID NO: 3726672 - RNA, 15 nt, Human
ugaauaaaaauuaag

SEQ ID NO: 3726673 - RNA, 15 nt, Human
ugaauaaaagugcac

SEQ ID NO: 3726674 - RNA, 13 nt, Human
ugaauaaaauuau

SEQ ID NO: 3726675 - RNA, 20 nt, Human
ugaauaaaauuauuuuggau

SEQ ID NO: 3726676 - RNA, 13 nt, Human
ugaauaaacuuca

SEQ ID NO: 3726677 - RNA, 16 nt, Human
ugaauaaacuucagca

SEQ ID NO: 3726678 - RNA, 17 nt, Human
ugaauaaacuucagcac

SEQ ID NO: 3726679 - RNA, 19 nt, Human
ugaauaaacuucagcacca

SEQ ID NO: 3726680 - RNA, 11 nt, Human
ugaauaaagaa

SEQ ID NO: 3726681 - RNA, 18 nt, Human
ugaauaaagaauacuuga

SEQ ID NO: 3726682 - RNA, 20 nt, Human
ugaauaaagaauacuugaac

SEQ ID NO: 3726683 - RNA, 22 nt, Human
ugaauaaagaauacuugaacuu

SEQ ID NO: 3726684 - RNA, 20 nt, Human
ugaauaaagccugcuuuuua

SEQ ID NO: 3726685 - RNA, 13 nt, Human
ugaauaaagugcu

SEQ ID NO: 3726686 - RNA, 12 nt, Human
ugaauaaagugu

SEQ ID NO: 3726687 - RNA, 17 nt, Human
ugaauaaaguguaacaa

SEQ ID NO: 3726688 - RNA, 13 nt, Human
ugaauaaauguca

SEQ ID NO: 3726689 - RNA, 13 nt, Human
ugaauaaaugucu

SEQ ID NO: 3726690 - RNA, 14 nt, Human
ugaauaaaugucuu

SEQ ID NO: 3726691 - RNA, 15 nt, Human
ugaauaaaugucuug

SEQ ID NO: 3726692 - RNA, 12 nt, Human
ugaauaaaugug

SEQ ID NO: 3726693 - RNA, 13 nt, Human
ugaauaaaugugu

SEQ ID NO: 3726694 - RNA, 19 nt, Human
ugaauaaauucuauaggaa

SEQ ID NO: 3726695 - RNA, 20 nt, Human
ugaauaagacaacaaagaga

SEQ ID NO: 3726696 - RNA, 12 nt, Human
ugaauaagcacu

SEQ ID NO: 3726697 - RNA, 15 nt, Human
ugaauaagcacuuuu

SEQ ID NO: 3726698 - RNA, 20 nt, Human
ugaauaauaagcaggauguu

SEQ ID NO: 3726699 - RNA, 13 nt, Human
ugaauaaugauuu

SEQ ID NO: 3726700 - RNA, 22 nt, Human
ugaauacaaacaauggaaacug

SEQ ID NO: 3726701 - RNA, 16 nt, Human
ugaauacagcagcaag

SEQ ID NO: 3726702 - RNA, 16 nt, Human
ugaauaccacucugua

SEQ ID NO: 3726703 - RNA, 19 nt, Human
ugaauaccacucuguaauu

SEQ ID NO: 3726704 - RNA, 23 nt, Human
ugaauaccacucuguaauugcaa

SEQ ID NO: 3726705 - RNA, 17 nt, Human
ugaauaccauuaaaacu

SEQ ID NO: 3726706 - RNA, 22 nt, Human
ugaauaccauuaaaacugcuuu

SEQ ID NO: 3726707 - RNA, 16 nt, Human
ugaauacuguauuuug

SEQ ID NO: 3726708 - RNA, 18 nt, Human
ugaauacuuacauucucu

SEQ ID NO: 3726709 - RNA, 13 nt, Human
ugaauacuugaac

SEQ ID NO: 3726710 - RNA, 15 nt, Human
ugaauacuugaacca

SEQ ID NO: 3726711 - RNA, 15 nt, Human
ugaauacuuuauaaa

SEQ ID NO: 3726712 - RNA, 19 nt, Human
ugaauacuuugaauguguu

SEQ ID NO: 3726713 - RNA, 16 nt, Human
ugaauacuuuuuacaa

SEQ ID NO: 3726714 - RNA, 22 nt, Human
ugaauagccauauuuguaaaau

SEQ ID NO: 3726715 - RNA, 15 nt, Human
ugaauaguauugugu

SEQ ID NO: 3726716 - RNA, 13 nt, Human
ugaauauaaaaaa

SEQ ID NO: 3726717 - RNA, 13 nt, Human
ugaauauaaaugu

SEQ ID NO: 3726718 - RNA, 19 nt, Human
ugaauauaaauguguguau

SEQ ID NO: 3726719 - RNA, 12 nt, Human
ugaauauaauga

SEQ ID NO: 3726720 - RNA, 20 nt, Human
ugaauauauggcauuugcag

SEQ ID NO: 3726721 - RNA, 22 nt, Human
ugaauauauuuaagcaacaucu

SEQ ID NO: 3726722 - RNA, 18 nt, Human
ugaauauccccucccagu

SEQ ID NO: 3726723 - RNA, 16 nt, Human
ugaauaucuauuaaua

SEQ ID NO: 3726724 - RNA, 18 nt, Human
ugaauauguacauaggca

SEQ ID NO: 3726725 - RNA, 18 nt, Human
ugaauauuguucauauug

SEQ ID NO: 3726726 - RNA, 11 nt, Human
ugaauauuuau

SEQ ID NO: 3726727 - RNA, 17 nt, Human
ugaauauuuauaacagc

SEQ ID NO: 3726728 - RNA, 19 nt, Human
ugaauauuuauaacagcau

SEQ ID NO: 3726729 - RNA, 19 nt, Human
ugaauauuuauauuucacu

SEQ ID NO: 3726730 - RNA, 23 nt, Human
ugaauauuugucgauauuuccau

SEQ ID NO: 3726731 - RNA, 21 nt, Human
ugaauauuuucauuaaaagcu

SEQ ID NO: 3726732 - RNA, 18 nt, Human
ugaaucaagggucaggcc

SEQ ID NO: 3726733 - RNA, 20 nt, Human
ugaaucaagggucaggccuu

SEQ ID NO: 3726734 - RNA, 17 nt, Human
ugaaucaauaauauauu

SEQ ID NO: 3726735 - RNA, 19 nt, Human
ugaaucaauaauauauuuu

SEQ ID NO: 3726736 - RNA, 20 nt, Human
ugaaucaauaauauauuuuc

SEQ ID NO: 3726737 - RNA, 21 nt, Human
ugaaucacuguuuuuagacac

SEQ ID NO: 3726738 - RNA, 22 nt, Human
ugaaucacuguuuuuagacacc

SEQ ID NO: 3726739 - RNA, 21 nt, Human
ugaaucaguauaaacaaaguu

SEQ ID NO: 3726740 - RNA, 18 nt, Human
ugaaucaugagccugcug

SEQ ID NO: 3726741 - RNA, 14 nt, Human
ugaaucauguagua

SEQ ID NO: 3726742 - RNA, 18 nt, Human
ugaauccaaaagaaaaac

SEQ ID NO: 3726743 - RNA, 15 nt, Human
ugaauccaaacuaau

SEQ ID NO: 3726744 - RNA, 14 nt, Human
ugaauccaugcuug

SEQ ID NO: 3726745 - RNA, 20 nt, Human
ugaaucccacccacauguga

SEQ ID NO: 3726746 - RNA, 22 nt, Human
ugaauccuaagggcuggucucu

SEQ ID NO: 3726747 - RNA, 15 nt, Human
ugaauccuuugccug

SEQ ID NO: 3726748 - RNA, 15 nt, Human
ugaaucgcuucucuu

SEQ ID NO: 3726749 - RNA, 15 nt, Human
ugaaucuaagcagca

SEQ ID NO: 3726750 - RNA, 15 nt, Human
ugaaucuagcuuauu

SEQ ID NO: 3726751 - RNA, 18 nt, Human
ugaaucuaugccaaagau

SEQ ID NO: 3726752 - RNA, 19 nt, Human
ugaaucuauuauacuguau

SEQ ID NO: 3726753 - RNA, 12 nt, Human
ugaaucuauugg

SEQ ID NO: 3726754 - RNA, 16 nt, Human
ugaaucugcucacuuu

SEQ ID NO: 3726755 - RNA, 13 nt, Human
ugaaucuguacag

SEQ ID NO: 3726756 - RNA, 22 nt, Human
ugaaucuucugaaaccaaaugu

SEQ ID NO: 3726757 - RNA, 14 nt, Human
ugaaucuugcguuu

SEQ ID NO: 3726758 - RNA, 15 nt, Human
ugaaucuugucucaa

SEQ ID NO: 3726759 - RNA, 19 nt, Human
ugaaucuugucucaaugcu

SEQ ID NO: 3726760 - RNA, 21 nt, Human
ugaaucuugucucaaugcuca

SEQ ID NO: 3726761 - RNA, 23 nt, Human
ugaaucuugucucaaugcucaua

SEQ ID NO: 3726762 - RNA, 20 nt, Human
ugaaugaaaaauuuaagcau

SEQ ID NO: 3726763 - RNA, 18 nt, Human
ugaaugaaacccccacac

SEQ ID NO: 3726764 - RNA, 20 nt, Human
ugaaugaaacccccacacac

SEQ ID NO: 3726765 - RNA, 12 nt, Human
ugaaugaacacu

SEQ ID NO: 3726766 - RNA, 15 nt, Human
ugaaugaacacucuu

SEQ ID NO: 3726767 - RNA, 15 nt, Human
ugaaugaaccuucug

SEQ ID NO: 3726768 - RNA, 11 nt, Human
ugaaugaagca

SEQ ID NO: 3726769 - RNA, 20 nt, Human
ugaaugaauggcuaagcaaa

SEQ ID NO: 3726770 - RNA, 19 nt, Human
gggcagggagcugggcccg

SEQ ID NO: 3726771 - RNA, 12 nt, Human
gggcagggcagc

SEQ ID NO: 3726772 - RNA, 14 nt, Human
gggcagggcaugac

SEQ ID NO: 3726773 - RNA, 20 nt, Human
gggcaggggaggccaucugg

SEQ ID NO: 3726774 - RNA, 23 nt, Human
gggcaggggagggucagccaggg

SEQ ID NO: 3726775 - RNA, 22 nt, Human
gggcaggugcuggagcacuggg

SEQ ID NO: 3726776 - RNA, 16 nt, Human
gggcaggugguggcac

SEQ ID NO: 3726777 - RNA, 18 nt, Human
gggcaggugguggcacug

SEQ ID NO: 3726778 - RNA, 17 nt, Human
gggcaguaccugagggu

SEQ ID NO: 3726779 - RNA, 19 nt, Human
gggcagucugagagaggcc

SEQ ID NO: 3726780 - RNA, 23 nt, Human
gggcagugcuagugagcugggca

SEQ ID NO: 3726781 - RNA, 20 nt, Human
gggcaguucgcagccacccu

SEQ ID NO: 3726782 - RNA, 14 nt, Human
gggcauaaaguaaa

SEQ ID NO: 3726783 - RNA, 15 nt, Human
gggcauacuaauaaa

SEQ ID NO: 3726784 - RNA, 17 nt, Human
gggcauauccaccaccu

SEQ ID NO: 3726785 - RNA, 23 nt, Human
gggcauccauggggucucucaca

SEQ ID NO: 3726786 - RNA, 14 nt, Human
gggcaucucugggc

SEQ ID NO: 3726787 - RNA, 15 nt, Human
gggcaucucugggcu

SEQ ID NO: 3726788 - RNA, 17 nt, Human
gggcaucucugggcugg

SEQ ID NO: 3726789 - RNA, 14 nt, Human
gggcaucugccccu

SEQ ID NO: 3726790 - RNA, 20 nt, Human
gggcaucugccccuccccca

SEQ ID NO: 3726791 - RNA, 13 nt, Human
gggcaucuggccu

SEQ ID NO: 3726792 - RNA, 20 nt, Human
gggcaugccccggccaccuc

SEQ ID NO: 3726793 - RNA, 13 nt, Human
gggcaugccuugu

SEQ ID NO: 3726794 - RNA, 20 nt, Human
gggcauggggugggccucug

SEQ ID NO: 3726795 - RNA, 20 nt, Human
gggcaugguaccagcccugg

SEQ ID NO: 3726796 - RNA, 21 nt, Human
gggcaugguguucuccugcug

SEQ ID NO: 3726797 - RNA, 22 nt, Human
gggcauguauuggccuggaggu

SEQ ID NO: 3726798 - RNA, 23 nt, Human
gggcauugauggggaaggaggcu

SEQ ID NO: 3726799 - RNA, 17 nt, Human
gggccaaaaggaaaaag

SEQ ID NO: 3726800 - RNA, 15 nt, Human
gggccaaacgcugag

SEQ ID NO: 3726801 - RNA, 23 nt, Human
gggccaaauauauucucuuuggu

SEQ ID NO: 3726802 - RNA, 22 nt, Human
gggccaaauccgcucucuuccu

SEQ ID NO: 3726803 - RNA, 18 nt, Human
gggccaagccagggaugg

SEQ ID NO: 3726804 - RNA, 13 nt, Human
gggccaaggacug

SEQ ID NO: 3726805 - RNA, 14 nt, Human
gggccaccaaagcu

SEQ ID NO: 3726806 - RNA, 19 nt, Human
gggccaccaaagcugccca

SEQ ID NO: 3726807 - RNA, 13 nt, Human
gggccaccccucc

SEQ ID NO: 3726808 - RNA, 16 nt, Human
gggccaccuccccagg

SEQ ID NO: 3726809 - RNA, 17 nt, Human
gggccaccuccccaggc

SEQ ID NO: 3726810 - RNA, 16 nt, Human
gggccacgcuccagcu

SEQ ID NO: 3726811 - RNA, 19 nt, Human
gggccacgugccaggcccg

SEQ ID NO: 3726812 - RNA, 17 nt, Human
gggccacuccuuccugc

SEQ ID NO: 3726813 - RNA, 23 nt, Human
gggccagaggaacuguccagaga

SEQ ID NO: 3726814 - RNA, 12 nt, Human
gggccagaggca

SEQ ID NO: 3726815 - RNA, 20 nt, Human
gggccagaguauuggucucc

SEQ ID NO: 3726816 - RNA, 13 nt, Human
gggccagccccuc

SEQ ID NO: 3726817 - RNA, 16 nt, Human
gggccagccccuccau

SEQ ID NO: 3726818 - RNA, 15 nt, Human
gggccagccccuccc

SEQ ID NO: 3726819 - RNA, 16 nt, Human
gggccaggacaggccc

SEQ ID NO: 3726820 - RNA, 17 nt, Human
gggccaggacaggcccg

SEQ ID NO: 3726821 - RNA, 14 nt, Human
gggccaggacugag

SEQ ID NO: 3726822 - RNA, 13 nt, Human
gggccaggagccu

SEQ ID NO: 3726823 - RNA, 23 nt, Human
gggccaggcaggugccuggacau

SEQ ID NO: 3726824 - RNA, 10 nt, Human
gggccaggcc

SEQ ID NO: 3726825 - RNA, 21 nt, Human
gggccaggcugggucgcccug

SEQ ID NO: 3726826 - RNA, 14 nt, Human
gggccagggcccug

SEQ ID NO: 3726827 - RNA, 20 nt, Human
gggccagggcugcccugaga

SEQ ID NO: 3726828 - RNA, 18 nt, Human
gggccagggucuguguga

SEQ ID NO: 3726829 - RNA, 15 nt, Human
gggccaguccugccu

SEQ ID NO: 3726830 - RNA, 18 nt, Human
gggccaguccugccuggc

SEQ ID NO: 3726831 - RNA, 15 nt, Human
gggccaguggggccu

SEQ ID NO: 3726832 - RNA, 16 nt, Human
gggccaguggggccug

SEQ ID NO: 3726833 - RNA, 15 nt, Human
gggccauacuggccu

SEQ ID NO: 3726834 - RNA, 15 nt, Human
gggccauagcuccug

SEQ ID NO: 3726835 - RNA, 15 nt, Human
gggccaugaacuuug

SEQ ID NO: 3726836 - RNA, 19 nt, Human
gggccaugagcuccagacc

SEQ ID NO: 3726837 - RNA, 22 nt, Human
gggccaugauggcaacagaucu

SEQ ID NO: 3726838 - RNA, 13 nt, Human
gggccaugccucc

SEQ ID NO: 3726839 - RNA, 22 nt, Human
gggccaugccuccucaggagcc

SEQ ID NO: 3726840 - RNA, 19 nt, Human
gggccaugcugaggccugg

SEQ ID NO: 3726841 - RNA, 21 nt, Human
gggccaugcugaggccugggc

SEQ ID NO: 3726842 - RNA, 13 nt, Human
gggccauggcuca

SEQ ID NO: 3726843 - RNA, 15 nt, Human
gggccauggcucagg

SEQ ID NO: 3726844 - RNA, 17 nt, Human
gggccauguccaaagag

SEQ ID NO: 3726845 - RNA, 21 nt, Human
gggccauguccaaagaggcug

SEQ ID NO: 3726846 - RNA, 22 nt, Human
gggccauguccaaagaggcugc

SEQ ID NO: 3726847 - RNA, 17 nt, Human
gggccauguugugccuc

SEQ ID NO: 3726848 - RNA, 23 nt, Human
gggcccaagacagaugccccaga

SEQ ID NO: 3726849 - RNA, 12 nt, Human
gggcccacaccc

SEQ ID NO: 3726850 - RNA, 18 nt, Human
gggcccacaccuccuucc

SEQ ID NO: 3726851 - RNA, 10 nt, Human
gggcccaccu

SEQ ID NO: 3726852 - RNA, 17 nt, Human
gggcccagagagggugg

SEQ ID NO: 3726853 - RNA, 11 nt, Human
gggcccagagc

SEQ ID NO: 3726854 - RNA, 12 nt, Human
gggcccagagca

SEQ ID NO: 3726855 - RNA, 13 nt, Human
gggcccagagccc

SEQ ID NO: 3726856 - RNA, 16 nt, Human
gggcccagagcccagc

SEQ ID NO: 3726857 - RNA, 20 nt, Human
gggcccagagcccagcucca

SEQ ID NO: 3726858 - RNA, 14 nt, Human
gggcccagaggagc

SEQ ID NO: 3726859 - RNA, 24 nt, Human
gggcccaggaccagcuggggcgug

SEQ ID NO: 3726860 - RNA, 20 nt, Human
gggcccaggccaucuuccag

SEQ ID NO: 3726861 - RNA, 22 nt, Human
gggcccagggacaccagccagg

SEQ ID NO: 3726862 - RNA, 11 nt, Human
gggcccagggg

SEQ ID NO: 3726863 - RNA, 22 nt, Human
gggcccagugcaugguggccag

SEQ ID NO: 3726864 - RNA, 22 nt, Human
gggccccaaacgggcugcccug

SEQ ID NO: 3726865 - RNA, 18 nt, Human
gggccccagaaggcaggg

SEQ ID NO: 3726866 - RNA, 14 nt, Human
gggccccagucagc

SEQ ID NO: 3726867 - RNA, 14 nt, Human
gggcccccaucuca

SEQ ID NO: 3726868 - RNA, 15 nt, Human
gggccccccagcuca

SEQ ID NO: 3726869 - RNA, 15 nt, Human
gggccccccuccuug

SEQ ID NO: 3726870 - RNA, 13 nt, Human
gggccccccugcc

SEQ ID NO: 3726871 - RNA, 14 nt, Human
gggccccuccagcu

SEQ ID NO: 3726872 - RNA, 19 nt, Human
gggccccucccuaccucaa

SEQ ID NO: 3726873 - RNA, 12 nt, Human
gggccccucucc

SEQ ID NO: 3726874 - RNA, 12 nt, Human
gggccccucugc

SEQ ID NO: 3726875 - RNA, 17 nt, Human
gggccccucugcccagc

SEQ ID NO: 3726876 - RNA, 13 nt, Human
gggccccugccuc

SEQ ID NO: 3726877 - RNA, 17 nt, Human
gggccccugccucucug

SEQ ID NO: 3726878 - RNA, 12 nt, Human
gggccccuggca

SEQ ID NO: 3726879 - RNA, 23 nt, Human
gggccccugggcuuggccugcug

SEQ ID NO: 3726880 - RNA, 18 nt, Human
gggccccuuugcugaccc

SEQ ID NO: 3726881 - RNA, 14 nt, Human
gggcccgcuugccu

SEQ ID NO: 3726882 - RNA, 21 nt, Human
gggcccgcuugccucggcucc

SEQ ID NO: 3726883 - RNA, 13 nt, Human
gggcccggccagc

SEQ ID NO: 3726884 - RNA, 22 nt, Human
gggcccggguugggucaccaga

SEQ ID NO: 3726885 - RNA, 17 nt, Human
gggcccguugaggauga

SEQ ID NO: 3726886 - RNA, 22 nt, Human
gggcccguugucucccuggccc

SEQ ID NO: 3726887 - RNA, 12 nt, Human
gggcccuccuga

SEQ ID NO: 3726888 - RNA, 13 nt, Human
gggcccuccuucc

SEQ ID NO: 3726889 - RNA, 14 nt, Human
gggcccucucuucu

SEQ ID NO: 3726890 - RNA, 19 nt, Human
gggcccugcccuggcaggg

SEQ ID NO: 3726891 - RNA, 11 nt, Human
gggcccuggag

SEQ ID NO: 3726892 - RNA, 13 nt, Human
gggcccuggagca

SEQ ID NO: 3726893 - RNA, 21 nt, Human
gggcccuggagcagccacccc

SEQ ID NO: 3726894 - RNA, 14 nt, Human
gggcccugggcugg

SEQ ID NO: 3726895 - RNA, 12 nt, Human
gggcccuggggc

SEQ ID NO: 3726896 - RNA, 17 nt, Human
gggcccuggggccugua

SEQ ID NO: 3726897 - RNA, 18 nt, Human
gggcccuggggccuguac

SEQ ID NO: 3726898 - RNA, 20 nt, Human
gggcccuggggccuguacug

SEQ ID NO: 3726899 - RNA, 19 nt, Human
gggcccuuuuucaauaacu

SEQ ID NO: 3726900 - RNA, 13 nt, Human
gggccgaccagag

SEQ ID NO: 3726901 - RNA, 14 nt, Human
gggccgacuaagag

SEQ ID NO: 3726902 - RNA, 15 nt, Human
gggccgagccugccu

SEQ ID NO: 3726903 - RNA, 20 nt, Human
gggccgaggaggugccugga

SEQ ID NO: 3726904 - RNA, 19 nt, Human
gggccgccgguuugaguga

SEQ ID NO: 3726905 - RNA, 14 nt, Human
gggccgcugccacc

SEQ ID NO: 3726906 - RNA, 20 nt, Human
gggccgggcgcgguggcuca

SEQ ID NO: 3726907 - RNA, 23 nt, Human
gggccggggaacuggccaagcug

SEQ ID NO: 3726908 - RNA, 18 nt, Human
gggccguaccccacccuc

SEQ ID NO: 3726909 - RNA, 19 nt, Human
gggccguaucuccggcucc

SEQ ID NO: 3726910 - RNA, 23 nt, Human
gggccguaucuccggcucccagc

SEQ ID NO: 3726911 - RNA, 20 nt, Human
gggccuagcgaucucuccug

SEQ ID NO: 3726912 - RNA, 14 nt, Human
gggccuaucagugu

SEQ ID NO: 3726913 - RNA, 18 nt, Human
gggccuaucagugugccc

SEQ ID NO: 3726914 - RNA, 22 nt, Human
gggccuaucagugugcccccca

SEQ ID NO: 3726915 - RNA, 19 nt, Human
gggccucaaaggcccgcuc

SEQ ID NO: 3726916 - RNA, 20 nt, Human
gggccucaaaggcccgcucu

SEQ ID NO: 3726917 - RNA, 13 nt, Human
gggccucagugcc

SEQ ID NO: 3726918 - RNA, 14 nt, Human
gggccuccagaacu

SEQ ID NO: 3726919 - RNA, 20 nt, Human
gggccuccaugggccccagg

SEQ ID NO: 3726920 - RNA, 16 nt, Human
gggccucgggaccuca

SEQ ID NO: 3726921 - RNA, 20 nt, Human
ucuuagaagaauauuguauu

SEQ ID NO: 3726922 - RNA, 21 nt, Human
ucuuagaaguggaccaggaca

SEQ ID NO: 3726923 - RNA, 18 nt, Human
ucuuagacuucugcuuuc

SEQ ID NO: 3726924 - RNA, 23 nt, Human
ucuuagacuugaaauacuacuua

SEQ ID NO: 3726925 - RNA, 12 nt, Human
ucuuagauguau

SEQ ID NO: 3726926 - RNA, 14 nt, Human
ucuuagauucuuaa

SEQ ID NO: 3726927 - RNA, 16 nt, Human
ucuuagcauccugccu

SEQ ID NO: 3726928 - RNA, 18 nt, Human
ucuuagcucaaugagcau

SEQ ID NO: 3726929 - RNA, 19 nt, Human
ucuuagcucaaugagcaug

SEQ ID NO: 3726930 - RNA, 21 nt, Human
ucuuagcucaaugagcauguu

SEQ ID NO: 3726931 - RNA, 14 nt, Human
ucuuagcuccccuc

SEQ ID NO: 3726932 - RNA, 16 nt, Human
ucuuagcuccccucca

SEQ ID NO: 3726933 - RNA, 18 nt, Human
ucuuagcugucugcucag

SEQ ID NO: 3726934 - RNA, 14 nt, Human
ucuuaggcacuuug

SEQ ID NO: 3726935 - RNA, 19 nt, Human
ucuuaggggagagcuuucu

SEQ ID NO: 3726936 - RNA, 23 nt, Human
ucuuagguuggcaaaaaggcagg

SEQ ID NO: 3726937 - RNA, 17 nt, Human
ucuuagucuagguccuu

SEQ ID NO: 3726938 - RNA, 16 nt, Human
ucuuaguggauguucu

SEQ ID NO: 3726939 - RNA, 14 nt, Human
ucuuauacacauug

SEQ ID NO: 3726940 - RNA, 14 nt, Human
ucuuauacauuuga

SEQ ID NO: 3726941 - RNA, 15 nt, Human
ucuuauacauuugau

SEQ ID NO: 3726942 - RNA, 19 nt, Human
ucuuauacgcuuuucuuug

SEQ ID NO: 3726943 - RNA, 16 nt, Human
ucuuauacuguacaau

SEQ ID NO: 3726944 - RNA, 23 nt, Human
ucuuauagcacuuugaaauaccu

SEQ ID NO: 3726945 - RNA, 22 nt, Human
ucuuauauagcagcaaaaauau

SEQ ID NO: 3726946 - RNA, 23 nt, Human
ucuuaucaaggacucugguuucu

SEQ ID NO: 3726947 - RNA, 23 nt, Human
ucuuaucaccacaguaaguuccu

SEQ ID NO: 3726948 - RNA, 20 nt, Human
ucuuaucucagauauuugca

SEQ ID NO: 3726949 - RNA, 21 nt, Human
ucuuaucucagauauuugcac

SEQ ID NO: 3726950 - RNA, 20 nt, Human
ucuuaucucagucaugcaua

SEQ ID NO: 3726951 - RNA, 16 nt, Human
ucuuaugaggagggga

SEQ ID NO: 3726952 - RNA, 15 nt, Human
ucuuaugcaaaaugg

SEQ ID NO: 3726953 - RNA, 17 nt, Human
ucuuaugcuuccagaaa

SEQ ID NO: 3726954 - RNA, 21 nt, Human
ucuuauggaauugauuugcau

SEQ ID NO: 3726955 - RNA, 12 nt, Human
ucuuauggaugu

SEQ ID NO: 3726956 - RNA, 14 nt, Human
ucuuaugggcuggg

SEQ ID NO: 3726957 - RNA, 18 nt, Human
ucuuauguaccucuuuua

SEQ ID NO: 3726958 - RNA, 16 nt, Human
ucuuaugugacauuaa

SEQ ID NO: 3726959 - RNA, 14 nt, Human
ucuuauuaaaacac

SEQ ID NO: 3726960 - RNA, 14 nt, Human
ucuuauuaaaguuu

SEQ ID NO: 3726961 - RNA, 18 nt, Human
ucuuauuaaaguuucaaa

SEQ ID NO: 3726962 - RNA, 20 nt, Human
ucuuauuaaaguuucaaaaa

SEQ ID NO: 3726963 - RNA, 21 nt, Human
ucuuauuaaaguuucaaaaau

SEQ ID NO: 3726964 - RNA, 23 nt, Human
ucuuauuauauauauaauauaua

SEQ ID NO: 3726965 - RNA, 17 nt, Human
ucuuauucaguaaaaaa

SEQ ID NO: 3726966 - RNA, 18 nt, Human
ucuuauuccauauuagaa

SEQ ID NO: 3726967 - RNA, 16 nt, Human
ucuuauugcgcugcua

SEQ ID NO: 3726968 - RNA, 17 nt, Human
ucuuauugcgcugcuac

SEQ ID NO: 3726969 - RNA, 15 nt, Human
ucuuauuucauuucu

SEQ ID NO: 3726970 - RNA, 14 nt, Human
ucuuauuuugugga

SEQ ID NO: 3726971 - RNA, 16 nt, Human
ucuucaaaaguaaugc

SEQ ID NO: 3726972 - RNA, 19 nt, Human
ucuucaaauccuuccaaaa

SEQ ID NO: 3726973 - RNA, 14 nt, Human
ucuucaaaugccug

SEQ ID NO: 3726974 - RNA, 24 nt, Human
ucuucaacaucaauguucauugua

SEQ ID NO: 3726975 - RNA, 17 nt, Human
ucuucaacauccugcca

SEQ ID NO: 3726976 - RNA, 18 nt, Human
ucuucaacauccugccag

SEQ ID NO: 3726977 - RNA, 19 nt, Human
ucuucaacauccugccagc

SEQ ID NO: 3726978 - RNA, 21 nt, Human
ucuucaacauccugccagccc

SEQ ID NO: 3726979 - RNA, 16 nt, Human
ucuucaagaucccauu

SEQ ID NO: 3726980 - RNA, 17 nt, Human
ucuucaccauuuggcaa

SEQ ID NO: 3726981 - RNA, 20 nt, Human
ucuucacccagcuaaucugu

SEQ ID NO: 3726982 - RNA, 19 nt, Human
ucuucacccaggccuaugu

SEQ ID NO: 3726983 - RNA, 23 nt, Human
ucuucacccaggccuauguugau

SEQ ID NO: 3726984 - RNA, 15 nt, Human
ucuucaccccggcag

SEQ ID NO: 3726985 - RNA, 18 nt, Human
ucuucaccccggcaggcc

SEQ ID NO: 3726986 - RNA, 20 nt, Human
ucuucaccccggcaggcccu

SEQ ID NO: 3726987 - RNA, 19 nt, Human
ucuucaccuaagucucugu

SEQ ID NO: 3726988 - RNA, 18 nt, Human
ucuucaccuccugccagc

SEQ ID NO: 3726989 - RNA, 21 nt, Human
ucuucaccugauucaacuaaa

SEQ ID NO: 3726990 - RNA, 15 nt, Human
ucuucacucuuaggc

SEQ ID NO: 3726991 - RNA, 16 nt, Human
ucuucacuuuugcaag

SEQ ID NO: 3726992 - RNA, 17 nt, Human
ucuucagagacuccugc

SEQ ID NO: 3726993 - RNA, 18 nt, Human
ucuucagagaucauggaa

SEQ ID NO: 3726994 - RNA, 14 nt, Human
ucuucagaucucua

SEQ ID NO: 3726995 - RNA, 13 nt, Human
ucuucagaugcca

SEQ ID NO: 3726996 - RNA, 21 nt, Human
ucuucagcaaaaauauuuuau

SEQ ID NO: 3726997 - RNA, 22 nt, Human
ucuucagcaaaaauauuuuaug

SEQ ID NO: 3726998 - RNA, 23 nt, Human
ucuucagcaaaaauauuuuauga

SEQ ID NO: 3726999 - RNA, 19 nt, Human
ucuucagcauucccuccca

SEQ ID NO: 3727000 - RNA, 19 nt, Human
ucuucagccaccucucuuu

SEQ ID NO: 3727001 - RNA, 20 nt, Human
ucuucagcuugugcacaauu

SEQ ID NO: 3727002 - RNA, 14 nt, Human
ucuucaggccuccc

SEQ ID NO: 3727003 - RNA, 13 nt, Human
ucuucagggcacu

SEQ ID NO: 3727004 - RNA, 16 nt, Human
ucuucagguggaaaaa

SEQ ID NO: 3727005 - RNA, 22 nt, Human
ucuucaguugguugugucuuuu

SEQ ID NO: 3727006 - RNA, 17 nt, Human
ucuucaguuugcagagu

SEQ ID NO: 3727007 - RNA, 18 nt, Human
ucuucaguuugcagagua

SEQ ID NO: 3727008 - RNA, 20 nt, Human
ucuucauaaaguacuugagu

SEQ ID NO: 3727009 - RNA, 19 nt, Human
ucuucaucugacuaugaca

SEQ ID NO: 3727010 - RNA, 16 nt, Human
ucuucaucugcccaac

SEQ ID NO: 3727011 - RNA, 13 nt, Human
ucuucaucuucac

SEQ ID NO: 3727012 - RNA, 16 nt, Human
ucuucaugaaaugcua

SEQ ID NO: 3727013 - RNA, 20 nt, Human
ucuucaugaguagugggcua

SEQ ID NO: 3727014 - RNA, 17 nt, Human
ucuucaugcaaugacau

SEQ ID NO: 3727015 - RNA, 17 nt, Human
ucuucauggugacacuc

SEQ ID NO: 3727016 - RNA, 16 nt, Human
ucuucauguucaauua

SEQ ID NO: 3727017 - RNA, 14 nt, Human
ucuucauguuccca

SEQ ID NO: 3727018 - RNA, 19 nt, Human
ucuucauguucccacuuca

SEQ ID NO: 3727019 - RNA, 22 nt, Human
ucuucauuaccucagugagaag

SEQ ID NO: 3727020 - RNA, 14 nt, Human
ucuucauuucauug

SEQ ID NO: 3727021 - RNA, 24 nt, Human
ucuucauuucauuguaugaugugu

SEQ ID NO: 3727022 - RNA, 19 nt, Human
ucuucauuuuuuuuaauug

SEQ ID NO: 3727023 - RNA, 21 nt, Human
ucuuccaaccauuuaucuuga

SEQ ID NO: 3727024 - RNA, 21 nt, Human
ucuuccaauuuaguuguugua

SEQ ID NO: 3727025 - RNA, 18 nt, Human
ucuuccacaaagaaaauu

SEQ ID NO: 3727026 - RNA, 15 nt, Human
ucuuccacacaugca

SEQ ID NO: 3727027 - RNA, 19 nt, Human
ucuuccagaagugugauug

SEQ ID NO: 3727028 - RNA, 14 nt, Human
ucuuccaggcuggg

SEQ ID NO: 3727029 - RNA, 17 nt, Human
ucuuccaggcugggaga

SEQ ID NO: 3727030 - RNA, 22 nt, Human
ucuuccaggcugggagagccuu

SEQ ID NO: 3727031 - RNA, 13 nt, Human
ucuuccagguggg

SEQ ID NO: 3727032 - RNA, 19 nt, Human
ucuuccagguggggugagg

SEQ ID NO: 3727033 - RNA, 18 nt, Human
ucuuccagucuuccugac

SEQ ID NO: 3727034 - RNA, 18 nt, Human
ucuuccaguuacuuucca

SEQ ID NO: 3727035 - RNA, 19 nt, Human
ucuuccaguuacuuuccaa

SEQ ID NO: 3727036 - RNA, 14 nt, Human
ucuuccaugcugug

SEQ ID NO: 3727037 - RNA, 16 nt, Human
ucuuccauguaucuuu

SEQ ID NO: 3727038 - RNA, 18 nt, Human
ucuucccaacuugccuuu

SEQ ID NO: 3727039 - RNA, 13 nt, Human
ucuucccaugcau

SEQ ID NO: 3727040 - RNA, 14 nt, Human
ucuucccauucucc

SEQ ID NO: 3727041 - RNA, 13 nt, Human
ucuuccccaggaa

SEQ ID NO: 3727042 - RNA, 14 nt, Human
ucuucccccaccac

SEQ ID NO: 3727043 - RNA, 15 nt, Human
ucuuccccuugcccu

SEQ ID NO: 3727044 - RNA, 19 nt, Human
ucuucccgaaccccaagga

SEQ ID NO: 3727045 - RNA, 14 nt, Human
ucuucccuaccuca

SEQ ID NO: 3727046 - RNA, 20 nt, Human
ucuucccuagggcugggugu

SEQ ID NO: 3727047 - RNA, 16 nt, Human
ucuucccucaaaugug

SEQ ID NO: 3727048 - RNA, 10 nt, Human
ucuucccucc

SEQ ID NO: 3727049 - RNA, 20 nt, Human
ucuucccugguaagaaaaag

SEQ ID NO: 3727050 - RNA, 13 nt, Human
ucuucccuuaaaa

SEQ ID NO: 3727051 - RNA, 21 nt, Human
ucuuccgacucuuucugagug

SEQ ID NO: 3727052 - RNA, 15 nt, Human
ucuuccgccccugcc

SEQ ID NO: 3727053 - RNA, 18 nt, Human
ucuuccgccccugccugc

SEQ ID NO: 3727054 - RNA, 15 nt, Human
ucuuccgucuccccc

SEQ ID NO: 3727055 - RNA, 20 nt, Human
ucuuccuaccaagucaaacu

SEQ ID NO: 3727056 - RNA, 17 nt, Human
ucuuccuacuggucucu

SEQ ID NO: 3727057 - RNA, 14 nt, Human
ucuuccuaucccau

SEQ ID NO: 3727058 - RNA, 18 nt, Human
ucuuccuaucccauccca

SEQ ID NO: 3727059 - RNA, 14 nt, Human
ucuuccuauuucag

SEQ ID NO: 3727060 - RNA, 15 nt, Human
ucuuccuauuucaga

SEQ ID NO: 3727061 - RNA, 13 nt, Human
ucuuccucagcca

SEQ ID NO: 3727062 - RNA, 18 nt, Human
ucuuccucagccagccuc

SEQ ID NO: 3727063 - RNA, 13 nt, Human
ucuuccuccagcu

SEQ ID NO: 3727064 - RNA, 15 nt, Human
ucuuccuccagcugc

SEQ ID NO: 3727065 - RNA, 17 nt, Human
ucuuccuccagcugcac

SEQ ID NO: 3727066 - RNA, 22 nt, Human
ucuuccucccaaguggugccua

SEQ ID NO: 3727067 - RNA, 17 nt, Human
ucuuccuccgaggccag

SEQ ID NO: 3727068 - RNA, 12 nt, Human
ucuuccuccuga

SEQ ID NO: 3727069 - RNA, 13 nt, Human
ucuuccucugagg

SEQ ID NO: 3727070 - RNA, 12 nt, Human
ucuuccucugcu

SEQ ID NO: 3727071 - RNA, 15 nt, Human
ugaaugacaaagagu

SEQ ID NO: 3727072 - RNA, 16 nt, Human
ugaaugacaaaguaug

SEQ ID NO: 3727073 - RNA, 22 nt, Human
ugaaugacuuccccaauaucuu

SEQ ID NO: 3727074 - RNA, 14 nt, Human
ugaaugagaaucua

SEQ ID NO: 3727075 - RNA, 22 nt, Human
ugaaugaggucccaggcagaga

SEQ ID NO: 3727076 - RNA, 14 nt, Human
ugaaugaugagccu

SEQ ID NO: 3727077 - RNA, 16 nt, Human
ugaaugauucaguguu

SEQ ID NO: 3727078 - RNA, 18 nt, Human
ugaaugauucauguuaua

SEQ ID NO: 3727079 - RNA, 19 nt, Human
ugaaugauuuccaaagaga

SEQ ID NO: 3727080 - RNA, 20 nt, Human
ugaaugauuuuucuuuacaa

SEQ ID NO: 3727081 - RNA, 20 nt, Human
ugaaugcagguuuuaucaga

SEQ ID NO: 3727082 - RNA, 14 nt, Human
ugaaugcauaaaau

SEQ ID NO: 3727083 - RNA, 16 nt, Human
ugaaugcauaaaaugu

SEQ ID NO: 3727084 - RNA, 18 nt, Human
ugaaugccagugugcuga

SEQ ID NO: 3727085 - RNA, 21 nt, Human
ugaaugccauagucaaagaga

SEQ ID NO: 3727086 - RNA, 20 nt, Human
ugaaugcccccagcuggccc

SEQ ID NO: 3727087 - RNA, 14 nt, Human
ugaaugccguggau

SEQ ID NO: 3727088 - RNA, 17 nt, Human
ugaaugccucaauguga

SEQ ID NO: 3727089 - RNA, 13 nt, Human
ugaaugccuccug

SEQ ID NO: 3727090 - RNA, 13 nt, Human
ugaaugcggccca

SEQ ID NO: 3727091 - RNA, 19 nt, Human
ugaaugcugggacucagcc

SEQ ID NO: 3727092 - RNA, 17 nt, Human
ugaaugcuuaaagaauu

SEQ ID NO: 3727093 - RNA, 21 nt, Human
ugaaugcuuaaagaauucaaa

SEQ ID NO: 3727094 - RNA, 21 nt, Human
ugaaugcuuugcauuuggaau

SEQ ID NO: 3727095 - RNA, 23 nt, Human
ugaaugcuuuuagugugugcaua

SEQ ID NO: 3727096 - RNA, 18 nt, Human
ugaaugcuuuuugaaugu

SEQ ID NO: 3727097 - RNA, 22 nt, Human
ugaauggacgguuuaggugaaa

SEQ ID NO: 3727098 - RNA, 14 nt, Human
ugaauggauuggau

SEQ ID NO: 3727099 - RNA, 12 nt, Human
ugaauggccugc

SEQ ID NO: 3727100 - RNA, 21 nt, Human
ugaauggccugccuugaagcc

SEQ ID NO: 3727101 - RNA, 21 nt, Human
ugaauggcuauguuuuuaaug

SEQ ID NO: 3727102 - RNA, 22 nt, Human
ugaauggcuuuguauagaaccu

SEQ ID NO: 3727103 - RNA, 18 nt, Human
ugaaugggaucaugaaag

SEQ ID NO: 3727104 - RNA, 17 nt, Human
ugaaugggcaaaacuga

SEQ ID NO: 3727105 - RNA, 20 nt, Human
ugaaugggcaaaacugaauu

SEQ ID NO: 3727106 - RNA, 18 nt, Human
ugaaugguguuguaugcc

SEQ ID NO: 3727107 - RNA, 19 nt, Human
ugaaugguuccaugccuga

SEQ ID NO: 3727108 - RNA, 22 nt, Human
ugaaugguuccaugccugaggg

SEQ ID NO: 3727109 - RNA, 15 nt, Human
ugaauguaaauuugu

SEQ ID NO: 3727110 - RNA, 19 nt, Human
ugaauguaaauuuguacua

SEQ ID NO: 3727111 - RNA, 15 nt, Human
ugaauguaauuugug

SEQ ID NO: 3727112 - RNA, 23 nt, Human
ugaauguauuuauuugggagacc

SEQ ID NO: 3727113 - RNA, 14 nt, Human
ugaaugucagugug

SEQ ID NO: 3727114 - RNA, 18 nt, Human
ugaaugucagugugacug

SEQ ID NO: 3727115 - RNA, 19 nt, Human
ugaaugucagugugacuga

SEQ ID NO: 3727116 - RNA, 16 nt, Human
ugaaugucuaaaauug

SEQ ID NO: 3727117 - RNA, 20 nt, Human
ugaaugucuaaggucacaca

SEQ ID NO: 3727118 - RNA, 13 nt, Human
ugaaugugaagcc

SEQ ID NO: 3727119 - RNA, 20 nt, Human
ugaaugugcugaucauuuga

SEQ ID NO: 3727120 - RNA, 15 nt, Human
ugaaugugggcacug

SEQ ID NO: 3727121 - RNA, 16 nt, Human
ugaauguguuucacag

SEQ ID NO: 3727122 - RNA, 17 nt, Human
ugaauguguuucacagu

SEQ ID NO: 3727123 - RNA, 22 nt, Human
ugaauguguuucacaguuugaa

SEQ ID NO: 3727124 - RNA, 21 nt, Human
ugaauguuaaagggauauuuu

SEQ ID NO: 3727125 - RNA, 13 nt, Human
ugaauguuaaaua

SEQ ID NO: 3727126 - RNA, 20 nt, Human
ugaauguuaaauaaauugua

SEQ ID NO: 3727127 - RNA, 14 nt, Human
ugaauguuaagaau

SEQ ID NO: 3727128 - RNA, 15 nt, Human
ugaauguuauuuguu

SEQ ID NO: 3727129 - RNA, 23 nt, Human
ugaauguuauuuguuauuuucag

SEQ ID NO: 3727130 - RNA, 21 nt, Human
ugaauguugucuguuuguucu

SEQ ID NO: 3727131 - RNA, 22 nt, Human
ugaauguuuccaaccuggagua

SEQ ID NO: 3727132 - RNA, 18 nt, Human
ugaauguuuuucuaaagg

SEQ ID NO: 3727133 - RNA, 11 nt, Human
ugaauuaaaac

SEQ ID NO: 3727134 - RNA, 16 nt, Human
ugaauuaaaacuucuu

SEQ ID NO: 3727135 - RNA, 18 nt, Human
ugaauuaaaacuucuuaa

SEQ ID NO: 3727136 - RNA, 15 nt, Human
ugaauuaaaguaauu

SEQ ID NO: 3727137 - RNA, 17 nt, Human
ugaauuaaauaaacccu

SEQ ID NO: 3727138 - RNA, 16 nt, Human
ugaauuaaauuaggaa

SEQ ID NO: 3727139 - RNA, 18 nt, Human
ugaauuaagcccaauuaa

SEQ ID NO: 3727140 - RNA, 22 nt, Human
ugaauuaauaucccuacaugua

SEQ ID NO: 3727141 - RNA, 13 nt, Human
ugaauuacuaacu

SEQ ID NO: 3727142 - RNA, 18 nt, Human
ugaauuacuaacuucuaa

SEQ ID NO: 3727143 - RNA, 23 nt, Human
ugaauuagaaacauaaauaaaau

SEQ ID NO: 3727144 - RNA, 16 nt, Human
ugaauuaguccuugcu

SEQ ID NO: 3727145 - RNA, 18 nt, Human
ugaauuagugaguauagu

SEQ ID NO: 3727146 - RNA, 15 nt, Human
ugaauuaucagcaaa

SEQ ID NO: 3727147 - RNA, 18 nt, Human
ugaauuaucagcaaagaa

SEQ ID NO: 3727148 - RNA, 19 nt, Human
ugaauuaucagcaaagaaa

SEQ ID NO: 3727149 - RNA, 20 nt, Human
ugaauuaucagcaaagaaaa

SEQ ID NO: 3727150 - RNA, 20 nt, Human
ugaauuaucccuuuucuuga

SEQ ID NO: 3727151 - RNA, 15 nt, Human
ugaauuaucuauaca

SEQ ID NO: 3727152 - RNA, 15 nt, Human
ugaauuauugacacu

SEQ ID NO: 3727153 - RNA, 16 nt, Human
ugaauuauuuucucuc

SEQ ID NO: 3727154 - RNA, 16 nt, Human
ugaauuccuaaaauua

SEQ ID NO: 3727155 - RNA, 18 nt, Human
ugaauuccuagaauuaaa

SEQ ID NO: 3727156 - RNA, 19 nt, Human
ugaauucugcaauguuuuc

SEQ ID NO: 3727157 - RNA, 17 nt, Human
ugaauucuuaugcuuau

SEQ ID NO: 3727158 - RNA, 17 nt, Human
ugaauugauaauaaacu

SEQ ID NO: 3727159 - RNA, 13 nt, Human
ugaauugauuuug

SEQ ID NO: 3727160 - RNA, 22 nt, Human
ugaauugcauuuuuuaaaacaa

SEQ ID NO: 3727161 - RNA, 16 nt, Human
ugaauugcguuggucu

SEQ ID NO: 3727162 - RNA, 15 nt, Human
ugaauuggaaugcac

SEQ ID NO: 3727163 - RNA, 21 nt, Human
ugaauuguaaggaaugauuaa

SEQ ID NO: 3727164 - RNA, 13 nt, Human
ugaauuguuacau

SEQ ID NO: 3727165 - RNA, 17 nt, Human
ugaauuguuuucuuuaa

SEQ ID NO: 3727166 - RNA, 12 nt, Human
ugaauuuaaaua

SEQ ID NO: 3727167 - RNA, 16 nt, Human
ugaauuuaaauagcuu

SEQ ID NO: 3727168 - RNA, 14 nt, Human
ugaauuuaaauaua

SEQ ID NO: 3727169 - RNA, 15 nt, Human
ugaauuuaaauauaa

SEQ ID NO: 3727170 - RNA, 20 nt, Human
ugaauuuagugagauuuacc

SEQ ID NO: 3727171 - RNA, 17 nt, Human
ugaauuuagugagcaua

SEQ ID NO: 3727172 - RNA, 21 nt, Human
ugaauuuagugagcauaggug

SEQ ID NO: 3727173 - RNA, 15 nt, Human
ugaauuuauuauugu

SEQ ID NO: 3727174 - RNA, 18 nt, Human
ugaauuuauuauuguucu

SEQ ID NO: 3727175 - RNA, 22 nt, Human
ugaauuuauuggcuuuucugau

SEQ ID NO: 3727176 - RNA, 13 nt, Human
ugaauuucuaaaa

SEQ ID NO: 3727177 - RNA, 15 nt, Human
ugaauuucuuuugcc

SEQ ID NO: 3727178 - RNA, 23 nt, Human
ugaauuucuuuugccguuauuaa

SEQ ID NO: 3727179 - RNA, 12 nt, Human
ugaauuugcaaa

SEQ ID NO: 3727180 - RNA, 20 nt, Human
ugaauuugcaaaguacugua

SEQ ID NO: 3727181 - RNA, 21 nt, Human
ugaauuugcaaaguacuguaa

SEQ ID NO: 3727182 - RNA, 18 nt, Human
ugaauuugcccugggaaa

SEQ ID NO: 3727183 - RNA, 15 nt, Human
ugaauuuggagacuc

SEQ ID NO: 3727184 - RNA, 17 nt, Human
ugaauuuggagacucug

SEQ ID NO: 3727185 - RNA, 21 nt, Human
ugaauuuggccugcacuaauu

SEQ ID NO: 3727186 - RNA, 21 nt, Human
ugaauuuguaaugucuugagc

SEQ ID NO: 3727187 - RNA, 13 nt, Human
ugaauuuguacuu

SEQ ID NO: 3727188 - RNA, 23 nt, Human
ugaauuugugaagguggaaauaa

SEQ ID NO: 3727189 - RNA, 23 nt, Human
ugaauuuuaaaucuaaaucuauu

SEQ ID NO: 3727190 - RNA, 14 nt, Human
ugaauuuuaagggu

SEQ ID NO: 3727191 - RNA, 16 nt, Human
ugaauuuuacauggcu

SEQ ID NO: 3727192 - RNA, 13 nt, Human
ugaauuuuagcuu

SEQ ID NO: 3727193 - RNA, 16 nt, Human
ugaauuuuagcuuuug

SEQ ID NO: 3727194 - RNA, 19 nt, Human
ugaauuuuagcuuuugugg

SEQ ID NO: 3727195 - RNA, 15 nt, Human
ugaauuuucauuuua

SEQ ID NO: 3727196 - RNA, 18 nt, Human
ugaauuuucauuuuacag

SEQ ID NO: 3727197 - RNA, 19 nt, Human
ugaauuuucauuuuacagu

SEQ ID NO: 3727198 - RNA, 16 nt, Human
ugaauuuucccacugc

SEQ ID NO: 3727199 - RNA, 17 nt, Human
ugaauuuucuaaaagcu

SEQ ID NO: 3727200 - RNA, 22 nt, Human
ugaauuuucuaaaagcuuucau

SEQ ID NO: 3727201 - RNA, 23 nt, Human
ugaauuuucuuuuuaauaaaaag

SEQ ID NO: 3727202 - RNA, 22 nt, Human
ugaauuuuggggauuuucaaaa

SEQ ID NO: 3727203 - RNA, 22 nt, Human
ugaauuuuguucucugggagaa

SEQ ID NO: 3727204 - RNA, 21 nt, Human
ugaauuuuuaaacaaguauuu

SEQ ID NO: 3727205 - RNA, 23 nt, Human
ugaauuuuuaaacaaguauuugu

SEQ ID NO: 3727206 - RNA, 13 nt, Human
ugaauuuuuaagc

SEQ ID NO: 3727207 - RNA, 23 nt, Human
ugaauuuuuauauauauaucugu

SEQ ID NO: 3727208 - RNA, 15 nt, Human
ugaauuuuuauuguu

SEQ ID NO: 3727209 - RNA, 13 nt, Human
ugaauuuuucucu

SEQ ID NO: 3727210 - RNA, 15 nt, Human
ugaauuuuucucuaa

SEQ ID NO: 3727211 - RNA, 15 nt, Human
ugaauuuuucucuuc

SEQ ID NO: 3727212 - RNA, 21 nt, Human
ugaauuuuuuucaucuucucu

SEQ ID NO: 3727213 - RNA, 18 nt, Human
ugaauuuuuuuguaauaa

SEQ ID NO: 3727214 - RNA, 21 nt, Human
ugaauuuuuuuuaacauuccu

SEQ ID NO: 3727215 - RNA, 21 nt, Human
ugacaaaaaauguuuuaaaga

SEQ ID NO: 3727216 - RNA, 18 nt, Human
ugacaaaaauucaacuca

SEQ ID NO: 3727217 - RNA, 15 nt, Human
ugacaaaauguuauu

SEQ ID NO: 3727218 - RNA, 18 nt, Human
ugacaaaauuuguugaaa

SEQ ID NO: 3727219 - RNA, 17 nt, Human
ugacaaaccucuaaccc

SEQ ID NO: 3727220 - RNA, 18 nt, Human
ucuuccugaguggugcca

SEQ ID NO: 3727221 - RNA, 13 nt, Human
ucuuccugccccu

SEQ ID NO: 3727222 - RNA, 16 nt, Human
ucuuccugccccucuu

SEQ ID NO: 3727223 - RNA, 17 nt, Human
ucuuccugccccucuuu

SEQ ID NO: 3727224 - RNA, 13 nt, Human
ucuuccuggacag

SEQ ID NO: 3727225 - RNA, 17 nt, Human
ucuuccuggauuauuca

SEQ ID NO: 3727226 - RNA, 22 nt, Human
ucuuccuggcuuuuuaacuccc

SEQ ID NO: 3727227 - RNA, 15 nt, Human
ucuuccuguaaucuu

SEQ ID NO: 3727228 - RNA, 12 nt, Human
ucuuccuguggg

SEQ ID NO: 3727229 - RNA, 13 nt, Human
ucuuccugugucc

SEQ ID NO: 3727230 - RNA, 20 nt, Human
ucuuccuuacuuuuuauaua

SEQ ID NO: 3727231 - RNA, 15 nt, Human
ucuuccuucccugcu

SEQ ID NO: 3727232 - RNA, 15 nt, Human
ucuuccuugauguuu

SEQ ID NO: 3727233 - RNA, 18 nt, Human
ucuuccuugauguuuggg

SEQ ID NO: 3727234 - RNA, 13 nt, Human
ucuuccuuuacuu

SEQ ID NO: 3727235 - RNA, 19 nt, Human
ucuuccuuuacuuucccuu

SEQ ID NO: 3727236 - RNA, 17 nt, Human
ucuucgaagccuugccu

SEQ ID NO: 3727237 - RNA, 22 nt, Human
ucuucgacuguuguuaucuguu

SEQ ID NO: 3727238 - RNA, 23 nt, Human
ucuucgcgcccgccccugcagca

SEQ ID NO: 3727239 - RNA, 14 nt, Human
ucuucgggaagaga

SEQ ID NO: 3727240 - RNA, 22 nt, Human
ucuucgggaagagaggaguuca

SEQ ID NO: 3727241 - RNA, 14 nt, Human
ucuucgggaccagg

SEQ ID NO: 3727242 - RNA, 15 nt, Human
ucuucguacaguucu

SEQ ID NO: 3727243 - RNA, 18 nt, Human
ucuucgucuucacucuua

SEQ ID NO: 3727244 - RNA, 19 nt, Human
ucuucguucuuuuuaaguu

SEQ ID NO: 3727245 - RNA, 23 nt, Human
ucuucuagagccgugaugccucc

SEQ ID NO: 3727246 - RNA, 22 nt, Human
ucuucuagaugauuuuuugaaa

SEQ ID NO: 3727247 - RNA, 22 nt, Human
ucuucuauuuauuuauuuauuc

SEQ ID NO: 3727248 - RNA, 16 nt, Human
ucuucuauuuuauucc

SEQ ID NO: 3727249 - RNA, 13 nt, Human
ucuucuauuuugu

SEQ ID NO: 3727250 - RNA, 16 nt, Human
ucuucucaagugccuu

SEQ ID NO: 3727251 - RNA, 14 nt, Human
ucuucucaaguucu

SEQ ID NO: 3727252 - RNA, 17 nt, Human
ucuucucaaguucuaag

SEQ ID NO: 3727253 - RNA, 23 nt, Human
ucuucucaaguucuaagauucua

SEQ ID NO: 3727254 - RNA, 14 nt, Human
ucuucucagccacu

SEQ ID NO: 3727255 - RNA, 14 nt, Human
ucuucucaggcucu

SEQ ID NO: 3727256 - RNA, 19 nt, Human
ucuucucauagcauuaacu

SEQ ID NO: 3727257 - RNA, 15 nt, Human
ucuucucauuacuug

SEQ ID NO: 3727258 - RNA, 15 nt, Human
ucuucucauuucacc

SEQ ID NO: 3727259 - RNA, 22 nt, Human
ucuucucauuucaccccucccu

SEQ ID NO: 3727260 - RNA, 16 nt, Human
ucuucuccacuggaug

SEQ ID NO: 3727261 - RNA, 21 nt, Human
ucuucuccacuuucuagccag

SEQ ID NO: 3727262 - RNA, 17 nt, Human
ucuucuccagauuuuuc

SEQ ID NO: 3727263 - RNA, 14 nt, Human
ucuucuccaggaug

SEQ ID NO: 3727264 - RNA, 12 nt, Human
ucuucuccaggc

SEQ ID NO: 3727265 - RNA, 15 nt, Human
ucuucuccaggcugu

SEQ ID NO: 3727266 - RNA, 14 nt, Human
ucuucuccaucugg

SEQ ID NO: 3727267 - RNA, 12 nt, Human
ucuucucccaga

SEQ ID NO: 3727268 - RNA, 13 nt, Human
ucuucucccccau

SEQ ID NO: 3727269 - RNA, 16 nt, Human
ucuucucccccauccu

SEQ ID NO: 3727270 - RNA, 16 nt, Human
ucuucuccccuuccau

SEQ ID NO: 3727271 - RNA, 15 nt, Human
ucuucucccuggaau

SEQ ID NO: 3727272 - RNA, 12 nt, Human
ucuucucucaga

SEQ ID NO: 3727273 - RNA, 14 nt, Human
ucuucucuccagcu

SEQ ID NO: 3727274 - RNA, 18 nt, Human
ucuucucuccagcugacu

SEQ ID NO: 3727275 - RNA, 24 nt, Human
ucuucugaacucaaacugaggaau

SEQ ID NO: 3727276 - RNA, 14 nt, Human
ucuucugacaaacu

SEQ ID NO: 3727277 - RNA, 17 nt, Human
ucuucugacgugccuuu

SEQ ID NO: 3727278 - RNA, 21 nt, Human
ucuucugacuuaagugugcaa

SEQ ID NO: 3727279 - RNA, 21 nt, Human
ucuucugagcuauuucaucua

SEQ ID NO: 3727280 - RNA, 13 nt, Human
ucuucugccaaga

SEQ ID NO: 3727281 - RNA, 12 nt, Human
ucuucugccugu

SEQ ID NO: 3727282 - RNA, 15 nt, Human
ucuucugccuguuau

SEQ ID NO: 3727283 - RNA, 17 nt, Human
ucuucugcgccucaggc

SEQ ID NO: 3727284 - RNA, 17 nt, Human
ucuucugcuccacccuu

SEQ ID NO: 3727285 - RNA, 13 nt, Human
ucuucugcuuugu

SEQ ID NO: 3727286 - RNA, 17 nt, Human
ucuucuggagucuccag

SEQ ID NO: 3727287 - RNA, 19 nt, Human
ucuucuggagucuccagug

SEQ ID NO: 3727288 - RNA, 12 nt, Human
ucuucuggcuca

SEQ ID NO: 3727289 - RNA, 18 nt, Human
ucuucuggcucaaaaaga

SEQ ID NO: 3727290 - RNA, 21 nt, Human
ucuucuggcucaaaaagagaa

SEQ ID NO: 3727291 - RNA, 20 nt, Human
ucuucuguauauaaauggga

SEQ ID NO: 3727292 - RNA, 24 nt, Human
ucuucuguauauaaaugggaacau

SEQ ID NO: 3727293 - RNA, 14 nt, Human
ucuucuguauuuuu

SEQ ID NO: 3727294 - RNA, 12 nt, Human
ucuucugucccu

SEQ ID NO: 3727295 - RNA, 13 nt, Human
ucuucuguggacc

SEQ ID NO: 3727296 - RNA, 20 nt, Human
ucuucuguggguuucuaaag

SEQ ID NO: 3727297 - RNA, 12 nt, Human
ucuucuguguuu

SEQ ID NO: 3727298 - RNA, 13 nt, Human
ucuucuuaacuua

SEQ ID NO: 3727299 - RNA, 13 nt, Human
ucuucuucaccau

SEQ ID NO: 3727300 - RNA, 14 nt, Human
ucuucuucaccauu

SEQ ID NO: 3727301 - RNA, 14 nt, Human
ucuucuuccaggua

SEQ ID NO: 3727302 - RNA, 19 nt, Human
ucuucuuccugaagcugag

SEQ ID NO: 3727303 - RNA, 14 nt, Human
ucuucuucuucaga

SEQ ID NO: 3727304 - RNA, 13 nt, Human
ucuucuugaaauu

SEQ ID NO: 3727305 - RNA, 19 nt, Human
ucuucuuggccaugggagg

SEQ ID NO: 3727306 - RNA, 19 nt, Human
ucuucuuggggcccagugc

SEQ ID NO: 3727307 - RNA, 20 nt, Human
ucuucuuggggcccagugca

SEQ ID NO: 3727308 - RNA, 16 nt, Human
ucuucuuggucucagu

SEQ ID NO: 3727309 - RNA, 17 nt, Human
ucuucuuguucugagau

SEQ ID NO: 3727310 - RNA, 23 nt, Human
ucuucuuuaggauugugaugguu

SEQ ID NO: 3727311 - RNA, 21 nt, Human
ucuucuuuuugaaaucagcau

SEQ ID NO: 3727312 - RNA, 15 nt, Human
ucuucuuuuugcugu

SEQ ID NO: 3727313 - RNA, 18 nt, Human
ucuucuuuuugcuguugu

SEQ ID NO: 3727314 - RNA, 19 nt, Human
ucuucuuuuugcuucaaaa

SEQ ID NO: 3727315 - RNA, 12 nt, Human
ucuugaaaugaa

SEQ ID NO: 3727316 - RNA, 13 nt, Human
ucuugaaaugaaa

SEQ ID NO: 3727317 - RNA, 20 nt, Human
ucuugaacacucaugcugaa

SEQ ID NO: 3727318 - RNA, 16 nt, Human
ucuugaaccagaacca

SEQ ID NO: 3727319 - RNA, 12 nt, Human
ucuugaacuccu

SEQ ID NO: 3727320 - RNA, 17 nt, Human
ucuugaacuccugaccu

SEQ ID NO: 3727321 - RNA, 18 nt, Human
ucuugaacuccuggccuc

SEQ ID NO: 3727322 - RNA, 19 nt, Human
ucuugaaggaaaaugauac

SEQ ID NO: 3727323 - RNA, 23 nt, Human
ucuugaaguccuggcuucaggca

SEQ ID NO: 3727324 - RNA, 20 nt, Human
ucuugaauacucugcccucu

SEQ ID NO: 3727325 - RNA, 14 nt, Human
ucuugaauauaaaa

SEQ ID NO: 3727326 - RNA, 22 nt, Human
ucuugaaucuagggagggggaa

SEQ ID NO: 3727327 - RNA, 16 nt, Human
ucuugaaugucuuuug

SEQ ID NO: 3727328 - RNA, 11 nt, Human
ucuugaaugug

SEQ ID NO: 3727329 - RNA, 18 nt, Human
ucuugaauguggucucag

SEQ ID NO: 3727330 - RNA, 21 nt, Human
ucuugaauuguaaggaaugau

SEQ ID NO: 3727331 - RNA, 23 nt, Human
ucuugaauuuaauaaucuguagg

SEQ ID NO: 3727332 - RNA, 13 nt, Human
ucuugacaaaacc

SEQ ID NO: 3727333 - RNA, 22 nt, Human
ucuugacaccagcuguucuguc

SEQ ID NO: 3727334 - RNA, 19 nt, Human
ucuugacauucaaggcauu

SEQ ID NO: 3727335 - RNA, 21 nt, Human
ucuugaccaagcaggaagcuc

SEQ ID NO: 3727336 - RNA, 20 nt, Human
ucuugacgagugugaagcuu

SEQ ID NO: 3727337 - RNA, 16 nt, Human
ucuugacuacagucag

SEQ ID NO: 3727338 - RNA, 13 nt, Human
ucuugacuauugg

SEQ ID NO: 3727339 - RNA, 14 nt, Human
ucuugagcaguggc

SEQ ID NO: 3727340 - RNA, 19 nt, Human
ucuugagccuugaacuuug

SEQ ID NO: 3727341 - RNA, 13 nt, Human
ucuugagcucuau

SEQ ID NO: 3727342 - RNA, 14 nt, Human
ucuugagcucuauu

SEQ ID NO: 3727343 - RNA, 23 nt, Human
ucuugagcuggccucucuagcac

SEQ ID NO: 3727344 - RNA, 15 nt, Human
ucuugaggccaggag

SEQ ID NO: 3727345 - RNA, 13 nt, Human
ucuugauacauuc

SEQ ID NO: 3727346 - RNA, 14 nt, Human
ucuugauacauuca

SEQ ID NO: 3727347 - RNA, 18 nt, Human
ucuugauacauucaaauu

SEQ ID NO: 3727348 - RNA, 19 nt, Human
ucuugauacauucaaauuu

SEQ ID NO: 3727349 - RNA, 20 nt, Human
ucuugauaccccccucuguc

SEQ ID NO: 3727350 - RNA, 22 nt, Human
ucuugauaccccccucugucuu

SEQ ID NO: 3727351 - RNA, 20 nt, Human
ucuugaucaacaucuuuucu

SEQ ID NO: 3727352 - RNA, 23 nt, Human
ucuugaucaacaucuuuucuugc

SEQ ID NO: 3727353 - RNA, 17 nt, Human
ucuugaucaguuaagaa

SEQ ID NO: 3727354 - RNA, 23 nt, Human
ucuugaucaguuaagaaauuuca

SEQ ID NO: 3727355 - RNA, 17 nt, Human
ucuugaucugcucagcc

SEQ ID NO: 3727356 - RNA, 19 nt, Human
ucuugaucugcucagcccu

SEQ ID NO: 3727357 - RNA, 20 nt, Human
ucuugaucugcucagcccug

SEQ ID NO: 3727358 - RNA, 21 nt, Human
ucuugaucugcucagcccugg

SEQ ID NO: 3727359 - RNA, 16 nt, Human
ucuugaugacuggaau

SEQ ID NO: 3727360 - RNA, 13 nt, Human
ucuugaugcaugc

SEQ ID NO: 3727361 - RNA, 14 nt, Human
ucuugauguaaaau

SEQ ID NO: 3727362 - RNA, 15 nt, Human
ucuugauguaaaauc

SEQ ID NO: 3727363 - RNA, 19 nt, Human
ucuugauguaaaaucuugu

SEQ ID NO: 3727364 - RNA, 22 nt, Human
ucuugauguaaaaucuugucau

SEQ ID NO: 3727365 - RNA, 21 nt, Human
ucuugauguaaggaugggcau

SEQ ID NO: 3727366 - RNA, 16 nt, Human
ucuugauguugcuuag

SEQ ID NO: 3727367 - RNA, 13 nt, Human
ucuugauucauaa

SEQ ID NO: 3727368 - RNA, 13 nt, Human
ucuugauuugagu

SEQ ID NO: 3727369 - RNA, 19 nt, Human
ucuugauuuguuuuagaau

SEQ ID NO: 3727370 - RNA, 13 nt, Human
ucuugcaauggca

SEQ ID NO: 3727371 - RNA, 22 nt, Human
gggccucgguguggagaagcgg

SEQ ID NO: 3727372 - RNA, 19 nt, Human
gggccucuuaugggcuggg

SEQ ID NO: 3727373 - RNA, 21 nt, Human
gggccucuuggaaaaagugau

SEQ ID NO: 3727374 - RNA, 23 nt, Human
gggccugaccucccccuccuucc

SEQ ID NO: 3727375 - RNA, 14 nt, Human
gggccugacugcuc

SEQ ID NO: 3727376 - RNA, 15 nt, Human
gggccugagccuggc

SEQ ID NO: 3727377 - RNA, 18 nt, Human
gggccugagccuggccag

SEQ ID NO: 3727378 - RNA, 18 nt, Human
gggccugaggcuccuuag

SEQ ID NO: 3727379 - RNA, 16 nt, Human
gggccugcccagacaa

SEQ ID NO: 3727380 - RNA, 14 nt, Human
gggccugcccagug

SEQ ID NO: 3727381 - RNA, 13 nt, Human
gggccugcuccag

SEQ ID NO: 3727382 - RNA, 14 nt, Human
gggccugcuccaga

SEQ ID NO: 3727383 - RNA, 17 nt, Human
gggccugcugcugagaa

SEQ ID NO: 3727384 - RNA, 20 nt, Human
gggccugcugcugagaaccu

SEQ ID NO: 3727385 - RNA, 23 nt, Human
gggccugcugcugagaaccuggc

SEQ ID NO: 3727386 - RNA, 14 nt, Human
gggccugcuggagg

SEQ ID NO: 3727387 - RNA, 15 nt, Human
gggccugcuggaggc

SEQ ID NO: 3727388 - RNA, 21 nt, Human
gggccugcuggaggccucagg

SEQ ID NO: 3727389 - RNA, 13 nt, Human
gggccuggaccug

SEQ ID NO: 3727390 - RNA, 18 nt, Human
gggccuggagcaggccuu

SEQ ID NO: 3727391 - RNA, 20 nt, Human
gggccuggauucauuuccug

SEQ ID NO: 3727392 - RNA, 10 nt, Human
gggccuggca

SEQ ID NO: 3727393 - RNA, 13 nt, Human
gggccuggcaggg

SEQ ID NO: 3727394 - RNA, 22 nt, Human
gggccuggcauucuuguacagu

SEQ ID NO: 3727395 - RNA, 14 nt, Human
gggccuggcccaug

SEQ ID NO: 3727396 - RNA, 14 nt, Human
gggccuggccugag

SEQ ID NO: 3727397 - RNA, 19 nt, Human
gggccuggccugagcuggg

SEQ ID NO: 3727398 - RNA, 20 nt, Human
gggccuggcgggaugggcca

SEQ ID NO: 3727399 - RNA, 22 nt, Human
gggccuggcgggaugggccacc

SEQ ID NO: 3727400 - RNA, 14 nt, Human
gggccuggcucagg

SEQ ID NO: 3727401 - RNA, 17 nt, Human
gggccuggcucaggugg

SEQ ID NO: 3727402 - RNA, 15 nt, Human
gggccuggcucccuc

SEQ ID NO: 3727403 - RNA, 17 nt, Human
gggccuggcucccucac

SEQ ID NO: 3727404 - RNA, 13 nt, Human
gggccuggcuggc

SEQ ID NO: 3727405 - RNA, 16 nt, Human
gggccuggcuggcuga

SEQ ID NO: 3727406 - RNA, 17 nt, Human
gggccuggcuggcugag

SEQ ID NO: 3727407 - RNA, 23 nt, Human
gggccuggcuggcugagggcagu

SEQ ID NO: 3727408 - RNA, 13 nt, Human
gggccugggcagg

SEQ ID NO: 3727409 - RNA, 16 nt, Human
gggccugggcaggagg

SEQ ID NO: 3727410 - RNA, 15 nt, Human
gggccugggccuggc

SEQ ID NO: 3727411 - RNA, 18 nt, Human
gggccugggcuccuggac

SEQ ID NO: 3727412 - RNA, 16 nt, Human
gggccuggucccuggg

SEQ ID NO: 3727413 - RNA, 18 nt, Human
gggccuggucguuuucaa

SEQ ID NO: 3727414 - RNA, 21 nt, Human
gggccuggucucacccuggag

SEQ ID NO: 3727415 - RNA, 22 nt, Human
gggccugguuaaauaaggcagg

SEQ ID NO: 3727416 - RNA, 15 nt, Human
gggccugguugaaga

SEQ ID NO: 3727417 - RNA, 20 nt, Human
gggccuguacaaaagggaca

SEQ ID NO: 3727418 - RNA, 21 nt, Human
gggccuguacagucugucuuc

SEQ ID NO: 3727419 - RNA, 18 nt, Human
gggccuguacugccugcu

SEQ ID NO: 3727420 - RNA, 14 nt, Human
gggccuguugcccu

SEQ ID NO: 3727421 - RNA, 21 nt, Human
gggccuuagggcacugggcug

SEQ ID NO: 3727422 - RNA, 17 nt, Human
gggccuuagugggccag

SEQ ID NO: 3727423 - RNA, 18 nt, Human
gggccuuagugggccagg

SEQ ID NO: 3727424 - RNA, 22 nt, Human
gggccuuagugggccagggcug

SEQ ID NO: 3727425 - RNA, 22 nt, Human
gggccuugcccagagaugccuc

SEQ ID NO: 3727426 - RNA, 21 nt, Human
gggccuugcgguauccgcccc

SEQ ID NO: 3727427 - RNA, 23 nt, Human
gggccuugcuaccucaaggggga

SEQ ID NO: 3727428 - RNA, 20 nt, Human
gggccuuuguucugggggga

SEQ ID NO: 3727429 - RNA, 19 nt, Human
gggcgaagcccaggccccu

SEQ ID NO: 3727430 - RNA, 18 nt, Human
gggcgagucacugccucu

SEQ ID NO: 3727431 - RNA, 13 nt, Human
gggcgcccaccuc

SEQ ID NO: 3727432 - RNA, 20 nt, Human
gggcgccgugcugggcagcc

SEQ ID NO: 3727433 - RNA, 24 nt, Human
gggcgccgugcugggcagcccgcu

SEQ ID NO: 3727434 - RNA, 18 nt, Human
gggcgcgaucccacacag

SEQ ID NO: 3727435 - RNA, 18 nt, Human
gggcgcggccagccccgg

SEQ ID NO: 3727436 - RNA, 15 nt, Human
gggcgcuggcccagc

SEQ ID NO: 3727437 - RNA, 16 nt, Human
gggcgcuggcccagcc

SEQ ID NO: 3727438 - RNA, 17 nt, Human
gggcgcuggcccagccg

SEQ ID NO: 3727439 - RNA, 18 nt, Human
gggcgcuggcccagccgg

SEQ ID NO: 3727440 - RNA, 19 nt, Human
gggcgcuggcccagccggc

SEQ ID NO: 3727441 - RNA, 17 nt, Human
gggcgucuguucccccu

SEQ ID NO: 3727442 - RNA, 16 nt, Human
gggcgugagaccugcc

SEQ ID NO: 3727443 - RNA, 15 nt, Human
gggcguggagggagg

SEQ ID NO: 3727444 - RNA, 21 nt, Human
gggcguggagggaggccccag

SEQ ID NO: 3727445 - RNA, 19 nt, Human
gggcguggucacugcuguc

SEQ ID NO: 3727446 - RNA, 13 nt, Human
gggcuaauuuaac

SEQ ID NO: 3727447 - RNA, 19 nt, Human
gggcuacccugagcugagg

SEQ ID NO: 3727448 - RNA, 21 nt, Human
gggcuacccugagcugaggca

SEQ ID NO: 3727449 - RNA, 18 nt, Human
gggcuaguugggcuuccu

SEQ ID NO: 3727450 - RNA, 13 nt, Human
gggcuauggacac

SEQ ID NO: 3727451 - RNA, 22 nt, Human
gggcucaagcaauccucucacc

SEQ ID NO: 3727452 - RNA, 18 nt, Human
gggcucagcaaaagaugc

SEQ ID NO: 3727453 - RNA, 20 nt, Human
gggcucagcaaggccaccuc

SEQ ID NO: 3727454 - RNA, 16 nt, Human
gggcucagccuggugg

SEQ ID NO: 3727455 - RNA, 20 nt, Human
gggcucagccuggugggccu

SEQ ID NO: 3727456 - RNA, 19 nt, Human
gggcucagcggggacagcu

SEQ ID NO: 3727457 - RNA, 21 nt, Human
gggcucagcggggacagcucc

SEQ ID NO: 3727458 - RNA, 22 nt, Human
gggcucagcucuggcucacaga

SEQ ID NO: 3727459 - RNA, 13 nt, Human
gggcucaggaaaa

SEQ ID NO: 3727460 - RNA, 20 nt, Human
gggcucagggaccacagcaa

SEQ ID NO: 3727461 - RNA, 11 nt, Human
gggcucccagg

SEQ ID NO: 3727462 - RNA, 13 nt, Human
gggcucccagggg

SEQ ID NO: 3727463 - RNA, 13 nt, Human
gggcuccccucuu

SEQ ID NO: 3727464 - RNA, 20 nt, Human
gggcuccccuuucgcccaca

SEQ ID NO: 3727465 - RNA, 13 nt, Human
gggcucccgccuc

SEQ ID NO: 3727466 - RNA, 18 nt, Human
gggcucccgccuccaacc

SEQ ID NO: 3727467 - RNA, 19 nt, Human
gggcucccgccuccaaccc

SEQ ID NO: 3727468 - RNA, 14 nt, Human
gggcucccuccgcc

SEQ ID NO: 3727469 - RNA, 23 nt, Human
gggcucccuccgcccccagguag

SEQ ID NO: 3727470 - RNA, 14 nt, Human
gggcucccugacug

SEQ ID NO: 3727471 - RNA, 13 nt, Human
gggcucccuucau

SEQ ID NO: 3727472 - RNA, 13 nt, Human
gggcucccuuccc

SEQ ID NO: 3727473 - RNA, 23 nt, Human
gggcucccuucccaccucucuca

SEQ ID NO: 3727474 - RNA, 12 nt, Human
gggcuccuccca

SEQ ID NO: 3727475 - RNA, 18 nt, Human
gggcuccugcacuuacuu

SEQ ID NO: 3727476 - RNA, 18 nt, Human
gggcuccugccuucuguc

SEQ ID NO: 3727477 - RNA, 19 nt, Human
gggcuccuugugggccugg

SEQ ID NO: 3727478 - RNA, 12 nt, Human
gggcuccuuucc

SEQ ID NO: 3727479 - RNA, 18 nt, Human
gggcuccuuucuccagcc

SEQ ID NO: 3727480 - RNA, 21 nt, Human
gggcuccuuucuccagccagc

SEQ ID NO: 3727481 - RNA, 18 nt, Human
gggcucgaggggugggcu

SEQ ID NO: 3727482 - RNA, 15 nt, Human
gggcucggaggcugc

SEQ ID NO: 3727483 - RNA, 18 nt, Human
gggcucuaacgccugagc

SEQ ID NO: 3727484 - RNA, 22 nt, Human
gggcucuaacgccugagcccag

SEQ ID NO: 3727485 - RNA, 23 nt, Human
gggcucuaacgccugagcccagg

SEQ ID NO: 3727486 - RNA, 13 nt, Human
gggcucucagcuc

SEQ ID NO: 3727487 - RNA, 13 nt, Human
gggcucuccuggc

SEQ ID NO: 3727488 - RNA, 22 nt, Human
gggcucuccuggcuucccaucc

SEQ ID NO: 3727489 - RNA, 12 nt, Human
gggcucugaggc

SEQ ID NO: 3727490 - RNA, 15 nt, Human
gggcucugaggcgcc

SEQ ID NO: 3727491 - RNA, 20 nt, Human
gggcucugcaauuccccucu

SEQ ID NO: 3727492 - RNA, 23 nt, Human
gggcucugcaauuccccucugcu

SEQ ID NO: 3727493 - RNA, 11 nt, Human
gggcucugccc

SEQ ID NO: 3727494 - RNA, 12 nt, Human
gggcucugcccc

SEQ ID NO: 3727495 - RNA, 14 nt, Human
gggcucugccccag

SEQ ID NO: 3727496 - RNA, 23 nt, Human
gggcucugccccagaggccucuc

SEQ ID NO: 3727497 - RNA, 20 nt, Human
gggcucugccccagcucugg

SEQ ID NO: 3727498 - RNA, 16 nt, Human
gggcucugccucccau

SEQ ID NO: 3727499 - RNA, 16 nt, Human
gggcucugugcugaca

SEQ ID NO: 3727500 - RNA, 16 nt, Human
gggcucugugggcugc

SEQ ID NO: 3727501 - RNA, 19 nt, Human
gggcucugugggcugcacu

SEQ ID NO: 3727502 - RNA, 18 nt, Human
gggcugaacggggagaaa

SEQ ID NO: 3727503 - RNA, 16 nt, Human
gggcugaccuuccucg

SEQ ID NO: 3727504 - RNA, 21 nt, Human
gggcugaccuuccucgcagag

SEQ ID NO: 3727505 - RNA, 13 nt, Human
gggcugagcccug

SEQ ID NO: 3727506 - RNA, 15 nt, Human
gggcugagcccuggc

SEQ ID NO: 3727507 - RNA, 23 nt, Human
gggcugagccuggucccacgagg

SEQ ID NO: 3727508 - RNA, 16 nt, Human
gggcugagcugccugu

SEQ ID NO: 3727509 - RNA, 23 nt, Human
gggcugagcuggggaccugguac

SEQ ID NO: 3727510 - RNA, 12 nt, Human
gggcugagggag

SEQ ID NO: 3727511 - RNA, 13 nt, Human
gggcugagggagc

SEQ ID NO: 3727512 - RNA, 13 nt, Human
gggcugagggccu

SEQ ID NO: 3727513 - RNA, 16 nt, Human
gggcugagggccugcu

SEQ ID NO: 3727514 - RNA, 11 nt, Human
gggcugagggg

SEQ ID NO: 3727515 - RNA, 19 nt, Human
gggcugcaguucgacucug

SEQ ID NO: 3727516 - RNA, 16 nt, Human
gggcugcaugauguuu

SEQ ID NO: 3727517 - RNA, 18 nt, Human
gggcugccaugugaagag

SEQ ID NO: 3727518 - RNA, 14 nt, Human
gggcugcccgcucc

SEQ ID NO: 3727519 - RNA, 20 nt, Human
gggcugccggggcagccccc

SEQ ID NO: 3727520 - RNA, 22 nt, Human
gggcugcgacgcuugcucuguu

SEQ ID NO: 3727521 - RNA, 18 nt, Human
ugacaaagauggcucaga

SEQ ID NO: 3727522 - RNA, 20 nt, Human
ugacaaagguaaaucagacu

SEQ ID NO: 3727523 - RNA, 15 nt, Human
ugacaaaucaaguuu

SEQ ID NO: 3727524 - RNA, 16 nt, Human
ugacaaaucuguguau

SEQ ID NO: 3727525 - RNA, 23 nt, Human
ugacaaauguguaucggaugcuu

SEQ ID NO: 3727526 - RNA, 15 nt, Human
ugacaaauguuucua

SEQ ID NO: 3727527 - RNA, 21 nt, Human
ugacaaauguuucuaagguaa

SEQ ID NO: 3727528 - RNA, 17 nt, Human
ugacaaauuuuaauuau

SEQ ID NO: 3727529 - RNA, 13 nt, Human
ugacaacacucau

SEQ ID NO: 3727530 - RNA, 14 nt, Human
ugacaacagaagcu

SEQ ID NO: 3727531 - RNA, 12 nt, Human
ugacaacaucug

SEQ ID NO: 3727532 - RNA, 19 nt, Human
ugacaaccaccgcucccca

SEQ ID NO: 3727533 - RNA, 23 nt, Human
ugacaaccaccgcuccccagccc

SEQ ID NO: 3727534 - RNA, 16 nt, Human
ugacaaccacuggucu

SEQ ID NO: 3727535 - RNA, 19 nt, Human
ugacaaccaugagaccacu

SEQ ID NO: 3727536 - RNA, 16 nt, Human
ugacaaccauuaaagu

SEQ ID NO: 3727537 - RNA, 19 nt, Human
ugacaacuggaauaguuuu

SEQ ID NO: 3727538 - RNA, 14 nt, Human
ugacaacuggcagg

SEQ ID NO: 3727539 - RNA, 13 nt, Human
ugacaacugucua

SEQ ID NO: 3727540 - RNA, 21 nt, Human
ugacaacugucuaacuuuaga

SEQ ID NO: 3727541 - RNA, 12 nt, Human
ugacaacuguga

SEQ ID NO: 3727542 - RNA, 15 nt, Human
ugacaacugugacug

SEQ ID NO: 3727543 - RNA, 19 nt, Human
ugacaacuuugccagcuuu

SEQ ID NO: 3727544 - RNA, 22 nt, Human
ugacaagaaaggcugcuguacu

SEQ ID NO: 3727545 - RNA, 15 nt, Human
ugacaagcacugcua

SEQ ID NO: 3727546 - RNA, 21 nt, Human
ugacaagccccaggcaggcug

SEQ ID NO: 3727547 - RNA, 20 nt, Human
ugacaagcucacagaccuuu

SEQ ID NO: 3727548 - RNA, 22 nt, Human
ugacaagcuccuggucuugaga

SEQ ID NO: 3727549 - RNA, 21 nt, Human
ugacaagcuggcuuacacugg

SEQ ID NO: 3727550 - RNA, 23 nt, Human
ugacaagcuggcuuacacuggca

SEQ ID NO: 3727551 - RNA, 23 nt, Human
ugacaaggauugcuacuguccua

SEQ ID NO: 3727552 - RNA, 17 nt, Human
ugacaaggccccagaga

SEQ ID NO: 3727553 - RNA, 13 nt, Human
ugacaauaaaaca

SEQ ID NO: 3727554 - RNA, 15 nt, Human
ugacaauaaaauauu

SEQ ID NO: 3727555 - RNA, 20 nt, Human
ugacaauaaaauauuauuga

SEQ ID NO: 3727556 - RNA, 18 nt, Human
ugacaauaauauuguugu

SEQ ID NO: 3727557 - RNA, 19 nt, Human
ugacaauaauauuguugua

SEQ ID NO: 3727558 - RNA, 20 nt, Human
ugacaauaauauuguuguau

SEQ ID NO: 3727559 - RNA, 16 nt, Human
ugacaauauuccagau

SEQ ID NO: 3727560 - RNA, 15 nt, Human
ugacaaucaacucua

SEQ ID NO: 3727561 - RNA, 23 nt, Human
ugacaauuccuagauaaaaagau

SEQ ID NO: 3727562 - RNA, 16 nt, Human
ugacaauucuguuuuu

SEQ ID NO: 3727563 - RNA, 16 nt, Human
ugacaauuuuguacaa

SEQ ID NO: 3727564 - RNA, 18 nt, Human
ugacacaaaccugccugg

SEQ ID NO: 3727565 - RNA, 19 nt, Human
ugacacaaaccugccuggg

SEQ ID NO: 3727566 - RNA, 14 nt, Human
ugacacaaaggaag

SEQ ID NO: 3727567 - RNA, 20 nt, Human
ugacacaagaggaauaagaa

SEQ ID NO: 3727568 - RNA, 22 nt, Human
ugacacaccaggcgcuaauuca

SEQ ID NO: 3727569 - RNA, 23 nt, Human
ugacacaccaggcgcuaauucaa

SEQ ID NO: 3727570 - RNA, 19 nt, Human
ugacacacuacaccacaca

SEQ ID NO: 3727571 - RNA, 20 nt, Human
ugacacacuacaccacacac

SEQ ID NO: 3727572 - RNA, 22 nt, Human
ugacacacuacaccacacacaa

SEQ ID NO: 3727573 - RNA, 19 nt, Human
ugacacagaaaauguugag

SEQ ID NO: 3727574 - RNA, 11 nt, Human
ugacacagacu

SEQ ID NO: 3727575 - RNA, 18 nt, Human
ugacacaggucuuuccua

SEQ ID NO: 3727576 - RNA, 17 nt, Human
ugacacauaguuuuuca

SEQ ID NO: 3727577 - RNA, 16 nt, Human
ugacaccaaagccacc

SEQ ID NO: 3727578 - RNA, 13 nt, Human
ugacaccagccuu

SEQ ID NO: 3727579 - RNA, 22 nt, Human
ugacacccgugagcgccugugc

SEQ ID NO: 3727580 - RNA, 15 nt, Human
ugacacccuucuccc

SEQ ID NO: 3727581 - RNA, 21 nt, Human
ugacaccgggguggugggaac

SEQ ID NO: 3727582 - RNA, 15 nt, Human
ugacaccuaacucuu

SEQ ID NO: 3727583 - RNA, 19 nt, Human
ugacaccuuugcaggcaug

SEQ ID NO: 3727584 - RNA, 20 nt, Human
ugacacgucucgccaagcag

SEQ ID NO: 3727585 - RNA, 22 nt, Human
ugacacuagcccaaugaaauga

SEQ ID NO: 3727586 - RNA, 18 nt, Human
ugacacucccacccaguc

SEQ ID NO: 3727587 - RNA, 19 nt, Human
ugacacucuccuugcaguu

SEQ ID NO: 3727588 - RNA, 20 nt, Human
ugacacucuccuugcaguuc

SEQ ID NO: 3727589 - RNA, 10 nt, Human
ugacacugaa

SEQ ID NO: 3727590 - RNA, 18 nt, Human
ugacacugaaaguuuugu

SEQ ID NO: 3727591 - RNA, 22 nt, Human
ugacacugaaaugccuuacuuu

SEQ ID NO: 3727592 - RNA, 17 nt, Human
ugacacugcaauuggca

SEQ ID NO: 3727593 - RNA, 16 nt, Human
ugacacugcucuaaca

SEQ ID NO: 3727594 - RNA, 21 nt, Human
ugacacugguauuccugccuc

SEQ ID NO: 3727595 - RNA, 15 nt, Human
ugacacuuaaaaaug

SEQ ID NO: 3727596 - RNA, 16 nt, Human
ugacacuuaaaaaugg

SEQ ID NO: 3727597 - RNA, 17 nt, Human
ugacacuucagagagcu

SEQ ID NO: 3727598 - RNA, 18 nt, Human
ugacacuucagagagcug

SEQ ID NO: 3727599 - RNA, 14 nt, Human
ugacacuuccaguc

SEQ ID NO: 3727600 - RNA, 19 nt, Human
ugacagaaaauauguauua

SEQ ID NO: 3727601 - RNA, 13 nt, Human
ugacagaaagcag

SEQ ID NO: 3727602 - RNA, 15 nt, Human
ugacagaacacuguc

SEQ ID NO: 3727603 - RNA, 16 nt, Human
ugacagaacacugucu

SEQ ID NO: 3727604 - RNA, 15 nt, Human
ugacagaaggugcca

SEQ ID NO: 3727605 - RNA, 16 nt, Human
ugacagaauauguuuc

SEQ ID NO: 3727606 - RNA, 18 nt, Human
ugacagacacaggcccgg

SEQ ID NO: 3727607 - RNA, 20 nt, Human
ugacagacacaggcccggcu

SEQ ID NO: 3727608 - RNA, 14 nt, Human
ugacagacaggcuc

SEQ ID NO: 3727609 - RNA, 21 nt, Human
ugacagagagagauacucugg

SEQ ID NO: 3727610 - RNA, 18 nt, Human
ugacagagcaagacucug

SEQ ID NO: 3727611 - RNA, 21 nt, Human
ugacagagcaagacucugucu

SEQ ID NO: 3727612 - RNA, 20 nt, Human
ugacagagccugccccagcg

SEQ ID NO: 3727613 - RNA, 13 nt, Human
ugacagaggcagc

SEQ ID NO: 3727614 - RNA, 17 nt, Human
ugacagagugagacucu

SEQ ID NO: 3727615 - RNA, 19 nt, Human
ugacagagugagacucugu

SEQ ID NO: 3727616 - RNA, 15 nt, Human
ugacagaguucacua

SEQ ID NO: 3727617 - RNA, 17 nt, Human
ugacagaucaagcugug

SEQ ID NO: 3727618 - RNA, 19 nt, Human
ugacagaucaagcugugag

SEQ ID NO: 3727619 - RNA, 22 nt, Human
ugacagaugucagccgagccgg

SEQ ID NO: 3727620 - RNA, 19 nt, Human
ugacagauguugaaugccc

SEQ ID NO: 3727621 - RNA, 14 nt, Human
ugacagcagcaucu

SEQ ID NO: 3727622 - RNA, 14 nt, Human
ugacagcagguggg

SEQ ID NO: 3727623 - RNA, 20 nt, Human
ugacagcagucgguuggagc

SEQ ID NO: 3727624 - RNA, 18 nt, Human
ugacagcaugugcccucc

SEQ ID NO: 3727625 - RNA, 23 nt, Human
ugacagcaugugcccuccugagg

SEQ ID NO: 3727626 - RNA, 11 nt, Human
ugacagccccu

SEQ ID NO: 3727627 - RNA, 19 nt, Human
ugacagccccucccuccuc

SEQ ID NO: 3727628 - RNA, 19 nt, Human
ugacagccucccaccccca

SEQ ID NO: 3727629 - RNA, 22 nt, Human
ugacagccucccacccccaucu

SEQ ID NO: 3727630 - RNA, 14 nt, Human
ugacagccugcagc

SEQ ID NO: 3727631 - RNA, 16 nt, Human
ugacagcgcacagcug

SEQ ID NO: 3727632 - RNA, 19 nt, Human
ugacagcgcacagcugcuc

SEQ ID NO: 3727633 - RNA, 20 nt, Human
ugacagcuaggaugugcauu

SEQ ID NO: 3727634 - RNA, 15 nt, Human
ugacagcugcuccua

SEQ ID NO: 3727635 - RNA, 18 nt, Human
ugacagcugcuccuagag

SEQ ID NO: 3727636 - RNA, 21 nt, Human
ugacagcugcuccuagaggga

SEQ ID NO: 3727637 - RNA, 12 nt, Human
ugacagcugucc

SEQ ID NO: 3727638 - RNA, 17 nt, Human
ugacagcugucccuguc

SEQ ID NO: 3727639 - RNA, 21 nt, Human
ugacagcugucccugucacca

SEQ ID NO: 3727640 - RNA, 13 nt, Human
ugacagcuuugcu

SEQ ID NO: 3727641 - RNA, 21 nt, Human
ugacagcuuugcugcugaagg

SEQ ID NO: 3727642 - RNA, 14 nt, Human
ugacaggacgcuga

SEQ ID NO: 3727643 - RNA, 16 nt, Human
ugacaggacgcugacc

SEQ ID NO: 3727644 - RNA, 20 nt, Human
ugacaggcaaugcuggcugu

SEQ ID NO: 3727645 - RNA, 15 nt, Human
ugacaggcagcagag

SEQ ID NO: 3727646 - RNA, 20 nt, Human
ugacaggcagccuggacaua

SEQ ID NO: 3727647 - RNA, 18 nt, Human
ugacaggccugaagauau

SEQ ID NO: 3727648 - RNA, 19 nt, Human
ugacagggaagcuacaggu

SEQ ID NO: 3727649 - RNA, 21 nt, Human
ugacagggaagcuacagguua

SEQ ID NO: 3727650 - RNA, 23 nt, Human
ugacagggaagcuacagguuaca

SEQ ID NO: 3727651 - RNA, 20 nt, Human
ugacagggcacaccgggcac

SEQ ID NO: 3727652 - RNA, 22 nt, Human
gcauuuucuggguucugggugg

SEQ ID NO: 3727653 - RNA, 17 nt, Human
gcauuuugcuauuguaa

SEQ ID NO: 3727654 - RNA, 13 nt, Human
gcauuuuggcgcu

SEQ ID NO: 3727655 - RNA, 12 nt, Human
gcauuuuucugc

SEQ ID NO: 3727656 - RNA, 20 nt, Human
gcauuuuugauuuaugcaug

SEQ ID NO: 3727657 - RNA, 16 nt, Human
gcauuuuugcaggagc

SEQ ID NO: 3727658 - RNA, 16 nt, Human
gccaaaaaaaaauaca

SEQ ID NO: 3727659 - RNA, 14 nt, Human
gccaaaaaaagaca

SEQ ID NO: 3727660 - RNA, 13 nt, Human
gccaaaaaggaua

SEQ ID NO: 3727661 - RNA, 16 nt, Human
gccaaaaaggauacau

SEQ ID NO: 3727662 - RNA, 21 nt, Human
gccaaaagcuagacagauccc

SEQ ID NO: 3727663 - RNA, 14 nt, Human
gccaaaaggaaaaa

SEQ ID NO: 3727664 - RNA, 17 nt, Human
gccaaaaggaaaaagcu

SEQ ID NO: 3727665 - RNA, 21 nt, Human
gccaaaauaaugucuuguuaa

SEQ ID NO: 3727666 - RNA, 23 nt, Human
gccaaaauaaugucuuguuaaua

SEQ ID NO: 3727667 - RNA, 14 nt, Human
gccaaaauuaaggu

SEQ ID NO: 3727668 - RNA, 21 nt, Human
gccaaaauuaagguguuugaa

SEQ ID NO: 3727669 - RNA, 23 nt, Human
gccaaaauuaagguguuugaaaa

SEQ ID NO: 3727670 - RNA, 23 nt, Human
gccaaacaaaaugagaucucauu

SEQ ID NO: 3727671 - RNA, 15 nt, Human
gccaaacagccacac

SEQ ID NO: 3727672 - RNA, 22 nt, Human
gccaaacccaugaggcaauguc

SEQ ID NO: 3727673 - RNA, 13 nt, Human
gccaaaccucugu

SEQ ID NO: 3727674 - RNA, 14 nt, Human
gccaaaccucuguu

SEQ ID NO: 3727675 - RNA, 15 nt, Human
gccaaaccucuguuc

SEQ ID NO: 3727676 - RNA, 14 nt, Human
gccaaacucaccug

SEQ ID NO: 3727677 - RNA, 16 nt, Human
gccaaacucaccugcc

SEQ ID NO: 3727678 - RNA, 13 nt, Human
gccaaacugcugg

SEQ ID NO: 3727679 - RNA, 23 nt, Human
gccaaacugcuggacgucuuucu

SEQ ID NO: 3727680 - RNA, 17 nt, Human
gccaaagaaaugaacau

SEQ ID NO: 3727681 - RNA, 21 nt, Human
gccaaagaaccaaagaagaaa

SEQ ID NO: 3727682 - RNA, 16 nt, Human
gccaaagauaaucucu

SEQ ID NO: 3727683 - RNA, 12 nt, Human
gccaaaggaagc

SEQ ID NO: 3727684 - RNA, 13 nt, Human
gccaaaggcuggc

SEQ ID NO: 3727685 - RNA, 20 nt, Human
gccaaaggggaccuggaagg

SEQ ID NO: 3727686 - RNA, 15 nt, Human
gccaaaguacagaau

SEQ ID NO: 3727687 - RNA, 17 nt, Human
gccaaaguacagaauuu

SEQ ID NO: 3727688 - RNA, 12 nt, Human
gccaaaguguua

SEQ ID NO: 3727689 - RNA, 18 nt, Human
gccaaauaaugucucugu

SEQ ID NO: 3727690 - RNA, 17 nt, Human
gccaaauccgcucucuu

SEQ ID NO: 3727691 - RNA, 22 nt, Human
gccaaaugguuuaacuucugcc

SEQ ID NO: 3727692 - RNA, 12 nt, Human
gccaaauuaaaa

SEQ ID NO: 3727693 - RNA, 14 nt, Human
gccaaauuaaaaaa

SEQ ID NO: 3727694 - RNA, 19 nt, Human
gccaaauuauuuguguaau

SEQ ID NO: 3727695 - RNA, 21 nt, Human
gccaaauuuaaaacuguugga

SEQ ID NO: 3727696 - RNA, 22 nt, Human
gccaacaagaaugcauugauau

SEQ ID NO: 3727697 - RNA, 16 nt, Human
gccaacacucaagaag

SEQ ID NO: 3727698 - RNA, 15 nt, Human
gccaacacugugggu

SEQ ID NO: 3727699 - RNA, 21 nt, Human
gccaacacuguggguguguga

SEQ ID NO: 3727700 - RNA, 23 nt, Human
gccaacagguggcaggaccagga

SEQ ID NO: 3727701 - RNA, 22 nt, Human
gccaacaguguuaggccuggca

SEQ ID NO: 3727702 - RNA, 14 nt, Human
gccaacauggugaa

SEQ ID NO: 3727703 - RNA, 13 nt, Human
gccaacccuucuc

SEQ ID NO: 3727704 - RNA, 15 nt, Human
gccaaccuaaaacuc

SEQ ID NO: 3727705 - RNA, 23 nt, Human
gccaaccucgcuccaacuccaac

SEQ ID NO: 3727706 - RNA, 20 nt, Human
gccaaccuguaauaaauaug

SEQ ID NO: 3727707 - RNA, 18 nt, Human
gccaacggccccagcuuc

SEQ ID NO: 3727708 - RNA, 14 nt, Human
gccaacuauggccu

SEQ ID NO: 3727709 - RNA, 15 nt, Human
gccaacuauggccug

SEQ ID NO: 3727710 - RNA, 19 nt, Human
gccaacugcugcuuuuuga

SEQ ID NO: 3727711 - RNA, 20 nt, Human
gccaacuucuucagagcuga

SEQ ID NO: 3727712 - RNA, 20 nt, Human
gccaacuugagggcccagag

SEQ ID NO: 3727713 - RNA, 18 nt, Human
gccaacuuguaaauacac

SEQ ID NO: 3727714 - RNA, 21 nt, Human
gccaacuuuccccacguuaaa

SEQ ID NO: 3727715 - RNA, 22 nt, Human
gccaagaaacgucuucuaaacu

SEQ ID NO: 3727716 - RNA, 18 nt, Human
gccaagaacugaaaacau

SEQ ID NO: 3727717 - RNA, 15 nt, Human
gccaagaagcagugg

SEQ ID NO: 3727718 - RNA, 16 nt, Human
gccaagaagcaguggc

SEQ ID NO: 3727719 - RNA, 19 nt, Human
gccaagaagcaguggccuu

SEQ ID NO: 3727720 - RNA, 20 nt, Human
gccaagaagcaguggccuua

SEQ ID NO: 3727721 - RNA, 18 nt, Human
gccaagaaguuuaaggaa

SEQ ID NO: 3727722 - RNA, 15 nt, Human
gccaagaauauugca

SEQ ID NO: 3727723 - RNA, 23 nt, Human
gccaagaauauugcaaaauacau

SEQ ID NO: 3727724 - RNA, 12 nt, Human
gccaagaaugua

SEQ ID NO: 3727725 - RNA, 14 nt, Human
gccaagaauucuua

SEQ ID NO: 3727726 - RNA, 18 nt, Human
gccaagaauucuuaaaua

SEQ ID NO: 3727727 - RNA, 19 nt, Human
gccaagacaaaucaacaga

SEQ ID NO: 3727728 - RNA, 14 nt, Human
gccaagacugcugu

SEQ ID NO: 3727729 - RNA, 23 nt, Human
gccaagacuuggcaacagaagca

SEQ ID NO: 3727730 - RNA, 21 nt, Human
gccaagagaaaggccugcaca

SEQ ID NO: 3727731 - RNA, 12 nt, Human
gccaagaggcug

SEQ ID NO: 3727732 - RNA, 13 nt, Human
gccaagaggcugc

SEQ ID NO: 3727733 - RNA, 22 nt, Human
gccaagagguuuggcuccugcc

SEQ ID NO: 3727734 - RNA, 21 nt, Human
gccaagaguggccccaccugg

SEQ ID NO: 3727735 - RNA, 23 nt, Human
gccaagauuuuccucuugugauu

SEQ ID NO: 3727736 - RNA, 20 nt, Human
gccaagcacagugccugcau

SEQ ID NO: 3727737 - RNA, 16 nt, Human
gccaagcacaguggug

SEQ ID NO: 3727738 - RNA, 15 nt, Human
gccaagcacugugcu

SEQ ID NO: 3727739 - RNA, 14 nt, Human
gccaagcagggagg

SEQ ID NO: 3727740 - RNA, 21 nt, Human
gccaagccauggguagccugg

SEQ ID NO: 3727741 - RNA, 15 nt, Human
gccaagccccauccu

SEQ ID NO: 3727742 - RNA, 21 nt, Human
gccaagcccuccccaucccau

SEQ ID NO: 3727743 - RNA, 16 nt, Human
gccaagcuccuuggga

SEQ ID NO: 3727744 - RNA, 14 nt, Human
gccaagcugaggug

SEQ ID NO: 3727745 - RNA, 18 nt, Human
gccaagcugaggugccca

SEQ ID NO: 3727746 - RNA, 16 nt, Human
gccaagcuuuaaauua

SEQ ID NO: 3727747 - RNA, 14 nt, Human
gccaaggaaaggca

SEQ ID NO: 3727748 - RNA, 17 nt, Human
gccaaggacugccgacc

SEQ ID NO: 3727749 - RNA, 16 nt, Human
gccaaggagcugcuau

SEQ ID NO: 3727750 - RNA, 21 nt, Human
gccaaggagcugcuauagccu

SEQ ID NO: 3727751 - RNA, 23 nt, Human
gccaaggagcugcuauagccugg

SEQ ID NO: 3727752 - RNA, 14 nt, Human
gccaaggcagaggc

SEQ ID NO: 3727753 - RNA, 11 nt, Human
gccaaggccaa

SEQ ID NO: 3727754 - RNA, 18 nt, Human
gccaaggccgaagcucug

SEQ ID NO: 3727755 - RNA, 19 nt, Human
uacaaaggggaaagaacau

SEQ ID NO: 3727756 - RNA, 18 nt, Human
uacaaagguuuaaaugaa

SEQ ID NO: 3727757 - RNA, 12 nt, Human
uacaaaguauua

SEQ ID NO: 3727758 - RNA, 13 nt, Human
uacaaaguauuaa

SEQ ID NO: 3727759 - RNA, 23 nt, Human
uacaaaguguauuuuauaaaauu

SEQ ID NO: 3727760 - RNA, 18 nt, Human
uacaaaguguguauuaaa

SEQ ID NO: 3727761 - RNA, 17 nt, Human
uacaaaguuaaaauugu

SEQ ID NO: 3727762 - RNA, 18 nt, Human
uacaaaguuaaaauuguu

SEQ ID NO: 3727763 - RNA, 12 nt, Human
uacaaauauaag

SEQ ID NO: 3727764 - RNA, 18 nt, Human
uacaaauauaagaauaaa

SEQ ID NO: 3727765 - RNA, 16 nt, Human
uacaaaucaaguauuu

SEQ ID NO: 3727766 - RNA, 13 nt, Human
uacaaaucaauca

SEQ ID NO: 3727767 - RNA, 20 nt, Human
uacaaaucagaagucaucuu

SEQ ID NO: 3727768 - RNA, 22 nt, Human
uacaaaucagaagucaucuugc

SEQ ID NO: 3727769 - RNA, 18 nt, Human
uacaaaugcaucuuugau

SEQ ID NO: 3727770 - RNA, 20 nt, Human
uacaaaugccuuaaaaugga

SEQ ID NO: 3727771 - RNA, 21 nt, Human
uacaaauggacauaggacuca

SEQ ID NO: 3727772 - RNA, 23 nt, Human
uacaaauguuaaaauguguuguu

SEQ ID NO: 3727773 - RNA, 14 nt, Human
uacaaauuaaaaag

SEQ ID NO: 3727774 - RNA, 16 nt, Human
uacaaauuaaaaagau

SEQ ID NO: 3727775 - RNA, 16 nt, Human
uacaaauuuuucugug

SEQ ID NO: 3727776 - RNA, 22 nt, Human
uacaacaagaguuuauuuccaa

SEQ ID NO: 3727777 - RNA, 18 nt, Human
uacaacaccaaaaaauau

SEQ ID NO: 3727778 - RNA, 13 nt, Human
uacaacagauuug

SEQ ID NO: 3727779 - RNA, 16 nt, Human
uacaacagauuuguga

SEQ ID NO: 3727780 - RNA, 20 nt, Human
uacaacagauuugugaacuc

SEQ ID NO: 3727781 - RNA, 14 nt, Human
uacaacagugcuaa

SEQ ID NO: 3727782 - RNA, 20 nt, Human
uacaaccaagcucucugcau

SEQ ID NO: 3727783 - RNA, 23 nt, Human
uacaacccgguucacucuucuca

SEQ ID NO: 3727784 - RNA, 17 nt, Human
uacaaccucccucuugu

SEQ ID NO: 3727785 - RNA, 15 nt, Human
uacaaccuccgccuc

SEQ ID NO: 3727786 - RNA, 12 nt, Human
uacaaccugcuu

SEQ ID NO: 3727787 - RNA, 12 nt, Human
uacaaccuucau

SEQ ID NO: 3727788 - RNA, 15 nt, Human
uacaacggagucaaa

SEQ ID NO: 3727789 - RNA, 20 nt, Human
uacaacucauuccagauccc

SEQ ID NO: 3727790 - RNA, 23 nt, Human
uacaacugccucgaaacacagaa

SEQ ID NO: 3727791 - RNA, 17 nt, Human
uacaacuuaaguugguc

SEQ ID NO: 3727792 - RNA, 14 nt, Human
uacaacuucaagug

SEQ ID NO: 3727793 - RNA, 14 nt, Human
uacaacuucagcag

SEQ ID NO: 3727794 - RNA, 15 nt, Human
uacaagaagcauuuu

SEQ ID NO: 3727795 - RNA, 22 nt, Human
uacaagaaguuuauucucauuu

SEQ ID NO: 3727796 - RNA, 18 nt, Human
uacaagacaacauuguaa

SEQ ID NO: 3727797 - RNA, 19 nt, Human
uacaagacugccauauuaa

SEQ ID NO: 3727798 - RNA, 23 nt, Human
uacaagagaaaaagcagaggcca

SEQ ID NO: 3727799 - RNA, 13 nt, Human
uacaagauuagaa

SEQ ID NO: 3727800 - RNA, 22 nt, Human
uacaagccaaaguggcauguuu

SEQ ID NO: 3727801 - RNA, 20 nt, Human
uacaagcgugagccacugca

SEQ ID NO: 3727802 - RNA, 19 nt, Human
uacaagggaagauuuaugu

SEQ ID NO: 3727803 - RNA, 18 nt, Human
uacaagguauaauaaaau

SEQ ID NO: 3727804 - RNA, 20 nt, Human
uacaagguauaauaaaauua

SEQ ID NO: 3727805 - RNA, 14 nt, Human
uacaaguaguucug

SEQ ID NO: 3727806 - RNA, 19 nt, Human
uacaaguaguucuguauuu

SEQ ID NO: 3727807 - RNA, 19 nt, Human
uacaaguauuuuuaauuaa

SEQ ID NO: 3727808 - RNA, 16 nt, Human
uacaagucaguuucua

SEQ ID NO: 3727809 - RNA, 13 nt, Human
uacaaguguauau

SEQ ID NO: 3727810 - RNA, 14 nt, Human
uacaaguguauauc

SEQ ID NO: 3727811 - RNA, 16 nt, Human
uacaaguuauaguacu

SEQ ID NO: 3727812 - RNA, 15 nt, Human
uacaaguuggaguca

SEQ ID NO: 3727813 - RNA, 17 nt, Human
uacaaguuuauauauau

SEQ ID NO: 3727814 - RNA, 13 nt, Human
uacaauaaaaaca

SEQ ID NO: 3727815 - RNA, 12 nt, Human
uacaauaaacua

SEQ ID NO: 3727816 - RNA, 13 nt, Human
uacaauaaauaau

SEQ ID NO: 3727817 - RNA, 16 nt, Human
uacaauaaauaaucug

SEQ ID NO: 3727818 - RNA, 13 nt, Human
uacaauaacauaa

SEQ ID NO: 3727819 - RNA, 14 nt, Human
uacaauaauggaaa

SEQ ID NO: 3727820 - RNA, 18 nt, Human
uacaauaauucauauucu

SEQ ID NO: 3727821 - RNA, 14 nt, Human
uacaauacaucuga

SEQ ID NO: 3727822 - RNA, 15 nt, Human
uacaauauguacauu

SEQ ID NO: 3727823 - RNA, 14 nt, Human
uacaauauugauug

SEQ ID NO: 3727824 - RNA, 19 nt, Human
uacaauauugauugggaaa

SEQ ID NO: 3727825 - RNA, 16 nt, Human
uacaauauuuaaaauu

SEQ ID NO: 3727826 - RNA, 16 nt, Human
uacaauauuuuaagca

SEQ ID NO: 3727827 - RNA, 21 nt, Human
uacaauauuuuaagcauuacu

SEQ ID NO: 3727828 - RNA, 14 nt, Human
uacaaucagcugcu

SEQ ID NO: 3727829 - RNA, 19 nt, Human
uacaaucagcugcuuuguu

SEQ ID NO: 3727830 - RNA, 22 nt, Human
uacaaucgagacugcaauguga

SEQ ID NO: 3727831 - RNA, 22 nt, Human
uacaaucucccuucacaaguuu

SEQ ID NO: 3727832 - RNA, 23 nt, Human
uacaaugaaaaggacuuuauaga

SEQ ID NO: 3727833 - RNA, 14 nt, Human
uacaaugcugugcc

SEQ ID NO: 3727834 - RNA, 16 nt, Human
uacaaugcugugcccu

SEQ ID NO: 3727835 - RNA, 14 nt, Human
uacaauguauuuau

SEQ ID NO: 3727836 - RNA, 22 nt, Human
uacaauguauuuauuuaaaaga

SEQ ID NO: 3727837 - RNA, 14 nt, Human
uacaaugugaacuu

SEQ ID NO: 3727838 - RNA, 16 nt, Human
uacaaugugaacuuua

SEQ ID NO: 3727839 - RNA, 13 nt, Human
uacaaugugacuu

SEQ ID NO: 3727840 - RNA, 21 nt, Human
uacaauguguuuuucuccagu

SEQ ID NO: 3727841 - RNA, 15 nt, Human
uacaauguucauccc

SEQ ID NO: 3727842 - RNA, 19 nt, Human
uacaauuaaagcuguuauu

SEQ ID NO: 3727843 - RNA, 22 nt, Human
uacaauuaauaguuugucuauu

SEQ ID NO: 3727844 - RNA, 18 nt, Human
uacaauuauuuuuacagu

SEQ ID NO: 3727845 - RNA, 17 nt, Human
uacaauuuacaaagugu

SEQ ID NO: 3727846 - RNA, 17 nt, Human
uacaauuucuuuugguu

SEQ ID NO: 3727847 - RNA, 13 nt, Human
uacaauuuuaaga

SEQ ID NO: 3727848 - RNA, 18 nt, Human
uacaauuuuaucuguuuc

SEQ ID NO: 3727849 - RNA, 15 nt, Human
uacaauuuuguuucu

SEQ ID NO: 3727850 - RNA, 17 nt, Human
uacaauuuuguuucugu

SEQ ID NO: 3727851 - RNA, 18 nt, Human
uacaauuuuguuucugua

SEQ ID NO: 3727852 - RNA, 19 nt, Human
uacaauuuuguuucuguac

SEQ ID NO: 3727853 - RNA, 21 nt, Human
uacaauuuuguuucuguacuu

SEQ ID NO: 3727854 - RNA, 13 nt, Human
uacaauuuuuauu

SEQ ID NO: 3727855 - RNA, 20 nt, Human
uacaauuuuuuuaauuuugu

SEQ ID NO: 3727856 - RNA, 22 nt, Human
uacaauuuuuuuaauuuuguau

SEQ ID NO: 3727857 - RNA, 24 nt, Human
uacacaaaggggaucauaaaguua

SEQ ID NO: 3727858 - RNA, 20 nt, Human
uacacaaauacuuauucauu

SEQ ID NO: 3727859 - RNA, 14 nt, Human
uacacaacucacuc

SEQ ID NO: 3727860 - RNA, 14 nt, Human
uacacaaguaaaca

SEQ ID NO: 3727861 - RNA, 16 nt, Human
uacacaaguaaacauu

SEQ ID NO: 3727862 - RNA, 20 nt, Human
uacacaaugguuuuuaaauu

SEQ ID NO: 3727863 - RNA, 21 nt, Human
uacacaaugguuuuuaaauuu

SEQ ID NO: 3727864 - RNA, 13 nt, Human
uacacacacacac

SEQ ID NO: 3727865 - RNA, 18 nt, Human
uacacacacacacacaca

SEQ ID NO: 3727866 - RNA, 21 nt, Human
uacacacacacgcgugcacac

SEQ ID NO: 3727867 - RNA, 14 nt, Human
uacacacgcugccu

SEQ ID NO: 3727868 - RNA, 15 nt, Human
uacacacgcugccuu

SEQ ID NO: 3727869 - RNA, 17 nt, Human
uacacacgcugccuucg

SEQ ID NO: 3727870 - RNA, 17 nt, Human
uacacacuguacacaua

SEQ ID NO: 3727871 - RNA, 13 nt, Human
uacacagaaacac

SEQ ID NO: 3727872 - RNA, 17 nt, Human
uacacagaaaugcugcu

SEQ ID NO: 3727873 - RNA, 18 nt, Human
uacacagaaaugcugcug

SEQ ID NO: 3727874 - RNA, 17 nt, Human
uacacagacuauugaca

SEQ ID NO: 3727875 - RNA, 21 nt, Human
uacacagacuauugacaucag

SEQ ID NO: 3727876 - RNA, 22 nt, Human
uacacagacuauugacaucagc

SEQ ID NO: 3727877 - RNA, 14 nt, Human
uacacaggacaggg

SEQ ID NO: 3727878 - RNA, 22 nt, Human
uacacagugggaacucugacaa

SEQ ID NO: 3727879 - RNA, 23 nt, Human
uacacagugggaacucugacaag

SEQ ID NO: 3727880 - RNA, 22 nt, Human
uacacagugugaauaaagugcu

SEQ ID NO: 3727881 - RNA, 20 nt, Human
uacacauauaaauugucuua

SEQ ID NO: 3727882 - RNA, 13 nt, Human
uacacauauaccu

SEQ ID NO: 3727883 - RNA, 18 nt, Human
uacacauauuugaagggu

SEQ ID NO: 3727884 - RNA, 17 nt, Human
uacacaucucagacccu

SEQ ID NO: 3727885 - RNA, 13 nt, Human
uacacauuagauu

SEQ ID NO: 3727886 - RNA, 13 nt, Human
uacacauuugcua

SEQ ID NO: 3727887 - RNA, 18 nt, Human
uacacauuuguacagaau

SEQ ID NO: 3727888 - RNA, 21 nt, Human
uacacauuuuauuuuauuaug

SEQ ID NO: 3727889 - RNA, 19 nt, Human
uacacauuuuuaaauuguu

SEQ ID NO: 3727890 - RNA, 19 nt, Human
uacacauuuuucagauaua

SEQ ID NO: 3727891 - RNA, 13 nt, Human
uacaccacacaca

SEQ ID NO: 3727892 - RNA, 21 nt, Human
uacaccacacacaacagccaa

SEQ ID NO: 3727893 - RNA, 22 nt, Human
uacaccacacacaacagccaac

SEQ ID NO: 3727894 - RNA, 16 nt, Human
uacaccacuacauucu

SEQ ID NO: 3727895 - RNA, 17 nt, Human
uacaccacuacauucug

SEQ ID NO: 3727896 - RNA, 16 nt, Human
uacaccacucuggcag

SEQ ID NO: 3727897 - RNA, 19 nt, Human
uacaccagagauaauauga

SEQ ID NO: 3727898 - RNA, 17 nt, Human
uacaccagcauuccuuu

SEQ ID NO: 3727899 - RNA, 14 nt, Human
uacacccagacccc

SEQ ID NO: 3727900 - RNA, 14 nt, Human
uacacccagcaaua

SEQ ID NO: 3727901 - RNA, 14 nt, Human
uacacccuuggacu

SEQ ID NO: 3727902 - RNA, 15 nt, Human
uacaccgggccugga

SEQ ID NO: 3727903 - RNA, 15 nt, Human
uacaccuaaaggugu

SEQ ID NO: 3727904 - RNA, 23 nt, Human
uacaccuaaagguguauuuaaac

SEQ ID NO: 3727905 - RNA, 14 nt, Human
uagaaccucuuugu

SEQ ID NO: 3727906 - RNA, 22 nt, Human
uagaaccuggagggcuagaacc

SEQ ID NO: 3727907 - RNA, 23 nt, Human
uagaacgccagggaccccagaau

SEQ ID NO: 3727908 - RNA, 21 nt, Human
uagaacucaaccucuacaggg

SEQ ID NO: 3727909 - RNA, 23 nt, Human
uagaacucaaccucuacaggguu

SEQ ID NO: 3727910 - RNA, 15 nt, Human
uagaacucacucugg

SEQ ID NO: 3727911 - RNA, 16 nt, Human
uagaacucacucuggg

SEQ ID NO: 3727912 - RNA, 19 nt, Human
uagaacucacucugggcug

SEQ ID NO: 3727913 - RNA, 20 nt, Human
uagaacucacucugggcugu

SEQ ID NO: 3727914 - RNA, 16 nt, Human
uagaacuccaggcccu

SEQ ID NO: 3727915 - RNA, 19 nt, Human
uagaacuccaggcccuccu

SEQ ID NO: 3727916 - RNA, 17 nt, Human
uagaacugaauuuuguc

SEQ ID NO: 3727917 - RNA, 16 nt, Human
uagaacugucugugaa

SEQ ID NO: 3727918 - RNA, 15 nt, Human
uagaacuuacuauuc

SEQ ID NO: 3727919 - RNA, 23 nt, Human
uagaacuucuccguccucgaugg

SEQ ID NO: 3727920 - RNA, 12 nt, Human
uagaacuuugua

SEQ ID NO: 3727921 - RNA, 12 nt, Human
uagaacuuuuuu

SEQ ID NO: 3727922 - RNA, 21 nt, Human
uagaacuuuuuuaaauaaacu

SEQ ID NO: 3727923 - RNA, 22 nt, Human
uagaacuuuuuuaaauaaacuu

SEQ ID NO: 3727924 - RNA, 18 nt, Human
uagaagaaaaaagaaugu

SEQ ID NO: 3727925 - RNA, 22 nt, Human
uagaagaacauccaaggagaaa

SEQ ID NO: 3727926 - RNA, 14 nt, Human
uagaagaagugugu

SEQ ID NO: 3727927 - RNA, 22 nt, Human
uagaagaaugcaugcuuuccau

SEQ ID NO: 3727928 - RNA, 21 nt, Human
uagaagacucuaccagacugu

SEQ ID NO: 3727929 - RNA, 14 nt, Human
uagaagauguuugc

SEQ ID NO: 3727930 - RNA, 23 nt, Human
uagaagcauuccuucuuugauaa

SEQ ID NO: 3727931 - RNA, 12 nt, Human
uagaagccaagg

SEQ ID NO: 3727932 - RNA, 16 nt, Human
uagaagccaagggaaa

SEQ ID NO: 3727933 - RNA, 12 nt, Human
uagaagccugca

SEQ ID NO: 3727934 - RNA, 24 nt, Human
uagaagcgauuuaaguuacaaugu

SEQ ID NO: 3727935 - RNA, 23 nt, Human
uagaaggaaaaaaguuccuuccu

SEQ ID NO: 3727936 - RNA, 15 nt, Human
uagaaggagacagag

SEQ ID NO: 3727937 - RNA, 23 nt, Human
uagaaggagacagagcugguugg

SEQ ID NO: 3727938 - RNA, 19 nt, Human
uagaagguugacacaguug

SEQ ID NO: 3727939 - RNA, 14 nt, Human
uagaaguagauucu

SEQ ID NO: 3727940 - RNA, 16 nt, Human
uagaaguauaaagaau

SEQ ID NO: 3727941 - RNA, 17 nt, Human
uagaaguauaaagaauu

SEQ ID NO: 3727942 - RNA, 19 nt, Human
uagaaguauaaagaauugu

SEQ ID NO: 3727943 - RNA, 15 nt, Human
uagaagucacacagu

SEQ ID NO: 3727944 - RNA, 17 nt, Human
uagaagucuuagaugua

SEQ ID NO: 3727945 - RNA, 20 nt, Human
uagaagucuuagauguauau

SEQ ID NO: 3727946 - RNA, 18 nt, Human
uagaagucuucaugaaau

SEQ ID NO: 3727947 - RNA, 20 nt, Human
uagaagucuucaugaaaugc

SEQ ID NO: 3727948 - RNA, 21 nt, Human
uagaagucuucaugaaaugcu

SEQ ID NO: 3727949 - RNA, 15 nt, Human
uagaagugcauuucu

SEQ ID NO: 3727950 - RNA, 19 nt, Human
uagaaguggaccaggacag

SEQ ID NO: 3727951 - RNA, 15 nt, Human
uagaagugucauguu

SEQ ID NO: 3727952 - RNA, 20 nt, Human
uagaaguucuaguguuuuca

SEQ ID NO: 3727953 - RNA, 16 nt, Human
uagaaguuucccuucc

SEQ ID NO: 3727954 - RNA, 21 nt, Human
uagaaguuuggcugcugucau

SEQ ID NO: 3727955 - RNA, 15 nt, Human
uagaaguuuuaaauu

SEQ ID NO: 3727956 - RNA, 14 nt, Human
uagaaguuuuugua

SEQ ID NO: 3727957 - RNA, 18 nt, Human
uagaaguuuuuguacugu

SEQ ID NO: 3727958 - RNA, 19 nt, Human
uagaauaaaauuguaaaau

SEQ ID NO: 3727959 - RNA, 22 nt, Human
uagaauaaugugggaagaaaca

SEQ ID NO: 3727960 - RNA, 23 nt, Human
uagaauaaugugggaagaaacaa

SEQ ID NO: 3727961 - RNA, 12 nt, Human
uagaauagcaug

SEQ ID NO: 3727962 - RNA, 16 nt, Human
uagaauaggcacuuua

SEQ ID NO: 3727963 - RNA, 16 nt, Human
uagaauauaggucucu

SEQ ID NO: 3727964 - RNA, 16 nt, Human
uagaauauccuacuuc

SEQ ID NO: 3727965 - RNA, 14 nt, Human
uagaauauucagac

SEQ ID NO: 3727966 - RNA, 15 nt, Human
uagaauauucagaca

SEQ ID NO: 3727967 - RNA, 16 nt, Human
uagaaucaauuuaagu

SEQ ID NO: 3727968 - RNA, 14 nt, Human
uagaauccaaacuu

SEQ ID NO: 3727969 - RNA, 23 nt, Human
uagaauccaaacuuggauuuuug

SEQ ID NO: 3727970 - RNA, 13 nt, Human
uagaaucccugug

SEQ ID NO: 3727971 - RNA, 13 nt, Human
uagaaucuauuuu

SEQ ID NO: 3727972 - RNA, 18 nt, Human
uagaaucuauuuucuaug

SEQ ID NO: 3727973 - RNA, 22 nt, Human
uagaaucugcaauucaaaaguu

SEQ ID NO: 3727974 - RNA, 18 nt, Human
uagaaugaaccacugccc

SEQ ID NO: 3727975 - RNA, 12 nt, Human
uagaaugacagu

SEQ ID NO: 3727976 - RNA, 17 nt, Human
uagaaugagaucugaau

SEQ ID NO: 3727977 - RNA, 16 nt, Human
uagaauggugauuuua

SEQ ID NO: 3727978 - RNA, 17 nt, Human
uagaauguaaagcuugu

SEQ ID NO: 3727979 - RNA, 18 nt, Human
uagaauguaaagcuuguc

SEQ ID NO: 3727980 - RNA, 15 nt, Human
uagaauguaaauguc

SEQ ID NO: 3727981 - RNA, 18 nt, Human
uagaauguaaaugucuca

SEQ ID NO: 3727982 - RNA, 23 nt, Human
uagaauguaguuugaggaaauuu

SEQ ID NO: 3727983 - RNA, 18 nt, Human
uagaauguauuguaccuu

SEQ ID NO: 3727984 - RNA, 19 nt, Human
uagaaugugugucaauuua

SEQ ID NO: 3727985 - RNA, 19 nt, Human
uagaauguuuucaaauguu

SEQ ID NO: 3727986 - RNA, 19 nt, Human
uagaauuagcuuuuucauc

SEQ ID NO: 3727987 - RNA, 21 nt, Human
uagaauuauaacuggaaagaa

SEQ ID NO: 3727988 - RNA, 20 nt, Human
uagaauuauuucacaaauaa

SEQ ID NO: 3727989 - RNA, 15 nt, Human
uagaauuauuuuuca

SEQ ID NO: 3727990 - RNA, 15 nt, Human
uagaauucccucucu

SEQ ID NO: 3727991 - RNA, 23 nt, Human
uagaauuccuucagggugaugcc

SEQ ID NO: 3727992 - RNA, 16 nt, Human
uagaauucuagugcug

SEQ ID NO: 3727993 - RNA, 22 nt, Human
uagaauucuagugcugcugaag

SEQ ID NO: 3727994 - RNA, 15 nt, Human
uagaauucuguauag

SEQ ID NO: 3727995 - RNA, 17 nt, Human
uagaauugaagguuuuu

SEQ ID NO: 3727996 - RNA, 23 nt, Human
uagaauugaagguuuuugauagc

SEQ ID NO: 3727997 - RNA, 18 nt, Human
uagaauugcaaucuauaa

SEQ ID NO: 3727998 - RNA, 20 nt, Human
uagaauugcaaucuauaaua

SEQ ID NO: 3727999 - RNA, 15 nt, Human
uagaauugcauugac

SEQ ID NO: 3728000 - RNA, 14 nt, Human
uagaauuguuauag

SEQ ID NO: 3728001 - RNA, 22 nt, Human
uagaauuugauaugugaacagu

SEQ ID NO: 3728002 - RNA, 16 nt, Human
uagaauuuuaagugcu

SEQ ID NO: 3728003 - RNA, 21 nt, Human
uagaauuuugguauaaagaaa

SEQ ID NO: 3728004 - RNA, 13 nt, Human
uagacaaaaagua

SEQ ID NO: 3728005 - RNA, 20 nt, Human
uagacaaaaaguauauuaaa

SEQ ID NO: 3728006 - RNA, 12 nt, Human
uagacaaaguac

SEQ ID NO: 3728007 - RNA, 17 nt, Human
uagacaagauauuguac

SEQ ID NO: 3728008 - RNA, 14 nt, Human
uagacaagccagaa

SEQ ID NO: 3728009 - RNA, 18 nt, Human
uagacaauauaagagcuu

SEQ ID NO: 3728010 - RNA, 17 nt, Human
uagacaaucauuguuuu

SEQ ID NO: 3728011 - RNA, 18 nt, Human
uagacaauugagguaagu

SEQ ID NO: 3728012 - RNA, 19 nt, Human
uagacacauaugaggggga

SEQ ID NO: 3728013 - RNA, 17 nt, Human
uagacacauuuaaggau

SEQ ID NO: 3728014 - RNA, 18 nt, Human
uagacaccaaaguucuaa

SEQ ID NO: 3728015 - RNA, 18 nt, Human
uagacacccauuuucaca

SEQ ID NO: 3728016 - RNA, 14 nt, Human
uagacagaacaccu

SEQ ID NO: 3728017 - RNA, 15 nt, Human
uagacagaacaccua

SEQ ID NO: 3728018 - RNA, 12 nt, Human
uagacagaagaa

SEQ ID NO: 3728019 - RNA, 14 nt, Human
uagacagaagaaac

SEQ ID NO: 3728020 - RNA, 14 nt, Human
uagacagcaugaga

SEQ ID NO: 3728021 - RNA, 17 nt, Human
uagacagucccugccaa

SEQ ID NO: 3728022 - RNA, 18 nt, Human
uagacagucucacuuugu

SEQ ID NO: 3728023 - RNA, 13 nt, Human
uagacaguuugua

SEQ ID NO: 3728024 - RNA, 18 nt, Human
uagacaguuuguaaaugu

SEQ ID NO: 3728025 - RNA, 22 nt, Human
uagacaguuuguaaauguuauu

SEQ ID NO: 3728026 - RNA, 14 nt, Human
uagacaucaaacuc

SEQ ID NO: 3728027 - RNA, 22 nt, Human
uagacaucaaacucaaugcuuu

SEQ ID NO: 3728028 - RNA, 23 nt, Human
uagacaucaaacucaaugcuuua

SEQ ID NO: 3728029 - RNA, 17 nt, Human
uagacauggagguucua

SEQ ID NO: 3728030 - RNA, 20 nt, Human
uagacauggagguucuaagg

SEQ ID NO: 3728031 - RNA, 22 nt, Human
uagacauggagguucuaaggcc

SEQ ID NO: 3728032 - RNA, 21 nt, Human
uagacauuugcuaugagcugg

SEQ ID NO: 3728033 - RNA, 19 nt, Human
uagacauuuguaaauguaa

SEQ ID NO: 3728034 - RNA, 23 nt, Human
uagacauuuuaacaagaagauga

SEQ ID NO: 3728035 - RNA, 23 nt, Human
uagaccaaggaacaaaaaaacca

SEQ ID NO: 3728036 - RNA, 10 nt, Human
uagaccaaua

SEQ ID NO: 3728037 - RNA, 15 nt, Human
uagaccaccaagccu

SEQ ID NO: 3728038 - RNA, 22 nt, Human
uagaccagcagacagagccagg

SEQ ID NO: 3728039 - RNA, 23 nt, Human
uagaccauuuaucugggauuaug

SEQ ID NO: 3728040 - RNA, 18 nt, Human
uagaccccauacaaguuu

SEQ ID NO: 3728041 - RNA, 17 nt, Human
uagacccucaugcugcc

SEQ ID NO: 3728042 - RNA, 19 nt, Human
uagacccucaugcugccaa

SEQ ID NO: 3728043 - RNA, 14 nt, Human
uagacccucucaag

SEQ ID NO: 3728044 - RNA, 12 nt, Human
uagacccugggu

SEQ ID NO: 3728045 - RNA, 16 nt, Human
uagacccugggugggc

SEQ ID NO: 3728046 - RNA, 19 nt, Human
uagaccuagggaggaccuu

SEQ ID NO: 3728047 - RNA, 14 nt, Human
uagacuaaaugaaa

SEQ ID NO: 3728048 - RNA, 20 nt, Human
uagacuauauacaugugugu

SEQ ID NO: 3728049 - RNA, 22 nt, Human
uagacuauauacauguguguau

SEQ ID NO: 3728050 - RNA, 23 nt, Human
uagacuauauacauguguguaua

SEQ ID NO: 3728051 - RNA, 21 nt, Human
uagacucaugguguguuacac

SEQ ID NO: 3728052 - RNA, 20 nt, Human
uagacucggggugcuuccuu

SEQ ID NO: 3728053 - RNA, 20 nt, Human
gccaaggccgaagcucuggc

SEQ ID NO: 3728054 - RNA, 14 nt, Human
gccaaggccuucuc

SEQ ID NO: 3728055 - RNA, 19 nt, Human
gccaagggcauaaauuauu

SEQ ID NO: 3728056 - RNA, 15 nt, Human
gccaaggucugagcc

SEQ ID NO: 3728057 - RNA, 22 nt, Human
gccaaggucugagccacagcag

SEQ ID NO: 3728058 - RNA, 14 nt, Human
gccaaggugggagg

SEQ ID NO: 3728059 - RNA, 23 nt, Human
gccaaggugggcugagcccuggc

SEQ ID NO: 3728060 - RNA, 23 nt, Human
gccaagguguccuacagaaaaac

SEQ ID NO: 3728061 - RNA, 20 nt, Human
gccaagguuuuauaaggcug

SEQ ID NO: 3728062 - RNA, 22 nt, Human
gccaaguauaauuuuuuguaau

SEQ ID NO: 3728063 - RNA, 12 nt, Human
gccaaguccaga

SEQ ID NO: 3728064 - RNA, 15 nt, Human
gccaaguccaggucc

SEQ ID NO: 3728065 - RNA, 16 nt, Human
gccaaguccagguccu

SEQ ID NO: 3728066 - RNA, 17 nt, Human
gccaaguccagguccug

SEQ ID NO: 3728067 - RNA, 19 nt, Human
gccaaguccagguccuggu

SEQ ID NO: 3728068 - RNA, 22 nt, Human
gccaaguccagguccugguggg

SEQ ID NO: 3728069 - RNA, 21 nt, Human
gccaaguccgcagaagcccug

SEQ ID NO: 3728070 - RNA, 16 nt, Human
gccaagugcaggcugg

SEQ ID NO: 3728071 - RNA, 13 nt, Human
gccaaguggggug

SEQ ID NO: 3728072 - RNA, 21 nt, Human
gccaaguuccucuagugcccu

SEQ ID NO: 3728073 - RNA, 16 nt, Human
gccaauaaaccaauga

SEQ ID NO: 3728074 - RNA, 20 nt, Human
gccaauaauaauaccucccu

SEQ ID NO: 3728075 - RNA, 17 nt, Human
gccaauauccuaauaaa

SEQ ID NO: 3728076 - RNA, 23 nt, Human
gccaauauccuaauaaaaaggug

SEQ ID NO: 3728077 - RNA, 13 nt, Human
gccaauauguauu

SEQ ID NO: 3728078 - RNA, 18 nt, Human
gccaauccccuccuuggg

SEQ ID NO: 3728079 - RNA, 21 nt, Human
gccaauccccuccuugggcac

SEQ ID NO: 3728080 - RNA, 21 nt, Human
gccaaucccucaccuucugag

SEQ ID NO: 3728081 - RNA, 23 nt, Human
gccaaucucuucuaaaaaaaaac

SEQ ID NO: 3728082 - RNA, 19 nt, Human
gccaaugcaccuaaagaaa

SEQ ID NO: 3728083 - RNA, 21 nt, Human
gccaauggagacugucucaag

SEQ ID NO: 3728084 - RNA, 20 nt, Human
gccaaugugaacagcggcug

SEQ ID NO: 3728085 - RNA, 19 nt, Human
gccaauguuuuccacccau

SEQ ID NO: 3728086 - RNA, 19 nt, Human
gccaauuauuguuacacau

SEQ ID NO: 3728087 - RNA, 11 nt, Human
gccaauuuuuc

SEQ ID NO: 3728088 - RNA, 23 nt, Human
gccaauuuuugccuucauuaccu

SEQ ID NO: 3728089 - RNA, 21 nt, Human
gccacaacccuguuuuauacu

SEQ ID NO: 3728090 - RNA, 14 nt, Human
gccacaagaaauuu

SEQ ID NO: 3728091 - RNA, 15 nt, Human
gccacaaggaagaaa

SEQ ID NO: 3728092 - RNA, 23 nt, Human
gccacaaggaagaaauuaacuua

SEQ ID NO: 3728093 - RNA, 19 nt, Human
gccacacaaacguuuacuu

SEQ ID NO: 3728094 - RNA, 12 nt, Human
gccacacacaca

SEQ ID NO: 3728095 - RNA, 15 nt, Human
gccacacacacagaa

SEQ ID NO: 3728096 - RNA, 16 nt, Human
gccacacacacagaaa

SEQ ID NO: 3728097 - RNA, 18 nt, Human
gccacacacacagaaaau

SEQ ID NO: 3728098 - RNA, 21 nt, Human
gccacacacacagaaaauaua

SEQ ID NO: 3728099 - RNA, 22 nt, Human
gccacacacacagaaaauauac

SEQ ID NO: 3728100 - RNA, 21 nt, Human
gccacacacagaaaaggcugc

SEQ ID NO: 3728101 - RNA, 23 nt, Human
gccacacaucacccuuaccaugu

SEQ ID NO: 3728102 - RNA, 14 nt, Human
gccacacaugggca

SEQ ID NO: 3728103 - RNA, 18 nt, Human
gccacaccaagcugugcc

SEQ ID NO: 3728104 - RNA, 21 nt, Human
gccacaccaagcugugccacc

SEQ ID NO: 3728105 - RNA, 21 nt, Human
gccacaccaggauagagacug

SEQ ID NO: 3728106 - RNA, 15 nt, Human
gccacacccaggcac

SEQ ID NO: 3728107 - RNA, 22 nt, Human
gccacacccucccccgccacuc

SEQ ID NO: 3728108 - RNA, 14 nt, Human
gccacaccugagcc

SEQ ID NO: 3728109 - RNA, 16 nt, Human
gccacaccuuugucca

SEQ ID NO: 3728110 - RNA, 21 nt, Human
gccacacgucugacccucucc

SEQ ID NO: 3728111 - RNA, 18 nt, Human
gccacacuauuaccauga

SEQ ID NO: 3728112 - RNA, 17 nt, Human
gccacacucagcacaag

SEQ ID NO: 3728113 - RNA, 12 nt, Human
gccacacuguga

SEQ ID NO: 3728114 - RNA, 16 nt, Human
gccacacugugacaca

SEQ ID NO: 3728115 - RNA, 20 nt, Human
gccacacuucaggcucuucu

SEQ ID NO: 3728116 - RNA, 19 nt, Human
gccacacuucucaggacac

SEQ ID NO: 3728117 - RNA, 14 nt, Human
gccacagaagccag

SEQ ID NO: 3728118 - RNA, 13 nt, Human
gccacagagaaag

SEQ ID NO: 3728119 - RNA, 16 nt, Human
gccacagcagcauuuu

SEQ ID NO: 3728120 - RNA, 19 nt, Human
gccacagcccagccacgga

SEQ ID NO: 3728121 - RNA, 16 nt, Human
gccacagcccaggccu

SEQ ID NO: 3728122 - RNA, 23 nt, Human
gccacagcccaggccuccagcuc

SEQ ID NO: 3728123 - RNA, 16 nt, Human
gccacagccuccccug

SEQ ID NO: 3728124 - RNA, 21 nt, Human
gccacagccuccccugccagg

SEQ ID NO: 3728125 - RNA, 18 nt, Human
gccacagcgccagccuca

SEQ ID NO: 3728126 - RNA, 16 nt, Human
gccacaggccucccug

SEQ ID NO: 3728127 - RNA, 17 nt, Human
gccacaggccucccugu

SEQ ID NO: 3728128 - RNA, 21 nt, Human
gccacaggccucccuguuuga

SEQ ID NO: 3728129 - RNA, 15 nt, Human
gccacaggucuuuau

SEQ ID NO: 3728130 - RNA, 15 nt, Human
gccacaguagaacug

SEQ ID NO: 3728131 - RNA, 12 nt, Human
gccacaguuguu

SEQ ID NO: 3728132 - RNA, 16 nt, Human
gccacauacuugcagc

SEQ ID NO: 3728133 - RNA, 16 nt, Human
gccacaucaaaccuuu

SEQ ID NO: 3728134 - RNA, 15 nt, Human
gccacaucaaagagg

SEQ ID NO: 3728135 - RNA, 14 nt, Human
gccacaugaguccc

SEQ ID NO: 3728136 - RNA, 18 nt, Human
gccacaugagucccagug

SEQ ID NO: 3728137 - RNA, 15 nt, Human
gccacaugggaggcu

SEQ ID NO: 3728138 - RNA, 15 nt, Human
gccacauuagaacuu

SEQ ID NO: 3728139 - RNA, 23 nt, Human
gccacauuagaacuucuccgucc

SEQ ID NO: 3728140 - RNA, 14 nt, Human
gccacauuuggaau

SEQ ID NO: 3728141 - RNA, 22 nt, Human
gccacauuuggaauacuuuuug

SEQ ID NO: 3728142 - RNA, 17 nt, Human
gccacauuuucagccaa

SEQ ID NO: 3728143 - RNA, 14 nt, Human
gccaccaaagcugc

SEQ ID NO: 3728144 - RNA, 16 nt, Human
gccaccaaagcugccc

SEQ ID NO: 3728145 - RNA, 17 nt, Human
gccaccaaagcugccca

SEQ ID NO: 3728146 - RNA, 16 nt, Human
gccaccaaaggccagg

SEQ ID NO: 3728147 - RNA, 12 nt, Human
gccaccaacaua

SEQ ID NO: 3728148 - RNA, 21 nt, Human
gccaccaacauacucccaucu

SEQ ID NO: 3728149 - RNA, 22 nt, Human
gccaccaacucuugcaggucuc

SEQ ID NO: 3728150 - RNA, 18 nt, Human
gccaccaacuggcccucu

SEQ ID NO: 3728151 - RNA, 14 nt, Human
gccaccaagaggga

SEQ ID NO: 3728152 - RNA, 19 nt, Human
gccaccaagagggacgccu

SEQ ID NO: 3728153 - RNA, 16 nt, Human
gccaccaccccccacu

SEQ ID NO: 3728154 - RNA, 22 nt, Human
gccaccaccccccacucugugc

SEQ ID NO: 3728155 - RNA, 12 nt, Human
gccaccaccucu

SEQ ID NO: 3728156 - RNA, 14 nt, Human
gccaccaccucugu

SEQ ID NO: 3728157 - RNA, 21 nt, Human
gccaccagagaccguccucac

SEQ ID NO: 3728158 - RNA, 23 nt, Human
gccaccagagaccguccucaccc

SEQ ID NO: 3728159 - RNA, 19 nt, Human
gccaccagcucugccgucu

SEQ ID NO: 3728160 - RNA, 22 nt, Human
gccaccaggaucagccaggagg

SEQ ID NO: 3728161 - RNA, 17 nt, Human
gccaccaggauggcccu

SEQ ID NO: 3728162 - RNA, 18 nt, Human
gccaccauccuauugcaa

SEQ ID NO: 3728163 - RNA, 15 nt, Human
gccaccauccugcug

SEQ ID NO: 3728164 - RNA, 22 nt, Human
gccaccaugccucacuaauuuu

SEQ ID NO: 3728165 - RNA, 16 nt, Human
gccaccauuccuggaa

SEQ ID NO: 3728166 - RNA, 14 nt, Human
gccacccaaagcag

SEQ ID NO: 3728167 - RNA, 16 nt, Human
gccacccaccucccug

SEQ ID NO: 3728168 - RNA, 14 nt, Human
gccacccagcccca

SEQ ID NO: 3728169 - RNA, 17 nt, Human
gccacccaggaggcagg

SEQ ID NO: 3728170 - RNA, 12 nt, Human
gccacccaggau

SEQ ID NO: 3728171 - RNA, 13 nt, Human
gccacccaggauc

SEQ ID NO: 3728172 - RNA, 15 nt, Human
gccaccccacccucc

SEQ ID NO: 3728173 - RNA, 21 nt, Human
gccaccccacccucccuggag

SEQ ID NO: 3728174 - RNA, 22 nt, Human
gccaccccacccucccuggagu

SEQ ID NO: 3728175 - RNA, 16 nt, Human
gccaccccgagggcug

SEQ ID NO: 3728176 - RNA, 23 nt, Human
gccaccccgagggcugagccugg

SEQ ID NO: 3728177 - RNA, 19 nt, Human
gccaccccgggcucucugc

SEQ ID NO: 3728178 - RNA, 21 nt, Human
gccaccccgggcucucugcug

SEQ ID NO: 3728179 - RNA, 20 nt, Human
gccaccccuaaacuccaggg

SEQ ID NO: 3728180 - RNA, 21 nt, Human
gccacccguucugcuggccug

SEQ ID NO: 3728181 - RNA, 13 nt, Human
gccacccucaugc

SEQ ID NO: 3728182 - RNA, 12 nt, Human
gccacccugagg

SEQ ID NO: 3728183 - RNA, 14 nt, Human
gccacccugaggag

SEQ ID NO: 3728184 - RNA, 23 nt, Human
gccacccugaggagucugagguc

SEQ ID NO: 3728185 - RNA, 18 nt, Human
gccacccugaggccucug

SEQ ID NO: 3728186 - RNA, 13 nt, Human
gccacccugggga

SEQ ID NO: 3728187 - RNA, 19 nt, Human
gccacccuggggagaaagu

SEQ ID NO: 3728188 - RNA, 12 nt, Human
gccacccugugc

SEQ ID NO: 3728189 - RNA, 22 nt, Human
gccaccgccgacuuuguacccc

SEQ ID NO: 3728190 - RNA, 16 nt, Human
gccaccgccuccuaca

SEQ ID NO: 3728191 - RNA, 17 nt, Human
gccaccgcgcccagccu

SEQ ID NO: 3728192 - RNA, 22 nt, Human
gccaccgcgggugugggaaagc

SEQ ID NO: 3728193 - RNA, 20 nt, Human
gccaccuccccuauccaccc

SEQ ID NO: 3728194 - RNA, 20 nt, Human
gccaccuccccuugccagcu

SEQ ID NO: 3728195 - RNA, 22 nt, Human
gccaccuccccuugccagcugc

SEQ ID NO: 3728196 - RNA, 24 nt, Human
gccaccuccccuugccagcugcug

SEQ ID NO: 3728197 - RNA, 20 nt, Human
gccaccucccugacccgucu

SEQ ID NO: 3728198 - RNA, 22 nt, Human
gccaccuccuaaaaggcccaga

SEQ ID NO: 3728199 - RNA, 21 nt, Human
gccaccucuaacagcaccaaa

SEQ ID NO: 3728200 - RNA, 21 nt, Human
gccaccucugcggaccccagc

SEQ ID NO: 3728201 - RNA, 14 nt, Human
uacaccuaugucau

SEQ ID NO: 3728202 - RNA, 18 nt, Human
uacaccuauuaucccagc

SEQ ID NO: 3728203 - RNA, 15 nt, Human
uacaccuggcugagg

SEQ ID NO: 3728204 - RNA, 22 nt, Human
uacaccuggcugagguuccucu

SEQ ID NO: 3728205 - RNA, 19 nt, Human
uacaccuuucuccuuugua

SEQ ID NO: 3728206 - RNA, 21 nt, Human
uacacguauuugaauggccuu

SEQ ID NO: 3728207 - RNA, 15 nt, Human
uacacuaaaagguga

SEQ ID NO: 3728208 - RNA, 19 nt, Human
uacacucaagcaugaagau

SEQ ID NO: 3728209 - RNA, 21 nt, Human
uacacucucaaagcaaauaau

SEQ ID NO: 3728210 - RNA, 12 nt, Human
uacacucuuaua

SEQ ID NO: 3728211 - RNA, 20 nt, Human
uacacugaaguuaacagaga

SEQ ID NO: 3728212 - RNA, 17 nt, Human
uacacugaauauuuaua

SEQ ID NO: 3728213 - RNA, 22 nt, Human
uacacugaauuuuuauguguga

SEQ ID NO: 3728214 - RNA, 21 nt, Human
uacacugagagccuuuuugaa

SEQ ID NO: 3728215 - RNA, 16 nt, Human
uacacugcaaucauau

SEQ ID NO: 3728216 - RNA, 21 nt, Human
uacacugcaaucauaugugau

SEQ ID NO: 3728217 - RNA, 16 nt, Human
uacacugccugccuua

SEQ ID NO: 3728218 - RNA, 18 nt, Human
uacacugccugccuuaag

SEQ ID NO: 3728219 - RNA, 21 nt, Human
uacacugccugccuuaaguga

SEQ ID NO: 3728220 - RNA, 13 nt, Human
uacacugccugua

SEQ ID NO: 3728221 - RNA, 17 nt, Human
uacacugccuguauacu

SEQ ID NO: 3728222 - RNA, 19 nt, Human
uacacugccuguauacuuu

SEQ ID NO: 3728223 - RNA, 21 nt, Human
uacacugccuguauacuuuag

SEQ ID NO: 3728224 - RNA, 24 nt, Human
uacacuggcaaugguaguuucugu

SEQ ID NO: 3728225 - RNA, 16 nt, Human
uacacuguauuacaua

SEQ ID NO: 3728226 - RNA, 17 nt, Human
uacacuguguaaauacc

SEQ ID NO: 3728227 - RNA, 16 nt, Human
uacacuguuagaacac

SEQ ID NO: 3728228 - RNA, 19 nt, Human
uacacuguuagaacacuau

SEQ ID NO: 3728229 - RNA, 20 nt, Human
uacacuguuagaacacuauu

SEQ ID NO: 3728230 - RNA, 15 nt, Human
uacacuguuauuuuc

SEQ ID NO: 3728231 - RNA, 14 nt, Human
uacacuguuucaaa

SEQ ID NO: 3728232 - RNA, 17 nt, Human
uacacuguuucaaacuu

SEQ ID NO: 3728233 - RNA, 19 nt, Human
uacacuguuucaaacuuua

SEQ ID NO: 3728234 - RNA, 16 nt, Human
uacacuuacacuuuau

SEQ ID NO: 3728235 - RNA, 13 nt, Human
uacacuugcccug

SEQ ID NO: 3728236 - RNA, 15 nt, Human
uacacuugcccugcu

SEQ ID NO: 3728237 - RNA, 19 nt, Human
uacacuuguauaaauguau

SEQ ID NO: 3728238 - RNA, 13 nt, Human
uacacuuuaugca

SEQ ID NO: 3728239 - RNA, 13 nt, Human
uacacuuuguugc

SEQ ID NO: 3728240 - RNA, 16 nt, Human
uacagaaaaaccuugg

SEQ ID NO: 3728241 - RNA, 14 nt, Human
uacagaaaaaucuu

SEQ ID NO: 3728242 - RNA, 18 nt, Human
uacagaaaaguugaauuu

SEQ ID NO: 3728243 - RNA, 22 nt, Human
uacagaaaaguugaauuuuaca

SEQ ID NO: 3728244 - RNA, 21 nt, Human
uacagaaagauggaugugcuu

SEQ ID NO: 3728245 - RNA, 13 nt, Human
uacagaaagcugc

SEQ ID NO: 3728246 - RNA, 10 nt, Human
uacagaaagu

SEQ ID NO: 3728247 - RNA, 22 nt, Human
uacagaaaguggugcucaguug

SEQ ID NO: 3728248 - RNA, 24 nt, Human
uacagaaaguggugcucaguugua

SEQ ID NO: 3728249 - RNA, 22 nt, Human
uacagaaauacuauaacauaug

SEQ ID NO: 3728250 - RNA, 19 nt, Human
uacagaaauuuaauucaga

SEQ ID NO: 3728251 - RNA, 16 nt, Human
uacagaacucuuucaa

SEQ ID NO: 3728252 - RNA, 18 nt, Human
uacagaauauuucuauug

SEQ ID NO: 3728253 - RNA, 21 nt, Human
uacagaauauuucuauugaau

SEQ ID NO: 3728254 - RNA, 21 nt, Human
uacagaauucugcuaccucac

SEQ ID NO: 3728255 - RNA, 21 nt, Human
uacagaauugugucugcagga

SEQ ID NO: 3728256 - RNA, 14 nt, Human
uacagaauuugaau

SEQ ID NO: 3728257 - RNA, 13 nt, Human
uacagacacuaag

SEQ ID NO: 3728258 - RNA, 18 nt, Human
uacagacacuaaguuaua

SEQ ID NO: 3728259 - RNA, 18 nt, Human
uacagacauauuuaacug

SEQ ID NO: 3728260 - RNA, 19 nt, Human
uacagaccgaacuguugua

SEQ ID NO: 3728261 - RNA, 16 nt, Human
uacagaccugcuuuuu

SEQ ID NO: 3728262 - RNA, 17 nt, Human
uacagacgcugcuguca

SEQ ID NO: 3728263 - RNA, 16 nt, Human
uacagacguaugcuua

SEQ ID NO: 3728264 - RNA, 17 nt, Human
uacagagaaaccagcuu

SEQ ID NO: 3728265 - RNA, 20 nt, Human
uacagagaaaccagcuuccu

SEQ ID NO: 3728266 - RNA, 19 nt, Human
uacagagaacuaacacuau

SEQ ID NO: 3728267 - RNA, 23 nt, Human
uacagagaacuaacacuauuuua

SEQ ID NO: 3728268 - RNA, 10 nt, Human
uacagagaag

SEQ ID NO: 3728269 - RNA, 11 nt, Human
uacagagaagc

SEQ ID NO: 3728270 - RNA, 17 nt, Human
uacagagaagccagcuu

SEQ ID NO: 3728271 - RNA, 18 nt, Human
uacagagaagccagcuug

SEQ ID NO: 3728272 - RNA, 13 nt, Human
uacagagaagccu

SEQ ID NO: 3728273 - RNA, 14 nt, Human
uacagagaagccuu

SEQ ID NO: 3728274 - RNA, 17 nt, Human
uacagagaagccuucaa

SEQ ID NO: 3728275 - RNA, 21 nt, Human
uacagagaagccuucaagcuc

SEQ ID NO: 3728276 - RNA, 22 nt, Human
uacagagaagccuucaagcucu

SEQ ID NO: 3728277 - RNA, 14 nt, Human
uacagagaaggaau

SEQ ID NO: 3728278 - RNA, 13 nt, Human
uacagagaaguca

SEQ ID NO: 3728279 - RNA, 20 nt, Human
uacagagaagucacagggca

SEQ ID NO: 3728280 - RNA, 22 nt, Human
uacagagaagucacagggcagu

SEQ ID NO: 3728281 - RNA, 15 nt, Human
uacagagaagugaau

SEQ ID NO: 3728282 - RNA, 17 nt, Human
uacagagacagaaagca

SEQ ID NO: 3728283 - RNA, 22 nt, Human
uacagagccguaaaaacugaag

SEQ ID NO: 3728284 - RNA, 15 nt, Human
uacagagcuucccug

SEQ ID NO: 3728285 - RNA, 16 nt, Human
uacagagguauuaaaa

SEQ ID NO: 3728286 - RNA, 22 nt, Human
uacagaguggaauaagacagag

SEQ ID NO: 3728287 - RNA, 14 nt, Human
uacagauaaaaugu

SEQ ID NO: 3728288 - RNA, 15 nt, Human
uacagauaaaugauu

SEQ ID NO: 3728289 - RNA, 20 nt, Human
uacagauaaaugauucaaaa

SEQ ID NO: 3728290 - RNA, 21 nt, Human
uacagauaaaugauucaaaaa

SEQ ID NO: 3728291 - RNA, 19 nt, Human
uacagauagagaguuguug

SEQ ID NO: 3728292 - RNA, 12 nt, Human
uacagaugaaaa

SEQ ID NO: 3728293 - RNA, 15 nt, Human
uacagauuuugauag

SEQ ID NO: 3728294 - RNA, 21 nt, Human
uacagauuuugauagcaaagc

SEQ ID NO: 3728295 - RNA, 22 nt, Human
uacagauuuugauagcaaagcg

SEQ ID NO: 3728296 - RNA, 20 nt, Human
uacagcaacaauuuaugaau

SEQ ID NO: 3728297 - RNA, 24 nt, Human
uacagcaaggagauuuacaacugg

SEQ ID NO: 3728298 - RNA, 15 nt, Human
uacagcacuacucug

SEQ ID NO: 3728299 - RNA, 23 nt, Human
uacagcacuacugggugucauuu

SEQ ID NO: 3728300 - RNA, 14 nt, Human
uacagcaguagaca

SEQ ID NO: 3728301 - RNA, 16 nt, Human
uacagcauuacaaauu

SEQ ID NO: 3728302 - RNA, 22 nt, Human
uacagcauuacaaauugcuuac

SEQ ID NO: 3728303 - RNA, 12 nt, Human
uacagcccagag

SEQ ID NO: 3728304 - RNA, 19 nt, Human
uacagccccuuuuucauau

SEQ ID NO: 3728305 - RNA, 22 nt, Human
uacagccgagacucgacucugu

SEQ ID NO: 3728306 - RNA, 20 nt, Human
uacagccuuaauauuuuccu

SEQ ID NO: 3728307 - RNA, 14 nt, Human
uacagcgagaggca

SEQ ID NO: 3728308 - RNA, 16 nt, Human
uacagcuaugaagaaa

SEQ ID NO: 3728309 - RNA, 16 nt, Human
uacagcucccccagcu

SEQ ID NO: 3728310 - RNA, 17 nt, Human
uacagcucccccagcuc

SEQ ID NO: 3728311 - RNA, 14 nt, Human
uacagcuccuuuga

SEQ ID NO: 3728312 - RNA, 17 nt, Human
uacagcuggggugcagg

SEQ ID NO: 3728313 - RNA, 18 nt, Human
uacagcuguauugucuga

SEQ ID NO: 3728314 - RNA, 16 nt, Human
uacagcuguuuaagau

SEQ ID NO: 3728315 - RNA, 23 nt, Human
uacagcuugaccgugaggccaga

SEQ ID NO: 3728316 - RNA, 20 nt, Human
uacagcuuuacacacacaga

SEQ ID NO: 3728317 - RNA, 21 nt, Human
uacagcuuuacacacacagau

SEQ ID NO: 3728318 - RNA, 23 nt, Human
uacagcuuucugaccuucagcuc

SEQ ID NO: 3728319 - RNA, 23 nt, Human
uacagcuuucuugcucccuucag

SEQ ID NO: 3728320 - RNA, 15 nt, Human
uacaggaaacaguug

SEQ ID NO: 3728321 - RNA, 21 nt, Human
uacaggaagcaccccaugcca

SEQ ID NO: 3728322 - RNA, 14 nt, Human
uacaggaaguacug

SEQ ID NO: 3728323 - RNA, 15 nt, Human
uacaggaaguacugg

SEQ ID NO: 3728324 - RNA, 22 nt, Human
uacaggaaguacuggagaaaau

SEQ ID NO: 3728325 - RNA, 13 nt, Human
uacaggaaguccc

SEQ ID NO: 3728326 - RNA, 14 nt, Human
uacaggacauauau

SEQ ID NO: 3728327 - RNA, 15 nt, Human
uacaggagugagcac

SEQ ID NO: 3728328 - RNA, 14 nt, Human
uacaggauuugaaa

SEQ ID NO: 3728329 - RNA, 23 nt, Human
uacaggauuugaacucagaucug

SEQ ID NO: 3728330 - RNA, 13 nt, Human
uacaggcaauucc

SEQ ID NO: 3728331 - RNA, 14 nt, Human
uacaggcaauuccg

SEQ ID NO: 3728332 - RNA, 15 nt, Human
uacaggcagucucuc

SEQ ID NO: 3728333 - RNA, 14 nt, Human
uacaggcuccugcc

SEQ ID NO: 3728334 - RNA, 16 nt, Human
uacagggaaugccuga

SEQ ID NO: 3728335 - RNA, 17 nt, Human
uacagggagccuccugc

SEQ ID NO: 3728336 - RNA, 21 nt, Human
uacagggagccuccugcccag

SEQ ID NO: 3728337 - RNA, 17 nt, Human
uacagggaugguguuca

SEQ ID NO: 3728338 - RNA, 21 nt, Human
uacaggggaauauuuuauuca

SEQ ID NO: 3728339 - RNA, 13 nt, Human
uacaggggccaga

SEQ ID NO: 3728340 - RNA, 19 nt, Human
uacagggggucuggcuggu

SEQ ID NO: 3728341 - RNA, 24 nt, Human
uacaggguaacugugcugaaugcu

SEQ ID NO: 3728342 - RNA, 22 nt, Human
uacaggguagcagguaccacug

SEQ ID NO: 3728343 - RNA, 21 nt, Human
uacagguaaggugagggaaua

SEQ ID NO: 3728344 - RNA, 16 nt, Human
uacagguaccaguucu

SEQ ID NO: 3728345 - RNA, 15 nt, Human
uacagguacuuuguc

SEQ ID NO: 3728346 - RNA, 23 nt, Human
uacaggucauauuaauauauuuc

SEQ ID NO: 3728347 - RNA, 16 nt, Human
uacaggugugagucac

SEQ ID NO: 3728348 - RNA, 13 nt, Human
uacagguuacaac

SEQ ID NO: 3728349 - RNA, 17 nt, Human
uacagguuacaacagau

SEQ ID NO: 3728350 - RNA, 13 nt, Human
uagacucuuacuu

SEQ ID NO: 3728351 - RNA, 17 nt, Human
uagacugccagcucuuc

SEQ ID NO: 3728352 - RNA, 19 nt, Human
uagacuggaacuugaacug

SEQ ID NO: 3728353 - RNA, 16 nt, Human
uagacuggaaguucau

SEQ ID NO: 3728354 - RNA, 16 nt, Human
uagacuggacagcuug

SEQ ID NO: 3728355 - RNA, 18 nt, Human
uagacuggacagcuugug

SEQ ID NO: 3728356 - RNA, 17 nt, Human
uagacuggugacugauu

SEQ ID NO: 3728357 - RNA, 18 nt, Human
uagacuggugacugauuc

SEQ ID NO: 3728358 - RNA, 24 nt, Human
uagacuucagggagucagcuguuu

SEQ ID NO: 3728359 - RNA, 13 nt, Human
uagacuugaaaag

SEQ ID NO: 3728360 - RNA, 23 nt, Human
uagacuugaaaagagacaggcag

SEQ ID NO: 3728361 - RNA, 15 nt, Human
uagacuugaaauacu

SEQ ID NO: 3728362 - RNA, 21 nt, Human
uagacuuuaacauaagcuauu

SEQ ID NO: 3728363 - RNA, 18 nt, Human
uagacuuuagaaauaaau

SEQ ID NO: 3728364 - RNA, 15 nt, Human
uagacuuuaggcuuu

SEQ ID NO: 3728365 - RNA, 14 nt, Human
uagacuuuuccaau

SEQ ID NO: 3728366 - RNA, 20 nt, Human
uagacuuuuccaauauguga

SEQ ID NO: 3728367 - RNA, 23 nt, Human
uagacuuuuccaauaugugauuu

SEQ ID NO: 3728368 - RNA, 19 nt, Human
uagagaacgcagcccuaga

SEQ ID NO: 3728369 - RNA, 15 nt, Human
uagagaacugaaaag

SEQ ID NO: 3728370 - RNA, 16 nt, Human
uagagaacugaaaaga

SEQ ID NO: 3728371 - RNA, 15 nt, Human
uagagaagacaggcu

SEQ ID NO: 3728372 - RNA, 15 nt, Human
uagagaaugagaaau

SEQ ID NO: 3728373 - RNA, 15 nt, Human
uagagacagaagcag

SEQ ID NO: 3728374 - RNA, 18 nt, Human
uagagacagaagcaggcu

SEQ ID NO: 3728375 - RNA, 17 nt, Human
uagagaggaagauugaa

SEQ ID NO: 3728376 - RNA, 21 nt, Human
uagagaggacaauacuggggu

SEQ ID NO: 3728377 - RNA, 22 nt, Human
uagagaggacaauacugggguu

SEQ ID NO: 3728378 - RNA, 16 nt, Human
uagagagggagaagaa

SEQ ID NO: 3728379 - RNA, 19 nt, Human
uagagagggagaagaaguc

SEQ ID NO: 3728380 - RNA, 15 nt, Human
uagagaguguugaaa

SEQ ID NO: 3728381 - RNA, 22 nt, Human
uagagauauuuuguaaaaugua

SEQ ID NO: 3728382 - RNA, 20 nt, Human
uagagaucauccuuuccagc

SEQ ID NO: 3728383 - RNA, 23 nt, Human
uagagaucauccuuuccagcaug

SEQ ID NO: 3728384 - RNA, 23 nt, Human
uagagaugaaguuuguaguuguu

SEQ ID NO: 3728385 - RNA, 21 nt, Human
uagagaugagcuuucuuuuua

SEQ ID NO: 3728386 - RNA, 23 nt, Human
uagagaugcuguaacuuaaaaua

SEQ ID NO: 3728387 - RNA, 17 nt, Human
uagagauggagucuugc

SEQ ID NO: 3728388 - RNA, 21 nt, Human
uagagaugugcaauugauuuc

SEQ ID NO: 3728389 - RNA, 19 nt, Human
uagagauguuuuuaaaagu

SEQ ID NO: 3728390 - RNA, 23 nt, Human
uagagauguuuuuaaaaguuuca

SEQ ID NO: 3728391 - RNA, 17 nt, Human
uagagauuaccuccuga

SEQ ID NO: 3728392 - RNA, 18 nt, Human
uagagauuaccuccugag

SEQ ID NO: 3728393 - RNA, 21 nt, Human
uagagauuaccuccugagaaa

SEQ ID NO: 3728394 - RNA, 16 nt, Human
uagagauuugucuaau

SEQ ID NO: 3728395 - RNA, 23 nt, Human
uagagauuuuuuuguuguuuguu

SEQ ID NO: 3728396 - RNA, 14 nt, Human
uagagcaaaauuga

SEQ ID NO: 3728397 - RNA, 16 nt, Human
uagagcacacuguagc

SEQ ID NO: 3728398 - RNA, 14 nt, Human
uagagcacugccac

SEQ ID NO: 3728399 - RNA, 16 nt, Human
uagagcacugccacca

SEQ ID NO: 3728400 - RNA, 17 nt, Human
uagagcacugccaccag

SEQ ID NO: 3728401 - RNA, 12 nt, Human
uagagcagaaau

SEQ ID NO: 3728402 - RNA, 13 nt, Human
uagagcagaaauu

SEQ ID NO: 3728403 - RNA, 15 nt, Human
uagagcagaaauucu

SEQ ID NO: 3728404 - RNA, 14 nt, Human
uagagcagcccugg

SEQ ID NO: 3728405 - RNA, 14 nt, Human
uagagcagggcaag

SEQ ID NO: 3728406 - RNA, 17 nt, Human
uagagcaguuucugucc

SEQ ID NO: 3728407 - RNA, 16 nt, Human
uagagcauugccauuc

SEQ ID NO: 3728408 - RNA, 19 nt, Human
uagagccaggcacacacug

SEQ ID NO: 3728409 - RNA, 18 nt, Human
uagagccugccuggagcg

SEQ ID NO: 3728410 - RNA, 17 nt, Human
uagagccugcuggaucu

SEQ ID NO: 3728411 - RNA, 18 nt, Human
uagagcugauccagagca

SEQ ID NO: 3728412 - RNA, 20 nt, Human
uagagcuguauuaagccacu

SEQ ID NO: 3728413 - RNA, 17 nt, Human
uagagcuguucaacauc

SEQ ID NO: 3728414 - RNA, 22 nt, Human
uagagcuguucaacaucacuga

SEQ ID NO: 3728415 - RNA, 22 nt, Human
uagaggaaaaaaaugacuaaaa

SEQ ID NO: 3728416 - RNA, 23 nt, Human
uagaggcaguucgaccagccagg

SEQ ID NO: 3728417 - RNA, 15 nt, Human
uagaggccugaggau

SEQ ID NO: 3728418 - RNA, 17 nt, Human
uagaggcuuccuucauu

SEQ ID NO: 3728419 - RNA, 19 nt, Human
uagaggcuuccuucauuuc

SEQ ID NO: 3728420 - RNA, 20 nt, Human
uagaggcuucuccgccagcc

SEQ ID NO: 3728421 - RNA, 22 nt, Human
uagaggcuucuccgccagccuc

SEQ ID NO: 3728422 - RNA, 19 nt, Human
uagagggaccucucccagg

SEQ ID NO: 3728423 - RNA, 24 nt, Human
uagaggggaaaagagaugaugaaa

SEQ ID NO: 3728424 - RNA, 23 nt, Human
uagaggggggauuuccagccagg

SEQ ID NO: 3728425 - RNA, 17 nt, Human
uagagggugcugcccca

SEQ ID NO: 3728426 - RNA, 17 nt, Human
uagaggguuccuguaga

SEQ ID NO: 3728427 - RNA, 15 nt, Human
uagagguauaauugu

SEQ ID NO: 3728428 - RNA, 21 nt, Human
uagagguauaauugugugaua

SEQ ID NO: 3728429 - RNA, 16 nt, Human
uagaggugagaaauuu

SEQ ID NO: 3728430 - RNA, 19 nt, Human
uagaguaaaaagaaaacaa

SEQ ID NO: 3728431 - RNA, 19 nt, Human
uagaguagaagauuugaug

SEQ ID NO: 3728432 - RNA, 14 nt, Human
uagaguauaugcac

SEQ ID NO: 3728433 - RNA, 13 nt, Human
uagagucagccuu

SEQ ID NO: 3728434 - RNA, 22 nt, Human
uagagucaucuccaucagcugu

SEQ ID NO: 3728435 - RNA, 16 nt, Human
uagagucauuguaaug

SEQ ID NO: 3728436 - RNA, 13 nt, Human
uagaguccaaggu

SEQ ID NO: 3728437 - RNA, 17 nt, Human
uagagucugaacagcug

SEQ ID NO: 3728438 - RNA, 21 nt, Human
uagagucugagggcuuguagu

SEQ ID NO: 3728439 - RNA, 15 nt, Human
uagagugagggccug

SEQ ID NO: 3728440 - RNA, 19 nt, Human
uagagugagggccugaggu

SEQ ID NO: 3728441 - RNA, 20 nt, Human
uagaguguaguuuacagaaa

SEQ ID NO: 3728442 - RNA, 15 nt, Human
uagagugucuuucca

SEQ ID NO: 3728443 - RNA, 15 nt, Human
uagaguuaacaauga

SEQ ID NO: 3728444 - RNA, 19 nt, Human
uagaguuaagaagcuguug

SEQ ID NO: 3728445 - RNA, 14 nt, Human
uagaguuagacugu

SEQ ID NO: 3728446 - RNA, 17 nt, Human
uagaguugauacuacag

SEQ ID NO: 3728447 - RNA, 13 nt, Human
uagaguugcugag

SEQ ID NO: 3728448 - RNA, 14 nt, Human
uagaguugcugaga

SEQ ID NO: 3728449 - RNA, 14 nt, Human
uagaguuggccaua

SEQ ID NO: 3728450 - RNA, 21 nt, Human
uagaguuuagcccugaacauu

SEQ ID NO: 3728451 - RNA, 17 nt, Human
uagaguuuagcuggaaa

SEQ ID NO: 3728452 - RNA, 15 nt, Human
uagaguuucuguuug

SEQ ID NO: 3728453 - RNA, 20 nt, Human
uagauaaaacaucuuugaaa

SEQ ID NO: 3728454 - RNA, 12 nt, Human
uagauaaacuca

SEQ ID NO: 3728455 - RNA, 19 nt, Human
uagauaaauauuugacuug

SEQ ID NO: 3728456 - RNA, 19 nt, Human
uagauaacgcuuaaaggaa

SEQ ID NO: 3728457 - RNA, 15 nt, Human
uagauaacucuuugg

SEQ ID NO: 3728458 - RNA, 15 nt, Human
uagauaauuaaccaa

SEQ ID NO: 3728459 - RNA, 17 nt, Human
uagauacaaucagcugc

SEQ ID NO: 3728460 - RNA, 19 nt, Human
uagauacaaucagcugcuu

SEQ ID NO: 3728461 - RNA, 22 nt, Human
uagauacaaucagcugcuuugu

SEQ ID NO: 3728462 - RNA, 22 nt, Human
uagauacccuacgcuguccaga

SEQ ID NO: 3728463 - RNA, 20 nt, Human
uagauacuuugcuagccggc

SEQ ID NO: 3728464 - RNA, 15 nt, Human
uagauagcagccugg

SEQ ID NO: 3728465 - RNA, 15 nt, Human
uagauagcccugucc

SEQ ID NO: 3728466 - RNA, 22 nt, Human
uagauaggucagugcaaauacu

SEQ ID NO: 3728467 - RNA, 17 nt, Human
uagauaguuagaaccug

SEQ ID NO: 3728468 - RNA, 15 nt, Human
uagauauaugcucug

SEQ ID NO: 3728469 - RNA, 19 nt, Human
uagauauccacuugagaca

SEQ ID NO: 3728470 - RNA, 15 nt, Human
uagauaucuuuuuau

SEQ ID NO: 3728471 - RNA, 21 nt, Human
uagauaucuuuuuauugaugu

SEQ ID NO: 3728472 - RNA, 16 nt, Human
uagauauuggacaaag

SEQ ID NO: 3728473 - RNA, 15 nt, Human
uagauauuuuucaua

SEQ ID NO: 3728474 - RNA, 21 nt, Human
uagauauuuuucauaaacaag

SEQ ID NO: 3728475 - RNA, 14 nt, Human
uagaucaaauacuu

SEQ ID NO: 3728476 - RNA, 23 nt, Human
uagaucaaauacuuuaaaggaaa

SEQ ID NO: 3728477 - RNA, 13 nt, Human
uagaucagaacag

SEQ ID NO: 3728478 - RNA, 14 nt, Human
uagaucagaugcuc

SEQ ID NO: 3728479 - RNA, 18 nt, Human
uagaucagaugcuccaag

SEQ ID NO: 3728480 - RNA, 19 nt, Human
uagaucauaguuuuauuua

SEQ ID NO: 3728481 - RNA, 19 nt, Human
uagaucauuuguucuggga

SEQ ID NO: 3728482 - RNA, 14 nt, Human
uagaucuaguucac

SEQ ID NO: 3728483 - RNA, 15 nt, Human
uagaucuggcauguu

SEQ ID NO: 3728484 - RNA, 18 nt, Human
uagaugaaaaagcaugua

SEQ ID NO: 3728485 - RNA, 21 nt, Human
uagaugaaaaagcauguacag

SEQ ID NO: 3728486 - RNA, 16 nt, Human
uagaugaaguuuuaca

SEQ ID NO: 3728487 - RNA, 22 nt, Human
uagaugaccucauuaaccgaug

SEQ ID NO: 3728488 - RNA, 22 nt, Human
uagaugagaauucagcugcccc

SEQ ID NO: 3728489 - RNA, 19 nt, Human
uagaugauuaaauaagauu

SEQ ID NO: 3728490 - RNA, 23 nt, Human
uagaugauuaaauaagauucuaa

SEQ ID NO: 3728491 - RNA, 18 nt, Human
uagaugauuuuuugaaag

SEQ ID NO: 3728492 - RNA, 22 nt, Human
uagaugauuuuuugaaaguuaa

SEQ ID NO: 3728493 - RNA, 16 nt, Human
uagaugcacuuaugca

SEQ ID NO: 3728494 - RNA, 17 nt, Human
uagaugcaguucugaag

SEQ ID NO: 3728495 - RNA, 20 nt, Human
uagaugcaguucugaagaag

SEQ ID NO: 3728496 - RNA, 19 nt, Human
uagaugcauguugaccaug

SEQ ID NO: 3728497 - RNA, 15 nt, Human
uagaugcauuugggu

SEQ ID NO: 3728498 - RNA, 13 nt, Human
uacaguaacuuua

SEQ ID NO: 3728499 - RNA, 13 nt, Human
uacaguaauaaau

SEQ ID NO: 3728500 - RNA, 15 nt, Human
uacaguacaggcagc

SEQ ID NO: 3728501 - RNA, 14 nt, Human
uacaguaggagccc

SEQ ID NO: 3728502 - RNA, 18 nt, Human
uacaguaggagcccagcu

SEQ ID NO: 3728503 - RNA, 21 nt, Human
uacaguagugagaagaauauu

SEQ ID NO: 3728504 - RNA, 19 nt, Human
uacaguauaauuaacaugu

SEQ ID NO: 3728505 - RNA, 15 nt, Human
uacaguauagauuuu

SEQ ID NO: 3728506 - RNA, 18 nt, Human
uacaguaucucagggccu

SEQ ID NO: 3728507 - RNA, 15 nt, Human
uacaguaugcuugcu

SEQ ID NO: 3728508 - RNA, 22 nt, Human
uacaguauggggguuguaaauu

SEQ ID NO: 3728509 - RNA, 12 nt, Human
uacaguccuccc

SEQ ID NO: 3728510 - RNA, 15 nt, Human
uacaguccucccauc

SEQ ID NO: 3728511 - RNA, 17 nt, Human
uacaguccucccaucuc

SEQ ID NO: 3728512 - RNA, 18 nt, Human
uacaguccucccaucuca

SEQ ID NO: 3728513 - RNA, 19 nt, Human
uacagucugucuucuguau

SEQ ID NO: 3728514 - RNA, 20 nt, Human
uacagucugucuucuguaua

SEQ ID NO: 3728515 - RNA, 21 nt, Human
uacagugaaaauguaagcugu

SEQ ID NO: 3728516 - RNA, 14 nt, Human
uacagugagccaag

SEQ ID NO: 3728517 - RNA, 21 nt, Human
uacagugcagagccuucucag

SEQ ID NO: 3728518 - RNA, 22 nt, Human
uacagugcauaguuguagacaa

SEQ ID NO: 3728519 - RNA, 23 nt, Human
uacaguggaaccguugccaaccg

SEQ ID NO: 3728520 - RNA, 16 nt, Human
uacaguguacagucuu

SEQ ID NO: 3728521 - RNA, 12 nt, Human
uacagugucuuu

SEQ ID NO: 3728522 - RNA, 13 nt, Human
uacagugucuuuu

SEQ ID NO: 3728523 - RNA, 23 nt, Human
uacagugucuuuuuuuguauagu

SEQ ID NO: 3728524 - RNA, 19 nt, Human
uacaguuacucagaauucu

SEQ ID NO: 3728525 - RNA, 15 nt, Human
uacaguuacuuuucc

SEQ ID NO: 3728526 - RNA, 13 nt, Human
uacaguuauaaaa

SEQ ID NO: 3728527 - RNA, 17 nt, Human
uacaguuauaaaauuaa

SEQ ID NO: 3728528 - RNA, 16 nt, Human
uacaguucaauaaacu

SEQ ID NO: 3728529 - RNA, 12 nt, Human
uacaguucuucg

SEQ ID NO: 3728530 - RNA, 21 nt, Human
uacaguucuucgggaagagag

SEQ ID NO: 3728531 - RNA, 22 nt, Human
uacaguucuucgggaagagagg

SEQ ID NO: 3728532 - RNA, 17 nt, Human
uacaguugaaauaacug

SEQ ID NO: 3728533 - RNA, 16 nt, Human
uacaguuguuggccuc

SEQ ID NO: 3728534 - RNA, 12 nt, Human
uacaguuucaaa

SEQ ID NO: 3728535 - RNA, 15 nt, Human
uacaguuugcuguac

SEQ ID NO: 3728536 - RNA, 16 nt, Human
uacaguuugcuguacu

SEQ ID NO: 3728537 - RNA, 23 nt, Human
uacaguuuggggcaagucaugua

SEQ ID NO: 3728538 - RNA, 17 nt, Human
uacaguuuguuuacaca

SEQ ID NO: 3728539 - RNA, 14 nt, Human
uacaguuuuaaaga

SEQ ID NO: 3728540 - RNA, 17 nt, Human
uacaguuuuaacugugg

SEQ ID NO: 3728541 - RNA, 21 nt, Human
uacaguuuuaacuguggauau

SEQ ID NO: 3728542 - RNA, 14 nt, Human
uacaguuuuccuaa

SEQ ID NO: 3728543 - RNA, 22 nt, Human
uacaguuuuccuaaauguauac

SEQ ID NO: 3728544 - RNA, 17 nt, Human
uacauaaaagaaauaaa

SEQ ID NO: 3728545 - RNA, 14 nt, Human
uacauaaacaauga

SEQ ID NO: 3728546 - RNA, 21 nt, Human
uacauaaauugcauaaagcau

SEQ ID NO: 3728547 - RNA, 22 nt, Human
uacauaaauugcauaaagcaua

SEQ ID NO: 3728548 - RNA, 13 nt, Human
uacauaacuaaau

SEQ ID NO: 3728549 - RNA, 20 nt, Human
uacauaacucuguaaaaaca

SEQ ID NO: 3728550 - RNA, 23 nt, Human
uacauaacucuguaaaaacacug

SEQ ID NO: 3728551 - RNA, 15 nt, Human
uacauaacugaaaau

SEQ ID NO: 3728552 - RNA, 13 nt, Human
uacauaacugccu

SEQ ID NO: 3728553 - RNA, 22 nt, Human
uacauaacugccuugaaccugu

SEQ ID NO: 3728554 - RNA, 17 nt, Human
uacauaagauaaaugug

SEQ ID NO: 3728555 - RNA, 19 nt, Human
uacauaaguaauucaagaa

SEQ ID NO: 3728556 - RNA, 12 nt, Human
uacauaaucugu

SEQ ID NO: 3728557 - RNA, 15 nt, Human
uacauaaugcgugca

SEQ ID NO: 3728558 - RNA, 21 nt, Human
uacauaaugcgugcauaccac

SEQ ID NO: 3728559 - RNA, 23 nt, Human
uacauaaugcgugcauaccacuu

SEQ ID NO: 3728560 - RNA, 14 nt, Human
uacauacaccagca

SEQ ID NO: 3728561 - RNA, 15 nt, Human
uacauacaccagcau

SEQ ID NO: 3728562 - RNA, 20 nt, Human
uacauacaccagcauuccuu

SEQ ID NO: 3728563 - RNA, 22 nt, Human
uacauacacuuguauaaaugua

SEQ ID NO: 3728564 - RNA, 22 nt, Human
uacauacccuggccgcccccug

SEQ ID NO: 3728565 - RNA, 19 nt, Human
uacauacgauuuaagguau

SEQ ID NO: 3728566 - RNA, 15 nt, Human
uacauacggucaggu

SEQ ID NO: 3728567 - RNA, 22 nt, Human
uacauacggucagguuuaacau

SEQ ID NO: 3728568 - RNA, 15 nt, Human
uacauacugcaucuu

SEQ ID NO: 3728569 - RNA, 23 nt, Human
uacauacuuucauccugacucug

SEQ ID NO: 3728570 - RNA, 14 nt, Human
uacauacuuuuugg

SEQ ID NO: 3728571 - RNA, 22 nt, Human
uacauagauuuauuuuucaguu

SEQ ID NO: 3728572 - RNA, 23 nt, Human
uacauagcaugacauuucuuugu

SEQ ID NO: 3728573 - RNA, 21 nt, Human
uacauagccuauauuuacagu

SEQ ID NO: 3728574 - RNA, 15 nt, Human
uacauaggcagcacu

SEQ ID NO: 3728575 - RNA, 16 nt, Human
uacauagucugaagug

SEQ ID NO: 3728576 - RNA, 13 nt, Human
uacauagugaaaa

SEQ ID NO: 3728577 - RNA, 21 nt, Human
uacauagugcauuguuucugu

SEQ ID NO: 3728578 - RNA, 22 nt, Human
uacauagugcauuguuucugug

SEQ ID NO: 3728579 - RNA, 22 nt, Human
uacauaguguaggcuuuacuua

SEQ ID NO: 3728580 - RNA, 15 nt, Human
uacauaguuuuaaac

SEQ ID NO: 3728581 - RNA, 19 nt, Human
uacauaguuuuaaacucau

SEQ ID NO: 3728582 - RNA, 20 nt, Human
uacauauaaaauguaauuac

SEQ ID NO: 3728583 - RNA, 22 nt, Human
uacauauaagugauugcugguu

SEQ ID NO: 3728584 - RNA, 18 nt, Human
uacauauauauauauaac

SEQ ID NO: 3728585 - RNA, 14 nt, Human
uacauauauauauu

SEQ ID NO: 3728586 - RNA, 18 nt, Human
uacauaucaccucauggc

SEQ ID NO: 3728587 - RNA, 16 nt, Human
uacauaucccuuccag

SEQ ID NO: 3728588 - RNA, 12 nt, Human
uacauaucuuua

SEQ ID NO: 3728589 - RNA, 16 nt, Human
uacauaugagugugga

SEQ ID NO: 3728590 - RNA, 15 nt, Human
uacauaugauaaauu

SEQ ID NO: 3728591 - RNA, 13 nt, Human
uacauaugcuuua

SEQ ID NO: 3728592 - RNA, 19 nt, Human
uacauauggauguuacucu

SEQ ID NO: 3728593 - RNA, 12 nt, Human
uacauauguaaa

SEQ ID NO: 3728594 - RNA, 16 nt, Human
uacauauguaaaauaa

SEQ ID NO: 3728595 - RNA, 19 nt, Human
uacaucacugcuugaugaa

SEQ ID NO: 3728596 - RNA, 20 nt, Human
uacaucaguuauucauucug

SEQ ID NO: 3728597 - RNA, 22 nt, Human
uacaucaugcuggaaccugcaa

SEQ ID NO: 3728598 - RNA, 22 nt, Human
uacauccucaugcagccgugau

SEQ ID NO: 3728599 - RNA, 13 nt, Human
uacauccuugugg

SEQ ID NO: 3728600 - RNA, 14 nt, Human
uacaucgcccucca

SEQ ID NO: 3728601 - RNA, 20 nt, Human
uacaucuauuuuggauugua

SEQ ID NO: 3728602 - RNA, 22 nt, Human
uacaucuauuuuggauuguaua

SEQ ID NO: 3728603 - RNA, 23 nt, Human
uacaucuauuuuggauuguauau

SEQ ID NO: 3728604 - RNA, 20 nt, Human
uacaucuggcuuauuuuaau

SEQ ID NO: 3728605 - RNA, 13 nt, Human
uacaucugucaug

SEQ ID NO: 3728606 - RNA, 18 nt, Human
uacaugaaaacacauuuu

SEQ ID NO: 3728607 - RNA, 19 nt, Human
uacaugaaaacacauuuuu

SEQ ID NO: 3728608 - RNA, 15 nt, Human
uacaugaaacagaaa

SEQ ID NO: 3728609 - RNA, 19 nt, Human
uacaugaaauuuuuguaaa

SEQ ID NO: 3728610 - RNA, 20 nt, Human
uacaugaaauuuuuguaaau

SEQ ID NO: 3728611 - RNA, 21 nt, Human
uacaugaagaauagaaacaag

SEQ ID NO: 3728612 - RNA, 16 nt, Human
uacaugacauuuauuu

SEQ ID NO: 3728613 - RNA, 22 nt, Human
uacaugagaacagacuggccug

SEQ ID NO: 3728614 - RNA, 21 nt, Human
uacaugaggacucuauucuuu

SEQ ID NO: 3728615 - RNA, 23 nt, Human
uacaugaggacucuauucuuuaa

SEQ ID NO: 3728616 - RNA, 19 nt, Human
uacaugcaaaaagaaauga

SEQ ID NO: 3728617 - RNA, 16 nt, Human
uacaugcaauuuauua

SEQ ID NO: 3728618 - RNA, 20 nt, Human
uacaugcaauuuauuaaaau

SEQ ID NO: 3728619 - RNA, 18 nt, Human
uacaugcacacucaugug

SEQ ID NO: 3728620 - RNA, 22 nt, Human
uacaugcagcccaugcccaccu

SEQ ID NO: 3728621 - RNA, 17 nt, Human
uacaugcauacaaagag

SEQ ID NO: 3728622 - RNA, 21 nt, Human
uacaugcauacacucucaaag

SEQ ID NO: 3728623 - RNA, 19 nt, Human
uacaugcauacuucaaaag

SEQ ID NO: 3728624 - RNA, 14 nt, Human
uacaugcauauaau

SEQ ID NO: 3728625 - RNA, 20 nt, Human
uacaugcauuacugcaugca

SEQ ID NO: 3728626 - RNA, 22 nt, Human
uacaugcauugagcucucucau

SEQ ID NO: 3728627 - RNA, 17 nt, Human
uacaugccacaucaaac

SEQ ID NO: 3728628 - RNA, 16 nt, Human
uacaugccauugaaaa

SEQ ID NO: 3728629 - RNA, 18 nt, Human
uacauggaauaacaugua

SEQ ID NO: 3728630 - RNA, 19 nt, Human
uacauggaauaacauguaa

SEQ ID NO: 3728631 - RNA, 17 nt, Human
uacauggacagaauuuu

SEQ ID NO: 3728632 - RNA, 23 nt, Human
uacauggcuggagcuagaauuug

SEQ ID NO: 3728633 - RNA, 17 nt, Human
uacauggguagcuucug

SEQ ID NO: 3728634 - RNA, 16 nt, Human
uacaugguugugaccu

SEQ ID NO: 3728635 - RNA, 19 nt, Human
uacauguaaaacauuaucu

SEQ ID NO: 3728636 - RNA, 17 nt, Human
uacauguacugauuacu

SEQ ID NO: 3728637 - RNA, 19 nt, Human
uacauguaucaagccuaga

SEQ ID NO: 3728638 - RNA, 19 nt, Human
uacauguauugcacauugu

SEQ ID NO: 3728639 - RNA, 20 nt, Human
uacauguauugcacauugua

SEQ ID NO: 3728640 - RNA, 22 nt, Human
uacauguauugcacauuguaaa

SEQ ID NO: 3728641 - RNA, 19 nt, Human
uacaugugauacauuuuuu

SEQ ID NO: 3728642 - RNA, 16 nt, Human
uacauguggcccaaca

SEQ ID NO: 3728643 - RNA, 16 nt, Human
uacauguguagccugu

SEQ ID NO: 3728644 - RNA, 19 nt, Human
uacauguguagccugugca

SEQ ID NO: 3728645 - RNA, 18 nt, Human
uacauguuuauguaaaca

SEQ ID NO: 3728646 - RNA, 19 nt, Human
uagaugcauuuggguccag

SEQ ID NO: 3728647 - RNA, 18 nt, Human
uagaugcuggcccagggc

SEQ ID NO: 3728648 - RNA, 21 nt, Human
uagaugcuggcccagggccca

SEQ ID NO: 3728649 - RNA, 14 nt, Human
uagauggauucucc

SEQ ID NO: 3728650 - RNA, 14 nt, Human
uagauggcuccucu

SEQ ID NO: 3728651 - RNA, 17 nt, Human
uagaugggaaugaagcu

SEQ ID NO: 3728652 - RNA, 23 nt, Human
uagaugggaaugaagcuugugua

SEQ ID NO: 3728653 - RNA, 21 nt, Human
uagaugggagggaggcucagg

SEQ ID NO: 3728654 - RNA, 22 nt, Human
uagaugggggaaagcaaagcac

SEQ ID NO: 3728655 - RNA, 22 nt, Human
uagaugggucuggcugagcuga

SEQ ID NO: 3728656 - RNA, 16 nt, Human
uagauggugcugagaa

SEQ ID NO: 3728657 - RNA, 18 nt, Human
uagaugguuacacuguua

SEQ ID NO: 3728658 - RNA, 23 nt, Human
uagauguagauaaacucagaaau

SEQ ID NO: 3728659 - RNA, 20 nt, Human
uagauguaugcacacacaua

SEQ ID NO: 3728660 - RNA, 22 nt, Human
uagauguaugcacacacauaua

SEQ ID NO: 3728661 - RNA, 22 nt, Human
uagaugucccuuucuuggccag

SEQ ID NO: 3728662 - RNA, 21 nt, Human
uagaugucuagguacuucagg

SEQ ID NO: 3728663 - RNA, 21 nt, Human
uagaugucuuuaggcagcagc

SEQ ID NO: 3728664 - RNA, 13 nt, Human
uagaugucuuuuc

SEQ ID NO: 3728665 - RNA, 21 nt, Human
uagaugugauuuaauaguguu

SEQ ID NO: 3728666 - RNA, 23 nt, Human
uagauguucucuaucauuuaaua

SEQ ID NO: 3728667 - RNA, 13 nt, Human
uagauguugcuaa

SEQ ID NO: 3728668 - RNA, 13 nt, Human
uagauguuuuaua

SEQ ID NO: 3728669 - RNA, 20 nt, Human
uagauguuuugguagauuaa

SEQ ID NO: 3728670 - RNA, 18 nt, Human
uagauuaaauauagauua

SEQ ID NO: 3728671 - RNA, 18 nt, Human
uagauuaagagauggguu

SEQ ID NO: 3728672 - RNA, 23 nt, Human
uagauuaauacucuauuuuuaca

SEQ ID NO: 3728673 - RNA, 16 nt, Human
uagauuaauggcacug

SEQ ID NO: 3728674 - RNA, 18 nt, Human
uagauuaauggcacugau

SEQ ID NO: 3728675 - RNA, 21 nt, Human
uagauuacccccucauuguuu

SEQ ID NO: 3728676 - RNA, 17 nt, Human
uagauuagaauucugua

SEQ ID NO: 3728677 - RNA, 19 nt, Human
uagauuagaauucuguaua

SEQ ID NO: 3728678 - RNA, 20 nt, Human
uagauuagaauucuguauag

SEQ ID NO: 3728679 - RNA, 20 nt, Human
uagauuagagaguguugaaa

SEQ ID NO: 3728680 - RNA, 14 nt, Human
uagauuagcucugg

SEQ ID NO: 3728681 - RNA, 18 nt, Human
uagauuagcucuggacca

SEQ ID NO: 3728682 - RNA, 22 nt, Human
uagauuaguacuggauuauuca

SEQ ID NO: 3728683 - RNA, 18 nt, Human
uagauuauauugagacaa

SEQ ID NO: 3728684 - RNA, 22 nt, Human
uagauuauauugagacaaaaau

SEQ ID NO: 3728685 - RNA, 16 nt, Human
uagauuauggagcuuu

SEQ ID NO: 3728686 - RNA, 15 nt, Human
uagauucaccuguaa

SEQ ID NO: 3728687 - RNA, 21 nt, Human
uagauucaccuguaaaacuuu

SEQ ID NO: 3728688 - RNA, 19 nt, Human
uagauucagguaauacaaa

SEQ ID NO: 3728689 - RNA, 20 nt, Human
uagauuccauugguccaaga

SEQ ID NO: 3728690 - RNA, 21 nt, Human
uagauuccauugguccaagau

SEQ ID NO: 3728691 - RNA, 21 nt, Human
uagauuccauuuacugcauuc

SEQ ID NO: 3728692 - RNA, 11 nt, Human
uagauucuaaa

SEQ ID NO: 3728693 - RNA, 12 nt, Human
uagauucuaaag

SEQ ID NO: 3728694 - RNA, 14 nt, Human
uagauucuaaagau

SEQ ID NO: 3728695 - RNA, 17 nt, Human
uagauucuaaagauucu

SEQ ID NO: 3728696 - RNA, 18 nt, Human
uagauucuaaagauucua

SEQ ID NO: 3728697 - RNA, 20 nt, Human
uagauucuacauauucuuua

SEQ ID NO: 3728698 - RNA, 23 nt, Human
uagauucucuuguauaagauccu

SEQ ID NO: 3728699 - RNA, 23 nt, Human
uagauugaaaacuuuucucagau

SEQ ID NO: 3728700 - RNA, 21 nt, Human
uagauugagaaguuuuguaca

SEQ ID NO: 3728701 - RNA, 23 nt, Human
uagauugauuguauuguugaaaa

SEQ ID NO: 3728702 - RNA, 12 nt, Human
uagauugcagaa

SEQ ID NO: 3728703 - RNA, 20 nt, Human
uagauuguccuuuugcaaag

SEQ ID NO: 3728704 - RNA, 23 nt, Human
uagauuguccuuuugcaaagaaa

SEQ ID NO: 3728705 - RNA, 16 nt, Human
uagauuuaauauaaag

SEQ ID NO: 3728706 - RNA, 14 nt, Human
uagauuuaguguaa

SEQ ID NO: 3728707 - RNA, 14 nt, Human
uagauuuauuucau

SEQ ID NO: 3728708 - RNA, 22 nt, Human
uagauuucauaguucagaauuu

SEQ ID NO: 3728709 - RNA, 13 nt, Human
uagauuucugauu

SEQ ID NO: 3728710 - RNA, 15 nt, Human
uagauuuguuuugug

SEQ ID NO: 3728711 - RNA, 14 nt, Human
uagauuuuacauga

SEQ ID NO: 3728712 - RNA, 16 nt, Human
uagauuuuacaugaag

SEQ ID NO: 3728713 - RNA, 20 nt, Human
uagauuuuacaugaaguauu

SEQ ID NO: 3728714 - RNA, 21 nt, Human
uagauuuuacaugaaguauuu

SEQ ID NO: 3728715 - RNA, 22 nt, Human
uagauuuuagacccuauugcug

SEQ ID NO: 3728716 - RNA, 19 nt, Human
uagauuuuauaguguguug

SEQ ID NO: 3728717 - RNA, 14 nt, Human
uagauuuucauguu

SEQ ID NO: 3728718 - RNA, 22 nt, Human
uagauuuucugguucuaacauu

SEQ ID NO: 3728719 - RNA, 14 nt, Human
uagauuuucuuuaa

SEQ ID NO: 3728720 - RNA, 15 nt, Human
uagauuuuguguuua

SEQ ID NO: 3728721 - RNA, 21 nt, Human
uagauuuuguguuuauucuug

SEQ ID NO: 3728722 - RNA, 15 nt, Human
uagauuuuguuuugc

SEQ ID NO: 3728723 - RNA, 12 nt, Human
uagauuuuuuca

SEQ ID NO: 3728724 - RNA, 22 nt, Human
uagcaaaacgcauggagugugu

SEQ ID NO: 3728725 - RNA, 22 nt, Human
uagcaaaacuaaauacuugcuc

SEQ ID NO: 3728726 - RNA, 19 nt, Human
uagcaaaacuuuuaaacua

SEQ ID NO: 3728727 - RNA, 14 nt, Human
uagcaaaagaagaa

SEQ ID NO: 3728728 - RNA, 16 nt, Human
uagcaaaagaagaagu

SEQ ID NO: 3728729 - RNA, 12 nt, Human
uagcaaacagag

SEQ ID NO: 3728730 - RNA, 19 nt, Human
uagcaaacccugucaaaca

SEQ ID NO: 3728731 - RNA, 20 nt, Human
uagcaaacccugucaaacau

SEQ ID NO: 3728732 - RNA, 21 nt, Human
uagcaaacccugucaaacauu

SEQ ID NO: 3728733 - RNA, 14 nt, Human
uagcaaacuuugua

SEQ ID NO: 3728734 - RNA, 16 nt, Human
uagcaaagauaucuca

SEQ ID NO: 3728735 - RNA, 19 nt, Human
uagcaaagauaucucaucu

SEQ ID NO: 3728736 - RNA, 23 nt, Human
uagcaaauaauuuccugguguga

SEQ ID NO: 3728737 - RNA, 12 nt, Human
uagcaaauacau

SEQ ID NO: 3728738 - RNA, 17 nt, Human
uagcaaauguuuugaca

SEQ ID NO: 3728739 - RNA, 13 nt, Human
uagcaacuuuugu

SEQ ID NO: 3728740 - RNA, 17 nt, Human
uagcaacuuuuguguaa

SEQ ID NO: 3728741 - RNA, 12 nt, Human
uagcaagacaca

SEQ ID NO: 3728742 - RNA, 20 nt, Human
uagcaagauugcuuaaaaua

SEQ ID NO: 3728743 - RNA, 14 nt, Human
uagcaagcuggccu

SEQ ID NO: 3728744 - RNA, 23 nt, Human
uagcaagguuuggugcaaaguau

SEQ ID NO: 3728745 - RNA, 17 nt, Human
uagcaaucacaacacug

SEQ ID NO: 3728746 - RNA, 14 nt, Human
uagcaaucucuuca

SEQ ID NO: 3728747 - RNA, 21 nt, Human
uagcacaacgugguacuauuu

SEQ ID NO: 3728748 - RNA, 13 nt, Human
uagcacaaguuau

SEQ ID NO: 3728749 - RNA, 18 nt, Human
uagcacagacccugcccu

SEQ ID NO: 3728750 - RNA, 15 nt, Human
uagcacagauuuuaa

SEQ ID NO: 3728751 - RNA, 18 nt, Human
uagcacagauuuuaauug

SEQ ID NO: 3728752 - RNA, 23 nt, Human
uagcacagauuuuaauugucaug

SEQ ID NO: 3728753 - RNA, 14 nt, Human
uagcacagcucccu

SEQ ID NO: 3728754 - RNA, 20 nt, Human
uagcacaggcugagugcagg

SEQ ID NO: 3728755 - RNA, 15 nt, Human
uagcacaugcuucaa

SEQ ID NO: 3728756 - RNA, 19 nt, Human
uagcacaugcuucaauagu

SEQ ID NO: 3728757 - RNA, 13 nt, Human
uagcaccagggaa

SEQ ID NO: 3728758 - RNA, 13 nt, Human
uagcaccagggcu

SEQ ID NO: 3728759 - RNA, 16 nt, Human
uagcacguuuaaaguu

SEQ ID NO: 3728760 - RNA, 14 nt, Human
uagcacugacagau

SEQ ID NO: 3728761 - RNA, 19 nt, Human
uagcacuuaaauuccucaa

SEQ ID NO: 3728762 - RNA, 15 nt, Human
uagcacuuucauugc

SEQ ID NO: 3728763 - RNA, 20 nt, Human
uagcacuuugaaauaccuca

SEQ ID NO: 3728764 - RNA, 21 nt, Human
uagcacuuugaaauaccucau

SEQ ID NO: 3728765 - RNA, 23 nt, Human
uagcagaagguugcaccuccccc

SEQ ID NO: 3728766 - RNA, 19 nt, Human
uagcagagaaugaaagggc

SEQ ID NO: 3728767 - RNA, 18 nt, Human
uagcagagagacuuucag

SEQ ID NO: 3728768 - RNA, 23 nt, Human
uagcagauuguuuccucuuccaa

SEQ ID NO: 3728769 - RNA, 20 nt, Human
uagcagcagccuuuaaugca

SEQ ID NO: 3728770 - RNA, 15 nt, Human
uagcagcccacccug

SEQ ID NO: 3728771 - RNA, 16 nt, Human
uagcagcccacccugc

SEQ ID NO: 3728772 - RNA, 16 nt, Human
uagcagccuggcuccc

SEQ ID NO: 3728773 - RNA, 12 nt, Human
uagcagccuuuc

SEQ ID NO: 3728774 - RNA, 13 nt, Human
uagcagccuuucu

SEQ ID NO: 3728775 - RNA, 12 nt, Human
uagcagcuggac

SEQ ID NO: 3728776 - RNA, 14 nt, Human
uagcagcuuccaga

SEQ ID NO: 3728777 - RNA, 22 nt, Human
uagcaggagaggagagccagag

SEQ ID NO: 3728778 - RNA, 18 nt, Human
uagcaggccaaggucuga

SEQ ID NO: 3728779 - RNA, 22 nt, Human
uagcaggccaaggucugagcca

SEQ ID NO: 3728780 - RNA, 21 nt, Human
uagcagggaaaauauauaucu

SEQ ID NO: 3728781 - RNA, 23 nt, Human
uagcaggugguccugagaccuga

SEQ ID NO: 3728782 - RNA, 17 nt, Human
uagcagugugaaguaca

SEQ ID NO: 3728783 - RNA, 16 nt, Human
uagcaguucugcaaau

SEQ ID NO: 3728784 - RNA, 13 nt, Human
uagcauaagggcu

SEQ ID NO: 3728785 - RNA, 12 nt, Human
uagcauaucaau

SEQ ID NO: 3728786 - RNA, 16 nt, Human
uagcauaucugccuuu

SEQ ID NO: 3728787 - RNA, 17 nt, Human
uagcauaucugccuuua

SEQ ID NO: 3728788 - RNA, 22 nt, Human
uagcauaucugccuuuauugug

SEQ ID NO: 3728789 - RNA, 21 nt, Human
uagcauaugacaaauguuucu

SEQ ID NO: 3728790 - RNA, 22 nt, Human
uagcauaugacaaauguuucua

SEQ ID NO: 3728791 - RNA, 22 nt, Human
uagcauauucuuuucugcaaaa

SEQ ID NO: 3728792 - RNA, 17 nt, Human
uagcauccuaagaaaua

SEQ ID NO: 3728793 - RNA, 18 nt, Human
uagcauccuaagaaauau

SEQ ID NO: 3728794 - RNA, 15 nt, Human
gccaccugagguggg

SEQ ID NO: 3728795 - RNA, 17 nt, Human
gccaccugaguuccuga

SEQ ID NO: 3728796 - RNA, 12 nt, Human
gccaccugcagg

SEQ ID NO: 3728797 - RNA, 16 nt, Human
gccaccugcccccuuc

SEQ ID NO: 3728798 - RNA, 17 nt, Human
gccaccugcccccuucu

SEQ ID NO: 3728799 - RNA, 18 nt, Human
gccaccugcccccuucuc

SEQ ID NO: 3728800 - RNA, 23 nt, Human
gccaccugccugcgucuuccgcc

SEQ ID NO: 3728801 - RNA, 18 nt, Human
uacuaaacauuuuguuau

SEQ ID NO: 3728802 - RNA, 18 nt, Human
uacuaaagccaaacauau

SEQ ID NO: 3728803 - RNA, 15 nt, Human
uacuaaauuuaaauu

SEQ ID NO: 3728804 - RNA, 17 nt, Human
uacuaacauuuauuuga

SEQ ID NO: 3728805 - RNA, 18 nt, Human
uacuaaccagcagaaaug

SEQ ID NO: 3728806 - RNA, 14 nt, Human
uacuaacuaaacuc

SEQ ID NO: 3728807 - RNA, 18 nt, Human
uacuaacuucuaaaacug

SEQ ID NO: 3728808 - RNA, 15 nt, Human
uacuaagaaaagaua

SEQ ID NO: 3728809 - RNA, 14 nt, Human
uacuaagaagaaaa

SEQ ID NO: 3728810 - RNA, 15 nt, Human
uacuaagaagaaaau

SEQ ID NO: 3728811 - RNA, 15 nt, Human
uacuaagaugacauu

SEQ ID NO: 3728812 - RNA, 20 nt, Human
uacuaagcauugaauggcua

SEQ ID NO: 3728813 - RNA, 22 nt, Human
uacuaagcuuugccagcugcug

SEQ ID NO: 3728814 - RNA, 22 nt, Human
uacuaaggaguaaucuguguac

SEQ ID NO: 3728815 - RNA, 22 nt, Human
uacuaaggauacaggcuggaaa

SEQ ID NO: 3728816 - RNA, 22 nt, Human
uacuaauaaaauuuaaaagucu

SEQ ID NO: 3728817 - RNA, 20 nt, Human
uacuaauaaacuaauaauug

SEQ ID NO: 3728818 - RNA, 20 nt, Human
uacuaauagaauaaaggcag

SEQ ID NO: 3728819 - RNA, 15 nt, Human
uacuaauagacaauu

SEQ ID NO: 3728820 - RNA, 13 nt, Human
uacuaaugaaaac

SEQ ID NO: 3728821 - RNA, 13 nt, Human
uacuaaugauguu

SEQ ID NO: 3728822 - RNA, 14 nt, Human
uacuaaugauguuu

SEQ ID NO: 3728823 - RNA, 16 nt, Human
uacuaauuccacaccu

SEQ ID NO: 3728824 - RNA, 15 nt, Human
uacuaauuuuacaca

SEQ ID NO: 3728825 - RNA, 22 nt, Human
uacuacacauuuuuaaauuguu

SEQ ID NO: 3728826 - RNA, 13 nt, Human
uacuacacugagg

SEQ ID NO: 3728827 - RNA, 15 nt, Human
uacuacagcuaugaa

SEQ ID NO: 3728828 - RNA, 21 nt, Human
uacuacagucaagauagaaag

SEQ ID NO: 3728829 - RNA, 17 nt, Human
uacuacaucgcccucca

SEQ ID NO: 3728830 - RNA, 17 nt, Human
uacuaccuccucuccug

SEQ ID NO: 3728831 - RNA, 14 nt, Human
uacuaccuguaaug

SEQ ID NO: 3728832 - RNA, 22 nt, Human
uacuaccuguguauauaguuuu

SEQ ID NO: 3728833 - RNA, 18 nt, Human
uacuacuagaugucuuua

SEQ ID NO: 3728834 - RNA, 21 nt, Human
gccagggcagagugagaccca

SEQ ID NO: 3728835 - RNA, 15 nt, Human
gccagggccacgcuc

SEQ ID NO: 3728836 - RNA, 22 nt, Human
gccagggccccucacccugccu

SEQ ID NO: 3728837 - RNA, 17 nt, Human
gccagggccccucuccc

SEQ ID NO: 3728838 - RNA, 18 nt, Human
gccagggccccucucccc

SEQ ID NO: 3728839 - RNA, 20 nt, Human
gccagggccccucuccccag

SEQ ID NO: 3728840 - RNA, 23 nt, Human
gccagggccccucuccccaggga

SEQ ID NO: 3728841 - RNA, 13 nt, Human
gccagggcccugc

SEQ ID NO: 3728842 - RNA, 14 nt, Human
gccagggccugcga

SEQ ID NO: 3728843 - RNA, 16 nt, Human
gccagggccugcgagg

SEQ ID NO: 3728844 - RNA, 10 nt, Human
gccagggcug

SEQ ID NO: 3728845 - RNA, 11 nt, Human
gccagggcugc

SEQ ID NO: 3728846 - RNA, 15 nt, Human
gccagggcugccccu

SEQ ID NO: 3728847 - RNA, 16 nt, Human
gccagggcugccccua

SEQ ID NO: 3728848 - RNA, 15 nt, Human
gccagggcuggagaa

SEQ ID NO: 3728849 - RNA, 20 nt, Human
gccaggggagcagaggggca

SEQ ID NO: 3728850 - RNA, 17 nt, Human
gccagggucucucccuc

SEQ ID NO: 3728851 - RNA, 18 nt, Human
gccagggucucucccuca

SEQ ID NO: 3728852 - RNA, 20 nt, Human
gccagggucucucccucagg

SEQ ID NO: 3728853 - RNA, 16 nt, Human
gccagggucuguguga

SEQ ID NO: 3728854 - RNA, 19 nt, Human
gccagggucugugugaaug

SEQ ID NO: 3728855 - RNA, 16 nt, Human
gccagggugagagcug

SEQ ID NO: 3728856 - RNA, 17 nt, Human
gccagggugagagcugc

SEQ ID NO: 3728857 - RNA, 21 nt, Human
gccaggguuucgagaagcugc

SEQ ID NO: 3728858 - RNA, 16 nt, Human
gccagguaaugaggga

SEQ ID NO: 3728859 - RNA, 21 nt, Human
gccagguaaugugaauaaauu

SEQ ID NO: 3728860 - RNA, 15 nt, Human
gccaggucacacgac

SEQ ID NO: 3728861 - RNA, 14 nt, Human
gccaggucccucuc

SEQ ID NO: 3728862 - RNA, 18 nt, Human
gccaggugaggucagcac

SEQ ID NO: 3728863 - RNA, 18 nt, Human
gccaggugcaaccaggga

SEQ ID NO: 3728864 - RNA, 15 nt, Human
gccaggugccuccug

SEQ ID NO: 3728865 - RNA, 15 nt, Human
gccaggugccuugga

SEQ ID NO: 3728866 - RNA, 16 nt, Human
gccaggugccuuggag

SEQ ID NO: 3728867 - RNA, 21 nt, Human
gccaguaaaaaaaaaaaaugg

SEQ ID NO: 3728868 - RNA, 16 nt, Human
gccaguaacacaggcc

SEQ ID NO: 3728869 - RNA, 20 nt, Human
gccaguaacgcgucuuccug

SEQ ID NO: 3728870 - RNA, 22 nt, Human
gccaguaacgcgucuuccugag

SEQ ID NO: 3728871 - RNA, 23 nt, Human
gccaguaagggaaauagaaaaac

SEQ ID NO: 3728872 - RNA, 14 nt, Human
gccaguaauccugu

SEQ ID NO: 3728873 - RNA, 22 nt, Human
gccaguaucuauauauguguau

SEQ ID NO: 3728874 - RNA, 17 nt, Human
gccaguauuagacugga

SEQ ID NO: 3728875 - RNA, 14 nt, Human
gccaguauuuuaaa

SEQ ID NO: 3728876 - RNA, 14 nt, Human
gccaguauuuuuua

SEQ ID NO: 3728877 - RNA, 18 nt, Human
gccagucaccccggccac

SEQ ID NO: 3728878 - RNA, 21 nt, Human
gccagucaccccggccaccug

SEQ ID NO: 3728879 - RNA, 19 nt, Human
gccaguccacccugccugc

SEQ ID NO: 3728880 - RNA, 16 nt, Human
gccagucccaggggca

SEQ ID NO: 3728881 - RNA, 16 nt, Human
gccaguccugccuggc

SEQ ID NO: 3728882 - RNA, 17 nt, Human
gccaguccugccuggcc

SEQ ID NO: 3728883 - RNA, 15 nt, Human
gccagucgcgcugcc

SEQ ID NO: 3728884 - RNA, 20 nt, Human
gccagucuguggaucagaga

SEQ ID NO: 3728885 - RNA, 11 nt, Human
gccagucuuaa

SEQ ID NO: 3728886 - RNA, 18 nt, Human
gccagugaccugaggaag

SEQ ID NO: 3728887 - RNA, 20 nt, Human
gccagugaccugaggaagcg

SEQ ID NO: 3728888 - RNA, 16 nt, Human
gccagugacuccagga

SEQ ID NO: 3728889 - RNA, 17 nt, Human
gccagugacuccaggag

SEQ ID NO: 3728890 - RNA, 17 nt, Human
gccagugaugugcggug

SEQ ID NO: 3728891 - RNA, 16 nt, Human
gccagugcccugagcc

SEQ ID NO: 3728892 - RNA, 15 nt, Human
gccagugccuuaccu

SEQ ID NO: 3728893 - RNA, 18 nt, Human
gccagugcgggugcagac

SEQ ID NO: 3728894 - RNA, 21 nt, Human
gccaguggccuuccccagcau

SEQ ID NO: 3728895 - RNA, 23 nt, Human
gccaguggcuggaucugugaggg

SEQ ID NO: 3728896 - RNA, 19 nt, Human
gccaguggggccuguggaa

SEQ ID NO: 3728897 - RNA, 21 nt, Human
gccaguggggccuguggaaug

SEQ ID NO: 3728898 - RNA, 19 nt, Human
gccaguguaaucccccagg

SEQ ID NO: 3728899 - RNA, 16 nt, Human
gccaguguccugagcc

SEQ ID NO: 3728900 - RNA, 13 nt, Human
gccagugucuguc

SEQ ID NO: 3728901 - RNA, 16 nt, Human
gccagugucugucccg

SEQ ID NO: 3728902 - RNA, 22 nt, Human
gccagugucugucccggggucc

SEQ ID NO: 3728903 - RNA, 13 nt, Human
gccagugucuuuc

SEQ ID NO: 3728904 - RNA, 13 nt, Human
gccagugugcuga

SEQ ID NO: 3728905 - RNA, 17 nt, Human
gccaguuagacuagucc

SEQ ID NO: 3728906 - RNA, 21 nt, Human
gccaguucuuuccauaauaaa

SEQ ID NO: 3728907 - RNA, 16 nt, Human
gccaguuggucccccu

SEQ ID NO: 3728908 - RNA, 18 nt, Human
gccaguuggucccccuuc

SEQ ID NO: 3728909 - RNA, 20 nt, Human
gccaguuggucccccuucca

SEQ ID NO: 3728910 - RNA, 13 nt, Human
gccaguuguccuc

SEQ ID NO: 3728911 - RNA, 14 nt, Human
gccaguuguccucc

SEQ ID NO: 3728912 - RNA, 20 nt, Human
gccauaaaacauuaagaaaa

SEQ ID NO: 3728913 - RNA, 20 nt, Human
gccauaagcaacaauuuuca

SEQ ID NO: 3728914 - RNA, 23 nt, Human
gccauaagcaacaauuuucagau

SEQ ID NO: 3728915 - RNA, 15 nt, Human
gccauaauacaaaag

SEQ ID NO: 3728916 - RNA, 14 nt, Human
gccauacuggccuc

SEQ ID NO: 3728917 - RNA, 17 nt, Human
gccauacuggccucgcc

SEQ ID NO: 3728918 - RNA, 20 nt, Human
gccauacuggccucgccugg

SEQ ID NO: 3728919 - RNA, 21 nt, Human
gccauacuggccucgccuggc

SEQ ID NO: 3728920 - RNA, 23 nt, Human
gccauacuggccucgccuggccu

SEQ ID NO: 3728921 - RNA, 22 nt, Human
gccauacuuaucucucugugcu

SEQ ID NO: 3728922 - RNA, 22 nt, Human
gccauagaguacacugccugcc

SEQ ID NO: 3728923 - RNA, 12 nt, Human
gccauagcuccu

SEQ ID NO: 3728924 - RNA, 17 nt, Human
gccauagucaaagagag

SEQ ID NO: 3728925 - RNA, 16 nt, Human
gccauauaaguuugaa

SEQ ID NO: 3728926 - RNA, 17 nt, Human
gccauauaaguuugaag

SEQ ID NO: 3728927 - RNA, 19 nt, Human
gccauauauaacagauaca

SEQ ID NO: 3728928 - RNA, 21 nt, Human
gccauauauaacagauacauu

SEQ ID NO: 3728929 - RNA, 23 nt, Human
gccauauauaacagauacauuuc

SEQ ID NO: 3728930 - RNA, 20 nt, Human
gccauauuaaauuuuuuguu

SEQ ID NO: 3728931 - RNA, 23 nt, Human
gccauauuaaauuuuuuguugac

SEQ ID NO: 3728932 - RNA, 18 nt, Human
gccauauuuaccucagcc

SEQ ID NO: 3728933 - RNA, 19 nt, Human
gccauauuuaccucagccu

SEQ ID NO: 3728934 - RNA, 20 nt, Human
gccauauuuguaaaaugaca

SEQ ID NO: 3728935 - RNA, 17 nt, Human
gccauauuuucaccauu

SEQ ID NO: 3728936 - RNA, 16 nt, Human
gccaucaagagacuga

SEQ ID NO: 3728937 - RNA, 14 nt, Human
gccaucaccucaga

SEQ ID NO: 3728938 - RNA, 15 nt, Human
gccaucaccucagau

SEQ ID NO: 3728939 - RNA, 23 nt, Human
gccaucaccucagauggcagcuu

SEQ ID NO: 3728940 - RNA, 20 nt, Human
gccaucaccuuagaccacca

SEQ ID NO: 3728941 - RNA, 19 nt, Human
gccaucauaggaagggacc

SEQ ID NO: 3728942 - RNA, 21 nt, Human
gccaucauguuuacagaggac

SEQ ID NO: 3728943 - RNA, 19 nt, Human
gccauccagguucagcuug

SEQ ID NO: 3728944 - RNA, 13 nt, Human
gccaucccagccc

SEQ ID NO: 3728945 - RNA, 15 nt, Human
gccaucccagcccca

SEQ ID NO: 3728946 - RNA, 16 nt, Human
gccaucccagccccaa

SEQ ID NO: 3728947 - RNA, 16 nt, Human
gccauccccagggggc

SEQ ID NO: 3728948 - RNA, 13 nt, Human
gccaucccucccu

SEQ ID NO: 3728949 - RNA, 21 nt, Human
gccaucccucgugguccccaa

SEQ ID NO: 3728950 - RNA, 12 nt, Human
gccaucccugug

SEQ ID NO: 3728951 - RNA, 13 nt, Human
gccaucccuguga

SEQ ID NO: 3728952 - RNA, 18 nt, Human
gccauccucaaacacugc

SEQ ID NO: 3728953 - RNA, 20 nt, Human
gccauccucaaacacugcag

SEQ ID NO: 3728954 - RNA, 21 nt, Human
gccauccucaaacacugcagg

SEQ ID NO: 3728955 - RNA, 14 nt, Human
gccauccuggccca

SEQ ID NO: 3728956 - RNA, 23 nt, Human
gccaucuagccagccccucuucc

SEQ ID NO: 3728957 - RNA, 12 nt, Human
gccaucucugcu

SEQ ID NO: 3728958 - RNA, 15 nt, Human
gccaucucugcucca

SEQ ID NO: 3728959 - RNA, 19 nt, Human
gccaucucuggaugccuga

SEQ ID NO: 3728960 - RNA, 15 nt, Human
gccaucugcccaggg

SEQ ID NO: 3728961 - RNA, 17 nt, Human
gccaucugcccaggggu

SEQ ID NO: 3728962 - RNA, 20 nt, Human
gccaucugcccaggggugcc

SEQ ID NO: 3728963 - RNA, 16 nt, Human
gccaucugcuccugga

SEQ ID NO: 3728964 - RNA, 20 nt, Human
gccaucuggagagcccagag

SEQ ID NO: 3728965 - RNA, 13 nt, Human
gccaucuguagcu

SEQ ID NO: 3728966 - RNA, 17 nt, Human
gccaucuuccagguggg

SEQ ID NO: 3728967 - RNA, 14 nt, Human
gccaucuucccagc

SEQ ID NO: 3728968 - RNA, 14 nt, Human
gccaucuugguaaa

SEQ ID NO: 3728969 - RNA, 16 nt, Human
gccaucuugguaaauu

SEQ ID NO: 3728970 - RNA, 15 nt, Human
gccaugaacuggagg

SEQ ID NO: 3728971 - RNA, 23 nt, Human
gccaugacccugccucucccagg

SEQ ID NO: 3728972 - RNA, 20 nt, Human
gccaugagaauguuuuagca

SEQ ID NO: 3728973 - RNA, 21 nt, Human
gccaugagccgcccaaggccu

SEQ ID NO: 3728974 - RNA, 16 nt, Human
gccaugagcuccagac

SEQ ID NO: 3728975 - RNA, 18 nt, Human
gccaugagcuccagaccc

SEQ ID NO: 3728976 - RNA, 16 nt, Human
gccaugaggccucagu

SEQ ID NO: 3728977 - RNA, 20 nt, Human
gccaugaggccucaguggac

SEQ ID NO: 3728978 - RNA, 22 nt, Human
gccaugauggaaauauuuauuu

SEQ ID NO: 3728979 - RNA, 17 nt, Human
gccaugauguggagugg

SEQ ID NO: 3728980 - RNA, 18 nt, Human
gccaugccagcuuaucuc

SEQ ID NO: 3728981 - RNA, 15 nt, Human
gccaugccaggaacc

SEQ ID NO: 3728982 - RNA, 16 nt, Human
gccaugccaggaaccu

SEQ ID NO: 3728983 - RNA, 13 nt, Human
uacuacuccugua

SEQ ID NO: 3728984 - RNA, 17 nt, Human
uacuacuccuguaggaa

SEQ ID NO: 3728985 - RNA, 15 nt, Human
uacuacugaaacaga

SEQ ID NO: 3728986 - RNA, 19 nt, Human
uacuacuuuguuaggauuu

SEQ ID NO: 3728987 - RNA, 23 nt, Human
uacuacuuuguuaggauuuucac

SEQ ID NO: 3728988 - RNA, 20 nt, Human
uacuacuuuugcaugaaaau

SEQ ID NO: 3728989 - RNA, 14 nt, Human
uacuagaagaugaa

SEQ ID NO: 3728990 - RNA, 18 nt, Human
uacuagacugccacaagg

SEQ ID NO: 3728991 - RNA, 20 nt, Human
uacuagagauauuuuguaaa

SEQ ID NO: 3728992 - RNA, 18 nt, Human
uacuagcaaaauaaaaca

SEQ ID NO: 3728993 - RNA, 24 nt, Human
uacuagcaaaauaaaacauagcaa

SEQ ID NO: 3728994 - RNA, 23 nt, Human
uacuagcuuuucaaacaagaaug

SEQ ID NO: 3728995 - RNA, 23 nt, Human
uacuaggaagaacguuuuuuccu

SEQ ID NO: 3728996 - RNA, 18 nt, Human
uacuagggaaaugccuuu

SEQ ID NO: 3728997 - RNA, 15 nt, Human
uacuagguaacuuca

SEQ ID NO: 3728998 - RNA, 14 nt, Human
uacuaguacugugu

SEQ ID NO: 3728999 - RNA, 20 nt, Human
uacuagucaccagagacuuu

SEQ ID NO: 3729000 - RNA, 17 nt, Human
uacuagucuguguggga

SEQ ID NO: 3729001 - RNA, 19 nt, Human
uacuaguuuuaguuuucuc

SEQ ID NO: 3729002 - RNA, 21 nt, Human
uacuauaacauagaauugcaa

SEQ ID NO: 3729003 - RNA, 13 nt, Human
uacuauaacauau

SEQ ID NO: 3729004 - RNA, 17 nt, Human
uacuauaagaacuuuga

SEQ ID NO: 3729005 - RNA, 20 nt, Human
uacuauccuggcuuugccca

SEQ ID NO: 3729006 - RNA, 23 nt, Human
uacuauggcccuggccuagcaua

SEQ ID NO: 3729007 - RNA, 16 nt, Human
uacuauggcugaguuc

SEQ ID NO: 3729008 - RNA, 12 nt, Human
uacuauguauca

SEQ ID NO: 3729009 - RNA, 14 nt, Human
uacuauguaucaau

SEQ ID NO: 3729010 - RNA, 19 nt, Human
uacuauguggaugugacag

SEQ ID NO: 3729011 - RNA, 15 nt, Human
uacuauuaaacaugc

SEQ ID NO: 3729012 - RNA, 16 nt, Human
uacuauuaaacaugcu

SEQ ID NO: 3729013 - RNA, 20 nt, Human
uacuauuaagcaguaaaaac

SEQ ID NO: 3729014 - RNA, 22 nt, Human
uacuauucaguggcgagaaaua

SEQ ID NO: 3729015 - RNA, 21 nt, Human
uacuauuuaaagccuccucau

SEQ ID NO: 3729016 - RNA, 13 nt, Human
uacuauuuaacug

SEQ ID NO: 3729017 - RNA, 14 nt, Human
uacuauuuaacuga

SEQ ID NO: 3729018 - RNA, 19 nt, Human
uacuauuuaacugacuauu

SEQ ID NO: 3729019 - RNA, 17 nt, Human
uacuauuuaagauguga

SEQ ID NO: 3729020 - RNA, 19 nt, Human
uacuauuuaagaugugaaa

SEQ ID NO: 3729021 - RNA, 13 nt, Human
uacuauuuagaua

SEQ ID NO: 3729022 - RNA, 19 nt, Human
uacuauuuucuacaauuaa

SEQ ID NO: 3729023 - RNA, 15 nt, Human
uacuauuuuuacugc

SEQ ID NO: 3729024 - RNA, 17 nt, Human
uacucaaaugaguaaca

SEQ ID NO: 3729025 - RNA, 23 nt, Human
uacucaacccucucaggugacca

SEQ ID NO: 3729026 - RNA, 15 nt, Human
uacucaagaggcuga

SEQ ID NO: 3729027 - RNA, 15 nt, Human
uacucaagcccgcgg

SEQ ID NO: 3729028 - RNA, 14 nt, Human
uacucaauggauuu

SEQ ID NO: 3729029 - RNA, 12 nt, Human
uacucaauuuua

SEQ ID NO: 3729030 - RNA, 13 nt, Human
uacucaauuuuaa

SEQ ID NO: 3729031 - RNA, 14 nt, Human
uacucacacaggca

SEQ ID NO: 3729032 - RNA, 14 nt, Human
uacucaccucaccc

SEQ ID NO: 3729033 - RNA, 24 nt, Human
uacucaccuugaacaccacgcuug

SEQ ID NO: 3729034 - RNA, 16 nt, Human
uacucacuuuucccac

SEQ ID NO: 3729035 - RNA, 18 nt, Human
uacucacuuuucccacuc

SEQ ID NO: 3729036 - RNA, 16 nt, Human
uacucagcagcccucc

SEQ ID NO: 3729037 - RNA, 16 nt, Human
uacucagcccugggcc

SEQ ID NO: 3729038 - RNA, 13 nt, Human
uacucagccugcu

SEQ ID NO: 3729039 - RNA, 22 nt, Human
uacucaggaggcugaggcagaa

SEQ ID NO: 3729040 - RNA, 23 nt, Human
uacucaggcugguggagaacucu

SEQ ID NO: 3729041 - RNA, 17 nt, Human
uacucagggaaagcauu

SEQ ID NO: 3729042 - RNA, 21 nt, Human
uacucagggcuccucccagcu

SEQ ID NO: 3729043 - RNA, 21 nt, Human
uacucaguuuauguuguacaa

SEQ ID NO: 3729044 - RNA, 23 nt, Human
uacucauauauaucuaucuuaua

SEQ ID NO: 3729045 - RNA, 16 nt, Human
uacucaugaucuugug

SEQ ID NO: 3729046 - RNA, 20 nt, Human
uacucauguguaugggcaaa

SEQ ID NO: 3729047 - RNA, 15 nt, Human
uacucauuagaauua

SEQ ID NO: 3729048 - RNA, 14 nt, Human
uacucauucaggga

SEQ ID NO: 3729049 - RNA, 18 nt, Human
uacucauuccccggggcg

SEQ ID NO: 3729050 - RNA, 17 nt, Human
uacucauuuaaaguauu

SEQ ID NO: 3729051 - RNA, 18 nt, Human
uacucauuucuaaaagaa

SEQ ID NO: 3729052 - RNA, 14 nt, Human
uacuccacacugca

SEQ ID NO: 3729053 - RNA, 14 nt, Human
uacuccagugguga

SEQ ID NO: 3729054 - RNA, 14 nt, Human
uacucccagacacc

SEQ ID NO: 3729055 - RNA, 15 nt, Human
uacuccccuccuuga

SEQ ID NO: 3729056 - RNA, 22 nt, Human
uacucccucaaagcacacguca

SEQ ID NO: 3729057 - RNA, 16 nt, Human
uacucccugcagaugc

SEQ ID NO: 3729058 - RNA, 19 nt, Human
uacucccugcagaugccac

SEQ ID NO: 3729059 - RNA, 14 nt, Human
uacuccuaccucag

SEQ ID NO: 3729060 - RNA, 16 nt, Human
uacuccuaccucagcc

SEQ ID NO: 3729061 - RNA, 14 nt, Human
uacuccuauuuuug

SEQ ID NO: 3729062 - RNA, 14 nt, Human
uacuccucacacuu

SEQ ID NO: 3729063 - RNA, 13 nt, Human
uacuccuccucuu

SEQ ID NO: 3729064 - RNA, 14 nt, Human
uacuccucugcagu

SEQ ID NO: 3729065 - RNA, 21 nt, Human
uacuccucugcagugccuugg

SEQ ID NO: 3729066 - RNA, 17 nt, Human
uacuccucuuuacacug

SEQ ID NO: 3729067 - RNA, 13 nt, Human
uacuccugacucc

SEQ ID NO: 3729068 - RNA, 16 nt, Human
uacuccugcaaaauuu

SEQ ID NO: 3729069 - RNA, 17 nt, Human
uacuccuguaauuccua

SEQ ID NO: 3729070 - RNA, 12 nt, Human
uacuccuguggg

SEQ ID NO: 3729071 - RNA, 22 nt, Human
uacuccuuaagaacacaaagcg

SEQ ID NO: 3729072 - RNA, 15 nt, Human
uacucgggaggcuga

SEQ ID NO: 3729073 - RNA, 22 nt, Human
uacucgggaggcugaggcacaa

SEQ ID NO: 3729074 - RNA, 20 nt, Human
uacucuaagaucuuagauuc

SEQ ID NO: 3729075 - RNA, 22 nt, Human
uacucuaagaucuuagauucuc

SEQ ID NO: 3729076 - RNA, 16 nt, Human
uacucuacccucuuag

SEQ ID NO: 3729077 - RNA, 13 nt, Human
uacucuacugaua

SEQ ID NO: 3729078 - RNA, 16 nt, Human
uacucuagauuuuguu

SEQ ID NO: 3729079 - RNA, 23 nt, Human
uacucuauaaccaaaugaaauau

SEQ ID NO: 3729080 - RNA, 14 nt, Human
uacucuccaaccug

SEQ ID NO: 3729081 - RNA, 16 nt, Human
uacucucccauggcuu

SEQ ID NO: 3729082 - RNA, 12 nt, Human
uacucuccuaga

SEQ ID NO: 3729083 - RNA, 13 nt, Human
uacucugaaacac

SEQ ID NO: 3729084 - RNA, 16 nt, Human
uacucugcccucuaga

SEQ ID NO: 3729085 - RNA, 17 nt, Human
uacucuggggugcugcc

SEQ ID NO: 3729086 - RNA, 21 nt, Human
uacucugugucagguggggca

SEQ ID NO: 3729087 - RNA, 16 nt, Human
uacucuuaagccaucu

SEQ ID NO: 3729088 - RNA, 20 nt, Human
uacucuuaagccaucuuggu

SEQ ID NO: 3729089 - RNA, 22 nt, Human
uacucuuaagccaucuugguaa

SEQ ID NO: 3729090 - RNA, 20 nt, Human
uacucuuaaguuucucagcu

SEQ ID NO: 3729091 - RNA, 21 nt, Human
uacucuuaaguuucucagcuc

SEQ ID NO: 3729092 - RNA, 21 nt, Human
uacucuuaggaagagaaacca

SEQ ID NO: 3729093 - RNA, 14 nt, Human
uacucuucuugaaa

SEQ ID NO: 3729094 - RNA, 14 nt, Human
uacucuuguaagau

SEQ ID NO: 3729095 - RNA, 21 nt, Human
uacucuuguaagauuuugaaa

SEQ ID NO: 3729096 - RNA, 19 nt, Human
uacucuuuacccuugagcc

SEQ ID NO: 3729097 - RNA, 14 nt, Human
uacugaacaguaac

SEQ ID NO: 3729098 - RNA, 18 nt, Human
uacugaacaucugagucc

SEQ ID NO: 3729099 - RNA, 17 nt, Human
uacugaaccacuuguag

SEQ ID NO: 3729100 - RNA, 22 nt, Human
uacugaaccacuuguagauuug

SEQ ID NO: 3729101 - RNA, 15 nt, Human
uacugaacuuucuua

SEQ ID NO: 3729102 - RNA, 22 nt, Human
uacugaagaugcagcaaaaugu

SEQ ID NO: 3729103 - RNA, 18 nt, Human
uacugaaggaaaaacaca

SEQ ID NO: 3729104 - RNA, 17 nt, Human
uacugaaguaaaacaaa

SEQ ID NO: 3729105 - RNA, 13 nt, Human
uacugaaucugcu

SEQ ID NO: 3729106 - RNA, 21 nt, Human
uacugaaugaagcaguauuuu

SEQ ID NO: 3729107 - RNA, 19 nt, Human
uacugaaugucauugaaaa

SEQ ID NO: 3729108 - RNA, 17 nt, Human
uacugaccagacaagcu

SEQ ID NO: 3729109 - RNA, 22 nt, Human
uacugacccuggggcuggcuuu

SEQ ID NO: 3729110 - RNA, 14 nt, Human
uacugacuuucuca

SEQ ID NO: 3729111 - RNA, 20 nt, Human
uacugagaaaagccucucca

SEQ ID NO: 3729112 - RNA, 15 nt, Human
uacugagcagugaua

SEQ ID NO: 3729113 - RNA, 21 nt, Human
uacugagcagugauauucuuu

SEQ ID NO: 3729114 - RNA, 19 nt, Human
uacugagccuuguaauucu

SEQ ID NO: 3729115 - RNA, 14 nt, Human
uacugagcuucucu

SEQ ID NO: 3729116 - RNA, 22 nt, Human
uacugaggauauggacacuggu

SEQ ID NO: 3729117 - RNA, 23 nt, Human
uacugagggaccaacugggccca

SEQ ID NO: 3729118 - RNA, 16 nt, Human
uacugaguuacauugu

SEQ ID NO: 3729119 - RNA, 16 nt, Human
uacugauaaagaaaga

SEQ ID NO: 3729120 - RNA, 14 nt, Human
uacugauauauuuu

SEQ ID NO: 3729121 - RNA, 16 nt, Human
uacugauauauuuuac

SEQ ID NO: 3729122 - RNA, 18 nt, Human
uacugaucaugcauuguu

SEQ ID NO: 3729123 - RNA, 14 nt, Human
uacugauucaauuu

SEQ ID NO: 3729124 - RNA, 17 nt, Human
uacugauucaauuugau

SEQ ID NO: 3729125 - RNA, 15 nt, Human
uacugauuguuucau

SEQ ID NO: 3729126 - RNA, 18 nt, Human
uacugauuucaguaaguc

SEQ ID NO: 3729127 - RNA, 21 nt, Human
uacugauuugggcugaaugua

SEQ ID NO: 3729128 - RNA, 17 nt, Human
uacugauuuuuguaaga

SEQ ID NO: 3729129 - RNA, 15 nt, Human
uacugauuuuuguga

SEQ ID NO: 3729130 - RNA, 16 nt, Human
uacugcaaacuauuua

SEQ ID NO: 3729131 - RNA, 22 nt, Human
uacugcaaaucaggcuuuuguu

SEQ ID NO: 3729132 - RNA, 15 nt, Human
uacugcaagaaaaug

SEQ ID NO: 3729133 - RNA, 13 nt, Human
uaggugacauaua

SEQ ID NO: 3729134 - RNA, 16 nt, Human
uaggugauccauguaa

SEQ ID NO: 3729135 - RNA, 21 nt, Human
uaggugauccauguaacugcc

SEQ ID NO: 3729136 - RNA, 19 nt, Human
uaggugcccuuggaggcca

SEQ ID NO: 3729137 - RNA, 16 nt, Human
uaggugcuaauuaaua

SEQ ID NO: 3729138 - RNA, 19 nt, Human
uaggugcuaauuaauaaag

SEQ ID NO: 3729139 - RNA, 23 nt, Human
uaggugcuacaaaaacacagcaa

SEQ ID NO: 3729140 - RNA, 19 nt, Human
uaggugcuauuugucaucu

SEQ ID NO: 3729141 - RNA, 16 nt, Human
uagguggcaaggcugu

SEQ ID NO: 3729142 - RNA, 19 nt, Human
uaggugugacugaauuucu

SEQ ID NO: 3729143 - RNA, 17 nt, Human
uagguguucaggccagu

SEQ ID NO: 3729144 - RNA, 22 nt, Human
uagguguugauuuucuguugua

SEQ ID NO: 3729145 - RNA, 20 nt, Human
uagguuaaaaaaaaaaguca

SEQ ID NO: 3729146 - RNA, 17 nt, Human
uagguuaaaaaaaggca

SEQ ID NO: 3729147 - RNA, 22 nt, Human
uagguuaauuccaauuauauga

SEQ ID NO: 3729148 - RNA, 22 nt, Human
uagguuauuaugauuagcuuug

SEQ ID NO: 3729149 - RNA, 22 nt, Human
uagguucccuguucuuccucca

SEQ ID NO: 3729150 - RNA, 12 nt, Human
uagguucuaaaa

SEQ ID NO: 3729151 - RNA, 18 nt, Human
uagguucuaaaguucuaa

SEQ ID NO: 3729152 - RNA, 24 nt, Human
uagguuggaagcuagcuccccucc

SEQ ID NO: 3729153 - RNA, 13 nt, Human
uagguuuaacaua

SEQ ID NO: 3729154 - RNA, 15 nt, Human
uagguuuaacauaaa

SEQ ID NO: 3729155 - RNA, 17 nt, Human
uagguuuaacauaaagg

SEQ ID NO: 3729156 - RNA, 19 nt, Human
uagguuuaacucagaucac

SEQ ID NO: 3729157 - RNA, 19 nt, Human
uagguuuaugacaguaauu

SEQ ID NO: 3729158 - RNA, 21 nt, Human
uagguuuuuccuuauuugcuu

SEQ ID NO: 3729159 - RNA, 15 nt, Human
uagguuuuuuuguau

SEQ ID NO: 3729160 - RNA, 21 nt, Human
uaguaaaaaaucaauuaacca

SEQ ID NO: 3729161 - RNA, 13 nt, Human
uaguaaaaauaaa

SEQ ID NO: 3729162 - RNA, 15 nt, Human
uaguaaaacacagag

SEQ ID NO: 3729163 - RNA, 15 nt, Human
uaguaaaauuuauuu

SEQ ID NO: 3729164 - RNA, 12 nt, Human
uaguaaaccaau

SEQ ID NO: 3729165 - RNA, 22 nt, Human
uaguaaaccaauccuaugcaug

SEQ ID NO: 3729166 - RNA, 13 nt, Human
uaguaaagaaaug

SEQ ID NO: 3729167 - RNA, 17 nt, Human
uaguaaagucaaggaga

SEQ ID NO: 3729168 - RNA, 18 nt, Human
uaguaaaucacgcuuuuu

SEQ ID NO: 3729169 - RNA, 11 nt, Human
uaguaaauguc

SEQ ID NO: 3729170 - RNA, 12 nt, Human
uaguaaaugucu

SEQ ID NO: 3729171 - RNA, 15 nt, Human
uaguaaaugucuuug

SEQ ID NO: 3729172 - RNA, 16 nt, Human
uaguaaaugucuuugu

SEQ ID NO: 3729173 - RNA, 17 nt, Human
uaguaaaugucuuugua

SEQ ID NO: 3729174 - RNA, 18 nt, Human
uaguaaaugucuuuguaa

SEQ ID NO: 3729175 - RNA, 13 nt, Human
uaguaaauguuau

SEQ ID NO: 3729176 - RNA, 15 nt, Human
uaguaacugacauga

SEQ ID NO: 3729177 - RNA, 11 nt, Human
uaguaagcaua

SEQ ID NO: 3729178 - RNA, 23 nt, Human
uaguaagcggcucaagcccagga

SEQ ID NO: 3729179 - RNA, 14 nt, Human
uaguaauagccugg

SEQ ID NO: 3729180 - RNA, 13 nt, Human
uaguaauauauuu

SEQ ID NO: 3729181 - RNA, 17 nt, Human
uaguaauauauuuaaag

SEQ ID NO: 3729182 - RNA, 14 nt, Human
uaguaaucacaguu

SEQ ID NO: 3729183 - RNA, 15 nt, Human
uaguaaucacaguug

SEQ ID NO: 3729184 - RNA, 15 nt, Human
uaguaauguuuuaua

SEQ ID NO: 3729185 - RNA, 14 nt, Human
uaguacaaaguuuc

SEQ ID NO: 3729186 - RNA, 21 nt, Human
uaguacauaaaggugguaugu

SEQ ID NO: 3729187 - RNA, 16 nt, Human
uaguaccauuuauaca

SEQ ID NO: 3729188 - RNA, 19 nt, Human
uaguaccauuuauacaaau

SEQ ID NO: 3729189 - RNA, 18 nt, Human
uaguaccugaaaaguaac

SEQ ID NO: 3729190 - RNA, 14 nt, Human
uaguacuaagcauu

SEQ ID NO: 3729191 - RNA, 15 nt, Human
uaguacuaagcauuu

SEQ ID NO: 3729192 - RNA, 15 nt, Human
uaguacuagaaacug

SEQ ID NO: 3729193 - RNA, 22 nt, Human
uaguacuagagauauuuuguaa

SEQ ID NO: 3729194 - RNA, 23 nt, Human
uaguacuagagauauuuuguaaa

SEQ ID NO: 3729195 - RNA, 20 nt, Human
uaguacuccugcaaaauuuu

SEQ ID NO: 3729196 - RNA, 19 nt, Human
uaguacuucuucuguaaua

SEQ ID NO: 3729197 - RNA, 16 nt, Human
uaguacuuuauagaag

SEQ ID NO: 3729198 - RNA, 21 nt, Human
uaguacuuuauagaagaaugc

SEQ ID NO: 3729199 - RNA, 15 nt, Human
uaguagacacacuau

SEQ ID NO: 3729200 - RNA, 15 nt, Human
uaguagagacagggu

SEQ ID NO: 3729201 - RNA, 22 nt, Human
uaguagagacaggguuuugcca

SEQ ID NO: 3729202 - RNA, 20 nt, Human
uaguagagguacacuuguga

SEQ ID NO: 3729203 - RNA, 14 nt, Human
uaguagcauguuga

SEQ ID NO: 3729204 - RNA, 23 nt, Human
uaguagcguuuuuuaaauguaua

SEQ ID NO: 3729205 - RNA, 18 nt, Human
uaguaguaugaugauaca

SEQ ID NO: 3729206 - RNA, 18 nt, Human
uaguauaccggaauuacu

SEQ ID NO: 3729207 - RNA, 18 nt, Human
uaguauauuaaaaauggu

SEQ ID NO: 3729208 - RNA, 14 nt, Human
uaguaucaaauauu

SEQ ID NO: 3729209 - RNA, 20 nt, Human
uaguaucaaauauuagaugu

SEQ ID NO: 3729210 - RNA, 23 nt, Human
uaguaucaaauauuagaugugau

SEQ ID NO: 3729211 - RNA, 13 nt, Human
uaguaucaguguu

SEQ ID NO: 3729212 - RNA, 16 nt, Human
uaguaucaguguuuua

SEQ ID NO: 3729213 - RNA, 18 nt, Human
uaguaucaucagauagca

SEQ ID NO: 3729214 - RNA, 13 nt, Human
uaguauccuccag

SEQ ID NO: 3729215 - RNA, 17 nt, Human
uaguauccuccagguuu

SEQ ID NO: 3729216 - RNA, 19 nt, Human
uaguauccuccagguuuuu

SEQ ID NO: 3729217 - RNA, 22 nt, Human
uaguauccuccagguuuuucaa

SEQ ID NO: 3729218 - RNA, 16 nt, Human
uaguaucuagcaauca

SEQ ID NO: 3729219 - RNA, 19 nt, Human
uaguaucuagcaaucacaa

SEQ ID NO: 3729220 - RNA, 13 nt, Human
uaguaugaaaaug

SEQ ID NO: 3729221 - RNA, 17 nt, Human
uaguauggccuguguca

SEQ ID NO: 3729222 - RNA, 14 nt, Human
uaguauugacaaaa

SEQ ID NO: 3729223 - RNA, 13 nt, Human
uaguauuguuguc

SEQ ID NO: 3729224 - RNA, 17 nt, Human
uaguauuguuguccuuu

SEQ ID NO: 3729225 - RNA, 18 nt, Human
uaguauuuauuuauguac

SEQ ID NO: 3729226 - RNA, 12 nt, Human
uaguauuugaaa

SEQ ID NO: 3729227 - RNA, 12 nt, Human
uaguauuugaau

SEQ ID NO: 3729228 - RNA, 18 nt, Human
uaguauuuuuuguauaau

SEQ ID NO: 3729229 - RNA, 23 nt, Human
uagucaaauguaauguggcuucu

SEQ ID NO: 3729230 - RNA, 13 nt, Human
uagucaaauugug

SEQ ID NO: 3729231 - RNA, 14 nt, Human
uagucaagcuccuc

SEQ ID NO: 3729232 - RNA, 15 nt, Human
uagucaagcuccucc

SEQ ID NO: 3729233 - RNA, 18 nt, Human
uagucaaucaagucuguu

SEQ ID NO: 3729234 - RNA, 19 nt, Human
uagucaaugacaugaauuu

SEQ ID NO: 3729235 - RNA, 21 nt, Human
uagucacauggccuaugcaca

SEQ ID NO: 3729236 - RNA, 15 nt, Human
uagucaccagagacu

SEQ ID NO: 3729237 - RNA, 18 nt, Human
uagucaccagagacuuua

SEQ ID NO: 3729238 - RNA, 21 nt, Human
uagucaccuuuuaaauccugu

SEQ ID NO: 3729239 - RNA, 22 nt, Human
uagucaccuuuuaaauccuguu

SEQ ID NO: 3729240 - RNA, 17 nt, Human
uagucacugagacagcc

SEQ ID NO: 3729241 - RNA, 21 nt, Human
uagucagcgcaggaaugcaca

SEQ ID NO: 3729242 - RNA, 19 nt, Human
uagucagcuagaucauuug

SEQ ID NO: 3729243 - RNA, 18 nt, Human
uagucauuccaaauauga

SEQ ID NO: 3729244 - RNA, 14 nt, Human
uagucauucuuccc

SEQ ID NO: 3729245 - RNA, 18 nt, Human
uagucauuuacuaaacau

SEQ ID NO: 3729246 - RNA, 13 nt, Human
uagucauuuugcu

SEQ ID NO: 3729247 - RNA, 23 nt, Human
uagucccagcuacuugggaggcu

SEQ ID NO: 3729248 - RNA, 22 nt, Human
uagucccccaacucugagccca

SEQ ID NO: 3729249 - RNA, 18 nt, Human
uagucccucaugcaaauc

SEQ ID NO: 3729250 - RNA, 16 nt, Human
uagucccugccacgaa

SEQ ID NO: 3729251 - RNA, 11 nt, Human
uaguccuguga

SEQ ID NO: 3729252 - RNA, 22 nt, Human
uaguccuuuacuaauccaaccc

SEQ ID NO: 3729253 - RNA, 21 nt, Human
uagucguggagaugucuucgu

SEQ ID NO: 3729254 - RNA, 17 nt, Human
uagucuaaccaaaugca

SEQ ID NO: 3729255 - RNA, 21 nt, Human
uagucuacucuuaagccaucu

SEQ ID NO: 3729256 - RNA, 20 nt, Human
uagucuagauggcuccucuc

SEQ ID NO: 3729257 - RNA, 16 nt, Human
uagucuaguguaguau

SEQ ID NO: 3729258 - RNA, 17 nt, Human
uagucucagugaagacu

SEQ ID NO: 3729259 - RNA, 11 nt, Human
uagucucaguu

SEQ ID NO: 3729260 - RNA, 22 nt, Human
uagucucaguuugugugucuua

SEQ ID NO: 3729261 - RNA, 21 nt, Human
uagucucuaucauuaaaguuc

SEQ ID NO: 3729262 - RNA, 14 nt, Human
uagucucugugcuu

SEQ ID NO: 3729263 - RNA, 17 nt, Human
uagucucugugcuuuga

SEQ ID NO: 3729264 - RNA, 18 nt, Human
uagucucuuuaaaaggaa

SEQ ID NO: 3729265 - RNA, 19 nt, Human
uagucucuuuauuccuagu

SEQ ID NO: 3729266 - RNA, 12 nt, Human
uagucugguuuc

SEQ ID NO: 3729267 - RNA, 23 nt, Human
uagucugugugggacuguacaca

SEQ ID NO: 3729268 - RNA, 22 nt, Human
uagucuucucaaauuagaaagu

SEQ ID NO: 3729269 - RNA, 23 nt, Human
uagucuuggaagcuguuuggaaa

SEQ ID NO: 3729270 - RNA, 14 nt, Human
uagucuuuugcuuu

SEQ ID NO: 3729271 - RNA, 17 nt, Human
uagugaagacuccagaa

SEQ ID NO: 3729272 - RNA, 19 nt, Human
uagugaaggcuucucucug

SEQ ID NO: 3729273 - RNA, 22 nt, Human
uagugacuaaaccauugugcau

SEQ ID NO: 3729274 - RNA, 18 nt, Human
uagugagcagugagcaga

SEQ ID NO: 3729275 - RNA, 12 nt, Human
uagugauauuuc

SEQ ID NO: 3729276 - RNA, 17 nt, Human
uagugaucugaacagaa

SEQ ID NO: 3729277 - RNA, 13 nt, Human
uagugaugguucc

SEQ ID NO: 3729278 - RNA, 14 nt, Human
uagugaugguuccc

SEQ ID NO: 3729279 - RNA, 18 nt, Human
uagugaugguuccccugu

SEQ ID NO: 3729280 - RNA, 20 nt, Human
uagugauuuuuaugccaccu

SEQ ID NO: 3729281 - RNA, 14 nt, Human
uagugcaaauuguc

SEQ ID NO: 3729282 - RNA, 15 nt, Human
uagugcaauauauuu

SEQ ID NO: 3729283 - RNA, 19 nt, Human
uacugcaauuaaagugaua

SEQ ID NO: 3729284 - RNA, 20 nt, Human
uacugcagccuuugccuccc

SEQ ID NO: 3729285 - RNA, 22 nt, Human
uacugcagccuuugccuccccg

SEQ ID NO: 3729286 - RNA, 23 nt, Human
uacugcagcuuuacaugcaauuu

SEQ ID NO: 3729287 - RNA, 16 nt, Human
uacugcagggccagga

SEQ ID NO: 3729288 - RNA, 22 nt, Human
uacugcauacuuuuuaaaugua

SEQ ID NO: 3729289 - RNA, 17 nt, Human
uacugcauaugaaagga

SEQ ID NO: 3729290 - RNA, 16 nt, Human
uacugcauuauuugag

SEQ ID NO: 3729291 - RNA, 18 nt, Human
uacugcauuuagggagua

SEQ ID NO: 3729292 - RNA, 15 nt, Human
uacugccagaugcug

SEQ ID NO: 3729293 - RNA, 24 nt, Human
uacugccagaugcugauguucagu

SEQ ID NO: 3729294 - RNA, 19 nt, Human
uacugcccaggccugccug

SEQ ID NO: 3729295 - RNA, 22 nt, Human
uacugcccaggccugccuguuc

SEQ ID NO: 3729296 - RNA, 22 nt, Human
uacugcccuccagcucuuuccu

SEQ ID NO: 3729297 - RNA, 23 nt, Human
uacugcccuccagcucuuuccuc

SEQ ID NO: 3729298 - RNA, 14 nt, Human
uacugccuauuuua

SEQ ID NO: 3729299 - RNA, 21 nt, Human
uacugccucuacaguuaauag

SEQ ID NO: 3729300 - RNA, 11 nt, Human
uacugccugcu

SEQ ID NO: 3729301 - RNA, 12 nt, Human
uacugccugcuu

SEQ ID NO: 3729302 - RNA, 19 nt, Human
uacugccuuuagaaaauau

SEQ ID NO: 3729303 - RNA, 17 nt, Human
uacugcgacuuucugcc

SEQ ID NO: 3729304 - RNA, 15 nt, Human
uacugcucaggcugc

SEQ ID NO: 3729305 - RNA, 15 nt, Human
uacugcucuccucca

SEQ ID NO: 3729306 - RNA, 13 nt, Human
uacugcuuaauuc

SEQ ID NO: 3729307 - RNA, 19 nt, Human
uacugcuuaauucaaauaa

SEQ ID NO: 3729308 - RNA, 22 nt, Human
uacugcuucuaccaacuggaag

SEQ ID NO: 3729309 - RNA, 18 nt, Human
uacugcuugaauaaacac

SEQ ID NO: 3729310 - RNA, 15 nt, Human
uacugcuuuuaacuu

SEQ ID NO: 3729311 - RNA, 14 nt, Human
uacuggagaagucu

SEQ ID NO: 3729312 - RNA, 16 nt, Human
uacuggauaaauuguu

SEQ ID NO: 3729313 - RNA, 18 nt, Human
uacuggauuuguuguucu

SEQ ID NO: 3729314 - RNA, 22 nt, Human
uacuggcaaaaggaucuuugug

SEQ ID NO: 3729315 - RNA, 18 nt, Human
uacuggccuuuuucauuu

SEQ ID NO: 3729316 - RNA, 18 nt, Human
uacuggcuccucuguggu

SEQ ID NO: 3729317 - RNA, 19 nt, Human
uacuggcuccucuguggug

SEQ ID NO: 3729318 - RNA, 17 nt, Human
uacugggaaggcuacuu

SEQ ID NO: 3729319 - RNA, 16 nt, Human
uacugggagccuaccc

SEQ ID NO: 3729320 - RNA, 20 nt, Human
uacugggccauguugugccu

SEQ ID NO: 3729321 - RNA, 22 nt, Human
uacugggccuuagugggccagg

SEQ ID NO: 3729322 - RNA, 19 nt, Human
uacuggggaaacuggccau

SEQ ID NO: 3729323 - RNA, 24 nt, Human
uacuggggaaacuggccauggccu

SEQ ID NO: 3729324 - RNA, 15 nt, Human
uacuggggcugggga

SEQ ID NO: 3729325 - RNA, 14 nt, Human
uacugggugucauu

SEQ ID NO: 3729326 - RNA, 23 nt, Human
uacuguaaaaugcaaaaaaucuu

SEQ ID NO: 3729327 - RNA, 20 nt, Human
uacuguaaagaaagagagaa

SEQ ID NO: 3729328 - RNA, 23 nt, Human
uacuguaaagaaagagagaaaau

SEQ ID NO: 3729329 - RNA, 11 nt, Human
uacuguaacac

SEQ ID NO: 3729330 - RNA, 19 nt, Human
uacuguaaccuguugcugu

SEQ ID NO: 3729331 - RNA, 19 nt, Human
uacuguaagaauaauuuau

SEQ ID NO: 3729332 - RNA, 20 nt, Human
uacuguaagaauaauuuaua

SEQ ID NO: 3729333 - RNA, 14 nt, Human
uacuguaagacauu

SEQ ID NO: 3729334 - RNA, 18 nt, Human
uacuguaaggcaaucaug

SEQ ID NO: 3729335 - RNA, 16 nt, Human
uacuguaauaauaccu

SEQ ID NO: 3729336 - RNA, 17 nt, Human
uacuguaauaauaccuc

SEQ ID NO: 3729337 - RNA, 17 nt, Human
uacuguaauuugugaua

SEQ ID NO: 3729338 - RNA, 12 nt, Human
uacuguaauuuu

SEQ ID NO: 3729339 - RNA, 19 nt, Human
uacuguacaaugacuuuau

SEQ ID NO: 3729340 - RNA, 19 nt, Human
uacuguacagacagaaaaa

SEQ ID NO: 3729341 - RNA, 23 nt, Human
uacuguacagacagaaaaaacug

SEQ ID NO: 3729342 - RNA, 18 nt, Human
uacuguacagauugcugc

SEQ ID NO: 3729343 - RNA, 21 nt, Human
uacuguacauaaacaaugaug

SEQ ID NO: 3729344 - RNA, 18 nt, Human
uacuguacaugaaaacac

SEQ ID NO: 3729345 - RNA, 21 nt, Human
uacuguacaugaaaacacauu

SEQ ID NO: 3729346 - RNA, 14 nt, Human
uacuguacuuaaua

SEQ ID NO: 3729347 - RNA, 15 nt, Human
uacuguaguuuuucu

SEQ ID NO: 3729348 - RNA, 20 nt, Human
uacuguauagacaguuugua

SEQ ID NO: 3729349 - RNA, 15 nt, Human
uacuguaugaucaaa

SEQ ID NO: 3729350 - RNA, 18 nt, Human
uacuguaugaucaaaugu

SEQ ID NO: 3729351 - RNA, 19 nt, Human
uacugucaaaauaauuuua

SEQ ID NO: 3729352 - RNA, 15 nt, Human
uacugucaaaugaug

SEQ ID NO: 3729353 - RNA, 21 nt, Human
uacugucaaaugaugugcaaa

SEQ ID NO: 3729354 - RNA, 11 nt, Human
uacugucaaua

SEQ ID NO: 3729355 - RNA, 13 nt, Human
uacugucaauaaa

SEQ ID NO: 3729356 - RNA, 16 nt, Human
uacugucaauaaacag

SEQ ID NO: 3729357 - RNA, 16 nt, Human
uacuguccuacccacc

SEQ ID NO: 3729358 - RNA, 18 nt, Human
uacugucuauuaauauuc

SEQ ID NO: 3729359 - RNA, 19 nt, Human
uacugucuauuaauauuca

SEQ ID NO: 3729360 - RNA, 22 nt, Human
uacugucucacugaaacauuua

SEQ ID NO: 3729361 - RNA, 22 nt, Human
uacugucugguuuuaacaauuu

SEQ ID NO: 3729362 - RNA, 14 nt, Human
uacugucuuaauua

SEQ ID NO: 3729363 - RNA, 14 nt, Human
uacugugacuuuau

SEQ ID NO: 3729364 - RNA, 18 nt, Human
uacugugcuggagccacu

SEQ ID NO: 3729365 - RNA, 12 nt, Human
uacuguggagga

SEQ ID NO: 3729366 - RNA, 15 nt, Human
uacuguggcuucuua

SEQ ID NO: 3729367 - RNA, 18 nt, Human
uacugugggcaauuuaga

SEQ ID NO: 3729368 - RNA, 23 nt, Human
uacuguguaaacucaucugaaau

SEQ ID NO: 3729369 - RNA, 22 nt, Human
uacuguguacagaauucugcua

SEQ ID NO: 3729370 - RNA, 23 nt, Human
uacuguguacagaauucugcuac

SEQ ID NO: 3729371 - RNA, 16 nt, Human
uacugugucauaaaca

SEQ ID NO: 3729372 - RNA, 21 nt, Human
uacugugugcuuguuuuauaa

SEQ ID NO: 3729373 - RNA, 19 nt, Human
uacuguguggaacuuuuau

SEQ ID NO: 3729374 - RNA, 14 nt, Human
uacuguguguguga

SEQ ID NO: 3729375 - RNA, 17 nt, Human
uacugugugugugaaug

SEQ ID NO: 3729376 - RNA, 21 nt, Human
uacugugugugugaaugaaca

SEQ ID NO: 3729377 - RNA, 10 nt, Human
uacuguguua

SEQ ID NO: 3729378 - RNA, 12 nt, Human
uacuguguuccu

SEQ ID NO: 3729379 - RNA, 16 nt, Human
uacuguuaaaggaaaa

SEQ ID NO: 3729380 - RNA, 15 nt, Human
uacuguuaaccauuu

SEQ ID NO: 3729381 - RNA, 17 nt, Human
uacuguuacugggcccu

SEQ ID NO: 3729382 - RNA, 15 nt, Human
uacuguuacuugaua

SEQ ID NO: 3729383 - RNA, 15 nt, Human
uacuguuauucuuug

SEQ ID NO: 3729384 - RNA, 13 nt, Human
uacuguucuaaag

SEQ ID NO: 3729385 - RNA, 17 nt, Human
uacuguucuaaagcucu

SEQ ID NO: 3729386 - RNA, 18 nt, Human
uacuguucucuucuugaa

SEQ ID NO: 3729387 - RNA, 10 nt, Human
uacuguucuu

SEQ ID NO: 3729388 - RNA, 12 nt, Human
uacuguucuugc

SEQ ID NO: 3729389 - RNA, 13 nt, Human
uacuguucuugcu

SEQ ID NO: 3729390 - RNA, 20 nt, Human
uacuguugauaauucuuauu

SEQ ID NO: 3729391 - RNA, 22 nt, Human
uacuguuguaagaauucugauu

SEQ ID NO: 3729392 - RNA, 17 nt, Human
uacuguuguccuauggg

SEQ ID NO: 3729393 - RNA, 15 nt, Human
uacuguuuauuucug

SEQ ID NO: 3729394 - RNA, 19 nt, Human
uacuguuugucuucucccc

SEQ ID NO: 3729395 - RNA, 20 nt, Human
uacuguuugucuucucccca

SEQ ID NO: 3729396 - RNA, 23 nt, Human
uacuuaaaaaaaaaaaaaagcuu

SEQ ID NO: 3729397 - RNA, 14 nt, Human
uacuuaaagauuua

SEQ ID NO: 3729398 - RNA, 21 nt, Human
uacuuaaaugguaauaagcac

SEQ ID NO: 3729399 - RNA, 18 nt, Human
uacuuaaauguuauguau

SEQ ID NO: 3729400 - RNA, 19 nt, Human
uacuuaaauguuauguaua

SEQ ID NO: 3729401 - RNA, 16 nt, Human
uacuuaagaauaugcu

SEQ ID NO: 3729402 - RNA, 12 nt, Human
uacuuaagacuu

SEQ ID NO: 3729403 - RNA, 16 nt, Human
uacuuaagagaaaugg

SEQ ID NO: 3729404 - RNA, 15 nt, Human
uacuuaauucaacuu

SEQ ID NO: 3729405 - RNA, 23 nt, Human
uacuuacaugcauuacugcaugc

SEQ ID NO: 3729406 - RNA, 22 nt, Human
uacuuacauucucuaauaagaa

SEQ ID NO: 3729407 - RNA, 17 nt, Human
uacuuacuaaaauauau

SEQ ID NO: 3729408 - RNA, 19 nt, Human
uacuuagaguuucuguuug

SEQ ID NO: 3729409 - RNA, 20 nt, Human
uacuuagaguuucuguuuga

SEQ ID NO: 3729410 - RNA, 17 nt, Human
uacuuagcaaaaagugg

SEQ ID NO: 3729411 - RNA, 20 nt, Human
uacuuagcauccuaagaaau

SEQ ID NO: 3729412 - RNA, 18 nt, Human
uacuuagcuuaucaauuu

SEQ ID NO: 3729413 - RNA, 20 nt, Human
uacuuagcuuaucaauuugu

SEQ ID NO: 3729414 - RNA, 22 nt, Human
uacuuagcuuaucaauuuguca

SEQ ID NO: 3729415 - RNA, 15 nt, Human
uacuuaguauugcaa

SEQ ID NO: 3729416 - RNA, 20 nt, Human
uacuuauauuuucguaugaa

SEQ ID NO: 3729417 - RNA, 22 nt, Human
uacuuauauuuucguaugaaaa

SEQ ID NO: 3729418 - RNA, 21 nt, Human
uacuuauauuuuuaauaaaag

SEQ ID NO: 3729419 - RNA, 15 nt, Human
uacuuaucccugccc

SEQ ID NO: 3729420 - RNA, 21 nt, Human
uacuuaucccugcccauuuca

SEQ ID NO: 3729421 - RNA, 23 nt, Human
uacuuaucccugcccauuucaua

SEQ ID NO: 3729422 - RNA, 13 nt, Human
uacuuauucauug

SEQ ID NO: 3729423 - RNA, 12 nt, Human
uacuuauuuaaa

SEQ ID NO: 3729424 - RNA, 22 nt, Human
uacuuauuuaugaacagacuuu

SEQ ID NO: 3729425 - RNA, 19 nt, Human
uacuucaaaaguauuuucc

SEQ ID NO: 3729426 - RNA, 20 nt, Human
uacuucacuauacaaacaaa

SEQ ID NO: 3729427 - RNA, 19 nt, Human
uacuucacuuuaauucuca

SEQ ID NO: 3729428 - RNA, 13 nt, Human
uacuucagcaaga

SEQ ID NO: 3729429 - RNA, 14 nt, Human
uacuucagcaagag

SEQ ID NO: 3729430 - RNA, 17 nt, Human
uacuucagcaagagaga

SEQ ID NO: 3729431 - RNA, 21 nt, Human
uacuucagcaagagagaaccu

SEQ ID NO: 3729432 - RNA, 19 nt, Human
uagugcaauauauuuugua

SEQ ID NO: 3729433 - RNA, 23 nt, Human
uagugcaauauauuuuguaugca

SEQ ID NO: 3729434 - RNA, 16 nt, Human
uagugcagcugaaauu

SEQ ID NO: 3729435 - RNA, 18 nt, Human
uagugcagcugaaauuga

SEQ ID NO: 3729436 - RNA, 19 nt, Human
uagugcagcugauuuuaac

SEQ ID NO: 3729437 - RNA, 21 nt, Human
uagugccagaauuuuaggaac

SEQ ID NO: 3729438 - RNA, 23 nt, Human
uagugcccuccacagccgcagcc

SEQ ID NO: 3729439 - RNA, 22 nt, Human
uagugccugagaguauuuaggc

SEQ ID NO: 3729440 - RNA, 14 nt, Human
uagugcggacaagu

SEQ ID NO: 3729441 - RNA, 13 nt, Human
uagugcuaagugu

SEQ ID NO: 3729442 - RNA, 14 nt, Human
uagugcuaagugug

SEQ ID NO: 3729443 - RNA, 15 nt, Human
uagugcuaaguguga

SEQ ID NO: 3729444 - RNA, 19 nt, Human
uagugcuaagugugaacug

SEQ ID NO: 3729445 - RNA, 14 nt, Human
uagugcuauauaua

SEQ ID NO: 3729446 - RNA, 22 nt, Human
uagugcuauauauauaaauauu

SEQ ID NO: 3729447 - RNA, 19 nt, Human
uagugcugaagcuuauuaa

SEQ ID NO: 3729448 - RNA, 22 nt, Human
uagugcugcugaagaugaauca

SEQ ID NO: 3729449 - RNA, 12 nt, Human
uagugcugugaa

SEQ ID NO: 3729450 - RNA, 16 nt, Human
uagugcugugaaaaaa

SEQ ID NO: 3729451 - RNA, 17 nt, Human
uagugcugugaaaaaaa

SEQ ID NO: 3729452 - RNA, 12 nt, Human
uagugcuuugag

SEQ ID NO: 3729453 - RNA, 15 nt, Human
uaguggaaaaggcac

SEQ ID NO: 3729454 - RNA, 17 nt, Human
uaguggaaacauuuaua

SEQ ID NO: 3729455 - RNA, 15 nt, Human
uaguggacccugaaa

SEQ ID NO: 3729456 - RNA, 18 nt, Human
uaguggauggaaggggcu

SEQ ID NO: 3729457 - RNA, 15 nt, Human
uaguggauguucuga

SEQ ID NO: 3729458 - RNA, 23 nt, Human
uaguggauuacugccauucacuu

SEQ ID NO: 3729459 - RNA, 17 nt, Human
uaguggccagaccagag

SEQ ID NO: 3729460 - RNA, 19 nt, Human
uaguggccaucauuucugg

SEQ ID NO: 3729461 - RNA, 13 nt, Human
uaguggcugucca

SEQ ID NO: 3729462 - RNA, 20 nt, Human
uaguggcuuaaaacaacacu

SEQ ID NO: 3729463 - RNA, 14 nt, Human
uagugggccagggc

SEQ ID NO: 3729464 - RNA, 20 nt, Human
uaguggggucucccucuccu

SEQ ID NO: 3729465 - RNA, 21 nt, Human
uaguggucuuuguaagagugu

SEQ ID NO: 3729466 - RNA, 14 nt, Human
uagugguguuuuaa

SEQ ID NO: 3729467 - RNA, 20 nt, Human
uagugguuuaucagcaaaaa

SEQ ID NO: 3729468 - RNA, 17 nt, Human
uaguguaaaaaugagaa

SEQ ID NO: 3729469 - RNA, 23 nt, Human
uaguguaacuugcuuaaauuucu

SEQ ID NO: 3729470 - RNA, 15 nt, Human
uaguguaauauacca

SEQ ID NO: 3729471 - RNA, 20 nt, Human
uaguguaggucagcgugcuu

SEQ ID NO: 3729472 - RNA, 14 nt, Human
uaguguaguauucu

SEQ ID NO: 3729473 - RNA, 12 nt, Human
uaguguaucaaa

SEQ ID NO: 3729474 - RNA, 17 nt, Human
uaguguaucaaaaugcu

SEQ ID NO: 3729475 - RNA, 19 nt, Human
uaguguccauuuugugaag

SEQ ID NO: 3729476 - RNA, 16 nt, Human
uaguguccuaugcaau

SEQ ID NO: 3729477 - RNA, 18 nt, Human
uagugugguuuucuguuu

SEQ ID NO: 3729478 - RNA, 15 nt, Human
uaguguguucugauu

SEQ ID NO: 3729479 - RNA, 12 nt, Human
uaguguguugug

SEQ ID NO: 3729480 - RNA, 15 nt, Human
uaguguuaaucaauu

SEQ ID NO: 3729481 - RNA, 13 nt, Human
uaguguuauauga

SEQ ID NO: 3729482 - RNA, 15 nt, Human
uaguguuauaugaac

SEQ ID NO: 3729483 - RNA, 22 nt, Human
uaguguuauaugaacauacaaa

SEQ ID NO: 3729484 - RNA, 15 nt, Human
uaguguucuguuugu

SEQ ID NO: 3729485 - RNA, 15 nt, Human
uaguguuucugugca

SEQ ID NO: 3729486 - RNA, 16 nt, Human
uaguguuucugugcau

SEQ ID NO: 3729487 - RNA, 19 nt, Human
uaguguuuuaagaaaugua

SEQ ID NO: 3729488 - RNA, 13 nt, Human
uaguuaaagaaga

SEQ ID NO: 3729489 - RNA, 20 nt, Human
uaguuaaauguuaccucuga

SEQ ID NO: 3729490 - RNA, 19 nt, Human
uaguuaaauuucuggaccu

SEQ ID NO: 3729491 - RNA, 23 nt, Human
uaguuaauauugugaagaaaaau

SEQ ID NO: 3729492 - RNA, 16 nt, Human
uaguuaaucaucaaga

SEQ ID NO: 3729493 - RNA, 14 nt, Human
uaguuaaucuauaa

SEQ ID NO: 3729494 - RNA, 19 nt, Human
uaguuaauggauuaaauuu

SEQ ID NO: 3729495 - RNA, 19 nt, Human
uaguuaccuuauaguuacu

SEQ ID NO: 3729496 - RNA, 20 nt, Human
uaguuacuguaaaaugcaaa

SEQ ID NO: 3729497 - RNA, 19 nt, Human
uaguuacuguguaaacuca

SEQ ID NO: 3729498 - RNA, 22 nt, Human
uaguuagcuaauaaaaagcuuu

SEQ ID NO: 3729499 - RNA, 16 nt, Human
uaguuaggaaauaaaa

SEQ ID NO: 3729500 - RNA, 21 nt, Human
uaguuaggaugcucaguugcu

SEQ ID NO: 3729501 - RNA, 16 nt, Human
uaguuauaguuucaga

SEQ ID NO: 3729502 - RNA, 15 nt, Human
uaguuauguaaauaa

SEQ ID NO: 3729503 - RNA, 20 nt, Human
uaguuauguaaauaauucuu

SEQ ID NO: 3729504 - RNA, 17 nt, Human
uaguuauucacaaaaau

SEQ ID NO: 3729505 - RNA, 15 nt, Human
uaguucaagaaauga

SEQ ID NO: 3729506 - RNA, 20 nt, Human
uaguucaagaaaugaagagc

SEQ ID NO: 3729507 - RNA, 20 nt, Human
uaguucaucccuucucuucc

SEQ ID NO: 3729508 - RNA, 17 nt, Human
uaguucaugucugcuau

SEQ ID NO: 3729509 - RNA, 23 nt, Human
uaguuccccuguuuauucauaug

SEQ ID NO: 3729510 - RNA, 14 nt, Human
uaguuccuaagaag

SEQ ID NO: 3729511 - RNA, 15 nt, Human
uaguucguagcuuuc

SEQ ID NO: 3729512 - RNA, 13 nt, Human
uaguucuaagacu

SEQ ID NO: 3729513 - RNA, 14 nt, Human
uaguucuagaaaaa

SEQ ID NO: 3729514 - RNA, 11 nt, Human
uaguucuagac

SEQ ID NO: 3729515 - RNA, 15 nt, Human
uaguucuaggcacug

SEQ ID NO: 3729516 - RNA, 16 nt, Human
uaguucuaggcacugu

SEQ ID NO: 3729517 - RNA, 15 nt, Human
uaguucuauuucuau

SEQ ID NO: 3729518 - RNA, 20 nt, Human
uaguucuauuucuaucccaa

SEQ ID NO: 3729519 - RNA, 20 nt, Human
uaguucucacuguucccucu

SEQ ID NO: 3729520 - RNA, 18 nt, Human
uaguucugagcugccagu

SEQ ID NO: 3729521 - RNA, 18 nt, Human
uaguucugcuccagacag

SEQ ID NO: 3729522 - RNA, 14 nt, Human
uaguucuguagaaa

SEQ ID NO: 3729523 - RNA, 11 nt, Human
uaguucuguga

SEQ ID NO: 3729524 - RNA, 17 nt, Human
uaguucuuacugcuuaa

SEQ ID NO: 3729525 - RNA, 12 nt, Human
uaguucuuuaaa

SEQ ID NO: 3729526 - RNA, 15 nt, Human
uaguucuuuggaaau

SEQ ID NO: 3729527 - RNA, 20 nt, Human
uaguugaacugauaguuacu

SEQ ID NO: 3729528 - RNA, 16 nt, Human
uaguugaauacuugaa

SEQ ID NO: 3729529 - RNA, 20 nt, Human
uaguugaauacuugaaccau

SEQ ID NO: 3729530 - RNA, 12 nt, Human
uaguugaauuuu

SEQ ID NO: 3729531 - RNA, 21 nt, Human
uaguugagccagcagacauug

SEQ ID NO: 3729532 - RNA, 22 nt, Human
uaguugagccagcagacauugu

SEQ ID NO: 3729533 - RNA, 19 nt, Human
uaguugcauagcaguauau

SEQ ID NO: 3729534 - RNA, 20 nt, Human
uaguugcauagcaguauaug

SEQ ID NO: 3729535 - RNA, 17 nt, Human
uaguugccuuaaaauaa

SEQ ID NO: 3729536 - RNA, 22 nt, Human
uaguugcguggacucugcacau

SEQ ID NO: 3729537 - RNA, 13 nt, Human
uaguugcuauuuu

SEQ ID NO: 3729538 - RNA, 19 nt, Human
uaguugcuauuuuuguaaa

SEQ ID NO: 3729539 - RNA, 15 nt, Human
uaguugguguucaaa

SEQ ID NO: 3729540 - RNA, 18 nt, Human
uaguuucagauauauauc

SEQ ID NO: 3729541 - RNA, 13 nt, Human
uaguuucuccaag

SEQ ID NO: 3729542 - RNA, 14 nt, Human
uaguuucuccaagc

SEQ ID NO: 3729543 - RNA, 13 nt, Human
uaguuucugaggc

SEQ ID NO: 3729544 - RNA, 15 nt, Human
uaguuucuguucugu

SEQ ID NO: 3729545 - RNA, 17 nt, Human
uaguuucuuuauuuugu

SEQ ID NO: 3729546 - RNA, 14 nt, Human
uaguuucuuuggga

SEQ ID NO: 3729547 - RNA, 19 nt, Human
uaguuugaggaaauuugca

SEQ ID NO: 3729548 - RNA, 16 nt, Human
uaguuugauuaaauuc

SEQ ID NO: 3729549 - RNA, 23 nt, Human
uaguuugauuaaauucuugcaaa

SEQ ID NO: 3729550 - RNA, 21 nt, Human
uaguuugauuauucaguguca

SEQ ID NO: 3729551 - RNA, 12 nt, Human
uaguuugcaguu

SEQ ID NO: 3729552 - RNA, 17 nt, Human
uaguuugcauuccugau

SEQ ID NO: 3729553 - RNA, 17 nt, Human
uaguuugcauuuaagaa

SEQ ID NO: 3729554 - RNA, 21 nt, Human
uaguuugcauuuaagaauugc

SEQ ID NO: 3729555 - RNA, 21 nt, Human
uaguuugcucauacuacauug

SEQ ID NO: 3729556 - RNA, 16 nt, Human
uaguuuggcauuugca

SEQ ID NO: 3729557 - RNA, 18 nt, Human
uaguuuggggcaaaaauc

SEQ ID NO: 3729558 - RNA, 15 nt, Human
uaguuugucuauuuu

SEQ ID NO: 3729559 - RNA, 15 nt, Human
uaguuugugagaaac

SEQ ID NO: 3729560 - RNA, 14 nt, Human
uaguuuuacuuuua

SEQ ID NO: 3729561 - RNA, 19 nt, Human
uaguuuuaucacauguaug

SEQ ID NO: 3729562 - RNA, 21 nt, Human
uaguuuuaucacauguauguu

SEQ ID NO: 3729563 - RNA, 15 nt, Human
uaguuuuauuuauau

SEQ ID NO: 3729564 - RNA, 17 nt, Human
uaguuuuauuuucuaaa

SEQ ID NO: 3729565 - RNA, 23 nt, Human
uaguuuuauuuucuaaaguacug

SEQ ID NO: 3729566 - RNA, 20 nt, Human
uaguuuucuuuccuccuuuc

SEQ ID NO: 3729567 - RNA, 22 nt, Human
uaguuuugauuuaauguuuuca

SEQ ID NO: 3729568 - RNA, 20 nt, Human
uaguuuuuacagcuguguua

SEQ ID NO: 3729569 - RNA, 18 nt, Human
uaguuuuuaccuaccaca

SEQ ID NO: 3729570 - RNA, 21 nt, Human
uaguuuuuguucuuaauugca

SEQ ID NO: 3729571 - RNA, 17 nt, Human
uaguuuuuucuuuuaac

SEQ ID NO: 3729572 - RNA, 23 nt, Human
uaguuuuuuuuuuuuuuauguga

SEQ ID NO: 3729573 - RNA, 17 nt, Human
uauaaaaaaaaugaaau

SEQ ID NO: 3729574 - RNA, 23 nt, Human
uauaaaaaaaaugaaauguuuua

SEQ ID NO: 3729575 - RNA, 13 nt, Human
uauaaaaaauaug

SEQ ID NO: 3729576 - RNA, 14 nt, Human
uauaaaaaauaugu

SEQ ID NO: 3729577 - RNA, 17 nt, Human
uauaaaaaauauguauu

SEQ ID NO: 3729578 - RNA, 11 nt, Human
uauaaaaacaa

SEQ ID NO: 3729579 - RNA, 20 nt, Human
uauaaaaauaaaaaacacug

SEQ ID NO: 3729580 - RNA, 19 nt, Human
uauaaaaauaaaaaagauc

SEQ ID NO: 3729581 - RNA, 23 nt, Human
uauaaaacagcccuauuucuuga

SEQ ID NO: 3729582 - RNA, 18 nt, Human
gccaugccaggaaccugu

SEQ ID NO: 3729583 - RNA, 18 nt, Human
gccaugccgucugccgga

SEQ ID NO: 3729584 - RNA, 13 nt, Human
gccaugccucagc

SEQ ID NO: 3729585 - RNA, 15 nt, Human
gccaugcugaaggga

SEQ ID NO: 3729586 - RNA, 18 nt, Human
gccauggacucuguccug

SEQ ID NO: 3729587 - RNA, 20 nt, Human
gccauggacucuguccugaa

SEQ ID NO: 3729588 - RNA, 21 nt, Human
gccauggacucuguccugaag

SEQ ID NO: 3729589 - RNA, 14 nt, Human
gccauggagaaagc

SEQ ID NO: 3729590 - RNA, 15 nt, Human
gccauggagaaagcu

SEQ ID NO: 3729591 - RNA, 23 nt, Human
gccauggagagcuggagccuggu

SEQ ID NO: 3729592 - RNA, 15 nt, Human
gccauggaggcacac

SEQ ID NO: 3729593 - RNA, 21 nt, Human
gccauggaggcacacagcugc

SEQ ID NO: 3729594 - RNA, 13 nt, Human
gccauggaggcag

SEQ ID NO: 3729595 - RNA, 16 nt, Human
gccaugggccuccugu

SEQ ID NO: 3729596 - RNA, 16 nt, Human
gccaugguacccccuu

SEQ ID NO: 3729597 - RNA, 17 nt, Human
gccaugguacccccuuc

SEQ ID NO: 3729598 - RNA, 21 nt, Human
gccauguaaauccccacuggg

SEQ ID NO: 3729599 - RNA, 17 nt, Human
gccauguacagacagag

SEQ ID NO: 3729600 - RNA, 17 nt, Human
gccauguacuaguuuua

SEQ ID NO: 3729601 - RNA, 15 nt, Human
gccauguagaagcug

SEQ ID NO: 3729602 - RNA, 17 nt, Human
gccauguauaaauguga

SEQ ID NO: 3729603 - RNA, 19 nt, Human
gccauguauaaaugugaua

SEQ ID NO: 3729604 - RNA, 15 nt, Human
gccaugucagacaca

SEQ ID NO: 3729605 - RNA, 23 nt, Human
gccaugugacucuggcuuggccu

SEQ ID NO: 3729606 - RNA, 19 nt, Human
gccaugugcauaguuucuu

SEQ ID NO: 3729607 - RNA, 14 nt, Human
gccaugugccaggu

SEQ ID NO: 3729608 - RNA, 16 nt, Human
gccaugugcuucugcc

SEQ ID NO: 3729609 - RNA, 17 nt, Human
gccauguguuuauccua

SEQ ID NO: 3729610 - RNA, 19 nt, Human
gccauguuccaauaaacag

SEQ ID NO: 3729611 - RNA, 20 nt, Human
gccauguuccaauaaacagg

SEQ ID NO: 3729612 - RNA, 15 nt, Human
gccauguugccccuu

SEQ ID NO: 3729613 - RNA, 15 nt, Human
gccauguuggccagg

SEQ ID NO: 3729614 - RNA, 18 nt, Human
gccauguuggccaggcug

SEQ ID NO: 3729615 - RNA, 19 nt, Human
gccauguugugccucccug

SEQ ID NO: 3729616 - RNA, 20 nt, Human
gccauguugugccucccugg

SEQ ID NO: 3729617 - RNA, 22 nt, Human
gccauguugugccucccuggug

SEQ ID NO: 3729618 - RNA, 23 nt, Human
gccauguugugccucccugguga

SEQ ID NO: 3729619 - RNA, 15 nt, Human
gccauuaaaugaaua

SEQ ID NO: 3729620 - RNA, 14 nt, Human
gccauuaacaaaug

SEQ ID NO: 3729621 - RNA, 19 nt, Human
gccauuacccagcuaaaua

SEQ ID NO: 3729622 - RNA, 20 nt, Human
gccauuauuuucugucagau

SEQ ID NO: 3729623 - RNA, 19 nt, Human
gccauucauguaugucaga

SEQ ID NO: 3729624 - RNA, 20 nt, Human
gccauuccugguacccagcc

SEQ ID NO: 3729625 - RNA, 22 nt, Human
gccauuccugguacccagccau

SEQ ID NO: 3729626 - RNA, 15 nt, Human
gccauucugauuauu

SEQ ID NO: 3729627 - RNA, 22 nt, Human
gccauucugccgcccccuccug

SEQ ID NO: 3729628 - RNA, 21 nt, Human
gccauugcacccagcccagau

SEQ ID NO: 3729629 - RNA, 12 nt, Human
gccauuggaguc

SEQ ID NO: 3729630 - RNA, 22 nt, Human
gccauugucuucggaaaccuug

SEQ ID NO: 3729631 - RNA, 17 nt, Human
gccauugugaaccaaug

SEQ ID NO: 3729632 - RNA, 13 nt, Human
gccauuuauuuau

SEQ ID NO: 3729633 - RNA, 16 nt, Human
gccauuuauuuauuga

SEQ ID NO: 3729634 - RNA, 11 nt, Human
gccauuucaug

SEQ ID NO: 3729635 - RNA, 17 nt, Human
gccauuucuuccacaag

SEQ ID NO: 3729636 - RNA, 20 nt, Human
gccauuucuuccacaagagc

SEQ ID NO: 3729637 - RNA, 11 nt, Human
gccauuugaga

SEQ ID NO: 3729638 - RNA, 13 nt, Human
gccauuugauacc

SEQ ID NO: 3729639 - RNA, 14 nt, Human
gccauuuguacuga

SEQ ID NO: 3729640 - RNA, 16 nt, Human
gccauuugucccaagu

SEQ ID NO: 3729641 - RNA, 20 nt, Human
gccauuugucccaagugcca

SEQ ID NO: 3729642 - RNA, 22 nt, Human
gccauuuuaaggaaaacuaccu

SEQ ID NO: 3729643 - RNA, 20 nt, Human
gccauuuugcauuuucaucu

SEQ ID NO: 3729644 - RNA, 14 nt, Human
gccauuuugugaau

SEQ ID NO: 3729645 - RNA, 18 nt, Human
gccauuuugugaauggau

SEQ ID NO: 3729646 - RNA, 14 nt, Human
gccauuuuuacugu

SEQ ID NO: 3729647 - RNA, 18 nt, Human
gccauuuuucaaagcaau

SEQ ID NO: 3729648 - RNA, 19 nt, Human
gccauuuuucaaagcaauu

SEQ ID NO: 3729649 - RNA, 21 nt, Human
gcccaaaauuuauuuuauaag

SEQ ID NO: 3729650 - RNA, 16 nt, Human
gcccaaagccagacag

SEQ ID NO: 3729651 - RNA, 16 nt, Human
gcccaaaggacgcacu

SEQ ID NO: 3729652 - RNA, 19 nt, Human
gcccaaaggacgcacugag

SEQ ID NO: 3729653 - RNA, 20 nt, Human
gcccaaaggggacaggccuc

SEQ ID NO: 3729654 - RNA, 21 nt, Human
gcccaaaggggacaggccuca

SEQ ID NO: 3729655 - RNA, 20 nt, Human
gcccaaauuaucaagcuaau

SEQ ID NO: 3729656 - RNA, 14 nt, Human
gcccaacaccagcc

SEQ ID NO: 3729657 - RNA, 17 nt, Human
gcccaacaccagccccu

SEQ ID NO: 3729658 - RNA, 16 nt, Human
gcccaacccugucugu

SEQ ID NO: 3729659 - RNA, 15 nt, Human
gcccaacccuucccc

SEQ ID NO: 3729660 - RNA, 16 nt, Human
gcccaacccuucccca

SEQ ID NO: 3729661 - RNA, 13 nt, Human
gcccaaccucagc

SEQ ID NO: 3729662 - RNA, 23 nt, Human
gcccaaccucuuccuccugacac

SEQ ID NO: 3729663 - RNA, 17 nt, Human
gcccaacuguguagcau

SEQ ID NO: 3729664 - RNA, 20 nt, Human
gcccaagacagaugccccag

SEQ ID NO: 3729665 - RNA, 13 nt, Human
gcccaagaugcuu

SEQ ID NO: 3729666 - RNA, 15 nt, Human
gcccaagcccaggcc

SEQ ID NO: 3729667 - RNA, 17 nt, Human
gcccaagcccaggccac

SEQ ID NO: 3729668 - RNA, 17 nt, Human
gcccaaggcggccccuc

SEQ ID NO: 3729669 - RNA, 14 nt, Human
gcccaaggcucccg

SEQ ID NO: 3729670 - RNA, 15 nt, Human
gcccaaggcucccgg

SEQ ID NO: 3729671 - RNA, 15 nt, Human
gcccaagucccuguu

SEQ ID NO: 3729672 - RNA, 17 nt, Human
gcccaagucccuguuuu

SEQ ID NO: 3729673 - RNA, 20 nt, Human
gcccaaguggcagagcuugg

SEQ ID NO: 3729674 - RNA, 18 nt, Human
gcccaauauuauaauuuu

SEQ ID NO: 3729675 - RNA, 14 nt, Human
gcccaaugaaauga

SEQ ID NO: 3729676 - RNA, 20 nt, Human
gcccaaugagacucuagggu

SEQ ID NO: 3729677 - RNA, 21 nt, Human
gcccaaugcacuuuguucugg

SEQ ID NO: 3729678 - RNA, 14 nt, Human
gcccacacacaggu

SEQ ID NO: 3729679 - RNA, 23 nt, Human
gcccacacccagcuacuuuaaca

SEQ ID NO: 3729680 - RNA, 13 nt, Human
gcccacaccuccu

SEQ ID NO: 3729681 - RNA, 14 nt, Human
gcccacaccuccug

SEQ ID NO: 3729682 - RNA, 17 nt, Human
gcccacagcccgcaugc

SEQ ID NO: 3729683 - RNA, 24 nt, Human
gcccacaggaggcaagcaagcucu

SEQ ID NO: 3729684 - RNA, 12 nt, Human
gcccacagggaa

SEQ ID NO: 3729685 - RNA, 22 nt, Human
gcccacagguguccccagccca

SEQ ID NO: 3729686 - RNA, 15 nt, Human
gcccacaguauauuu

SEQ ID NO: 3729687 - RNA, 12 nt, Human
gcccacagucug

SEQ ID NO: 3729688 - RNA, 19 nt, Human
gcccacagucugacuuccc

SEQ ID NO: 3729689 - RNA, 14 nt, Human
gcccacaucccagg

SEQ ID NO: 3729690 - RNA, 23 nt, Human
gcccacauguguccaucccagcg

SEQ ID NO: 3729691 - RNA, 15 nt, Human
gcccacauuggaaga

SEQ ID NO: 3729692 - RNA, 15 nt, Human
gcccacauuuagucu

SEQ ID NO: 3729693 - RNA, 21 nt, Human
gcccacauuuagucucuuuau

SEQ ID NO: 3729694 - RNA, 13 nt, Human
gcccaccagagcu

SEQ ID NO: 3729695 - RNA, 21 nt, Human
gcccaccauuuggcaucccug

SEQ ID NO: 3729696 - RNA, 19 nt, Human
gcccacccaagcaggaggc

SEQ ID NO: 3729697 - RNA, 22 nt, Human
gcccaccccacccacuucugca

SEQ ID NO: 3729698 - RNA, 15 nt, Human
gcccaccccccucau

SEQ ID NO: 3729699 - RNA, 15 nt, Human
gcccacccccucaag

SEQ ID NO: 3729700 - RNA, 15 nt, Human
gcccacccccugccc

SEQ ID NO: 3729701 - RNA, 18 nt, Human
gcccacccccugcccugc

SEQ ID NO: 3729702 - RNA, 19 nt, Human
gcccacccguggagauggg

SEQ ID NO: 3729703 - RNA, 18 nt, Human
gcccacccuccugucuuc

SEQ ID NO: 3729704 - RNA, 12 nt, Human
gcccacccugcu

SEQ ID NO: 3729705 - RNA, 18 nt, Human
gcccacccugcugccuuc

SEQ ID NO: 3729706 - RNA, 21 nt, Human
gcccacccugcugcuggugca

SEQ ID NO: 3729707 - RNA, 17 nt, Human
gcccaccgcaugccccc

SEQ ID NO: 3729708 - RNA, 18 nt, Human
gcccaccgcaugcccccu

SEQ ID NO: 3729709 - RNA, 21 nt, Human
gcccaccuaccuucaaagcug

SEQ ID NO: 3729710 - RNA, 22 nt, Human
gcccaccuaccuucaaagcuga

SEQ ID NO: 3729711 - RNA, 10 nt, Human
gcccaccucc

SEQ ID NO: 3729712 - RNA, 12 nt, Human
gcccaccucccc

SEQ ID NO: 3729713 - RNA, 17 nt, Human
gcccaccuccccacgcc

SEQ ID NO: 3729714 - RNA, 14 nt, Human
gcccaccugcccau

SEQ ID NO: 3729715 - RNA, 15 nt, Human
gcccaccugcccauc

SEQ ID NO: 3729716 - RNA, 17 nt, Human
gcccaccugccuggccg

SEQ ID NO: 3729717 - RNA, 13 nt, Human
gcccaccuggcca

SEQ ID NO: 3729718 - RNA, 20 nt, Human
gcccaccuggccaccugagg

SEQ ID NO: 3729719 - RNA, 16 nt, Human
gcccaccuggccucug

SEQ ID NO: 3729720 - RNA, 17 nt, Human
gcccaccuuggcucaag

SEQ ID NO: 3729721 - RNA, 13 nt, Human
gcccacgccccca

SEQ ID NO: 3729722 - RNA, 21 nt, Human
gcccacgcccccacuggugac

SEQ ID NO: 3729723 - RNA, 17 nt, Human
gcccacgcuggagugca

SEQ ID NO: 3729724 - RNA, 19 nt, Human
gcccacgcuggagugcagu

SEQ ID NO: 3729725 - RNA, 23 nt, Human
gcccacggcuaagaggcugcuga

SEQ ID NO: 3729726 - RNA, 14 nt, Human
gcccacguccuguc

SEQ ID NO: 3729727 - RNA, 23 nt, Human
gcccacguucucucugccuguga

SEQ ID NO: 3729728 - RNA, 17 nt, Human
gcccacuagacccacug

SEQ ID NO: 3729729 - RNA, 23 nt, Human
gcccacuagacccacuggacuca

SEQ ID NO: 3729730 - RNA, 16 nt, Human
gcccacucagggguca

SEQ ID NO: 3729731 - RNA, 15 nt, Human
gcccacuccaucugg

SEQ ID NO: 3729732 - RNA, 16 nt, Human
uacuucaugcugucua

SEQ ID NO: 3729733 - RNA, 22 nt, Human
uacuuccaccucgggcacauuu

SEQ ID NO: 3729734 - RNA, 14 nt, Human
uacuuccccuuccu

SEQ ID NO: 3729735 - RNA, 14 nt, Human
uacuuccuccuccc

SEQ ID NO: 3729736 - RNA, 15 nt, Human
uacuuccugaguggc

SEQ ID NO: 3729737 - RNA, 12 nt, Human
uacuuccugccu

SEQ ID NO: 3729738 - RNA, 23 nt, Human
uacuuccugugacuucagcucug

SEQ ID NO: 3729739 - RNA, 18 nt, Human
uacuucgucuucuaauuu

SEQ ID NO: 3729740 - RNA, 13 nt, Human
uacuucuccaccc

SEQ ID NO: 3729741 - RNA, 18 nt, Human
uacuucuccacccugcuc

SEQ ID NO: 3729742 - RNA, 14 nt, Human
uacuucucuauaaa

SEQ ID NO: 3729743 - RNA, 13 nt, Human
uacuucugaggua

SEQ ID NO: 3729744 - RNA, 16 nt, Human
uacuucuguaauugug

SEQ ID NO: 3729745 - RNA, 22 nt, Human
uacuucuguaauuguguggauu

SEQ ID NO: 3729746 - RNA, 12 nt, Human
uacuucuucugu

SEQ ID NO: 3729747 - RNA, 20 nt, Human
uacuucuugaauauaaaaaa

SEQ ID NO: 3729748 - RNA, 21 nt, Human
uacuucuugaauauaaaaaau

SEQ ID NO: 3729749 - RNA, 19 nt, Human
uacuucuuguguguaugca

SEQ ID NO: 3729750 - RNA, 20 nt, Human
uacuucuuuuuucaaaagaa

SEQ ID NO: 3729751 - RNA, 22 nt, Human
uacuucuuuuuucaaaagaaag

SEQ ID NO: 3729752 - RNA, 14 nt, Human
uacuugaacaaaag

SEQ ID NO: 3729753 - RNA, 19 nt, Human
uacuugaaccauaaaaugu

SEQ ID NO: 3729754 - RNA, 20 nt, Human
uacuugaaccauaaaauguc

SEQ ID NO: 3729755 - RNA, 20 nt, Human
uacuugaacguuuucuaauu

SEQ ID NO: 3729756 - RNA, 21 nt, Human
uacuugaacguuuucuaauug

SEQ ID NO: 3729757 - RNA, 23 nt, Human
uacuugaagucuaaaagcagaaa

SEQ ID NO: 3729758 - RNA, 18 nt, Human
uacuugaauaaccaucug

SEQ ID NO: 3729759 - RNA, 21 nt, Human
uacuugauaacaauguuuuaa

SEQ ID NO: 3729760 - RNA, 14 nt, Human
uacuugcacucuuc

SEQ ID NO: 3729761 - RNA, 22 nt, Human
uacuugcagcucccauucuaug

SEQ ID NO: 3729762 - RNA, 16 nt, Human
uacuugcccugaccau

SEQ ID NO: 3729763 - RNA, 22 nt, Human
uacuugcccugaccaugcauuu

SEQ ID NO: 3729764 - RNA, 16 nt, Human
uacuugcucuggaccu

SEQ ID NO: 3729765 - RNA, 20 nt, Human
uacuugcucuggaccugccc

SEQ ID NO: 3729766 - RNA, 14 nt, Human
uacuugcucuugau

SEQ ID NO: 3729767 - RNA, 23 nt, Human
uacuugggagaccuguaaucaua

SEQ ID NO: 3729768 - RNA, 12 nt, Human
uacuugggaggc

SEQ ID NO: 3729769 - RNA, 18 nt, Human
uacuugggaggcugaggc

SEQ ID NO: 3729770 - RNA, 19 nt, Human
uacuugggccauagcuccu

SEQ ID NO: 3729771 - RNA, 17 nt, Human
uacuuggucacagccag

SEQ ID NO: 3729772 - RNA, 13 nt, Human
uacuuguaaauau

SEQ ID NO: 3729773 - RNA, 14 nt, Human
uacuuguaaauaua

SEQ ID NO: 3729774 - RNA, 15 nt, Human
uacuuguaaauauaa

SEQ ID NO: 3729775 - RNA, 12 nt, Human
uacuuguaauua

SEQ ID NO: 3729776 - RNA, 20 nt, Human
uacuugucaauauuuaaaca

SEQ ID NO: 3729777 - RNA, 14 nt, Human
uacuugucuguuuu

SEQ ID NO: 3729778 - RNA, 18 nt, Human
uacuugugaaacacagcu

SEQ ID NO: 3729779 - RNA, 15 nt, Human
uacuuguggacacag

SEQ ID NO: 3729780 - RNA, 22 nt, Human
uacuuguucaaaauauguucuu

SEQ ID NO: 3729781 - RNA, 14 nt, Human
uacuuguugccuau

SEQ ID NO: 3729782 - RNA, 17 nt, Human
uacuuguugccuauaag

SEQ ID NO: 3729783 - RNA, 13 nt, Human
uacuuguuuugga

SEQ ID NO: 3729784 - RNA, 15 nt, Human
uacuuguuuuuguaa

SEQ ID NO: 3729785 - RNA, 16 nt, Human
uacuuguuuuuguaaa

SEQ ID NO: 3729786 - RNA, 14 nt, Human
uacuuuaaacuugu

SEQ ID NO: 3729787 - RNA, 17 nt, Human
uacuuuaaacuugucuu

SEQ ID NO: 3729788 - RNA, 14 nt, Human
uacuuuaaaggaaa

SEQ ID NO: 3729789 - RNA, 16 nt, Human
uacuuuaaauaauuua

SEQ ID NO: 3729790 - RNA, 14 nt, Human
uacuuuaacaugcc

SEQ ID NO: 3729791 - RNA, 18 nt, Human
uacuuuacacaauucuua

SEQ ID NO: 3729792 - RNA, 15 nt, Human
uacuuuaguaugacg

SEQ ID NO: 3729793 - RNA, 19 nt, Human
uacuuuauaacuaacaugu

SEQ ID NO: 3729794 - RNA, 13 nt, Human
uacuuuauagaag

SEQ ID NO: 3729795 - RNA, 14 nt, Human
uacuuuauagaaga

SEQ ID NO: 3729796 - RNA, 17 nt, Human
uacuuuauguuacuaca

SEQ ID NO: 3729797 - RNA, 20 nt, Human
uacuuucauccugacucugc

SEQ ID NO: 3729798 - RNA, 15 nt, Human
uacuuuccaauucuc

SEQ ID NO: 3729799 - RNA, 19 nt, Human
uacuuucccuacccucuag

SEQ ID NO: 3729800 - RNA, 19 nt, Human
uacuuuccuuuccccagcc

SEQ ID NO: 3729801 - RNA, 17 nt, Human
uacuuucuucagguaaa

SEQ ID NO: 3729802 - RNA, 14 nt, Human
uacuuugaagucau

SEQ ID NO: 3729803 - RNA, 14 nt, Human
uacuuugaaugugu

SEQ ID NO: 3729804 - RNA, 20 nt, Human
uacuuugaauguguuucaca

SEQ ID NO: 3729805 - RNA, 15 nt, Human
uacuuugacaguguu

SEQ ID NO: 3729806 - RNA, 20 nt, Human
uacuuugacaguguuuuuag

SEQ ID NO: 3729807 - RNA, 14 nt, Human
uacuuugacuuuuu

SEQ ID NO: 3729808 - RNA, 23 nt, Human
uacuuugauauuuucaacgcagc

SEQ ID NO: 3729809 - RNA, 15 nt, Human
uacuuugauucacau

SEQ ID NO: 3729810 - RNA, 20 nt, Human
uacuuugauucacauguuuu

SEQ ID NO: 3729811 - RNA, 17 nt, Human
uacuuugccuuuugcaa

SEQ ID NO: 3729812 - RNA, 20 nt, Human
uacuuuggaauacauuucuc

SEQ ID NO: 3729813 - RNA, 18 nt, Human
uacuuugguuucugucug

SEQ ID NO: 3729814 - RNA, 13 nt, Human
uacuuuguaaaua

SEQ ID NO: 3729815 - RNA, 14 nt, Human
uacuuuguaaauuc

SEQ ID NO: 3729816 - RNA, 20 nt, Human
uacuuuguaugauauuccau

SEQ ID NO: 3729817 - RNA, 22 nt, Human
uacuuuguaugauauuccauag

SEQ ID NO: 3729818 - RNA, 16 nt, Human
uacuuuguauuguccu

SEQ ID NO: 3729819 - RNA, 16 nt, Human
uacuuuguauuuugau

SEQ ID NO: 3729820 - RNA, 21 nt, Human
uacuuuguauuuugauuauuu

SEQ ID NO: 3729821 - RNA, 11 nt, Human
uacuuugucag

SEQ ID NO: 3729822 - RNA, 14 nt, Human
uacuuugucugaaa

SEQ ID NO: 3729823 - RNA, 15 nt, Human
uacuuugugcauucu

SEQ ID NO: 3729824 - RNA, 22 nt, Human
uacuuugugcugggguuaucug

SEQ ID NO: 3729825 - RNA, 14 nt, Human
uacuuuguucugcu

SEQ ID NO: 3729826 - RNA, 22 nt, Human
uacuuuguucugcuguucucua

SEQ ID NO: 3729827 - RNA, 19 nt, Human
uacuuuguuuuuaaaugau

SEQ ID NO: 3729828 - RNA, 15 nt, Human
uacuuuuaaagaauu

SEQ ID NO: 3729829 - RNA, 20 nt, Human
uacuuuuacaaguaacaaaa

SEQ ID NO: 3729830 - RNA, 19 nt, Human
uacuuuuaugauguauauu

SEQ ID NO: 3729831 - RNA, 22 nt, Human
uacuuuucuucuauugccucug

SEQ ID NO: 3729832 - RNA, 16 nt, Human
uacuuuugagugugug

SEQ ID NO: 3729833 - RNA, 18 nt, Human
uacuuuuggaaucuagaa

SEQ ID NO: 3729834 - RNA, 10 nt, Human
uacuuuuugg

SEQ ID NO: 3729835 - RNA, 19 nt, Human
uacuuuuuggcauaacaua

SEQ ID NO: 3729836 - RNA, 13 nt, Human
uacuuuuuguuau

SEQ ID NO: 3729837 - RNA, 18 nt, Human
uacuuuuuuaaauauuuu

SEQ ID NO: 3729838 - RNA, 15 nt, Human
uagaaaaauaaaaau

SEQ ID NO: 3729839 - RNA, 12 nt, Human
uagaaaaaugga

SEQ ID NO: 3729840 - RNA, 15 nt, Human
uagaaaacaaugcaa

SEQ ID NO: 3729841 - RNA, 15 nt, Human
uagaaaacaggaaaa

SEQ ID NO: 3729842 - RNA, 17 nt, Human
uagaaaacaggaaaaaa

SEQ ID NO: 3729843 - RNA, 19 nt, Human
uagaaaacauuuggcagaa

SEQ ID NO: 3729844 - RNA, 17 nt, Human
uagaaaaggacuauaag

SEQ ID NO: 3729845 - RNA, 22 nt, Human
uagaaaaggugauaaaaucaua

SEQ ID NO: 3729846 - RNA, 16 nt, Human
uagaaaaguagacaau

SEQ ID NO: 3729847 - RNA, 17 nt, Human
uagaaaagugaauugaa

SEQ ID NO: 3729848 - RNA, 12 nt, Human
uagaaaaguuau

SEQ ID NO: 3729849 - RNA, 21 nt, Human
uagaaaauagagcuuuuaaaa

SEQ ID NO: 3729850 - RNA, 18 nt, Human
uagaaaauauucucuauu

SEQ ID NO: 3729851 - RNA, 12 nt, Human
uagaaaauguga

SEQ ID NO: 3729852 - RNA, 15 nt, Human
uagaaaauucauaac

SEQ ID NO: 3729853 - RNA, 22 nt, Human
uagaaaauuuguuauuuugcaa

SEQ ID NO: 3729854 - RNA, 17 nt, Human
uagaaacaaaauacaau

SEQ ID NO: 3729855 - RNA, 16 nt, Human
uagaaacaacacugua

SEQ ID NO: 3729856 - RNA, 18 nt, Human
uagaaacaacacuguagu

SEQ ID NO: 3729857 - RNA, 20 nt, Human
uagaaacacauaauuaacac

SEQ ID NO: 3729858 - RNA, 17 nt, Human
uagaaacaccaaaaaaa

SEQ ID NO: 3729859 - RNA, 16 nt, Human
uagaaacagugcaaca

SEQ ID NO: 3729860 - RNA, 23 nt, Human
uagaaacaugguuuugaaaugcu

SEQ ID NO: 3729861 - RNA, 15 nt, Human
uagaaaccuuaauau

SEQ ID NO: 3729862 - RNA, 19 nt, Human
uagaaacucaccauguaaa

SEQ ID NO: 3729863 - RNA, 14 nt, Human
uagaaacuggaaau

SEQ ID NO: 3729864 - RNA, 17 nt, Human
uagaaacuggaaauacu

SEQ ID NO: 3729865 - RNA, 23 nt, Human
uagaaacuuaucuuacaaagugu

SEQ ID NO: 3729866 - RNA, 23 nt, Human
uagaaagaauauuugguuuuccu

SEQ ID NO: 3729867 - RNA, 16 nt, Human
uagaaagagaaacagu

SEQ ID NO: 3729868 - RNA, 16 nt, Human
uagaaagcagagauuu

SEQ ID NO: 3729869 - RNA, 15 nt, Human
uagaaagcaggggcu

SEQ ID NO: 3729870 - RNA, 22 nt, Human
uagaaagcaggggcuacaagag

SEQ ID NO: 3729871 - RNA, 15 nt, Human
uagaaagcauuugaa

SEQ ID NO: 3729872 - RNA, 16 nt, Human
uagaaagcauuugaau

SEQ ID NO: 3729873 - RNA, 18 nt, Human
uagaaagcauuugaaugc

SEQ ID NO: 3729874 - RNA, 19 nt, Human
uagaaagcauuugaaugca

SEQ ID NO: 3729875 - RNA, 20 nt, Human
uagaaagugaauaaaaauua

SEQ ID NO: 3729876 - RNA, 18 nt, Human
uagaaagugccagaaagu

SEQ ID NO: 3729877 - RNA, 20 nt, Human
uagaaaguguucuguuacaa

SEQ ID NO: 3729878 - RNA, 20 nt, Human
uagaaauaaaggaugugauu

SEQ ID NO: 3729879 - RNA, 19 nt, Human
uagaaauaaauagcuauau

SEQ ID NO: 3729880 - RNA, 12 nt, Human
uagaaauaagug

SEQ ID NO: 3729881 - RNA, 23 nt, Human
uagaaauaagugguuauuucuca

SEQ ID NO: 3729882 - RNA, 19 nt, Human
uauaaaacugcguuaaagg

SEQ ID NO: 3729883 - RNA, 12 nt, Human
uauaaaacuucu

SEQ ID NO: 3729884 - RNA, 14 nt, Human
uauaaaagacugac

SEQ ID NO: 3729885 - RNA, 12 nt, Human
uauaaaagccug

SEQ ID NO: 3729886 - RNA, 17 nt, Human
uauaaaagccuguuuaa

SEQ ID NO: 3729887 - RNA, 14 nt, Human
uauaaaauaaauau

SEQ ID NO: 3729888 - RNA, 19 nt, Human
uauaaaauaaauauauaua

SEQ ID NO: 3729889 - RNA, 21 nt, Human
uauaaaauaaauauauauaaa

SEQ ID NO: 3729890 - RNA, 15 nt, Human
uauaaaauaacuaaa

SEQ ID NO: 3729891 - RNA, 11 nt, Human
uauaaaauaau

SEQ ID NO: 3729892 - RNA, 23 nt, Human
uauaaaauaauuuuuauauuuga

SEQ ID NO: 3729893 - RNA, 12 nt, Human
uauaaaauacau

SEQ ID NO: 3729894 - RNA, 21 nt, Human
uauaaaauacauagugaaaau

SEQ ID NO: 3729895 - RNA, 18 nt, Human
uauaaaauauaaacaaag

SEQ ID NO: 3729896 - RNA, 21 nt, Human
uauaaaauaugaagacauaaa

SEQ ID NO: 3729897 - RNA, 20 nt, Human
uauaaaaucagccaauuaug

SEQ ID NO: 3729898 - RNA, 21 nt, Human
uauaaaaucagccaauuaugu

SEQ ID NO: 3729899 - RNA, 17 nt, Human
uauaaaauccugugcaa

SEQ ID NO: 3729900 - RNA, 16 nt, Human
uauaaaauggcaacaa

SEQ ID NO: 3729901 - RNA, 12 nt, Human
uauaaaaugugc

SEQ ID NO: 3729902 - RNA, 21 nt, Human
uauaaaaugugcagaugcaau

SEQ ID NO: 3729903 - RNA, 18 nt, Human
uauaaaauuaaagaaaau

SEQ ID NO: 3729904 - RNA, 12 nt, Human
uauaaaauuaug

SEQ ID NO: 3729905 - RNA, 18 nt, Human
uauaaacaaagauucaug

SEQ ID NO: 3729906 - RNA, 14 nt, Human
uauaaacacuauau

SEQ ID NO: 3729907 - RNA, 16 nt, Human
uauaaacauuaaaugu

SEQ ID NO: 3729908 - RNA, 18 nt, Human
uauaaacauuaaaugucu

SEQ ID NO: 3729909 - RNA, 16 nt, Human
uauaaaccuaaaaaag

SEQ ID NO: 3729910 - RNA, 19 nt, Human
uauaaaccuaaaaaagaua

SEQ ID NO: 3729911 - RNA, 19 nt, Human
uauaaaccucuaauuuauu

SEQ ID NO: 3729912 - RNA, 19 nt, Human
uauaaacuaucaguuuguc

SEQ ID NO: 3729913 - RNA, 17 nt, Human
uauaaacuuuaccuuuu

SEQ ID NO: 3729914 - RNA, 13 nt, Human
uauaaacuuuaga

SEQ ID NO: 3729915 - RNA, 17 nt, Human
uauaaagacguuuuaua

SEQ ID NO: 3729916 - RNA, 14 nt, Human
uauaaagagaaaau

SEQ ID NO: 3729917 - RNA, 22 nt, Human
uauaaagagaaaauugaauuua

SEQ ID NO: 3729918 - RNA, 17 nt, Human
uauaaagagaagacgaa

SEQ ID NO: 3729919 - RNA, 15 nt, Human
uauaaagcaucuaaa

SEQ ID NO: 3729920 - RNA, 21 nt, Human
uauaaagccuguauucucaaa

SEQ ID NO: 3729921 - RNA, 16 nt, Human
uauaaagcuagaugcu

SEQ ID NO: 3729922 - RNA, 15 nt, Human
uauaaaguaaagcua

SEQ ID NO: 3729923 - RNA, 16 nt, Human
uauaaaguaaagcuaa

SEQ ID NO: 3729924 - RNA, 18 nt, Human
uauaaaguaguccuguga

SEQ ID NO: 3729925 - RNA, 18 nt, Human
uauaaaguauagagagaa

SEQ ID NO: 3729926 - RNA, 19 nt, Human
uauaaaguauagagagaag

SEQ ID NO: 3729927 - RNA, 19 nt, Human
uauaaagugcuuguguaau

SEQ ID NO: 3729928 - RNA, 19 nt, Human
uauaaaguggaaguaugua

SEQ ID NO: 3729929 - RNA, 17 nt, Human
uauaaaguuuuauauau

SEQ ID NO: 3729930 - RNA, 22 nt, Human
uauaaaguuuuauauauuauau

SEQ ID NO: 3729931 - RNA, 18 nt, Human
uauaaauaaauauauaua

SEQ ID NO: 3729932 - RNA, 20 nt, Human
uauaaauagaauguaaaugu

SEQ ID NO: 3729933 - RNA, 17 nt, Human
uauaaauaggagaggau

SEQ ID NO: 3729934 - RNA, 17 nt, Human
uauaaauauaagccuuu

SEQ ID NO: 3729935 - RNA, 19 nt, Human
uauaaauauauauaaagaa

SEQ ID NO: 3729936 - RNA, 15 nt, Human
uauaaauauauuauu

SEQ ID NO: 3729937 - RNA, 10 nt, Human
uauaaauaug

SEQ ID NO: 3729938 - RNA, 17 nt, Human
uauaaaugggaacauuu

SEQ ID NO: 3729939 - RNA, 16 nt, Human
uauaaauguauauaca

SEQ ID NO: 3729940 - RNA, 20 nt, Human
uauaaauguauauacacaua

SEQ ID NO: 3729941 - RNA, 15 nt, Human
uauaaaugugauaug

SEQ ID NO: 3729942 - RNA, 19 nt, Human
uauaaauuaaauauaugua

SEQ ID NO: 3729943 - RNA, 22 nt, Human
uauaaauuaaauauauguaugu

SEQ ID NO: 3729944 - RNA, 12 nt, Human
uauaaauucugu

SEQ ID NO: 3729945 - RNA, 23 nt, Human
uauaaauugucuuuaaaaacugu

SEQ ID NO: 3729946 - RNA, 20 nt, Human
uauaaauuucgcuucuuaga

SEQ ID NO: 3729947 - RNA, 18 nt, Human
uauaacaaugcuguauuu

SEQ ID NO: 3729948 - RNA, 13 nt, Human
uauaacacauuuu

SEQ ID NO: 3729949 - RNA, 23 nt, Human
uauaacacauuuuuuugcaugca

SEQ ID NO: 3729950 - RNA, 21 nt, Human
uauaacagguuauuuuaguuu

SEQ ID NO: 3729951 - RNA, 15 nt, Human
uauaacaugaaauga

SEQ ID NO: 3729952 - RNA, 19 nt, Human
uauaaccaacuuuucuauu

SEQ ID NO: 3729953 - RNA, 15 nt, Human
uauaaccaauguuua

SEQ ID NO: 3729954 - RNA, 17 nt, Human
uauaaccaauguuuaaa

SEQ ID NO: 3729955 - RNA, 15 nt, Human
uauaaccauaugaua

SEQ ID NO: 3729956 - RNA, 15 nt, Human
uauaaccuuaauuua

SEQ ID NO: 3729957 - RNA, 22 nt, Human
uauauggcagaguuguaaauau

SEQ ID NO: 3729958 - RNA, 20 nt, Human
uauauggggaugguaguuuu

SEQ ID NO: 3729959 - RNA, 19 nt, Human
uauauguacuugucaaaga

SEQ ID NO: 3729960 - RNA, 15 nt, Human
uauauguauccagua

SEQ ID NO: 3729961 - RNA, 19 nt, Human
uauauguauguguuuagaa

SEQ ID NO: 3729962 - RNA, 16 nt, Human
uauauguauuauuuau

SEQ ID NO: 3729963 - RNA, 14 nt, Human
uauauguguauaua

SEQ ID NO: 3729964 - RNA, 13 nt, Human
uauauguguccau

SEQ ID NO: 3729965 - RNA, 12 nt, Human
uauauguuuuaa

SEQ ID NO: 3729966 - RNA, 18 nt, Human
uauauuaaaaaagagaca

SEQ ID NO: 3729967 - RNA, 13 nt, Human
uauauuaaaaaug

SEQ ID NO: 3729968 - RNA, 15 nt, Human
uauauuaaaaauggu

SEQ ID NO: 3729969 - RNA, 22 nt, Human
uauauuaaaaaugguaaaauug

SEQ ID NO: 3729970 - RNA, 13 nt, Human
uauauuaaaauuc

SEQ ID NO: 3729971 - RNA, 21 nt, Human
uauauuaaaauuccaaauuca

SEQ ID NO: 3729972 - RNA, 15 nt, Human
uauauuaagcagaaa

SEQ ID NO: 3729973 - RNA, 15 nt, Human
uauauuaauaguaau

SEQ ID NO: 3729974 - RNA, 22 nt, Human
uauauuaauaguaauuuguaaa

SEQ ID NO: 3729975 - RNA, 17 nt, Human
uauauuaauguacuugu

SEQ ID NO: 3729976 - RNA, 17 nt, Human
uauauuacacauuugua

SEQ ID NO: 3729977 - RNA, 17 nt, Human
uauauuacagauauuug

SEQ ID NO: 3729978 - RNA, 21 nt, Human
uauauuaccagcaagaauaaa

SEQ ID NO: 3729979 - RNA, 14 nt, Human
uauauuaguugcuu

SEQ ID NO: 3729980 - RNA, 18 nt, Human
uauauuauacuuguaauu

SEQ ID NO: 3729981 - RNA, 20 nt, Human
uauauuaucaugcaaaugcu

SEQ ID NO: 3729982 - RNA, 13 nt, Human
uauauuaucuuuu

SEQ ID NO: 3729983 - RNA, 21 nt, Human
uauauucaaccauggacuuua

SEQ ID NO: 3729984 - RNA, 14 nt, Human
uauauucauauauu

SEQ ID NO: 3729985 - RNA, 17 nt, Human
uauauucuauuuuacaa

SEQ ID NO: 3729986 - RNA, 17 nt, Human
uauauucucagcagagu

SEQ ID NO: 3729987 - RNA, 14 nt, Human
uauauucucuuugg

SEQ ID NO: 3729988 - RNA, 22 nt, Human
uauauucuggccagacucgaug

SEQ ID NO: 3729989 - RNA, 14 nt, Human
uauauugaaaaaaa

SEQ ID NO: 3729990 - RNA, 18 nt, Human
uauauugaaauuuauuua

SEQ ID NO: 3729991 - RNA, 21 nt, Human
uauauugaacuuuuguacuga

SEQ ID NO: 3729992 - RNA, 19 nt, Human
uauauugagacaaaaauua

SEQ ID NO: 3729993 - RNA, 12 nt, Human
uauauugauaac

SEQ ID NO: 3729994 - RNA, 22 nt, Human
uauauugauaacagcacugacu

SEQ ID NO: 3729995 - RNA, 15 nt, Human
uauauugguuuuaug

SEQ ID NO: 3729996 - RNA, 17 nt, Human
uauauugguuuuaugau

SEQ ID NO: 3729997 - RNA, 23 nt, Human
uauauugguuuuaugaugacgua

SEQ ID NO: 3729998 - RNA, 20 nt, Human
uauauuguaagaaauacugu

SEQ ID NO: 3729999 - RNA, 18 nt, Human
uauauuguguuuguguau

SEQ ID NO: 3730000 - RNA, 14 nt, Human
uauauuuaaaaaua

SEQ ID NO: 3730001 - RNA, 14 nt, Human
uauauuuaaacuca

SEQ ID NO: 3730002 - RNA, 15 nt, Human
uauauuuaacaagau

SEQ ID NO: 3730003 - RNA, 22 nt, Human
uauauuuaaugcauuaaaccug

SEQ ID NO: 3730004 - RNA, 15 nt, Human
uauauuuaauuauua

SEQ ID NO: 3730005 - RNA, 18 nt, Human
uauauuuacaacacuuua

SEQ ID NO: 3730006 - RNA, 20 nt, Human
uauauuuacuaaaauggacu

SEQ ID NO: 3730007 - RNA, 21 nt, Human
uauauuuagauuguuaaaaua

SEQ ID NO: 3730008 - RNA, 22 nt, Human
uauauuuauaacucaucauaaa

SEQ ID NO: 3730009 - RNA, 15 nt, Human
uauauuuauaaggaa

SEQ ID NO: 3730010 - RNA, 15 nt, Human
uauauuuauuacugu

SEQ ID NO: 3730011 - RNA, 12 nt, Human
uauauuuauuga

SEQ ID NO: 3730012 - RNA, 13 nt, Human
uauauuuauugac

SEQ ID NO: 3730013 - RNA, 16 nt, Human
uauauuuauuuaaagc

SEQ ID NO: 3730014 - RNA, 22 nt, Human
uauauuuauuuaaagcauugcu

SEQ ID NO: 3730015 - RNA, 16 nt, Human
uauauuucagauguaa

SEQ ID NO: 3730016 - RNA, 22 nt, Human
uauauuuccuauaccauuuccg

SEQ ID NO: 3730017 - RNA, 18 nt, Human
uauauuuccuuuauguga

SEQ ID NO: 3730018 - RNA, 19 nt, Human
uauauuuccuuuaugugaa

SEQ ID NO: 3730019 - RNA, 17 nt, Human
uauauuugauuuauuaa

SEQ ID NO: 3730020 - RNA, 14 nt, Human
uauauuugcuuuuu

SEQ ID NO: 3730021 - RNA, 22 nt, Human
uauauuugggccugcuccagac

SEQ ID NO: 3730022 - RNA, 17 nt, Human
uauauuuguaaagcuau

SEQ ID NO: 3730023 - RNA, 20 nt, Human
uauauuuguaaauuuaugug

SEQ ID NO: 3730024 - RNA, 12 nt, Human
uauauuuguaca

SEQ ID NO: 3730025 - RNA, 13 nt, Human
uauauuuguacaa

SEQ ID NO: 3730026 - RNA, 13 nt, Human
uauauuuguauua

SEQ ID NO: 3730027 - RNA, 17 nt, Human
uauauuugugcuauagu

SEQ ID NO: 3730028 - RNA, 13 nt, Human
uauauuuuaagaa

SEQ ID NO: 3730029 - RNA, 13 nt, Human
uauauuuuaagac

SEQ ID NO: 3730030 - RNA, 15 nt, Human
uauauuuuaccauac

SEQ ID NO: 3730031 - RNA, 17 nt, Human
uauauuuuauuucaaug

SEQ ID NO: 3730032 - RNA, 18 nt, Human
uauauuuuauuucaaugu

SEQ ID NO: 3730033 - RNA, 18 nt, Human
uauauuuuauuuuuagaa

SEQ ID NO: 3730034 - RNA, 18 nt, Human
uauauuuucaauucaaaa

SEQ ID NO: 3730035 - RNA, 22 nt, Human
uauauuuucaauucaaaaaugu

SEQ ID NO: 3730036 - RNA, 12 nt, Human
uauauuuucgua

SEQ ID NO: 3730037 - RNA, 16 nt, Human
uauauuuuguaugcaa

SEQ ID NO: 3730038 - RNA, 21 nt, Human
uauauuuuguaugcaagcagu

SEQ ID NO: 3730039 - RNA, 18 nt, Human
uauauuuuuaaaaaauga

SEQ ID NO: 3730040 - RNA, 18 nt, Human
uauauuuuuauauuuacu

SEQ ID NO: 3730041 - RNA, 19 nt, Human
uauauuuuuauauuuacua

SEQ ID NO: 3730042 - RNA, 13 nt, Human
uauauuuuuaucu

SEQ ID NO: 3730043 - RNA, 16 nt, Human
uauauuuuuguuuguu

SEQ ID NO: 3730044 - RNA, 19 nt, Human
uauauuuuuuaaaauaagu

SEQ ID NO: 3730045 - RNA, 22 nt, Human
uauauuuuuuaauuugaugaaa

SEQ ID NO: 3730046 - RNA, 19 nt, Human
uauauuuuuuucugaaauu

SEQ ID NO: 3730047 - RNA, 14 nt, Human
uaucaaaagaaaga

SEQ ID NO: 3730048 - RNA, 14 nt, Human
uaucaaaaugcucu

SEQ ID NO: 3730049 - RNA, 23 nt, Human
uaucaaacaccaacauaaaaaug

SEQ ID NO: 3730050 - RNA, 18 nt, Human
uaucaaacccuagccuug

SEQ ID NO: 3730051 - RNA, 22 nt, Human
uaucaaacccuagccuugcuug

SEQ ID NO: 3730052 - RNA, 23 nt, Human
uaucaaacccuagccuugcuugu

SEQ ID NO: 3730053 - RNA, 20 nt, Human
uaucaaacuacuuuuuaaca

SEQ ID NO: 3730054 - RNA, 12 nt, Human
uaucaaagcaua

SEQ ID NO: 3730055 - RNA, 18 nt, Human
uaucaaagggugaaaauu

SEQ ID NO: 3730056 - RNA, 23 nt, Human
uaucaaauacauuuaaaacauua

SEQ ID NO: 3730057 - RNA, 18 nt, Human
uaucaaauauuagaugug

SEQ ID NO: 3730058 - RNA, 15 nt, Human
uaucaaauuaauugu

SEQ ID NO: 3730059 - RNA, 19 nt, Human
uaucaaauuaauuguguga

SEQ ID NO: 3730060 - RNA, 20 nt, Human
uaucaaauuaauugugugaa

SEQ ID NO: 3730061 - RNA, 21 nt, Human
uaucaaauuaauugugugaac

SEQ ID NO: 3730062 - RNA, 21 nt, Human
uaucaacacuguuacuuucgu

SEQ ID NO: 3730063 - RNA, 19 nt, Human
uaucaacuuagucaauaag

SEQ ID NO: 3730064 - RNA, 15 nt, Human
uaucaagacauagca

SEQ ID NO: 3730065 - RNA, 22 nt, Human
uaucaagccuagauguuuuaua

SEQ ID NO: 3730066 - RNA, 13 nt, Human
uaucaagcuaaua

SEQ ID NO: 3730067 - RNA, 21 nt, Human
uaucaaggucguuuuuuucau

SEQ ID NO: 3730068 - RNA, 19 nt, Human
uaucaaguauagaaaaucu

SEQ ID NO: 3730069 - RNA, 21 nt, Human
uaucaaguauuauaccuuuuu

SEQ ID NO: 3730070 - RNA, 13 nt, Human
uaucaauagucaa

SEQ ID NO: 3730071 - RNA, 20 nt, Human
uaucaauagucaagaaaaau

SEQ ID NO: 3730072 - RNA, 22 nt, Human
uagcagaagaaaggaacauuua

SEQ ID NO: 3730073 - RNA, 11 nt, Human
uagcagacagg

SEQ ID NO: 3730074 - RNA, 16 nt, Human
uagcagaguuaaaucu

SEQ ID NO: 3730075 - RNA, 14 nt, Human
uagcagaugguuuc

SEQ ID NO: 3730076 - RNA, 21 nt, Human
uagcagaugguuuccacauuu

SEQ ID NO: 3730077 - RNA, 18 nt, Human
uagcagauuuuaauuuug

SEQ ID NO: 3730078 - RNA, 20 nt, Human
uagcagauuuuaauuuugaa

SEQ ID NO: 3730079 - RNA, 17 nt, Human
uagcagcaaaaauauaa

SEQ ID NO: 3730080 - RNA, 20 nt, Human
uagcagcaccguucugugca

SEQ ID NO: 3730081 - RNA, 14 nt, Human
uagcagcaccuccu

SEQ ID NO: 3730082 - RNA, 17 nt, Human
uagcagcccacccugcu

SEQ ID NO: 3730083 - RNA, 21 nt, Human
uagcagcccacccugcugcug

SEQ ID NO: 3730084 - RNA, 22 nt, Human
uagcagccccgggagggcggca

SEQ ID NO: 3730085 - RNA, 15 nt, Human
uagcagccuggcucc

SEQ ID NO: 3730086 - RNA, 22 nt, Human
uagcagcggaacaaggagucag

SEQ ID NO: 3730087 - RNA, 22 nt, Human
uagcaggacugaauugucccca

SEQ ID NO: 3730088 - RNA, 11 nt, Human
uagcagggaaa

SEQ ID NO: 3730089 - RNA, 20 nt, Human
uagcagggcauggcugggaa

SEQ ID NO: 3730090 - RNA, 23 nt, Human
uagcaguaaaaaaugguguuuua

SEQ ID NO: 3730091 - RNA, 16 nt, Human
uagcaguaaaagauga

SEQ ID NO: 3730092 - RNA, 16 nt, Human
uagcaguggcaggcag

SEQ ID NO: 3730093 - RNA, 18 nt, Human
uagcaguggcaggcagag

SEQ ID NO: 3730094 - RNA, 24 nt, Human
uagcaguggcaggcagaggcccag

SEQ ID NO: 3730095 - RNA, 21 nt, Human
uagcagugugaaguacaauaa

SEQ ID NO: 3730096 - RNA, 20 nt, Human
uagcaguucugcaaauagaa

SEQ ID NO: 3730097 - RNA, 18 nt, Human
uagcauaaacacaucaca

SEQ ID NO: 3730098 - RNA, 17 nt, Human
uagcauacguacacauu

SEQ ID NO: 3730099 - RNA, 18 nt, Human
uagcauacguacacauuu

SEQ ID NO: 3730100 - RNA, 19 nt, Human
uagcauacguacacauuuu

SEQ ID NO: 3730101 - RNA, 14 nt, Human
uagcauacuggcuu

SEQ ID NO: 3730102 - RNA, 19 nt, Human
uagcauaugacaaauguuu

SEQ ID NO: 3730103 - RNA, 15 nt, Human
uagcaucauccugca

SEQ ID NO: 3730104 - RNA, 19 nt, Human
uagcauccuaagaaauaug

SEQ ID NO: 3730105 - RNA, 22 nt, Human
uagcauccuaagaaauauguga

SEQ ID NO: 3730106 - RNA, 13 nt, Human
uagcauccuggaa

SEQ ID NO: 3730107 - RNA, 16 nt, Human
uagcauccuggaauau

SEQ ID NO: 3730108 - RNA, 18 nt, Human
uagcaucugcauugccca

SEQ ID NO: 3730109 - RNA, 14 nt, Human
uagcaucuguacaa

SEQ ID NO: 3730110 - RNA, 15 nt, Human
uagcaugaaauaaaa

SEQ ID NO: 3730111 - RNA, 16 nt, Human
uagcaugaaauaaaau

SEQ ID NO: 3730112 - RNA, 16 nt, Human
uagcaugacauuucuu

SEQ ID NO: 3730113 - RNA, 13 nt, Human
uagcaugccaaca

SEQ ID NO: 3730114 - RNA, 20 nt, Human
uagcaugccaacaagaaugc

SEQ ID NO: 3730115 - RNA, 21 nt, Human
uagcaugccaacaagaaugca

SEQ ID NO: 3730116 - RNA, 17 nt, Human
uagcaugcuuguugcaa

SEQ ID NO: 3730117 - RNA, 17 nt, Human
uagcauggcauauuuuu

SEQ ID NO: 3730118 - RNA, 13 nt, Human
uagcauguauugu

SEQ ID NO: 3730119 - RNA, 19 nt, Human
uagcauguauugugucuuu

SEQ ID NO: 3730120 - RNA, 17 nt, Human
uagcaugucacuaaagc

SEQ ID NO: 3730121 - RNA, 21 nt, Human
uagcaugucgucaaagcugaa

SEQ ID NO: 3730122 - RNA, 13 nt, Human
uagcauguuguag

SEQ ID NO: 3730123 - RNA, 22 nt, Human
uagcauguuuauaucugcaaaa

SEQ ID NO: 3730124 - RNA, 13 nt, Human
uagcauguuugcu

SEQ ID NO: 3730125 - RNA, 16 nt, Human
uagcauguuugcugaa

SEQ ID NO: 3730126 - RNA, 12 nt, Human
uagcauuaacua

SEQ ID NO: 3730127 - RNA, 22 nt, Human
uagcauuacccccaaccucauu

SEQ ID NO: 3730128 - RNA, 22 nt, Human
uagcauuaugcaauuagguuuu

SEQ ID NO: 3730129 - RNA, 17 nt, Human
uagcauucuuuggaguu

SEQ ID NO: 3730130 - RNA, 19 nt, Human
uagcauuguaaaagcauuu

SEQ ID NO: 3730131 - RNA, 22 nt, Human
uagcauugucuauuuuucucuu

SEQ ID NO: 3730132 - RNA, 15 nt, Human
uagcauuucauucuu

SEQ ID NO: 3730133 - RNA, 18 nt, Human
uagcauuucauucuucuc

SEQ ID NO: 3730134 - RNA, 15 nt, Human
uagcauuuggugcuu

SEQ ID NO: 3730135 - RNA, 18 nt, Human
uagcauuuuaaacaaaau

SEQ ID NO: 3730136 - RNA, 23 nt, Human
uagcauuuuaaacaaaauagaaa

SEQ ID NO: 3730137 - RNA, 19 nt, Human
uagcauuuucugcaucucc

SEQ ID NO: 3730138 - RNA, 22 nt, Human
uagcauuuugcuaaaugugaau

SEQ ID NO: 3730139 - RNA, 15 nt, Human
uagcauuuuggcgcu

SEQ ID NO: 3730140 - RNA, 20 nt, Human
uagcauuuuugauuuaugca

SEQ ID NO: 3730141 - RNA, 16 nt, Human
uagccaaacccuuguc

SEQ ID NO: 3730142 - RNA, 14 nt, Human
uagccaaaccucac

SEQ ID NO: 3730143 - RNA, 22 nt, Human
uagccaaaccucaccaacuccu

SEQ ID NO: 3730144 - RNA, 20 nt, Human
uagccaaaugguuuaacuuc

SEQ ID NO: 3730145 - RNA, 22 nt, Human
uagccaaauugaaaaaagaaau

SEQ ID NO: 3730146 - RNA, 21 nt, Human
uagccaacacccaucuguuuu

SEQ ID NO: 3730147 - RNA, 14 nt, Human
uagccaagugcagg

SEQ ID NO: 3730148 - RNA, 15 nt, Human
uagccacaccaggau

SEQ ID NO: 3730149 - RNA, 22 nt, Human
uagccaccaacucuugcagguc

SEQ ID NO: 3730150 - RNA, 13 nt, Human
uagccaccaucuu

SEQ ID NO: 3730151 - RNA, 17 nt, Human
uagccaccugaguuccu

SEQ ID NO: 3730152 - RNA, 20 nt, Human
uagccacuaaccuugccugg

SEQ ID NO: 3730153 - RNA, 16 nt, Human
uagccacuuaccuuca

SEQ ID NO: 3730154 - RNA, 18 nt, Human
uagccacuuaccuucaau

SEQ ID NO: 3730155 - RNA, 17 nt, Human
uagccagaggcucuaau

SEQ ID NO: 3730156 - RNA, 18 nt, Human
uagccagcugucaagggc

SEQ ID NO: 3730157 - RNA, 23 nt, Human
uagccaggaucaugguguaauaa

SEQ ID NO: 3730158 - RNA, 19 nt, Human
uagccaggucccccugcag

SEQ ID NO: 3730159 - RNA, 16 nt, Human
uagccaguaauccugu

SEQ ID NO: 3730160 - RNA, 19 nt, Human
uagccauauuuguaaaaug

SEQ ID NO: 3730161 - RNA, 22 nt, Human
uagccauauuuguaaaaugaca

SEQ ID NO: 3730162 - RNA, 23 nt, Human
uagccauauuuguaaaaugacaa

SEQ ID NO: 3730163 - RNA, 14 nt, Human
uagccaugggacca

SEQ ID NO: 3730164 - RNA, 19 nt, Human
uagccauguuaacaugaca

SEQ ID NO: 3730165 - RNA, 18 nt, Human
uagccauuccugguaccc

SEQ ID NO: 3730166 - RNA, 17 nt, Human
uagccauugaucauaaa

SEQ ID NO: 3730167 - RNA, 18 nt, Human
uagccauuuuucaaagca

SEQ ID NO: 3730168 - RNA, 19 nt, Human
uagccauuuuucaaagcaa

SEQ ID NO: 3730169 - RNA, 13 nt, Human
uagcccacccugc

SEQ ID NO: 3730170 - RNA, 18 nt, Human
uagcccagcgcucugccu

SEQ ID NO: 3730171 - RNA, 16 nt, Human
uagcccaggagagaga

SEQ ID NO: 3730172 - RNA, 12 nt, Human
uagcccaucccu

SEQ ID NO: 3730173 - RNA, 13 nt, Human
uagccccagugac

SEQ ID NO: 3730174 - RNA, 17 nt, Human
uagcccccuggccucug

SEQ ID NO: 3730175 - RNA, 18 nt, Human
uagcccccuggccucugu

SEQ ID NO: 3730176 - RNA, 21 nt, Human
uagcccccugguaauagcugu

SEQ ID NO: 3730177 - RNA, 20 nt, Human
uagccccucccaagcuggcu

SEQ ID NO: 3730178 - RNA, 14 nt, Human
uagccccugaaagc

SEQ ID NO: 3730179 - RNA, 22 nt, Human
uagccccugggguggccaccag

SEQ ID NO: 3730180 - RNA, 13 nt, Human
uagcccucccacu

SEQ ID NO: 3730181 - RNA, 12 nt, Human
uagcccugcccg

SEQ ID NO: 3730182 - RNA, 18 nt, Human
uagcccuggccagaggcu

SEQ ID NO: 3730183 - RNA, 14 nt, Human
uagcccuguccugg

SEQ ID NO: 3730184 - RNA, 15 nt, Human
uagcccuguccuggu

SEQ ID NO: 3730185 - RNA, 22 nt, Human
uagcccuguccuggugguauuu

SEQ ID NO: 3730186 - RNA, 15 nt, Human
uagcccuuucugugu

SEQ ID NO: 3730187 - RNA, 13 nt, Human
uagccgaccucag

SEQ ID NO: 3730188 - RNA, 19 nt, Human
uagccgagagccugcuccc

SEQ ID NO: 3730189 - RNA, 22 nt, Human
uagccgauaucagaauuugugu

SEQ ID NO: 3730190 - RNA, 19 nt, Human
uagccggagugacagagua

SEQ ID NO: 3730191 - RNA, 19 nt, Human
uagccgggcaugguggcgc

SEQ ID NO: 3730192 - RNA, 21 nt, Human
uagccgguuccugucccugcg

SEQ ID NO: 3730193 - RNA, 18 nt, Human
uagccgugucacgggcau

SEQ ID NO: 3730194 - RNA, 20 nt, Human
uagccuaaggcuccuguuuu

SEQ ID NO: 3730195 - RNA, 21 nt, Human
uagccuaaggcuccuguuuug

SEQ ID NO: 3730196 - RNA, 20 nt, Human
uagccuaauacaacauguag

SEQ ID NO: 3730197 - RNA, 22 nt, Human
uagccuagauaugaauauaugg

SEQ ID NO: 3730198 - RNA, 23 nt, Human
uagccucacuuuuaaugaacaaa

SEQ ID NO: 3730199 - RNA, 12 nt, Human
uagccucccuga

SEQ ID NO: 3730200 - RNA, 19 nt, Human
uagccuccuucgcaggcau

SEQ ID NO: 3730201 - RNA, 20 nt, Human
uagccucgccgucugugaau

SEQ ID NO: 3730202 - RNA, 23 nt, Human
uagccugcacuuugaugucaugu

SEQ ID NO: 3730203 - RNA, 23 nt, Human
uagccugcagaaguaagccucau

SEQ ID NO: 3730204 - RNA, 21 nt, Human
uagccuggaccucugacagca

SEQ ID NO: 3730205 - RNA, 23 nt, Human
uagccuggaccucugacagcagc

SEQ ID NO: 3730206 - RNA, 20 nt, Human
uagccuggagcaccuuuccu

SEQ ID NO: 3730207 - RNA, 20 nt, Human
uagccuggauacaguauaaa

SEQ ID NO: 3730208 - RNA, 12 nt, Human
uagccuguccug

SEQ ID NO: 3730209 - RNA, 20 nt, Human
uagccugugccucugggacu

SEQ ID NO: 3730210 - RNA, 20 nt, Human
uagccuuccguaacccaacu

SEQ ID NO: 3730211 - RNA, 22 nt, Human
uagccuucucuguucauuuccu

SEQ ID NO: 3730212 - RNA, 22 nt, Human
uagccuugcccggauucuggga

SEQ ID NO: 3730213 - RNA, 21 nt, Human
uagccuuuacauggacagaau

SEQ ID NO: 3730214 - RNA, 22 nt, Human
uagccuuuacauggacagaauu

SEQ ID NO: 3730215 - RNA, 23 nt, Human
uagccuuuacauggacagaauuu

SEQ ID NO: 3730216 - RNA, 15 nt, Human
uagccuuuuuguaua

SEQ ID NO: 3730217 - RNA, 17 nt, Human
uagccuuuuuguauaaa

SEQ ID NO: 3730218 - RNA, 19 nt, Human
uagccuuuuuuccccagac

SEQ ID NO: 3730219 - RNA, 14 nt, Human
gccccaugcuggag

SEQ ID NO: 3730220 - RNA, 19 nt, Human
gccccaugcuggagccugu

SEQ ID NO: 3730221 - RNA, 20 nt, Human
gccccaugcuggagccugug

SEQ ID NO: 3730222 - RNA, 22 nt, Human
gccccaugcuggagccugugua

SEQ ID NO: 3730223 - RNA, 23 nt, Human
gccccaugcuggagccuguguaa

SEQ ID NO: 3730224 - RNA, 12 nt, Human
gccccauuccug

SEQ ID NO: 3730225 - RNA, 15 nt, Human
gccccauucugccug

SEQ ID NO: 3730226 - RNA, 19 nt, Human
gcccccaaagcagcccuuc

SEQ ID NO: 3730227 - RNA, 16 nt, Human
gcccccaaccucaggg

SEQ ID NO: 3730228 - RNA, 19 nt, Human
gcccccaaccucagggcuc

SEQ ID NO: 3730229 - RNA, 23 nt, Human
gcccccacagaaagacugagcuc

SEQ ID NO: 3730230 - RNA, 15 nt, Human
gcccccacagugcug

SEQ ID NO: 3730231 - RNA, 18 nt, Human
gcccccacaguugcucua

SEQ ID NO: 3730232 - RNA, 17 nt, Human
gcccccaccacacaucc

SEQ ID NO: 3730233 - RNA, 21 nt, Human
gcccccaccccggggacccug

SEQ ID NO: 3730234 - RNA, 11 nt, Human
gcccccacccu

SEQ ID NO: 3730235 - RNA, 17 nt, Human
gcccccaccgugggcag

SEQ ID NO: 3730236 - RNA, 20 nt, Human
gcccccaccgugggcaggga

SEQ ID NO: 3730237 - RNA, 13 nt, Human
gcccccaccucca

SEQ ID NO: 3730238 - RNA, 18 nt, Human
gcccccaccuccacccuc

SEQ ID NO: 3730239 - RNA, 17 nt, Human
gcccccacugaccagaa

SEQ ID NO: 3730240 - RNA, 13 nt, Human
gcccccacuggcu

SEQ ID NO: 3730241 - RNA, 18 nt, Human
gcccccacuggcuguggg

SEQ ID NO: 3730242 - RNA, 19 nt, Human
gcccccacuggcugugggc

SEQ ID NO: 3730243 - RNA, 14 nt, Human
gcccccacuugccu

SEQ ID NO: 3730244 - RNA, 11 nt, Human
gcccccagagc

SEQ ID NO: 3730245 - RNA, 17 nt, Human
gcccccagagccacagu

SEQ ID NO: 3730246 - RNA, 13 nt, Human
gcccccagagccc

SEQ ID NO: 3730247 - RNA, 18 nt, Human
gcccccagagcccaggcu

SEQ ID NO: 3730248 - RNA, 13 nt, Human
gcccccagcccaa

SEQ ID NO: 3730249 - RNA, 14 nt, Human
gcccccagcccaaa

SEQ ID NO: 3730250 - RNA, 18 nt, Human
gcccccagcccagggcuc

SEQ ID NO: 3730251 - RNA, 21 nt, Human
gcccccagcccagggcuccug

SEQ ID NO: 3730252 - RNA, 18 nt, Human
gcccccagcccccuccug

SEQ ID NO: 3730253 - RNA, 20 nt, Human
gcccccagccccggggugag

SEQ ID NO: 3730254 - RNA, 20 nt, Human
gcccccagccccucccccau

SEQ ID NO: 3730255 - RNA, 12 nt, Human
gcccccagccua

SEQ ID NO: 3730256 - RNA, 21 nt, Human
gcccccagccugucagaucca

SEQ ID NO: 3730257 - RNA, 15 nt, Human
gcccccagcuaagaa

SEQ ID NO: 3730258 - RNA, 18 nt, Human
gcccccagcuguggguac

SEQ ID NO: 3730259 - RNA, 18 nt, Human
gcccccagcuuccagcag

SEQ ID NO: 3730260 - RNA, 19 nt, Human
gcccccagcuuccagcagg

SEQ ID NO: 3730261 - RNA, 20 nt, Human
gcccccagggcacuucacag

SEQ ID NO: 3730262 - RNA, 22 nt, Human
gcccccaguaucucuucagucu

SEQ ID NO: 3730263 - RNA, 23 nt, Human
gcccccagugugcacgaguggga

SEQ ID NO: 3730264 - RNA, 21 nt, Human
gccccccacacuucccuggcg

SEQ ID NO: 3730265 - RNA, 13 nt, Human
gccccccacccca

SEQ ID NO: 3730266 - RNA, 15 nt, Human
gccccccagcucagg

SEQ ID NO: 3730267 - RNA, 22 nt, Human
gcccccccaacacugugcccug

SEQ ID NO: 3730268 - RNA, 23 nt, Human
gcccccccaacacugugcccugg

SEQ ID NO: 3730269 - RNA, 15 nt, Human
gcccccccuuccacu

SEQ ID NO: 3730270 - RNA, 14 nt, Human
gccccccucaaacc

SEQ ID NO: 3730271 - RNA, 18 nt, Human
gcccccgcauccccugcc

SEQ ID NO: 3730272 - RNA, 16 nt, Human
gcccccgccccgcccc

SEQ ID NO: 3730273 - RNA, 20 nt, Human
gcccccgcuguaaugaaaca

SEQ ID NO: 3730274 - RNA, 14 nt, Human
gcccccggcccccu

SEQ ID NO: 3730275 - RNA, 20 nt, Human
gcccccuccgcccugccacu

SEQ ID NO: 3730276 - RNA, 16 nt, Human
gcccccuccucuccca

SEQ ID NO: 3730277 - RNA, 14 nt, Human
gcccccucgugcca

SEQ ID NO: 3730278 - RNA, 15 nt, Human
gcccccucucaggag

SEQ ID NO: 3730279 - RNA, 15 nt, Human
gcccccucugcccug

SEQ ID NO: 3730280 - RNA, 17 nt, Human
gcccccucuucccuggu

SEQ ID NO: 3730281 - RNA, 12 nt, Human
gcccccugcagg

SEQ ID NO: 3730282 - RNA, 20 nt, Human
gcccccugcaggaaggagcu

SEQ ID NO: 3730283 - RNA, 22 nt, Human
gcccccugcaggaaggagcugc

SEQ ID NO: 3730284 - RNA, 13 nt, Human
gcccccugccccc

SEQ ID NO: 3730285 - RNA, 20 nt, Human
gcccccugcuggcucuucug

SEQ ID NO: 3730286 - RNA, 19 nt, Human
gcccccuggccucugugcc

SEQ ID NO: 3730287 - RNA, 13 nt, Human
gcccccuggucuc

SEQ ID NO: 3730288 - RNA, 14 nt, Human
gcccccuggucucu

SEQ ID NO: 3730289 - RNA, 16 nt, Human
gcccccuggucucugg

SEQ ID NO: 3730290 - RNA, 21 nt, Human
gcccccugguggacaguccug

SEQ ID NO: 3730291 - RNA, 14 nt, Human
gcccccugucucuc

SEQ ID NO: 3730292 - RNA, 17 nt, Human
gcccccuguggaugcug

SEQ ID NO: 3730293 - RNA, 17 nt, Human
gcccccuucucccacac

SEQ ID NO: 3730294 - RNA, 20 nt, Human
gcccccuucucccacacugc

SEQ ID NO: 3730295 - RNA, 22 nt, Human
gcccccuucucccacacugcua

SEQ ID NO: 3730296 - RNA, 16 nt, Human
gccccgaagggccccc

SEQ ID NO: 3730297 - RNA, 13 nt, Human
gccccgacuccag

SEQ ID NO: 3730298 - RNA, 14 nt, Human
gccccgacuccagc

SEQ ID NO: 3730299 - RNA, 18 nt, Human
gccccgacuccagccagc

SEQ ID NO: 3730300 - RNA, 19 nt, Human
gccccgacuccagccagcg

SEQ ID NO: 3730301 - RNA, 13 nt, Human
gccccgagcuguc

SEQ ID NO: 3730302 - RNA, 22 nt, Human
gccccgaggccuucucugaagg

SEQ ID NO: 3730303 - RNA, 23 nt, Human
gccccgaggccuucucugaagga

SEQ ID NO: 3730304 - RNA, 15 nt, Human
gccccgcagaccucc

SEQ ID NO: 3730305 - RNA, 18 nt, Human
gccccgcagaccucccca

SEQ ID NO: 3730306 - RNA, 19 nt, Human
gccccgcagaccuccccag

SEQ ID NO: 3730307 - RNA, 20 nt, Human
gccccgcagaccuccccagc

SEQ ID NO: 3730308 - RNA, 21 nt, Human
gccccgcagaccuccccagcc

SEQ ID NO: 3730309 - RNA, 14 nt, Human
gccccgccccacau

SEQ ID NO: 3730310 - RNA, 13 nt, Human
gccccgcccucau

SEQ ID NO: 3730311 - RNA, 18 nt, Human
gccccgcccucuuccuga

SEQ ID NO: 3730312 - RNA, 14 nt, Human
gccccgccuccccg

SEQ ID NO: 3730313 - RNA, 13 nt, Human
gccccgcguggaa

SEQ ID NO: 3730314 - RNA, 16 nt, Human
gccccgcuuguccagc

SEQ ID NO: 3730315 - RNA, 18 nt, Human
gccccgcuuguccagcgc

SEQ ID NO: 3730316 - RNA, 14 nt, Human
gccccggccaccuc

SEQ ID NO: 3730317 - RNA, 14 nt, Human
gccccggccccagc

SEQ ID NO: 3730318 - RNA, 18 nt, Human
gccccggucaccuagcaa

SEQ ID NO: 3730319 - RNA, 15 nt, Human
gccccgucaccaucu

SEQ ID NO: 3730320 - RNA, 18 nt, Human
gccccgucaccaucucag

SEQ ID NO: 3730321 - RNA, 20 nt, Human
gccccgucaccaucucaggc

SEQ ID NO: 3730322 - RNA, 17 nt, Human
gccccgucccccucugg

SEQ ID NO: 3730323 - RNA, 14 nt, Human
gccccgucucaggu

SEQ ID NO: 3730324 - RNA, 20 nt, Human
gccccgucucaugaggggcc

SEQ ID NO: 3730325 - RNA, 13 nt, Human
gccccgugaggca

SEQ ID NO: 3730326 - RNA, 22 nt, Human
gccccgugcagacuggagggga

SEQ ID NO: 3730327 - RNA, 19 nt, Human
gccccuacugcugugaacc

SEQ ID NO: 3730328 - RNA, 22 nt, Human
gccccuagcuuagagccucccu

SEQ ID NO: 3730329 - RNA, 23 nt, Human
gccccucaacucuccuccagagu

SEQ ID NO: 3730330 - RNA, 18 nt, Human
gccccucacccugccuua

SEQ ID NO: 3730331 - RNA, 17 nt, Human
gccccucaccugggcac

SEQ ID NO: 3730332 - RNA, 20 nt, Human
gccccucaccugggcaccug

SEQ ID NO: 3730333 - RNA, 18 nt, Human
gccccucagggucccugg

SEQ ID NO: 3730334 - RNA, 19 nt, Human
gccccucagggucccuggu

SEQ ID NO: 3730335 - RNA, 21 nt, Human
gccccucagggucccuggugg

SEQ ID NO: 3730336 - RNA, 21 nt, Human
gccccucaucucucugcccaa

SEQ ID NO: 3730337 - RNA, 21 nt, Human
gccccucccacacacacccac

SEQ ID NO: 3730338 - RNA, 21 nt, Human
gccccucccacacccaaagcu

SEQ ID NO: 3730339 - RNA, 23 nt, Human
gccccucccacacccaaagcuga

SEQ ID NO: 3730340 - RNA, 18 nt, Human
gccccucccacagcgcug

SEQ ID NO: 3730341 - RNA, 12 nt, Human
gccccucccacc

SEQ ID NO: 3730342 - RNA, 13 nt, Human
gccccucccacca

SEQ ID NO: 3730343 - RNA, 14 nt, Human
gccccucccaccac

SEQ ID NO: 3730344 - RNA, 15 nt, Human
gccccucccccaacc

SEQ ID NO: 3730345 - RNA, 22 nt, Human
gccccucccccaacccccaccc

SEQ ID NO: 3730346 - RNA, 14 nt, Human
gccccucccuaccu

SEQ ID NO: 3730347 - RNA, 16 nt, Human
gccccucccuaccuca

SEQ ID NO: 3730348 - RNA, 13 nt, Human
gccccucccuccu

SEQ ID NO: 3730349 - RNA, 18 nt, Human
gccccuccucucugcccu

SEQ ID NO: 3730350 - RNA, 13 nt, Human
gccccuccucugc

SEQ ID NO: 3730351 - RNA, 20 nt, Human
gccccuccucugccaccucc

SEQ ID NO: 3730352 - RNA, 21 nt, Human
gccccuccucugccaccuccc

SEQ ID NO: 3730353 - RNA, 15 nt, Human
gccccucucaccaaa

SEQ ID NO: 3730354 - RNA, 16 nt, Human
gccccucucagcccuc

SEQ ID NO: 3730355 - RNA, 20 nt, Human
gccccucucccuugggcucu

SEQ ID NO: 3730356 - RNA, 15 nt, Human
gccccucucugggcc

SEQ ID NO: 3730357 - RNA, 15 nt, Human
gccccucugaccccu

SEQ ID NO: 3730358 - RNA, 16 nt, Human
gccccucugcccagcu

SEQ ID NO: 3730359 - RNA, 19 nt, Human
gccccucugcccagcuugg

SEQ ID NO: 3730360 - RNA, 18 nt, Human
gccccucuggucgcuccu

SEQ ID NO: 3730361 - RNA, 19 nt, Human
gccccucuggucgcuccug

SEQ ID NO: 3730362 - RNA, 20 nt, Human
gccccucuggucgcuccugc

SEQ ID NO: 3730363 - RNA, 19 nt, Human
gccccucuugccccccacc

SEQ ID NO: 3730364 - RNA, 17 nt, Human
gccccucuuggagaagu

SEQ ID NO: 3730365 - RNA, 12 nt, Human
gccccucuuucu

SEQ ID NO: 3730366 - RNA, 22 nt, Human
gccccugagacaaauggaggcc

SEQ ID NO: 3730367 - RNA, 20 nt, Human
gccccugagcaaugucugug

SEQ ID NO: 3730368 - RNA, 12 nt, Human
gccccugagccc

SEQ ID NO: 3730369 - RNA, 14 nt, Human
uaucaauaucuaau

SEQ ID NO: 3730370 - RNA, 13 nt, Human
uaucaaucauuuu

SEQ ID NO: 3730371 - RNA, 12 nt, Human
uaucaauguguc

SEQ ID NO: 3730372 - RNA, 15 nt, Human
uaucaaugugucuuu

SEQ ID NO: 3730373 - RNA, 19 nt, Human
uaucaauuaccacaccauc

SEQ ID NO: 3730374 - RNA, 14 nt, Human
uaucacaaaucuua

SEQ ID NO: 3730375 - RNA, 16 nt, Human
uaucacaaaucuuaac

SEQ ID NO: 3730376 - RNA, 16 nt, Human
uaucacacaaagcaga

SEQ ID NO: 3730377 - RNA, 17 nt, Human
uaucacauguauguuuu

SEQ ID NO: 3730378 - RNA, 23 nt, Human
uaucaccaaaaaccuauuccacu

SEQ ID NO: 3730379 - RNA, 16 nt, Human
uaucacccaacgcucc

SEQ ID NO: 3730380 - RNA, 23 nt, Human
uaucacccagacauaaaggaaaa

SEQ ID NO: 3730381 - RNA, 14 nt, Human
uaucaccucauggc

SEQ ID NO: 3730382 - RNA, 13 nt, Human
uaucaccuccccu

SEQ ID NO: 3730383 - RNA, 16 nt, Human
uaucaccuccccuccu

SEQ ID NO: 3730384 - RNA, 18 nt, Human
uaucaccuggcuuguuua

SEQ ID NO: 3730385 - RNA, 20 nt, Human
uaucacuuccaugacauaag

SEQ ID NO: 3730386 - RNA, 16 nt, Human
uaucacuuuuugaacu

SEQ ID NO: 3730387 - RNA, 20 nt, Human
uaucacuuuuugaacuaaga

SEQ ID NO: 3730388 - RNA, 20 nt, Human
uaucagaacuauguuuuugu

SEQ ID NO: 3730389 - RNA, 14 nt, Human
uaucagaagaccac

SEQ ID NO: 3730390 - RNA, 15 nt, Human
uaucagaagagaggg

SEQ ID NO: 3730391 - RNA, 13 nt, Human
uaucagauacauc

SEQ ID NO: 3730392 - RNA, 16 nt, Human
uaucagauacaucacu

SEQ ID NO: 3730393 - RNA, 18 nt, Human
uaucagauacaucacugc

SEQ ID NO: 3730394 - RNA, 15 nt, Human
uaucagauugcuuuu

SEQ ID NO: 3730395 - RNA, 19 nt, Human
uaucagccugucucuucca

SEQ ID NO: 3730396 - RNA, 22 nt, Human
uaucagccugucucuuccauau

SEQ ID NO: 3730397 - RNA, 20 nt, Human
uaucagcggccccuugacuc

SEQ ID NO: 3730398 - RNA, 19 nt, Human
uaucagcuacuuaagagaa

SEQ ID NO: 3730399 - RNA, 21 nt, Human
uaucagcuacuuaagagaaau

SEQ ID NO: 3730400 - RNA, 14 nt, Human
uaucagcuucagaa

SEQ ID NO: 3730401 - RNA, 23 nt, Human
uaucaggauuuccucuugaacca

SEQ ID NO: 3730402 - RNA, 19 nt, Human
uaucaggcaaauuugcauu

SEQ ID NO: 3730403 - RNA, 22 nt, Human
uaucagggaaacuaagauucuu

SEQ ID NO: 3730404 - RNA, 21 nt, Human
uaucaguaacccccuuaaauu

SEQ ID NO: 3730405 - RNA, 20 nt, Human
uaucagucaauauuuuuaga

SEQ ID NO: 3730406 - RNA, 14 nt, Human
uaucagucucugag

SEQ ID NO: 3730407 - RNA, 17 nt, Human
uaucaguguaagcccug

SEQ ID NO: 3730408 - RNA, 15 nt, Human
uaucagugugccccc

SEQ ID NO: 3730409 - RNA, 17 nt, Human
uaucaguguuuuaaauu

SEQ ID NO: 3730410 - RNA, 19 nt, Human
uaucaguguuuuaaauucu

SEQ ID NO: 3730411 - RNA, 16 nt, Human
uaucaguuacccacuc

SEQ ID NO: 3730412 - RNA, 17 nt, Human
uaucaguuacucagccc

SEQ ID NO: 3730413 - RNA, 14 nt, Human
uaucaguugcaaua

SEQ ID NO: 3730414 - RNA, 12 nt, Human
uaucaguuugau

SEQ ID NO: 3730415 - RNA, 13 nt, Human
uaucaguuugauc

SEQ ID NO: 3730416 - RNA, 13 nt, Human
uaucaguuugcua

SEQ ID NO: 3730417 - RNA, 23 nt, Human
uaucauagaaauguaacuuuugu

SEQ ID NO: 3730418 - RNA, 16 nt, Human
uaucauaguuaacaua

SEQ ID NO: 3730419 - RNA, 15 nt, Human
uaucauauauuuaau

SEQ ID NO: 3730420 - RNA, 18 nt, Human
uaucaucacguauguuau

SEQ ID NO: 3730421 - RNA, 18 nt, Human
uaucaucagauagcaucu

SEQ ID NO: 3730422 - RNA, 15 nt, Human
uaucauccacacaug

SEQ ID NO: 3730423 - RNA, 16 nt, Human
uaucauccacauuguu

SEQ ID NO: 3730424 - RNA, 22 nt, Human
uaucaucuaccuagauuuaaua

SEQ ID NO: 3730425 - RNA, 19 nt, Human
uaucaucuggauaggagcc

SEQ ID NO: 3730426 - RNA, 12 nt, Human
uaucaugaauuu

SEQ ID NO: 3730427 - RNA, 15 nt, Human
uaucaugaauuuuaa

SEQ ID NO: 3730428 - RNA, 24 nt, Human
uaucaugaauuuuaaaguaugcau

SEQ ID NO: 3730429 - RNA, 17 nt, Human
uaucaugcaaaugcugu

SEQ ID NO: 3730430 - RNA, 12 nt, Human
uaucaugcauuc

SEQ ID NO: 3730431 - RNA, 17 nt, Human
uaucauggucucaguca

SEQ ID NO: 3730432 - RNA, 12 nt, Human
uaucauguaugg

SEQ ID NO: 3730433 - RNA, 22 nt, Human
uaucauguguaaucaauaaacg

SEQ ID NO: 3730434 - RNA, 21 nt, Human
uaucauguuaguaauaccucu

SEQ ID NO: 3730435 - RNA, 14 nt, Human
uaucauuaaaguuc

SEQ ID NO: 3730436 - RNA, 14 nt, Human
uaucauucaagugu

SEQ ID NO: 3730437 - RNA, 13 nt, Human
uaucauucagcaa

SEQ ID NO: 3730438 - RNA, 13 nt, Human
uaucauucauucu

SEQ ID NO: 3730439 - RNA, 17 nt, Human
uaucauucuaaagauag

SEQ ID NO: 3730440 - RNA, 23 nt, Human
uaucauucuaaagauagaguaaa

SEQ ID NO: 3730441 - RNA, 14 nt, Human
uaucauuuaauaau

SEQ ID NO: 3730442 - RNA, 16 nt, Human
uaucauuuaauaauau

SEQ ID NO: 3730443 - RNA, 21 nt, Human
uaucauuuaauaauauacuug

SEQ ID NO: 3730444 - RNA, 20 nt, Human
uaucauuuauuuuuuacauu

SEQ ID NO: 3730445 - RNA, 14 nt, Human
uaucauuuucugca

SEQ ID NO: 3730446 - RNA, 21 nt, Human
uaucauuuuuguacaguuugc

SEQ ID NO: 3730447 - RNA, 19 nt, Human
uauccaaaccaaauaaaaa

SEQ ID NO: 3730448 - RNA, 14 nt, Human
uauccaaucuguga

SEQ ID NO: 3730449 - RNA, 14 nt, Human
uauccaaugaaaua

SEQ ID NO: 3730450 - RNA, 21 nt, Human
uauccacagaaacauuuucau

SEQ ID NO: 3730451 - RNA, 22 nt, Human
uauccacagagagucccacugc

SEQ ID NO: 3730452 - RNA, 13 nt, Human
uauccaccaccuc

SEQ ID NO: 3730453 - RNA, 14 nt, Human
uauccacccagccc

SEQ ID NO: 3730454 - RNA, 15 nt, Human
uauccacccagccca

SEQ ID NO: 3730455 - RNA, 21 nt, Human
uauccacuguuuauucaacaa

SEQ ID NO: 3730456 - RNA, 13 nt, Human
uauccacuugucc

SEQ ID NO: 3730457 - RNA, 15 nt, Human
uauccacuuugcaca

SEQ ID NO: 3730458 - RNA, 15 nt, Human
uauccagaauggaau

SEQ ID NO: 3730459 - RNA, 11 nt, Human
uauccaggacu

SEQ ID NO: 3730460 - RNA, 17 nt, Human
uauccaggcaccaggac

SEQ ID NO: 3730461 - RNA, 20 nt, Human
uauccaggucaacagaauga

SEQ ID NO: 3730462 - RNA, 21 nt, Human
uauccaggucaacagaaugaa

SEQ ID NO: 3730463 - RNA, 22 nt, Human
uauccaggucaacagaaugaaa

SEQ ID NO: 3730464 - RNA, 19 nt, Human
uauccagguucccucccag

SEQ ID NO: 3730465 - RNA, 17 nt, Human
uauccauaaaaaaaaau

SEQ ID NO: 3730466 - RNA, 24 nt, Human
uauccauaaugcauucuucucugu

SEQ ID NO: 3730467 - RNA, 22 nt, Human
uauccauagugacuuuucaagu

SEQ ID NO: 3730468 - RNA, 17 nt, Human
uauccauauugagucaa

SEQ ID NO: 3730469 - RNA, 22 nt, Human
uauccauauuuuauuacuguuu

SEQ ID NO: 3730470 - RNA, 16 nt, Human
uauccaugcaccaaac

SEQ ID NO: 3730471 - RNA, 14 nt, Human
uauccauguacugu

SEQ ID NO: 3730472 - RNA, 18 nt, Human
uauccauguacuguaguu

SEQ ID NO: 3730473 - RNA, 16 nt, Human
uauccauuaucaugug

SEQ ID NO: 3730474 - RNA, 19 nt, Human
uauccauuaucauguguaa

SEQ ID NO: 3730475 - RNA, 14 nt, Human
uauccauucuuucu

SEQ ID NO: 3730476 - RNA, 22 nt, Human
uaucccaaaguuguuguaaccu

SEQ ID NO: 3730477 - RNA, 17 nt, Human
uaucccaacagucaugu

SEQ ID NO: 3730478 - RNA, 16 nt, Human
uaucccaaucauuguu

SEQ ID NO: 3730479 - RNA, 16 nt, Human
uaucccacauccaacu

SEQ ID NO: 3730480 - RNA, 19 nt, Human
uaucccacggaaaaugcca

SEQ ID NO: 3730481 - RNA, 14 nt, Human
uaucccagcugccu

SEQ ID NO: 3730482 - RNA, 20 nt, Human
uauccccccaucuugcuucc

SEQ ID NO: 3730483 - RNA, 21 nt, Human
uauccccccccuguauaguua

SEQ ID NO: 3730484 - RNA, 13 nt, Human
uauccccugcuac

SEQ ID NO: 3730485 - RNA, 20 nt, Human
uaucccuacuguaauuugug

SEQ ID NO: 3730486 - RNA, 12 nt, Human
uaucccucucca

SEQ ID NO: 3730487 - RNA, 10 nt, Human
uaucccuucc

SEQ ID NO: 3730488 - RNA, 16 nt, Human
uaucccuuccagaugg

SEQ ID NO: 3730489 - RNA, 12 nt, Human
uaucccuucuca

SEQ ID NO: 3730490 - RNA, 16 nt, Human
uaucccuuuucuugac

SEQ ID NO: 3730491 - RNA, 14 nt, Human
uauccgcugccagc

SEQ ID NO: 3730492 - RNA, 18 nt, Human
uauccuaauaaaaaggug

SEQ ID NO: 3730493 - RNA, 12 nt, Human
uauccuacuucu

SEQ ID NO: 3730494 - RNA, 22 nt, Human
uauccuagcacaugcuucaaua

SEQ ID NO: 3730495 - RNA, 13 nt, Human
uauccuauuucag

SEQ ID NO: 3730496 - RNA, 13 nt, Human
uauccucacugcc

SEQ ID NO: 3730497 - RNA, 16 nt, Human
uauccucacugcccuc

SEQ ID NO: 3730498 - RNA, 15 nt, Human
uauccuccaccgucu

SEQ ID NO: 3730499 - RNA, 14 nt, Human
uauccuccagguuu

SEQ ID NO: 3730500 - RNA, 18 nt, Human
uauccuccagguuuuuca

SEQ ID NO: 3730501 - RNA, 19 nt, Human
uauccuccagguuuuucaa

SEQ ID NO: 3730502 - RNA, 11 nt, Human
uauccucccug

SEQ ID NO: 3730503 - RNA, 14 nt, Human
uauccucccuguaa

SEQ ID NO: 3730504 - RNA, 16 nt, Human
uauccucgcucccggg

SEQ ID NO: 3730505 - RNA, 18 nt, Human
uauccucucuuccucuuc

SEQ ID NO: 3730506 - RNA, 11 nt, Human
uauccucugau

SEQ ID NO: 3730507 - RNA, 18 nt, Human
uauccugccaaaaucauu

SEQ ID NO: 3730508 - RNA, 10 nt, Human
uauccugccc

SEQ ID NO: 3730509 - RNA, 15 nt, Human
uauccugcccagugu

SEQ ID NO: 3730510 - RNA, 12 nt, Human
uauccugccuca

SEQ ID NO: 3730511 - RNA, 16 nt, Human
uauccugccucagccc

SEQ ID NO: 3730512 - RNA, 15 nt, Human
uauccugcuguucua

SEQ ID NO: 3730513 - RNA, 23 nt, Human
uauccugggcuuuuguuuugcuu

SEQ ID NO: 3730514 - RNA, 13 nt, Human
uauccugugacug

SEQ ID NO: 3730515 - RNA, 16 nt, Human
uauccugugacugucu

SEQ ID NO: 3730516 - RNA, 21 nt, Human
uauccuguuugaggaaagcaa

SEQ ID NO: 3730517 - RNA, 22 nt, Human
uauccuguuugaggaaagcaag

SEQ ID NO: 3730518 - RNA, 15 nt, Human
uauccuucagccuga

SEQ ID NO: 3730519 - RNA, 17 nt, Human
uauccuuccucuccuuc

SEQ ID NO: 3730520 - RNA, 19 nt, Human
uauccuugggggcucccag

SEQ ID NO: 3730521 - RNA, 20 nt, Human
uagccuuuuuuccccagacu

SEQ ID NO: 3730522 - RNA, 20 nt, Human
uagcgaacccuuuauuugaa

SEQ ID NO: 3730523 - RNA, 20 nt, Human
uagcgacuaaacuagauuuu

SEQ ID NO: 3730524 - RNA, 16 nt, Human
uagcgcacucuucaug

SEQ ID NO: 3730525 - RNA, 17 nt, Human
uagcgcccaguugggug

SEQ ID NO: 3730526 - RNA, 21 nt, Human
uagcgcugccgcaccccagag

SEQ ID NO: 3730527 - RNA, 13 nt, Human
uagcgcuguuuuu

SEQ ID NO: 3730528 - RNA, 19 nt, Human
uagcgugcccgugugcaug

SEQ ID NO: 3730529 - RNA, 16 nt, Human
uagcgugcucacugac

SEQ ID NO: 3730530 - RNA, 13 nt, Human
uagcguucccaac

SEQ ID NO: 3730531 - RNA, 18 nt, Human
uagcguucccaacaacau

SEQ ID NO: 3730532 - RNA, 13 nt, Human
uagcguucuugua

SEQ ID NO: 3730533 - RNA, 14 nt, Human
uagcguucuuguaa

SEQ ID NO: 3730534 - RNA, 17 nt, Human
uagcguucuuguaauuu

SEQ ID NO: 3730535 - RNA, 18 nt, Human
uagcuaaacggauuccaa

SEQ ID NO: 3730536 - RNA, 20 nt, Human
uagcuaacauuuuaaauaaa

SEQ ID NO: 3730537 - RNA, 22 nt, Human
uagcuaaguacacaauaagcaa

SEQ ID NO: 3730538 - RNA, 20 nt, Human
uagcuacagagaaaccagcu

SEQ ID NO: 3730539 - RNA, 23 nt, Human
uagcuacagagaaaccagcuucc

SEQ ID NO: 3730540 - RNA, 21 nt, Human
uagcuacguuuacucacagcc

SEQ ID NO: 3730541 - RNA, 19 nt, Human
uagcuagaagugggccagg

SEQ ID NO: 3730542 - RNA, 16 nt, Human
uagcuaggauuugaac

SEQ ID NO: 3730543 - RNA, 15 nt, Human
uagcuaggugacaua

SEQ ID NO: 3730544 - RNA, 23 nt, Human
uagcuauaauugggucauagaaa

SEQ ID NO: 3730545 - RNA, 14 nt, Human
uagcuauauccaug

SEQ ID NO: 3730546 - RNA, 15 nt, Human
uagcuauauccaugu

SEQ ID NO: 3730547 - RNA, 18 nt, Human
uagcuauauccauguacu

SEQ ID NO: 3730548 - RNA, 20 nt, Human
uagcuauauccauguacugu

SEQ ID NO: 3730549 - RNA, 22 nt, Human
uagcuauauccauguacuguag

SEQ ID NO: 3730550 - RNA, 14 nt, Human
uagcuaucagaaga

SEQ ID NO: 3730551 - RNA, 15 nt, Human
uagcuaucagaagac

SEQ ID NO: 3730552 - RNA, 16 nt, Human
uagcuaucagaagacc

SEQ ID NO: 3730553 - RNA, 21 nt, Human
uagcuaucagaagaccacaaa

SEQ ID NO: 3730554 - RNA, 14 nt, Human
uagcuaugcuguau

SEQ ID NO: 3730555 - RNA, 16 nt, Human
uagcuaugcuguaucu

SEQ ID NO: 3730556 - RNA, 21 nt, Human
uagcuaugcuguaucugugcu

SEQ ID NO: 3730557 - RNA, 16 nt, Human
uagcuaugugaccuug

SEQ ID NO: 3730558 - RNA, 17 nt, Human
uagcuauuuuuauggaa

SEQ ID NO: 3730559 - RNA, 21 nt, Human
uagcuauuuuuauggaauuuu

SEQ ID NO: 3730560 - RNA, 17 nt, Human
uagcucaaacguggcuu

SEQ ID NO: 3730561 - RNA, 13 nt, Human
uagcucaaugagc

SEQ ID NO: 3730562 - RNA, 17 nt, Human
uagcucaaugagcaugu

SEQ ID NO: 3730563 - RNA, 15 nt, Human
uagcucaauuagugu

SEQ ID NO: 3730564 - RNA, 21 nt, Human
uagcucaggugucccugcacu

SEQ ID NO: 3730565 - RNA, 21 nt, Human
uagcuccccgcuucugccugc

SEQ ID NO: 3730566 - RNA, 14 nt, Human
uagcuccccuccuc

SEQ ID NO: 3730567 - RNA, 16 nt, Human
uagcuccuguggcccc

SEQ ID NO: 3730568 - RNA, 20 nt, Human
uagcuccuguggccccaccc

SEQ ID NO: 3730569 - RNA, 22 nt, Human
uagcuccuguggccccacccug

SEQ ID NO: 3730570 - RNA, 22 nt, Human
uagcucuaaaaucugcuuguau

SEQ ID NO: 3730571 - RNA, 21 nt, Human
uagcucuaauguuugcauaua

SEQ ID NO: 3730572 - RNA, 21 nt, Human
uagcucuaggagggcuggcaa

SEQ ID NO: 3730573 - RNA, 11 nt, Human
uagcucugaga

SEQ ID NO: 3730574 - RNA, 17 nt, Human
uagcucugagccaguuc

SEQ ID NO: 3730575 - RNA, 22 nt, Human
uagcucuggggugggcaguuuu

SEQ ID NO: 3730576 - RNA, 20 nt, Human
uagcucuuaauuguucauuu

SEQ ID NO: 3730577 - RNA, 17 nt, Human
uagcugaagaauugaaa

SEQ ID NO: 3730578 - RNA, 19 nt, Human
uagcugaauguuuuucuaa

SEQ ID NO: 3730579 - RNA, 15 nt, Human
uagcugcaaaaauaa

SEQ ID NO: 3730580 - RNA, 15 nt, Human
uagcugcccauuucg

SEQ ID NO: 3730581 - RNA, 23 nt, Human
uagcugccuagcaagcuggccuc

SEQ ID NO: 3730582 - RNA, 12 nt, Human
uagcugcuacaa

SEQ ID NO: 3730583 - RNA, 15 nt, Human
uagcugcuacaaaga

SEQ ID NO: 3730584 - RNA, 16 nt, Human
uagcugcuacaaagaa

SEQ ID NO: 3730585 - RNA, 21 nt, Human
uagcugcuacaaagaagacau

SEQ ID NO: 3730586 - RNA, 23 nt, Human
uagcugcuacaaagaagacaugu

SEQ ID NO: 3730587 - RNA, 23 nt, Human
uagcuggaauuuuuuauucuugu

SEQ ID NO: 3730588 - RNA, 23 nt, Human
uagcuggagaggagcccugccuc

SEQ ID NO: 3730589 - RNA, 22 nt, Human
uagcuggcucugugagggugcu

SEQ ID NO: 3730590 - RNA, 16 nt, Human
uagcugggaaagcaua

SEQ ID NO: 3730591 - RNA, 12 nt, Human
uagcugggacua

SEQ ID NO: 3730592 - RNA, 15 nt, Human
uagcugggacuacag

SEQ ID NO: 3730593 - RNA, 17 nt, Human
uagcugggacuacaggc

SEQ ID NO: 3730594 - RNA, 20 nt, Human
uagcugggacuacaggcacc

SEQ ID NO: 3730595 - RNA, 15 nt, Human
uagcugggauuacag

SEQ ID NO: 3730596 - RNA, 21 nt, Human
uagcugggauuuuaaacuaga

SEQ ID NO: 3730597 - RNA, 22 nt, Human
uagcuggucuuauuuguaaagc

SEQ ID NO: 3730598 - RNA, 12 nt, Human
uagcuguaaggc

SEQ ID NO: 3730599 - RNA, 16 nt, Human
uagcuguacaaauaua

SEQ ID NO: 3730600 - RNA, 13 nt, Human
uagcugugaccug

SEQ ID NO: 3730601 - RNA, 14 nt, Human
uagcugugugaaau

SEQ ID NO: 3730602 - RNA, 11 nt, Human
uagcuguguua

SEQ ID NO: 3730603 - RNA, 13 nt, Human
uagcuguugagcu

SEQ ID NO: 3730604 - RNA, 16 nt, Human
uagcuuaccugacaca

SEQ ID NO: 3730605 - RNA, 19 nt, Human
uagcuuaccugacacaaga

SEQ ID NO: 3730606 - RNA, 17 nt, Human
uagcuuagaccucagcc

SEQ ID NO: 3730607 - RNA, 18 nt, Human
uagcuuagaccucagccu

SEQ ID NO: 3730608 - RNA, 20 nt, Human
uagcuuagaccucagccugu

SEQ ID NO: 3730609 - RNA, 23 nt, Human
uagcuuagaccucagccugugcu

SEQ ID NO: 3730610 - RNA, 19 nt, Human
uagcuuagagccucccuca

SEQ ID NO: 3730611 - RNA, 14 nt, Human
uagcuuaucaauuu

SEQ ID NO: 3730612 - RNA, 18 nt, Human
uagcuuaucaauuuguca

SEQ ID NO: 3730613 - RNA, 20 nt, Human
uagcuuaucaauuugucauu

SEQ ID NO: 3730614 - RNA, 19 nt, Human
uagcuuaucuacuuccaaa

SEQ ID NO: 3730615 - RNA, 22 nt, Human
uagcuuaucuacuuccaaacua

SEQ ID NO: 3730616 - RNA, 14 nt, Human
uagcuuauguuaac

SEQ ID NO: 3730617 - RNA, 11 nt, Human
uagcuucagga

SEQ ID NO: 3730618 - RNA, 18 nt, Human
uagcuucaggaaccucga

SEQ ID NO: 3730619 - RNA, 12 nt, Human
uagcuuccauga

SEQ ID NO: 3730620 - RNA, 21 nt, Human
uagcuucuaccaugaacagaa

SEQ ID NO: 3730621 - RNA, 13 nt, Human
uagcuucugaccu

SEQ ID NO: 3730622 - RNA, 17 nt, Human
uagcuucugaccucagc

SEQ ID NO: 3730623 - RNA, 16 nt, Human
uagcuucugcuuuucu

SEQ ID NO: 3730624 - RNA, 19 nt, Human
uagcuugaaggaucuguuu

SEQ ID NO: 3730625 - RNA, 19 nt, Human
uagcuugauaaagggccaa

SEQ ID NO: 3730626 - RNA, 17 nt, Human
uagcuugcagaacugua

SEQ ID NO: 3730627 - RNA, 20 nt, Human
uagcuuggaaacuggaugag

SEQ ID NO: 3730628 - RNA, 17 nt, Human
uagcuuggggccaggga

SEQ ID NO: 3730629 - RNA, 14 nt, Human
uagcuuuacccuca

SEQ ID NO: 3730630 - RNA, 15 nt, Human
uagcuuuacccucag

SEQ ID NO: 3730631 - RNA, 15 nt, Human
uagcuuuauucuuca

SEQ ID NO: 3730632 - RNA, 22 nt, Human
uagcuuuauuuuuuaaguauuu

SEQ ID NO: 3730633 - RNA, 22 nt, Human
uagcuuuggaaguuuagcucug

SEQ ID NO: 3730634 - RNA, 14 nt, Human
uagcuuuuaggaaa

SEQ ID NO: 3730635 - RNA, 20 nt, Human
uagcuuuuaggaaaaucacu

SEQ ID NO: 3730636 - RNA, 13 nt, Human
uagcuuuucaaac

SEQ ID NO: 3730637 - RNA, 19 nt, Human
uagcuuuugugggggacug

SEQ ID NO: 3730638 - RNA, 15 nt, Human
uagcuuuuuaauugu

SEQ ID NO: 3730639 - RNA, 23 nt, Human
uagcuuuuuucucugauacagaa

SEQ ID NO: 3730640 - RNA, 13 nt, Human
uaggaaaaacuga

SEQ ID NO: 3730641 - RNA, 16 nt, Human
uaggaaaagaaaucua

SEQ ID NO: 3730642 - RNA, 17 nt, Human
uaggaaaaguacauuua

SEQ ID NO: 3730643 - RNA, 12 nt, Human
uaggaaaauuau

SEQ ID NO: 3730644 - RNA, 23 nt, Human
uaggaaaauuggacauuaagcau

SEQ ID NO: 3730645 - RNA, 23 nt, Human
uaggaaaucuuguccagagacaa

SEQ ID NO: 3730646 - RNA, 23 nt, Human
uaggaaauggcuuugugauucaa

SEQ ID NO: 3730647 - RNA, 13 nt, Human
uaggaacaaaucu

SEQ ID NO: 3730648 - RNA, 14 nt, Human
uaggaacaaaucuu

SEQ ID NO: 3730649 - RNA, 20 nt, Human
uaggaacgguaaauuucugu

SEQ ID NO: 3730650 - RNA, 15 nt, Human
uaggaacugcugggc

SEQ ID NO: 3730651 - RNA, 21 nt, Human
uaggaacuuaaauaaugugaa

SEQ ID NO: 3730652 - RNA, 14 nt, Human
uaggaacuucagag

SEQ ID NO: 3730653 - RNA, 16 nt, Human
uaggaacuucagagau

SEQ ID NO: 3730654 - RNA, 17 nt, Human
uaggaagaaagaagaca

SEQ ID NO: 3730655 - RNA, 13 nt, Human
uaggaagaauuuu

SEQ ID NO: 3730656 - RNA, 21 nt, Human
uaggaagagccuuccacccag

SEQ ID NO: 3730657 - RNA, 14 nt, Human
uaggaagccucaga

SEQ ID NO: 3730658 - RNA, 17 nt, Human
uaggaaggcacuucugc

SEQ ID NO: 3730659 - RNA, 21 nt, Human
uaggaaggcacuucugccuga

SEQ ID NO: 3730660 - RNA, 15 nt, Human
uaggaagggaccaag

SEQ ID NO: 3730661 - RNA, 24 nt, Human
uaggaagguacuguaugaucaaau

SEQ ID NO: 3730662 - RNA, 16 nt, Human
uaggaaguaaauuaua

SEQ ID NO: 3730663 - RNA, 20 nt, Human
uaggaagucaauauguggaa

SEQ ID NO: 3730664 - RNA, 18 nt, Human
uaggaaguguaacagcug

SEQ ID NO: 3730665 - RNA, 20 nt, Human
uaggaaguguaacagcugag

SEQ ID NO: 3730666 - RNA, 21 nt, Human
uaggaaguguaacagcugagg

SEQ ID NO: 3730667 - RNA, 19 nt, Human
uaggaaguuaaaagcacaa

SEQ ID NO: 3730668 - RNA, 21 nt, Human
uaggaaguuagccuuuaucua

SEQ ID NO: 3730669 - RNA, 17 nt, Human
uaggaaguugacuuaua

SEQ ID NO: 3730670 - RNA, 23 nt, Human
uauccuugggggcucccagggca

SEQ ID NO: 3730671 - RNA, 12 nt, Human
uauccuuucaca

SEQ ID NO: 3730672 - RNA, 18 nt, Human
uauccuuucauauaguua

SEQ ID NO: 3730673 - RNA, 17 nt, Human
uauccuuucuaacaaaa

SEQ ID NO: 3730674 - RNA, 14 nt, Human
uauccuuuucugug

SEQ ID NO: 3730675 - RNA, 16 nt, Human
uauccuuuucuguguu

SEQ ID NO: 3730676 - RNA, 16 nt, Human
uaucgaaauaacaaug

SEQ ID NO: 3730677 - RNA, 16 nt, Human
uaucgaucucuuauuu

SEQ ID NO: 3730678 - RNA, 19 nt, Human
uaucgauguuauguaaaag

SEQ ID NO: 3730679 - RNA, 20 nt, Human
uaucgcugacuucauggaau

SEQ ID NO: 3730680 - RNA, 18 nt, Human
uaucgcuucauguaacua

SEQ ID NO: 3730681 - RNA, 14 nt, Human
uaucggaagcagug

SEQ ID NO: 3730682 - RNA, 16 nt, Human
uaucggagacagugau

SEQ ID NO: 3730683 - RNA, 17 nt, Human
uaucggggaagccagac

SEQ ID NO: 3730684 - RNA, 18 nt, Human
uaucggggaagccagacg

SEQ ID NO: 3730685 - RNA, 12 nt, Human
uaucgggggcug

SEQ ID NO: 3730686 - RNA, 16 nt, Human
uaucgguauaaaggca

SEQ ID NO: 3730687 - RNA, 18 nt, Human
uaucguuuucuuaaagug

SEQ ID NO: 3730688 - RNA, 14 nt, Human
uaucuaaaagaaau

SEQ ID NO: 3730689 - RNA, 12 nt, Human
uaucuaaaguua

SEQ ID NO: 3730690 - RNA, 19 nt, Human
uaucuaaaguuauauuuca

SEQ ID NO: 3730691 - RNA, 20 nt, Human
uaucuaaaguuauauuucag

SEQ ID NO: 3730692 - RNA, 12 nt, Human
uaucuaaaugau

SEQ ID NO: 3730693 - RNA, 12 nt, Human
uaucuaaauuaa

SEQ ID NO: 3730694 - RNA, 17 nt, Human
uaucuaaauugaauaau

SEQ ID NO: 3730695 - RNA, 21 nt, Human
uaucuaaauugaauaauggua

SEQ ID NO: 3730696 - RNA, 13 nt, Human
uaucuaagaauaa

SEQ ID NO: 3730697 - RNA, 15 nt, Human
uaucuaagaauaaua

SEQ ID NO: 3730698 - RNA, 19 nt, Human
uaucuaagaauaauaaaau

SEQ ID NO: 3730699 - RNA, 18 nt, Human
uaucuaagaauacagcuu

SEQ ID NO: 3730700 - RNA, 15 nt, Human
uaucuaauaccucug

SEQ ID NO: 3730701 - RNA, 17 nt, Human
uaucuaauauauaugaa

SEQ ID NO: 3730702 - RNA, 18 nt, Human
uaucuaauauauaugaau

SEQ ID NO: 3730703 - RNA, 21 nt, Human
uaucuaauauguaacaagcca

SEQ ID NO: 3730704 - RNA, 13 nt, Human
uaucuaaucauga

SEQ ID NO: 3730705 - RNA, 13 nt, Human
uaucuaaugacau

SEQ ID NO: 3730706 - RNA, 14 nt, Human
uaucuaauucuuua

SEQ ID NO: 3730707 - RNA, 16 nt, Human
uaucuacaucuuuuuu

SEQ ID NO: 3730708 - RNA, 15 nt, Human
uaucuaccaacuuuc

SEQ ID NO: 3730709 - RNA, 22 nt, Human
uaucuacccaagggcagaaagu

SEQ ID NO: 3730710 - RNA, 14 nt, Human
uaucuacucuccuc

SEQ ID NO: 3730711 - RNA, 20 nt, Human
uaucuacugauaaagaaaga

SEQ ID NO: 3730712 - RNA, 22 nt, Human
uaucuacuuuuacucauaagua

SEQ ID NO: 3730713 - RNA, 19 nt, Human
uaucuagauacuguaucau

SEQ ID NO: 3730714 - RNA, 15 nt, Human
uaucuagauguaaau

SEQ ID NO: 3730715 - RNA, 13 nt, Human
uaucuagcugcau

SEQ ID NO: 3730716 - RNA, 14 nt, Human
uaucuaguaauaua

SEQ ID NO: 3730717 - RNA, 20 nt, Human
uaucuagugcagcugauuuu

SEQ ID NO: 3730718 - RNA, 15 nt, Human
uaucuaguguuugau

SEQ ID NO: 3730719 - RNA, 21 nt, Human
uaucuauauaguaccuuugcu

SEQ ID NO: 3730720 - RNA, 17 nt, Human
uaucuauauauguguau

SEQ ID NO: 3730721 - RNA, 22 nt, Human
uaucuauauauguguauguacg

SEQ ID NO: 3730722 - RNA, 14 nt, Human
uaucuaucuuccaa

SEQ ID NO: 3730723 - RNA, 14 nt, Human
uaucuauguuuuac

SEQ ID NO: 3730724 - RNA, 13 nt, Human
uaucuauuaauau

SEQ ID NO: 3730725 - RNA, 18 nt, Human
uaucuauucugagaaaac

SEQ ID NO: 3730726 - RNA, 19 nt, Human
uaucuauuguaagauaaaa

SEQ ID NO: 3730727 - RNA, 19 nt, Human
uaucuauuuguauauauac

SEQ ID NO: 3730728 - RNA, 20 nt, Human
uaucuauuuguauauauaca

SEQ ID NO: 3730729 - RNA, 17 nt, Human
uaucucaaaacugcacu

SEQ ID NO: 3730730 - RNA, 22 nt, Human
uaucucaaugaaccauaaauuc

SEQ ID NO: 3730731 - RNA, 14 nt, Human
uaucucacagcaca

SEQ ID NO: 3730732 - RNA, 16 nt, Human
uaucucacagcacacu

SEQ ID NO: 3730733 - RNA, 12 nt, Human
uaucucagaaag

SEQ ID NO: 3730734 - RNA, 15 nt, Human
uaucucagggccugg

SEQ ID NO: 3730735 - RNA, 18 nt, Human
uaucucagucaugcauaa

SEQ ID NO: 3730736 - RNA, 14 nt, Human
uaucucaucaacaa

SEQ ID NO: 3730737 - RNA, 23 nt, Human
uaucucaucaacaaagaaauauu

SEQ ID NO: 3730738 - RNA, 11 nt, Human
uaucucaucuc

SEQ ID NO: 3730739 - RNA, 16 nt, Human
uaucuccagcggcccu

SEQ ID NO: 3730740 - RNA, 16 nt, Human
uaucucccccagcccc

SEQ ID NO: 3730741 - RNA, 18 nt, Human
uaucucccccagccccau

SEQ ID NO: 3730742 - RNA, 22 nt, Human
uaucucccugccuccugccggc

SEQ ID NO: 3730743 - RNA, 16 nt, Human
uaucuccggcucccag

SEQ ID NO: 3730744 - RNA, 18 nt, Human
uaucuccucgcaagcugg

SEQ ID NO: 3730745 - RNA, 14 nt, Human
uaucuccugacaga

SEQ ID NO: 3730746 - RNA, 20 nt, Human
uaucucuacugaaugucauu

SEQ ID NO: 3730747 - RNA, 16 nt, Human
uaucucuauuuaauau

SEQ ID NO: 3730748 - RNA, 12 nt, Human
uaucucucugug

SEQ ID NO: 3730749 - RNA, 17 nt, Human
uaucucugaagcauguu

SEQ ID NO: 3730750 - RNA, 18 nt, Human
uaucucugaagcauguuu

SEQ ID NO: 3730751 - RNA, 18 nt, Human
uaucucugaguucugugu

SEQ ID NO: 3730752 - RNA, 16 nt, Human
uaucucugugugcaca

SEQ ID NO: 3730753 - RNA, 23 nt, Human
uaucucugugugcacaaauauuu

SEQ ID NO: 3730754 - RNA, 14 nt, Human
uaucucuucagucu

SEQ ID NO: 3730755 - RNA, 16 nt, Human
uaucucuuuuauauuu

SEQ ID NO: 3730756 - RNA, 14 nt, Human
uaucugaaaacugg

SEQ ID NO: 3730757 - RNA, 16 nt, Human
uaucugaaaacuggaa

SEQ ID NO: 3730758 - RNA, 20 nt, Human
uaucugaaaauguaugugua

SEQ ID NO: 3730759 - RNA, 14 nt, Human
uaucugaacauuua

SEQ ID NO: 3730760 - RNA, 15 nt, Human
uaucugaacauuuac

SEQ ID NO: 3730761 - RNA, 18 nt, Human
uaucugacaucucugcaa

SEQ ID NO: 3730762 - RNA, 19 nt, Human
uaucugagcucuuugcacu

SEQ ID NO: 3730763 - RNA, 16 nt, Human
uaucugaggaauucug

SEQ ID NO: 3730764 - RNA, 17 nt, Human
uaucugaggaauucugu

SEQ ID NO: 3730765 - RNA, 21 nt, Human
uaucugaggaauucuguauag

SEQ ID NO: 3730766 - RNA, 13 nt, Human
uaucugaggucac

SEQ ID NO: 3730767 - RNA, 18 nt, Human
uaucugaguugccaagac

SEQ ID NO: 3730768 - RNA, 13 nt, Human
uaucugaucagaa

SEQ ID NO: 3730769 - RNA, 18 nt, Human
uaucugcaggcagacacg

SEQ ID NO: 3730770 - RNA, 21 nt, Human
uaucugcaggcagacacggau

SEQ ID NO: 3730771 - RNA, 14 nt, Human
uaucugccuuuauu

SEQ ID NO: 3730772 - RNA, 20 nt, Human
uaucugcuucaguggagaau

SEQ ID NO: 3730773 - RNA, 16 nt, Human
uaucuggaaugagccu

SEQ ID NO: 3730774 - RNA, 20 nt, Human
uaucuggaggccuuccagcu

SEQ ID NO: 3730775 - RNA, 19 nt, Human
uaucuggccauauuuacua

SEQ ID NO: 3730776 - RNA, 22 nt, Human
uaucuggccccagguagaaacu

SEQ ID NO: 3730777 - RNA, 18 nt, Human
uaucuggccuaaaaucuu

SEQ ID NO: 3730778 - RNA, 18 nt, Human
uaucugggaacugugccu

SEQ ID NO: 3730779 - RNA, 23 nt, Human
uaucugggaagcuauuuuuuuca

SEQ ID NO: 3730780 - RNA, 18 nt, Human
uaucugggcuuccuggag

SEQ ID NO: 3730781 - RNA, 22 nt, Human
uaucuggucaaccuccuggaca

SEQ ID NO: 3730782 - RNA, 15 nt, Human
uaucuguaagagugu

SEQ ID NO: 3730783 - RNA, 13 nt, Human
uaucuguaauggu

SEQ ID NO: 3730784 - RNA, 21 nt, Human
uaucuguagacggcucaguau

SEQ ID NO: 3730785 - RNA, 15 nt, Human
uaucugucagcugca

SEQ ID NO: 3730786 - RNA, 14 nt, Human
uaucugucuuucca

SEQ ID NO: 3730787 - RNA, 16 nt, Human
uaucugugaaauauca

SEQ ID NO: 3730788 - RNA, 17 nt, Human
uaucugugaaauaucau

SEQ ID NO: 3730789 - RNA, 19 nt, Human
uaucugugaaaugcuggca

SEQ ID NO: 3730790 - RNA, 22 nt, Human
uaucugugcucaggacucagaa

SEQ ID NO: 3730791 - RNA, 13 nt, Human
uaucuguggucuu

SEQ ID NO: 3730792 - RNA, 17 nt, Human
uaucuguguuuuugaaa

SEQ ID NO: 3730793 - RNA, 20 nt, Human
uaucuguguuuuugaaauau

SEQ ID NO: 3730794 - RNA, 12 nt, Human
uaucuguucuug

SEQ ID NO: 3730795 - RNA, 19 nt, Human
uaucuguucuuuaauuuau

SEQ ID NO: 3730796 - RNA, 20 nt, Human
uaucuguucuuuaauuuauu

SEQ ID NO: 3730797 - RNA, 18 nt, Human
uaucuguuuaaagcauau

SEQ ID NO: 3730798 - RNA, 19 nt, Human
uaucuguuuuacugcuuuu

SEQ ID NO: 3730799 - RNA, 20 nt, Human
uaucuguuuuacugcuuuua

SEQ ID NO: 3730800 - RNA, 18 nt, Human
uaucuuaucucagauauu

SEQ ID NO: 3730801 - RNA, 15 nt, Human
uaucuucacauaguu

SEQ ID NO: 3730802 - RNA, 14 nt, Human
uaucuucacuuguc

SEQ ID NO: 3730803 - RNA, 16 nt, Human
uaucuucauguaaauu

SEQ ID NO: 3730804 - RNA, 18 nt, Human
uaucuucauguaaauuga

SEQ ID NO: 3730805 - RNA, 21 nt, Human
uaucuucguuaguaaucugua

SEQ ID NO: 3730806 - RNA, 17 nt, Human
uaucuucucaaguucua

SEQ ID NO: 3730807 - RNA, 21 nt, Human
uaucuucucaaguucuaagau

SEQ ID NO: 3730808 - RNA, 17 nt, Human
uaucuucugcucuuucu

SEQ ID NO: 3730809 - RNA, 14 nt, Human
uaucuugaaggaaa

SEQ ID NO: 3730810 - RNA, 15 nt, Human
uaucuugauacauuc

SEQ ID NO: 3730811 - RNA, 16 nt, Human
uaucuugauacauuca

SEQ ID NO: 3730812 - RNA, 17 nt, Human
uaucuugauacauucaa

SEQ ID NO: 3730813 - RNA, 18 nt, Human
uaucuugauacauucaaa

SEQ ID NO: 3730814 - RNA, 20 nt, Human
uaucuugcuugaacuuacag

SEQ ID NO: 3730815 - RNA, 17 nt, Human
uaucuuggacaaaucac

SEQ ID NO: 3730816 - RNA, 20 nt, Human
uaucuuggacugacauuuag

SEQ ID NO: 3730817 - RNA, 16 nt, Human
uaucuuguagcuuuau

SEQ ID NO: 3730818 - RNA, 17 nt, Human
uaucuugucucugggcu

SEQ ID NO: 3730819 - RNA, 18 nt, Human
uaucuuguguuguccuuu

SEQ ID NO: 3730820 - RNA, 14 nt, Human
uaucuuguuuuucc

SEQ ID NO: 3730821 - RNA, 14 nt, Human
uaggaauauuauau

SEQ ID NO: 3730822 - RNA, 19 nt, Human
uaggaauucuuuuggggaa

SEQ ID NO: 3730823 - RNA, 12 nt, Human
uaggaauugacc

SEQ ID NO: 3730824 - RNA, 19 nt, Human
uaggacaagggaaaauaaa

SEQ ID NO: 3730825 - RNA, 19 nt, Human
uaggacaaggugcaggcag

SEQ ID NO: 3730826 - RNA, 20 nt, Human
uaggacauaaauuagagguc

SEQ ID NO: 3730827 - RNA, 20 nt, Human
uaggacauguucccuucucc

SEQ ID NO: 3730828 - RNA, 15 nt, Human
uaggaccacucagcc

SEQ ID NO: 3730829 - RNA, 14 nt, Human
uaggacccaagcag

SEQ ID NO: 3730830 - RNA, 15 nt, Human
uaggacgccacccag

SEQ ID NO: 3730831 - RNA, 18 nt, Human
uaggacucugaggcucuu

SEQ ID NO: 3730832 - RNA, 13 nt, Human
uaggacuguagaa

SEQ ID NO: 3730833 - RNA, 20 nt, Human
uaggagaaccaaaucuggaa

SEQ ID NO: 3730834 - RNA, 17 nt, Human
uaggagacuugccagag

SEQ ID NO: 3730835 - RNA, 17 nt, Human
uaggagcaaagccuguu

SEQ ID NO: 3730836 - RNA, 12 nt, Human
uaggagcaugag

SEQ ID NO: 3730837 - RNA, 11 nt, Human
uaggagccugc

SEQ ID NO: 3730838 - RNA, 14 nt, Human
uaggagcuaaggcu

SEQ ID NO: 3730839 - RNA, 16 nt, Human
uaggagcugagguuuc

SEQ ID NO: 3730840 - RNA, 18 nt, Human
uaggagcugccuuggcuc

SEQ ID NO: 3730841 - RNA, 23 nt, Human
uaggagcuuugacucaggagccu

SEQ ID NO: 3730842 - RNA, 20 nt, Human
uaggaggaccagagcuacug

SEQ ID NO: 3730843 - RNA, 16 nt, Human
uaggagggaguuaucu

SEQ ID NO: 3730844 - RNA, 17 nt, Human
uaggagugugugauuuu

SEQ ID NO: 3730845 - RNA, 22 nt, Human
uaggaguuaaccccugcgcucu

SEQ ID NO: 3730846 - RNA, 21 nt, Human
uaggaguucacuucaucuucu

SEQ ID NO: 3730847 - RNA, 16 nt, Human
uaggauaaaaagccag

SEQ ID NO: 3730848 - RNA, 23 nt, Human
uaggauaaaaagccagggcugga

SEQ ID NO: 3730849 - RNA, 13 nt, Human
uaggauagcauuu

SEQ ID NO: 3730850 - RNA, 19 nt, Human
uaggauagcuaacuguaaa

SEQ ID NO: 3730851 - RNA, 20 nt, Human
uaggaucauuuguuggaaug

SEQ ID NO: 3730852 - RNA, 20 nt, Human
uaggaucuaaggcuguuugc

SEQ ID NO: 3730853 - RNA, 21 nt, Human
uaggaucuaaggcuguuugcu

SEQ ID NO: 3730854 - RNA, 16 nt, Human
uaggaugguaaaguua

SEQ ID NO: 3730855 - RNA, 13 nt, Human
uaggauguugaaa

SEQ ID NO: 3730856 - RNA, 13 nt, Human
uaggauguuuuuc

SEQ ID NO: 3730857 - RNA, 21 nt, Human
uaggauucacaccccaccugc

SEQ ID NO: 3730858 - RNA, 12 nt, Human
uaggauucuaaa

SEQ ID NO: 3730859 - RNA, 14 nt, Human
uaggauucuaaaau

SEQ ID NO: 3730860 - RNA, 21 nt, Human
uaggauuuaacagucauuuaa

SEQ ID NO: 3730861 - RNA, 16 nt, Human
uaggauuuauuuaaaa

SEQ ID NO: 3730862 - RNA, 21 nt, Human
uaggauuuauuuaaaauagca

SEQ ID NO: 3730863 - RNA, 13 nt, Human
uaggauuuucaca

SEQ ID NO: 3730864 - RNA, 14 nt, Human
uaggauuuuuagaa

SEQ ID NO: 3730865 - RNA, 19 nt, Human
uaggcaagauggcacaggg

SEQ ID NO: 3730866 - RNA, 18 nt, Human
uaggcacccauccuagag

SEQ ID NO: 3730867 - RNA, 19 nt, Human
uaggcacccauccuagaga

SEQ ID NO: 3730868 - RNA, 20 nt, Human
uaggcacuguaguucuaaga

SEQ ID NO: 3730869 - RNA, 21 nt, Human
uaggcacuguaguucuaagac

SEQ ID NO: 3730870 - RNA, 22 nt, Human
uaggcacuguaguucuaagacu

SEQ ID NO: 3730871 - RNA, 11 nt, Human
uaggcagacac

SEQ ID NO: 3730872 - RNA, 22 nt, Human
uaggcagacacagggacuugaa

SEQ ID NO: 3730873 - RNA, 17 nt, Human
uaggcagacuggguuuc

SEQ ID NO: 3730874 - RNA, 12 nt, Human
uaggcagagccu

SEQ ID NO: 3730875 - RNA, 16 nt, Human
uaggcagccugagagu

SEQ ID NO: 3730876 - RNA, 15 nt, Human
uaggcaggaccugug

SEQ ID NO: 3730877 - RNA, 24 nt, Human
uaggcaguaggccggugugccuga

SEQ ID NO: 3730878 - RNA, 16 nt, Human
uaggcaguauaaagaa

SEQ ID NO: 3730879 - RNA, 19 nt, Human
uaggcaucccaggggacca

SEQ ID NO: 3730880 - RNA, 16 nt, Human
uaggcauuaacacaaa

SEQ ID NO: 3730881 - RNA, 18 nt, Human
uaggcauuaacacaaagg

SEQ ID NO: 3730882 - RNA, 12 nt, Human
uaggcauuuccu

SEQ ID NO: 3730883 - RNA, 16 nt, Human
uaggcauuugcugaau

SEQ ID NO: 3730884 - RNA, 13 nt, Human
uaggcauuuguaa

SEQ ID NO: 3730885 - RNA, 14 nt, Human
uaggcauuuguaaa

SEQ ID NO: 3730886 - RNA, 21 nt, Human
uaggcauuuguaaauauuaaa

SEQ ID NO: 3730887 - RNA, 21 nt, Human
uaggcauuuuuaccaucacug

SEQ ID NO: 3730888 - RNA, 18 nt, Human
uaggccaaagacaaauag

SEQ ID NO: 3730889 - RNA, 14 nt, Human
uaggccacuccucc

SEQ ID NO: 3730890 - RNA, 17 nt, Human
uaggccagagcccacuc

SEQ ID NO: 3730891 - RNA, 22 nt, Human
uaggccagccgcgcaucagacu

SEQ ID NO: 3730892 - RNA, 22 nt, Human
uaggccaggugcaaccagggag

SEQ ID NO: 3730893 - RNA, 16 nt, Human
uaggccaugggacagg

SEQ ID NO: 3730894 - RNA, 13 nt, Human
uaggcccacacac

SEQ ID NO: 3730895 - RNA, 14 nt, Human
uaggcccacacaca

SEQ ID NO: 3730896 - RNA, 17 nt, Human
uaggcccacacacaggu

SEQ ID NO: 3730897 - RNA, 14 nt, Human
uaggcccccacuug

SEQ ID NO: 3730898 - RNA, 19 nt, Human
uaggcccggagcugccccu

SEQ ID NO: 3730899 - RNA, 14 nt, Human
uaggccucagccag

SEQ ID NO: 3730900 - RNA, 14 nt, Human
uaggccuggccaga

SEQ ID NO: 3730901 - RNA, 16 nt, Human
uaggccugggugcugg

SEQ ID NO: 3730902 - RNA, 13 nt, Human
uaggccuucuugu

SEQ ID NO: 3730903 - RNA, 19 nt, Human
uaggccuucuugugaucuu

SEQ ID NO: 3730904 - RNA, 21 nt, Human
uaggccuugcggcuccucagg

SEQ ID NO: 3730905 - RNA, 24 nt, Human
uaggccuugcggcuccucagggac

SEQ ID NO: 3730906 - RNA, 18 nt, Human
uaggccuuuuaacauuuu

SEQ ID NO: 3730907 - RNA, 16 nt, Human
uaggcgugagaagcau

SEQ ID NO: 3730908 - RNA, 13 nt, Human
uaggcuacagaga

SEQ ID NO: 3730909 - RNA, 15 nt, Human
uaggcuacagagaag

SEQ ID NO: 3730910 - RNA, 18 nt, Human
uaggcuacagagaagccu

SEQ ID NO: 3730911 - RNA, 17 nt, Human
uaggcuauuaaaaaagu

SEQ ID NO: 3730912 - RNA, 18 nt, Human
uaggcuauuuguaaaucu

SEQ ID NO: 3730913 - RNA, 20 nt, Human
uaggcuccuucaacaaggcu

SEQ ID NO: 3730914 - RNA, 15 nt, Human
uaggcucugcacaga

SEQ ID NO: 3730915 - RNA, 20 nt, Human
uaggcucugcacagauggau

SEQ ID NO: 3730916 - RNA, 12 nt, Human
uaggcucugccu

SEQ ID NO: 3730917 - RNA, 17 nt, Human
uaggcucugccugacag

SEQ ID NO: 3730918 - RNA, 18 nt, Human
uaggcuggaaggaggaag

SEQ ID NO: 3730919 - RNA, 14 nt, Human
uaggcuggagaagc

SEQ ID NO: 3730920 - RNA, 16 nt, Human
uaggcuggagcccagg

SEQ ID NO: 3730921 - RNA, 16 nt, Human
uaggcugggcccagag

SEQ ID NO: 3730922 - RNA, 18 nt, Human
uaggcugggugcccacag

SEQ ID NO: 3730923 - RNA, 15 nt, Human
uaggcugguggccca

SEQ ID NO: 3730924 - RNA, 18 nt, Human
uaggcugguggcccagga

SEQ ID NO: 3730925 - RNA, 19 nt, Human
uaggcugguggcccaggac

SEQ ID NO: 3730926 - RNA, 14 nt, Human
uaggcuuuacuuag

SEQ ID NO: 3730927 - RNA, 14 nt, Human
uaggcuuuuuaauc

SEQ ID NO: 3730928 - RNA, 11 nt, Human
uagggaaaaac

SEQ ID NO: 3730929 - RNA, 19 nt, Human
uagggaaaaaccagcgugu

SEQ ID NO: 3730930 - RNA, 16 nt, Human
uagggaaaaguucaua

SEQ ID NO: 3730931 - RNA, 13 nt, Human
uagggaaagaaag

SEQ ID NO: 3730932 - RNA, 14 nt, Human
uagggaacaauuug

SEQ ID NO: 3730933 - RNA, 13 nt, Human
uagggaagagaaa

SEQ ID NO: 3730934 - RNA, 15 nt, Human
uagggaagagaaaca

SEQ ID NO: 3730935 - RNA, 19 nt, Human
uagggaagcuggccugaga

SEQ ID NO: 3730936 - RNA, 21 nt, Human
uagggacaggaccccagcucu

SEQ ID NO: 3730937 - RNA, 14 nt, Human
uagggaccagaacc

SEQ ID NO: 3730938 - RNA, 15 nt, Human
uagggaccagaacca

SEQ ID NO: 3730939 - RNA, 16 nt, Human
uagggaccccuccucc

SEQ ID NO: 3730940 - RNA, 17 nt, Human
uagggaccccuccuccc

SEQ ID NO: 3730941 - RNA, 16 nt, Human
uagggaccuggggaag

SEQ ID NO: 3730942 - RNA, 14 nt, Human
uagggacuuaaaaa

SEQ ID NO: 3730943 - RNA, 17 nt, Human
uagggagagucauauuu

SEQ ID NO: 3730944 - RNA, 23 nt, Human
uagggaggaccagggcagggcca

SEQ ID NO: 3730945 - RNA, 17 nt, Human
uagggaggcagccucca

SEQ ID NO: 3730946 - RNA, 17 nt, Human
uagggaucccucaucug

SEQ ID NO: 3730947 - RNA, 14 nt, Human
uagggaugccuccu

SEQ ID NO: 3730948 - RNA, 15 nt, Human
uagggaugccuccuu

SEQ ID NO: 3730949 - RNA, 19 nt, Human
uagggauggggcugugggg

SEQ ID NO: 3730950 - RNA, 18 nt, Human
uagggauuuauuuucaau

SEQ ID NO: 3730951 - RNA, 18 nt, Human
uagggcaauuaauuccuu

SEQ ID NO: 3730952 - RNA, 21 nt, Human
uagggcaauuaauuccuucag

SEQ ID NO: 3730953 - RNA, 14 nt, Human
uagggcacugggcu

SEQ ID NO: 3730954 - RNA, 15 nt, Human
uagggcagcuugccc

SEQ ID NO: 3730955 - RNA, 19 nt, Human
uagggcauaaugaugaugg

SEQ ID NO: 3730956 - RNA, 23 nt, Human
uagggccaagcccagcacugcuu

SEQ ID NO: 3730957 - RNA, 21 nt, Human
uagggccaggcaggugccugg

SEQ ID NO: 3730958 - RNA, 16 nt, Human
uagggcccuggaggcg

SEQ ID NO: 3730959 - RNA, 21 nt, Human
uagggccuggucccugggagg

SEQ ID NO: 3730960 - RNA, 13 nt, Human
uagggccuugguu

SEQ ID NO: 3730961 - RNA, 16 nt, Human
uagggcucuaauuucc

SEQ ID NO: 3730962 - RNA, 19 nt, Human
uagggcugggcaaggaaaa

SEQ ID NO: 3730963 - RNA, 12 nt, Human
uagggcugggug

SEQ ID NO: 3730964 - RNA, 14 nt, Human
uagggcuuaguguu

SEQ ID NO: 3730965 - RNA, 14 nt, Human
uaggggaaugaggg

SEQ ID NO: 3730966 - RNA, 13 nt, Human
uaggggagcaggg

SEQ ID NO: 3730967 - RNA, 18 nt, Human
uaggggaggggcuccuuu

SEQ ID NO: 3730968 - RNA, 23 nt, Human
uaggggagggguugccacaggcc

SEQ ID NO: 3730969 - RNA, 22 nt, Human
uaggggcuuauaauaaaggacu

SEQ ID NO: 3730970 - RNA, 20 nt, Human
uagggggcuggaggagccca

SEQ ID NO: 3730971 - RNA, 16 nt, Human
uagggguaccacugaa

SEQ ID NO: 3730972 - RNA, 15 nt, Human
uaucuuuauuaauca

SEQ ID NO: 3730973 - RNA, 16 nt, Human
uaucuuugauucuccu

SEQ ID NO: 3730974 - RNA, 17 nt, Human
uaucuuugauucuccuu

SEQ ID NO: 3730975 - RNA, 18 nt, Human
uaucuuugauucuccuuc

SEQ ID NO: 3730976 - RNA, 19 nt, Human
uaucuuugauucuccuuca

SEQ ID NO: 3730977 - RNA, 16 nt, Human
uaucuuugccacccuc

SEQ ID NO: 3730978 - RNA, 22 nt, Human
uaucuuugccacccucaugcug

SEQ ID NO: 3730979 - RNA, 16 nt, Human
uaucuuuuauguuuga

SEQ ID NO: 3730980 - RNA, 21 nt, Human
uaucuuuucauacauuuucua

SEQ ID NO: 3730981 - RNA, 23 nt, Human
uaucuuuucauacauuuucuaag

SEQ ID NO: 3730982 - RNA, 23 nt, Human
uaucuuuucuauuguuuauucuu

SEQ ID NO: 3730983 - RNA, 22 nt, Human
uaucuuuucuuuagagaacuga

SEQ ID NO: 3730984 - RNA, 15 nt, Human
uaugaaaaagaagaa

SEQ ID NO: 3730985 - RNA, 20 nt, Human
uaugaaaacauggaacagug

SEQ ID NO: 3730986 - RNA, 17 nt, Human
uaugaaaacuauacaac

SEQ ID NO: 3730987 - RNA, 13 nt, Human
uaugaaaacuuau

SEQ ID NO: 3730988 - RNA, 20 nt, Human
uaugaaagauggcugugccu

SEQ ID NO: 3730989 - RNA, 17 nt, Human
uaugaaagauugugggg

SEQ ID NO: 3730990 - RNA, 21 nt, Human
uaugaaauauuauguuaaaac

SEQ ID NO: 3730991 - RNA, 23 nt, Human
uaugaacccuuccugagcuuuau

SEQ ID NO: 3730992 - RNA, 16 nt, Human
uaugaacccuuuguuu

SEQ ID NO: 3730993 - RNA, 18 nt, Human
uaugaacggugagcauug

SEQ ID NO: 3730994 - RNA, 15 nt, Human
uaugaacugcaugua

SEQ ID NO: 3730995 - RNA, 15 nt, Human
uaugaacuuaacaug

SEQ ID NO: 3730996 - RNA, 19 nt, Human
uaugaacuuaacaugcugu

SEQ ID NO: 3730997 - RNA, 16 nt, Human
uaugaacuugaggaca

SEQ ID NO: 3730998 - RNA, 18 nt, Human
uaugaacuugaggacaca

SEQ ID NO: 3730999 - RNA, 19 nt, Human
uaugaacuugaggacacau

SEQ ID NO: 3731000 - RNA, 23 nt, Human
uaugaacuugaggacacaugucc

SEQ ID NO: 3731001 - RNA, 20 nt, Human
uaugaacuuuauaguuguuu

SEQ ID NO: 3731002 - RNA, 16 nt, Human
uaugaagaaaauacuu

SEQ ID NO: 3731003 - RNA, 18 nt, Human
uaugaagaaacgcaacaa

SEQ ID NO: 3731004 - RNA, 17 nt, Human
uaugaagcucaccuguu

SEQ ID NO: 3731005 - RNA, 20 nt, Human
uaugaagcuuuuaugugaaa

SEQ ID NO: 3731006 - RNA, 21 nt, Human
uaugaaggcuguacacugcac

SEQ ID NO: 3731007 - RNA, 20 nt, Human
uaugaaguaaagaacugcac

SEQ ID NO: 3731008 - RNA, 23 nt, Human
uaugaaguaaagaacugcacaug

SEQ ID NO: 3731009 - RNA, 14 nt, Human
uaugaaguauauaa

SEQ ID NO: 3731010 - RNA, 16 nt, Human
uaugaaguaucuaaaa

SEQ ID NO: 3731011 - RNA, 20 nt, Human
uaugaaguaucuaaaagugu

SEQ ID NO: 3731012 - RNA, 21 nt, Human
uaugaaguuacuuucuuaaug

SEQ ID NO: 3731013 - RNA, 18 nt, Human
uaugaaguuuaaaacagu

SEQ ID NO: 3731014 - RNA, 12 nt, Human
uaugaauaaagu

SEQ ID NO: 3731015 - RNA, 16 nt, Human
uaugaauacagcagca

SEQ ID NO: 3731016 - RNA, 15 nt, Human
uaugaauacuuugca

SEQ ID NO: 3731017 - RNA, 13 nt, Human
uaugaaucuaugc

SEQ ID NO: 3731018 - RNA, 21 nt, Human
uaugaaucuaugccaaagauc

SEQ ID NO: 3731019 - RNA, 21 nt, Human
uaugaaucuauuauacuguau

SEQ ID NO: 3731020 - RNA, 23 nt, Human
uaugaaucuauuauacuguauua

SEQ ID NO: 3731021 - RNA, 23 nt, Human
uaugaaucugcucacuuuaaacc

SEQ ID NO: 3731022 - RNA, 16 nt, Human
uaugaaugauuugcau

SEQ ID NO: 3731023 - RNA, 23 nt, Human
uaugaauguacugcauguuacca

SEQ ID NO: 3731024 - RNA, 15 nt, Human
uaugaaugugaagcc

SEQ ID NO: 3731025 - RNA, 16 nt, Human
uaugaaugugaagccu

SEQ ID NO: 3731026 - RNA, 19 nt, Human
uaugaaugugaagccuucc

SEQ ID NO: 3731027 - RNA, 23 nt, Human
uaugaauuacauuuguauaaaau

SEQ ID NO: 3731028 - RNA, 18 nt, Human
uaugaauugaauuaucuu

SEQ ID NO: 3731029 - RNA, 20 nt, Human
uaugaauuuaaauauaauuc

SEQ ID NO: 3731030 - RNA, 22 nt, Human
uaugacaguaauuguguuuaca

SEQ ID NO: 3731031 - RNA, 23 nt, Human
uaugacaguaauuguguuuacau

SEQ ID NO: 3731032 - RNA, 19 nt, Human
uaugacauucaugccuggc

SEQ ID NO: 3731033 - RNA, 19 nt, Human
uaugaccacacuccagcug

SEQ ID NO: 3731034 - RNA, 23 nt, Human
uaugacgcugauacauaacuaaa

SEQ ID NO: 3731035 - RNA, 19 nt, Human
uaugacggaagaacauaga

SEQ ID NO: 3731036 - RNA, 17 nt, Human
uaugacuaaagagagaa

SEQ ID NO: 3731037 - RNA, 19 nt, Human
uaugacuaaagagagaaug

SEQ ID NO: 3731038 - RNA, 20 nt, Human
uaugacuaaagagagaaugu

SEQ ID NO: 3731039 - RNA, 17 nt, Human
uaugacuauguaaacua

SEQ ID NO: 3731040 - RNA, 16 nt, Human
uaugacucccaaauuu

SEQ ID NO: 3731041 - RNA, 22 nt, Human
uaugacugcuccccagcccugg

SEQ ID NO: 3731042 - RNA, 19 nt, Human
uaugacuuuuuauaaaaug

SEQ ID NO: 3731043 - RNA, 23 nt, Human
uaugagaaaagaggcgucuguau

SEQ ID NO: 3731044 - RNA, 14 nt, Human
uaugagaaauguaa

SEQ ID NO: 3731045 - RNA, 15 nt, Human
uaugagaggcaauga

SEQ ID NO: 3731046 - RNA, 14 nt, Human
uaugagauacuuug

SEQ ID NO: 3731047 - RNA, 16 nt, Human
uaugagauacuuugca

SEQ ID NO: 3731048 - RNA, 21 nt, Human
uaugagauugguuuuccugug

SEQ ID NO: 3731049 - RNA, 13 nt, Human
uaugagcauccug

SEQ ID NO: 3731050 - RNA, 20 nt, Human
uaugagccgugaacugugca

SEQ ID NO: 3731051 - RNA, 12 nt, Human
uaugagcugagg

SEQ ID NO: 3731052 - RNA, 23 nt, Human
uaugagcuggggaugucucucau

SEQ ID NO: 3731053 - RNA, 18 nt, Human
uaugagcuuccuucugug

SEQ ID NO: 3731054 - RNA, 17 nt, Human
uaugaggaauaauuauu

SEQ ID NO: 3731055 - RNA, 17 nt, Human
uaugaggacuugugucu

SEQ ID NO: 3731056 - RNA, 19 nt, Human
uaugaggcaaccugauugu

SEQ ID NO: 3731057 - RNA, 22 nt, Human
uaugaggcaaccugauuguaaa

SEQ ID NO: 3731058 - RNA, 16 nt, Human
uaugaggcauuuggca

SEQ ID NO: 3731059 - RNA, 23 nt, Human
uaugaggcauuuguuugaacuga

SEQ ID NO: 3731060 - RNA, 16 nt, Human
uaugaguauacaauau

SEQ ID NO: 3731061 - RNA, 18 nt, Human
uaugaguggaaaaagcca

SEQ ID NO: 3731062 - RNA, 18 nt, Human
uaugaguuguuuucagac

SEQ ID NO: 3731063 - RNA, 21 nt, Human
uaugaguuucauagcuaagaa

SEQ ID NO: 3731064 - RNA, 23 nt, Human
uaugaguuuuugauagcuuuauu

SEQ ID NO: 3731065 - RNA, 19 nt, Human
uaugauaaaaaauuuugua

SEQ ID NO: 3731066 - RNA, 21 nt, Human
uaugauaaaaaauuuuguaau

SEQ ID NO: 3731067 - RNA, 13 nt, Human
uaugauaaauuug

SEQ ID NO: 3731068 - RNA, 15 nt, Human
uaugauaauagauuc

SEQ ID NO: 3731069 - RNA, 17 nt, Human
uaugauaauagauucuc

SEQ ID NO: 3731070 - RNA, 20 nt, Human
uaugauacuucgacacuguu

SEQ ID NO: 3731071 - RNA, 12 nt, Human
uaugaucaaaug

SEQ ID NO: 3731072 - RNA, 23 nt, Human
uaugaucacggcucacugcagcc

SEQ ID NO: 3731073 - RNA, 13 nt, Human
uaugaucaguguu

SEQ ID NO: 3731074 - RNA, 15 nt, Human
uaugaucccagcacu

SEQ ID NO: 3731075 - RNA, 15 nt, Human
uaugaucgcgccacu

SEQ ID NO: 3731076 - RNA, 19 nt, Human
uaugaucucagguucuccu

SEQ ID NO: 3731077 - RNA, 21 nt, Human
uaugaugaaaaccuacauauu

SEQ ID NO: 3731078 - RNA, 21 nt, Human
uaugaugacucccuuaaaaua

SEQ ID NO: 3731079 - RNA, 22 nt, Human
uaugaugauacaagauuagaag

SEQ ID NO: 3731080 - RNA, 15 nt, Human
uaugaugcuguugcc

SEQ ID NO: 3731081 - RNA, 17 nt, Human
uaugauguguugugaua

SEQ ID NO: 3731082 - RNA, 18 nt, Human
uaugauguguugugauag

SEQ ID NO: 3731083 - RNA, 21 nt, Human
uaugauuaaaaauaucaaauu

SEQ ID NO: 3731084 - RNA, 22 nt, Human
uaugauuacuggccuuuuucau

SEQ ID NO: 3731085 - RNA, 12 nt, Human
uaugauuauuaa

SEQ ID NO: 3731086 - RNA, 16 nt, Human
uaugauucaaaugucu

SEQ ID NO: 3731087 - RNA, 16 nt, Human
uaugauucccagccag

SEQ ID NO: 3731088 - RNA, 21 nt, Human
uaugauuguuucucaaaucuu

SEQ ID NO: 3731089 - RNA, 14 nt, Human
uaugauuuaaaaca

SEQ ID NO: 3731090 - RNA, 18 nt, Human
uaugauuuaauaaaauaa

SEQ ID NO: 3731091 - RNA, 18 nt, Human
uaugauuuaauuugaaau

SEQ ID NO: 3731092 - RNA, 20 nt, Human
uaugauuuauaaacagacaa

SEQ ID NO: 3731093 - RNA, 15 nt, Human
uaugauuuauaguuu

SEQ ID NO: 3731094 - RNA, 22 nt, Human
uaugauuucacuagaaaagcug

SEQ ID NO: 3731095 - RNA, 16 nt, Human
uaugauuuucauaacu

SEQ ID NO: 3731096 - RNA, 16 nt, Human
uaugauuuuuuaaaag

SEQ ID NO: 3731097 - RNA, 17 nt, Human
uaugauuuuuuaaaaga

SEQ ID NO: 3731098 - RNA, 19 nt, Human
uaugauuuuuuuuucauac

SEQ ID NO: 3731099 - RNA, 14 nt, Human
uaugcaaaagcaag

SEQ ID NO: 3731100 - RNA, 11 nt, Human
uaugcaaaagg

SEQ ID NO: 3731101 - RNA, 13 nt, Human
uaugcaaagcacu

SEQ ID NO: 3731102 - RNA, 15 nt, Human
uaugcaaagcacuga

SEQ ID NO: 3731103 - RNA, 12 nt, Human
uaugcaauaaaa

SEQ ID NO: 3731104 - RNA, 18 nt, Human
uaugcaaucaaaucugcu

SEQ ID NO: 3731105 - RNA, 22 nt, Human
uaugcaauggauuuucaaccag

SEQ ID NO: 3731106 - RNA, 20 nt, Human
uaugcacaauuccaugacaa

SEQ ID NO: 3731107 - RNA, 14 nt, Human
uaugcacaguaaaa

SEQ ID NO: 3731108 - RNA, 20 nt, Human
uaugcacauauggacucugc

SEQ ID NO: 3731109 - RNA, 18 nt, Human
uaugcaccuugugucugu

SEQ ID NO: 3731110 - RNA, 15 nt, Human
uaugcacgaccuugg

SEQ ID NO: 3731111 - RNA, 17 nt, Human
uaugcacuaagucucuu

SEQ ID NO: 3731112 - RNA, 20 nt, Human
uaugcacuuauaauuuuccu

SEQ ID NO: 3731113 - RNA, 16 nt, Human
uaugcagaauggcauu

SEQ ID NO: 3731114 - RNA, 15 nt, Human
uauuauauaaacuuu

SEQ ID NO: 3731115 - RNA, 13 nt, Human
uauuauauacaua

SEQ ID NO: 3731116 - RNA, 14 nt, Human
uauuauauguucua

SEQ ID NO: 3731117 - RNA, 17 nt, Human
uauuauauucauucuuu

SEQ ID NO: 3731118 - RNA, 11 nt, Human
uauuauauuug

SEQ ID NO: 3731119 - RNA, 16 nt, Human
uauuauauuuggaugc

SEQ ID NO: 3731120 - RNA, 20 nt, Human
uauuaucaaagggauaaaga

SEQ ID NO: 3731121 - RNA, 15 nt, Human
uauuaucaacaauag

SEQ ID NO: 3731122 - RNA, 14 nt, Human
uauuaucaaguaga

SEQ ID NO: 3731123 - RNA, 22 nt, Human
uauuaucaaguagacuacuguu

SEQ ID NO: 3731124 - RNA, 20 nt, Human
uauuaucaggggagaaaaau

SEQ ID NO: 3731125 - RNA, 18 nt, Human
uauuaucaugcaaaugcu

SEQ ID NO: 3731126 - RNA, 21 nt, Human
uauuauccuagauuauaucaa

SEQ ID NO: 3731127 - RNA, 23 nt, Human
uauuauccuagauuauaucaaag

SEQ ID NO: 3731128 - RNA, 18 nt, Human
uauuaucuuguucaggaa

SEQ ID NO: 3731129 - RNA, 21 nt, Human
uauuaucuuguucaggaaaag

SEQ ID NO: 3731130 - RNA, 12 nt, Human
uauuaucuuuaa

SEQ ID NO: 3731131 - RNA, 19 nt, Human
uauuaucuuuucauacauu

SEQ ID NO: 3731132 - RNA, 21 nt, Human
uauuaugaaacuuguguaaau

SEQ ID NO: 3731133 - RNA, 13 nt, Human
uauuaugaaugug

SEQ ID NO: 3731134 - RNA, 15 nt, Human
uauuaugcaaauucc

SEQ ID NO: 3731135 - RNA, 18 nt, Human
uauuaugcaaauucccag

SEQ ID NO: 3731136 - RNA, 19 nt, Human
uauuaugcaaauucccaga

SEQ ID NO: 3731137 - RNA, 19 nt, Human
uauuaugcauuauaucaaa

SEQ ID NO: 3731138 - RNA, 13 nt, Human
uauuaugcggaaa

SEQ ID NO: 3731139 - RNA, 16 nt, Human
uauuauggaaaacugu

SEQ ID NO: 3731140 - RNA, 20 nt, Human
uauuauggaggcaggaguuu

SEQ ID NO: 3731141 - RNA, 12 nt, Human
uauuauguguuu

SEQ ID NO: 3731142 - RNA, 17 nt, Human
uauuauuaacauaccua

SEQ ID NO: 3731143 - RNA, 11 nt, Human
uauuauuaaug

SEQ ID NO: 3731144 - RNA, 14 nt, Human
uauuauuaaugcuu

SEQ ID NO: 3731145 - RNA, 16 nt, Human
uauuauuaaugcuuug

SEQ ID NO: 3731146 - RNA, 13 nt, Human
uauuauuacuguu

SEQ ID NO: 3731147 - RNA, 14 nt, Human
uauuauuacuguuu

SEQ ID NO: 3731148 - RNA, 14 nt, Human
uauuauuacuugua

SEQ ID NO: 3731149 - RNA, 18 nt, Human
uauuauuagaaauuagaa

SEQ ID NO: 3731150 - RNA, 12 nt, Human
uauuauuagggc

SEQ ID NO: 3731151 - RNA, 22 nt, Human
uauuauuauaaucuuauaauug

SEQ ID NO: 3731152 - RNA, 15 nt, Human
uauuauuaucuuuaa

SEQ ID NO: 3731153 - RNA, 15 nt, Human
uauuauuauuuuggg

SEQ ID NO: 3731154 - RNA, 16 nt, Human
uauuauucccauucua

SEQ ID NO: 3731155 - RNA, 13 nt, Human
uauuauucugcag

SEQ ID NO: 3731156 - RNA, 14 nt, Human
uauuauugaaauug

SEQ ID NO: 3731157 - RNA, 15 nt, Human
uauuauugaaauugu

SEQ ID NO: 3731158 - RNA, 18 nt, Human
uauuauugcuguugcuug

SEQ ID NO: 3731159 - RNA, 15 nt, Human
uauuauuuauaauuc

SEQ ID NO: 3731160 - RNA, 19 nt, Human
uauaaauaggagaggauga

SEQ ID NO: 3731161 - RNA, 14 nt, Human
uauaaauauacagu

SEQ ID NO: 3731162 - RNA, 15 nt, Human
uauaaauauacagua

SEQ ID NO: 3731163 - RNA, 23 nt, Human
uauaaauauauauaaauauauau

SEQ ID NO: 3731164 - RNA, 23 nt, Human
uauaaaucaacaccuuaauaugc

SEQ ID NO: 3731165 - RNA, 18 nt, Human
uauaaaucauauugauga

SEQ ID NO: 3731166 - RNA, 14 nt, Human
uauaaauccaguga

SEQ ID NO: 3731167 - RNA, 18 nt, Human
uauaaaucgcuuuugaua

SEQ ID NO: 3731168 - RNA, 21 nt, Human
uauaaaugaaguuuauacagu

SEQ ID NO: 3731169 - RNA, 12 nt, Human
uauaaaugagca

SEQ ID NO: 3731170 - RNA, 17 nt, Human
uauaaaugcaaauaaca

SEQ ID NO: 3731171 - RNA, 18 nt, Human
uauaaaugcaaauaacaa

SEQ ID NO: 3731172 - RNA, 15 nt, Human
uauaaaugcaauauu

SEQ ID NO: 3731173 - RNA, 14 nt, Human
uauaaaugcuauuu

SEQ ID NO: 3731174 - RNA, 15 nt, Human
uauaaaugggaacau

SEQ ID NO: 3731175 - RNA, 16 nt, Human
uauaaauguauaaaua

SEQ ID NO: 3731176 - RNA, 20 nt, Human
uauaaauguauaaauauaca

SEQ ID NO: 3731177 - RNA, 23 nt, Human
uauaaaugucuuuaaugcaauau

SEQ ID NO: 3731178 - RNA, 14 nt, Human
uauaaaugugugua

SEQ ID NO: 3731179 - RNA, 11 nt, Human
uauaaauuaaa

SEQ ID NO: 3731180 - RNA, 13 nt, Human
uauaaauuaaaua

SEQ ID NO: 3731181 - RNA, 20 nt, Human
uauaaauuaaauauauguau

SEQ ID NO: 3731182 - RNA, 22 nt, Human
uauaaauuauguuuauauaaau

SEQ ID NO: 3731183 - RNA, 20 nt, Human
uauaaauuccucuuugcuuu

SEQ ID NO: 3731184 - RNA, 21 nt, Human
uauaaauuccucuuugcuuug

SEQ ID NO: 3731185 - RNA, 20 nt, Human
uauaaauugucuuaauggau

SEQ ID NO: 3731186 - RNA, 14 nt, Human
uauaaauugucuuu

SEQ ID NO: 3731187 - RNA, 14 nt, Human
uauaaauuuauuua

SEQ ID NO: 3731188 - RNA, 16 nt, Human
uauaaauuuauuuacu

SEQ ID NO: 3731189 - RNA, 16 nt, Human
uauaaauuuguguaau

SEQ ID NO: 3731190 - RNA, 20 nt, Human
uauaacaaaggauacuuauu

SEQ ID NO: 3731191 - RNA, 22 nt, Human
uauaacacauuuuuuugcaugc

SEQ ID NO: 3731192 - RNA, 20 nt, Human
uauaacagguuauuuuaguu

SEQ ID NO: 3731193 - RNA, 21 nt, Human
uauaacagugugguaguuaau

SEQ ID NO: 3731194 - RNA, 20 nt, Human
uauaaccuaguuaaagaaag

SEQ ID NO: 3731195 - RNA, 20 nt, Human
uauaaccuuaauuuauuauu

SEQ ID NO: 3731196 - RNA, 20 nt, Human
uauaacguguucaauauuuu

SEQ ID NO: 3731197 - RNA, 19 nt, Human
uauaacuacuccggagaca

SEQ ID NO: 3731198 - RNA, 21 nt, Human
uauaacucaucauaaaauaaa

SEQ ID NO: 3731199 - RNA, 16 nt, Human
uauaacuggaaagaag

SEQ ID NO: 3731200 - RNA, 13 nt, Human
uauaacuguauuu

SEQ ID NO: 3731201 - RNA, 19 nt, Human
uauaacuuaaaaaaaugac

SEQ ID NO: 3731202 - RNA, 22 nt, Human
uauaacuuaaaaaaaugacaga

SEQ ID NO: 3731203 - RNA, 18 nt, Human
uauaacuuaaaauauuuu

SEQ ID NO: 3731204 - RNA, 14 nt, Human
uauaacuuaaugaa

SEQ ID NO: 3731205 - RNA, 16 nt, Human
uauaacuuaaugaaaa

SEQ ID NO: 3731206 - RNA, 15 nt, Human
uauaacuucuuaaaa

SEQ ID NO: 3731207 - RNA, 11 nt, Human
uauaagaaaaa

SEQ ID NO: 3731208 - RNA, 13 nt, Human
uauaagaaagaca

SEQ ID NO: 3731209 - RNA, 16 nt, Human
uauaagaauaaaaugu

SEQ ID NO: 3731210 - RNA, 14 nt, Human
uauaagauccuaga

SEQ ID NO: 3731211 - RNA, 18 nt, Human
uauaagauccuagauccu

SEQ ID NO: 3731212 - RNA, 17 nt, Human
uauaagcaucauuauuu

SEQ ID NO: 3731213 - RNA, 16 nt, Human
uauaagcauggagaac

SEQ ID NO: 3731214 - RNA, 21 nt, Human
uauaagccaaaauuaaggugu

SEQ ID NO: 3731215 - RNA, 22 nt, Human
uauaaggaaagcaauaaaugaa

SEQ ID NO: 3731216 - RNA, 11 nt, Human
uauaaggacug

SEQ ID NO: 3731217 - RNA, 13 nt, Human
uauaaggacugca

SEQ ID NO: 3731218 - RNA, 14 nt, Human
uauaaggacugcau

SEQ ID NO: 3731219 - RNA, 16 nt, Human
uauaaggcagccuuga

SEQ ID NO: 3731220 - RNA, 24 nt, Human
uauaagggaaguaguuaucauguu

SEQ ID NO: 3731221 - RNA, 22 nt, Human
uauaagggcaaauuggagaaaa

SEQ ID NO: 3731222 - RNA, 23 nt, Human
uauaagguguuuucuguguaacc

SEQ ID NO: 3731223 - RNA, 15 nt, Human
uauaaguaagaaaau

SEQ ID NO: 3731224 - RNA, 16 nt, Human
uauaaguauucuaaau

SEQ ID NO: 3731225 - RNA, 18 nt, Human
uauaagugaagugauacu

SEQ ID NO: 3731226 - RNA, 23 nt, Human
uauaagugcacacagaaauauau

SEQ ID NO: 3731227 - RNA, 14 nt, Human
uauaagugcuguau

SEQ ID NO: 3731228 - RNA, 19 nt, Human
uauaagugcuguauaaaau

SEQ ID NO: 3731229 - RNA, 13 nt, Human
uauaaguguacau

SEQ ID NO: 3731230 - RNA, 17 nt, Human
uauaaguguguguuuuu

SEQ ID NO: 3731231 - RNA, 22 nt, Human
uauaaguuauuuuuguacaugu

SEQ ID NO: 3731232 - RNA, 16 nt, Human
uauaaguuugaaggaa

SEQ ID NO: 3731233 - RNA, 12 nt, Human
uauaauaaaagg

SEQ ID NO: 3731234 - RNA, 12 nt, Human
uauaauaaacau

SEQ ID NO: 3731235 - RNA, 13 nt, Human
uauaauaaaguau

SEQ ID NO: 3731236 - RNA, 14 nt, Human
uauaauaaauauau

SEQ ID NO: 3731237 - RNA, 14 nt, Human
uauaauacuuugua

SEQ ID NO: 3731238 - RNA, 19 nt, Human
uauaauacuuuguauacaa

SEQ ID NO: 3731239 - RNA, 20 nt, Human
uauaauacuuuguauacaag

SEQ ID NO: 3731240 - RNA, 21 nt, Human
uauaauacuuuguauacaagu

SEQ ID NO: 3731241 - RNA, 13 nt, Human
uauaauauaaaaa

SEQ ID NO: 3731242 - RNA, 15 nt, Human
uauaauauccuuugu

SEQ ID NO: 3731243 - RNA, 19 nt, Human
uauaauauugaaaauugaa

SEQ ID NO: 3731244 - RNA, 13 nt, Human
uauaauauuuuaa

SEQ ID NO: 3731245 - RNA, 22 nt, Human
uauaauauuuuuaauuaaauaa

SEQ ID NO: 3731246 - RNA, 20 nt, Human
uauaaucacuuuuuuccaca

SEQ ID NO: 3731247 - RNA, 17 nt, Human
uauaaucauuauuacuu

SEQ ID NO: 3731248 - RNA, 22 nt, Human
uauaauccuugauaauauauug

SEQ ID NO: 3731249 - RNA, 13 nt, Human
uauaaucugucaa

SEQ ID NO: 3731250 - RNA, 23 nt, Human
uauaaucugucaaaacacugugg

SEQ ID NO: 3731251 - RNA, 11 nt, Human
uauaaugaacc

SEQ ID NO: 3731252 - RNA, 18 nt, Human
uauaaugaaugaaacauu

SEQ ID NO: 3731253 - RNA, 16 nt, Human
uauaaugaauuuagug

SEQ ID NO: 3731254 - RNA, 14 nt, Human
uauaaugaggauga

SEQ ID NO: 3731255 - RNA, 15 nt, Human
uauaaugcuggagcg

SEQ ID NO: 3731256 - RNA, 20 nt, Human
uauaauggacagauuaauau

SEQ ID NO: 3731257 - RNA, 16 nt, Human
uauaaugguuucaaag

SEQ ID NO: 3731258 - RNA, 18 nt, Human
uauaaugguuucaaagau

SEQ ID NO: 3731259 - RNA, 19 nt, Human
uauaauguaagcucuacug

SEQ ID NO: 3731260 - RNA, 20 nt, Human
uauaauguaagcucuacuga

SEQ ID NO: 3731261 - RNA, 20 nt, Human
uauaaugucauuaaacauga

SEQ ID NO: 3731262 - RNA, 19 nt, Human
uauaaugugaaauguaacu

SEQ ID NO: 3731263 - RNA, 18 nt, Human
uauaauguuguuauuuaa

SEQ ID NO: 3731264 - RNA, 18 nt, Human
uauaauguuuauuaaaug

SEQ ID NO: 3731265 - RNA, 15 nt, Human
uauaauguuugcuau

SEQ ID NO: 3731266 - RNA, 19 nt, Human
uauaauuaacauguuaaac

SEQ ID NO: 3731267 - RNA, 22 nt, Human
uauaauuaacauguuaaaccau

SEQ ID NO: 3731268 - RNA, 18 nt, Human
uauaauuacauauuugca

SEQ ID NO: 3731269 - RNA, 13 nt, Human
uauaauuauaugu

SEQ ID NO: 3731270 - RNA, 15 nt, Human
uauaauucacauugu

SEQ ID NO: 3731271 - RNA, 20 nt, Human
uauaauucacucaagcacug

SEQ ID NO: 3731272 - RNA, 13 nt, Human
uauaauucaguau

SEQ ID NO: 3731273 - RNA, 22 nt, Human
uauaauucaguauguuuuacac

SEQ ID NO: 3731274 - RNA, 23 nt, Human
uauaauucaguauguuuuacacu

SEQ ID NO: 3731275 - RNA, 21 nt, Human
uauaauuccuauauccuguga

SEQ ID NO: 3731276 - RNA, 22 nt, Human
uauaauuccuauauccugugac

SEQ ID NO: 3731277 - RNA, 23 nt, Human
uauaauuccuguuuuuauuauua

SEQ ID NO: 3731278 - RNA, 17 nt, Human
uauaauucuacuuugag

SEQ ID NO: 3731279 - RNA, 15 nt, Human
uauaauucucauuaa

SEQ ID NO: 3731280 - RNA, 13 nt, Human
uauaauucuguaa

SEQ ID NO: 3731281 - RNA, 16 nt, Human
uauaauucuguaaaug

SEQ ID NO: 3731282 - RNA, 20 nt, Human
uauaauucuguacauagccu

SEQ ID NO: 3731283 - RNA, 13 nt, Human
uauaauucuuuca

SEQ ID NO: 3731284 - RNA, 22 nt, Human
uauaauuggauuuccuaauacu

SEQ ID NO: 3731285 - RNA, 20 nt, Human
uauaauugggucauagaaau

SEQ ID NO: 3731286 - RNA, 22 nt, Human
uauaauugugugauauuucaga

SEQ ID NO: 3731287 - RNA, 15 nt, Human
uauaauuguugcaua

SEQ ID NO: 3731288 - RNA, 18 nt, Human
uauaauuguuuuaucuga

SEQ ID NO: 3731289 - RNA, 20 nt, Human
uauaauuguuuuuuaucuuu

SEQ ID NO: 3731290 - RNA, 15 nt, Human
uauaauuuccauuua

SEQ ID NO: 3731291 - RNA, 21 nt, Human
uauaauuuccauuuacuuaag

SEQ ID NO: 3731292 - RNA, 20 nt, Human
uauaauuucgagauuuguag

SEQ ID NO: 3731293 - RNA, 22 nt, Human
uauaauuuuaugaaugucuuug

SEQ ID NO: 3731294 - RNA, 19 nt, Human
uauaauuuucugaaaguua

SEQ ID NO: 3731295 - RNA, 19 nt, Human
uauaauuuugugaagcaaa

SEQ ID NO: 3731296 - RNA, 19 nt, Human
uauaauuuuuaaaguauau

SEQ ID NO: 3731297 - RNA, 19 nt, Human
uauaauuuuuuguaaugug

SEQ ID NO: 3731298 - RNA, 22 nt, Human
uauaauuuuuuuauguuuuguu

SEQ ID NO: 3731299 - RNA, 20 nt, Human
uauacaaauauauuguuaau

SEQ ID NO: 3731300 - RNA, 18 nt, Human
uauacaaauuaaaaagau

SEQ ID NO: 3731301 - RNA, 14 nt, Human
uauacaaauuagaa

SEQ ID NO: 3731302 - RNA, 16 nt, Human
uauacaaauuagaaaa

SEQ ID NO: 3731303 - RNA, 18 nt, Human
uauacaaauuagaaaaug

SEQ ID NO: 3731304 - RNA, 18 nt, Human
uauacaacaccaaaaaau

SEQ ID NO: 3731305 - RNA, 21 nt, Human
uauacaacaccaaaaaauauc

SEQ ID NO: 3731306 - RNA, 12 nt, Human
uauacaacagug

SEQ ID NO: 3731307 - RNA, 15 nt, Human
uauacaacagugcua

SEQ ID NO: 3731308 - RNA, 16 nt, Human
uauacaacagugcuaa

SEQ ID NO: 3731309 - RNA, 13 nt, Human
uauuauuuauaua

SEQ ID NO: 3731310 - RNA, 12 nt, Human
uauuauuuggca

SEQ ID NO: 3731311 - RNA, 14 nt, Human
uauuauuuggcagu

SEQ ID NO: 3731312 - RNA, 13 nt, Human
uauuauuuugggg

SEQ ID NO: 3731313 - RNA, 20 nt, Human
uauuauuuuuuuaaaauuuu

SEQ ID NO: 3731314 - RNA, 23 nt, Human
uauucaaacagucucaggaaauc

SEQ ID NO: 3731315 - RNA, 12 nt, Human
uauucaaaguug

SEQ ID NO: 3731316 - RNA, 23 nt, Human
uauucaaaguugccuaaauccau

SEQ ID NO: 3731317 - RNA, 13 nt, Human
uauucaaauuccu

SEQ ID NO: 3731318 - RNA, 17 nt, Human
uauucaaccauggacuu

SEQ ID NO: 3731319 - RNA, 10 nt, Human
uauucaaggu

SEQ ID NO: 3731320 - RNA, 11 nt, Human
uauucaaggua

SEQ ID NO: 3731321 - RNA, 20 nt, Human
uauucaauaaaaaaaagaaa

SEQ ID NO: 3731322 - RNA, 13 nt, Human
uauucaauaaagc

SEQ ID NO: 3731323 - RNA, 14 nt, Human
uauucaauaaagua

SEQ ID NO: 3731324 - RNA, 19 nt, Human
uauucaauaaaguauuuaa

SEQ ID NO: 3731325 - RNA, 20 nt, Human
uauucaauaaaguauuuaau

SEQ ID NO: 3731326 - RNA, 16 nt, Human
uauucaauauccuuug

SEQ ID NO: 3731327 - RNA, 17 nt, Human
uauucaauuaaagaaau

SEQ ID NO: 3731328 - RNA, 17 nt, Human
uauucaauuccucuggg

SEQ ID NO: 3731329 - RNA, 22 nt, Human
uauucacaucgcuucuguguau

SEQ ID NO: 3731330 - RNA, 18 nt, Human
uauucaccauguaaaaca

SEQ ID NO: 3731331 - RNA, 19 nt, Human
uauucaccauguaaaacaa

SEQ ID NO: 3731332 - RNA, 23 nt, Human
uauucacgugcagcagcaacaca

SEQ ID NO: 3731333 - RNA, 15 nt, Human
uauucagaauauuca

SEQ ID NO: 3731334 - RNA, 15 nt, Human
uauucagaauuauga

SEQ ID NO: 3731335 - RNA, 19 nt, Human
uauucagaauuaugaugga

SEQ ID NO: 3731336 - RNA, 15 nt, Human
uauucagacaaaaug

SEQ ID NO: 3731337 - RNA, 18 nt, Human
uauucagacaagcaacag

SEQ ID NO: 3731338 - RNA, 13 nt, Human
uauucagacagau

SEQ ID NO: 3731339 - RNA, 17 nt, Human
uauucagagaauaucaa

SEQ ID NO: 3731340 - RNA, 23 nt, Human
uauucagcaaggcgcuaacuugc

SEQ ID NO: 3731341 - RNA, 19 nt, Human
uauucagcaccaagcaugu

SEQ ID NO: 3731342 - RNA, 15 nt, Human
uauucagcucaugga

SEQ ID NO: 3731343 - RNA, 16 nt, Human
uauucagcuucauuug

SEQ ID NO: 3731344 - RNA, 17 nt, Human
uauucaggaaaagccuc

SEQ ID NO: 3731345 - RNA, 14 nt, Human
uauucaggaagcuc

SEQ ID NO: 3731346 - RNA, 18 nt, Human
uauucaggaagcucaggg

SEQ ID NO: 3731347 - RNA, 22 nt, Human
uauucaggaagcucagggccug

SEQ ID NO: 3731348 - RNA, 23 nt, Human
uauucagggaaggaggagccugu

SEQ ID NO: 3731349 - RNA, 15 nt, Human
uauucagugcugugg

SEQ ID NO: 3731350 - RNA, 23 nt, Human
uauucaguugguaagcuuccagg

SEQ ID NO: 3731351 - RNA, 14 nt, Human
uauucauaauuauu

SEQ ID NO: 3731352 - RNA, 15 nt, Human
uauucauaugcauau

SEQ ID NO: 3731353 - RNA, 17 nt, Human
uauucauaugcauauuu

SEQ ID NO: 3731354 - RNA, 16 nt, Human
uauucauauuuguacu

SEQ ID NO: 3731355 - RNA, 21 nt, Human
uauucauccaaguuaaaugua

SEQ ID NO: 3731356 - RNA, 22 nt, Human
uauucauccaaguuaaauguag

SEQ ID NO: 3731357 - RNA, 23 nt, Human
uauucauccaaguuaaauguaga

SEQ ID NO: 3731358 - RNA, 13 nt, Human
uauucauguaaac

SEQ ID NO: 3731359 - RNA, 17 nt, Human
uauucauuauuugucaa

SEQ ID NO: 3731360 - RNA, 23 nt, Human
uauucauucuuuuugaaauguca

SEQ ID NO: 3731361 - RNA, 12 nt, Human
uauucauuuaaa

SEQ ID NO: 3731362 - RNA, 14 nt, Human
uauucauuuaaaau

SEQ ID NO: 3731363 - RNA, 21 nt, Human
uauuccaaaccaaauuuuaau

SEQ ID NO: 3731364 - RNA, 19 nt, Human
uauuccaccuuaaauuaaa

SEQ ID NO: 3731365 - RNA, 20 nt, Human
uauuccagaaugcuguacau

SEQ ID NO: 3731366 - RNA, 21 nt, Human
uauuccagaaugcuguacauc

SEQ ID NO: 3731367 - RNA, 22 nt, Human
uauuccagaucuuucagaaaua

SEQ ID NO: 3731368 - RNA, 13 nt, Human
uauuccagcucau

SEQ ID NO: 3731369 - RNA, 21 nt, Human
uauuccaguuuguuuauuacu

SEQ ID NO: 3731370 - RNA, 23 nt, Human
uauuccauaguauauuaaaaaug

SEQ ID NO: 3731371 - RNA, 14 nt, Human
uauuccauauauua

SEQ ID NO: 3731372 - RNA, 20 nt, Human
uauuccauauuagaaaacuu

SEQ ID NO: 3731373 - RNA, 15 nt, Human
uauuccauauuuauu

SEQ ID NO: 3731374 - RNA, 17 nt, Human
uauuccaugaauguauc

SEQ ID NO: 3731375 - RNA, 14 nt, Human
uauuccaugacugc

SEQ ID NO: 3731376 - RNA, 16 nt, Human
uauuccaugacugcuu

SEQ ID NO: 3731377 - RNA, 23 nt, Human
uauucccaagcucuagugggaag

SEQ ID NO: 3731378 - RNA, 22 nt, Human
uauuccccacccuccccuuccc

SEQ ID NO: 3731379 - RNA, 17 nt, Human
uauuccccauucuuccu

SEQ ID NO: 3731380 - RNA, 24 nt, Human
uauuccuaguuggugagaaaccug

SEQ ID NO: 3731381 - RNA, 20 nt, Human
uauuccuauauaguuuauug

SEQ ID NO: 3731382 - RNA, 21 nt, Human
uauuccuauauaguuuauuga

SEQ ID NO: 3731383 - RNA, 18 nt, Human
uauuccuccugcucauau

SEQ ID NO: 3731384 - RNA, 20 nt, Human
uauuccugcauuugugaaau

SEQ ID NO: 3731385 - RNA, 11 nt, Human
uauuccugccu

SEQ ID NO: 3731386 - RNA, 22 nt, Human
uauuccuguggauguaaaguga

SEQ ID NO: 3731387 - RNA, 15 nt, Human
uauuccuuucccuuc

SEQ ID NO: 3731388 - RNA, 19 nt, Human
uauucgccacacaguauuu

SEQ ID NO: 3731389 - RNA, 20 nt, Human
uauucgccacacaguauuuu

SEQ ID NO: 3731390 - RNA, 17 nt, Human
uauucguuaucuaauag

SEQ ID NO: 3731391 - RNA, 23 nt, Human
uauucuaagacuuacucuaagau

SEQ ID NO: 3731392 - RNA, 15 nt, Human
uauucuaauaagcua

SEQ ID NO: 3731393 - RNA, 20 nt, Human
uauucuaauaagcuaguuga

SEQ ID NO: 3731394 - RNA, 21 nt, Human
uauucuagccugcauugagcu

SEQ ID NO: 3731395 - RNA, 17 nt, Human
uauucuauuuuacaacu

SEQ ID NO: 3731396 - RNA, 15 nt, Human
uauucucacuccacc

SEQ ID NO: 3731397 - RNA, 21 nt, Human
uauucucagcagagugcuuua

SEQ ID NO: 3731398 - RNA, 13 nt, Human
uauucucauucuu

SEQ ID NO: 3731399 - RNA, 16 nt, Human
uauucuccuauguuug

SEQ ID NO: 3731400 - RNA, 15 nt, Human
uauucucuauuugaa

SEQ ID NO: 3731401 - RNA, 18 nt, Human
uauucucuccaaaaaugc

SEQ ID NO: 3731402 - RNA, 17 nt, Human
uauucucuccucagacu

SEQ ID NO: 3731403 - RNA, 13 nt, Human
uauucucuguaca

SEQ ID NO: 3731404 - RNA, 21 nt, Human
uauucucuuaauuuuucuuaa

SEQ ID NO: 3731405 - RNA, 15 nt, Human
uauucugagaaaaca

SEQ ID NO: 3731406 - RNA, 22 nt, Human
uauucugauuacacaaaacaaa

SEQ ID NO: 3731407 - RNA, 14 nt, Human
uauucugauuccac

SEQ ID NO: 3731408 - RNA, 22 nt, Human
uauucugcucuauuauauaaac

SEQ ID NO: 3731409 - RNA, 12 nt, Human
uauucuggaguu

SEQ ID NO: 3731410 - RNA, 16 nt, Human
uauucugggaauguau

SEQ ID NO: 3731411 - RNA, 21 nt, Human
uauucugggaauguauaguau

SEQ ID NO: 3731412 - RNA, 20 nt, Human
uauucugggcaccacaaaau

SEQ ID NO: 3731413 - RNA, 15 nt, Human
uauucugucuucauc

SEQ ID NO: 3731414 - RNA, 22 nt, Human
uauucuguguugcauuauucau

SEQ ID NO: 3731415 - RNA, 15 nt, Human
uauucuguuggaagc

SEQ ID NO: 3731416 - RNA, 22 nt, Human
uauucuuaagggaacuuccaca

SEQ ID NO: 3731417 - RNA, 15 nt, Human
uauucuuauuuaaug

SEQ ID NO: 3731418 - RNA, 15 nt, Human
uauucuucauauccu

SEQ ID NO: 3731419 - RNA, 13 nt, Human
uauucuucucuuc

SEQ ID NO: 3731420 - RNA, 15 nt, Human
uauucuugaaagaag

SEQ ID NO: 3731421 - RNA, 23 nt, Human
uauucuugaaagaagaauguguu

SEQ ID NO: 3731422 - RNA, 22 nt, Human
uauucuugaucaguaguuugca

SEQ ID NO: 3731423 - RNA, 14 nt, Human
uauucuugaugaaa

SEQ ID NO: 3731424 - RNA, 15 nt, Human
uauucuugaugaaaa

SEQ ID NO: 3731425 - RNA, 19 nt, Human
uauucuugaugaaaagcuu

SEQ ID NO: 3731426 - RNA, 13 nt, Human
uauucuugguuuu

SEQ ID NO: 3731427 - RNA, 14 nt, Human
uauucuugugaaua

SEQ ID NO: 3731428 - RNA, 15 nt, Human
uauucuugugaauau

SEQ ID NO: 3731429 - RNA, 12 nt, Human
uauucuuucucc

SEQ ID NO: 3731430 - RNA, 16 nt, Human
uauucuuucuccuuuu

SEQ ID NO: 3731431 - RNA, 20 nt, Human
uauucuuugauguuaacaca

SEQ ID NO: 3731432 - RNA, 23 nt, Human
uauucuuugauguuaacacauuu

SEQ ID NO: 3731433 - RNA, 16 nt, Human
uauucuuugcacuuuu

SEQ ID NO: 3731434 - RNA, 13 nt, Human
uauucuuuguuaa

SEQ ID NO: 3731435 - RNA, 15 nt, Human
uauucuuuguuaauu

SEQ ID NO: 3731436 - RNA, 20 nt, Human
uauugaaaauugaaaaguac

SEQ ID NO: 3731437 - RNA, 18 nt, Human
uauugaaagaauuauccu

SEQ ID NO: 3731438 - RNA, 20 nt, Human
uauugaaauuguacauauuu

SEQ ID NO: 3731439 - RNA, 14 nt, Human
uauugaacuuuuuu

SEQ ID NO: 3731440 - RNA, 13 nt, Human
uauugaagaaaca

SEQ ID NO: 3731441 - RNA, 14 nt, Human
uauugaagacaauu

SEQ ID NO: 3731442 - RNA, 14 nt, Human
uauugaagcagagu

SEQ ID NO: 3731443 - RNA, 16 nt, Human
uauugaagcagagugg

SEQ ID NO: 3731444 - RNA, 13 nt, Human
uauugaagcauuu

SEQ ID NO: 3731445 - RNA, 17 nt, Human
uauugaagcauuuuaua

SEQ ID NO: 3731446 - RNA, 22 nt, Human
uauugaaggaagccaaauuuau

SEQ ID NO: 3731447 - RNA, 20 nt, Human
uauugaauauaauauauuug

SEQ ID NO: 3731448 - RNA, 22 nt, Human
uauugaauauaauauauuugug

SEQ ID NO: 3731449 - RNA, 13 nt, Human
uauugaauauugu

SEQ ID NO: 3731450 - RNA, 12 nt, Human
uauugaauguuu

SEQ ID NO: 3731451 - RNA, 18 nt, Human
uauugaauuuuuccuaug

SEQ ID NO: 3731452 - RNA, 12 nt, Human
uauugacaaaau

SEQ ID NO: 3731453 - RNA, 16 nt, Human
uauugacaaaauguua

SEQ ID NO: 3731454 - RNA, 14 nt, Human
uauugacaaacucu

SEQ ID NO: 3731455 - RNA, 18 nt, Human
uauugacacagaaaaugu

SEQ ID NO: 3731456 - RNA, 13 nt, Human
uauugacacugaa

SEQ ID NO: 3731457 - RNA, 14 nt, Human
uauugacauuugua

SEQ ID NO: 3731458 - RNA, 15 nt, Human
uauugacauuuguag

SEQ ID NO: 3731459 - RNA, 18 nt, Human
uauacaaccuucauuuaa

SEQ ID NO: 3731460 - RNA, 20 nt, Human
uauacaaccuucauuuaaaa

SEQ ID NO: 3731461 - RNA, 20 nt, Human
uauacaagauaagcuuccag

SEQ ID NO: 3731462 - RNA, 16 nt, Human
uauacaaguacuggua

SEQ ID NO: 3731463 - RNA, 19 nt, Human
uauacaaguacugguaaga

SEQ ID NO: 3731464 - RNA, 15 nt, Human
uauacaauaauggaa

SEQ ID NO: 3731465 - RNA, 20 nt, Human
uauacaauuaugaagauuua

SEQ ID NO: 3731466 - RNA, 12 nt, Human
uauacacacaca

SEQ ID NO: 3731467 - RNA, 13 nt, Human
uauacacacacac

SEQ ID NO: 3731468 - RNA, 14 nt, Human
uauacacacacaca

SEQ ID NO: 3731469 - RNA, 21 nt, Human
uauacacuuacacuuuaugca

SEQ ID NO: 3731470 - RNA, 22 nt, Human
uauacacuuggaguuugcauuc

SEQ ID NO: 3731471 - RNA, 12 nt, Human
uauacagaugaa

SEQ ID NO: 3731472 - RNA, 13 nt, Human
uauacagaugaaa

SEQ ID NO: 3731473 - RNA, 15 nt, Human
uauacagaugaaaau

SEQ ID NO: 3731474 - RNA, 16 nt, Human
uauacaggucauauua

SEQ ID NO: 3731475 - RNA, 21 nt, Human
uauacaggucauauuaauaua

SEQ ID NO: 3731476 - RNA, 22 nt, Human
uauacaguaacuuuauguguaa

SEQ ID NO: 3731477 - RNA, 22 nt, Human
uauacaguauagauuuuugggu

SEQ ID NO: 3731478 - RNA, 14 nt, Human
uauacagugauaua

SEQ ID NO: 3731479 - RNA, 18 nt, Human
uauacagugcagagccuu

SEQ ID NO: 3731480 - RNA, 20 nt, Human
uauacaguuauaaaauuaaa

SEQ ID NO: 3731481 - RNA, 22 nt, Human
uauacaguuauaaaauuaaaag

SEQ ID NO: 3731482 - RNA, 23 nt, Human
uauacaguuauaaaauuaaaagu

SEQ ID NO: 3731483 - RNA, 16 nt, Human
uauacaguucaauaaa

SEQ ID NO: 3731484 - RNA, 14 nt, Human
uauacauaaacaag

SEQ ID NO: 3731485 - RNA, 21 nt, Human
uauacauaacaggguaaauua

SEQ ID NO: 3731486 - RNA, 23 nt, Human
uauacauaacaggguaaauuauu

SEQ ID NO: 3731487 - RNA, 19 nt, Human
uauacauacacuuguauaa

SEQ ID NO: 3731488 - RNA, 16 nt, Human
uauacauacuaugaaa

SEQ ID NO: 3731489 - RNA, 21 nt, Human
uauacauaucuuuauuaauca

SEQ ID NO: 3731490 - RNA, 15 nt, Human
uauacauauguagac

SEQ ID NO: 3731491 - RNA, 15 nt, Human
uauacaugacacuga

SEQ ID NO: 3731492 - RNA, 16 nt, Human
uauacaugacacugaa

SEQ ID NO: 3731493 - RNA, 20 nt, Human
uauacaugacacugaaaugc

SEQ ID NO: 3731494 - RNA, 23 nt, Human
uauacaugacacugaaaugccuu

SEQ ID NO: 3731495 - RNA, 11 nt, Human
uauacaugcca

SEQ ID NO: 3731496 - RNA, 13 nt, Human
uauacaugccagu

SEQ ID NO: 3731497 - RNA, 15 nt, Human
uauacaugugauaca

SEQ ID NO: 3731498 - RNA, 13 nt, Human
uauacaugugugu

SEQ ID NO: 3731499 - RNA, 22 nt, Human
uauacauguguguauauaugug

SEQ ID NO: 3731500 - RNA, 15 nt, Human
uauacauguuuaugu

SEQ ID NO: 3731501 - RNA, 16 nt, Human
uauacauguuuaugua

SEQ ID NO: 3731502 - RNA, 17 nt, Human
uauacauguuuauguaa

SEQ ID NO: 3731503 - RNA, 18 nt, Human
uauacauguuuauguaaa

SEQ ID NO: 3731504 - RNA, 20 nt, Human
uauacauguuuauguaaaca

SEQ ID NO: 3731505 - RNA, 16 nt, Human
uauacauuaguaaaug

SEQ ID NO: 3731506 - RNA, 20 nt, Human
uauacauuaguaaaugucuu

SEQ ID NO: 3731507 - RNA, 14 nt, Human
uauaccaauaaagu

SEQ ID NO: 3731508 - RNA, 19 nt, Human
uauaccauggugaauuaau

SEQ ID NO: 3731509 - RNA, 14 nt, Human
uauacccacccaga

SEQ ID NO: 3731510 - RNA, 16 nt, Human
uauacccagaaaguua

SEQ ID NO: 3731511 - RNA, 21 nt, Human
uauaccccgugaagcauccag

SEQ ID NO: 3731512 - RNA, 19 nt, Human
uauaccccuuacuuagcau

SEQ ID NO: 3731513 - RNA, 22 nt, Human
uauaccccuuacuuagcaugca

SEQ ID NO: 3731514 - RNA, 16 nt, Human
uauaccuaacugaaua

SEQ ID NO: 3731515 - RNA, 18 nt, Human
uauaccuauaaugugugu

SEQ ID NO: 3731516 - RNA, 22 nt, Human
uauaccucaauuuucacugugu

SEQ ID NO: 3731517 - RNA, 20 nt, Human
uauaccugauuuuuuuuccu

SEQ ID NO: 3731518 - RNA, 19 nt, Human
uauaccugugccucggcuu

SEQ ID NO: 3731519 - RNA, 23 nt, Human
uauaccuguguuucuugccucau

SEQ ID NO: 3731520 - RNA, 13 nt, Human
uauaccuguugcu

SEQ ID NO: 3731521 - RNA, 23 nt, Human
uauaccuguugcuuaauuacaau

SEQ ID NO: 3731522 - RNA, 17 nt, Human
uauacguguagcuauau

SEQ ID NO: 3731523 - RNA, 19 nt, Human
uauacuaagauguucacug

SEQ ID NO: 3731524 - RNA, 16 nt, Human
uauacuauauuuaugg

SEQ ID NO: 3731525 - RNA, 17 nt, Human
uauacucacuuucuaga

SEQ ID NO: 3731526 - RNA, 19 nt, Human
uauacucuuucuguauaua

SEQ ID NO: 3731527 - RNA, 22 nt, Human
uauacucuuucuguauauacuu

SEQ ID NO: 3731528 - RNA, 20 nt, Human
uauacugaaggaaaaacaca

SEQ ID NO: 3731529 - RNA, 22 nt, Human
uauacugaaggaaaaacacaag

SEQ ID NO: 3731530 - RNA, 17 nt, Human
uauacugcauacuuuuu

SEQ ID NO: 3731531 - RNA, 22 nt, Human
uauacuggaacccuuuuaaagu

SEQ ID NO: 3731532 - RNA, 11 nt, Human
uauacuguaaa

SEQ ID NO: 3731533 - RNA, 12 nt, Human
uauacuguaaag

SEQ ID NO: 3731534 - RNA, 17 nt, Human
uauacuguaaagaaaga

SEQ ID NO: 3731535 - RNA, 19 nt, Human
uauacuguaaagaaagaga

SEQ ID NO: 3731536 - RNA, 20 nt, Human
uauacuguaaagaaagagag

SEQ ID NO: 3731537 - RNA, 23 nt, Human
uauacuguaaagaaagagagaaa

SEQ ID NO: 3731538 - RNA, 17 nt, Human
uauacuguacaauaaaa

SEQ ID NO: 3731539 - RNA, 13 nt, Human
uauacuguauuaa

SEQ ID NO: 3731540 - RNA, 18 nt, Human
uauacugugugcuuguuu

SEQ ID NO: 3731541 - RNA, 14 nt, Human
uauacuuguaauua

SEQ ID NO: 3731542 - RNA, 17 nt, Human
uauacuuguggacuaaa

SEQ ID NO: 3731543 - RNA, 16 nt, Human
uauacuuuaaauaauu

SEQ ID NO: 3731544 - RNA, 15 nt, Human
uauacuuuaguauga

SEQ ID NO: 3731545 - RNA, 23 nt, Human
uauacuuugguuggcagcauucc

SEQ ID NO: 3731546 - RNA, 14 nt, Human
uauacuuuguggac

SEQ ID NO: 3731547 - RNA, 20 nt, Human
uauacuuuguggaccaauua

SEQ ID NO: 3731548 - RNA, 13 nt, Human
uauacuuuuacaa

SEQ ID NO: 3731549 - RNA, 16 nt, Human
uauagaaaaaaacauu

SEQ ID NO: 3731550 - RNA, 20 nt, Human
uauagaaaguguucuguuac

SEQ ID NO: 3731551 - RNA, 21 nt, Human
uauagaaauauauacgaacaa

SEQ ID NO: 3731552 - RNA, 18 nt, Human
uauagaagaaugcaugcu

SEQ ID NO: 3731553 - RNA, 19 nt, Human
uauagaaguauaaagaauu

SEQ ID NO: 3731554 - RNA, 14 nt, Human
uauagaagucuuca

SEQ ID NO: 3731555 - RNA, 15 nt, Human
uauagaagucuucau

SEQ ID NO: 3731556 - RNA, 19 nt, Human
uauagaagucuucaugaaa

SEQ ID NO: 3731557 - RNA, 21 nt, Human
uauagaagucuucaugaaaug

SEQ ID NO: 3731558 - RNA, 23 nt, Human
uauagaagucuucaugaaaugcu

SEQ ID NO: 3731559 - RNA, 20 nt, Human
uauagaauaggcacuuuaaa

SEQ ID NO: 3731560 - RNA, 23 nt, Human
uauagaauaggcacuuuaaaaca

SEQ ID NO: 3731561 - RNA, 20 nt, Human
uauagaauuagcuuuuucau

SEQ ID NO: 3731562 - RNA, 18 nt, Human
uauagacaggagaagaaa

SEQ ID NO: 3731563 - RNA, 21 nt, Human
uauagacaggagaagaaagaa

SEQ ID NO: 3731564 - RNA, 16 nt, Human
uauagacaguuuguaa

SEQ ID NO: 3731565 - RNA, 17 nt, Human
uauagacaguuuguaaa

SEQ ID NO: 3731566 - RNA, 11 nt, Human
uauagacucua

SEQ ID NO: 3731567 - RNA, 18 nt, Human
uauagagcagaaauucug

SEQ ID NO: 3731568 - RNA, 20 nt, Human
uauagagcagaaauucuguu

SEQ ID NO: 3731569 - RNA, 21 nt, Human
uauagaggcuagcuucugcuu

SEQ ID NO: 3731570 - RNA, 16 nt, Human
uauagaugggaaugaa

SEQ ID NO: 3731571 - RNA, 22 nt, Human
uauagaugggggaaagcaaagc

SEQ ID NO: 3731572 - RNA, 15 nt, Human
uauagaugucuuuuc

SEQ ID NO: 3731573 - RNA, 21 nt, Human
uauagauguugcuaacagcaa

SEQ ID NO: 3731574 - RNA, 15 nt, Human
uauagauuaaaucau

SEQ ID NO: 3731575 - RNA, 17 nt, Human
uauagauuagaaaaauu

SEQ ID NO: 3731576 - RNA, 12 nt, Human
uauagauucuaa

SEQ ID NO: 3731577 - RNA, 20 nt, Human
uauagcaaaacuuuuaaacu

SEQ ID NO: 3731578 - RNA, 13 nt, Human
uauagcaagacau

SEQ ID NO: 3731579 - RNA, 13 nt, Human
uauagcaauccau

SEQ ID NO: 3731580 - RNA, 15 nt, Human
uauagcacuuugaaa

SEQ ID NO: 3731581 - RNA, 23 nt, Human
uauagcacuuugaaauaccucau

SEQ ID NO: 3731582 - RNA, 18 nt, Human
uauagcaguaaaaaaugg

SEQ ID NO: 3731583 - RNA, 14 nt, Human
uauagcaucacuua

SEQ ID NO: 3731584 - RNA, 18 nt, Human
uauagcaucacuuaaaac

SEQ ID NO: 3731585 - RNA, 16 nt, Human
uauagcaugaaauaaa

SEQ ID NO: 3731586 - RNA, 19 nt, Human
uauagccaaaaauagcuaa

SEQ ID NO: 3731587 - RNA, 21 nt, Human
uauagccacaucccuuugaaa

SEQ ID NO: 3731588 - RNA, 22 nt, Human
uauagcccagccaggccccagg

SEQ ID NO: 3731589 - RNA, 20 nt, Human
uauagccuauggcagaaaaa

SEQ ID NO: 3731590 - RNA, 23 nt, Human
uauagcucuaauguuugcauaua

SEQ ID NO: 3731591 - RNA, 17 nt, Human
uauagcugcuuccagug

SEQ ID NO: 3731592 - RNA, 19 nt, Human
uauagcuguauugaaucau

SEQ ID NO: 3731593 - RNA, 16 nt, Human
uauagcuugaaacaua

SEQ ID NO: 3731594 - RNA, 15 nt, Human
uauagcuugcagaac

SEQ ID NO: 3731595 - RNA, 13 nt, Human
uauaggaauugac

SEQ ID NO: 3731596 - RNA, 19 nt, Human
uauaggaauugacccacaa

SEQ ID NO: 3731597 - RNA, 12 nt, Human
uauaggagagga

SEQ ID NO: 3731598 - RNA, 14 nt, Human
uauaggcuggagaa

SEQ ID NO: 3731599 - RNA, 14 nt, Human
uauaggucacuccu

SEQ ID NO: 3731600 - RNA, 17 nt, Human
uauagguccuuuagaaa

SEQ ID NO: 3731601 - RNA, 22 nt, Human
uauaggucucuucucccagaau

SEQ ID NO: 3731602 - RNA, 21 nt, Human
uauaggugcuacaaaaacaca

SEQ ID NO: 3731603 - RNA, 21 nt, Human
uauagguguugguuuuggggg

SEQ ID NO: 3731604 - RNA, 16 nt, Human
uauagguuuuguuugc

SEQ ID NO: 3731605 - RNA, 14 nt, Human
uauaguauuugaaa

SEQ ID NO: 3731606 - RNA, 17 nt, Human
uauaguauuugaaaaca

SEQ ID NO: 3731607 - RNA, 15 nt, Human
uauagucaauggcuu

SEQ ID NO: 3731608 - RNA, 19 nt, Human
gcccugguggcccucuccc

SEQ ID NO: 3731609 - RNA, 23 nt, Human
gcccuggugguggcucgggaggc

SEQ ID NO: 3731610 - RNA, 20 nt, Human
gcccugguuucacuggccca

SEQ ID NO: 3731611 - RNA, 22 nt, Human
gcccugguuucacuggcccaag

SEQ ID NO: 3731612 - RNA, 15 nt, Human
gcccugguuuccugc

SEQ ID NO: 3731613 - RNA, 21 nt, Human
gcccugguuuccugcccuggg

SEQ ID NO: 3731614 - RNA, 20 nt, Human
gcccugucagcaugaauuug

SEQ ID NO: 3731615 - RNA, 14 nt, Human
gcccugucagugca

SEQ ID NO: 3731616 - RNA, 19 nt, Human
gcccugucccucccaccuc

SEQ ID NO: 3731617 - RNA, 21 nt, Human
gcccugucccucccaccucug

SEQ ID NO: 3731618 - RNA, 23 nt, Human
gcccugucccucccaccucugug

SEQ ID NO: 3731619 - RNA, 22 nt, Human
gcccuguccugccuaaggcuga

SEQ ID NO: 3731620 - RNA, 20 nt, Human
gcccugucgggcuuugugug

SEQ ID NO: 3731621 - RNA, 22 nt, Human
gcccugugccccuugacaacug

SEQ ID NO: 3731622 - RNA, 20 nt, Human
gcccugugggaccccaggcc

SEQ ID NO: 3731623 - RNA, 17 nt, Human
gcccugugggcccccaa

SEQ ID NO: 3731624 - RNA, 15 nt, Human
gcccugugugcaggu

SEQ ID NO: 3731625 - RNA, 13 nt, Human
gcccuguuaaaag

SEQ ID NO: 3731626 - RNA, 20 nt, Human
gcccuguucagcuacuccca

SEQ ID NO: 3731627 - RNA, 22 nt, Human
gcccuguucucuaccaagcuau

SEQ ID NO: 3731628 - RNA, 21 nt, Human
gcccuguucugggugcagcug

SEQ ID NO: 3731629 - RNA, 20 nt, Human
gcccuguugacacaggucuu

SEQ ID NO: 3731630 - RNA, 14 nt, Human
gcccuguugugcca

SEQ ID NO: 3731631 - RNA, 17 nt, Human
gcccuguuguguauaga

SEQ ID NO: 3731632 - RNA, 15 nt, Human
gcccuuaaaaauaug

SEQ ID NO: 3731633 - RNA, 21 nt, Human
gcccuuaccugccaggaagcc

SEQ ID NO: 3731634 - RNA, 23 nt, Human
gcccuuaccugccaggaagccag

SEQ ID NO: 3731635 - RNA, 20 nt, Human
gcccuuagcagggaaacagc

SEQ ID NO: 3731636 - RNA, 17 nt, Human
gcccuuagucccccaac

SEQ ID NO: 3731637 - RNA, 15 nt, Human
gcccuuaucugugcu

SEQ ID NO: 3731638 - RNA, 19 nt, Human
gcccuuaucugugcucagg

SEQ ID NO: 3731639 - RNA, 17 nt, Human
gcccuuauuuucaagaa

SEQ ID NO: 3731640 - RNA, 16 nt, Human
gcccuucacaguguuu

SEQ ID NO: 3731641 - RNA, 15 nt, Human
gcccuucauuuggag

SEQ ID NO: 3731642 - RNA, 21 nt, Human
gcccuuccaugucgccucugc

SEQ ID NO: 3731643 - RNA, 22 nt, Human
gcccuuccaugucgccucugca

SEQ ID NO: 3731644 - RNA, 12 nt, Human
gcccuucccacu

SEQ ID NO: 3731645 - RNA, 12 nt, Human
gcccuucccugu

SEQ ID NO: 3731646 - RNA, 15 nt, Human
gcccuucccuguccc

SEQ ID NO: 3731647 - RNA, 13 nt, Human
gcccuuccucucc

SEQ ID NO: 3731648 - RNA, 16 nt, Human
gcccuuccucuccacu

SEQ ID NO: 3731649 - RNA, 19 nt, Human
gcccuuccucuccacugcc

SEQ ID NO: 3731650 - RNA, 13 nt, Human
gcccuuccucugc

SEQ ID NO: 3731651 - RNA, 17 nt, Human
gcccuuccucugcuccc

SEQ ID NO: 3731652 - RNA, 16 nt, Human
gcccuuccuggacagc

SEQ ID NO: 3731653 - RNA, 20 nt, Human
gcccuuccuggacagcugug

SEQ ID NO: 3731654 - RNA, 21 nt, Human
gcccuuccuggacagcugugc

SEQ ID NO: 3731655 - RNA, 21 nt, Human
gcccuucggaggaccagggcu

SEQ ID NO: 3731656 - RNA, 23 nt, Human
gcccuucucuccagccccuggau

SEQ ID NO: 3731657 - RNA, 17 nt, Human
gcccuugaguccccauu

SEQ ID NO: 3731658 - RNA, 16 nt, Human
gcccuugcccugaccu

SEQ ID NO: 3731659 - RNA, 18 nt, Human
gcccuugcccugaccucc

SEQ ID NO: 3731660 - RNA, 13 nt, Human
gcccuugccuccc

SEQ ID NO: 3731661 - RNA, 14 nt, Human
gcccuugccucccc

SEQ ID NO: 3731662 - RNA, 18 nt, Human
gcccuugcuuaccucuca

SEQ ID NO: 3731663 - RNA, 21 nt, Human
gcccuuggagcguggacuggu

SEQ ID NO: 3731664 - RNA, 15 nt, Human
gcccuuggcuucugu

SEQ ID NO: 3731665 - RNA, 21 nt, Human
gcccuuggggguccuccucca

SEQ ID NO: 3731666 - RNA, 16 nt, Human
gcccuugucggcccca

SEQ ID NO: 3731667 - RNA, 18 nt, Human
gcccuuguuuggggcagg

SEQ ID NO: 3731668 - RNA, 17 nt, Human
gcccuuuacuugucuuu

SEQ ID NO: 3731669 - RNA, 21 nt, Human
gcccuuuacuugucuuucugg

SEQ ID NO: 3731670 - RNA, 21 nt, Human
gcccuuuccccgacgcccacc

SEQ ID NO: 3731671 - RNA, 15 nt, Human
gcccuuuccuccuca

SEQ ID NO: 3731672 - RNA, 19 nt, Human
gcccuuucggauccaggga

SEQ ID NO: 3731673 - RNA, 22 nt, Human
gcccuuucuguaccauuuauuu

SEQ ID NO: 3731674 - RNA, 18 nt, Human
gcccuuugagugcagucc

SEQ ID NO: 3731675 - RNA, 20 nt, Human
gcccuuugcaucguccccuc

SEQ ID NO: 3731676 - RNA, 14 nt, Human
gcccuuugcugucc

SEQ ID NO: 3731677 - RNA, 17 nt, Human
gcccuuugggaggcuga

SEQ ID NO: 3731678 - RNA, 13 nt, Human
gcccuuuuccccu

SEQ ID NO: 3731679 - RNA, 19 nt, Human
gcccuuuuccccuaccaau

SEQ ID NO: 3731680 - RNA, 12 nt, Human
gccgaaacugga

SEQ ID NO: 3731681 - RNA, 15 nt, Human
gccgaaccaaaagaa

SEQ ID NO: 3731682 - RNA, 13 nt, Human
gccgaagcccagg

SEQ ID NO: 3731683 - RNA, 17 nt, Human
gccgaagcucuggcuga

SEQ ID NO: 3731684 - RNA, 15 nt, Human
gccgaauagcugaug

SEQ ID NO: 3731685 - RNA, 20 nt, Human
gccgaauccccucccuguca

SEQ ID NO: 3731686 - RNA, 17 nt, Human
gccgacauugucucccg

SEQ ID NO: 3731687 - RNA, 19 nt, Human
gccgaccagaggagccuuu

SEQ ID NO: 3731688 - RNA, 17 nt, Human
gccgaccucagccuucc

SEQ ID NO: 3731689 - RNA, 19 nt, Human
gccgaccucguccuccccc

SEQ ID NO: 3731690 - RNA, 13 nt, Human
gccgaccuuagau

SEQ ID NO: 3731691 - RNA, 15 nt, Human
gccgacucuggcccu

SEQ ID NO: 3731692 - RNA, 21 nt, Human
gccgacuuuguaccccccaac

SEQ ID NO: 3731693 - RNA, 23 nt, Human
gccgacuuuguaccccccaaccc

SEQ ID NO: 3731694 - RNA, 14 nt, Human
gccgagaagcaaga

SEQ ID NO: 3731695 - RNA, 12 nt, Human
gccgagagccug

SEQ ID NO: 3731696 - RNA, 22 nt, Human
gccgagagccugcucccccacc

SEQ ID NO: 3731697 - RNA, 20 nt, Human
gccgagaucacgccacugca

SEQ ID NO: 3731698 - RNA, 14 nt, Human
gccgagcaaccgug

SEQ ID NO: 3731699 - RNA, 14 nt, Human
gccgagcaggaggc

SEQ ID NO: 3731700 - RNA, 21 nt, Human
gccgagcucguguauccuggg

SEQ ID NO: 3731701 - RNA, 22 nt, Human
gccgagcucguguauccugggg

SEQ ID NO: 3731702 - RNA, 16 nt, Human
gccgaggagccaggca

SEQ ID NO: 3731703 - RNA, 15 nt, Human
gccgaguccaagcug

SEQ ID NO: 3731704 - RNA, 14 nt, Human
gccgaugcccagag

SEQ ID NO: 3731705 - RNA, 13 nt, Human
gccgauggagaca

SEQ ID NO: 3731706 - RNA, 17 nt, Human
gccgauuucuguaaacu

SEQ ID NO: 3731707 - RNA, 16 nt, Human
gccgcaaaccacacug

SEQ ID NO: 3731708 - RNA, 13 nt, Human
gccgcaccccaga

SEQ ID NO: 3731709 - RNA, 21 nt, Human
gccgcaccuaaagcagccagc

SEQ ID NO: 3731710 - RNA, 13 nt, Human
gccgcagcucuug

SEQ ID NO: 3731711 - RNA, 20 nt, Human
gccgcagcucuugcccuucc

SEQ ID NO: 3731712 - RNA, 23 nt, Human
gccgcaucucacagcuaugcaaa

SEQ ID NO: 3731713 - RNA, 18 nt, Human
gccgcaucuucuccaucu

SEQ ID NO: 3731714 - RNA, 20 nt, Human
gccgcaucuucuccaucugg

SEQ ID NO: 3731715 - RNA, 18 nt, Human
gccgcauucccugaguca

SEQ ID NO: 3731716 - RNA, 16 nt, Human
gccgccaucagcccaa

SEQ ID NO: 3731717 - RNA, 16 nt, Human
gccgccaugcuccugg

SEQ ID NO: 3731718 - RNA, 14 nt, Human
gccgccccacccag

SEQ ID NO: 3731719 - RNA, 20 nt, Human
gccgccccaucugccccaca

SEQ ID NO: 3731720 - RNA, 18 nt, Human
gccgcccugcgggugaac

SEQ ID NO: 3731721 - RNA, 13 nt, Human
gccgccgccucgc

SEQ ID NO: 3731722 - RNA, 13 nt, Human
gccgccgccucuu

SEQ ID NO: 3731723 - RNA, 23 nt, Human
gccgccggcaauaaaagcccagg

SEQ ID NO: 3731724 - RNA, 17 nt, Human
gccgccucccagccugg

SEQ ID NO: 3731725 - RNA, 18 nt, Human
gccgccuccgggaccccc

SEQ ID NO: 3731726 - RNA, 17 nt, Human
gccgccucgcccaccgc

SEQ ID NO: 3731727 - RNA, 13 nt, Human
gccgccugcacuc

SEQ ID NO: 3731728 - RNA, 23 nt, Human
gccgccugcccgucucucuccca

SEQ ID NO: 3731729 - RNA, 13 nt, Human
gccgccugguacu

SEQ ID NO: 3731730 - RNA, 15 nt, Human
gccgccuguggacag

SEQ ID NO: 3731731 - RNA, 16 nt, Human
gccgcguggugccauc

SEQ ID NO: 3731732 - RNA, 21 nt, Human
gccgcguggugccauccccag

SEQ ID NO: 3731733 - RNA, 11 nt, Human
gccgcuaccuc

SEQ ID NO: 3731734 - RNA, 17 nt, Human
gccgcuagaggccugag

SEQ ID NO: 3731735 - RNA, 11 nt, Human
gccgcuccaga

SEQ ID NO: 3731736 - RNA, 12 nt, Human
gccgcuccagag

SEQ ID NO: 3731737 - RNA, 13 nt, Human
gccgcuccagagu

SEQ ID NO: 3731738 - RNA, 16 nt, Human
gccgcuccagagucag

SEQ ID NO: 3731739 - RNA, 15 nt, Human
gccgcuccaggggug

SEQ ID NO: 3731740 - RNA, 15 nt, Human
gccgcucggaggccc

SEQ ID NO: 3731741 - RNA, 16 nt, Human
gccgcucggaggcccc

SEQ ID NO: 3731742 - RNA, 12 nt, Human
gccgcugccacc

SEQ ID NO: 3731743 - RNA, 14 nt, Human
gccgcugccaccca

SEQ ID NO: 3731744 - RNA, 17 nt, Human
gccgcugugagccccug

SEQ ID NO: 3731745 - RNA, 16 nt, Human
gccgcuguucacccac

SEQ ID NO: 3731746 - RNA, 19 nt, Human
gccgcuuggcgaugccagc

SEQ ID NO: 3731747 - RNA, 22 nt, Human
gccggacacccgacuccagucc

SEQ ID NO: 3731748 - RNA, 13 nt, Human
gccggagaggaag

SEQ ID NO: 3731749 - RNA, 18 nt, Human
gccggagaggaagagaca

SEQ ID NO: 3731750 - RNA, 16 nt, Human
gccggagucagugcca

SEQ ID NO: 3731751 - RNA, 21 nt, Human
gccggaguccacucccagugc

SEQ ID NO: 3731752 - RNA, 17 nt, Human
gccggaucugagggaga

SEQ ID NO: 3731753 - RNA, 20 nt, Human
gccggcaaccccaguucugc

SEQ ID NO: 3731754 - RNA, 21 nt, Human
gccggcaaccccaguucugcu

SEQ ID NO: 3731755 - RNA, 18 nt, Human
gccggcaauaaaagccca

SEQ ID NO: 3731756 - RNA, 13 nt, Human
gccggcacagggu

SEQ ID NO: 3731757 - RNA, 16 nt, Human
gccggcacggcccgug

SEQ ID NO: 3731758 - RNA, 16 nt, Human
uauugacauuuguagu

SEQ ID NO: 3731759 - RNA, 15 nt, Human
uauugacucuggguc

SEQ ID NO: 3731760 - RNA, 22 nt, Human
uauugacucuggguccuuccug

SEQ ID NO: 3731761 - RNA, 15 nt, Human
uauugacuuguauau

SEQ ID NO: 3731762 - RNA, 14 nt, Human
uauugacuuugucu

SEQ ID NO: 3731763 - RNA, 18 nt, Human
uauugagaauuuuaaauu

SEQ ID NO: 3731764 - RNA, 15 nt, Human
uauugagacaaaaau

SEQ ID NO: 3731765 - RNA, 19 nt, Human
uauugagagagauguguaa

SEQ ID NO: 3731766 - RNA, 15 nt, Human
uauugagauuucuua

SEQ ID NO: 3731767 - RNA, 22 nt, Human
uauugaggccaagaauauugca

SEQ ID NO: 3731768 - RNA, 20 nt, Human
uauugagggaaauguuuuca

SEQ ID NO: 3731769 - RNA, 14 nt, Human
uauugagucaaaug

SEQ ID NO: 3731770 - RNA, 21 nt, Human
uauugaguuccaguugaaguu

SEQ ID NO: 3731771 - RNA, 21 nt, Human
uauugaguuuguagguaaaau

SEQ ID NO: 3731772 - RNA, 14 nt, Human
uauugauaacagca

SEQ ID NO: 3731773 - RNA, 17 nt, Human
uauugauaagaucuuuu

SEQ ID NO: 3731774 - RNA, 23 nt, Human
uauugauaaguucauacauugua

SEQ ID NO: 3731775 - RNA, 15 nt, Human
uauugauaguacucu

SEQ ID NO: 3731776 - RNA, 20 nt, Human
uauugauaugcuuauacacu

SEQ ID NO: 3731777 - RNA, 11 nt, Human
uauugauauuc

SEQ ID NO: 3731778 - RNA, 18 nt, Human
uauugaugaaaagauuua

SEQ ID NO: 3731779 - RNA, 13 nt, Human
uauugaugaaaau

SEQ ID NO: 3731780 - RNA, 20 nt, Human
uauugaugugcaaaaauuuu

SEQ ID NO: 3731781 - RNA, 13 nt, Human
uauugauguuuuc

SEQ ID NO: 3731782 - RNA, 14 nt, Human
uauugauguuuuca

SEQ ID NO: 3731783 - RNA, 23 nt, Human
uauugauucaccuccuaaaacaa

SEQ ID NO: 3731784 - RNA, 12 nt, Human
uauugcaaaaua

SEQ ID NO: 3731785 - RNA, 15 nt, Human
uauugcaaaauacau

SEQ ID NO: 3731786 - RNA, 17 nt, Human
uauugcaaaauacauga

SEQ ID NO: 3731787 - RNA, 18 nt, Human
uauugcaaaauacaugaa

SEQ ID NO: 3731788 - RNA, 21 nt, Human
uauugcaaagguuccaacugu

SEQ ID NO: 3731789 - RNA, 20 nt, Human
uauugcaaagucaggaauca

SEQ ID NO: 3731790 - RNA, 20 nt, Human
uauugcagcaauuaaaaauu

SEQ ID NO: 3731791 - RNA, 11 nt, Human
uauugcaguuu

SEQ ID NO: 3731792 - RNA, 13 nt, Human
uauugcaguuuau

SEQ ID NO: 3731793 - RNA, 20 nt, Human
uauugcaguuuaucauucaa

SEQ ID NO: 3731794 - RNA, 19 nt, Human
uauugcauacuauuaaaca

SEQ ID NO: 3731795 - RNA, 15 nt, Human
uauugcauaugcaua

SEQ ID NO: 3731796 - RNA, 14 nt, Human
uauugcaucuguau

SEQ ID NO: 3731797 - RNA, 17 nt, Human
uauugcaucuguauaag

SEQ ID NO: 3731798 - RNA, 15 nt, Human
uauugcauuaauuuu

SEQ ID NO: 3731799 - RNA, 17 nt, Human
uauugcauuuauaugua

SEQ ID NO: 3731800 - RNA, 14 nt, Human
uauugccaaacauu

SEQ ID NO: 3731801 - RNA, 18 nt, Human
uauugccaaacauuaaug

SEQ ID NO: 3731802 - RNA, 21 nt, Human
uauugccaaacauuaauguug

SEQ ID NO: 3731803 - RNA, 15 nt, Human
uauugcccacgcugg

SEQ ID NO: 3731804 - RNA, 22 nt, Human
uauugccuaagaauaaacauuu

SEQ ID NO: 3731805 - RNA, 17 nt, Human
uauugccugagagcaca

SEQ ID NO: 3731806 - RNA, 11 nt, Human
uauugccuucu

SEQ ID NO: 3731807 - RNA, 17 nt, Human
uauugccuucucaccag

SEQ ID NO: 3731808 - RNA, 21 nt, Human
uauugccuucucaccagcugc

SEQ ID NO: 3731809 - RNA, 15 nt, Human
uauugccuucuuuga

SEQ ID NO: 3731810 - RNA, 16 nt, Human
uauugccuucuuugaa

SEQ ID NO: 3731811 - RNA, 18 nt, Human
uauugccuucuuugaaga

SEQ ID NO: 3731812 - RNA, 14 nt, Human
uauugcgcugcuac

SEQ ID NO: 3731813 - RNA, 18 nt, Human
uauugcuacuuccugccu

SEQ ID NO: 3731814 - RNA, 14 nt, Human
uauugcuagagcuc

SEQ ID NO: 3731815 - RNA, 15 nt, Human
uauugcuaguauuug

SEQ ID NO: 3731816 - RNA, 15 nt, Human
uauugcugaagaauc

SEQ ID NO: 3731817 - RNA, 17 nt, Human
uauugcugaaugcaaga

SEQ ID NO: 3731818 - RNA, 15 nt, Human
uauugcugagagaaa

SEQ ID NO: 3731819 - RNA, 16 nt, Human
uauugcugagagaaau

SEQ ID NO: 3731820 - RNA, 17 nt, Human
uauugcugauggugcaa

SEQ ID NO: 3731821 - RNA, 19 nt, Human
uauugcuguccuugaaugc

SEQ ID NO: 3731822 - RNA, 19 nt, Human
uauugcuguguaacacugu

SEQ ID NO: 3731823 - RNA, 18 nt, Human
uauugcuguugcuugaau

SEQ ID NO: 3731824 - RNA, 21 nt, Human
uauugcuuauugcuuaguaaa

SEQ ID NO: 3731825 - RNA, 15 nt, Human
uauuggaacuugcga

SEQ ID NO: 3731826 - RNA, 15 nt, Human
uauuggaauuaaccu

SEQ ID NO: 3731827 - RNA, 21 nt, Human
uauuggaauuaaccuggugcu

SEQ ID NO: 3731828 - RNA, 23 nt, Human
uauuggaauuaaccuggugcugg

SEQ ID NO: 3731829 - RNA, 23 nt, Human
uauuggaggaccaaaaaaauaag

SEQ ID NO: 3731830 - RNA, 15 nt, Human
uauuggcuuuucuga

SEQ ID NO: 3731831 - RNA, 17 nt, Human
uauuggggucugacccc

SEQ ID NO: 3731832 - RNA, 13 nt, Human
uauugguccagcu

SEQ ID NO: 3731833 - RNA, 16 nt, Human
uauugguggcuuuccu

SEQ ID NO: 3731834 - RNA, 18 nt, Human
uauugguggcuuuccuug

SEQ ID NO: 3731835 - RNA, 22 nt, Human
uauugguuuaaagaaaguguau

SEQ ID NO: 3731836 - RNA, 13 nt, Human
uauugguuuuaug

SEQ ID NO: 3731837 - RNA, 16 nt, Human
uauuguaaacaugugu

SEQ ID NO: 3731838 - RNA, 14 nt, Human
uauuguaaauaugu

SEQ ID NO: 3731839 - RNA, 15 nt, Human
uauuguaaauauguu

SEQ ID NO: 3731840 - RNA, 15 nt, Human
uauuguaacagacau

SEQ ID NO: 3731841 - RNA, 16 nt, Human
uauuguaacagacauu

SEQ ID NO: 3731842 - RNA, 19 nt, Human
uauuguaacagacauuguu

SEQ ID NO: 3731843 - RNA, 22 nt, Human
uauuguacaaaguauuaagcau

SEQ ID NO: 3731844 - RNA, 23 nt, Human
uauuguacaaaguauuaagcaua

SEQ ID NO: 3731845 - RNA, 11 nt, Human
uauuguacagu

SEQ ID NO: 3731846 - RNA, 13 nt, Human
uauuguacaguuu

SEQ ID NO: 3731847 - RNA, 17 nt, Human
uauuguacaguuuuuau

SEQ ID NO: 3731848 - RNA, 11 nt, Human
uauuguaccuc

SEQ ID NO: 3731849 - RNA, 14 nt, Human
uauuguaccucucu

SEQ ID NO: 3731850 - RNA, 20 nt, Human
uauuguagcauccuggaaua

SEQ ID NO: 3731851 - RNA, 15 nt, Human
uauuguagcauuucu

SEQ ID NO: 3731852 - RNA, 16 nt, Human
uauuguauaaacuauc

SEQ ID NO: 3731853 - RNA, 13 nt, Human
uauuguauucugg

SEQ ID NO: 3731854 - RNA, 18 nt, Human
uauuguauuguuagaugu

SEQ ID NO: 3731855 - RNA, 15 nt, Human
uauuguauuuauuca

SEQ ID NO: 3731856 - RNA, 16 nt, Human
uauuguauuuauucaa

SEQ ID NO: 3731857 - RNA, 17 nt, Human
uauuguauuuauucaau

SEQ ID NO: 3731858 - RNA, 20 nt, Human
uauuguauuuauucaauaaa

SEQ ID NO: 3731859 - RNA, 15 nt, Human
uauuguauuuauucc

SEQ ID NO: 3731860 - RNA, 15 nt, Human
uauuguccauugucc

SEQ ID NO: 3731861 - RNA, 13 nt, Human
uauugucuguaaa

SEQ ID NO: 3731862 - RNA, 14 nt, Human
uauugucuguaaau

SEQ ID NO: 3731863 - RNA, 14 nt, Human
uauugugaacauuu

SEQ ID NO: 3731864 - RNA, 19 nt, Human
uauugugauuugacuguuu

SEQ ID NO: 3731865 - RNA, 21 nt, Human
uauugugauuugacuguuuuu

SEQ ID NO: 3731866 - RNA, 17 nt, Human
uauugugcaauguaaau

SEQ ID NO: 3731867 - RNA, 16 nt, Human
uauugugcaaugugua

SEQ ID NO: 3731868 - RNA, 18 nt, Human
uauugugcaauguguaua

SEQ ID NO: 3731869 - RNA, 22 nt, Human
uauugugguaggccuuuuaaca

SEQ ID NO: 3731870 - RNA, 23 nt, Human
uauugugguaggccuuuuaacau

SEQ ID NO: 3731871 - RNA, 16 nt, Human
uauugugucuuuugca

SEQ ID NO: 3731872 - RNA, 16 nt, Human
uauuguguuuguguau

SEQ ID NO: 3731873 - RNA, 21 nt, Human
uauuguuaacucuugucuauu

SEQ ID NO: 3731874 - RNA, 15 nt, Human
uauuguuacucuggu

SEQ ID NO: 3731875 - RNA, 16 nt, Human
uauuguucaaacaaua

SEQ ID NO: 3731876 - RNA, 20 nt, Human
uauuguucaaacaauaucau

SEQ ID NO: 3731877 - RNA, 17 nt, Human
uauuguucagcaugcaa

SEQ ID NO: 3731878 - RNA, 13 nt, Human
uauuguuccaaga

SEQ ID NO: 3731879 - RNA, 17 nt, Human
uauuguuccaagacauu

SEQ ID NO: 3731880 - RNA, 19 nt, Human
uauuguuccaagacauugu

SEQ ID NO: 3731881 - RNA, 21 nt, Human
uauuguuccaagacauuguca

SEQ ID NO: 3731882 - RNA, 23 nt, Human
uauuguuccaagacauugucaau

SEQ ID NO: 3731883 - RNA, 17 nt, Human
uauuguucccagugaca

SEQ ID NO: 3731884 - RNA, 21 nt, Human
uauuguucccagugacacuuc

SEQ ID NO: 3731885 - RNA, 21 nt, Human
uauuguuccuaaguucuuaga

SEQ ID NO: 3731886 - RNA, 14 nt, Human
uauuguugaaaaag

SEQ ID NO: 3731887 - RNA, 20 nt, Human
uauuguugacaacugugacu

SEQ ID NO: 3731888 - RNA, 14 nt, Human
uauuguuguauaau

SEQ ID NO: 3731889 - RNA, 14 nt, Human
uauuguuguccuuu

SEQ ID NO: 3731890 - RNA, 13 nt, Human
uauuguuuaugua

SEQ ID NO: 3731891 - RNA, 22 nt, Human
uauuguuuauucuuuuuaaagu

SEQ ID NO: 3731892 - RNA, 13 nt, Human
uauuguuucuuua

SEQ ID NO: 3731893 - RNA, 15 nt, Human
uauuguuugguaaau

SEQ ID NO: 3731894 - RNA, 14 nt, Human
uauuuaaaaaacua

SEQ ID NO: 3731895 - RNA, 19 nt, Human
uauuuaaaaacaaaaggca

SEQ ID NO: 3731896 - RNA, 17 nt, Human
uauuuaaaaauaaguca

SEQ ID NO: 3731897 - RNA, 13 nt, Human
uauuuaaaaaugu

SEQ ID NO: 3731898 - RNA, 17 nt, Human
uauuuaaaaaugucuug

SEQ ID NO: 3731899 - RNA, 12 nt, Human
uauuuaaaagau

SEQ ID NO: 3731900 - RNA, 15 nt, Human
uauuuaaaagauuca

SEQ ID NO: 3731901 - RNA, 16 nt, Human
uauuuaaaagauucau

SEQ ID NO: 3731902 - RNA, 14 nt, Human
uauuuaaaauagca

SEQ ID NO: 3731903 - RNA, 15 nt, Human
uauuuaaacuaucuu

SEQ ID NO: 3731904 - RNA, 16 nt, Human
uauuuaaacuuauaaa

SEQ ID NO: 3731905 - RNA, 20 nt, Human
uauuuaaagaagaaacgucu

SEQ ID NO: 3731906 - RNA, 12 nt, Human
uauuuaaagaca

SEQ ID NO: 3731907 - RNA, 18 nt, Human
uauuuaaagacaaagaca

SEQ ID NO: 3731908 - RNA, 14 nt, Human
uauuuaaagacagg

SEQ ID NO: 3731909 - RNA, 18 nt, Human
uauuuaaagggaaauuga

SEQ ID NO: 3731910 - RNA, 15 nt, Human
uauuuaaauagauga

SEQ ID NO: 3731911 - RNA, 21 nt, Human
uauuuaaauccugaagagcau

SEQ ID NO: 3731912 - RNA, 18 nt, Human
uauuuaaauguaaagaca

SEQ ID NO: 3731913 - RNA, 14 nt, Human
uauuuaaaugucua

SEQ ID NO: 3731914 - RNA, 15 nt, Human
uauuuaaauucuuuu

SEQ ID NO: 3731915 - RNA, 13 nt, Human
uauuuaacagaaa

SEQ ID NO: 3731916 - RNA, 16 nt, Human
uauuuaacagaaauug

SEQ ID NO: 3731917 - RNA, 17 nt, Human
uauuuaaccucuaaauu

SEQ ID NO: 3731918 - RNA, 13 nt, Human
uauuuaacuaauu

SEQ ID NO: 3731919 - RNA, 14 nt, Human
uauuuaacuucuga

SEQ ID NO: 3731920 - RNA, 21 nt, Human
uauuuaagaaaauacaauaaa

SEQ ID NO: 3731921 - RNA, 14 nt, Human
uauuuaagauguga

SEQ ID NO: 3731922 - RNA, 13 nt, Human
uauuuaagcaaau

SEQ ID NO: 3731923 - RNA, 20 nt, Human
uauuuaaguaacuuuaaauu

SEQ ID NO: 3731924 - RNA, 18 nt, Human
uauuuaauagcaaagaau

SEQ ID NO: 3731925 - RNA, 22 nt, Human
uauuuaauagcaaagaauugac

SEQ ID NO: 3731926 - RNA, 21 nt, Human
uauuuaaugcauuaaaccugu

SEQ ID NO: 3731927 - RNA, 17 nt, Human
uauuuaauggaagugua

SEQ ID NO: 3731928 - RNA, 15 nt, Human
uauuuaauguuaugu

SEQ ID NO: 3731929 - RNA, 12 nt, Human
uauuuaauguug

SEQ ID NO: 3731930 - RNA, 13 nt, Human
uauuuaauguuga

SEQ ID NO: 3731931 - RNA, 17 nt, Human
uauuuaauguugaacaa

SEQ ID NO: 3731932 - RNA, 15 nt, Human
uauuuaauguuuuaa

SEQ ID NO: 3731933 - RNA, 17 nt, Human
uauuuaauguuuuaaau

SEQ ID NO: 3731934 - RNA, 21 nt, Human
uauuuaauuagugcuaagugu

SEQ ID NO: 3731935 - RNA, 14 nt, Human
uauuuaauucaugu

SEQ ID NO: 3731936 - RNA, 16 nt, Human
uauuuaauuguaaacu

SEQ ID NO: 3731937 - RNA, 17 nt, Human
uauuuaauuguaaacug

SEQ ID NO: 3731938 - RNA, 16 nt, Human
uauuuacaaccuagaa

SEQ ID NO: 3731939 - RNA, 16 nt, Human
uauuuacaagaagaac

SEQ ID NO: 3731940 - RNA, 15 nt, Human
uauuuacaauguauu

SEQ ID NO: 3731941 - RNA, 15 nt, Human
uauuuacacaauuua

SEQ ID NO: 3731942 - RNA, 13 nt, Human
uauuuaccucagc

SEQ ID NO: 3731943 - RNA, 15 nt, Human
uauuuaccucagccu

SEQ ID NO: 3731944 - RNA, 14 nt, Human
uauuuacgcuuuga

SEQ ID NO: 3731945 - RNA, 14 nt, Human
uauuuacugagcuu

SEQ ID NO: 3731946 - RNA, 21 nt, Human
uauuuacugagcuucucugug

SEQ ID NO: 3731947 - RNA, 13 nt, Human
uauuuagacaaga

SEQ ID NO: 3731948 - RNA, 22 nt, Human
uauuuagauuguuaaaauaacu

SEQ ID NO: 3731949 - RNA, 21 nt, Human
uauuuagcaugacaagcccca

SEQ ID NO: 3731950 - RNA, 20 nt, Human
uauuuagugcugcaucuuau

SEQ ID NO: 3731951 - RNA, 15 nt, Human
uauuuaguuauaguu

SEQ ID NO: 3731952 - RNA, 20 nt, Human
uauuuauaacaaccuaaauu

SEQ ID NO: 3731953 - RNA, 14 nt, Human
uauuuauaacagca

SEQ ID NO: 3731954 - RNA, 18 nt, Human
uauuuauaacagcauucu

SEQ ID NO: 3731955 - RNA, 22 nt, Human
uauuuauaacucaucauaaaau

SEQ ID NO: 3731956 - RNA, 16 nt, Human
uauuuauaagaaaaau

SEQ ID NO: 3731957 - RNA, 20 nt, Human
uauuuauaagaaaaauguga

SEQ ID NO: 3731958 - RNA, 17 nt, Human
uauuuauaaucacuuuu

SEQ ID NO: 3731959 - RNA, 19 nt, Human
uauuuauacaagauugaaa

SEQ ID NO: 3731960 - RNA, 23 nt, Human
uauuuauauaauuauguuauuga

SEQ ID NO: 3731961 - RNA, 17 nt, Human
uauuuauauguacuguu

SEQ ID NO: 3731962 - RNA, 16 nt, Human
uauuuauauguaugug

SEQ ID NO: 3731963 - RNA, 18 nt, Human
uauuuauauguauguguu

SEQ ID NO: 3731964 - RNA, 15 nt, Human
uauuuauauuucacu

SEQ ID NO: 3731965 - RNA, 16 nt, Human
uauuuauauuucacua

SEQ ID NO: 3731966 - RNA, 18 nt, Human
uauuuaucagugacagag

SEQ ID NO: 3731967 - RNA, 20 nt, Human
uauuuauccaaaauguguau

SEQ ID NO: 3731968 - RNA, 15 nt, Human
uauuuauccauuugu

SEQ ID NO: 3731969 - RNA, 17 nt, Human
uauuuaucuauuguaag

SEQ ID NO: 3731970 - RNA, 16 nt, Human
uauuuaucucuauuua

SEQ ID NO: 3731971 - RNA, 17 nt, Human
uauuuaucucuauuuaa

SEQ ID NO: 3731972 - RNA, 15 nt, Human
uauuuaucugauuaa

SEQ ID NO: 3731973 - RNA, 20 nt, Human
uauuuaucugugcaaauccu

SEQ ID NO: 3731974 - RNA, 13 nt, Human
uauuuaucuucau

SEQ ID NO: 3731975 - RNA, 12 nt, Human
uauuuaugaagu

SEQ ID NO: 3731976 - RNA, 14 nt, Human
uauuuaugaaguuu

SEQ ID NO: 3731977 - RNA, 16 nt, Human
uauuuaugaaguuuaa

SEQ ID NO: 3731978 - RNA, 21 nt, Human
uauuuaugccuugaugauuua

SEQ ID NO: 3731979 - RNA, 22 nt, Human
uauuuaugccuugaugauuuaa

SEQ ID NO: 3731980 - RNA, 19 nt, Human
uauuuauggaugcaacacg

SEQ ID NO: 3731981 - RNA, 20 nt, Human
uauuuauguauugugcaaug

SEQ ID NO: 3731982 - RNA, 21 nt, Human
uauuuaugucuauuuaagccu

SEQ ID NO: 3731983 - RNA, 13 nt, Human
uauuuauguuugc

SEQ ID NO: 3731984 - RNA, 15 nt, Human
uauuuauuaaauaaa

SEQ ID NO: 3731985 - RNA, 17 nt, Human
uauuuauuaaauaaaau

SEQ ID NO: 3731986 - RNA, 13 nt, Human
uauuuauuaaauu

SEQ ID NO: 3731987 - RNA, 14 nt, Human
uauuuauuaaauuu

SEQ ID NO: 3731988 - RNA, 24 nt, Human
uauuuauuaaauuuuuuuguauga

SEQ ID NO: 3731989 - RNA, 13 nt, Human
uauuuauuaauau

SEQ ID NO: 3731990 - RNA, 18 nt, Human
uauuuauuaauauuuaac

SEQ ID NO: 3731991 - RNA, 19 nt, Human
uauuuauuaauauuuaaca

SEQ ID NO: 3731992 - RNA, 20 nt, Human
uauuuauuacauaauuuagu

SEQ ID NO: 3731993 - RNA, 14 nt, Human
uauuuauuacugua

SEQ ID NO: 3731994 - RNA, 20 nt, Human
uauuuauuaugcuuuauugg

SEQ ID NO: 3731995 - RNA, 19 nt, Human
uauuuauuauuuucaccug

SEQ ID NO: 3731996 - RNA, 14 nt, Human
uauuuauucaauaa

SEQ ID NO: 3731997 - RNA, 24 nt, Human
uauuuauucagcuucauuuguguc

SEQ ID NO: 3731998 - RNA, 21 nt, Human
uauuuauucugggaauguaua

SEQ ID NO: 3731999 - RNA, 15 nt, Human
uauuuauugacucuu

SEQ ID NO: 3732000 - RNA, 17 nt, Human
uauuuauugacucuuga

SEQ ID NO: 3732001 - RNA, 21 nt, Human
uauuuauugacucuugaguug

SEQ ID NO: 3732002 - RNA, 21 nt, Human
uauuuauugcuacuuccugcc

SEQ ID NO: 3732003 - RNA, 13 nt, Human
uauuuauuguauu

SEQ ID NO: 3732004 - RNA, 16 nt, Human
uauuuauuguuuauuu

SEQ ID NO: 3732005 - RNA, 13 nt, Human
uauuuauuuaaaa

SEQ ID NO: 3732006 - RNA, 17 nt, Human
uauuuauuuaaagcauu

SEQ ID NO: 3732007 - RNA, 16 nt, Human
uauuuauuuaaauguc

SEQ ID NO: 3732008 - RNA, 12 nt, Human
uauuuauuuaau

SEQ ID NO: 3732009 - RNA, 11 nt, Human
uauuuauuuac

SEQ ID NO: 3732010 - RNA, 13 nt, Human
uauuuauuuacug

SEQ ID NO: 3732011 - RNA, 17 nt, Human
uauuuauuuacugagcu

SEQ ID NO: 3732012 - RNA, 13 nt, Human
uauuuauuuguga

SEQ ID NO: 3732013 - RNA, 21 nt, Human
uauuuauuuuccuaaagagag

SEQ ID NO: 3732014 - RNA, 21 nt, Human
uauuuauuuucuuuugaauug

SEQ ID NO: 3732015 - RNA, 14 nt, Human
uauuuauuuuguaa

SEQ ID NO: 3732016 - RNA, 15 nt, Human
uauuuauuuuguaau

SEQ ID NO: 3732017 - RNA, 19 nt, Human
uauuuauuuuguaauuaug

SEQ ID NO: 3732018 - RNA, 18 nt, Human
uauuuauuuuuacaagaa

SEQ ID NO: 3732019 - RNA, 14 nt, Human
uauuucaaaaauuu

SEQ ID NO: 3732020 - RNA, 17 nt, Human
uauuucaaaaauuugga

SEQ ID NO: 3732021 - RNA, 14 nt, Human
uauuucaaauugga

SEQ ID NO: 3732022 - RNA, 18 nt, Human
uauuucaaauuggagcuu

SEQ ID NO: 3732023 - RNA, 16 nt, Human
uauuucaauguuagcc

SEQ ID NO: 3732024 - RNA, 20 nt, Human
uauuucacaaauaauaggug

SEQ ID NO: 3732025 - RNA, 22 nt, Human
uauuucacacgcuguucuaaug

SEQ ID NO: 3732026 - RNA, 14 nt, Human
uauuucacuggagc

SEQ ID NO: 3732027 - RNA, 15 nt, Human
uauuucacuggagca

SEQ ID NO: 3732028 - RNA, 20 nt, Human
uauuucagauguaauguuuu

SEQ ID NO: 3732029 - RNA, 12 nt, Human
uauuucagauuu

SEQ ID NO: 3732030 - RNA, 19 nt, Human
uauuucagauuuugauaac

SEQ ID NO: 3732031 - RNA, 23 nt, Human
uauuucagauuuugauaacuguu

SEQ ID NO: 3732032 - RNA, 22 nt, Human
uauuucaguguaguuaauuuau

SEQ ID NO: 3732033 - RNA, 23 nt, Human
uauuucaguguaguuaauuuauc

SEQ ID NO: 3732034 - RNA, 21 nt, Human
uauuucaucauauuauacaga

SEQ ID NO: 3732035 - RNA, 21 nt, Human
uauuucaugcugggaaugaga

SEQ ID NO: 3732036 - RNA, 13 nt, Human
uauuucauguuuu

SEQ ID NO: 3732037 - RNA, 21 nt, Human
uauuucauguuuuugaucaaa

SEQ ID NO: 3732038 - RNA, 12 nt, Human
uauuucauugcc

SEQ ID NO: 3732039 - RNA, 13 nt, Human
uauuucauuuauu

SEQ ID NO: 3732040 - RNA, 13 nt, Human
uauuucauuucuu

SEQ ID NO: 3732041 - RNA, 14 nt, Human
uauuuccacuaaaa

SEQ ID NO: 3732042 - RNA, 17 nt, Human
uauuuccacuaaaaaua

SEQ ID NO: 3732043 - RNA, 22 nt, Human
uauuuccaguguucuaugaaca

SEQ ID NO: 3732044 - RNA, 18 nt, Human
uauuuccauucaacaaga

SEQ ID NO: 3732045 - RNA, 21 nt, Human
uauuuccauuccagaauaucu

SEQ ID NO: 3732046 - RNA, 19 nt, Human
uauuucccuaaaauacauu

SEQ ID NO: 3732047 - RNA, 15 nt, Human
uauuucccuacauua

SEQ ID NO: 3732048 - RNA, 16 nt, Human
uauuucccuacauuaa

SEQ ID NO: 3732049 - RNA, 22 nt, Human
uauuucccucaccuuucccauc

SEQ ID NO: 3732050 - RNA, 20 nt, Human
uauuucccuccccuggggac

SEQ ID NO: 3732051 - RNA, 17 nt, Human
uauuuccuauaccauuu

SEQ ID NO: 3732052 - RNA, 15 nt, Human
uauuuccuaugaugu

SEQ ID NO: 3732053 - RNA, 19 nt, Human
uauuuccucaugugaucac

SEQ ID NO: 3732054 - RNA, 19 nt, Human
uauuuccuuaaacugugug

SEQ ID NO: 3732055 - RNA, 16 nt, Human
uauuuccuuuauguga

SEQ ID NO: 3732056 - RNA, 15 nt, Human
uauuucgaaagcugc

SEQ ID NO: 3732057 - RNA, 19 nt, Human
uauuucuagggcugggaaa

SEQ ID NO: 3732058 - RNA, 16 nt, Human
uauuucuaucccaaac

SEQ ID NO: 3732059 - RNA, 14 nt, Human
uauuucuaugaaau

SEQ ID NO: 3732060 - RNA, 22 nt, Human
uauagucaauggcuuguucauc

SEQ ID NO: 3732061 - RNA, 13 nt, Human
uauaguccagcuu

SEQ ID NO: 3732062 - RNA, 20 nt, Human
uauagucuaagacuauauau

SEQ ID NO: 3732063 - RNA, 13 nt, Human
uauagugauguaa

SEQ ID NO: 3732064 - RNA, 15 nt, Human
uauagugcaauauau

SEQ ID NO: 3732065 - RNA, 16 nt, Human
uauagugcacaaaaug

SEQ ID NO: 3732066 - RNA, 18 nt, Human
uauagugcacaaaaugaa

SEQ ID NO: 3732067 - RNA, 15 nt, Human
uauaguggaaaaaca

SEQ ID NO: 3732068 - RNA, 18 nt, Human
uauaguguaaaauaagaa

SEQ ID NO: 3732069 - RNA, 13 nt, Human
uauaguuaacaca

SEQ ID NO: 3732070 - RNA, 18 nt, Human
uauaguuaacacacuacc

SEQ ID NO: 3732071 - RNA, 15 nt, Human
uauaguucuagacau

SEQ ID NO: 3732072 - RNA, 14 nt, Human
uauaguugcuugcc

SEQ ID NO: 3732073 - RNA, 22 nt, Human
uauaguugcuugccugauauaa

SEQ ID NO: 3732074 - RNA, 21 nt, Human
uauaguuguggacauuuaaga

SEQ ID NO: 3732075 - RNA, 14 nt, Human
uauaguuuaaaaca

SEQ ID NO: 3732076 - RNA, 16 nt, Human
uauaguuuacuauuuu

SEQ ID NO: 3732077 - RNA, 19 nt, Human
uauaguuuauugacaauaa

SEQ ID NO: 3732078 - RNA, 22 nt, Human
uauaguuucugaggcuuuauga

SEQ ID NO: 3732079 - RNA, 17 nt, Human
uauaguuugggcuucag

SEQ ID NO: 3732080 - RNA, 15 nt, Human
uauaguuuuacuuuu

SEQ ID NO: 3732081 - RNA, 16 nt, Human
uauaguuuuacuuuua

SEQ ID NO: 3732082 - RNA, 22 nt, Human
uauaguuuugaauccuuugccu

SEQ ID NO: 3732083 - RNA, 14 nt, Human
uauauaaaaauaua

SEQ ID NO: 3732084 - RNA, 22 nt, Human
uauauaaaauaaauauauauaa

SEQ ID NO: 3732085 - RNA, 23 nt, Human
uauauaaagaaaaugauacagca

SEQ ID NO: 3732086 - RNA, 15 nt, Human
uauauaaagaauaua

SEQ ID NO: 3732087 - RNA, 19 nt, Human
uauauaaagaauauauaua

SEQ ID NO: 3732088 - RNA, 12 nt, Human
uauauaaagaga

SEQ ID NO: 3732089 - RNA, 16 nt, Human
uauauaaaguauucuu

SEQ ID NO: 3732090 - RNA, 16 nt, Human
uauauaaauaaauaua

SEQ ID NO: 3732091 - RNA, 19 nt, Human
uauauaaauaaauauauau

SEQ ID NO: 3732092 - RNA, 22 nt, Human
uauauaaauaaauauauauauc

SEQ ID NO: 3732093 - RNA, 15 nt, Human
uauauaaauauauau

SEQ ID NO: 3732094 - RNA, 16 nt, Human
uauauaaauauauaua

SEQ ID NO: 3732095 - RNA, 17 nt, Human
uauauaaaugggaacau

SEQ ID NO: 3732096 - RNA, 19 nt, Human
uauauaacaaugcuguauu

SEQ ID NO: 3732097 - RNA, 22 nt, Human
uauauaagauggaagcuuccag

SEQ ID NO: 3732098 - RNA, 13 nt, Human
uauauaauaucua

SEQ ID NO: 3732099 - RNA, 17 nt, Human
uauauaauaucuaaagu

SEQ ID NO: 3732100 - RNA, 16 nt, Human
uauauaaucaucaagu

SEQ ID NO: 3732101 - RNA, 22 nt, Human
uauauaauuacauauuugcaua

SEQ ID NO: 3732102 - RNA, 14 nt, Human
uauauaauuauguu

SEQ ID NO: 3732103 - RNA, 21 nt, Human
uauauaauucacucaagcacu

SEQ ID NO: 3732104 - RNA, 14 nt, Human
uauauaauucugua

SEQ ID NO: 3732105 - RNA, 16 nt, Human
uauauacaaaaagaaa

SEQ ID NO: 3732106 - RNA, 12 nt, Human
uauauacacaua

SEQ ID NO: 3732107 - RNA, 13 nt, Human
uauauacacauau

SEQ ID NO: 3732108 - RNA, 23 nt, Human
uauauacagaggaaaucuguaac

SEQ ID NO: 3732109 - RNA, 14 nt, Human
uauauacaguaacu

SEQ ID NO: 3732110 - RNA, 13 nt, Human
uauauacauaugu

SEQ ID NO: 3732111 - RNA, 17 nt, Human
uauauacauauguagac

SEQ ID NO: 3732112 - RNA, 14 nt, Human
uauauacaugugug

SEQ ID NO: 3732113 - RNA, 17 nt, Human
uauauacauguguguau

SEQ ID NO: 3732114 - RNA, 21 nt, Human
uauauacauuuaugaauuaaa

SEQ ID NO: 3732115 - RNA, 15 nt, Human
uauauaccguggggg

SEQ ID NO: 3732116 - RNA, 20 nt, Human
uauauacuuguuguuuaaug

SEQ ID NO: 3732117 - RNA, 21 nt, Human
uauauagcagcaaaaauauaa

SEQ ID NO: 3732118 - RNA, 23 nt, Human
uauauagcaguaaaaaauggugu

SEQ ID NO: 3732119 - RNA, 15 nt, Human
uauauagcauuuaug

SEQ ID NO: 3732120 - RNA, 14 nt, Human
uauauagcuggcaa

SEQ ID NO: 3732121 - RNA, 19 nt, Human
uauauagcuggcaagaaug

SEQ ID NO: 3732122 - RNA, 20 nt, Human
uauauagcuggcaagaaugg

SEQ ID NO: 3732123 - RNA, 18 nt, Human
uauauaggcuauuuucua

SEQ ID NO: 3732124 - RNA, 21 nt, Human
uauauagguuuuguuugcuau

SEQ ID NO: 3732125 - RNA, 17 nt, Human
uauauaguaccuuugcu

SEQ ID NO: 3732126 - RNA, 14 nt, Human
uauauagugcuaua

SEQ ID NO: 3732127 - RNA, 17 nt, Human
uauauagugcuauauau

SEQ ID NO: 3732128 - RNA, 12 nt, Human
uauauauaaaau

SEQ ID NO: 3732129 - RNA, 13 nt, Human
uauauauaaaaua

SEQ ID NO: 3732130 - RNA, 12 nt, Human
uauauauaaaua

SEQ ID NO: 3732131 - RNA, 15 nt, Human
uauauauaaauguau

SEQ ID NO: 3732132 - RNA, 16 nt, Human
uauauauaacauauau

SEQ ID NO: 3732133 - RNA, 18 nt, Human
uauauauaauucuguaca

SEQ ID NO: 3732134 - RNA, 13 nt, Human
uauauauacagua

SEQ ID NO: 3732135 - RNA, 11 nt, Human
uauauauacau

SEQ ID NO: 3732136 - RNA, 12 nt, Human
uauauauacaua

SEQ ID NO: 3732137 - RNA, 13 nt, Human
uauauauacauau

SEQ ID NO: 3732138 - RNA, 14 nt, Human
uauauauacauaua

SEQ ID NO: 3732139 - RNA, 16 nt, Human
uauauauacauaugua

SEQ ID NO: 3732140 - RNA, 18 nt, Human
uauauauacauauguaga

SEQ ID NO: 3732141 - RNA, 13 nt, Human
uauauauagaauc

SEQ ID NO: 3732142 - RNA, 19 nt, Human
uauauauagugcuauauau

SEQ ID NO: 3732143 - RNA, 12 nt, Human
uauauauauaaa

SEQ ID NO: 3732144 - RNA, 14 nt, Human
uauauauauaaaau

SEQ ID NO: 3732145 - RNA, 14 nt, Human
uauauauauaaaua

SEQ ID NO: 3732146 - RNA, 15 nt, Human
uauauauauauaaag

SEQ ID NO: 3732147 - RNA, 15 nt, Human
uauauauauauauaa

SEQ ID NO: 3732148 - RNA, 14 nt, Human
uauauauauauaug

SEQ ID NO: 3732149 - RNA, 13 nt, Human
uauauauauaucu

SEQ ID NO: 3732150 - RNA, 15 nt, Human
uauauauauauguac

SEQ ID NO: 3732151 - RNA, 13 nt, Human
uauauauaucagu

SEQ ID NO: 3732152 - RNA, 13 nt, Human
uauauauaucugu

SEQ ID NO: 3732153 - RNA, 13 nt, Human
uauauauaugcau

SEQ ID NO: 3732154 - RNA, 15 nt, Human
uauauauaugcauau

SEQ ID NO: 3732155 - RNA, 13 nt, Human
uauauaucaguuu

SEQ ID NO: 3732156 - RNA, 17 nt, Human
uauauaucaguuugauc

SEQ ID NO: 3732157 - RNA, 22 nt, Human
uauauaucauauugguauucac

SEQ ID NO: 3732158 - RNA, 16 nt, Human
uauauauccucuguau

SEQ ID NO: 3732159 - RNA, 15 nt, Human
uauauaucuaucuua

SEQ ID NO: 3732160 - RNA, 19 nt, Human
uauauaucugcuucagugg

SEQ ID NO: 3732161 - RNA, 21 nt, Human
uauauaugccuuuuuccuagc

SEQ ID NO: 3732162 - RNA, 22 nt, Human
uauauauggggaugguaguuuu

SEQ ID NO: 3732163 - RNA, 14 nt, Human
uauauauguacagu

SEQ ID NO: 3732164 - RNA, 18 nt, Human
uauauauguauaaauaaa

SEQ ID NO: 3732165 - RNA, 14 nt, Human
uauauaugugagga

SEQ ID NO: 3732166 - RNA, 21 nt, Human
uauauauguguauauauacau

SEQ ID NO: 3732167 - RNA, 14 nt, Human
uauauaugugugug

SEQ ID NO: 3732168 - RNA, 16 nt, Human
uauauauuauacuugu

SEQ ID NO: 3732169 - RNA, 15 nt, Human
uauauauuauaugga

SEQ ID NO: 3732170 - RNA, 16 nt, Human
uauauauuauauggaa

SEQ ID NO: 3732171 - RNA, 15 nt, Human
uauauauuuaaaagu

SEQ ID NO: 3732172 - RNA, 19 nt, Human
uauauauuuaaaaguguca

SEQ ID NO: 3732173 - RNA, 13 nt, Human
uauauauuuauaa

SEQ ID NO: 3732174 - RNA, 18 nt, Human
uauauauuuugugugaaa

SEQ ID NO: 3732175 - RNA, 22 nt, Human
uauauauuuuugguugucaaua

SEQ ID NO: 3732176 - RNA, 20 nt, Human
uauauauuuuuuucugaaau

SEQ ID NO: 3732177 - RNA, 23 nt, Human
uauauauuuuuuucugaaauuuc

SEQ ID NO: 3732178 - RNA, 11 nt, Human
uauaucagccu

SEQ ID NO: 3732179 - RNA, 14 nt, Human
uauaucauauguau

SEQ ID NO: 3732180 - RNA, 19 nt, Human
uauaucauguaaagaaaug

SEQ ID NO: 3732181 - RNA, 16 nt, Human
uauaucauucuaaaga

SEQ ID NO: 3732182 - RNA, 20 nt, Human
uauauccaaaagcuuuuuau

SEQ ID NO: 3732183 - RNA, 19 nt, Human
uauauccauguacuguagu

SEQ ID NO: 3732184 - RNA, 16 nt, Human
uauaucccugauaaau

SEQ ID NO: 3732185 - RNA, 17 nt, Human
uauauccugugacuguc

SEQ ID NO: 3732186 - RNA, 17 nt, Human
uauauccuuucuaacaa

SEQ ID NO: 3732187 - RNA, 13 nt, Human
uauauccuuuucu

SEQ ID NO: 3732188 - RNA, 20 nt, Human
uauauccuuuucuucuaugu

SEQ ID NO: 3732189 - RNA, 19 nt, Human
uauaucuaaaucuguccaa

SEQ ID NO: 3732190 - RNA, 13 nt, Human
uauaucuaaauug

SEQ ID NO: 3732191 - RNA, 17 nt, Human
uauaucuaaauugaaua

SEQ ID NO: 3732192 - RNA, 21 nt, Human
uauaucuaccccagacuagau

SEQ ID NO: 3732193 - RNA, 18 nt, Human
uauaucuagguuuaugac

SEQ ID NO: 3732194 - RNA, 21 nt, Human
uauaucuauauauaauucugu

SEQ ID NO: 3732195 - RNA, 17 nt, Human
uauaucuauauauauaa

SEQ ID NO: 3732196 - RNA, 17 nt, Human
uauaucuauauguacuu

SEQ ID NO: 3732197 - RNA, 14 nt, Human
uauaucuaucuauu

SEQ ID NO: 3732198 - RNA, 14 nt, Human
uauaucucuauuug

SEQ ID NO: 3732199 - RNA, 16 nt, Human
uauaucucucaugcau

SEQ ID NO: 3732200 - RNA, 16 nt, Human
uauaucugaaaacugg

SEQ ID NO: 3732201 - RNA, 18 nt, Human
uauaucugaggaauucug

SEQ ID NO: 3732202 - RNA, 15 nt, Human
uauaucuguauauaa

SEQ ID NO: 3732203 - RNA, 14 nt, Human
uauaucuguggucu

SEQ ID NO: 3732204 - RNA, 18 nt, Human
uauaucuguggucuucaa

SEQ ID NO: 3732205 - RNA, 12 nt, Human
uauaucuuguuu

SEQ ID NO: 3732206 - RNA, 14 nt, Human
uauaugaaaaccug

SEQ ID NO: 3732207 - RNA, 14 nt, Human
uauaugaaaacuaa

SEQ ID NO: 3732208 - RNA, 19 nt, Human
uauaugaacauacaaaugc

SEQ ID NO: 3732209 - RNA, 19 nt, Human
uauaugaacuuaacaugcu

SEQ ID NO: 3732210 - RNA, 22 nt, Human
uauaugaacuuaacaugcugug

SEQ ID NO: 3732211 - RNA, 19 nt, Human
uauaugaagaaaaucacuu

SEQ ID NO: 3732212 - RNA, 22 nt, Human
uauaugaauuuaaauauaauuc

SEQ ID NO: 3732213 - RNA, 20 nt, Human
uauaugagaagaauagccua

SEQ ID NO: 3732214 - RNA, 18 nt, Human
uauaugagacuuuaugug

SEQ ID NO: 3732215 - RNA, 19 nt, Human
uauaugaggacuugugucu

SEQ ID NO: 3732216 - RNA, 13 nt, Human
uauaugauggggg

SEQ ID NO: 3732217 - RNA, 16 nt, Human
uauaugauuuauaguu

SEQ ID NO: 3732218 - RNA, 16 nt, Human
uauaugccaugaugga

SEQ ID NO: 3732219 - RNA, 16 nt, Human
uauaugcuauuucuau

SEQ ID NO: 3732220 - RNA, 20 nt, Human
uauaugcucugcauguuaca

SEQ ID NO: 3732221 - RNA, 21 nt, Human
uauaugcucugcauguuacau

SEQ ID NO: 3732222 - RNA, 16 nt, Human
uauaugcuuacugaua

SEQ ID NO: 3732223 - RNA, 14 nt, Human
uauaugcuucuguu

SEQ ID NO: 3732224 - RNA, 16 nt, Human
uauaugcuucuguuuu

SEQ ID NO: 3732225 - RNA, 18 nt, Human
uauaugcuuuauuaaugu

SEQ ID NO: 3732226 - RNA, 18 nt, Human
uauauggaaauauauauu

SEQ ID NO: 3732227 - RNA, 22 nt, Human
uauauggaaauauauauuauac

SEQ ID NO: 3732228 - RNA, 17 nt, Human
uauauggaagaggaaaa

SEQ ID NO: 3732229 - RNA, 16 nt, Human
uauauggaugauucag

SEQ ID NO: 3732230 - RNA, 20 nt, Human
uauauggcagaguuguaaau

SEQ ID NO: 3732231 - RNA, 23 nt, Human
uauauggcagaguuguaaauaua

SEQ ID NO: 3732232 - RNA, 20 nt, Human
uauauggugguaauaaggga

SEQ ID NO: 3732233 - RNA, 12 nt, Human
uauauguacagu

SEQ ID NO: 3732234 - RNA, 19 nt, Human
uauauguacccucugaaau

SEQ ID NO: 3732235 - RNA, 22 nt, Human
uauauguacccucugaaauaca

SEQ ID NO: 3732236 - RNA, 21 nt, Human
uauauguauauuuuuuuaauu

SEQ ID NO: 3732237 - RNA, 19 nt, Human
uauauguauuauuuauaau

SEQ ID NO: 3732238 - RNA, 12 nt, Human
uauauguauuuu

SEQ ID NO: 3732239 - RNA, 17 nt, Human
uauauguauuuuuauau

SEQ ID NO: 3732240 - RNA, 12 nt, Human
uauaugucaaag

SEQ ID NO: 3732241 - RNA, 18 nt, Human
uauaugugaaaggauaug

SEQ ID NO: 3732242 - RNA, 18 nt, Human
uauaugugaacauuuauc

SEQ ID NO: 3732243 - RNA, 22 nt, Human
uauaugugaauccucuucuuua

SEQ ID NO: 3732244 - RNA, 17 nt, Human
uauaugugccacauuuu

SEQ ID NO: 3732245 - RNA, 19 nt, Human
uauauguguauauauacau

SEQ ID NO: 3732246 - RNA, 20 nt, Human
uauauguguauauauacaua

SEQ ID NO: 3732247 - RNA, 14 nt, Human
uauauguguaugca

SEQ ID NO: 3732248 - RNA, 14 nt, Human
uauauguguaugua

SEQ ID NO: 3732249 - RNA, 13 nt, Human
uauaugugugugu

SEQ ID NO: 3732250 - RNA, 19 nt, Human
uauauguguguguauguuu

SEQ ID NO: 3732251 - RNA, 15 nt, Human
uauauguguguuuaa

SEQ ID NO: 3732252 - RNA, 14 nt, Human
uauauguucacugu

SEQ ID NO: 3732253 - RNA, 20 nt, Human
uauauguuuaccuuuuaauu

SEQ ID NO: 3732254 - RNA, 23 nt, Human
uauauguuuaccuuuuaauuaau

SEQ ID NO: 3732255 - RNA, 11 nt, Human
uauauguuuua

SEQ ID NO: 3732256 - RNA, 19 nt, Human
uauauguuuuugaaggcag

SEQ ID NO: 3732257 - RNA, 21 nt, Human
uauauuaaaaauauaaaacug

SEQ ID NO: 3732258 - RNA, 19 nt, Human
uauauuaaaaaugguaaaa

SEQ ID NO: 3732259 - RNA, 16 nt, Human
uauauuaaaagcaggc

SEQ ID NO: 3732260 - RNA, 22 nt, Human
uauauuaaaauuccaaauucau

SEQ ID NO: 3732261 - RNA, 13 nt, Human
uauauuaaacaaa

SEQ ID NO: 3732262 - RNA, 13 nt, Human
uauauuaagcaga

SEQ ID NO: 3732263 - RNA, 13 nt, Human
uauauuaauagua

SEQ ID NO: 3732264 - RNA, 20 nt, Human
uauauuacacauuuguacag

SEQ ID NO: 3732265 - RNA, 18 nt, Human
uauauuaccagcaagaau

SEQ ID NO: 3732266 - RNA, 18 nt, Human
uauauuaguugcuuuguu

SEQ ID NO: 3732267 - RNA, 13 nt, Human
uauauuauaauag

SEQ ID NO: 3732268 - RNA, 13 nt, Human
uauauuauaugga

SEQ ID NO: 3732269 - RNA, 19 nt, Human
uauauuauauggaaauaua

SEQ ID NO: 3732270 - RNA, 16 nt, Human
uauauuauuacuugua

SEQ ID NO: 3732271 - RNA, 19 nt, Human
uauauuauuacuuguaaau

SEQ ID NO: 3732272 - RNA, 13 nt, Human
uauauuauuuggc

SEQ ID NO: 3732273 - RNA, 12 nt, Human
uauauucaacca

SEQ ID NO: 3732274 - RNA, 14 nt, Human
uauauucaaccaug

SEQ ID NO: 3732275 - RNA, 22 nt, Human
uauauucaggacuugaaagaaa

SEQ ID NO: 3732276 - RNA, 16 nt, Human
guucuguuuacaucag

SEQ ID NO: 3732277 - RNA, 14 nt, Human
guucuguuucaagg

SEQ ID NO: 3732278 - RNA, 18 nt, Human
guucuguuucaaggcacu

SEQ ID NO: 3732279 - RNA, 15 nt, Human
guucuguuuguuaaa

SEQ ID NO: 3732280 - RNA, 17 nt, Human
guucuguuuguuaaaac

SEQ ID NO: 3732281 - RNA, 22 nt, Human
guucuguuuguuaaaacuggca

SEQ ID NO: 3732282 - RNA, 18 nt, Human
guucuguuuguuauuguu

SEQ ID NO: 3732283 - RNA, 23 nt, Human
guucuguuuguuauuguuuuguu

SEQ ID NO: 3732284 - RNA, 12 nt, Human
guucuguuuugu

SEQ ID NO: 3732285 - RNA, 17 nt, Human
guucuuaauucuuagcu

SEQ ID NO: 3732286 - RNA, 19 nt, Human
guucuuaauugcacucuaa

SEQ ID NO: 3732287 - RNA, 16 nt, Human
guucuuacacauacag

SEQ ID NO: 3732288 - RNA, 22 nt, Human
guucuuacacauacaguuuuau

SEQ ID NO: 3732289 - RNA, 16 nt, Human
guucuuagcucaauga

SEQ ID NO: 3732290 - RNA, 17 nt, Human
guucuuagcucaaugag

SEQ ID NO: 3732291 - RNA, 17 nt, Human
guucuuaugcaaaaugg

SEQ ID NO: 3732292 - RNA, 19 nt, Human
guucuuaugcaaaauggaa

SEQ ID NO: 3732293 - RNA, 16 nt, Human
guucuuccucagccag

SEQ ID NO: 3732294 - RNA, 16 nt, Human
guucuucgggaagaga

SEQ ID NO: 3732295 - RNA, 21 nt, Human
guucuucgggaagagaggagu

SEQ ID NO: 3732296 - RNA, 17 nt, Human
guucuucuuccugaagc

SEQ ID NO: 3732297 - RNA, 16 nt, Human
guucuugaggggacca

SEQ ID NO: 3732298 - RNA, 20 nt, Human
guucuugaggggaccaggag

SEQ ID NO: 3732299 - RNA, 22 nt, Human
guucuugaggggaccaggagug

SEQ ID NO: 3732300 - RNA, 22 nt, Human
guucuuggcaauaaauuuugaa

SEQ ID NO: 3732301 - RNA, 14 nt, Human
guucuugguuugua

SEQ ID NO: 3732302 - RNA, 12 nt, Human
guucuuguauuu

SEQ ID NO: 3732303 - RNA, 16 nt, Human
guucuuguucuguuuu

SEQ ID NO: 3732304 - RNA, 15 nt, Human
guucuuguuggugca

SEQ ID NO: 3732305 - RNA, 23 nt, Human
guucuuuaaaauguaaagccaug

SEQ ID NO: 3732306 - RNA, 16 nt, Human
guucuuuauauacaau

SEQ ID NO: 3732307 - RNA, 20 nt, Human
guucuuuauauacaauaaug

SEQ ID NO: 3732308 - RNA, 21 nt, Human
guucuuuauauacaauaaugg

SEQ ID NO: 3732309 - RNA, 18 nt, Human
guucuuucacccuuuucu

SEQ ID NO: 3732310 - RNA, 14 nt, Human
guucuuuccaaagu

SEQ ID NO: 3732311 - RNA, 18 nt, Human
guucuuuccaaaguacac

SEQ ID NO: 3732312 - RNA, 15 nt, Human
guucuuucuggaguc

SEQ ID NO: 3732313 - RNA, 22 nt, Human
guucuuugggccagacaugcca

SEQ ID NO: 3732314 - RNA, 12 nt, Human
guucuuugugua

SEQ ID NO: 3732315 - RNA, 15 nt, Human
guucuuuuaagccca

SEQ ID NO: 3732316 - RNA, 19 nt, Human
guucuuuucaauauauuug

SEQ ID NO: 3732317 - RNA, 12 nt, Human
guugaaaaaauu

SEQ ID NO: 3732318 - RNA, 17 nt, Human
guugaaaaccaaaauga

SEQ ID NO: 3732319 - RNA, 22 nt, Human
guugaaaauucaaaaaguguuu

SEQ ID NO: 3732320 - RNA, 21 nt, Human
guugaaacggaugauuucuau

SEQ ID NO: 3732321 - RNA, 22 nt, Human
guugaaacggaugauuucuaug

SEQ ID NO: 3732322 - RNA, 13 nt, Human
guugaaagguuuu

SEQ ID NO: 3732323 - RNA, 14 nt, Human
guugaaagguuuuu

SEQ ID NO: 3732324 - RNA, 21 nt, Human
guugaaagguuuuuuuucagu

SEQ ID NO: 3732325 - RNA, 23 nt, Human
guugaaagguuuuuuuucaguug

SEQ ID NO: 3732326 - RNA, 16 nt, Human
guugaaauaugauguu

SEQ ID NO: 3732327 - RNA, 20 nt, Human
guugaaauuguaauuauauc

SEQ ID NO: 3732328 - RNA, 24 nt, Human
guugaaauuuugcaaauauaaaca

SEQ ID NO: 3732329 - RNA, 14 nt, Human
guugaacaaaauaa

SEQ ID NO: 3732330 - RNA, 15 nt, Human
guugaacaaaauaaa

SEQ ID NO: 3732331 - RNA, 18 nt, Human
guugaaccuauuucucuu

SEQ ID NO: 3732332 - RNA, 21 nt, Human
guugaacugauaguuacuguu

SEQ ID NO: 3732333 - RNA, 17 nt, Human
guugaacuguuagaaug

SEQ ID NO: 3732334 - RNA, 19 nt, Human
guugaagagacagagacaa

SEQ ID NO: 3732335 - RNA, 20 nt, Human
guugaagagacagagacaag

SEQ ID NO: 3732336 - RNA, 22 nt, Human
guugaagagacagagacaagua

SEQ ID NO: 3732337 - RNA, 23 nt, Human
guugaagcaaaucgaaugaaauu

SEQ ID NO: 3732338 - RNA, 22 nt, Human
guugaagcuaagauuuagagau

SEQ ID NO: 3732339 - RNA, 16 nt, Human
guugaagucaugcucc

SEQ ID NO: 3732340 - RNA, 13 nt, Human
guugaauauuugu

SEQ ID NO: 3732341 - RNA, 13 nt, Human
guugaauguugca

SEQ ID NO: 3732342 - RNA, 21 nt, Human
guugaauuuauuggcuuuucu

SEQ ID NO: 3732343 - RNA, 22 nt, Human
guugaauuuauuggcuuuucug

SEQ ID NO: 3732344 - RNA, 21 nt, Human
guugaauuuuguucucuggga

SEQ ID NO: 3732345 - RNA, 16 nt, Human
guugacaacugugacu

SEQ ID NO: 3732346 - RNA, 19 nt, Human
guugacacaguuguagggu

SEQ ID NO: 3732347 - RNA, 15 nt, Human
uaaaauccucaaucc

SEQ ID NO: 3732348 - RNA, 17 nt, Human
uaaaaucuauucugugu

SEQ ID NO: 3732349 - RNA, 23 nt, Human
uaaaaucugagggaaauguuuug

SEQ ID NO: 3732350 - RNA, 21 nt, Human
uaaaaucugauauguauuguu

SEQ ID NO: 3732351 - RNA, 22 nt, Human
uaaaaucugauauguauuguuu

SEQ ID NO: 3732352 - RNA, 13 nt, Human
uaaaaucuuaaac

SEQ ID NO: 3732353 - RNA, 13 nt, Human
uaaaaucuuauag

SEQ ID NO: 3732354 - RNA, 22 nt, Human
uaaaaucuuggaaguacaugaa

SEQ ID NO: 3732355 - RNA, 14 nt, Human
uaaaaucuugucau

SEQ ID NO: 3732356 - RNA, 15 nt, Human
uaaaaucuugucaug

SEQ ID NO: 3732357 - RNA, 16 nt, Human
uaaaaucuugucaugu

SEQ ID NO: 3732358 - RNA, 20 nt, Human
uaaaaucuugucauguguau

SEQ ID NO: 3732359 - RNA, 18 nt, Human
uaaaaucuuucuuucuua

SEQ ID NO: 3732360 - RNA, 16 nt, Human
uaaaaugaaaauugua

SEQ ID NO: 3732361 - RNA, 14 nt, Human
uaaaaugaaauuac

SEQ ID NO: 3732362 - RNA, 15 nt, Human
uaaaaugaagaauuu

SEQ ID NO: 3732363 - RNA, 16 nt, Human
uaaaaugaagaauuua

SEQ ID NO: 3732364 - RNA, 17 nt, Human
uaaaaugaagaauuuaa

SEQ ID NO: 3732365 - RNA, 18 nt, Human
uaaaaugacaaucaugug

SEQ ID NO: 3732366 - RNA, 21 nt, Human
uaaaaugaccaguaauuguga

SEQ ID NO: 3732367 - RNA, 15 nt, Human
uaaaaugacuacuua

SEQ ID NO: 3732368 - RNA, 16 nt, Human
uaaaaugacuacuuag

SEQ ID NO: 3732369 - RNA, 19 nt, Human
uaaaaugacuacuuagcau

SEQ ID NO: 3732370 - RNA, 20 nt, Human
uaaaaugagguucaacuguu

SEQ ID NO: 3732371 - RNA, 14 nt, Human
uaaaaugauuguaa

SEQ ID NO: 3732372 - RNA, 16 nt, Human
uaaaaugauuguaaaa

SEQ ID NO: 3732373 - RNA, 18 nt, Human
uaaaaugauuguaaaaua

SEQ ID NO: 3732374 - RNA, 17 nt, Human
uaaaaugauuuguagug

SEQ ID NO: 3732375 - RNA, 23 nt, Human
uaaaaugauuuguaguggaaaca

SEQ ID NO: 3732376 - RNA, 20 nt, Human
uaaaaugcaaaaaaucuuaa

SEQ ID NO: 3732377 - RNA, 15 nt, Human
uaaaaugcaauguaa

SEQ ID NO: 3732378 - RNA, 16 nt, Human
uaaaaugcaugauuuu

SEQ ID NO: 3732379 - RNA, 21 nt, Human
uaaaaugccucaguguauuug

SEQ ID NO: 3732380 - RNA, 23 nt, Human
uaaaauggaauugaaaaacucuu

SEQ ID NO: 3732381 - RNA, 16 nt, Human
uaaaauggcaacaaac

SEQ ID NO: 3732382 - RNA, 17 nt, Human
uaaaauggcaacaaacu

SEQ ID NO: 3732383 - RNA, 18 nt, Human
uaaaauggcuguaaucau

SEQ ID NO: 3732384 - RNA, 18 nt, Human
uaaaaugguuuguccuga

SEQ ID NO: 3732385 - RNA, 10 nt, Human
uaaaauguaa

SEQ ID NO: 3732386 - RNA, 15 nt, Human
uaaaauguaaagcca

SEQ ID NO: 3732387 - RNA, 14 nt, Human
uaaaauguaagauu

SEQ ID NO: 3732388 - RNA, 17 nt, Human
uaaaauguaauuuaaau

SEQ ID NO: 3732389 - RNA, 18 nt, Human
uaaaauguacauguauua

SEQ ID NO: 3732390 - RNA, 22 nt, Human
uaaaauguaucuaagaauaaua

SEQ ID NO: 3732391 - RNA, 17 nt, Human
uaaaauguaugcauguu

SEQ ID NO: 3732392 - RNA, 22 nt, Human
uaaaauguauucuuaaauucau

SEQ ID NO: 3732393 - RNA, 23 nt, Human
uaaaauguauucuuaaauucauu

SEQ ID NO: 3732394 - RNA, 20 nt, Human
uaaaauguccaguaagauca

SEQ ID NO: 3732395 - RNA, 22 nt, Human
uaaaauguccaguaagaucacu

SEQ ID NO: 3732396 - RNA, 20 nt, Human
uaaaaugucuuuccaaauua

SEQ ID NO: 3732397 - RNA, 13 nt, Human
uaaaaugugaagu

SEQ ID NO: 3732398 - RNA, 19 nt, Human
uaaaaugugauguucuaag

SEQ ID NO: 3732399 - RNA, 20 nt, Human
uaaaaugugauguucuaagg

SEQ ID NO: 3732400 - RNA, 22 nt, Human
uaaaaugugauguucuaaggcu

SEQ ID NO: 3732401 - RNA, 18 nt, Human
uaaaaugugggauuaugg

SEQ ID NO: 3732402 - RNA, 23 nt, Human
uaaaaugugggauuaugggucac

SEQ ID NO: 3732403 - RNA, 23 nt, Human
uaaaauguguuguuccaaauacu

SEQ ID NO: 3732404 - RNA, 22 nt, Human
uaaaauguucacuuuugacaaa

SEQ ID NO: 3732405 - RNA, 14 nt, Human
uaaaauguugaaaa

SEQ ID NO: 3732406 - RNA, 17 nt, Human
uaaaauguugaaaaguc

SEQ ID NO: 3732407 - RNA, 19 nt, Human
uaaaauguugaaaagucaa

SEQ ID NO: 3732408 - RNA, 20 nt, Human
uaaaauguugaaaagucaaa

SEQ ID NO: 3732409 - RNA, 13 nt, Human
uaaaauguuuuca

SEQ ID NO: 3732410 - RNA, 12 nt, Human
uaaaauuaaaga

SEQ ID NO: 3732411 - RNA, 17 nt, Human
uaaaauuacaacuaagu

SEQ ID NO: 3732412 - RNA, 16 nt, Human
uaaaauuauacugugu

SEQ ID NO: 3732413 - RNA, 20 nt, Human
uaaaauuauacuguguguga

SEQ ID NO: 3732414 - RNA, 16 nt, Human
uaaaauuauagcucua

SEQ ID NO: 3732415 - RNA, 22 nt, Human
uaaaauuaucaauaucuaauau

SEQ ID NO: 3732416 - RNA, 20 nt, Human
uaaaauuaugaaucugauuu

SEQ ID NO: 3732417 - RNA, 21 nt, Human
uaaaauuauuuuggauuuugu

SEQ ID NO: 3732418 - RNA, 14 nt, Human
uaaaauucaguuuu

SEQ ID NO: 3732419 - RNA, 17 nt, Human
uaaaauuccaaauucau

SEQ ID NO: 3732420 - RNA, 15 nt, Human
uaaaauucucuucca

SEQ ID NO: 3732421 - RNA, 15 nt, Human
uaaaauucugaauuu

SEQ ID NO: 3732422 - RNA, 12 nt, Human
uaaaauugcaug

SEQ ID NO: 3732423 - RNA, 18 nt, Human
uaaaauugccauauugca

SEQ ID NO: 3732424 - RNA, 23 nt, Human
uaaaauugcuauguuacuauuuu

SEQ ID NO: 3732425 - RNA, 19 nt, Human
uaaaauuguaaaauuguau

SEQ ID NO: 3732426 - RNA, 20 nt, Human
uaaaauuguacauuuggaga

SEQ ID NO: 3732427 - RNA, 16 nt, Human
uaaaauuuauauugua

SEQ ID NO: 3732428 - RNA, 13 nt, Human
uaaaauuucaaca

SEQ ID NO: 3732429 - RNA, 16 nt, Human
uaaaauuucuuagaaa

SEQ ID NO: 3732430 - RNA, 14 nt, Human
uaaaauuugaaaca

SEQ ID NO: 3732431 - RNA, 16 nt, Human
uaaaauuugcccuccc

SEQ ID NO: 3732432 - RNA, 21 nt, Human
uaaaauuuggccaaacaagug

SEQ ID NO: 3732433 - RNA, 12 nt, Human
uaaaauuugugg

SEQ ID NO: 3732434 - RNA, 16 nt, Human
uaaaauuuugccuaau

SEQ ID NO: 3732435 - RNA, 17 nt, Human
uaaaauuuuuaaucuuu

SEQ ID NO: 3732436 - RNA, 16 nt, Human
uaaaauuuuuuuagaa

SEQ ID NO: 3732437 - RNA, 21 nt, Human
uaaaauuuuuuuagaaagcau

SEQ ID NO: 3732438 - RNA, 23 nt, Human
uaaaauuuuuuuucauguuuuaa

SEQ ID NO: 3732439 - RNA, 16 nt, Human
uaaacaaaauagaaag

SEQ ID NO: 3732440 - RNA, 17 nt, Human
uaaacaaacucuugaag

SEQ ID NO: 3732441 - RNA, 18 nt, Human
uaaacaaacuguguaacu

SEQ ID NO: 3732442 - RNA, 19 nt, Human
uaaacaaauguaugauuac

SEQ ID NO: 3732443 - RNA, 21 nt, Human
uaaacaaauucauauucuguc

SEQ ID NO: 3732444 - RNA, 14 nt, Human
uaaacaagaaaaau

SEQ ID NO: 3732445 - RNA, 19 nt, Human
uaaacaagaaaaauaaaga

SEQ ID NO: 3732446 - RNA, 21 nt, Human
uaaacaagaaaaauaaagaaa

SEQ ID NO: 3732447 - RNA, 21 nt, Human
uaaacaagaccacguuucuaa

SEQ ID NO: 3732448 - RNA, 22 nt, Human
uaaacaagaccacguuucuaaa

SEQ ID NO: 3732449 - RNA, 23 nt, Human
uaaacaagaccacguuucuaaag

SEQ ID NO: 3732450 - RNA, 18 nt, Human
uaaacaaguauuuguuaa

SEQ ID NO: 3732451 - RNA, 18 nt, Human
uaaacaauaucagacuuu

SEQ ID NO: 3732452 - RNA, 23 nt, Human
uaaacaaugaugcccugcuccag

SEQ ID NO: 3732453 - RNA, 24 nt, Human
uaaacaauuuauuuuauuuuagca

SEQ ID NO: 3732454 - RNA, 20 nt, Human
uaaacacaagauugguguuu

SEQ ID NO: 3732455 - RNA, 14 nt, Human
uaaacacacagaua

SEQ ID NO: 3732456 - RNA, 21 nt, Human
uaaacacagucaaaauaauuc

SEQ ID NO: 3732457 - RNA, 13 nt, Human
uaaacacauagau

SEQ ID NO: 3732458 - RNA, 16 nt, Human
uaaacacauagauuca

SEQ ID NO: 3732459 - RNA, 20 nt, Human
uaaacacauagauucaccug

SEQ ID NO: 3732460 - RNA, 17 nt, Human
uaaacacucaccuucua

SEQ ID NO: 3732461 - RNA, 14 nt, Human
uaaacacucagcug

SEQ ID NO: 3732462 - RNA, 15 nt, Human
uaaacacucagcugu

SEQ ID NO: 3732463 - RNA, 16 nt, Human
uaaacagauauaaaug

SEQ ID NO: 3732464 - RNA, 16 nt, Human
uaaacagaugaauaaa

SEQ ID NO: 3732465 - RNA, 23 nt, Human
uaaacagauguccaucagaugac

SEQ ID NO: 3732466 - RNA, 13 nt, Human
uaaacagcagugu

SEQ ID NO: 3732467 - RNA, 13 nt, Human
uaaacaggcccag

SEQ ID NO: 3732468 - RNA, 15 nt, Human
uaaacaggcccagca

SEQ ID NO: 3732469 - RNA, 20 nt, Human
uaaacagggcaucuccagga

SEQ ID NO: 3732470 - RNA, 17 nt, Human
uaaacagguggugagaa

SEQ ID NO: 3732471 - RNA, 20 nt, Human
uaaacagugagccugaauuu

SEQ ID NO: 3732472 - RNA, 17 nt, Human
uaaacagugccugcuga

SEQ ID NO: 3732473 - RNA, 22 nt, Human
uaaacaguugcacagcaucuca

SEQ ID NO: 3732474 - RNA, 15 nt, Human
uaaacauaauucuug

SEQ ID NO: 3732475 - RNA, 22 nt, Human
uaaacauaugauuucacuagaa

SEQ ID NO: 3732476 - RNA, 16 nt, Human
uaaacaucagguuagg

SEQ ID NO: 3732477 - RNA, 19 nt, Human
uaaacaucagguuaggcag

SEQ ID NO: 3732478 - RNA, 21 nt, Human
uaaacaucagguuaggcagua

SEQ ID NO: 3732479 - RNA, 15 nt, Human
uaaacaucauucauu

SEQ ID NO: 3732480 - RNA, 18 nt, Human
uaaacaugacuccauaga

SEQ ID NO: 3732481 - RNA, 22 nt, Human
uaaacaugacuccauagaccuu

SEQ ID NO: 3732482 - RNA, 22 nt, Human
uaaacaugcuguacauacuuuu

SEQ ID NO: 3732483 - RNA, 18 nt, Human
uaaacaugguuacaauca

SEQ ID NO: 3732484 - RNA, 15 nt, Human
uaaacauguguuuua

SEQ ID NO: 3732485 - RNA, 18 nt, Human
uaaacauuaaaugucuua

SEQ ID NO: 3732486 - RNA, 22 nt, Human
uaaacauuaaucaaucaucugu

SEQ ID NO: 3732487 - RNA, 18 nt, Human
uaaacauucuuuuaacuu

SEQ ID NO: 3732488 - RNA, 21 nt, Human
uaaacauugguucuuguauua

SEQ ID NO: 3732489 - RNA, 11 nt, Human
uaaacauuuuc

SEQ ID NO: 3732490 - RNA, 15 nt, Human
uaaaccaaaggacau

SEQ ID NO: 3732491 - RNA, 19 nt, Human
uaaaccaaaggacauuaug

SEQ ID NO: 3732492 - RNA, 23 nt, Human
uaaaccaaaggacauuaugugug

SEQ ID NO: 3732493 - RNA, 17 nt, Human
uaaaccaaugaacgaag

SEQ ID NO: 3732494 - RNA, 20 nt, Human
uaaaccacugaaaaaauaua

SEQ ID NO: 3732495 - RNA, 16 nt, Human
guugacaccugagaaa

SEQ ID NO: 3732496 - RNA, 18 nt, Human
guugacaguucauaugua

SEQ ID NO: 3732497 - RNA, 20 nt, Human
guugacauauuuaauguuuu

SEQ ID NO: 3732498 - RNA, 18 nt, Human
guugacaugggacauuug

SEQ ID NO: 3732499 - RNA, 14 nt, Human
guugacauucugaa

SEQ ID NO: 3732500 - RNA, 14 nt, Human
guugaccccagagg

SEQ ID NO: 3732501 - RNA, 22 nt, Human
guugaccuaagauuuauuuugu

SEQ ID NO: 3732502 - RNA, 22 nt, Human
guugacucuaguacugugaauc

SEQ ID NO: 3732503 - RNA, 19 nt, Human
guugacuuauaguacauga

SEQ ID NO: 3732504 - RNA, 21 nt, Human
guugacuuauuuucucugugu

SEQ ID NO: 3732505 - RNA, 20 nt, Human
guugacuugacagaacacug

SEQ ID NO: 3732506 - RNA, 16 nt, Human
guugagaaucccaaau

SEQ ID NO: 3732507 - RNA, 20 nt, Human
guugagaauugugcucaaaa

SEQ ID NO: 3732508 - RNA, 14 nt, Human
guugagaggacacu

SEQ ID NO: 3732509 - RNA, 17 nt, Human
guugagagugugaccaa

SEQ ID NO: 3732510 - RNA, 19 nt, Human
guugagcaugacagccugc

SEQ ID NO: 3732511 - RNA, 16 nt, Human
guugagccagcagaca

SEQ ID NO: 3732512 - RNA, 15 nt, Human
guugagccccaaguc

SEQ ID NO: 3732513 - RNA, 19 nt, Human
guugagccccaaguccuga

SEQ ID NO: 3732514 - RNA, 12 nt, Human
guugagcuauga

SEQ ID NO: 3732515 - RNA, 15 nt, Human
guugagcuaugacuu

SEQ ID NO: 3732516 - RNA, 13 nt, Human
guugagcuguuuu

SEQ ID NO: 3732517 - RNA, 17 nt, Human
guugaggaacuguacag

SEQ ID NO: 3732518 - RNA, 21 nt, Human
guugaggaguuuccuaaaagu

SEQ ID NO: 3732519 - RNA, 21 nt, Human
guugaggcagggcaaaugaca

SEQ ID NO: 3732520 - RNA, 19 nt, Human
guugaggccacuguguucc

SEQ ID NO: 3732521 - RNA, 19 nt, Human
guugagggaacagacagga

SEQ ID NO: 3732522 - RNA, 21 nt, Human
guugagguccagcccuggcug

SEQ ID NO: 3732523 - RNA, 22 nt, Human
guugagguccagcccuggcuga

SEQ ID NO: 3732524 - RNA, 20 nt, Human
guugagguggaagcccuccu

SEQ ID NO: 3732525 - RNA, 19 nt, Human
guugauacuguugcacgug

SEQ ID NO: 3732526 - RNA, 22 nt, Human
guugauagcaagugaauuuuuc

SEQ ID NO: 3732527 - RNA, 19 nt, Human
guugauagcacagacccug

SEQ ID NO: 3732528 - RNA, 23 nt, Human
guugauagcacagacccugcccu

SEQ ID NO: 3732529 - RNA, 20 nt, Human
guugaucacuggcaaugaaa

SEQ ID NO: 3732530 - RNA, 14 nt, Human
guugaucagaucug

SEQ ID NO: 3732531 - RNA, 15 nt, Human
guugauccauccagc

SEQ ID NO: 3732532 - RNA, 17 nt, Human
guugaucuggaacccag

SEQ ID NO: 3732533 - RNA, 15 nt, Human
guugaugaggccucu

SEQ ID NO: 3732534 - RNA, 20 nt, Human
guugauggugguauguuuuc

SEQ ID NO: 3732535 - RNA, 13 nt, Human
guugauuaaacuc

SEQ ID NO: 3732536 - RNA, 12 nt, Human
guugauuaaggc

SEQ ID NO: 3732537 - RNA, 13 nt, Human
guugauucucucc

SEQ ID NO: 3732538 - RNA, 14 nt, Human
guugauucucucca

SEQ ID NO: 3732539 - RNA, 12 nt, Human
guugauugcuaa

SEQ ID NO: 3732540 - RNA, 13 nt, Human
guugauugcuaaa

SEQ ID NO: 3732541 - RNA, 15 nt, Human
guugauugcuaaaug

SEQ ID NO: 3732542 - RNA, 16 nt, Human
guugauuucuaguuau

SEQ ID NO: 3732543 - RNA, 22 nt, Human
guugauuucuaguuauuuauuc

SEQ ID NO: 3732544 - RNA, 17 nt, Human
guugauuuuuacugugu

SEQ ID NO: 3732545 - RNA, 15 nt, Human
guugcaaacucagcc

SEQ ID NO: 3732546 - RNA, 17 nt, Human
guugcaaggccgcuguu

SEQ ID NO: 3732547 - RNA, 22 nt, Human
guugcaauagaacagagaaaga

SEQ ID NO: 3732548 - RNA, 16 nt, Human
guugcaaugugaaaaa

SEQ ID NO: 3732549 - RNA, 20 nt, Human
guugcacacccacucagcuc

SEQ ID NO: 3732550 - RNA, 10 nt, Human
guugcacagc

SEQ ID NO: 3732551 - RNA, 15 nt, Human
guugcacccagcccu

SEQ ID NO: 3732552 - RNA, 18 nt, Human
guugcacccagcccuggu

SEQ ID NO: 3732553 - RNA, 20 nt, Human
guugcacccagcccuggucu

SEQ ID NO: 3732554 - RNA, 23 nt, Human
guugcacguguguuuuucuauua

SEQ ID NO: 3732555 - RNA, 13 nt, Human
guugcacugaagu

SEQ ID NO: 3732556 - RNA, 21 nt, Human
guugcacugaaguuugauaaa

SEQ ID NO: 3732557 - RNA, 15 nt, Human
guugcagacaggaau

SEQ ID NO: 3732558 - RNA, 16 nt, Human
guugcagacaggaauc

SEQ ID NO: 3732559 - RNA, 19 nt, Human
guugcauacugagccaagu

SEQ ID NO: 3732560 - RNA, 18 nt, Human
guugcauagcaguauaug

SEQ ID NO: 3732561 - RNA, 14 nt, Human
guugcaucagaaau

SEQ ID NO: 3732562 - RNA, 16 nt, Human
guugcaucagaaaugu

SEQ ID NO: 3732563 - RNA, 13 nt, Human
guugcauggaaau

SEQ ID NO: 3732564 - RNA, 14 nt, Human
guugcauggaaauc

SEQ ID NO: 3732565 - RNA, 19 nt, Human
guugccaaauauguccugg

SEQ ID NO: 3732566 - RNA, 21 nt, Human
guugccaaauauguccugggg

SEQ ID NO: 3732567 - RNA, 20 nt, Human
guugccaagacaaaucaaca

SEQ ID NO: 3732568 - RNA, 13 nt, Human
guugccaagcugg

SEQ ID NO: 3732569 - RNA, 15 nt, Human
guugccacaggacac

SEQ ID NO: 3732570 - RNA, 16 nt, Human
guugccacaggccucc

SEQ ID NO: 3732571 - RNA, 19 nt, Human
guugccacaguagaacugu

SEQ ID NO: 3732572 - RNA, 17 nt, Human
guugccaccaccucugu

SEQ ID NO: 3732573 - RNA, 19 nt, Human
guugccaccaccucugugg

SEQ ID NO: 3732574 - RNA, 20 nt, Human
guugccaccaccucuguggc

SEQ ID NO: 3732575 - RNA, 18 nt, Human
guugcccagccucuuucc

SEQ ID NO: 3732576 - RNA, 22 nt, Human
guugcccagccucuuucccuuc

SEQ ID NO: 3732577 - RNA, 15 nt, Human
guugcccaggcuggc

SEQ ID NO: 3732578 - RNA, 21 nt, Human
guugcccaggcuggcgugcag

SEQ ID NO: 3732579 - RNA, 15 nt, Human
guugcccccauuucu

SEQ ID NO: 3732580 - RNA, 19 nt, Human
guugccccuuucucuuuuc

SEQ ID NO: 3732581 - RNA, 14 nt, Human
guugccuaaaucca

SEQ ID NO: 3732582 - RNA, 22 nt, Human
guugccuaaauccauuuggaaa

SEQ ID NO: 3732583 - RNA, 18 nt, Human
guugccuaagcauugccu

SEQ ID NO: 3732584 - RNA, 22 nt, Human
guugccuaaguauuaaaacauu

SEQ ID NO: 3732585 - RNA, 16 nt, Human
guugccuaauaaacau

SEQ ID NO: 3732586 - RNA, 24 nt, Human
guugccuuuuucauuuuccaauac

SEQ ID NO: 3732587 - RNA, 15 nt, Human
guugcgacggagaga

SEQ ID NO: 3732588 - RNA, 15 nt, Human
guugcggggggaggg

SEQ ID NO: 3732589 - RNA, 18 nt, Human
guugcguaacuggcugug

SEQ ID NO: 3732590 - RNA, 17 nt, Human
guugcguuccuuucuuu

SEQ ID NO: 3732591 - RNA, 23 nt, Human
guugcuaacagcaacacaaagcu

SEQ ID NO: 3732592 - RNA, 14 nt, Human
guugcuaacugaac

SEQ ID NO: 3732593 - RNA, 17 nt, Human
guugcuaagccccagca

SEQ ID NO: 3732594 - RNA, 20 nt, Human
guugcucaaaucuauucaga

SEQ ID NO: 3732595 - RNA, 22 nt, Human
guugcucagucucccuuucccu

SEQ ID NO: 3732596 - RNA, 18 nt, Human
guugcuccgccucugcug

SEQ ID NO: 3732597 - RNA, 20 nt, Human
guugcuccgccucugcuggc

SEQ ID NO: 3732598 - RNA, 23 nt, Human
guugcugaugaacucuuaaucaa

SEQ ID NO: 3732599 - RNA, 13 nt, Human
guugcugauuuua

SEQ ID NO: 3732600 - RNA, 14 nt, Human
guugcugauuuuau

SEQ ID NO: 3732601 - RNA, 18 nt, Human
guugcugauuuuauucuu

SEQ ID NO: 3732602 - RNA, 20 nt, Human
guugcugauuuuauucuuga

SEQ ID NO: 3732603 - RNA, 12 nt, Human
guugcugccuca

SEQ ID NO: 3732604 - RNA, 18 nt, Human
guugcuggcuuguuguaa

SEQ ID NO: 3732605 - RNA, 19 nt, Human
guugcuggcuuguuguaaa

SEQ ID NO: 3732606 - RNA, 21 nt, Human
guugcuggcuuguuguaaagc

SEQ ID NO: 3732607 - RNA, 23 nt, Human
guugcuggcuuguuguaaagcaa

SEQ ID NO: 3732608 - RNA, 15 nt, Human
guugcugguacacac

SEQ ID NO: 3732609 - RNA, 19 nt, Human
guugcugguugcugugugg

SEQ ID NO: 3732610 - RNA, 19 nt, Human
guugcugucauaagaauga

SEQ ID NO: 3732611 - RNA, 14 nt, Human
guugcugugggaac

SEQ ID NO: 3732612 - RNA, 19 nt, Human
guugcuguguuuaauuuga

SEQ ID NO: 3732613 - RNA, 17 nt, Human
guugcuguuuuccuccc

SEQ ID NO: 3732614 - RNA, 18 nt, Human
guugcuguuuuccucccu

SEQ ID NO: 3732615 - RNA, 16 nt, Human
guugcuuacaauuuuu

SEQ ID NO: 3732616 - RNA, 20 nt, Human
guugcuucuugugaaggcca

SEQ ID NO: 3732617 - RNA, 14 nt, Human
guugcuuuguugca

SEQ ID NO: 3732618 - RNA, 13 nt, Human
guuggaaaaaauu

SEQ ID NO: 3732619 - RNA, 22 nt, Human
guuggaaaagaauacagaaaga

SEQ ID NO: 3732620 - RNA, 15 nt, Human
guuggaaacacuaaa

SEQ ID NO: 3732621 - RNA, 19 nt, Human
guuggaaacacuaaauguu

SEQ ID NO: 3732622 - RNA, 20 nt, Human
guuggaaacacuaaauguua

SEQ ID NO: 3732623 - RNA, 22 nt, Human
guuggaaacacuaaauguuaaa

SEQ ID NO: 3732624 - RNA, 17 nt, Human
guuggacaagcuucuga

SEQ ID NO: 3732625 - RNA, 23 nt, Human
guuggacagcaaaaccauugcuu

SEQ ID NO: 3732626 - RNA, 17 nt, Human
guuggacccgcucugga

SEQ ID NO: 3732627 - RNA, 18 nt, Human
guuggacccgcucuggac

SEQ ID NO: 3732628 - RNA, 19 nt, Human
guuggagagcuagaaccug

SEQ ID NO: 3732629 - RNA, 13 nt, Human
guuggagcuccag

SEQ ID NO: 3732630 - RNA, 17 nt, Human
guuggagcuccagccug

SEQ ID NO: 3732631 - RNA, 14 nt, Human
guuggauguagcau

SEQ ID NO: 3732632 - RNA, 15 nt, Human
guuggauuccaugcu

SEQ ID NO: 3732633 - RNA, 20 nt, Human
guuggcaauuguuucaacca

SEQ ID NO: 3732634 - RNA, 15 nt, Human
guuggcacucacaga

SEQ ID NO: 3732635 - RNA, 18 nt, Human
guuggcagaugcagcucu

SEQ ID NO: 3732636 - RNA, 13 nt, Human
guuggcaggcugg

SEQ ID NO: 3732637 - RNA, 16 nt, Human
guuggcaggcuggcca

SEQ ID NO: 3732638 - RNA, 17 nt, Human
guuggcaggcuggccag

SEQ ID NO: 3732639 - RNA, 14 nt, Human
guuggcaugcaucc

SEQ ID NO: 3732640 - RNA, 13 nt, Human
guuggccaggcug

SEQ ID NO: 3732641 - RNA, 14 nt, Human
guuggccaggcugc

SEQ ID NO: 3732642 - RNA, 19 nt, Human
guuggccaggcugcucuca

SEQ ID NO: 3732643 - RNA, 14 nt, Human
guuggccaguguga

SEQ ID NO: 3732644 - RNA, 17 nt, Human
guuggcccaagcucuug

SEQ ID NO: 3732645 - RNA, 14 nt, Human
gauugagaaguuca

SEQ ID NO: 3732646 - RNA, 20 nt, Human
gauugagaccuacaggcuga

SEQ ID NO: 3732647 - RNA, 21 nt, Human
gauugagaccuacaggcugac

SEQ ID NO: 3732648 - RNA, 15 nt, Human
gauugauaauugcau

SEQ ID NO: 3732649 - RNA, 19 nt, Human
gauugauagaguguuauca

SEQ ID NO: 3732650 - RNA, 16 nt, Human
gauugauuuuaaaaug

SEQ ID NO: 3732651 - RNA, 17 nt, Human
gauugauuuuaaaaugu

SEQ ID NO: 3732652 - RNA, 18 nt, Human
gauugauuuuaaaaugua

SEQ ID NO: 3732653 - RNA, 21 nt, Human
gauugcaauuugcacaaguuu

SEQ ID NO: 3732654 - RNA, 16 nt, Human
gauugcaccacugcac

SEQ ID NO: 3732655 - RNA, 16 nt, Human
gauugcacguggccuc

SEQ ID NO: 3732656 - RNA, 19 nt, Human
gauugcacguggccucuug

SEQ ID NO: 3732657 - RNA, 23 nt, Human
gauugcacguggccucuugagca

SEQ ID NO: 3732658 - RNA, 15 nt, Human
gauugcagaauuguu

SEQ ID NO: 3732659 - RNA, 11 nt, Human
gauugcagcuu

SEQ ID NO: 3732660 - RNA, 21 nt, Human
gauugccuuuuuauaacuuuu

SEQ ID NO: 3732661 - RNA, 22 nt, Human
gauugccuuuuuauaacuuuuu

SEQ ID NO: 3732662 - RNA, 13 nt, Human
gauugcgagagau

SEQ ID NO: 3732663 - RNA, 15 nt, Human
gauugcgagagaugu

SEQ ID NO: 3732664 - RNA, 16 nt, Human
gauugcgagagaugug

SEQ ID NO: 3732665 - RNA, 18 nt, Human
gauugcgagagaugugug

SEQ ID NO: 3732666 - RNA, 19 nt, Human
gauugcgagagaugugugu

SEQ ID NO: 3732667 - RNA, 22 nt, Human
gauugcguggaauugugcugag

SEQ ID NO: 3732668 - RNA, 15 nt, Human
gauugcuaugaauga

SEQ ID NO: 3732669 - RNA, 21 nt, Human
gauugcuguguccaacuccag

SEQ ID NO: 3732670 - RNA, 14 nt, Human
gauugcuuaaaaua

SEQ ID NO: 3732671 - RNA, 18 nt, Human
gauugcuuaaaauagcaa

SEQ ID NO: 3732672 - RNA, 14 nt, Human
gauugcuuuuaaaa

SEQ ID NO: 3732673 - RNA, 18 nt, Human
gauuggaaggagacacag

SEQ ID NO: 3732674 - RNA, 15 nt, Human
gauuggacaaaauga

SEQ ID NO: 3732675 - RNA, 23 nt, Human
gauuggacggccugaugcucccu

SEQ ID NO: 3732676 - RNA, 11 nt, Human
gauuggauuau

SEQ ID NO: 3732677 - RNA, 17 nt, Human
gauuggauuauucauuu

SEQ ID NO: 3732678 - RNA, 21 nt, Human
gauuggauuauuuaauaacau

SEQ ID NO: 3732679 - RNA, 18 nt, Human
gauuggcucacacugaga

SEQ ID NO: 3732680 - RNA, 19 nt, Human
gauuggcuuguguguuuca

SEQ ID NO: 3732681 - RNA, 16 nt, Human
gauuggcuuuaaacac

SEQ ID NO: 3732682 - RNA, 16 nt, Human
gauugggaauccgccc

SEQ ID NO: 3732683 - RNA, 17 nt, Human
gauugggccccugccag

SEQ ID NO: 3732684 - RNA, 18 nt, Human
gauugggggcuggugcca

SEQ ID NO: 3732685 - RNA, 23 nt, Human
gauugggggggccaaaaggaaaa

SEQ ID NO: 3732686 - RNA, 21 nt, Human
gauugguuucucuucuccccu

SEQ ID NO: 3732687 - RNA, 23 nt, Human
gauugguuuuaauugaaggaaag

SEQ ID NO: 3732688 - RNA, 20 nt, Human
gauuguaaaauagcuuguau

SEQ ID NO: 3732689 - RNA, 22 nt, Human
gauuguaaaccgcuuuggccug

SEQ ID NO: 3732690 - RNA, 18 nt, Human
gauuguaacguugcugug

SEQ ID NO: 3732691 - RNA, 23 nt, Human
gauuguaauauguaaaugguaug

SEQ ID NO: 3732692 - RNA, 20 nt, Human
gauugucaaugcuggagaaa

SEQ ID NO: 3732693 - RNA, 15 nt, Human
gauuguccccgaccc

SEQ ID NO: 3732694 - RNA, 20 nt, Human
gauuguccccgacccuugcc

SEQ ID NO: 3732695 - RNA, 17 nt, Human
gauuguccuuuugcaaa

SEQ ID NO: 3732696 - RNA, 15 nt, Human
gauugucuuaauauu

SEQ ID NO: 3732697 - RNA, 21 nt, Human
gauugugaauauuuccauaug

SEQ ID NO: 3732698 - RNA, 21 nt, Human
gauuguuaagucuaaauauuu

SEQ ID NO: 3732699 - RNA, 16 nt, Human
gauuguuacagaagcu

SEQ ID NO: 3732700 - RNA, 15 nt, Human
gauuguuccugcuuu

SEQ ID NO: 3732701 - RNA, 18 nt, Human
gauuguucgggugugcaa

SEQ ID NO: 3732702 - RNA, 11 nt, Human
gauuguuucua

SEQ ID NO: 3732703 - RNA, 16 nt, Human
gauuuaaaaacuggaa

SEQ ID NO: 3732704 - RNA, 16 nt, Human
gauuuaaaagccugcu

SEQ ID NO: 3732705 - RNA, 13 nt, Human
gauuuaaacucug

SEQ ID NO: 3732706 - RNA, 13 nt, Human
gauuuaacagaaa

SEQ ID NO: 3732707 - RNA, 16 nt, Human
gauuuaacagaaaugu

SEQ ID NO: 3732708 - RNA, 18 nt, Human
gauuuaacagucauuuaa

SEQ ID NO: 3732709 - RNA, 19 nt, Human
gauuuaacagucauuuaaa

SEQ ID NO: 3732710 - RNA, 19 nt, Human
gauuuaauaaaauaauucu

SEQ ID NO: 3732711 - RNA, 19 nt, Human
gauuuaauaacauaacaaa

SEQ ID NO: 3732712 - RNA, 14 nt, Human
gauuuaauaguguu

SEQ ID NO: 3732713 - RNA, 17 nt, Human
gauuuaauaguguuaau

SEQ ID NO: 3732714 - RNA, 14 nt, Human
gauuuaauaugcaa

SEQ ID NO: 3732715 - RNA, 19 nt, Human
gauuuaaucugccaagggc

SEQ ID NO: 3732716 - RNA, 21 nt, Human
gauuuaauuaaucaugaaugu

SEQ ID NO: 3732717 - RNA, 12 nt, Human
gauuuaauucuc

SEQ ID NO: 3732718 - RNA, 13 nt, Human
gauuuaauuucca

SEQ ID NO: 3732719 - RNA, 14 nt, Human
gauuuaauuugcca

SEQ ID NO: 3732720 - RNA, 15 nt, Human
gauuuagaacuguau

SEQ ID NO: 3732721 - RNA, 20 nt, Human
gauuuagaagugucauguuu

SEQ ID NO: 3732722 - RNA, 22 nt, Human
gauuuaguguuuuuaccucugu

SEQ ID NO: 3732723 - RNA, 14 nt, Human
gauuuaguuucagu

SEQ ID NO: 3732724 - RNA, 16 nt, Human
gauuuaguuucaguag

SEQ ID NO: 3732725 - RNA, 14 nt, Human
gauuuauaaacaga

SEQ ID NO: 3732726 - RNA, 21 nt, Human
gauuuauuaauauauauuauc

SEQ ID NO: 3732727 - RNA, 18 nt, Human
gauuuauuucaucauauu

SEQ ID NO: 3732728 - RNA, 11 nt, Human
gauuuauuugc

SEQ ID NO: 3732729 - RNA, 15 nt, Human
gauuuauuugcuucu

SEQ ID NO: 3732730 - RNA, 21 nt, Human
gauuuauuuuguaugaaauau

SEQ ID NO: 3732731 - RNA, 15 nt, Human
gauuucaagccugcc

SEQ ID NO: 3732732 - RNA, 19 nt, Human
gauuucacaaauauuaaaa

SEQ ID NO: 3732733 - RNA, 13 nt, Human
gauuucacucucc

SEQ ID NO: 3732734 - RNA, 20 nt, Human
gauuucagcucacugcaacc

SEQ ID NO: 3732735 - RNA, 20 nt, Human
gauuucaggauacucuguca

SEQ ID NO: 3732736 - RNA, 19 nt, Human
gauuucaguucuaggaaaa

SEQ ID NO: 3732737 - RNA, 20 nt, Human
gauuucaguuuuaacaaaug

SEQ ID NO: 3732738 - RNA, 23 nt, Human
gauuucaguuuuaacaaaugcua

SEQ ID NO: 3732739 - RNA, 15 nt, Human
gauuucauacuguaa

SEQ ID NO: 3732740 - RNA, 15 nt, Human
gauuucaucugcucu

SEQ ID NO: 3732741 - RNA, 13 nt, Human
gauuucaugauuu

SEQ ID NO: 3732742 - RNA, 19 nt, Human
gauuucauguacugcauua

SEQ ID NO: 3732743 - RNA, 21 nt, Human
gauuucauuucaacuguuugc

SEQ ID NO: 3732744 - RNA, 19 nt, Human
gauuuccagaaccacacuu

SEQ ID NO: 3732745 - RNA, 15 nt, Human
gauuuccagccaggg

SEQ ID NO: 3732746 - RNA, 15 nt, Human
gauuuccagccuucu

SEQ ID NO: 3732747 - RNA, 22 nt, Human
gauuuccagucuccaccaggaa

SEQ ID NO: 3732748 - RNA, 17 nt, Human
gauuuccccuuuugcau

SEQ ID NO: 3732749 - RNA, 19 nt, Human
gauuuccccuuuugcauuc

SEQ ID NO: 3732750 - RNA, 23 nt, Human
gauuuccccuuuugcauucuccc

SEQ ID NO: 3732751 - RNA, 22 nt, Human
gauuuccguuaaaauaccagcc

SEQ ID NO: 3732752 - RNA, 22 nt, Human
gauuuccucccucugccccucc

SEQ ID NO: 3732753 - RNA, 22 nt, Human
gauuuccugcuuugggaagccg

SEQ ID NO: 3732754 - RNA, 13 nt, Human
gauuuccuugaau

SEQ ID NO: 3732755 - RNA, 14 nt, Human
gauuucuaaucaaa

SEQ ID NO: 3732756 - RNA, 18 nt, Human
gauuucuagguaggaaau

SEQ ID NO: 3732757 - RNA, 21 nt, Human
gauuucucacacucuaacugu

SEQ ID NO: 3732758 - RNA, 16 nt, Human
gauuucucauugacuu

SEQ ID NO: 3732759 - RNA, 22 nt, Human
gauuucucauugacuuuuauaa

SEQ ID NO: 3732760 - RNA, 11 nt, Human
gauuucuccca

SEQ ID NO: 3732761 - RNA, 20 nt, Human
gauuucucccagcucuagac

SEQ ID NO: 3732762 - RNA, 14 nt, Human
gauuucugaggaaa

SEQ ID NO: 3732763 - RNA, 17 nt, Human
gauuucugcagguucuu

SEQ ID NO: 3732764 - RNA, 14 nt, Human
gauuucuguucagc

SEQ ID NO: 3732765 - RNA, 13 nt, Human
gauuucuuaaaua

SEQ ID NO: 3732766 - RNA, 20 nt, Human
gauuucuuuaaaagaaugac

SEQ ID NO: 3732767 - RNA, 19 nt, Human
gauuucuuuucuuccuggc

SEQ ID NO: 3732768 - RNA, 15 nt, Human
gauuugaaaaauaua

SEQ ID NO: 3732769 - RNA, 20 nt, Human
gauuugaacacuuggugcug

SEQ ID NO: 3732770 - RNA, 18 nt, Human
gauuugaagaacauguga

SEQ ID NO: 3732771 - RNA, 13 nt, Human
gauuugaauccag

SEQ ID NO: 3732772 - RNA, 13 nt, Human
gauuugaccuccu

SEQ ID NO: 3732773 - RNA, 20 nt, Human
gauuugaccuccucccuguu

SEQ ID NO: 3732774 - RNA, 13 nt, Human
gauuugacuguuu

SEQ ID NO: 3732775 - RNA, 16 nt, Human
gauuugagcucagccc

SEQ ID NO: 3732776 - RNA, 23 nt, Human
gauuugaggagcagcuucaguug

SEQ ID NO: 3732777 - RNA, 15 nt, Human
gauuugaugcuggag

SEQ ID NO: 3732778 - RNA, 18 nt, Human
gauuugcuaucaaaauaa

SEQ ID NO: 3732779 - RNA, 15 nt, Human
gauuugcugcucuuc

SEQ ID NO: 3732780 - RNA, 19 nt, Human
gauuuggcacuagccaaag

SEQ ID NO: 3732781 - RNA, 15 nt, Human
gauuugggagaaggg

SEQ ID NO: 3732782 - RNA, 12 nt, Human
gauuugggcugg

SEQ ID NO: 3732783 - RNA, 13 nt, Human
gauuuggggugga

SEQ ID NO: 3732784 - RNA, 22 nt, Human
gauuugguacuuuugagugugu

SEQ ID NO: 3732785 - RNA, 18 nt, Human
gauuuggugaauuugaau

SEQ ID NO: 3732786 - RNA, 19 nt, Human
gauuugguguacaauucag

SEQ ID NO: 3732787 - RNA, 14 nt, Human
gauuuguacugaaa

SEQ ID NO: 3732788 - RNA, 21 nt, Human
gauuuguaggaaggucucauu

SEQ ID NO: 3732789 - RNA, 21 nt, Human
gauuuguuguucuuucagaaa

SEQ ID NO: 3732790 - RNA, 18 nt, Human
gauuuguuuuuaaacugu

SEQ ID NO: 3732791 - RNA, 13 nt, Human
gauuuuaaaaugu

SEQ ID NO: 3732792 - RNA, 18 nt, Human
gauuuuaaaauguacaug

SEQ ID NO: 3732793 - RNA, 21 nt, Human
gauuuuaaaauguacauguau

SEQ ID NO: 3732794 - RNA, 14 nt, Human
uaaaccacugugcg

SEQ ID NO: 3732795 - RNA, 22 nt, Human
uaaaccacuuaaacgaagaguu

SEQ ID NO: 3732796 - RNA, 21 nt, Human
uaaaccagguuuagacaguau

SEQ ID NO: 3732797 - RNA, 17 nt, Human
uaaaccauaaaaagcug

SEQ ID NO: 3732798 - RNA, 18 nt, Human
uaaaccauaaaaagcuga

SEQ ID NO: 3732799 - RNA, 13 nt, Human
uaaaccaucuccc

SEQ ID NO: 3732800 - RNA, 19 nt, Human
uaaaccaucucccuggugc

SEQ ID NO: 3732801 - RNA, 22 nt, Human
uaaaccaugggauaaaugccau

SEQ ID NO: 3732802 - RNA, 14 nt, Human
uaaacccauuuuag

SEQ ID NO: 3732803 - RNA, 22 nt, Human
uaaaccccaccccaaaauuagc

SEQ ID NO: 3732804 - RNA, 20 nt, Human
uaaaccccaccuuuauuccu

SEQ ID NO: 3732805 - RNA, 14 nt, Human
uaaaccccuguccc

SEQ ID NO: 3732806 - RNA, 16 nt, Human
uaaaccgccaaggcug

SEQ ID NO: 3732807 - RNA, 18 nt, Human
uaaaccgccaaggcuggg

SEQ ID NO: 3732808 - RNA, 18 nt, Human
uaaaccucaaaaugucua

SEQ ID NO: 3732809 - RNA, 19 nt, Human
uaaaccuguagaaucaauu

SEQ ID NO: 3732810 - RNA, 19 nt, Human
uaaaccuguuuuuuuuuca

SEQ ID NO: 3732811 - RNA, 15 nt, Human
uaaaccuuaaguaag

SEQ ID NO: 3732812 - RNA, 12 nt, Human
uaaaccuuaaua

SEQ ID NO: 3732813 - RNA, 16 nt, Human
uaaaccuuaguacuga

SEQ ID NO: 3732814 - RNA, 22 nt, Human
uaaacgauuuaauucucuugaa

SEQ ID NO: 3732815 - RNA, 16 nt, Human
uaaacggauuauuuuu

SEQ ID NO: 3732816 - RNA, 18 nt, Human
uaaacggauuauuuuuuc

SEQ ID NO: 3732817 - RNA, 19 nt, Human
uaaacggauuauuuuuuca

SEQ ID NO: 3732818 - RNA, 16 nt, Human
uaaacgguucaguuuc

SEQ ID NO: 3732819 - RNA, 18 nt, Human
uaaacguaagcacuguuu

SEQ ID NO: 3732820 - RNA, 15 nt, Human
uaaacguaugcaugu

SEQ ID NO: 3732821 - RNA, 17 nt, Human
uaaacgugaugaucagc

SEQ ID NO: 3732822 - RNA, 14 nt, Human
uaaacguggauguu

SEQ ID NO: 3732823 - RNA, 18 nt, Human
uaaacguggauguuacuc

SEQ ID NO: 3732824 - RNA, 20 nt, Human
uaaacguguauguuuuucag

SEQ ID NO: 3732825 - RNA, 16 nt, Human
uaaacuaauaauugca

SEQ ID NO: 3732826 - RNA, 17 nt, Human
uaaacuaauaauugcag

SEQ ID NO: 3732827 - RNA, 23 nt, Human
uaaacuaaugaguuucuuuuaua

SEQ ID NO: 3732828 - RNA, 11 nt, Human
uaaacuagaug

SEQ ID NO: 3732829 - RNA, 14 nt, Human
uaaacuagaugacc

SEQ ID NO: 3732830 - RNA, 21 nt, Human
uaaacuagcauaucugccuuu

SEQ ID NO: 3732831 - RNA, 22 nt, Human
uaaacuagcauaucugccuuua

SEQ ID NO: 3732832 - RNA, 15 nt, Human
uaaacuauaagcaag

SEQ ID NO: 3732833 - RNA, 17 nt, Human
uaaacuauaagcaagaa

SEQ ID NO: 3732834 - RNA, 20 nt, Human
uaaacuaucuuggugaauuu

SEQ ID NO: 3732835 - RNA, 21 nt, Human
uaaacuaucuuggugaauuuu

SEQ ID NO: 3732836 - RNA, 22 nt, Human
uaaacuaucuuggugaauuuuu

SEQ ID NO: 3732837 - RNA, 15 nt, Human
uaaacucaaaacuua

SEQ ID NO: 3732838 - RNA, 21 nt, Human
uaaacucaaaauauuuguaca

SEQ ID NO: 3732839 - RNA, 22 nt, Human
uaaacucaaaauauuuguacau

SEQ ID NO: 3732840 - RNA, 15 nt, Human
uaaacucaagacaau

SEQ ID NO: 3732841 - RNA, 17 nt, Human
uaaacucauuucuagca

SEQ ID NO: 3732842 - RNA, 14 nt, Human
uaaacuccuguccu

SEQ ID NO: 3732843 - RNA, 20 nt, Human
uaaacuccuuccuggccuga

SEQ ID NO: 3732844 - RNA, 21 nt, Human
uaaacuccuuccuggccugag

SEQ ID NO: 3732845 - RNA, 14 nt, Human
uaaacucuaaacau

SEQ ID NO: 3732846 - RNA, 22 nt, Human
uaaacucuaaacauuaaucaau

SEQ ID NO: 3732847 - RNA, 17 nt, Human
uaaacucugcauccaga

SEQ ID NO: 3732848 - RNA, 18 nt, Human
uaaacucugcauccagag

SEQ ID NO: 3732849 - RNA, 16 nt, Human
uaaacugcauuagaaa

SEQ ID NO: 3732850 - RNA, 12 nt, Human
uaaacugccccc

SEQ ID NO: 3732851 - RNA, 16 nt, Human
uaaacuggagacugug

SEQ ID NO: 3732852 - RNA, 20 nt, Human
uaaacugguauuuuaucuuu

SEQ ID NO: 3732853 - RNA, 13 nt, Human
uaaacuguacagu

SEQ ID NO: 3732854 - RNA, 19 nt, Human
uaaacuguacuagucugug

SEQ ID NO: 3732855 - RNA, 18 nt, Human
uaaacuguccucuuucag

SEQ ID NO: 3732856 - RNA, 19 nt, Human
uaaacuguccucuuucaga

SEQ ID NO: 3732857 - RNA, 22 nt, Human
uaaacuguguauuccaagacau

SEQ ID NO: 3732858 - RNA, 12 nt, Human
uaaacuguguuu

SEQ ID NO: 3732859 - RNA, 14 nt, Human
uaaacuguuaacuu

SEQ ID NO: 3732860 - RNA, 17 nt, Human
uaaacuguuagcacugu

SEQ ID NO: 3732861 - RNA, 20 nt, Human
uaaacuguuagcacuguuga

SEQ ID NO: 3732862 - RNA, 20 nt, Human
uaaacuuaacuuuaacugaa

SEQ ID NO: 3732863 - RNA, 20 nt, Human
uaaacuuagaauaaaauugu

SEQ ID NO: 3732864 - RNA, 13 nt, Human
uaaacuucagcac

SEQ ID NO: 3732865 - RNA, 16 nt, Human
uaaacuucagcaccau

SEQ ID NO: 3732866 - RNA, 13 nt, Human
uaaacuuccaaag

SEQ ID NO: 3732867 - RNA, 20 nt, Human
uaaacuucucugaagggagg

SEQ ID NO: 3732868 - RNA, 15 nt, Human
uaaacuugucuuuuc

SEQ ID NO: 3732869 - RNA, 16 nt, Human
uaaacuuuaauaugua

SEQ ID NO: 3732870 - RNA, 22 nt, Human
uaaacuuuaccuuuuuuauaca

SEQ ID NO: 3732871 - RNA, 16 nt, Human
uaaacuuuaucacuua

SEQ ID NO: 3732872 - RNA, 12 nt, Human
uaaacuuucaca

SEQ ID NO: 3732873 - RNA, 12 nt, Human
uaaacuuugaaa

SEQ ID NO: 3732874 - RNA, 17 nt, Human
uaaacuuuuaauucauu

SEQ ID NO: 3732875 - RNA, 22 nt, Human
uaaacuuuuaccacuugcugca

SEQ ID NO: 3732876 - RNA, 14 nt, Human
uaaacuuuuagaaa

SEQ ID NO: 3732877 - RNA, 12 nt, Human
uaaacuuuuugu

SEQ ID NO: 3732878 - RNA, 15 nt, Human
uaaagaaaaaaauac

SEQ ID NO: 3732879 - RNA, 14 nt, Human
uaaagaaaaaaaug

SEQ ID NO: 3732880 - RNA, 16 nt, Human
uaaagaaaaaaaugua

SEQ ID NO: 3732881 - RNA, 17 nt, Human
uaaagaaaaaaauguau

SEQ ID NO: 3732882 - RNA, 17 nt, Human
uaaagaaaaaaauguca

SEQ ID NO: 3732883 - RNA, 15 nt, Human
uaaagaaaaaaauug

SEQ ID NO: 3732884 - RNA, 16 nt, Human
uaaagaaaaaaauuga

SEQ ID NO: 3732885 - RNA, 18 nt, Human
uaaagaaaaaaauugaaa

SEQ ID NO: 3732886 - RNA, 21 nt, Human
uaaagaaaaaaauugaaaugu

SEQ ID NO: 3732887 - RNA, 14 nt, Human
uaaagaaaaacaaa

SEQ ID NO: 3732888 - RNA, 15 nt, Human
uaaagaaaaacaaac

SEQ ID NO: 3732889 - RNA, 17 nt, Human
uaaagaaaaagucaucc

SEQ ID NO: 3732890 - RNA, 15 nt, Human
uaaagaaaaauauuu

SEQ ID NO: 3732891 - RNA, 13 nt, Human
uaaagaaaagaug

SEQ ID NO: 3732892 - RNA, 16 nt, Human
uaaagaaaagaugaaa

SEQ ID NO: 3732893 - RNA, 14 nt, Human
uaaagaaaagaugc

SEQ ID NO: 3732894 - RNA, 21 nt, Human
uaaagaaaaguuuaccaucug

SEQ ID NO: 3732895 - RNA, 12 nt, Human
uaaagaaaauaa

SEQ ID NO: 3732896 - RNA, 13 nt, Human
uaaagaaacagcu

SEQ ID NO: 3732897 - RNA, 12 nt, Human
uaaagaaagaga

SEQ ID NO: 3732898 - RNA, 16 nt, Human
uaaagaaagagagaaa

SEQ ID NO: 3732899 - RNA, 20 nt, Human
uaaagaaagagagaaaauaa

SEQ ID NO: 3732900 - RNA, 21 nt, Human
uaaagaaagagagaaaauaaa

SEQ ID NO: 3732901 - RNA, 11 nt, Human
uaaagaaagau

SEQ ID NO: 3732902 - RNA, 23 nt, Human
uaaagaaaggaaaagaaaacaaa

SEQ ID NO: 3732903 - RNA, 14 nt, Human
uaaagaaaguguau

SEQ ID NO: 3732904 - RNA, 15 nt, Human
uaaagaaaguguauu

SEQ ID NO: 3732905 - RNA, 23 nt, Human
uaaagaaaguguauuuggaaaua

SEQ ID NO: 3732906 - RNA, 20 nt, Human
uaaagaaauuuacuauauau

SEQ ID NO: 3732907 - RNA, 22 nt, Human
uaaagaaauuuacuauauauau

SEQ ID NO: 3732908 - RNA, 13 nt, Human
uaaagaacaaagu

SEQ ID NO: 3732909 - RNA, 19 nt, Human
uaaagaacugcacaugaag

SEQ ID NO: 3732910 - RNA, 12 nt, Human
uaaagaagaccu

SEQ ID NO: 3732911 - RNA, 21 nt, Human
uaaagaagaccugagaaugua

SEQ ID NO: 3732912 - RNA, 18 nt, Human
uaaagaagauguuuaacu

SEQ ID NO: 3732913 - RNA, 19 nt, Human
uaaagaaguauuuuuagaa

SEQ ID NO: 3732914 - RNA, 16 nt, Human
uaaagaauacuugaac

SEQ ID NO: 3732915 - RNA, 19 nt, Human
uaaagaauacuugaacuug

SEQ ID NO: 3732916 - RNA, 14 nt, Human
uaaagaauaggacu

SEQ ID NO: 3732917 - RNA, 15 nt, Human
uaaagaauuauuuug

SEQ ID NO: 3732918 - RNA, 14 nt, Human
uaaagaauucaaau

SEQ ID NO: 3732919 - RNA, 18 nt, Human
uaaagaauugugguuuau

SEQ ID NO: 3732920 - RNA, 14 nt, Human
uaaagaauuucuuu

SEQ ID NO: 3732921 - RNA, 20 nt, Human
uaaagaauuugucacaggaa

SEQ ID NO: 3732922 - RNA, 15 nt, Human
uaaagacaaagacaa

SEQ ID NO: 3732923 - RNA, 15 nt, Human
uaaagacaccugguu

SEQ ID NO: 3732924 - RNA, 15 nt, Human
uaaagacagaggcag

SEQ ID NO: 3732925 - RNA, 15 nt, Human
uaaagacaggagaca

SEQ ID NO: 3732926 - RNA, 19 nt, Human
uaaagacaggguuucacca

SEQ ID NO: 3732927 - RNA, 11 nt, Human
uaaagacauuc

SEQ ID NO: 3732928 - RNA, 15 nt, Human
uaaagaccagaaauu

SEQ ID NO: 3732929 - RNA, 21 nt, Human
uaaagacccuaaaucugagga

SEQ ID NO: 3732930 - RNA, 15 nt, Human
uaaagacuaaguagc

SEQ ID NO: 3732931 - RNA, 17 nt, Human
uaaagagaaaauugaau

SEQ ID NO: 3732932 - RNA, 19 nt, Human
uaaagagaaaauugaauuu

SEQ ID NO: 3732933 - RNA, 23 nt, Human
uaaagagaaaauugaauuuaaca

SEQ ID NO: 3732934 - RNA, 11 nt, Human
uaaagagaaac

SEQ ID NO: 3732935 - RNA, 13 nt, Human
uaaagagaaacuu

SEQ ID NO: 3732936 - RNA, 13 nt, Human
uaaagagaaugag

SEQ ID NO: 3732937 - RNA, 15 nt, Human
uaaagagaccuaccu

SEQ ID NO: 3732938 - RNA, 12 nt, Human
uaaagagagaau

SEQ ID NO: 3732939 - RNA, 18 nt, Human
uaaagagauucacacaca

SEQ ID NO: 3732940 - RNA, 20 nt, Human
uaaagagcaucugauucuug

SEQ ID NO: 3732941 - RNA, 15 nt, Human
uaaagagcccuugcc

SEQ ID NO: 3732942 - RNA, 19 nt, Human
uaaagagcccuugccuccc

SEQ ID NO: 3732943 - RNA, 21 nt, Human
uaaagagcccuugccucccca

SEQ ID NO: 3732944 - RNA, 19 nt, Human
uaaagaggcguugcuuuca

SEQ ID NO: 3732945 - RNA, 20 nt, Human
guuggccccugcccggcugc

SEQ ID NO: 3732946 - RNA, 13 nt, Human
guuggccuccggc

SEQ ID NO: 3732947 - RNA, 20 nt, Human
guuggcguaggcuacagaga

SEQ ID NO: 3732948 - RNA, 23 nt, Human
guuggcguaggcuacagagaagc

SEQ ID NO: 3732949 - RNA, 15 nt, Human
guuggcucugccagu

SEQ ID NO: 3732950 - RNA, 20 nt, Human
guuggcugacuuccacaccu

SEQ ID NO: 3732951 - RNA, 14 nt, Human
guuggcuggaugaa

SEQ ID NO: 3732952 - RNA, 16 nt, Human
guuggcugggcccaga

SEQ ID NO: 3732953 - RNA, 17 nt, Human
guuggcugggcccagaa

SEQ ID NO: 3732954 - RNA, 23 nt, Human
guuggcuucuguuucuaguugag

SEQ ID NO: 3732955 - RNA, 14 nt, Human
guugggaagacaug

SEQ ID NO: 3732956 - RNA, 17 nt, Human
guugggaaugaggcuug

SEQ ID NO: 3732957 - RNA, 22 nt, Human
guugggacccaguggcagggca

SEQ ID NO: 3732958 - RNA, 23 nt, Human
guugggagagggcgcaggccgug

SEQ ID NO: 3732959 - RNA, 15 nt, Human
guugggagcacugga

SEQ ID NO: 3732960 - RNA, 21 nt, Human
guugggauacugcagggccag

SEQ ID NO: 3732961 - RNA, 18 nt, Human
guugggaucgcauugcau

SEQ ID NO: 3732962 - RNA, 18 nt, Human
guugggaucuaggagagg

SEQ ID NO: 3732963 - RNA, 22 nt, Human
guugggauuccugacccaggcc

SEQ ID NO: 3732964 - RNA, 22 nt, Human
guugggauugggggcuggugcc

SEQ ID NO: 3732965 - RNA, 19 nt, Human
guugggcagccagaccagc

SEQ ID NO: 3732966 - RNA, 12 nt, Human
guugggcaugug

SEQ ID NO: 3732967 - RNA, 17 nt, Human
guugggccaggagccuc

SEQ ID NO: 3732968 - RNA, 20 nt, Human
guugggccauacuggccucg

SEQ ID NO: 3732969 - RNA, 15 nt, Human
guugggcccagaucu

SEQ ID NO: 3732970 - RNA, 14 nt, Human
guuggggaggggcg

SEQ ID NO: 3732971 - RNA, 22 nt, Human
guuggggggacucugagcggga

SEQ ID NO: 3732972 - RNA, 22 nt, Human
guugggggucagugcugccugu

SEQ ID NO: 3732973 - RNA, 15 nt, Human
guuggggugacaguc

SEQ ID NO: 3732974 - RNA, 13 nt, Human
guuggguggaugc

SEQ ID NO: 3732975 - RNA, 18 nt, Human
guugguauuaauaaaaag

SEQ ID NO: 3732976 - RNA, 22 nt, Human
guugguccagagcggaggcugu

SEQ ID NO: 3732977 - RNA, 16 nt, Human
guuggucccccuucca

SEQ ID NO: 3732978 - RNA, 15 nt, Human
guuggucuguacuga

SEQ ID NO: 3732979 - RNA, 19 nt, Human
guuggugagaaaccuguau

SEQ ID NO: 3732980 - RNA, 12 nt, Human
guuguaaaaaga

SEQ ID NO: 3732981 - RNA, 13 nt, Human
guuguaaaauaua

SEQ ID NO: 3732982 - RNA, 22 nt, Human
guuguaaaauauagcuguacaa

SEQ ID NO: 3732983 - RNA, 15 nt, Human
guuguaaauauauaa

SEQ ID NO: 3732984 - RNA, 14 nt, Human
guuguaaauauuua

SEQ ID NO: 3732985 - RNA, 14 nt, Human
guuguaaauuggca

SEQ ID NO: 3732986 - RNA, 14 nt, Human
guuguaaccugcug

SEQ ID NO: 3732987 - RNA, 14 nt, Human
guuguaaugcugca

SEQ ID NO: 3732988 - RNA, 14 nt, Human
guuguacaugaaau

SEQ ID NO: 3732989 - RNA, 18 nt, Human
guuguaccgcaaugugac

SEQ ID NO: 3732990 - RNA, 15 nt, Human
guuguacuuaaaugg

SEQ ID NO: 3732991 - RNA, 17 nt, Human
guuguauaaauuuauuu

SEQ ID NO: 3732992 - RNA, 19 nt, Human
guuguauaaauuuauuuac

SEQ ID NO: 3732993 - RNA, 18 nt, Human
guuguaucagcacgugug

SEQ ID NO: 3732994 - RNA, 15 nt, Human
guuguauuagauguu

SEQ ID NO: 3732995 - RNA, 12 nt, Human
guuguauucauu

SEQ ID NO: 3732996 - RNA, 13 nt, Human
guuguauucuuug

SEQ ID NO: 3732997 - RNA, 20 nt, Human
guuguauucuuugauguuaa

SEQ ID NO: 3732998 - RNA, 16 nt, Human
guuguauuuaacagaa

SEQ ID NO: 3732999 - RNA, 17 nt, Human
guugucaagucucugcu

SEQ ID NO: 3733000 - RNA, 21 nt, Human
guugucaauauuaaauacaga

SEQ ID NO: 3733001 - RNA, 23 nt, Human
guugucaauauuaaauacagaca

SEQ ID NO: 3733002 - RNA, 14 nt, Human
guugucaccuucac

SEQ ID NO: 3733003 - RNA, 16 nt, Human
guugucacugcuuuug

SEQ ID NO: 3733004 - RNA, 22 nt, Human
guugucaguauuauucuacuau

SEQ ID NO: 3733005 - RNA, 20 nt, Human
guugucauugcuguuguccc

SEQ ID NO: 3733006 - RNA, 14 nt, Human
guugucauugcuuu

SEQ ID NO: 3733007 - RNA, 18 nt, Human
guuguccauauuuucaca

SEQ ID NO: 3733008 - RNA, 13 nt, Human
guugucccucugc

SEQ ID NO: 3733009 - RNA, 12 nt, Human
guugucccugca

SEQ ID NO: 3733010 - RNA, 15 nt, Human
guuguccuuuucaua

SEQ ID NO: 3733011 - RNA, 17 nt, Human
guugucguaaagauuug

SEQ ID NO: 3733012 - RNA, 13 nt, Human
guugucucccugg

SEQ ID NO: 3733013 - RNA, 18 nt, Human
guugucucuagagcaggg

SEQ ID NO: 3733014 - RNA, 11 nt, Human
guugucucuga

SEQ ID NO: 3733015 - RNA, 14 nt, Human
guugucucugaugc

SEQ ID NO: 3733016 - RNA, 15 nt, Human
guugucucugaugca

SEQ ID NO: 3733017 - RNA, 14 nt, Human
guugucucuucucc

SEQ ID NO: 3733018 - RNA, 19 nt, Human
guugugaaaguuuugagua

SEQ ID NO: 3733019 - RNA, 15 nt, Human
guugugaagauguuu

SEQ ID NO: 3733020 - RNA, 13 nt, Human
guugugaggccug

SEQ ID NO: 3733021 - RNA, 14 nt, Human
guugugaggccugg

SEQ ID NO: 3733022 - RNA, 21 nt, Human
guugugaucaucccaucuaag

SEQ ID NO: 3733023 - RNA, 10 nt, Human
guugugcagc

SEQ ID NO: 3733024 - RNA, 12 nt, Human
guugugccaaau

SEQ ID NO: 3733025 - RNA, 21 nt, Human
guugugccacagaguguagcc

SEQ ID NO: 3733026 - RNA, 19 nt, Human
guuguggaaagccucugcu

SEQ ID NO: 3733027 - RNA, 22 nt, Human
guuguggauuuaacagaaaugu

SEQ ID NO: 3733028 - RNA, 13 nt, Human
guuguggccuuug

SEQ ID NO: 3733029 - RNA, 14 nt, Human
guuguguaagagaa

SEQ ID NO: 3733030 - RNA, 16 nt, Human
guuguguacguggaga

SEQ ID NO: 3733031 - RNA, 20 nt, Human
guuguguacucuggccucug

SEQ ID NO: 3733032 - RNA, 10 nt, Human
guugugugcc

SEQ ID NO: 3733033 - RNA, 16 nt, Human
guugugugugggagug

SEQ ID NO: 3733034 - RNA, 14 nt, Human
guuguguugucacc

SEQ ID NO: 3733035 - RNA, 15 nt, Human
guuguuacauuuuua

SEQ ID NO: 3733036 - RNA, 21 nt, Human
guuguuacuaacuaaacucuc

SEQ ID NO: 3733037 - RNA, 17 nt, Human
guuguuaucuguuugag

SEQ ID NO: 3733038 - RNA, 13 nt, Human
guuguuaugaugu

SEQ ID NO: 3733039 - RNA, 13 nt, Human
guuguuaugcuau

SEQ ID NO: 3733040 - RNA, 16 nt, Human
guuguuauggaaacug

SEQ ID NO: 3733041 - RNA, 17 nt, Human
guuguuaugugaucaug

SEQ ID NO: 3733042 - RNA, 13 nt, Human
guuguucaacuau

SEQ ID NO: 3733043 - RNA, 13 nt, Human
guuguucgggcca

SEQ ID NO: 3733044 - RNA, 19 nt, Human
guuguucugaaaugucagu

SEQ ID NO: 3733045 - RNA, 13 nt, Human
guuguucuuuucc

SEQ ID NO: 3733046 - RNA, 17 nt, Human
guuguugcauguuugaa

SEQ ID NO: 3733047 - RNA, 15 nt, Human
guuguuuauaauaaa

SEQ ID NO: 3733048 - RNA, 18 nt, Human
guuguuuauaauaaaaau

SEQ ID NO: 3733049 - RNA, 19 nt, Human
guuguuucuuaauuuggaa

SEQ ID NO: 3733050 - RNA, 12 nt, Human
guuguuucuucc

SEQ ID NO: 3733051 - RNA, 13 nt, Human
guuguuugaaaau

SEQ ID NO: 3733052 - RNA, 18 nt, Human
guuguuugagaaauuaag

SEQ ID NO: 3733053 - RNA, 22 nt, Human
guuguuugaugcauuaaaagaa

SEQ ID NO: 3733054 - RNA, 12 nt, Human
guuguuugcaug

SEQ ID NO: 3733055 - RNA, 17 nt, Human
guuguuuguauguauaa

SEQ ID NO: 3733056 - RNA, 14 nt, Human
guuguuuuuguaua

SEQ ID NO: 3733057 - RNA, 20 nt, Human
guuuaaaaaaguuuaaaaug

SEQ ID NO: 3733058 - RNA, 21 nt, Human
guuuaaaaaaguuuaaaaugu

SEQ ID NO: 3733059 - RNA, 19 nt, Human
guuuaaaaaccgaauaaau

SEQ ID NO: 3733060 - RNA, 20 nt, Human
guuuaaaaaccgaauaaaug

SEQ ID NO: 3733061 - RNA, 16 nt, Human
guuuaaaaaucaacuu

SEQ ID NO: 3733062 - RNA, 12 nt, Human
guuuaaaaaugg

SEQ ID NO: 3733063 - RNA, 16 nt, Human
guuuaaacugauucau

SEQ ID NO: 3733064 - RNA, 14 nt, Human
guuuaaagaaagug

SEQ ID NO: 3733065 - RNA, 16 nt, Human
guuuaaagaaagugua

SEQ ID NO: 3733066 - RNA, 17 nt, Human
guuuaaagaaaguguau

SEQ ID NO: 3733067 - RNA, 19 nt, Human
guuuaaagagucuagauuc

SEQ ID NO: 3733068 - RNA, 17 nt, Human
guuuaaauaaaguauca

SEQ ID NO: 3733069 - RNA, 22 nt, Human
guuuaaauaaaguaucaugcau

SEQ ID NO: 3733070 - RNA, 13 nt, Human
guuuaaauauuuc

SEQ ID NO: 3733071 - RNA, 14 nt, Human
guuuaaaugaacaa

SEQ ID NO: 3733072 - RNA, 13 nt, Human
guuuaacauuugc

SEQ ID NO: 3733073 - RNA, 22 nt, Human
guuuaaccaaaaagaccagacu

SEQ ID NO: 3733074 - RNA, 15 nt, Human
guuuaacucagauca

SEQ ID NO: 3733075 - RNA, 23 nt, Human
guuuaacucagaucacuacugca

SEQ ID NO: 3733076 - RNA, 18 nt, Human
guuuaagaaaaguauuuu

SEQ ID NO: 3733077 - RNA, 20 nt, Human
guuuaagacuguaaugaauc

SEQ ID NO: 3733078 - RNA, 18 nt, Human
guuuaagcagaauuggaa

SEQ ID NO: 3733079 - RNA, 17 nt, Human
guuuaagccaaaacaau

SEQ ID NO: 3733080 - RNA, 18 nt, Human
guuuaaguagauuucaug

SEQ ID NO: 3733081 - RNA, 13 nt, Human
guuuaauacucau

SEQ ID NO: 3733082 - RNA, 17 nt, Human
guuuaauauugagaaag

SEQ ID NO: 3733083 - RNA, 19 nt, Human
guuuaauauugagaaagaa

SEQ ID NO: 3733084 - RNA, 14 nt, Human
guuuaaucuguuau

SEQ ID NO: 3733085 - RNA, 15 nt, Human
guuuaaugaaugcuu

SEQ ID NO: 3733086 - RNA, 13 nt, Human
guuuaauguuuug

SEQ ID NO: 3733087 - RNA, 15 nt, Human
guuuaauuguuuguc

SEQ ID NO: 3733088 - RNA, 14 nt, Human
guuuaauuucuuca

SEQ ID NO: 3733089 - RNA, 20 nt, Human
guuuaauuuuuauuucuucc

SEQ ID NO: 3733090 - RNA, 22 nt, Human
guuuacaagcccccccuuccac

SEQ ID NO: 3733091 - RNA, 16 nt, Human
guuuacaauuuacaaa

SEQ ID NO: 3733092 - RNA, 23 nt, Human
guuuacagcacuacucugugcca

SEQ ID NO: 3733093 - RNA, 14 nt, Human
guuuacaggcccug

SEQ ID NO: 3733094 - RNA, 19 nt, Human
guuuacaggcccugcuccu

SEQ ID NO: 3733095 - RNA, 16 nt, Human
guuuacagggagccuc

SEQ ID NO: 3733096 - RNA, 17 nt, Human
guuuacagggagccucc

SEQ ID NO: 3733097 - RNA, 23 nt, Human
gauuuuaaaccauaaaaagcuga

SEQ ID NO: 3733098 - RNA, 14 nt, Human
gauuuuaaacuaga

SEQ ID NO: 3733099 - RNA, 21 nt, Human
gauuuuaaacuagaugaccuc

SEQ ID NO: 3733100 - RNA, 23 nt, Human
gauuuuaaacuagaugaccucau

SEQ ID NO: 3733101 - RNA, 20 nt, Human
gauuuuaacaaaagcaagac

SEQ ID NO: 3733102 - RNA, 15 nt, Human
gauuuuaacaauaac

SEQ ID NO: 3733103 - RNA, 23 nt, Human
gauuuuaauggauuguuaauuuc

SEQ ID NO: 3733104 - RNA, 14 nt, Human
gauuuuaauuguca

SEQ ID NO: 3733105 - RNA, 19 nt, Human
gauuuuacaauugaaauga

SEQ ID NO: 3733106 - RNA, 16 nt, Human
gauuuuacaugaagua

SEQ ID NO: 3733107 - RNA, 15 nt, Human
gauuuuaguuuuauu

SEQ ID NO: 3733108 - RNA, 22 nt, Human
gauuuuaguuuuauuuucuaaa

SEQ ID NO: 3733109 - RNA, 18 nt, Human
gauuuuauguugacauuu

SEQ ID NO: 3733110 - RNA, 15 nt, Human
gauuuuauuauguaa

SEQ ID NO: 3733111 - RNA, 18 nt, Human
gauuuuauuauguaaauc

SEQ ID NO: 3733112 - RNA, 15 nt, Human
gauuuuauuuuacua

SEQ ID NO: 3733113 - RNA, 18 nt, Human
gauuuucaaagcuuuuuc

SEQ ID NO: 3733114 - RNA, 21 nt, Human
gauuuucaaccagauaacaua

SEQ ID NO: 3733115 - RNA, 11 nt, Human
gauuuucagcc

SEQ ID NO: 3733116 - RNA, 23 nt, Human
gauuuucauaacuuauugcugau

SEQ ID NO: 3733117 - RNA, 21 nt, Human
gauuuuccugaaacacuaaag

SEQ ID NO: 3733118 - RNA, 19 nt, Human
gauuuuccuuuuuuauaca

SEQ ID NO: 3733119 - RNA, 12 nt, Human
gauuuucuauug

SEQ ID NO: 3733120 - RNA, 22 nt, Human
gauuuucuauuguuacucuggu

SEQ ID NO: 3733121 - RNA, 14 nt, Human
gauuuucuccagcu

SEQ ID NO: 3733122 - RNA, 16 nt, Human
gauuuucuuuaaaaga

SEQ ID NO: 3733123 - RNA, 20 nt, Human
gauuuucuuuaaaagaaugg

SEQ ID NO: 3733124 - RNA, 24 nt, Human
gauuuucuuuaaaagaaugggcag

SEQ ID NO: 3733125 - RNA, 17 nt, Human
gauuuucuuuugccuuu

SEQ ID NO: 3733126 - RNA, 13 nt, Human
gauuuugaaaacu

SEQ ID NO: 3733127 - RNA, 17 nt, Human
gauuuugagguaaagau

SEQ ID NO: 3733128 - RNA, 20 nt, Human
gauuuugcaguucuuuggcu

SEQ ID NO: 3733129 - RNA, 13 nt, Human
gauuuugccugug

SEQ ID NO: 3733130 - RNA, 16 nt, Human
gauuuugcuguagaag

SEQ ID NO: 3733131 - RNA, 18 nt, Human
gauuuugcuguauauuug

SEQ ID NO: 3733132 - RNA, 19 nt, Human
gauuuuggccucauuacuu

SEQ ID NO: 3733133 - RNA, 13 nt, Human
gauuuuguuuugc

SEQ ID NO: 3733134 - RNA, 14 nt, Human
gauuuuuaauuaaa

SEQ ID NO: 3733135 - RNA, 20 nt, Human
gauuuuuaauuaaaaacuag

SEQ ID NO: 3733136 - RNA, 12 nt, Human
gauuuuuaccag

SEQ ID NO: 3733137 - RNA, 20 nt, Human
gauuuuuaccguuucuuccc

SEQ ID NO: 3733138 - RNA, 15 nt, Human
gauuuuuagaauuaa

SEQ ID NO: 3733139 - RNA, 14 nt, Human
gauuuuuauccaau

SEQ ID NO: 3733140 - RNA, 23 nt, Human
gauuuuucggaggccccacugau

SEQ ID NO: 3733141 - RNA, 22 nt, Human
gauuuuucuaaccuugaaugcu

SEQ ID NO: 3733142 - RNA, 12 nt, Human
gauuuuucucaa

SEQ ID NO: 3733143 - RNA, 20 nt, Human
gauuuuugcaauaccaagua

SEQ ID NO: 3733144 - RNA, 15 nt, Human
gauuuuuguaagaca

SEQ ID NO: 3733145 - RNA, 15 nt, Human
gauuuuuuaaaagaa

SEQ ID NO: 3733146 - RNA, 16 nt, Human
gauuuuuuaaaagaaa

SEQ ID NO: 3733147 - RNA, 19 nt, Human
gauuuuuuaauaauuuaga

SEQ ID NO: 3733148 - RNA, 12 nt, Human
gauuuuuuccaa

SEQ ID NO: 3733149 - RNA, 13 nt, Human
gauuuuuuccaaa

SEQ ID NO: 3733150 - RNA, 21 nt, Human
gauuuuuuccuucaaaguuua

SEQ ID NO: 3733151 - RNA, 23 nt, Human
gauuuuuuuucccauuuagaaug

SEQ ID NO: 3733152 - RNA, 18 nt, Human
gauuuuuuuuuccuucag

SEQ ID NO: 3733153 - RNA, 21 nt, Human
gauuuuuuuuuuuuuccuguc

SEQ ID NO: 3733154 - RNA, 21 nt, Human
gauuuuuuuuuuuuuuuccuu

SEQ ID NO: 3733155 - RNA, 19 nt, Human
gcaaaaaaaguuguaugau

SEQ ID NO: 3733156 - RNA, 13 nt, Human
gcaaaaaagaaaa

SEQ ID NO: 3733157 - RNA, 21 nt, Human
gcaaaaaauacuuuuucuaau

SEQ ID NO: 3733158 - RNA, 20 nt, Human
gcaaaaacaaaaagaaaaga

SEQ ID NO: 3733159 - RNA, 21 nt, Human
gcaaaaacaaaaagaaaagaa

SEQ ID NO: 3733160 - RNA, 15 nt, Human
gcaaaaacauguaug

SEQ ID NO: 3733161 - RNA, 17 nt, Human
gcaaaaacgaaagcugg

SEQ ID NO: 3733162 - RNA, 13 nt, Human
gcaaaaauauaaa

SEQ ID NO: 3733163 - RNA, 14 nt, Human
gcaaaaauauuuau

SEQ ID NO: 3733164 - RNA, 22 nt, Human
gcaaaaauauuuuaugauccag

SEQ ID NO: 3733165 - RNA, 14 nt, Human
gcaaaaauuuuugg

SEQ ID NO: 3733166 - RNA, 17 nt, Human
gcaaaacaugcuaccug

SEQ ID NO: 3733167 - RNA, 18 nt, Human
gcaaaaccauugcuucac

SEQ ID NO: 3733168 - RNA, 20 nt, Human
gcaaaacgcauggagugugu

SEQ ID NO: 3733169 - RNA, 22 nt, Human
gcaaaacucuacuuaauccaau

SEQ ID NO: 3733170 - RNA, 12 nt, Human
gcaaaacugaau

SEQ ID NO: 3733171 - RNA, 23 nt, Human
gcaaaagaguguaaaauauuuua

SEQ ID NO: 3733172 - RNA, 17 nt, Human
gcaaaagaugcuucuca

SEQ ID NO: 3733173 - RNA, 18 nt, Human
gcaaaagcagugggcucc

SEQ ID NO: 3733174 - RNA, 19 nt, Human
gcaaaagcuuacaaauacu

SEQ ID NO: 3733175 - RNA, 21 nt, Human
gcaaaaggaucuuuguggcca

SEQ ID NO: 3733176 - RNA, 21 nt, Human
gcaaaagguucacuaaagcag

SEQ ID NO: 3733177 - RNA, 16 nt, Human
gcaaaauaaaaacuau

SEQ ID NO: 3733178 - RNA, 13 nt, Human
gcaaaauaauuuu

SEQ ID NO: 3733179 - RNA, 13 nt, Human
gcaaaauacauga

SEQ ID NO: 3733180 - RNA, 14 nt, Human
gcaaaauacaugaa

SEQ ID NO: 3733181 - RNA, 13 nt, Human
gcaaaauagcauu

SEQ ID NO: 3733182 - RNA, 13 nt, Human
gcaaaaucaguuu

SEQ ID NO: 3733183 - RNA, 22 nt, Human
gcaaaauggaacgcuaaugaaa

SEQ ID NO: 3733184 - RNA, 13 nt, Human
gcaaaaugugaau

SEQ ID NO: 3733185 - RNA, 13 nt, Human
gcaaaauugcaaa

SEQ ID NO: 3733186 - RNA, 17 nt, Human
gcaaaauugcaaaucuu

SEQ ID NO: 3733187 - RNA, 21 nt, Human
gcaaaauuguuuuugguugga

SEQ ID NO: 3733188 - RNA, 15 nt, Human
gcaaaauuugaugcc

SEQ ID NO: 3733189 - RNA, 21 nt, Human
gcaaaauuugaugccaggaca

SEQ ID NO: 3733190 - RNA, 13 nt, Human
gcaaacaccugcu

SEQ ID NO: 3733191 - RNA, 14 nt, Human
gcaaacacuccacc

SEQ ID NO: 3733192 - RNA, 13 nt, Human
gcaaacagggccu

SEQ ID NO: 3733193 - RNA, 20 nt, Human
gcaaacauuuucucuuagaa

SEQ ID NO: 3733194 - RNA, 20 nt, Human
gcaaaccaagagauugcuaa

SEQ ID NO: 3733195 - RNA, 16 nt, Human
gcaaaccaucauugaa

SEQ ID NO: 3733196 - RNA, 19 nt, Human
gcaaaccaucauugaaauc

SEQ ID NO: 3733197 - RNA, 20 nt, Human
gcaaaccaucauugaaaucu

SEQ ID NO: 3733198 - RNA, 15 nt, Human
gcaaacccagacggc

SEQ ID NO: 3733199 - RNA, 19 nt, Human
gcaaacccaucaacaaaaa

SEQ ID NO: 3733200 - RNA, 18 nt, Human
gcaaacccccuuugugcu

SEQ ID NO: 3733201 - RNA, 22 nt, Human
gcaaacccccuuugugcugugg

SEQ ID NO: 3733202 - RNA, 19 nt, Human
gcaaaccuaauugcacaac

SEQ ID NO: 3733203 - RNA, 14 nt, Human
gcaaaccugcccca

SEQ ID NO: 3733204 - RNA, 16 nt, Human
gcaaacucaagcuucu

SEQ ID NO: 3733205 - RNA, 19 nt, Human
gcaaacugcaugcccagag

SEQ ID NO: 3733206 - RNA, 23 nt, Human
gcaaacuggccgcgggggcaggg

SEQ ID NO: 3733207 - RNA, 20 nt, Human
gcaaacuuaagaaacacuga

SEQ ID NO: 3733208 - RNA, 20 nt, Human
gcaaacuuuauuuuguguuu

SEQ ID NO: 3733209 - RNA, 23 nt, Human
gcaaagaaaaaaaaaaaagccag

SEQ ID NO: 3733210 - RNA, 12 nt, Human
gcaaagaaaaug

SEQ ID NO: 3733211 - RNA, 19 nt, Human
gcaaagagacccagucaau

SEQ ID NO: 3733212 - RNA, 21 nt, Human
gcaaagaggacucgcuuguaa

SEQ ID NO: 3733213 - RNA, 14 nt, Human
gcaaagaggcaaga

SEQ ID NO: 3733214 - RNA, 18 nt, Human
gcaaagaggcaagaggcu

SEQ ID NO: 3733215 - RNA, 16 nt, Human
gcaaagauaucucauc

SEQ ID NO: 3733216 - RNA, 12 nt, Human
gcaaagcacaga

SEQ ID NO: 3733217 - RNA, 22 nt, Human
gcaaagcagcaacuauucacaa

SEQ ID NO: 3733218 - RNA, 12 nt, Human
gcaaagcauuga

SEQ ID NO: 3733219 - RNA, 16 nt, Human
gcaaagccaggucccu

SEQ ID NO: 3733220 - RNA, 21 nt, Human
gcaaagcccagcuugaaaccu

SEQ ID NO: 3733221 - RNA, 20 nt, Human
gcaaagccccaugcuggagc

SEQ ID NO: 3733222 - RNA, 23 nt, Human
gcaaagccccaugcuggagccug

SEQ ID NO: 3733223 - RNA, 19 nt, Human
gcaaagcccccagagccca

SEQ ID NO: 3733224 - RNA, 23 nt, Human
gcaaagcccccagagcccaggcu

SEQ ID NO: 3733225 - RNA, 12 nt, Human
gcaaagccuguu

SEQ ID NO: 3733226 - RNA, 20 nt, Human
gcaaagccuguucauggcag

SEQ ID NO: 3733227 - RNA, 19 nt, Human
gcaaagcggguuauaauga

SEQ ID NO: 3733228 - RNA, 23 nt, Human
gcaaaggaaacuuugcagaugug

SEQ ID NO: 3733229 - RNA, 14 nt, Human
gcaaaggaaauacc

SEQ ID NO: 3733230 - RNA, 17 nt, Human
gcaaaggaguagaaaga

SEQ ID NO: 3733231 - RNA, 18 nt, Human
gcaaagggagcacugggu

SEQ ID NO: 3733232 - RNA, 18 nt, Human
gcaaagggagcagaacug

SEQ ID NO: 3733233 - RNA, 16 nt, Human
gcaaagggccaggaag

SEQ ID NO: 3733234 - RNA, 22 nt, Human
gcaaagggccugcccagacaag

SEQ ID NO: 3733235 - RNA, 15 nt, Human
gcaaagggcugaaag

SEQ ID NO: 3733236 - RNA, 13 nt, Human
gcaaaggggacag

SEQ ID NO: 3733237 - RNA, 14 nt, Human
gcaaaggggacagc

SEQ ID NO: 3733238 - RNA, 20 nt, Human
gcaaaggggucccauagagg

SEQ ID NO: 3733239 - RNA, 16 nt, Human
gcaaaguacaaugugu

SEQ ID NO: 3733240 - RNA, 12 nt, Human
gcaaaguacugu

SEQ ID NO: 3733241 - RNA, 13 nt, Human
gcaaaguacugua

SEQ ID NO: 3733242 - RNA, 14 nt, Human
gcaaaguacuguaa

SEQ ID NO: 3733243 - RNA, 23 nt, Human
gcaaaguaguacuucuucuguaa

SEQ ID NO: 3733244 - RNA, 16 nt, Human
gcaaaguauuguaaau

SEQ ID NO: 3733245 - RNA, 20 nt, Human
gcaaaguauuguaaauuaua

SEQ ID NO: 3733246 - RNA, 20 nt, Human
uaaagaggcugaaagaggcc

SEQ ID NO: 3733247 - RNA, 23 nt, Human
uaaagagucuagauucaaagguu

SEQ ID NO: 3733248 - RNA, 12 nt, Human
uaaagaguucuu

SEQ ID NO: 3733249 - RNA, 20 nt, Human
uaaagaguuguguuguucuu

SEQ ID NO: 3733250 - RNA, 15 nt, Human
uaaagauaauauuac

SEQ ID NO: 3733251 - RNA, 19 nt, Human
uaaagauaauauuacuguu

SEQ ID NO: 3733252 - RNA, 18 nt, Human
uaaagauaauugcuauuu

SEQ ID NO: 3733253 - RNA, 16 nt, Human
uaaagauauggagaau

SEQ ID NO: 3733254 - RNA, 13 nt, Human
uaaagauauuauu

SEQ ID NO: 3733255 - RNA, 17 nt, Human
uaaagaucuacaugaau

SEQ ID NO: 3733256 - RNA, 16 nt, Human
uaaagaugaacucuga

SEQ ID NO: 3733257 - RNA, 19 nt, Human
uaaagaugagcuuugucua

SEQ ID NO: 3733258 - RNA, 13 nt, Human
uaaagaugaucua

SEQ ID NO: 3733259 - RNA, 21 nt, Human
uaaagaugcaaggaccaggac

SEQ ID NO: 3733260 - RNA, 17 nt, Human
uaaagauggaguuucua

SEQ ID NO: 3733261 - RNA, 21 nt, Human
uaaagauggaguuucuaaggu

SEQ ID NO: 3733262 - RNA, 20 nt, Human
uaaagauguagcaaacccug

SEQ ID NO: 3733263 - RNA, 19 nt, Human
uaaagauucuauaguucua

SEQ ID NO: 3733264 - RNA, 24 nt, Human
uaaagauucuauaguucuagacau

SEQ ID NO: 3733265 - RNA, 13 nt, Human
uaaagauugugug

SEQ ID NO: 3733266 - RNA, 13 nt, Human
uaaagauuucugu

SEQ ID NO: 3733267 - RNA, 14 nt, Human
uaaagauuucuguu

SEQ ID NO: 3733268 - RNA, 15 nt, Human
uaaagauuuugaucu

SEQ ID NO: 3733269 - RNA, 21 nt, Human
uaaagauuuugaucucacauu

SEQ ID NO: 3733270 - RNA, 16 nt, Human
uaaagauuuuuuaaua

SEQ ID NO: 3733271 - RNA, 17 nt, Human
uaaagauuuuuuaauaa

SEQ ID NO: 3733272 - RNA, 20 nt, Human
uaaagauuuuuuaauaauuu

SEQ ID NO: 3733273 - RNA, 10 nt, Human
uaaagcaaaa

SEQ ID NO: 3733274 - RNA, 10 nt, Human
uaaagcaaau

SEQ ID NO: 3733275 - RNA, 20 nt, Human
uaaagcaacugucuauuucu

SEQ ID NO: 3733276 - RNA, 19 nt, Human
uaaagcaagcucacuugcu

SEQ ID NO: 3733277 - RNA, 23 nt, Human
uaaagcaauaauggucccaucca

SEQ ID NO: 3733278 - RNA, 16 nt, Human
uaaagcaauuuuccuu

SEQ ID NO: 3733279 - RNA, 17 nt, Human
uaaagcaauuuuccuug

SEQ ID NO: 3733280 - RNA, 14 nt, Human
uaaagcacugagca

SEQ ID NO: 3733281 - RNA, 20 nt, Human
uaaagcagagggacuuugua

SEQ ID NO: 3733282 - RNA, 16 nt, Human
uaaagcagcguuucua

SEQ ID NO: 3733283 - RNA, 19 nt, Human
uaaagcagcguuucuauga

SEQ ID NO: 3733284 - RNA, 20 nt, Human
uaaagcaggccuuuugauau

SEQ ID NO: 3733285 - RNA, 13 nt, Human
uaaagcaguauuu

SEQ ID NO: 3733286 - RNA, 14 nt, Human
uaaagcaguauuuu

SEQ ID NO: 3733287 - RNA, 16 nt, Human
uaaagcauaaguauac

SEQ ID NO: 3733288 - RNA, 12 nt, Human
uaaagcauauag

SEQ ID NO: 3733289 - RNA, 15 nt, Human
uaaagcaucuaaacu

SEQ ID NO: 3733290 - RNA, 16 nt, Human
uaaagcaugaaaugug

SEQ ID NO: 3733291 - RNA, 18 nt, Human
uaaagcaugaaaugugaa

SEQ ID NO: 3733292 - RNA, 20 nt, Human
uaaagcaugaaaugugaauu

SEQ ID NO: 3733293 - RNA, 23 nt, Human
uaaagcauucaauuuauucaaga

SEQ ID NO: 3733294 - RNA, 15 nt, Human
uaaagcauuccaaca

SEQ ID NO: 3733295 - RNA, 19 nt, Human
uaaagcauugcuguuaugu

SEQ ID NO: 3733296 - RNA, 20 nt, Human
uaaagcauugcuguuauguc

SEQ ID NO: 3733297 - RNA, 23 nt, Human
uaaagcauugcuguuaugucugu

SEQ ID NO: 3733298 - RNA, 13 nt, Human
uaaagcauugcuu

SEQ ID NO: 3733299 - RNA, 11 nt, Human
uaaagcauuua

SEQ ID NO: 3733300 - RNA, 13 nt, Human
uaaagcauuuaua

SEQ ID NO: 3733301 - RNA, 11 nt, Human
uaaagccaagg

SEQ ID NO: 3733302 - RNA, 17 nt, Human
uaaagccagccugaccu

SEQ ID NO: 3733303 - RNA, 15 nt, Human
uaaagccaugcugga

SEQ ID NO: 3733304 - RNA, 23 nt, Human
uaaagcccgccugacagaaacca

SEQ ID NO: 3733305 - RNA, 12 nt, Human
uaaagccuccuc

SEQ ID NO: 3733306 - RNA, 14 nt, Human
uaaagcgaaaaacu

SEQ ID NO: 3733307 - RNA, 17 nt, Human
uaaagcgaaaaacucaa

SEQ ID NO: 3733308 - RNA, 18 nt, Human
uaaagcgauauacagaug

SEQ ID NO: 3733309 - RNA, 23 nt, Human
uaaagcgauauacagaugaaaau

SEQ ID NO: 3733310 - RNA, 20 nt, Human
uaaagcuaaaaugauuuuau

SEQ ID NO: 3733311 - RNA, 15 nt, Human
uaaagcuaaggaccu

SEQ ID NO: 3733312 - RNA, 17 nt, Human
uaaagcucaaaugaaau

SEQ ID NO: 3733313 - RNA, 19 nt, Human
uaaagcucaaaugaaaugu

SEQ ID NO: 3733314 - RNA, 17 nt, Human
uaaagcucgaaaacaau

SEQ ID NO: 3733315 - RNA, 16 nt, Human
uaaagcugccuguagu

SEQ ID NO: 3733316 - RNA, 15 nt, Human
uaaagcugguuuaau

SEQ ID NO: 3733317 - RNA, 11 nt, Human
uaaaggaaaag

SEQ ID NO: 3733318 - RNA, 16 nt, Human
uaaaggaaaagacaca

SEQ ID NO: 3733319 - RNA, 16 nt, Human
uaaaggaaaugauuga

SEQ ID NO: 3733320 - RNA, 14 nt, Human
uaaaggaauuuaaa

SEQ ID NO: 3733321 - RNA, 16 nt, Human
uaaaggaguuaagagu

SEQ ID NO: 3733322 - RNA, 20 nt, Human
uaaaggaguuaagaguagca

SEQ ID NO: 3733323 - RNA, 17 nt, Human
uaaaggauguugguguu

SEQ ID NO: 3733324 - RNA, 20 nt, Human
uaaaggcagcuguugucucu

SEQ ID NO: 3733325 - RNA, 15 nt, Human
uaaaggccucugccu

SEQ ID NO: 3733326 - RNA, 16 nt, Human
uaaaggcuaacuauga

SEQ ID NO: 3733327 - RNA, 15 nt, Human
uaaaggcuaccuuug

SEQ ID NO: 3733328 - RNA, 19 nt, Human
uaaaggcuaccuuuguauu

SEQ ID NO: 3733329 - RNA, 20 nt, Human
uaaaggcuauacuugucuug

SEQ ID NO: 3733330 - RNA, 14 nt, Human
uaaaggcuucucuc

SEQ ID NO: 3733331 - RNA, 19 nt, Human
uaaaggcuucucucucacc

SEQ ID NO: 3733332 - RNA, 13 nt, Human
uaaagggaagaaa

SEQ ID NO: 3733333 - RNA, 20 nt, Human
uaaagggcccaaugaauuau

SEQ ID NO: 3733334 - RNA, 15 nt, Human
uaaaggggggagggg

SEQ ID NO: 3733335 - RNA, 20 nt, Human
uaaaggugaaaaaagcuuuu

SEQ ID NO: 3733336 - RNA, 21 nt, Human
uaaaggugacaucggaaaaau

SEQ ID NO: 3733337 - RNA, 22 nt, Human
uaaaggugacaucggaaaaaua

SEQ ID NO: 3733338 - RNA, 23 nt, Human
uaaaggugguauguguguguaug

SEQ ID NO: 3733339 - RNA, 20 nt, Human
uaaagguggugaggcaauaa

SEQ ID NO: 3733340 - RNA, 19 nt, Human
uaaagguuauuuucuccug

SEQ ID NO: 3733341 - RNA, 19 nt, Human
uaaaguaaaaacaaagaaa

SEQ ID NO: 3733342 - RNA, 21 nt, Human
uaaaguaaaaacaaagaaauu

SEQ ID NO: 3733343 - RNA, 15 nt, Human
uaaaguaaagcuaaa

SEQ ID NO: 3733344 - RNA, 17 nt, Human
uaaaguaauuguuccag

SEQ ID NO: 3733345 - RNA, 23 nt, Human
uaaaguacugagcagugauauuc

SEQ ID NO: 3733346 - RNA, 21 nt, Human
uaaaguacuugaguguaaugu

SEQ ID NO: 3733347 - RNA, 16 nt, Human
uaaaguacuuguaguu

SEQ ID NO: 3733348 - RNA, 13 nt, Human
uaaaguagaagag

SEQ ID NO: 3733349 - RNA, 13 nt, Human
uaaaguauaaugu

SEQ ID NO: 3733350 - RNA, 19 nt, Human
uaaaguauagagagaaguu

SEQ ID NO: 3733351 - RNA, 19 nt, Human
uaaaguauauauagaaucu

SEQ ID NO: 3733352 - RNA, 20 nt, Human
uaaaguaucaggauacuaua

SEQ ID NO: 3733353 - RNA, 13 nt, Human
uaaaguauucuuu

SEQ ID NO: 3733354 - RNA, 13 nt, Human
uaaagucaggggu

SEQ ID NO: 3733355 - RNA, 14 nt, Human
uaaagucugaauca

SEQ ID NO: 3733356 - RNA, 22 nt, Human
uaaagucuguugauuaaagaug

SEQ ID NO: 3733357 - RNA, 15 nt, Human
uaaagucuugcugug

SEQ ID NO: 3733358 - RNA, 23 nt, Human
uaaagugaggccacugaagagga

SEQ ID NO: 3733359 - RNA, 15 nt, Human
uaaagugauauuucc

SEQ ID NO: 3733360 - RNA, 16 nt, Human
uaaagugauauuuccc

SEQ ID NO: 3733361 - RNA, 15 nt, Human
uaaagugcuaagguu

SEQ ID NO: 3733362 - RNA, 19 nt, Human
uaaagugcuaagguucuaa

SEQ ID NO: 3733363 - RNA, 22 nt, Human
uaaagugcuaagguucuaaggc

SEQ ID NO: 3733364 - RNA, 16 nt, Human
uaaagugcuuguguaa

SEQ ID NO: 3733365 - RNA, 22 nt, Human
uaaaguggguuauucuggaguu

SEQ ID NO: 3733366 - RNA, 15 nt, Human
uaaaguguaaauccu

SEQ ID NO: 3733367 - RNA, 22 nt, Human
uaaaguguaaauccuuuuucuu

SEQ ID NO: 3733368 - RNA, 16 nt, Human
uaaaguguaacauaug

SEQ ID NO: 3733369 - RNA, 20 nt, Human
uaaaguguauuuuuuuacua

SEQ ID NO: 3733370 - RNA, 22 nt, Human
uaaaguguauuuuuuuacuaau

SEQ ID NO: 3733371 - RNA, 11 nt, Human
uaaaguguuuc

SEQ ID NO: 3733372 - RNA, 15 nt, Human
uaaaguguuucagcu

SEQ ID NO: 3733373 - RNA, 17 nt, Human
uaaaguguuucuguuau

SEQ ID NO: 3733374 - RNA, 14 nt, Human
uaaaguguuugaaa

SEQ ID NO: 3733375 - RNA, 15 nt, Human
uaaaguguuuucaga

SEQ ID NO: 3733376 - RNA, 18 nt, Human
uaaaguuaaacauuuuua

SEQ ID NO: 3733377 - RNA, 13 nt, Human
uaaaguuacauug

SEQ ID NO: 3733378 - RNA, 15 nt, Human
uaaaguuacauugcu

SEQ ID NO: 3733379 - RNA, 15 nt, Human
uaaaguuaguaaaga

SEQ ID NO: 3733380 - RNA, 16 nt, Human
uaaaguuagucuacuc

SEQ ID NO: 3733381 - RNA, 13 nt, Human
uaaaguuauucuu

SEQ ID NO: 3733382 - RNA, 14 nt, Human
uaaaguucaaacuc

SEQ ID NO: 3733383 - RNA, 12 nt, Human
uaaaguucuaag

SEQ ID NO: 3733384 - RNA, 14 nt, Human
uaaaguucuaagau

SEQ ID NO: 3733385 - RNA, 15 nt, Human
uaaaguucuaagauu

SEQ ID NO: 3733386 - RNA, 17 nt, Human
uaaaguucuaagauucu

SEQ ID NO: 3733387 - RNA, 23 nt, Human
uaaaguucuguacucaaauguag

SEQ ID NO: 3733388 - RNA, 21 nt, Human
uaaaguugaauuuauuggcuu

SEQ ID NO: 3733389 - RNA, 23 nt, Human
uaaaguugaauuuauuggcuuuu

SEQ ID NO: 3733390 - RNA, 17 nt, Human
uaaaguugguauuaaua

SEQ ID NO: 3733391 - RNA, 19 nt, Human
uaaaguugguauuaauaaa

SEQ ID NO: 3733392 - RNA, 16 nt, Human
uaaaguugguuggaua

SEQ ID NO: 3733393 - RNA, 17 nt, Human
uaaaguugguuggauaa

SEQ ID NO: 3733394 - RNA, 17 nt, Human
uaaaguuuacaguaaau

SEQ ID NO: 3733395 - RNA, 12 nt, Human
uaaaguuucaaa

SEQ ID NO: 3733396 - RNA, 17 nt, Human
uaaaguuucaaaaaucu

SEQ ID NO: 3733397 - RNA, 20 nt, Human
guuuacagggagccuccugc

SEQ ID NO: 3733398 - RNA, 23 nt, Human
guuuacagggagccuccugccca

SEQ ID NO: 3733399 - RNA, 14 nt, Human
guuuacagucuauu

SEQ ID NO: 3733400 - RNA, 16 nt, Human
guuuacagucuauuug

SEQ ID NO: 3733401 - RNA, 13 nt, Human
guuuacaguguuc

SEQ ID NO: 3733402 - RNA, 21 nt, Human
guuuacauguguagccuaugu

SEQ ID NO: 3733403 - RNA, 22 nt, Human
guuuacauguguagccuauguu

SEQ ID NO: 3733404 - RNA, 11 nt, Human
guuuacauuua

SEQ ID NO: 3733405 - RNA, 12 nt, Human
guuuacauuuaa

SEQ ID NO: 3733406 - RNA, 14 nt, Human
guuuacauuuaaag

SEQ ID NO: 3733407 - RNA, 21 nt, Human
guuuacauuuaaagcauugcu

SEQ ID NO: 3733408 - RNA, 23 nt, Human
guuuacauuuaaagcauugcugu

SEQ ID NO: 3733409 - RNA, 21 nt, Human
guuuacauuugaugcaugucu

SEQ ID NO: 3733410 - RNA, 11 nt, Human
guuuacauuuu

SEQ ID NO: 3733411 - RNA, 23 nt, Human
guuuacauuuuuauuuaugaagu

SEQ ID NO: 3733412 - RNA, 16 nt, Human
guuuacccaugaagau

SEQ ID NO: 3733413 - RNA, 23 nt, Human
guuuaccuagaagaagcuauguc

SEQ ID NO: 3733414 - RNA, 16 nt, Human
guuuaccugaauaaau

SEQ ID NO: 3733415 - RNA, 21 nt, Human
guuuaccuggcuuauuuaaua

SEQ ID NO: 3733416 - RNA, 13 nt, Human
guuuacuauuuua

SEQ ID NO: 3733417 - RNA, 23 nt, Human
guuuacuguuuugaaaucaaugc

SEQ ID NO: 3733418 - RNA, 14 nt, Human
guuuacuuaaagau

SEQ ID NO: 3733419 - RNA, 20 nt, Human
guuuacuuccccuauggaau

SEQ ID NO: 3733420 - RNA, 13 nt, Human
guuuacuuuaacu

SEQ ID NO: 3733421 - RNA, 15 nt, Human
guuuagaacagguuu

SEQ ID NO: 3733422 - RNA, 16 nt, Human
guuuagaagaagugug

SEQ ID NO: 3733423 - RNA, 18 nt, Human
guuuagauagggcugggc

SEQ ID NO: 3733424 - RNA, 19 nt, Human
guuuagauagggcugggca

SEQ ID NO: 3733425 - RNA, 18 nt, Human
guuuagaugaaugucagu

SEQ ID NO: 3733426 - RNA, 22 nt, Human
guuuagauuugccauagaguac

SEQ ID NO: 3733427 - RNA, 14 nt, Human
guuuagauuuugug

SEQ ID NO: 3733428 - RNA, 22 nt, Human
guuuagauuuuguguuuauucu

SEQ ID NO: 3733429 - RNA, 23 nt, Human
guuuagcagcagccuuuaaugca

SEQ ID NO: 3733430 - RNA, 13 nt, Human
guuuagcaguaua

SEQ ID NO: 3733431 - RNA, 15 nt, Human
guuuagcugacaaaa

SEQ ID NO: 3733432 - RNA, 17 nt, Human
guuuagcugacaaaaua

SEQ ID NO: 3733433 - RNA, 16 nt, Human
uaacaucuucuuuccu

SEQ ID NO: 3733434 - RNA, 17 nt, Human
uaacaucuuuauugaaa

SEQ ID NO: 3733435 - RNA, 21 nt, Human
uaacaucuuuauugaaauucu

SEQ ID NO: 3733436 - RNA, 22 nt, Human
uaacaucuuuauugaaauucua

SEQ ID NO: 3733437 - RNA, 13 nt, Human
uaacaugaaauga

SEQ ID NO: 3733438 - RNA, 14 nt, Human
uaacaugaaaugau

SEQ ID NO: 3733439 - RNA, 21 nt, Human
uaacaugaacacccuuagaaa

SEQ ID NO: 3733440 - RNA, 17 nt, Human
guuuugacaucagccag

SEQ ID NO: 3733441 - RNA, 17 nt, Human
guuuugacauuuuuagu

SEQ ID NO: 3733442 - RNA, 15 nt, Human
guuuugauaugagua

SEQ ID NO: 3733443 - RNA, 23 nt, Human
guuuugauguuuguggccucaga

SEQ ID NO: 3733444 - RNA, 19 nt, Human
guuuugauuuaauaacaua

SEQ ID NO: 3733445 - RNA, 20 nt, Human
guuuugauuuaauguuuuca

SEQ ID NO: 3733446 - RNA, 13 nt, Human
guuuugcacucuu

SEQ ID NO: 3733447 - RNA, 22 nt, Human
guuuugcacucuuguuucuccc

SEQ ID NO: 3733448 - RNA, 13 nt, Human
guuuugcacuuuu

SEQ ID NO: 3733449 - RNA, 16 nt, Human
guuuugccauguuggc

SEQ ID NO: 3733450 - RNA, 22 nt, Human
guuuugccauguuggccaggcu

SEQ ID NO: 3733451 - RNA, 18 nt, Human
guuuugcucuuguagccc

SEQ ID NO: 3733452 - RNA, 18 nt, Human
guuuuggacaguuuacca

SEQ ID NO: 3733453 - RNA, 16 nt, Human
guuuuggacuccaucu

SEQ ID NO: 3733454 - RNA, 19 nt, Human
guuuuggaucuugaaugug

SEQ ID NO: 3733455 - RNA, 23 nt, Human
guuuuggauuuggagagaaauau

SEQ ID NO: 3733456 - RNA, 22 nt, Human
guuuugggggucaggcagccag

SEQ ID NO: 3733457 - RNA, 16 nt, Human
guuuugguguaacauc

SEQ ID NO: 3733458 - RNA, 17 nt, Human
guuuuguaaacauuuau

SEQ ID NO: 3733459 - RNA, 16 nt, Human
guuuuguaaacuuuga

SEQ ID NO: 3733460 - RNA, 17 nt, Human
guuuuguaaagucccca

SEQ ID NO: 3733461 - RNA, 14 nt, Human
guuuuguaaauuuc

SEQ ID NO: 3733462 - RNA, 23 nt, Human
guuuuguaagaugcuggguuggu

SEQ ID NO: 3733463 - RNA, 14 nt, Human
guuuuguacauaga

SEQ ID NO: 3733464 - RNA, 12 nt, Human
guuuuguacaug

SEQ ID NO: 3733465 - RNA, 19 nt, Human
guuuuguacauguaacauu

SEQ ID NO: 3733466 - RNA, 15 nt, Human
guuuuguagguacuu

SEQ ID NO: 3733467 - RNA, 12 nt, Human
guuuuguauaca

SEQ ID NO: 3733468 - RNA, 13 nt, Human
guuuugugaaauu

SEQ ID NO: 3733469 - RNA, 23 nt, Human
guuuugugaaauuuuucauauuu

SEQ ID NO: 3733470 - RNA, 24 nt, Human
guuuugugacuauauagagauguu

SEQ ID NO: 3733471 - RNA, 16 nt, Human
guuuugugucucuuau

SEQ ID NO: 3733472 - RNA, 18 nt, Human
guuuuguguuuguuguag

SEQ ID NO: 3733473 - RNA, 15 nt, Human
guuuuguguuuuuuu

SEQ ID NO: 3733474 - RNA, 17 nt, Human
guuuuguuauauaauuu

SEQ ID NO: 3733475 - RNA, 21 nt, Human
guuuuguucaccauuauaaug

SEQ ID NO: 3733476 - RNA, 18 nt, Human
guuuuguugacauucuga

SEQ ID NO: 3733477 - RNA, 22 nt, Human
guuuuguugacauucugaaugc

SEQ ID NO: 3733478 - RNA, 12 nt, Human
guuuuguugagc

SEQ ID NO: 3733479 - RNA, 10 nt, Human
guuuuguugc

SEQ ID NO: 3733480 - RNA, 20 nt, Human
guuuuguuuggcaaggaaag

SEQ ID NO: 3733481 - RNA, 18 nt, Human
guuuuuaaaaguuucaau

SEQ ID NO: 3733482 - RNA, 17 nt, Human
guuuuuaaaauaucuuu

SEQ ID NO: 3733483 - RNA, 20 nt, Human
guuuuuaaaaucuuauuaaa

SEQ ID NO: 3733484 - RNA, 13 nt, Human
guuuuuaaacugu

SEQ ID NO: 3733485 - RNA, 17 nt, Human
guuuuuaaacuguacag

SEQ ID NO: 3733486 - RNA, 20 nt, Human
guuuuuaaacuguacagugu

SEQ ID NO: 3733487 - RNA, 18 nt, Human
guuuuuaaauagaguuug

SEQ ID NO: 3733488 - RNA, 19 nt, Human
guuuuuaacucaauauuuu

SEQ ID NO: 3733489 - RNA, 19 nt, Human
guuuuuaagcuguuuccau

SEQ ID NO: 3733490 - RNA, 21 nt, Human
guuuuuaaggguuuguggaaa

SEQ ID NO: 3733491 - RNA, 12 nt, Human
guuuuuaaugua

SEQ ID NO: 3733492 - RNA, 11 nt, Human
guuuuuacagc

SEQ ID NO: 3733493 - RNA, 17 nt, Human
guuuuuacagcuguguu

SEQ ID NO: 3733494 - RNA, 14 nt, Human
guuuuuacccauau

SEQ ID NO: 3733495 - RNA, 22 nt, Human
guuuuuaccuaccacagugucu

SEQ ID NO: 3733496 - RNA, 23 nt, Human
guuuuuaccugucacauugcauu

SEQ ID NO: 3733497 - RNA, 16 nt, Human
guuuuuacuacaguug

SEQ ID NO: 3733498 - RNA, 21 nt, Human
guuuuuagacaccuucauuuu

SEQ ID NO: 3733499 - RNA, 21 nt, Human
guuuuuaguaaucuguacauu

SEQ ID NO: 3733500 - RNA, 18 nt, Human
guuuuuauaaaaaauggu

SEQ ID NO: 3733501 - RNA, 15 nt, Human
guuuuuauaauaaaa

SEQ ID NO: 3733502 - RNA, 17 nt, Human
guuuuuauuaaaaggaa

SEQ ID NO: 3733503 - RNA, 15 nt, Human
guuuuuauuauuaac

SEQ ID NO: 3733504 - RNA, 18 nt, Human
guuuuuauuauuaacaaa

SEQ ID NO: 3733505 - RNA, 14 nt, Human
guuuuuauuuccua

SEQ ID NO: 3733506 - RNA, 15 nt, Human
guuuuucaauuaaac

SEQ ID NO: 3733507 - RNA, 17 nt, Human
guuuuucaauuaaacgg

SEQ ID NO: 3733508 - RNA, 21 nt, Human
guuuuucaauuaaacggauua

SEQ ID NO: 3733509 - RNA, 12 nt, Human
guuuuucauuca

SEQ ID NO: 3733510 - RNA, 15 nt, Human
guuuuuccacuacug

SEQ ID NO: 3733511 - RNA, 18 nt, Human
guuuuuccuaucauguua

SEQ ID NO: 3733512 - RNA, 14 nt, Human
guuuuuccuggaau

SEQ ID NO: 3733513 - RNA, 17 nt, Human
guuuuuccuuauuugcu

SEQ ID NO: 3733514 - RNA, 14 nt, Human
guuuuuccuuuaaa

SEQ ID NO: 3733515 - RNA, 18 nt, Human
guuuuuccuuuuuuugua

SEQ ID NO: 3733516 - RNA, 11 nt, Human
guuuuucuauu

SEQ ID NO: 3733517 - RNA, 19 nt, Human
guuuuucuauuaaaagacu

SEQ ID NO: 3733518 - RNA, 22 nt, Human
guuuuucuauuaaaagacucau

SEQ ID NO: 3733519 - RNA, 16 nt, Human
guuuuucuccagugcu

SEQ ID NO: 3733520 - RNA, 17 nt, Human
guuuuucugcuuuugaa

SEQ ID NO: 3733521 - RNA, 16 nt, Human
guuuuucuggguggcc

SEQ ID NO: 3733522 - RNA, 12 nt, Human
guuuuucuucaa

SEQ ID NO: 3733523 - RNA, 14 nt, Human
guuuuucuuguaaa

SEQ ID NO: 3733524 - RNA, 14 nt, Human
guuuuugaaacaga

SEQ ID NO: 3733525 - RNA, 24 nt, Human
guuuuuggaugguguuacauauua

SEQ ID NO: 3733526 - RNA, 18 nt, Human
guuuuugguuuuuaaaac

SEQ ID NO: 3733527 - RNA, 13 nt, Human
guuuuuguaaaga

SEQ ID NO: 3733528 - RNA, 21 nt, Human
guuuuuguaaagaaaaauauu

SEQ ID NO: 3733529 - RNA, 15 nt, Human
guuuuuguaaagauu

SEQ ID NO: 3733530 - RNA, 21 nt, Human
guuuuuguaaauuaaucuuuu

SEQ ID NO: 3733531 - RNA, 16 nt, Human
guuuuugucuuaaaaa

SEQ ID NO: 3733532 - RNA, 19 nt, Human
guuuuuguuuuuguuuugu

SEQ ID NO: 3733533 - RNA, 18 nt, Human
guuuuuuaaaaaucugug

SEQ ID NO: 3733534 - RNA, 21 nt, Human
guuuuuuaaagucuugcugug

SEQ ID NO: 3733535 - RNA, 23 nt, Human
guuuuuuaagggcccuuuuucaa

SEQ ID NO: 3733536 - RNA, 12 nt, Human
guuuuuuaaguc

SEQ ID NO: 3733537 - RNA, 19 nt, Human
guuuuuuagaucaaauacu

SEQ ID NO: 3733538 - RNA, 16 nt, Human
guuuuuuaugaagugc

SEQ ID NO: 3733539 - RNA, 11 nt, Human
guuuuuucauc

SEQ ID NO: 3733540 - RNA, 15 nt, Human
guuuuuuccucagug

SEQ ID NO: 3733541 - RNA, 14 nt, Human
guuuuuuccugagc

SEQ ID NO: 3733542 - RNA, 21 nt, Human
guuuuuuccugagcuuggcca

SEQ ID NO: 3733543 - RNA, 13 nt, Human
guuuuuuccuuug

SEQ ID NO: 3733544 - RNA, 12 nt, Human
guuuuuugaaaa

SEQ ID NO: 3733545 - RNA, 16 nt, Human
guuuuuugaaguguug

SEQ ID NO: 3733546 - RNA, 23 nt, Human
guuuuuugccacagcuuuugcaa

SEQ ID NO: 3733547 - RNA, 9 nt, Human
guuuuuugu

SEQ ID NO: 3733548 - RNA, 20 nt, Human
guuuuuuuaggguuucugau

SEQ ID NO: 3733549 - RNA, 13 nt, Human
guuuuuuuccagu

SEQ ID NO: 3733550 - RNA, 18 nt, Human
guuuuuuuuaaauaaaag

SEQ ID NO: 3733551 - RNA, 20 nt, Human
guuuuuuuuaaauaaaagca

SEQ ID NO: 3733552 - RNA, 13 nt, Human
guuuuuuuucuaa

SEQ ID NO: 3733553 - RNA, 14 nt, Human
guuuuuuuuucauu

SEQ ID NO: 3733554 - RNA, 20 nt, Human
guuuuuuuuuccuguccuuc

SEQ ID NO: 3733555 - RNA, 16 nt, Human
guuuuuuuuuuguuug

SEQ ID NO: 3733556 - RNA, 22 nt, Human
guuuuuuuuuuuaaaaaaagaa

SEQ ID NO: 3733557 - RNA, 19 nt, Human
guuuuuuuuuuuuuuuugg

SEQ ID NO: 3733558 - RNA, 18 nt, Human
uaaaaaaaaaaaaaagcu

SEQ ID NO: 3733559 - RNA, 22 nt, Human
uaaaaaaaaaaaaaagcuuuau

SEQ ID NO: 3733560 - RNA, 22 nt, Human
uaaaaaaaaaaaaaauguucuu

SEQ ID NO: 3733561 - RNA, 19 nt, Human
uaaaaaaaaaaaaaggaaa

SEQ ID NO: 3733562 - RNA, 18 nt, Human
uaaaaaaaaaaagauugu

SEQ ID NO: 3733563 - RNA, 14 nt, Human
uaaaaaaaaaggca

SEQ ID NO: 3733564 - RNA, 14 nt, Human
uaaaaaaaaaguca

SEQ ID NO: 3733565 - RNA, 15 nt, Human
uaaaaaaaaagucag

SEQ ID NO: 3733566 - RNA, 15 nt, Human
uaaaaaaaaaugccu

SEQ ID NO: 3733567 - RNA, 18 nt, Human
uaaaaaaaaaugccuuug

SEQ ID NO: 3733568 - RNA, 17 nt, Human
uaaaaaaaacaaaaaga

SEQ ID NO: 3733569 - RNA, 15 nt, Human
uaaaaaaaagaaaaa

SEQ ID NO: 3733570 - RNA, 16 nt, Human
uaaaaaaaauaauaaa

SEQ ID NO: 3733571 - RNA, 14 nt, Human
uaaaaaaaauaguu

SEQ ID NO: 3733572 - RNA, 19 nt, Human
uaaaaaaaauccuucuaau

SEQ ID NO: 3733573 - RNA, 20 nt, Human
uaaaaaaaaugaaauguuuu

SEQ ID NO: 3733574 - RNA, 13 nt, Human
uaaaaaaagaaaa

SEQ ID NO: 3733575 - RNA, 15 nt, Human
uaaaaaaagaaaaaa

SEQ ID NO: 3733576 - RNA, 14 nt, Human
uaaaaaaagaaaau

SEQ ID NO: 3733577 - RNA, 15 nt, Human
uaaaaaaagaaagca

SEQ ID NO: 3733578 - RNA, 17 nt, Human
uaaaaaaagaagagaaa

SEQ ID NO: 3733579 - RNA, 19 nt, Human
uaaaaaaauaaaacauuuu

SEQ ID NO: 3733580 - RNA, 20 nt, Human
uaaaaaaauaagaagaaugc

SEQ ID NO: 3733581 - RNA, 22 nt, Human
uaaaaaaauaagaagaaugcuu

SEQ ID NO: 3733582 - RNA, 20 nt, Human
uaaaaaaauaauaauaaugu

SEQ ID NO: 3733583 - RNA, 22 nt, Human
uaaaaaaauacaguauucugua

SEQ ID NO: 3733584 - RNA, 15 nt, Human
uaaaaaaauuuaagu

SEQ ID NO: 3733585 - RNA, 17 nt, Human
uaaaaaacuaaaaacua

SEQ ID NO: 3733586 - RNA, 23 nt, Human
uaaaaaacugcugacuguuuucu

SEQ ID NO: 3733587 - RNA, 21 nt, Human
uaaaaaacuuucuacucauuu

SEQ ID NO: 3733588 - RNA, 16 nt, Human
uaaaaaagaaacauuu

SEQ ID NO: 3733589 - RNA, 13 nt, Human
uaaaaaagagaca

SEQ ID NO: 3733590 - RNA, 18 nt, Human
uaaaaaagcucuuuuaau

SEQ ID NO: 3733591 - RNA, 20 nt, Human
uaaaaaagcuuaaaacuuug

SEQ ID NO: 3733592 - RNA, 16 nt, Human
uaaaaaagucucuauu

SEQ ID NO: 3733593 - RNA, 19 nt, Human
uaaaaaagucucuauuuaa

SEQ ID NO: 3733594 - RNA, 17 nt, Human
uaaaaaaguuuaaaaug

SEQ ID NO: 3733595 - RNA, 22 nt, Human
uaaaaaaguuuagaaugugugu

SEQ ID NO: 3733596 - RNA, 19 nt, Human
uaaaaaauaauaauacaag

SEQ ID NO: 3733597 - RNA, 16 nt, Human
uaaaaaauauuuucuc

SEQ ID NO: 3733598 - RNA, 13 nt, Human
uaaaaaaugaaau

SEQ ID NO: 3733599 - RNA, 15 nt, Human
uaaaaaauggaaaga

SEQ ID NO: 3733600 - RNA, 19 nt, Human
uaaaaaaugguucagaauu

SEQ ID NO: 3733601 - RNA, 22 nt, Human
uaaaaaauguguguauucuuaa

SEQ ID NO: 3733602 - RNA, 19 nt, Human
uaaaaaauuuuaaaaaucu

SEQ ID NO: 3733603 - RNA, 10 nt, Human
uaaaaacaaa

SEQ ID NO: 3733604 - RNA, 17 nt, Human
uaaaaacaaagaaauua

SEQ ID NO: 3733605 - RNA, 18 nt, Human
uaaaaacaacgaaagaag

SEQ ID NO: 3733606 - RNA, 18 nt, Human
uaaaaacagcauugcuuu

SEQ ID NO: 3733607 - RNA, 18 nt, Human
uaaaaaccagacaaggaa

SEQ ID NO: 3733608 - RNA, 23 nt, Human
uaaaaacccacaaaaauguugaa

SEQ ID NO: 3733609 - RNA, 20 nt, Human
uaaaaacuagaggugagaaa

SEQ ID NO: 3733610 - RNA, 19 nt, Human
uaaaaacuaguaguucucu

SEQ ID NO: 3733611 - RNA, 14 nt, Human
uaaaaacugaaguu

SEQ ID NO: 3733612 - RNA, 17 nt, Human
uaaaaacugacuccuua

SEQ ID NO: 3733613 - RNA, 14 nt, Human
uaaaaacuuugcua

SEQ ID NO: 3733614 - RNA, 23 nt, Human
uaaaaagaaaaaccacucccagu

SEQ ID NO: 3733615 - RNA, 18 nt, Human
uaaaaagaaaaaugugua

SEQ ID NO: 3733616 - RNA, 16 nt, Human
uaaaaagaaacaagau

SEQ ID NO: 3733617 - RNA, 18 nt, Human
uaaaaagaaacaagaugc

SEQ ID NO: 3733618 - RNA, 19 nt, Human
uaaaaagaaacaagaugcu

SEQ ID NO: 3733619 - RNA, 21 nt, Human
uaaaaagaaggaaaaugaucu

SEQ ID NO: 3733620 - RNA, 20 nt, Human
uaaaaagagagaaaacuuau

SEQ ID NO: 3733621 - RNA, 13 nt, Human
uaaaaagauucuu

SEQ ID NO: 3733622 - RNA, 19 nt, Human
uaaaaagauucuuuuucug

SEQ ID NO: 3733623 - RNA, 23 nt, Human
uaaaaagccacuagacucuucac

SEQ ID NO: 3733624 - RNA, 20 nt, Human
uaaaaagccagggcuggaga

SEQ ID NO: 3733625 - RNA, 16 nt, Human
uaaaaagcccaaccuc

SEQ ID NO: 3733626 - RNA, 22 nt, Human
uaaaaagccugcaauuucauau

SEQ ID NO: 3733627 - RNA, 18 nt, Human
uaaaaaggacaucagcaa

SEQ ID NO: 3733628 - RNA, 19 nt, Human
uaaaaaguauaaaauagua

SEQ ID NO: 3733629 - RNA, 20 nt, Human
uaaaaaguauugccaaacau

SEQ ID NO: 3733630 - RNA, 17 nt, Human
uaaaaaguggaauuucu

SEQ ID NO: 3733631 - RNA, 18 nt, Human
uaaaaaguggaauuucuu

SEQ ID NO: 3733632 - RNA, 11 nt, Human
uaaaaaguuaa

SEQ ID NO: 3733633 - RNA, 21 nt, Human
uaaaaaguuaaaaaaaauaau

SEQ ID NO: 3733634 - RNA, 12 nt, Human
uaaaaaguuaau

SEQ ID NO: 3733635 - RNA, 14 nt, Human
uaaaaaguuguuca

SEQ ID NO: 3733636 - RNA, 16 nt, Human
uaaaaauaaacauguu

SEQ ID NO: 3733637 - RNA, 21 nt, Human
uaaaaauaaauagaaaaguag

SEQ ID NO: 3733638 - RNA, 16 nt, Human
uaaaaauaaccuugca

SEQ ID NO: 3733639 - RNA, 13 nt, Human
uaaaaauaacugu

SEQ ID NO: 3733640 - RNA, 15 nt, Human
uaaaaauaagucaac

SEQ ID NO: 3733641 - RNA, 16 nt, Human
uaaaaauaagucaaca

SEQ ID NO: 3733642 - RNA, 12 nt, Human
uaaaaauagaaa

SEQ ID NO: 3733643 - RNA, 13 nt, Human
uaaaaauagaaac

SEQ ID NO: 3733644 - RNA, 15 nt, Human
uaaaaauagaaacau

SEQ ID NO: 3733645 - RNA, 16 nt, Human
uaaaaauauacauguu

SEQ ID NO: 3733646 - RNA, 22 nt, Human
uaaaaauauauauagugcuaua

SEQ ID NO: 3733647 - RNA, 15 nt, Human
uaaaaaucaacuuuu

SEQ ID NO: 3733648 - RNA, 20 nt, Human
uaaaaaucuaccuucuguag

SEQ ID NO: 3733649 - RNA, 16 nt, Human
uaaaaaucucaaauuu

SEQ ID NO: 3733650 - RNA, 19 nt, Human
uaaaaaucucaaauuucua

SEQ ID NO: 3733651 - RNA, 11 nt, Human
uaaaaaucuuu

SEQ ID NO: 3733652 - RNA, 13 nt, Human
uaaaaaugagaac

SEQ ID NO: 3733653 - RNA, 15 nt, Human
uaaaaaugaucuaaa

SEQ ID NO: 3733654 - RNA, 19 nt, Human
uaaaaaugcaaauccuaug

SEQ ID NO: 3733655 - RNA, 22 nt, Human
uaaaaauggaaacuauauugac

SEQ ID NO: 3733656 - RNA, 23 nt, Human
uaaaaauggcaggggguggaauu

SEQ ID NO: 3733657 - RNA, 19 nt, Human
uaaaaaugggacuucuuuu

SEQ ID NO: 3733658 - RNA, 16 nt, Human
uaaaaaugguaaaauu

SEQ ID NO: 3733659 - RNA, 17 nt, Human
uaaaaaugguaaaauug

SEQ ID NO: 3733660 - RNA, 20 nt, Human
uaaaaaugguggcuucagcu

SEQ ID NO: 3733661 - RNA, 18 nt, Human
uaaaaaugguuuaaaugg

SEQ ID NO: 3733662 - RNA, 13 nt, Human
uaaaaauguaaau

SEQ ID NO: 3733663 - RNA, 18 nt, Human
uaaaaauguaaauauucu

SEQ ID NO: 3733664 - RNA, 20 nt, Human
uaaaaauguaaauauucuau

SEQ ID NO: 3733665 - RNA, 16 nt, Human
uaaaaauuccagaaug

SEQ ID NO: 3733666 - RNA, 22 nt, Human
uaaaaauugccauuggacaguu

SEQ ID NO: 3733667 - RNA, 19 nt, Human
uaaaaauugucuucaugua

SEQ ID NO: 3733668 - RNA, 23 nt, Human
uaaaaauugucuucauguacauu

SEQ ID NO: 3733669 - RNA, 23 nt, Human
uaaaaauuguuucaaaauaaaaa

SEQ ID NO: 3733670 - RNA, 12 nt, Human
uaaaacaaaaca

SEQ ID NO: 3733671 - RNA, 17 nt, Human
uaaaacaaaauuuguuu

SEQ ID NO: 3733672 - RNA, 16 nt, Human
uaaaacaacagaugua

SEQ ID NO: 3733673 - RNA, 17 nt, Human
uaaaacaacagcucgau

SEQ ID NO: 3733674 - RNA, 19 nt, Human
uaaaacaagaaaguuuccc

SEQ ID NO: 3733675 - RNA, 21 nt, Human
uaaaacacaccuaagagaaaa

SEQ ID NO: 3733676 - RNA, 13 nt, Human
uaaaacacagagg

SEQ ID NO: 3733677 - RNA, 14 nt, Human
uaaaacacuucugu

SEQ ID NO: 3733678 - RNA, 14 nt, Human
uaaaacagaagccu

SEQ ID NO: 3733679 - RNA, 15 nt, Human
uaaaacagacacugg

SEQ ID NO: 3733680 - RNA, 19 nt, Human
uaaaacagacacuggcaug

SEQ ID NO: 3733681 - RNA, 17 nt, Human
uaaaacagaguaaucuu

SEQ ID NO: 3733682 - RNA, 20 nt, Human
uaaaacaguauuuauuuugu

SEQ ID NO: 3733683 - RNA, 21 nt, Human
uaaaacaguauuuauuuugua

SEQ ID NO: 3733684 - RNA, 21 nt, Human
uaaaacaguuggcaugcaucc

SEQ ID NO: 3733685 - RNA, 17 nt, Human
uaaaacaucauuacuau

SEQ ID NO: 3733686 - RNA, 18 nt, Human
uaaaacaugacuccuaca

SEQ ID NO: 3733687 - RNA, 14 nt, Human
uaaaacauuaagaa

SEQ ID NO: 3733688 - RNA, 12 nt, Human
uaaaacauuaau

SEQ ID NO: 3733689 - RNA, 12 nt, Human
uaaaacauuaug

SEQ ID NO: 3733690 - RNA, 15 nt, Human
uaaaacauuggauua

SEQ ID NO: 3733691 - RNA, 16 nt, Human
uaaaacauuggauuau

SEQ ID NO: 3733692 - RNA, 14 nt, Human
uaaaacauuuauuu

SEQ ID NO: 3733693 - RNA, 14 nt, Human
uaaaacauuuuaaa

SEQ ID NO: 3733694 - RNA, 18 nt, Human
uaaaacauuuuaaaugga

SEQ ID NO: 3733695 - RNA, 17 nt, Human
uaaaacauuuucacaca

SEQ ID NO: 3733696 - RNA, 21 nt, Human
uaaaaccauguagaaaauuug

SEQ ID NO: 3733697 - RNA, 18 nt, Human
uaaaacccguugauuacu

SEQ ID NO: 3733698 - RNA, 18 nt, Human
uaaaaccugagcuagaag

SEQ ID NO: 3733699 - RNA, 15 nt, Human
uaaaaccugucaaug

SEQ ID NO: 3733700 - RNA, 10 nt, Human
uaaaaccuuu

SEQ ID NO: 3733701 - RNA, 13 nt, Human
uaaaaccuuucaa

SEQ ID NO: 3733702 - RNA, 20 nt, Human
uaaaacgcugucaaaaguug

SEQ ID NO: 3733703 - RNA, 23 nt, Human
uaaaacggugcugugagggaggg

SEQ ID NO: 3733704 - RNA, 18 nt, Human
uaaaacuaaauagcaugu

SEQ ID NO: 3733705 - RNA, 15 nt, Human
uaaaacuacaaaaau

SEQ ID NO: 3733706 - RNA, 19 nt, Human
uaaaacuaggcauuuguaa

SEQ ID NO: 3733707 - RNA, 21 nt, Human
uaaaacuaggcauuuguaaau

SEQ ID NO: 3733708 - RNA, 16 nt, Human
uaaaacugaagucuga

SEQ ID NO: 3733709 - RNA, 19 nt, Human
uaaaacugaagucugaaau

SEQ ID NO: 3733710 - RNA, 16 nt, Human
uaaaacugaugugaaa

SEQ ID NO: 3733711 - RNA, 16 nt, Human
uaaaacuguacuuuga

SEQ ID NO: 3733712 - RNA, 19 nt, Human
uaaaacuguacuuugauuc

SEQ ID NO: 3733713 - RNA, 23 nt, Human
uaaaacuguacuuugauucacau

SEQ ID NO: 3733714 - RNA, 13 nt, Human
uaaaacugucccu

SEQ ID NO: 3733715 - RNA, 20 nt, Human
uaaaacuuaccuaagugaca

SEQ ID NO: 3733716 - RNA, 22 nt, Human
uaaaacuucaguuucacagaaa

SEQ ID NO: 3733717 - RNA, 20 nt, Human
uaaaacuucucaagauacug

SEQ ID NO: 3733718 - RNA, 18 nt, Human
uaaaacuucuuaaauauc

SEQ ID NO: 3733719 - RNA, 20 nt, Human
uaaaacuugauguguuaucu

SEQ ID NO: 3733720 - RNA, 13 nt, Human
uaaaacuuuaauc

SEQ ID NO: 3733721 - RNA, 15 nt, Human
uaaaacuuuccucgc

SEQ ID NO: 3733722 - RNA, 14 nt, Human
uaaaacuuugaagu

SEQ ID NO: 3733723 - RNA, 15 nt, Human
uaaaacuuugaaguu

SEQ ID NO: 3733724 - RNA, 15 nt, Human
uaaaacuuugcugcc

SEQ ID NO: 3733725 - RNA, 16 nt, Human
uaaaacuuuucugcug

SEQ ID NO: 3733726 - RNA, 14 nt, Human
uaaaagaaaauaaa

SEQ ID NO: 3733727 - RNA, 15 nt, Human
uaaaagaaaccacuu

SEQ ID NO: 3733728 - RNA, 21 nt, Human
uaaaagaaagccucagagaau

SEQ ID NO: 3733729 - RNA, 23 nt, Human
uaaaagaaaugcacaaugucuug

SEQ ID NO: 3733730 - RNA, 18 nt, Human
uaaaagaacuuacugauu

SEQ ID NO: 3733731 - RNA, 19 nt, Human
uaaaagaacuuacugauua

SEQ ID NO: 3733732 - RNA, 17 nt, Human
uaaaagaauauucagag

SEQ ID NO: 3733733 - RNA, 21 nt, Human
uaaaagaaugggcaguuacau

SEQ ID NO: 3733734 - RNA, 12 nt, Human
uaaaagaauugu

SEQ ID NO: 3733735 - RNA, 19 nt, Human
uaaaagaauuuuuuugucu

SEQ ID NO: 3733736 - RNA, 20 nt, Human
uaaaagaauuuuuuugucuu

SEQ ID NO: 3733737 - RNA, 11 nt, Human
uaaaagacaaa

SEQ ID NO: 3733738 - RNA, 22 nt, Human
uaaaagacaaaucaaagcagau

SEQ ID NO: 3733739 - RNA, 21 nt, Human
uaaaagacaguguauguagaa

SEQ ID NO: 3733740 - RNA, 20 nt, Human
uaacaugaauauuuaguguu

SEQ ID NO: 3733741 - RNA, 18 nt, Human
uaacaugaggggacauuu

SEQ ID NO: 3733742 - RNA, 19 nt, Human
uaacaugaggggacauuuu

SEQ ID NO: 3733743 - RNA, 14 nt, Human
uaacaugauuuggg

SEQ ID NO: 3733744 - RNA, 13 nt, Human
uaacaugcugugu

SEQ ID NO: 3733745 - RNA, 18 nt, Human
uaacaugcuguguaagcu

SEQ ID NO: 3733746 - RNA, 20 nt, Human
uaacauggaagggaagaaaa

SEQ ID NO: 3733747 - RNA, 14 nt, Human
uaacauggaaguac

SEQ ID NO: 3733748 - RNA, 11 nt, Human
uaacaugggcu

SEQ ID NO: 3733749 - RNA, 19 nt, Human
uaacauguaauuaaguacu

SEQ ID NO: 3733750 - RNA, 19 nt, Human
uaacaugugaaaagaauag

SEQ ID NO: 3733751 - RNA, 22 nt, Human
uaacauguguuaaguauuuuca

SEQ ID NO: 3733752 - RNA, 17 nt, Human
uaacauguuaaaccaug

SEQ ID NO: 3733753 - RNA, 18 nt, Human
uaacauguuaaaccaugg

SEQ ID NO: 3733754 - RNA, 21 nt, Human
uaacauuaaugccugcuuuuu

SEQ ID NO: 3733755 - RNA, 13 nt, Human
uaacauuaccuua

SEQ ID NO: 3733756 - RNA, 17 nt, Human
uaacauuaccuuacugu

SEQ ID NO: 3733757 - RNA, 22 nt, Human
uaacauuaucuaguucauugaa

SEQ ID NO: 3733758 - RNA, 14 nt, Human
uaacauuauuuaua

SEQ ID NO: 3733759 - RNA, 20 nt, Human
uaacauuccuaaaaugcuuc

SEQ ID NO: 3733760 - RNA, 21 nt, Human
uaacauuccucaugaauguaa

SEQ ID NO: 3733761 - RNA, 19 nt, Human
uaacauucuauuucaacuu

SEQ ID NO: 3733762 - RNA, 19 nt, Human
uaacauugaccaagaacug

SEQ ID NO: 3733763 - RNA, 16 nt, Human
uaacauuucaagggca

SEQ ID NO: 3733764 - RNA, 14 nt, Human
uaacauuugcuguu

SEQ ID NO: 3733765 - RNA, 13 nt, Human
uaacauuuuaaau

SEQ ID NO: 3733766 - RNA, 10 nt, Human
uaacauuuug

SEQ ID NO: 3733767 - RNA, 15 nt, Human
uaacauuuuucaaua

SEQ ID NO: 3733768 - RNA, 17 nt, Human
uaaccaaaaagaccaga

SEQ ID NO: 3733769 - RNA, 11 nt, Human
uaaccaaaggu

SEQ ID NO: 3733770 - RNA, 17 nt, Human
uaaccaaaggugaagga

SEQ ID NO: 3733771 - RNA, 21 nt, Human
uaaccaaaggugaaggaauau

SEQ ID NO: 3733772 - RNA, 21 nt, Human
uaaccaaaugcaucaauccug

SEQ ID NO: 3733773 - RNA, 14 nt, Human
uaaccaagaggcug

SEQ ID NO: 3733774 - RNA, 19 nt, Human
uaaccaagcugaguuuccu

SEQ ID NO: 3733775 - RNA, 22 nt, Human
uaaccaaucuacaaucucccuu

SEQ ID NO: 3733776 - RNA, 12 nt, Human
uaaccaauguuu

SEQ ID NO: 3733777 - RNA, 14 nt, Human
uaaccaauguuuaa

SEQ ID NO: 3733778 - RNA, 22 nt, Human
uaaccaauguuuaaaaaaguuu

SEQ ID NO: 3733779 - RNA, 14 nt, Human
uaaccacaacuuuc

SEQ ID NO: 3733780 - RNA, 17 nt, Human
uaaccacagcuccuuuu

SEQ ID NO: 3733781 - RNA, 18 nt, Human
uaaccacagcuccuuuuc

SEQ ID NO: 3733782 - RNA, 23 nt, Human
uaaccacagcuccuuuuccagag

SEQ ID NO: 3733783 - RNA, 21 nt, Human
uaaccaccuaccuuacaguga

SEQ ID NO: 3733784 - RNA, 13 nt, Human
uaaccagaucauu

SEQ ID NO: 3733785 - RNA, 20 nt, Human
uaaccagccagauccucuug

SEQ ID NO: 3733786 - RNA, 16 nt, Human
uaaccagggccagaag

SEQ ID NO: 3733787 - RNA, 21 nt, Human
uaaccagucugaaguuucauu

SEQ ID NO: 3733788 - RNA, 23 nt, Human
uaaccaguguuguggauuuaaca

SEQ ID NO: 3733789 - RNA, 20 nt, Human
uaaccauggaguagagguac

SEQ ID NO: 3733790 - RNA, 22 nt, Human
uaaccaugugaaaaggcaaaaa

SEQ ID NO: 3733791 - RNA, 10 nt, Human
uaaccauuuu

SEQ ID NO: 3733792 - RNA, 16 nt, Human
uaacccaacucuccug

SEQ ID NO: 3733793 - RNA, 19 nt, Human
uaacccaggccugucugac

SEQ ID NO: 3733794 - RNA, 16 nt, Human
uaacccauaauugaag

SEQ ID NO: 3733795 - RNA, 11 nt, Human
uaaccccaccc

SEQ ID NO: 3733796 - RNA, 13 nt, Human
uaaccccaggccc

SEQ ID NO: 3733797 - RNA, 17 nt, Human
uaaccccauucuuugcu

SEQ ID NO: 3733798 - RNA, 17 nt, Human
uaaccccccuguacaca

SEQ ID NO: 3733799 - RNA, 19 nt, Human
uaacccccuuaaauuuaau

SEQ ID NO: 3733800 - RNA, 18 nt, Human
uaaccccgggcggguggc

SEQ ID NO: 3733801 - RNA, 17 nt, Human
uaaccccgucaacaaau

SEQ ID NO: 3733802 - RNA, 12 nt, Human
uaaccccuuucc

SEQ ID NO: 3733803 - RNA, 13 nt, Human
uaaccccuuuccu

SEQ ID NO: 3733804 - RNA, 23 nt, Human
uaacccgcucaucacuggaugaa

SEQ ID NO: 3733805 - RNA, 23 nt, Human
uaacccuucaacguuucuucacu

SEQ ID NO: 3733806 - RNA, 18 nt, Human
uaacccuucaucuuccug

SEQ ID NO: 3733807 - RNA, 19 nt, Human
uaacccuuugugugcucuc

SEQ ID NO: 3733808 - RNA, 22 nt, Human
uaaccgagaucaguauuuaacu

SEQ ID NO: 3733809 - RNA, 14 nt, Human
uaaccgaugcuuua

SEQ ID NO: 3733810 - RNA, 19 nt, Human
uaaccgaugcuuuaccaaa

SEQ ID NO: 3733811 - RNA, 14 nt, Human
uaaccgcuccaggu

SEQ ID NO: 3733812 - RNA, 21 nt, Human
uaaccuaauuaauauauuaaa

SEQ ID NO: 3733813 - RNA, 22 nt, Human
uaaccuauaugauuuauaguuu

SEQ ID NO: 3733814 - RNA, 19 nt, Human
uaaccucaagugauccucc

SEQ ID NO: 3733815 - RNA, 13 nt, Human
uaaccucagcucu

SEQ ID NO: 3733816 - RNA, 17 nt, Human
uaaccucagcucuggga

SEQ ID NO: 3733817 - RNA, 19 nt, Human
uaaccucagcucugggaga

SEQ ID NO: 3733818 - RNA, 16 nt, Human
uaaccucgggccugcu

SEQ ID NO: 3733819 - RNA, 14 nt, Human
uaaccucugcacua

SEQ ID NO: 3733820 - RNA, 20 nt, Human
uaaccucugcuuuuaucuca

SEQ ID NO: 3733821 - RNA, 14 nt, Human
uaaccucuguucag

SEQ ID NO: 3733822 - RNA, 12 nt, Human
uaaccuggugcu

SEQ ID NO: 3733823 - RNA, 23 nt, Human
uaaccuggugcuggauauuuuca

SEQ ID NO: 3733824 - RNA, 19 nt, Human
uaacgaaguugggcaauau

SEQ ID NO: 3733825 - RNA, 17 nt, Human
uaacgaccacagggucu

SEQ ID NO: 3733826 - RNA, 23 nt, Human
uaacgcaauaaacgcauuaucag

SEQ ID NO: 3733827 - RNA, 12 nt, Human
uaacgccugagc

SEQ ID NO: 3733828 - RNA, 13 nt, Human
uaacgccugagcc

SEQ ID NO: 3733829 - RNA, 18 nt, Human
uaacgccugagcccaggg

SEQ ID NO: 3733830 - RNA, 19 nt, Human
uaacggaucagaaauacag

SEQ ID NO: 3733831 - RNA, 21 nt, Human
uaacggaucagaaauacagau

SEQ ID NO: 3733832 - RNA, 15 nt, Human
uaacggcuccaggau

SEQ ID NO: 3733833 - RNA, 17 nt, Human
uaacguauaaaagccug

SEQ ID NO: 3733834 - RNA, 15 nt, Human
uaacgugugcugugu

SEQ ID NO: 3733835 - RNA, 17 nt, Human
uaacgugugcuguguuu

SEQ ID NO: 3733836 - RNA, 22 nt, Human
uaacgugugcuguguuugcucc

SEQ ID NO: 3733837 - RNA, 20 nt, Human
uaacguuuaagccaaaacaa

SEQ ID NO: 3733838 - RNA, 12 nt, Human
uaacuaaaauaa

SEQ ID NO: 3733839 - RNA, 14 nt, Human
uaacuaaaauguau

SEQ ID NO: 3733840 - RNA, 17 nt, Human
uaacuaaacucucuuug

SEQ ID NO: 3733841 - RNA, 16 nt, Human
uaacuaaauuugauac

SEQ ID NO: 3733842 - RNA, 19 nt, Human
uaacuaaauuuuaaagcca

SEQ ID NO: 3733843 - RNA, 16 nt, Human
uaacuaacuaaaacaa

SEQ ID NO: 3733844 - RNA, 20 nt, Human
uaacuaauacagcugagcua

SEQ ID NO: 3733845 - RNA, 22 nt, Human
uaacuaaucuauuggguucauu

SEQ ID NO: 3733846 - RNA, 21 nt, Human
uaacuacaaagguuuaaauga

SEQ ID NO: 3733847 - RNA, 21 nt, Human
uaacuacuccggagacagggu

SEQ ID NO: 3733848 - RNA, 16 nt, Human
uaacuacuguguuccu

SEQ ID NO: 3733849 - RNA, 17 nt, Human
uaacuacuuuauaacua

SEQ ID NO: 3733850 - RNA, 23 nt, Human
uaacuacuuuauaacuaacaugu

SEQ ID NO: 3733851 - RNA, 17 nt, Human
uaacuagaauuuauuca

SEQ ID NO: 3733852 - RNA, 20 nt, Human
uaacuagacaccaaaguucu

SEQ ID NO: 3733853 - RNA, 22 nt, Human
uaacuagacaccaaaguucuaa

SEQ ID NO: 3733854 - RNA, 18 nt, Human
uaacuagagcagcccugg

SEQ ID NO: 3733855 - RNA, 20 nt, Human
uaacuagauggugcugagaa

SEQ ID NO: 3733856 - RNA, 15 nt, Human
uaacuagcuuggaaa

SEQ ID NO: 3733857 - RNA, 12 nt, Human
uaacuaggagcu

SEQ ID NO: 3733858 - RNA, 15 nt, Human
uaacuaggcucagag

SEQ ID NO: 3733859 - RNA, 17 nt, Human
uaacuaguccuuuacua

SEQ ID NO: 3733860 - RNA, 17 nt, Human
uaacuauauuugcuuuu

SEQ ID NO: 3733861 - RNA, 16 nt, Human
uaacuaucacugguuu

SEQ ID NO: 3733862 - RNA, 17 nt, Human
uaacuauguacaauauu

SEQ ID NO: 3733863 - RNA, 15 nt, Human
uaacuauguuuaaag

SEQ ID NO: 3733864 - RNA, 21 nt, Human
uaacuauugcauuuauaugua

SEQ ID NO: 3733865 - RNA, 21 nt, Human
uaacucaaauacacauuugcu

SEQ ID NO: 3733866 - RNA, 23 nt, Human
uaacucaaggauaccuucuuauu

SEQ ID NO: 3733867 - RNA, 16 nt, Human
uaacucaccuaacuca

SEQ ID NO: 3733868 - RNA, 13 nt, Human
uaacucagaucac

SEQ ID NO: 3733869 - RNA, 21 nt, Human
uaacucaggacuccagcccau

SEQ ID NO: 3733870 - RNA, 23 nt, Human
uaacucauacugugcuggagcca

SEQ ID NO: 3733871 - RNA, 16 nt, Human
uaacucauuagacugg

SEQ ID NO: 3733872 - RNA, 12 nt, Human
uaacucauuugu

SEQ ID NO: 3733873 - RNA, 22 nt, Human
uaacuccaccaacccaucagaa

SEQ ID NO: 3733874 - RNA, 14 nt, Human
uaacuccagugaag

SEQ ID NO: 3733875 - RNA, 19 nt, Human
uaacuccagugauguucuu

SEQ ID NO: 3733876 - RNA, 19 nt, Human
uaacucccagugaugcugu

SEQ ID NO: 3733877 - RNA, 14 nt, Human
uaacucccauuacc

SEQ ID NO: 3733878 - RNA, 19 nt, Human
uaacuccccuguuucaauc

SEQ ID NO: 3733879 - RNA, 14 nt, Human
uaacucuaaaagau

SEQ ID NO: 3733880 - RNA, 18 nt, Human
uaacucuaaaagauccuu

SEQ ID NO: 3733881 - RNA, 23 nt, Human
uaacucuaaaagauccuuuuuaa

SEQ ID NO: 3733882 - RNA, 22 nt, Human
uaacucuaauucccauuuugca

SEQ ID NO: 3733883 - RNA, 15 nt, Human
uaacucugucuucac

SEQ ID NO: 3733884 - RNA, 14 nt, Human
uaacucuugucuau

SEQ ID NO: 3733885 - RNA, 21 nt, Human
uaacucuuugccuuugccacc

SEQ ID NO: 3733886 - RNA, 21 nt, Human
uaacugaaaaugugcuauacu

SEQ ID NO: 3733887 - RNA, 20 nt, Human
uaacugaaaauuauuuaaac

SEQ ID NO: 3733888 - RNA, 15 nt, Human
uaacugaaggagaag

SEQ ID NO: 3733889 - RNA, 21 nt, Human
gcacacaccuguagucccagc

SEQ ID NO: 3733890 - RNA, 15 nt, Human
gcacacacucagugc

SEQ ID NO: 3733891 - RNA, 19 nt, Human
gcacacacugugcuuucua

SEQ ID NO: 3733892 - RNA, 15 nt, Human
gcacacagaaauaua

SEQ ID NO: 3733893 - RNA, 23 nt, Human
gcacacagaaauauauauacaua

SEQ ID NO: 3733894 - RNA, 18 nt, Human
gcacacagcuacucuccc

SEQ ID NO: 3733895 - RNA, 19 nt, Human
gcacacagcugcagagaca

SEQ ID NO: 3733896 - RNA, 14 nt, Human
gcacacagucaccu

SEQ ID NO: 3733897 - RNA, 16 nt, Human
gcacacaucaucugua

SEQ ID NO: 3733898 - RNA, 12 nt, Human
gcacacauuuuu

SEQ ID NO: 3733899 - RNA, 14 nt, Human
gcacacauuuuuua

SEQ ID NO: 3733900 - RNA, 14 nt, Human
gcacaccccacucc

SEQ ID NO: 3733901 - RNA, 20 nt, Human
gcacacccucacucugccag

SEQ ID NO: 3733902 - RNA, 15 nt, Human
gcacaccuccuccca

SEQ ID NO: 3733903 - RNA, 20 nt, Human
gcacaccuccucccacugcc

SEQ ID NO: 3733904 - RNA, 22 nt, Human
gcacaccuccucccacugccca

SEQ ID NO: 3733905 - RNA, 14 nt, Human
gcacacgccuccca

SEQ ID NO: 3733906 - RNA, 19 nt, Human
gcacacgccucccacuggg

SEQ ID NO: 3733907 - RNA, 15 nt, Human
gcacacgcugcucug

SEQ ID NO: 3733908 - RNA, 17 nt, Human
gcacacgucauguuucu

SEQ ID NO: 3733909 - RNA, 21 nt, Human
gcacacucagcacccccuucu

SEQ ID NO: 3733910 - RNA, 23 nt, Human
gcacacucagcacccccuucucu

SEQ ID NO: 3733911 - RNA, 17 nt, Human
gcacacugagccagcag

SEQ ID NO: 3733912 - RNA, 19 nt, Human
gcacacuggcucacccagu

SEQ ID NO: 3733913 - RNA, 12 nt, Human
gcacacuguagc

SEQ ID NO: 3733914 - RNA, 13 nt, Human
gcacacugucugc

SEQ ID NO: 3733915 - RNA, 14 nt, Human
gcacacuuugccau

SEQ ID NO: 3733916 - RNA, 18 nt, Human
gcacacuuuggcccaggg

SEQ ID NO: 3733917 - RNA, 20 nt, Human
gcacagaaaauggaagacag

SEQ ID NO: 3733918 - RNA, 22 nt, Human
gcacagaaaauggaagacagcu

SEQ ID NO: 3733919 - RNA, 21 nt, Human
gcacagaaaccucuacuaaaa

SEQ ID NO: 3733920 - RNA, 18 nt, Human
gcacagaaguccuguaug

SEQ ID NO: 3733921 - RNA, 12 nt, Human
gcacagaauaug

SEQ ID NO: 3733922 - RNA, 18 nt, Human
gcacagacccugcccugu

SEQ ID NO: 3733923 - RNA, 19 nt, Human
gcacagacccugcccugug

SEQ ID NO: 3733924 - RNA, 20 nt, Human
gcacagacccugcccugugg

SEQ ID NO: 3733925 - RNA, 12 nt, Human
gcacagagaagc

SEQ ID NO: 3733926 - RNA, 15 nt, Human
gcacagagagggggc

SEQ ID NO: 3733927 - RNA, 17 nt, Human
gcacagagagggggcca

SEQ ID NO: 3733928 - RNA, 22 nt, Human
gcacagaguuguuacauuuuua

SEQ ID NO: 3733929 - RNA, 17 nt, Human
gcacagauauacuuugu

SEQ ID NO: 3733930 - RNA, 13 nt, Human
gcacagauggauu

SEQ ID NO: 3733931 - RNA, 15 nt, Human
gcacagauggauuug

SEQ ID NO: 3733932 - RNA, 18 nt, Human
gcacagauggauuugccu

SEQ ID NO: 3733933 - RNA, 24 nt, Human
gcacagauggauuugccugugcca

SEQ ID NO: 3733934 - RNA, 14 nt, Human
gcacagauuuuaau

SEQ ID NO: 3733935 - RNA, 17 nt, Human
gcacagauuuuaauugu

SEQ ID NO: 3733936 - RNA, 14 nt, Human
gcacagcaaggagg

SEQ ID NO: 3733937 - RNA, 17 nt, Human
gcacagcagccugcuuc

SEQ ID NO: 3733938 - RNA, 22 nt, Human
gcacagcagccuggggcuggcc

SEQ ID NO: 3733939 - RNA, 12 nt, Human
gcacagcaggcu

SEQ ID NO: 3733940 - RNA, 18 nt, Human
gcacagcaggcugccagu

SEQ ID NO: 3733941 - RNA, 23 nt, Human
gcacagcaggcugccagugccug

SEQ ID NO: 3733942 - RNA, 13 nt, Human
gcacagcaucuca

SEQ ID NO: 3733943 - RNA, 17 nt, Human
gcacagccaaauuuaaa

SEQ ID NO: 3733944 - RNA, 15 nt, Human
gcacagccaaggacu

SEQ ID NO: 3733945 - RNA, 17 nt, Human
gcacagcccaaagaagg

SEQ ID NO: 3733946 - RNA, 18 nt, Human
gcacagcccucccgcccc

SEQ ID NO: 3733947 - RNA, 22 nt, Human
gcacagcccucccgccccuucc

SEQ ID NO: 3733948 - RNA, 18 nt, Human
gcacagccucuuagaugc

SEQ ID NO: 3733949 - RNA, 20 nt, Human
gcacagcucaggaggcgccc

SEQ ID NO: 3733950 - RNA, 16 nt, Human
gcacagcucccugcca

SEQ ID NO: 3733951 - RNA, 23 nt, Human
gcacagcuguagugggguucuag

SEQ ID NO: 3733952 - RNA, 17 nt, Human
gcacagcuuagauuuca

SEQ ID NO: 3733953 - RNA, 19 nt, Human
gcacagcuuagauuucaua

SEQ ID NO: 3733954 - RNA, 14 nt, Human
gcacaggacaugcg

SEQ ID NO: 3733955 - RNA, 21 nt, Human
gcacaggacaugcgguagcca

SEQ ID NO: 3733956 - RNA, 22 nt, Human
gcacaggacaugcgguagccag

SEQ ID NO: 3733957 - RNA, 12 nt, Human
gcacaggagcua

SEQ ID NO: 3733958 - RNA, 15 nt, Human
gcacaggaggcaggc

SEQ ID NO: 3733959 - RNA, 22 nt, Human
gcacaggagggggucguggaga

SEQ ID NO: 3733960 - RNA, 15 nt, Human
gcacaggaugcuggc

SEQ ID NO: 3733961 - RNA, 16 nt, Human
gcacaggaugcuggcc

SEQ ID NO: 3733962 - RNA, 20 nt, Human
gcacaggcagggcaggacca

SEQ ID NO: 3733963 - RNA, 14 nt, Human
gcacaggcccccuu

SEQ ID NO: 3733964 - RNA, 16 nt, Human
gcacaggcuaauuuuu

SEQ ID NO: 3733965 - RNA, 17 nt, Human
gcacaggcugagugcag

SEQ ID NO: 3733966 - RNA, 19 nt, Human
gcacaggcugagugcaggc

SEQ ID NO: 3733967 - RNA, 20 nt, Human
gcacaggcugagugcaggcc

SEQ ID NO: 3733968 - RNA, 16 nt, Human
gcacagggagaggccg

SEQ ID NO: 3733969 - RNA, 19 nt, Human
gcacagggcagcugggccc

SEQ ID NO: 3733970 - RNA, 16 nt, Human
gcacagggcaguggga

SEQ ID NO: 3733971 - RNA, 23 nt, Human
gcacagggcaugaaaugaacaca

SEQ ID NO: 3733972 - RNA, 14 nt, Human
gcacagggccuggc

SEQ ID NO: 3733973 - RNA, 19 nt, Human
gcacagggccuggcccaug

SEQ ID NO: 3733974 - RNA, 17 nt, Human
gcacagggucugcucuu

SEQ ID NO: 3733975 - RNA, 15 nt, Human
gcacaggucaggggu

SEQ ID NO: 3733976 - RNA, 22 nt, Human
gcacaggucaggggugacacag

SEQ ID NO: 3733977 - RNA, 23 nt, Human
gcacaggucaggggugacacaga

SEQ ID NO: 3733978 - RNA, 23 nt, Human
gcacaggucccaccuccagcccg

SEQ ID NO: 3733979 - RNA, 19 nt, Human
gcacaggucgggcgcagga

SEQ ID NO: 3733980 - RNA, 20 nt, Human
gcacaggucgggcgcaggau

SEQ ID NO: 3733981 - RNA, 12 nt, Human
gcacagugauuu

SEQ ID NO: 3733982 - RNA, 18 nt, Human
gcacaguuuucugagaaa

SEQ ID NO: 3733983 - RNA, 23 nt, Human
gcacaguuuucuggcuggagccu

SEQ ID NO: 3733984 - RNA, 17 nt, Human
gcacauaguagaacgcu

SEQ ID NO: 3733985 - RNA, 13 nt, Human
gcacauauggacu

SEQ ID NO: 3733986 - RNA, 20 nt, Human
gcacauauuagugcagccaa

SEQ ID NO: 3733987 - RNA, 19 nt, Human
gcacaucagcacgauuucu

SEQ ID NO: 3733988 - RNA, 21 nt, Human
gcacaucagcacgauuucugu

SEQ ID NO: 3733989 - RNA, 15 nt, Human
gcacauccauuccca

SEQ ID NO: 3733990 - RNA, 13 nt, Human
gcacaucccugga

SEQ ID NO: 3733991 - RNA, 19 nt, Human
gcacauccgcgugugccug

SEQ ID NO: 3733992 - RNA, 20 nt, Human
gcacauccuaugcaauauau

SEQ ID NO: 3733993 - RNA, 16 nt, Human
gcacaugaacuuagau

SEQ ID NO: 3733994 - RNA, 17 nt, Human
gcacaugauuucacaaa

SEQ ID NO: 3733995 - RNA, 20 nt, Human
gcacaugauuucacaaauau

SEQ ID NO: 3733996 - RNA, 22 nt, Human
gcacaugcagauggggcucccg

SEQ ID NO: 3733997 - RNA, 13 nt, Human
gcacaugccucuc

SEQ ID NO: 3733998 - RNA, 19 nt, Human
gcacaugccucucucaggc

SEQ ID NO: 3733999 - RNA, 21 nt, Human
gcacaugccucucucaggcca

SEQ ID NO: 3734000 - RNA, 19 nt, Human
gcacaugccuguaguccca

SEQ ID NO: 3734001 - RNA, 20 nt, Human
gcacaugcugagucucccaa

SEQ ID NO: 3734002 - RNA, 13 nt, Human
gcacaugcuggcc

SEQ ID NO: 3734003 - RNA, 22 nt, Human
gcacaugcuggccagccugggg

SEQ ID NO: 3734004 - RNA, 13 nt, Human
gcacaugcuucaa

SEQ ID NO: 3734005 - RNA, 22 nt, Human
gcacauggaggagcuuggggga

SEQ ID NO: 3734006 - RNA, 13 nt, Human
gcacaugucuuaa

SEQ ID NO: 3734007 - RNA, 12 nt, Human
gcacaugugugc

SEQ ID NO: 3734008 - RNA, 14 nt, Human
gcacauugagcugu

SEQ ID NO: 3734009 - RNA, 18 nt, Human
gcacauugagcugugcaa

SEQ ID NO: 3734010 - RNA, 17 nt, Human
gcacauuuaagagacag

SEQ ID NO: 3734011 - RNA, 22 nt, Human
gcacauuuccccagaccugagc

SEQ ID NO: 3734012 - RNA, 23 nt, Human
gcaccaaaucaaaaucucuccac

SEQ ID NO: 3734013 - RNA, 16 nt, Human
gcaccaacccagccgc

SEQ ID NO: 3734014 - RNA, 22 nt, Human
gcaccaacccagccgcugcccg

SEQ ID NO: 3734015 - RNA, 13 nt, Human
gcaccaagcccac

SEQ ID NO: 3734016 - RNA, 17 nt, Human
gcaccaagcccacaggu

SEQ ID NO: 3734017 - RNA, 22 nt, Human
gcaccaagugcggguccggcag

SEQ ID NO: 3734018 - RNA, 21 nt, Human
gcaccaauaaagccuucaaac

SEQ ID NO: 3734019 - RNA, 21 nt, Human
gcaccacugcacuccagccug

SEQ ID NO: 3734020 - RNA, 22 nt, Human
gcaccacugcacuccagccugg

SEQ ID NO: 3734021 - RNA, 23 nt, Human
gcaccacugcacuccagccuggg

SEQ ID NO: 3734022 - RNA, 17 nt, Human
gcaccagacacccagga

SEQ ID NO: 3734023 - RNA, 15 nt, Human
gcaccagaggcugca

SEQ ID NO: 3734024 - RNA, 14 nt, Human
gcaccagcagccug

SEQ ID NO: 3734025 - RNA, 15 nt, Human
gcaccagcagccugg

SEQ ID NO: 3734026 - RNA, 18 nt, Human
gcaccagcgaagggagug

SEQ ID NO: 3734027 - RNA, 16 nt, Human
gcaccagcuucuccag

SEQ ID NO: 3734028 - RNA, 18 nt, Human
gcaccagcuucuccaggc

SEQ ID NO: 3734029 - RNA, 21 nt, Human
gcaccagggaaggggacaagg

SEQ ID NO: 3734030 - RNA, 23 nt, Human
gcaccaggguugaccccagagga

SEQ ID NO: 3734031 - RNA, 14 nt, Human
gcaccagucccugu

SEQ ID NO: 3734032 - RNA, 19 nt, Human
gcaccaguguccuccccuc

SEQ ID NO: 3734033 - RNA, 22 nt, Human
gcaccaguugcugcuucaauuu

SEQ ID NO: 3734034 - RNA, 18 nt, Human
gcaccaugcugcugggga

SEQ ID NO: 3734035 - RNA, 15 nt, Human
gcaccauucaggaac

SEQ ID NO: 3734036 - RNA, 16 nt, Human
gcaccauucaggaacc

SEQ ID NO: 3734037 - RNA, 23 nt, Human
gcaccauucaggaaccuggacca

SEQ ID NO: 3734038 - RNA, 16 nt, Human
uaaaagagauuucaag

SEQ ID NO: 3734039 - RNA, 18 nt, Human
uaaaagagauuucaagag

SEQ ID NO: 3734040 - RNA, 18 nt, Human
uaaaagagguuuuucuua

SEQ ID NO: 3734041 - RNA, 14 nt, Human
uaaaagauacaguu

SEQ ID NO: 3734042 - RNA, 21 nt, Human
uaaaagauacauuuguauguu

SEQ ID NO: 3734043 - RNA, 16 nt, Human
uaaaagauauaagugc

SEQ ID NO: 3734044 - RNA, 19 nt, Human
uaaaagauauaagugcugu

SEQ ID NO: 3734045 - RNA, 20 nt, Human
uaaaagauauaagugcugua

SEQ ID NO: 3734046 - RNA, 14 nt, Human
uaaaagauccuuuu

SEQ ID NO: 3734047 - RNA, 15 nt, Human
uaaaagaucuucaaa

SEQ ID NO: 3734048 - RNA, 19 nt, Human
uaaaagaucuucaaaagua

SEQ ID NO: 3734049 - RNA, 20 nt, Human
uaaaagauggggucuguaaa

SEQ ID NO: 3734050 - RNA, 21 nt, Human
uaaaagauggggucuguaaaa

SEQ ID NO: 3734051 - RNA, 20 nt, Human
uaaaagaugucucugcaaac

SEQ ID NO: 3734052 - RNA, 14 nt, Human
uaaaagauucauuu

SEQ ID NO: 3734053 - RNA, 18 nt, Human
uaaaagcaaaaaagaaaa

SEQ ID NO: 3734054 - RNA, 14 nt, Human
uaaaagcaaaucau

SEQ ID NO: 3734055 - RNA, 20 nt, Human
uaaaagcaaaucauuuguuu

SEQ ID NO: 3734056 - RNA, 11 nt, Human
uaaaagcagca

SEQ ID NO: 3734057 - RNA, 21 nt, Human
uaaaagcagcaucugcuaaua

SEQ ID NO: 3734058 - RNA, 20 nt, Human
uaaaagccaucauguaaauu

SEQ ID NO: 3734059 - RNA, 19 nt, Human
uaaaagccuaggucuauuu

SEQ ID NO: 3734060 - RNA, 14 nt, Human
uaaaagccugcuca

SEQ ID NO: 3734061 - RNA, 19 nt, Human
uaaaagccuuggccucaga

SEQ ID NO: 3734062 - RNA, 22 nt, Human
uaaaagcuaucuucauguaaau

SEQ ID NO: 3734063 - RNA, 21 nt, Human
uaaaaggaaagaaaacaucuu

SEQ ID NO: 3734064 - RNA, 21 nt, Human
uaaaaggaaaucucaccccau

SEQ ID NO: 3734065 - RNA, 21 nt, Human
uaaaaggaagcuuacaugccu

SEQ ID NO: 3734066 - RNA, 14 nt, Human
uaaaaggauggcaa

SEQ ID NO: 3734067 - RNA, 18 nt, Human
uaaaaggccaaaccucug

SEQ ID NO: 3734068 - RNA, 20 nt, Human
uaaaaggccaaaccucuguu

SEQ ID NO: 3734069 - RNA, 13 nt, Human
uaaaaggcccaga

SEQ ID NO: 3734070 - RNA, 22 nt, Human
uaaaaggcccauagcagccagu

SEQ ID NO: 3734071 - RNA, 19 nt, Human
uaaaagggacugagaaauu

SEQ ID NO: 3734072 - RNA, 21 nt, Human
uaaaaggggguccguggaaga

SEQ ID NO: 3734073 - RNA, 15 nt, Human
uaaaagguaaugugu

SEQ ID NO: 3734074 - RNA, 18 nt, Human
uaaaaggucuaugcucau

SEQ ID NO: 3734075 - RNA, 15 nt, Human
uaaaagguucaggga

SEQ ID NO: 3734076 - RNA, 20 nt, Human
uaaaaguacauguuaaacuu

SEQ ID NO: 3734077 - RNA, 15 nt, Human
uaaaagucacaaugu

SEQ ID NO: 3734078 - RNA, 23 nt, Human
uaaaagugaaugaaagauuaaac

SEQ ID NO: 3734079 - RNA, 22 nt, Human
uaaaagugucaccuuuucuugc

SEQ ID NO: 3734080 - RNA, 18 nt, Human
uaaaagugugagcaguga

SEQ ID NO: 3734081 - RNA, 14 nt, Human
uaaaaguucauaac

SEQ ID NO: 3734082 - RNA, 17 nt, Human
uaaaaguuuuauaugcu

SEQ ID NO: 3734083 - RNA, 19 nt, Human
uaaaaguuuuauaugcuuu

SEQ ID NO: 3734084 - RNA, 21 nt, Human
uaaaaguuuuuuauuaugcau

SEQ ID NO: 3734085 - RNA, 21 nt, Human
uaaaauaaaaugaaaauugua

SEQ ID NO: 3734086 - RNA, 14 nt, Human
uaaaauaaacuuuc

SEQ ID NO: 3734087 - RNA, 17 nt, Human
uaaaauaaagaaauaga

SEQ ID NO: 3734088 - RNA, 17 nt, Human
uaaaauaaaguauauau

SEQ ID NO: 3734089 - RNA, 14 nt, Human
uaaaauaaauauug

SEQ ID NO: 3734090 - RNA, 17 nt, Human
uaaaauaagucugauuu

SEQ ID NO: 3734091 - RNA, 18 nt, Human
uaaaauaaugcaaagaau

SEQ ID NO: 3734092 - RNA, 18 nt, Human
uaaaauaauuauauaacu

SEQ ID NO: 3734093 - RNA, 20 nt, Human
uaaaauaauuauauaacugu

SEQ ID NO: 3734094 - RNA, 21 nt, Human
uaaaauaauuauauaacugua

SEQ ID NO: 3734095 - RNA, 14 nt, Human
uaaaauaauuuugu

SEQ ID NO: 3734096 - RNA, 21 nt, Human
uaaaauaauuuuguaauguau

SEQ ID NO: 3734097 - RNA, 21 nt, Human
uaaaauacacacucaaaucaa

SEQ ID NO: 3734098 - RNA, 19 nt, Human
uaaaauacauagugaaaau

SEQ ID NO: 3734099 - RNA, 20 nt, Human
uaaaauacuauuuuuacugc

SEQ ID NO: 3734100 - RNA, 16 nt, Human
uaaaauacuguagaua

SEQ ID NO: 3734101 - RNA, 20 nt, Human
uaaaauacuguagauaauua

SEQ ID NO: 3734102 - RNA, 21 nt, Human
uaaaauacuguagauaauuaa

SEQ ID NO: 3734103 - RNA, 19 nt, Human
uaaaauagaaauuuuguaa

SEQ ID NO: 3734104 - RNA, 23 nt, Human
uaaaauagaguguaguuuacaga

SEQ ID NO: 3734105 - RNA, 18 nt, Human
uaaaauagauauaaauuu

SEQ ID NO: 3734106 - RNA, 23 nt, Human
uaaaauagccacuuaccuucaau

SEQ ID NO: 3734107 - RNA, 21 nt, Human
uaaaauagcguucuuguaauu

SEQ ID NO: 3734108 - RNA, 19 nt, Human
uaaaauauagcuguacaaa

SEQ ID NO: 3734109 - RNA, 17 nt, Human
uaaaauauauuucagau

SEQ ID NO: 3734110 - RNA, 15 nt, Human
uaaaauaucauucag

SEQ ID NO: 3734111 - RNA, 17 nt, Human
uaaaauaucauucagca

SEQ ID NO: 3734112 - RNA, 19 nt, Human
uaaaauaugaagacauaaa

SEQ ID NO: 3734113 - RNA, 15 nt, Human
uaaaauauuauugaa

SEQ ID NO: 3734114 - RNA, 16 nt, Human
uaaaauauuauugaac

SEQ ID NO: 3734115 - RNA, 20 nt, Human
uaaaauauuuaugaagaaaa

SEQ ID NO: 3734116 - RNA, 21 nt, Human
uaaaauauuuaugaagaaaau

SEQ ID NO: 3734117 - RNA, 13 nt, Human
uaaaauauuuauu

SEQ ID NO: 3734118 - RNA, 19 nt, Human
uaaaauauuuucugugugu

SEQ ID NO: 3734119 - RNA, 14 nt, Human
uaaaauauuuugaa

SEQ ID NO: 3734120 - RNA, 11 nt, Human
uaaaaucacua

SEQ ID NO: 3734121 - RNA, 17 nt, Human
uaaaaucacuaacauua

SEQ ID NO: 3734122 - RNA, 13 nt, Human
uaaaaucagccaa

SEQ ID NO: 3734123 - RNA, 15 nt, Human
uaaaaucagccaauu

SEQ ID NO: 3734124 - RNA, 23 nt, Human
uaaaaucagccaauuauguuaaa

SEQ ID NO: 3734125 - RNA, 20 nt, Human
uaaaaucagcuauuuuguga

SEQ ID NO: 3734126 - RNA, 21 nt, Human
uaaaaucauaaguauuuggaa

SEQ ID NO: 3734127 - RNA, 12 nt, Human
uaaaaucaugaa

SEQ ID NO: 3734128 - RNA, 13 nt, Human
uaaaaucauuucu

SEQ ID NO: 3734129 - RNA, 22 nt, Human
uaaaaucauuucugcaucagcu

SEQ ID NO: 3734130 - RNA, 17 nt, Human
uaaaauccauacauuug

SEQ ID NO: 3734131 - RNA, 18 nt, Human
uaaaauccauacauuugu

SEQ ID NO: 3734132 - RNA, 23 nt, Human
uaaaauccccaugccuguggcug

SEQ ID NO: 3734133 - RNA, 20 nt, Human
uaaaauccugcuuaaaacuu

SEQ ID NO: 3734134 - RNA, 15 nt, Human
uaaaaucuauucugu

SEQ ID NO: 3734135 - RNA, 17 nt, Human
uaaaaucuccuaaaugc

SEQ ID NO: 3734136 - RNA, 21 nt, Human
uaaaaucugagggaaauguuu

SEQ ID NO: 3734137 - RNA, 20 nt, Human
uaaaaucugauauguauugu

SEQ ID NO: 3734138 - RNA, 14 nt, Human
uaaaaucugucacg

SEQ ID NO: 3734139 - RNA, 18 nt, Human
uaaaaucuuauuaaaguu

SEQ ID NO: 3734140 - RNA, 19 nt, Human
uaaaaucuuauuaaaguuu

SEQ ID NO: 3734141 - RNA, 21 nt, Human
uaaaaucuuauuaaaguuuca

SEQ ID NO: 3734142 - RNA, 20 nt, Human
uaaaaucuuggcacagaaac

SEQ ID NO: 3734143 - RNA, 19 nt, Human
uaaaaucuugucaugugua

SEQ ID NO: 3734144 - RNA, 19 nt, Human
uaaaaucuuucuuucuuag

SEQ ID NO: 3734145 - RNA, 15 nt, Human
uaaaaucuuuucuau

SEQ ID NO: 3734146 - RNA, 14 nt, Human
uaaaaugacaauca

SEQ ID NO: 3734147 - RNA, 15 nt, Human
uaaaaugagaaaucu

SEQ ID NO: 3734148 - RNA, 16 nt, Human
uaaaaugagaaaucua

SEQ ID NO: 3734149 - RNA, 17 nt, Human
uaaaaugauuguaaaau

SEQ ID NO: 3734150 - RNA, 16 nt, Human
uaaaaugauuguagua

SEQ ID NO: 3734151 - RNA, 18 nt, Human
uaaaaugauuuuaucugu

SEQ ID NO: 3734152 - RNA, 12 nt, Human
uaaaaugcaaua

SEQ ID NO: 3734153 - RNA, 19 nt, Human
uaaaaugcaugauuuugua

SEQ ID NO: 3734154 - RNA, 17 nt, Human
uaaaaugccucagugua

SEQ ID NO: 3734155 - RNA, 17 nt, Human
uaaaaugcuagguucua

SEQ ID NO: 3734156 - RNA, 20 nt, Human
uaaaaugcuagguucuaccu

SEQ ID NO: 3734157 - RNA, 21 nt, Human
uaaaaugcuucacuguacgua

SEQ ID NO: 3734158 - RNA, 12 nt, Human
uaaaauggaauu

SEQ ID NO: 3734159 - RNA, 13 nt, Human
uaaaauggaauug

SEQ ID NO: 3734160 - RNA, 15 nt, Human
uaaaauggaauugaa

SEQ ID NO: 3734161 - RNA, 22 nt, Human
uaaaauggaugccuugaauaau

SEQ ID NO: 3734162 - RNA, 22 nt, Human
uaaaauggcaacaaacugcaca

SEQ ID NO: 3734163 - RNA, 21 nt, Human
uaaaauggugaagaacuagca

SEQ ID NO: 3734164 - RNA, 16 nt, Human
uaaaaugguguuuuca

SEQ ID NO: 3734165 - RNA, 13 nt, Human
uaaaauguaaaaa

SEQ ID NO: 3734166 - RNA, 22 nt, Human
uaaaauguacauguauuaaauu

SEQ ID NO: 3734167 - RNA, 15 nt, Human
uaaaauguauaaguu

SEQ ID NO: 3734168 - RNA, 15 nt, Human
uaaaauguaucaaca

SEQ ID NO: 3734169 - RNA, 17 nt, Human
uaaaauguaucuaagaa

SEQ ID NO: 3734170 - RNA, 19 nt, Human
uaaaauguaugcauguugu

SEQ ID NO: 3734171 - RNA, 12 nt, Human
uaaaauguauua

SEQ ID NO: 3734172 - RNA, 13 nt, Human
uaaaauguauuuu

SEQ ID NO: 3734173 - RNA, 14 nt, Human
uaaaauguauuuuu

SEQ ID NO: 3734174 - RNA, 19 nt, Human
uaaaauguccaguaagauc

SEQ ID NO: 3734175 - RNA, 15 nt, Human
uaaaaugucuuucca

SEQ ID NO: 3734176 - RNA, 22 nt, Human
uaaaaugucuuuccaaauuauu

SEQ ID NO: 3734177 - RNA, 11 nt, Human
uaaaaugugaa

SEQ ID NO: 3734178 - RNA, 17 nt, Human
uaaaaugugauguucua

SEQ ID NO: 3734179 - RNA, 18 nt, Human
uaaaaugugauuuuucug

SEQ ID NO: 3734180 - RNA, 20 nt, Human
uaaaaugugggauuaugggu

SEQ ID NO: 3734181 - RNA, 18 nt, Human
uaaaauguguugaaacug

SEQ ID NO: 3734182 - RNA, 19 nt, Human
uaaaauguguugaaacugc

SEQ ID NO: 3734183 - RNA, 17 nt, Human
uaaaauguucacuuuug

SEQ ID NO: 3734184 - RNA, 18 nt, Human
uaaaauguugaaaaguca

SEQ ID NO: 3734185 - RNA, 14 nt, Human
uaaaauguuuucag

SEQ ID NO: 3734186 - RNA, 16 nt, Human
uaaaauguuuucagcu

SEQ ID NO: 3734187 - RNA, 19 nt, Human
uaacugaauaccacucugu

SEQ ID NO: 3734188 - RNA, 14 nt, Human
uaacugacaaauca

SEQ ID NO: 3734189 - RNA, 18 nt, Human
uaacugacaaaucaaguu

SEQ ID NO: 3734190 - RNA, 20 nt, Human
uaacugacaaaucaaguuuc

SEQ ID NO: 3734191 - RNA, 16 nt, Human
uaacugacaagccauc

SEQ ID NO: 3734192 - RNA, 20 nt, Human
uaacugacaagccaucuuga

SEQ ID NO: 3734193 - RNA, 21 nt, Human
uaacugacaagcuccauuuaa

SEQ ID NO: 3734194 - RNA, 17 nt, Human
uaacugacccucccuuc

SEQ ID NO: 3734195 - RNA, 23 nt, Human
uaacugcaaccuuguuuauuaaa

SEQ ID NO: 3734196 - RNA, 14 nt, Human
uaacugcauacacu

SEQ ID NO: 3734197 - RNA, 16 nt, Human
uaacugcauuuuuaga

SEQ ID NO: 3734198 - RNA, 18 nt, Human
uaacugccuuaaaacuuu

SEQ ID NO: 3734199 - RNA, 21 nt, Human
uaacugcuuucuguuccaaau

SEQ ID NO: 3734200 - RNA, 22 nt, Human
uaacuggaaaacagaacacuua

SEQ ID NO: 3734201 - RNA, 13 nt, Human
uaacuggaaagaa

SEQ ID NO: 3734202 - RNA, 18 nt, Human
uaacuggagccccaucag

SEQ ID NO: 3734203 - RNA, 17 nt, Human
uaacugggggaaaagau

SEQ ID NO: 3734204 - RNA, 15 nt, Human
uaacuguaaagaugu

SEQ ID NO: 3734205 - RNA, 18 nt, Human
uaacuguaauuauuugaa

SEQ ID NO: 3734206 - RNA, 16 nt, Human
uaacuguauauuugua

SEQ ID NO: 3734207 - RNA, 14 nt, Human
uaacuguauuugaa

SEQ ID NO: 3734208 - RNA, 22 nt, Human
uaacuguauuugaaauaagaau

SEQ ID NO: 3734209 - RNA, 22 nt, Human
uaacugucaggcugaaaacaau

SEQ ID NO: 3734210 - RNA, 11 nt, Human
uaacuguccug

SEQ ID NO: 3734211 - RNA, 12 nt, Human
uaacuguccugu

SEQ ID NO: 3734212 - RNA, 23 nt, Human
uaacuguccuuuuucuucccuua

SEQ ID NO: 3734213 - RNA, 18 nt, Human
uaacugugccaguucuuu

SEQ ID NO: 3734214 - RNA, 15 nt, Human
uaacuguguacuguu

SEQ ID NO: 3734215 - RNA, 11 nt, Human
uaacuguguau

SEQ ID NO: 3734216 - RNA, 13 nt, Human
uaacuguguaugu

SEQ ID NO: 3734217 - RNA, 14 nt, Human
uaacuguguaugua

SEQ ID NO: 3734218 - RNA, 15 nt, Human
uaacuguguauguac

SEQ ID NO: 3734219 - RNA, 15 nt, Human
uaacugugucauuug

SEQ ID NO: 3734220 - RNA, 21 nt, Human
uaacuguuacaguaaugucau

SEQ ID NO: 3734221 - RNA, 19 nt, Human
uaacuguuaccauuggaaa

SEQ ID NO: 3734222 - RNA, 21 nt, Human
uaacuguuauuuauaaucacu

SEQ ID NO: 3734223 - RNA, 15 nt, Human
uaacuguuuauaugu

SEQ ID NO: 3734224 - RNA, 20 nt, Human
uaacuuaaaaauguaaauau

SEQ ID NO: 3734225 - RNA, 17 nt, Human
uaacuuaaauaguauuu

SEQ ID NO: 3734226 - RNA, 14 nt, Human
uaacuuaacugaaa

SEQ ID NO: 3734227 - RNA, 16 nt, Human
uaacuuaacugaaaug

SEQ ID NO: 3734228 - RNA, 16 nt, Human
uaacuuaauaguauuu

SEQ ID NO: 3734229 - RNA, 16 nt, Human
uaacuuaaugaaaaca

SEQ ID NO: 3734230 - RNA, 17 nt, Human
uaacuuacccuuaggga

SEQ ID NO: 3734231 - RNA, 15 nt, Human
uaacuuauauuaaua

SEQ ID NO: 3734232 - RNA, 15 nt, Human
uaacuuauucaaaga

SEQ ID NO: 3734233 - RNA, 19 nt, Human
uaacuuauugcugauuuua

SEQ ID NO: 3734234 - RNA, 23 nt, Human
uaacuuauugcugauuuuaaugg

SEQ ID NO: 3734235 - RNA, 15 nt, Human
uaacuuauuuagaga

SEQ ID NO: 3734236 - RNA, 20 nt, Human
uaacuucccugaaaaaucua

SEQ ID NO: 3734237 - RNA, 14 nt, Human
uaacuuccuguacu

SEQ ID NO: 3734238 - RNA, 17 nt, Human
uaacuucuaaaacugua

SEQ ID NO: 3734239 - RNA, 23 nt, Human
uaacuucugauagcguuggaauu

SEQ ID NO: 3734240 - RNA, 18 nt, Human
uaacuucuuaaaaguugu

SEQ ID NO: 3734241 - RNA, 18 nt, Human
uaacuucuuauggaauug

SEQ ID NO: 3734242 - RNA, 15 nt, Human
uaacuucuugcuucu

SEQ ID NO: 3734243 - RNA, 12 nt, Human
uaacuucuuucu

SEQ ID NO: 3734244 - RNA, 23 nt, Human
uaacuucuuucuauuugacuugu

SEQ ID NO: 3734245 - RNA, 22 nt, Human
uaacuugagaguagaugguuug

SEQ ID NO: 3734246 - RNA, 12 nt, Human
uaacuugaugca

SEQ ID NO: 3734247 - RNA, 13 nt, Human
uaacuugcuuaaa

SEQ ID NO: 3734248 - RNA, 14 nt, Human
uaacuugcuuaaau

SEQ ID NO: 3734249 - RNA, 18 nt, Human
uaacuugcuuaaauguga

SEQ ID NO: 3734250 - RNA, 19 nt, Human
uaacuuggauguagccaug

SEQ ID NO: 3734251 - RNA, 20 nt, Human
uaacuugguuauacaugaca

SEQ ID NO: 3734252 - RNA, 16 nt, Human
uaacuuuauaaaucca

SEQ ID NO: 3734253 - RNA, 14 nt, Human
uaacuuuaugugua

SEQ ID NO: 3734254 - RNA, 15 nt, Human
uaacuuuauguguaa

SEQ ID NO: 3734255 - RNA, 18 nt, Human
uaacuuuauguguaaaua

SEQ ID NO: 3734256 - RNA, 18 nt, Human
uaacuuuauucuugaaag

SEQ ID NO: 3734257 - RNA, 12 nt, Human
uaacuuugcuug

SEQ ID NO: 3734258 - RNA, 24 nt, Human
uaacuuugcuugcaguagauuuuc

SEQ ID NO: 3734259 - RNA, 14 nt, Human
uaacuuuguuuuau

SEQ ID NO: 3734260 - RNA, 18 nt, Human
uaacuuuuauaaacuuua

SEQ ID NO: 3734261 - RNA, 19 nt, Human
uaacuuuuauaaacuuuac

SEQ ID NO: 3734262 - RNA, 20 nt, Human
uaacuuuuguaaauacacau

SEQ ID NO: 3734263 - RNA, 12 nt, Human
uaacuuuuguga

SEQ ID NO: 3734264 - RNA, 22 nt, Human
uaacuuuugugaauuaggcugu

SEQ ID NO: 3734265 - RNA, 16 nt, Human
uaacuuuugugugaaa

SEQ ID NO: 3734266 - RNA, 16 nt, Human
uaacuuuuuauauucu

SEQ ID NO: 3734267 - RNA, 19 nt, Human
uaacuuuuuuuuuucuuua

SEQ ID NO: 3734268 - RNA, 11 nt, Human
uaagaaaaacu

SEQ ID NO: 3734269 - RNA, 20 nt, Human
uaagaaaaacuuuuuugguu

SEQ ID NO: 3734270 - RNA, 19 nt, Human
uaagaaaaagcaaaaggca

SEQ ID NO: 3734271 - RNA, 17 nt, Human
uaagaaaaaucauguuu

SEQ ID NO: 3734272 - RNA, 21 nt, Human
uaagaaaaccaccccuuagau

SEQ ID NO: 3734273 - RNA, 15 nt, Human
uaagaaaaguauuuu

SEQ ID NO: 3734274 - RNA, 22 nt, Human
uaagaaaaguauuuugaaguuu

SEQ ID NO: 3734275 - RNA, 14 nt, Human
uaagaaaauacaau

SEQ ID NO: 3734276 - RNA, 21 nt, Human
uaagaaacacacugaggcagg

SEQ ID NO: 3734277 - RNA, 23 nt, Human
uaagaaacacacugaggcaggga

SEQ ID NO: 3734278 - RNA, 16 nt, Human
uaagaaacagagcagu

SEQ ID NO: 3734279 - RNA, 12 nt, Human
uaagaaacauug

SEQ ID NO: 3734280 - RNA, 16 nt, Human
uaagaaacauuggaag

SEQ ID NO: 3734281 - RNA, 21 nt, Human
uaagaaaccaaucaagauaaa

SEQ ID NO: 3734282 - RNA, 21 nt, Human
uaagaaacccucugucauucg

SEQ ID NO: 3734283 - RNA, 18 nt, Human
uaagaaacuuuuguaaag

SEQ ID NO: 3734284 - RNA, 24 nt, Human
uaagaaagacuaucuaaauguuga

SEQ ID NO: 3734285 - RNA, 18 nt, Human
uaagaaaggaagcauugu

SEQ ID NO: 3734286 - RNA, 20 nt, Human
uaagaaaggaagcauuguaa

SEQ ID NO: 3734287 - RNA, 21 nt, Human
uaagaaaggaagcauuguaaa

SEQ ID NO: 3734288 - RNA, 23 nt, Human
uaagaaaggaagcauuguaaaau

SEQ ID NO: 3734289 - RNA, 19 nt, Human
uaagaaauaaaacuguuaa

SEQ ID NO: 3734290 - RNA, 18 nt, Human
uaagaaauaucugugaaa

SEQ ID NO: 3734291 - RNA, 12 nt, Human
uaagaaauaugu

SEQ ID NO: 3734292 - RNA, 15 nt, Human
uaagaaaucaaguaa

SEQ ID NO: 3734293 - RNA, 19 nt, Human
uaagaaaucucccaugugc

SEQ ID NO: 3734294 - RNA, 22 nt, Human
uaagaaaucucccaugugcaua

SEQ ID NO: 3734295 - RNA, 15 nt, Human
uaagaaaucuguuuu

SEQ ID NO: 3734296 - RNA, 18 nt, Human
uaagaaauguauaaacuu

SEQ ID NO: 3734297 - RNA, 21 nt, Human
uaagaaauugaauacuuugaa

SEQ ID NO: 3734298 - RNA, 23 nt, Human
uaagaacccauggaaaaaugcca

SEQ ID NO: 3734299 - RNA, 15 nt, Human
uaagaacgaggauuu

SEQ ID NO: 3734300 - RNA, 17 nt, Human
uaagaacuaaagaagau

SEQ ID NO: 3734301 - RNA, 22 nt, Human
uaagaacugcuuucuuucguuu

SEQ ID NO: 3734302 - RNA, 13 nt, Human
uaagaagaaacua

SEQ ID NO: 3734303 - RNA, 15 nt, Human
uaagaagcuguugua

SEQ ID NO: 3734304 - RNA, 19 nt, Human
uaagaagcuguuguacauu

SEQ ID NO: 3734305 - RNA, 16 nt, Human
uaagaagcuucuaaua

SEQ ID NO: 3734306 - RNA, 19 nt, Human
uaagaagcuucuaauaaau

SEQ ID NO: 3734307 - RNA, 17 nt, Human
uaagaaggcaauauuaa

SEQ ID NO: 3734308 - RNA, 13 nt, Human
uaagaagugaaaa

SEQ ID NO: 3734309 - RNA, 17 nt, Human
uaagaauaaaauguuga

SEQ ID NO: 3734310 - RNA, 14 nt, Human
uaagaauaauaaaa

SEQ ID NO: 3734311 - RNA, 23 nt, Human
uaagaauaccacaucaaauaaga

SEQ ID NO: 3734312 - RNA, 19 nt, Human
uaagaauagaacaacauau

SEQ ID NO: 3734313 - RNA, 17 nt, Human
uaagaaucagaguagaa

SEQ ID NO: 3734314 - RNA, 18 nt, Human
uaagaaucagaguagaaa

SEQ ID NO: 3734315 - RNA, 21 nt, Human
uaagaaucuagcaagaauuga

SEQ ID NO: 3734316 - RNA, 14 nt, Human
uaagaaucuuuaga

SEQ ID NO: 3734317 - RNA, 15 nt, Human
uaagaaugaaauacu

SEQ ID NO: 3734318 - RNA, 21 nt, Human
uaagaaugaaauacuguuuga

SEQ ID NO: 3734319 - RNA, 18 nt, Human
uaagaaugaguuucuuag

SEQ ID NO: 3734320 - RNA, 20 nt, Human
uaagaaugaguuucuuagac

SEQ ID NO: 3734321 - RNA, 22 nt, Human
uaagaaugcugguuuuccuaaa

SEQ ID NO: 3734322 - RNA, 23 nt, Human
uaagaaugcugguuuuccuaaau

SEQ ID NO: 3734323 - RNA, 12 nt, Human
uaagaauuauuu

SEQ ID NO: 3734324 - RNA, 18 nt, Human
uaagaauucaaacugggg

SEQ ID NO: 3734325 - RNA, 13 nt, Human
uaagaauucugau

SEQ ID NO: 3734326 - RNA, 13 nt, Human
uaagaauugacca

SEQ ID NO: 3734327 - RNA, 18 nt, Human
uaagaauugaguaauggu

SEQ ID NO: 3734328 - RNA, 12 nt, Human
uaagaauuugca

SEQ ID NO: 3734329 - RNA, 13 nt, Human
uaagaauuugcau

SEQ ID NO: 3734330 - RNA, 23 nt, Human
uaagacacaaaugcaugaacaag

SEQ ID NO: 3734331 - RNA, 17 nt, Human
uaagacagcauguguua

SEQ ID NO: 3734332 - RNA, 12 nt, Human
uaagacauaacg

SEQ ID NO: 3734333 - RNA, 21 nt, Human
uaagacauaacguuuuuccuu

SEQ ID NO: 3734334 - RNA, 20 nt, Human
uaagacauacuccuuccauc

SEQ ID NO: 3734335 - RNA, 19 nt, Human
uaagacaugauuuccuuga

SEQ ID NO: 3734336 - RNA, 13 nt, Human
uaaaauuaaagaa

SEQ ID NO: 3734337 - RNA, 14 nt, Human
uaaaauuaaagaaa

SEQ ID NO: 3734338 - RNA, 14 nt, Human
uaaaauuaagaaug

SEQ ID NO: 3734339 - RNA, 15 nt, Human
uaaaauuaagaaugu

SEQ ID NO: 3734340 - RNA, 19 nt, Human
uaaaauuacaacuaaguga

SEQ ID NO: 3734341 - RNA, 15 nt, Human
uaaaauuauaccugu

SEQ ID NO: 3734342 - RNA, 19 nt, Human
uaaaauuauggaaacagau

SEQ ID NO: 3734343 - RNA, 13 nt, Human
uaaaauuauuuca

SEQ ID NO: 3734344 - RNA, 14 nt, Human
uaaaauuauuugca

SEQ ID NO: 3734345 - RNA, 12 nt, Human
uaaaauuccacu

SEQ ID NO: 3734346 - RNA, 13 nt, Human
uaaaauucuaaau

SEQ ID NO: 3734347 - RNA, 13 nt, Human
uaaaauugaaagg

SEQ ID NO: 3734348 - RNA, 13 nt, Human
uaaaauugcaugg

SEQ ID NO: 3734349 - RNA, 15 nt, Human
uaaaauugccauauu

SEQ ID NO: 3734350 - RNA, 14 nt, Human
uaaaauuguauaga

SEQ ID NO: 3734351 - RNA, 16 nt, Human
uaaaauuguauagaga

SEQ ID NO: 3734352 - RNA, 23 nt, Human
uaaaauuguauagagauaugcag

SEQ ID NO: 3734353 - RNA, 12 nt, Human
uaaaauuguuau

SEQ ID NO: 3734354 - RNA, 12 nt, Human
uaaaauuugaaa

SEQ ID NO: 3734355 - RNA, 17 nt, Human
uaaaauuugaaacauug

SEQ ID NO: 3734356 - RNA, 13 nt, Human
uaaaauuuguucu

SEQ ID NO: 3734357 - RNA, 20 nt, Human
uaaaauuuguucuuguauuu

SEQ ID NO: 3734358 - RNA, 21 nt, Human
uaaaauuuuaggcaaguuuuc

SEQ ID NO: 3734359 - RNA, 22 nt, Human
uaaaauuuuaggcacucuuaaa

SEQ ID NO: 3734360 - RNA, 19 nt, Human
uaaaauuuugcuuuuaauu

SEQ ID NO: 3734361 - RNA, 20 nt, Human
uaaaauuuuuuuagaaagca

SEQ ID NO: 3734362 - RNA, 16 nt, Human
uaaaauuuuuuugguc

SEQ ID NO: 3734363 - RNA, 19 nt, Human
uaaaauuuuuuuucauguu

SEQ ID NO: 3734364 - RNA, 15 nt, Human
uaaacaaaauagaaa

SEQ ID NO: 3734365 - RNA, 16 nt, Human
uaaacaaaaugaagcu

SEQ ID NO: 3734366 - RNA, 22 nt, Human
uaaacaaacauuguguugacau

SEQ ID NO: 3734367 - RNA, 13 nt, Human
uaaacaaacucuu

SEQ ID NO: 3734368 - RNA, 19 nt, Human
uaaacaaacuguguaacug

SEQ ID NO: 3734369 - RNA, 13 nt, Human
uaaacaaagguug

SEQ ID NO: 3734370 - RNA, 23 nt, Human
uaaacaaaguuucagaguauauu

SEQ ID NO: 3734371 - RNA, 16 nt, Human
uaaacaaaucuuucca

SEQ ID NO: 3734372 - RNA, 19 nt, Human
uaaacaaauucauauucug

SEQ ID NO: 3734373 - RNA, 15 nt, Human
uaaacaacagcugaa

SEQ ID NO: 3734374 - RNA, 24 nt, Human
uaaacaacauugagauuaugauga

SEQ ID NO: 3734375 - RNA, 20 nt, Human
uaaacaagaccacguuucua

SEQ ID NO: 3734376 - RNA, 15 nt, Human
uaaacaagauuuuaa

SEQ ID NO: 3734377 - RNA, 23 nt, Human
uaaacaaugaaauauugcuguau

SEQ ID NO: 3734378 - RNA, 22 nt, Human
uaaacaaugaugcccugcucca

SEQ ID NO: 3734379 - RNA, 21 nt, Human
uaaacacacagauacacacac

SEQ ID NO: 3734380 - RNA, 16 nt, Human
uaaacacagucaaaau

SEQ ID NO: 3734381 - RNA, 22 nt, Human
uaaacacauuaaagguacuuug

SEQ ID NO: 3734382 - RNA, 13 nt, Human
uaaacacauuuug

SEQ ID NO: 3734383 - RNA, 23 nt, Human
uaaacacccaugaaucaaagaca

SEQ ID NO: 3734384 - RNA, 18 nt, Human
uaaacacgccugcaaacg

SEQ ID NO: 3734385 - RNA, 22 nt, Human
uaaacacucagcuguucagauu

SEQ ID NO: 3734386 - RNA, 21 nt, Human
uaaacacucuugaaaaaugca

SEQ ID NO: 3734387 - RNA, 11 nt, Human
uaaacacugug

SEQ ID NO: 3734388 - RNA, 14 nt, Human
uaaacacuguguau

SEQ ID NO: 3734389 - RNA, 13 nt, Human
uaaacagacaaua

SEQ ID NO: 3734390 - RNA, 23 nt, Human
uaaacagacuauuuaacuugagg

SEQ ID NO: 3734391 - RNA, 16 nt, Human
uaaacagacuguuaau

SEQ ID NO: 3734392 - RNA, 19 nt, Human
uaaacagauuuuuacaaau

SEQ ID NO: 3734393 - RNA, 23 nt, Human
uaaacagcuucaugccuuuguaa

SEQ ID NO: 3734394 - RNA, 18 nt, Human
uaaacaggagacaggaag

SEQ ID NO: 3734395 - RNA, 14 nt, Human
uaaacaggcccagc

SEQ ID NO: 3734396 - RNA, 17 nt, Human
uaaacaguaagauaucu

SEQ ID NO: 3734397 - RNA, 13 nt, Human
uaaacagugccug

SEQ ID NO: 3734398 - RNA, 18 nt, Human
uaaacaguugcacagcau

SEQ ID NO: 3734399 - RNA, 19 nt, Human
uaaacaguugcacagcauc

SEQ ID NO: 3734400 - RNA, 15 nt, Human
uaaacauaaguguac

SEQ ID NO: 3734401 - RNA, 20 nt, Human
uaaacauauccaaguuugaa

SEQ ID NO: 3734402 - RNA, 15 nt, Human
uaaacauaugauuuc

SEQ ID NO: 3734403 - RNA, 16 nt, Human
uaaacaucacacacac

SEQ ID NO: 3734404 - RNA, 20 nt, Human
uaaacaucagguuaggcagu

SEQ ID NO: 3734405 - RNA, 17 nt, Human
uaaacauccaauauuuu

SEQ ID NO: 3734406 - RNA, 22 nt, Human
uaaacaugaaaacacuugaaau

SEQ ID NO: 3734407 - RNA, 23 nt, Human
uaaacaugcuguacauacuuuuu

SEQ ID NO: 3734408 - RNA, 16 nt, Human
uaaacaugguuacaau

SEQ ID NO: 3734409 - RNA, 12 nt, Human
uaaacauguguu

SEQ ID NO: 3734410 - RNA, 17 nt, Human
uaaacauuaaaaaugga

SEQ ID NO: 3734411 - RNA, 15 nt, Human
uaaacauuaaauguc

SEQ ID NO: 3734412 - RNA, 16 nt, Human
uaaacauuaaaugucu

SEQ ID NO: 3734413 - RNA, 20 nt, Human
uaaacauuaauagcagccuu

SEQ ID NO: 3734414 - RNA, 14 nt, Human
uaaacauucuuuua

SEQ ID NO: 3734415 - RNA, 19 nt, Human
uaaacauugguucuuguau

SEQ ID NO: 3734416 - RNA, 13 nt, Human
uaaaccacugaaa

SEQ ID NO: 3734417 - RNA, 18 nt, Human
uaaaccaguuuagauuuc

SEQ ID NO: 3734418 - RNA, 16 nt, Human
uaaaccaucucccugg

SEQ ID NO: 3734419 - RNA, 18 nt, Human
uaaaccaugggauaaaug

SEQ ID NO: 3734420 - RNA, 20 nt, Human
uaaaccaugggauaaaugcc

SEQ ID NO: 3734421 - RNA, 21 nt, Human
uaaaccaugggauaaaugcca

SEQ ID NO: 3734422 - RNA, 23 nt, Human
uaaacccauauuguaaaacaggu

SEQ ID NO: 3734423 - RNA, 23 nt, Human
uaaacccauuuuagucacuuuuu

SEQ ID NO: 3734424 - RNA, 15 nt, Human
uaaaccccuguccca

SEQ ID NO: 3734425 - RNA, 16 nt, Human
uaaacccucagagccu

SEQ ID NO: 3734426 - RNA, 13 nt, Human
uaaaccuaaaaaa

SEQ ID NO: 3734427 - RNA, 15 nt, Human
uaaaccuaaaaaaga

SEQ ID NO: 3734428 - RNA, 16 nt, Human
uaaaccuaaaaaagau

SEQ ID NO: 3734429 - RNA, 11 nt, Human
uaaaccuaccu

SEQ ID NO: 3734430 - RNA, 20 nt, Human
uaaaccuguuuuuuuuucau

SEQ ID NO: 3734431 - RNA, 18 nt, Human
uaaacgauuuaauucucu

SEQ ID NO: 3734432 - RNA, 16 nt, Human
uaaacgauuuuuaaaa

SEQ ID NO: 3734433 - RNA, 20 nt, Human
uaaacgauuuuuaaaaugua

SEQ ID NO: 3734434 - RNA, 21 nt, Human
uaaacgauuuuuaaaauguac

SEQ ID NO: 3734435 - RNA, 19 nt, Human
uaaacgcaagcugagcugg

SEQ ID NO: 3734436 - RNA, 16 nt, Human
uaaacgcauuaucagc

SEQ ID NO: 3734437 - RNA, 17 nt, Human
uaaacggauuauuuuuu

SEQ ID NO: 3734438 - RNA, 23 nt, Human
uaaacggauuauuuuuucagacc

SEQ ID NO: 3734439 - RNA, 15 nt, Human
uaaacggauuccaaa

SEQ ID NO: 3734440 - RNA, 21 nt, Human
uaaacgguucaguuucuucug

SEQ ID NO: 3734441 - RNA, 13 nt, Human
uaaacgucuuaaa

SEQ ID NO: 3734442 - RNA, 17 nt, Human
uaaacgucuuaaauauu

SEQ ID NO: 3734443 - RNA, 22 nt, Human
uaaacgugaugaucagcuguuu

SEQ ID NO: 3734444 - RNA, 13 nt, Human
uaaacguggagaa

SEQ ID NO: 3734445 - RNA, 15 nt, Human
uaaacguuucaguaa

SEQ ID NO: 3734446 - RNA, 13 nt, Human
uaaacuaaacacg

SEQ ID NO: 3734447 - RNA, 22 nt, Human
uaaacuacauuagguugugaau

SEQ ID NO: 3734448 - RNA, 15 nt, Human
uaaacuacucuuuga

SEQ ID NO: 3734449 - RNA, 15 nt, Human
uaaacuagaugaccu

SEQ ID NO: 3734450 - RNA, 17 nt, Human
uaaacuagcauaucugc

SEQ ID NO: 3734451 - RNA, 19 nt, Human
uaaacuagcauaucugccu

SEQ ID NO: 3734452 - RNA, 17 nt, Human
uaaacuaggaaaauugg

SEQ ID NO: 3734453 - RNA, 14 nt, Human
uaaacuauauuuuc

SEQ ID NO: 3734454 - RNA, 19 nt, Human
uaaacucaaaacuuaacau

SEQ ID NO: 3734455 - RNA, 20 nt, Human
uaaacucaaaacuuaacaua

SEQ ID NO: 3734456 - RNA, 19 nt, Human
uaaacucaaaauauuugua

SEQ ID NO: 3734457 - RNA, 23 nt, Human
uaaacucagcaucaaaauauuuc

SEQ ID NO: 3734458 - RNA, 18 nt, Human
uaaacucaucugaaaugu

SEQ ID NO: 3734459 - RNA, 22 nt, Human
uaaacucaucugaaauguuaca

SEQ ID NO: 3734460 - RNA, 15 nt, Human
uaaacuccuuccugg

SEQ ID NO: 3734461 - RNA, 13 nt, Human
uaaacucugaaua

SEQ ID NO: 3734462 - RNA, 20 nt, Human
uaaacucugagugcaaacuu

SEQ ID NO: 3734463 - RNA, 13 nt, Human
uaaacucugcauc

SEQ ID NO: 3734464 - RNA, 15 nt, Human
uaaacucuguugcaa

SEQ ID NO: 3734465 - RNA, 14 nt, Human
uaaacugacuauca

SEQ ID NO: 3734466 - RNA, 15 nt, Human
uaaacugacuaucau

SEQ ID NO: 3734467 - RNA, 18 nt, Human
uaaacugacuaucauaaa

SEQ ID NO: 3734468 - RNA, 21 nt, Human
uaaacugcccccucugcccug

SEQ ID NO: 3734469 - RNA, 22 nt, Human
uaaacugcccccucugcccugc

SEQ ID NO: 3734470 - RNA, 23 nt, Human
uaaacugcccccucugcccugcg

SEQ ID NO: 3734471 - RNA, 13 nt, Human
uaaacugcccugu

SEQ ID NO: 3734472 - RNA, 22 nt, Human
uaaacuggaauuaaaaggauag

SEQ ID NO: 3734473 - RNA, 13 nt, Human
uaaacuggagacu

SEQ ID NO: 3734474 - RNA, 12 nt, Human
uaaacuguacag

SEQ ID NO: 3734475 - RNA, 15 nt, Human
uaaacuguacagugu

SEQ ID NO: 3734476 - RNA, 17 nt, Human
uaaacuguacagugucu

SEQ ID NO: 3734477 - RNA, 18 nt, Human
uaaacuguacagugucuu

SEQ ID NO: 3734478 - RNA, 19 nt, Human
uaaacuguacagugucuuu

SEQ ID NO: 3734479 - RNA, 17 nt, Human
uaaacuguccucuuuca

SEQ ID NO: 3734480 - RNA, 23 nt, Human
uaaacuguccucuuucagaaaac

SEQ ID NO: 3734481 - RNA, 14 nt, Human
uaaacugugcacca

SEQ ID NO: 3734482 - RNA, 15 nt, Human
uaaacuguguacaua

SEQ ID NO: 3734483 - RNA, 17 nt, Human
uaaacuguguauuccaa

SEQ ID NO: 3734484 - RNA, 20 nt, Human
uaaacuguguggacugugau

SEQ ID NO: 3734485 - RNA, 21 nt, Human
uaaacuguuaacuuauucaaa

SEQ ID NO: 3734486 - RNA, 19 nt, Human
uaagaccaccucaaauuua

SEQ ID NO: 3734487 - RNA, 13 nt, Human
uaagaccuggcag

SEQ ID NO: 3734488 - RNA, 18 nt, Human
uaagaccuggcagcucug

SEQ ID NO: 3734489 - RNA, 20 nt, Human
uaagacggauuuauuuuucc

SEQ ID NO: 3734490 - RNA, 17 nt, Human
uaagacuaaaucuguaa

SEQ ID NO: 3734491 - RNA, 19 nt, Human
uaagacuauauauauaaau

SEQ ID NO: 3734492 - RNA, 15 nt, Human
uaagacuguguauuc

SEQ ID NO: 3734493 - RNA, 20 nt, Human
uaagacuuacucuaagaucu

SEQ ID NO: 3734494 - RNA, 14 nt, Human
uaagacuugacagu

SEQ ID NO: 3734495 - RNA, 13 nt, Human
uaagacuuuacuu

SEQ ID NO: 3734496 - RNA, 15 nt, Human
uaagacuuugggaua

SEQ ID NO: 3734497 - RNA, 15 nt, Human
uaagagaaaagagag

SEQ ID NO: 3734498 - RNA, 18 nt, Human
uaagagaaaagagagaaa

SEQ ID NO: 3734499 - RNA, 21 nt, Human
uaagagaaacuuuauacauua

SEQ ID NO: 3734500 - RNA, 13 nt, Human
uaagagaaagaaa

SEQ ID NO: 3734501 - RNA, 15 nt, Human
uaagagaaaugagcu

SEQ ID NO: 3734502 - RNA, 14 nt, Human
uaagagaaguagaa

SEQ ID NO: 3734503 - RNA, 19 nt, Human
uaagagaauauuuuaagua

SEQ ID NO: 3734504 - RNA, 20 nt, Human
uaagagacagaauguaucug

SEQ ID NO: 3734505 - RNA, 13 nt, Human
uaagagacaguca

SEQ ID NO: 3734506 - RNA, 18 nt, Human
uaagagagaaaucugaaa

SEQ ID NO: 3734507 - RNA, 22 nt, Human
uaagagcaccuuccucacuucc

SEQ ID NO: 3734508 - RNA, 16 nt, Human
uaagagcuagcgcugc

SEQ ID NO: 3734509 - RNA, 14 nt, Human
uaagagcuauacag

SEQ ID NO: 3734510 - RNA, 15 nt, Human
uaagagcuuuacaaa

SEQ ID NO: 3734511 - RNA, 17 nt, Human
uaagaggcugcccuccu

SEQ ID NO: 3734512 - RNA, 22 nt, Human
uaagagggagggagggcuccag

SEQ ID NO: 3734513 - RNA, 23 nt, Human
uaagagggagggagggcuccaga

SEQ ID NO: 3734514 - RNA, 18 nt, Human
uaagagggcacacacugu

SEQ ID NO: 3734515 - RNA, 20 nt, Human
uaagagggcacacacugugu

SEQ ID NO: 3734516 - RNA, 21 nt, Human
uaagaguagaaacugcaggga

SEQ ID NO: 3734517 - RNA, 22 nt, Human
uaagaguaugugccaggaaacu

SEQ ID NO: 3734518 - RNA, 16 nt, Human
uaagaguguagaagca

SEQ ID NO: 3734519 - RNA, 21 nt, Human
uaagaguuaguuucuuuggga

SEQ ID NO: 3734520 - RNA, 13 nt, Human
uaagauaaaaaag

SEQ ID NO: 3734521 - RNA, 12 nt, Human
uaagauaauaau

SEQ ID NO: 3734522 - RNA, 18 nt, Human
uaagauaauaguuuacau

SEQ ID NO: 3734523 - RNA, 13 nt, Human
uaagauaauuaua

SEQ ID NO: 3734524 - RNA, 22 nt, Human
uaagauacaaauuaauuuuacu

SEQ ID NO: 3734525 - RNA, 23 nt, Human
uaagauauacuuguuuuuguaaa

SEQ ID NO: 3734526 - RNA, 17 nt, Human
uaagauaucucaaugaa

SEQ ID NO: 3734527 - RNA, 21 nt, Human
uaagauaugggacauuuuuga

SEQ ID NO: 3734528 - RNA, 18 nt, Human
uaagaucacuguuuagau

SEQ ID NO: 3734529 - RNA, 16 nt, Human
uaagaucuuagauucu

SEQ ID NO: 3734530 - RNA, 20 nt, Human
uaagaucuuagauucucugu

SEQ ID NO: 3734531 - RNA, 17 nt, Human
uaagaugacauugcuaa

SEQ ID NO: 3734532 - RNA, 19 nt, Human
uaagaugaucaucuaauuu

SEQ ID NO: 3734533 - RNA, 17 nt, Human
uaagaugcuaccuugug

SEQ ID NO: 3734534 - RNA, 24 nt, Human
uaagaugcucuaucuugcucugua

SEQ ID NO: 3734535 - RNA, 13 nt, Human
uaagaugcugggu

SEQ ID NO: 3734536 - RNA, 17 nt, Human
uaagauggaagcuucca

SEQ ID NO: 3734537 - RNA, 19 nt, Human
uaagauggaagcuuccagu

SEQ ID NO: 3734538 - RNA, 15 nt, Human
uaagauggauucuca

SEQ ID NO: 3734539 - RNA, 18 nt, Human
uaagauggauucucagau

SEQ ID NO: 3734540 - RNA, 20 nt, Human
uaagauggauucucagauau

SEQ ID NO: 3734541 - RNA, 18 nt, Human
uaagaugggcagcuaguu

SEQ ID NO: 3734542 - RNA, 12 nt, Human
uaagaugugaaa

SEQ ID NO: 3734543 - RNA, 16 nt, Human
uaagaugugaaaauua

SEQ ID NO: 3734544 - RNA, 18 nt, Human
uaagaugugauauucuaa

SEQ ID NO: 3734545 - RNA, 19 nt, Human
uaagaugugauauucuaag

SEQ ID NO: 3734546 - RNA, 21 nt, Human
uaagaugugauauucuaagac

SEQ ID NO: 3734547 - RNA, 22 nt, Human
uaagaugugauauucuaagacu

SEQ ID NO: 3734548 - RNA, 17 nt, Human
uaagauguguucuuauu

SEQ ID NO: 3734549 - RNA, 14 nt, Human
uaagauguuauauu

SEQ ID NO: 3734550 - RNA, 15 nt, Human
uaagauguuauauuu

SEQ ID NO: 3734551 - RNA, 19 nt, Human
uaagauguuauauuuuucu

SEQ ID NO: 3734552 - RNA, 17 nt, Human
uaagauguucacugugg

SEQ ID NO: 3734553 - RNA, 19 nt, Human
uaagauuacaaaucagaag

SEQ ID NO: 3734554 - RNA, 13 nt, Human
uaagauuagaaug

SEQ ID NO: 3734555 - RNA, 18 nt, Human
uaagauuagaaugaaaau

SEQ ID NO: 3734556 - RNA, 15 nt, Human
uaagauuauaauugu

SEQ ID NO: 3734557 - RNA, 15 nt, Human
uaagauuauagauuc

SEQ ID NO: 3734558 - RNA, 16 nt, Human
uaagauuauagauucu

SEQ ID NO: 3734559 - RNA, 17 nt, Human
uaagauuauagauucua

SEQ ID NO: 3734560 - RNA, 18 nt, Human
uaagauuauagauucuaa

SEQ ID NO: 3734561 - RNA, 19 nt, Human
uaagauuauagauucuaaa

SEQ ID NO: 3734562 - RNA, 23 nt, Human
uaagauuauagauucuaaagauu

SEQ ID NO: 3734563 - RNA, 16 nt, Human
uaagauuaucugggga

SEQ ID NO: 3734564 - RNA, 14 nt, Human
uaagauucauauuu

SEQ ID NO: 3734565 - RNA, 14 nt, Human
uaagauuccuuuuc

SEQ ID NO: 3734566 - RNA, 11 nt, Human
uaagauucuaa

SEQ ID NO: 3734567 - RNA, 12 nt, Human
uaagauucuaau

SEQ ID NO: 3734568 - RNA, 14 nt, Human
uaagauucuaauga

SEQ ID NO: 3734569 - RNA, 15 nt, Human
uaagauucuaaugau

SEQ ID NO: 3734570 - RNA, 13 nt, Human
uaagauucuagau

SEQ ID NO: 3734571 - RNA, 13 nt, Human
uaagauucugauu

SEQ ID NO: 3734572 - RNA, 13 nt, Human
uaagauucuuggu

SEQ ID NO: 3734573 - RNA, 20 nt, Human
uaagauucuugguauuugga

SEQ ID NO: 3734574 - RNA, 14 nt, Human
uaagauucuuuuaa

SEQ ID NO: 3734575 - RNA, 23 nt, Human
uaagauugauaucuauaaaauag

SEQ ID NO: 3734576 - RNA, 21 nt, Human
uaagauuuaauuugccaaaau

SEQ ID NO: 3734577 - RNA, 15 nt, Human
uaagauuuguuuuua

SEQ ID NO: 3734578 - RNA, 18 nt, Human
uaagauuuguuuuuaaac

SEQ ID NO: 3734579 - RNA, 20 nt, Human
uaagauuuguuuuuaaacug

SEQ ID NO: 3734580 - RNA, 23 nt, Human
uaagauuuguuuuuaaacuguac

SEQ ID NO: 3734581 - RNA, 14 nt, Human
uaagauuuuacaaa

SEQ ID NO: 3734582 - RNA, 20 nt, Human
uaagauuuuucucaaaguuu

SEQ ID NO: 3734583 - RNA, 21 nt, Human
uaagauuuuucucaaaguuuu

SEQ ID NO: 3734584 - RNA, 21 nt, Human
uaagcaaagcacccauuucaa

SEQ ID NO: 3734585 - RNA, 19 nt, Human
uaagcaaaggggacagcug

SEQ ID NO: 3734586 - RNA, 22 nt, Human
uaagcaaaggggacagcugugu

SEQ ID NO: 3734587 - RNA, 12 nt, Human
uaagcaaauacu

SEQ ID NO: 3734588 - RNA, 17 nt, Human
uaauauggguucuuuuu

SEQ ID NO: 3734589 - RNA, 15 nt, Human
uaauauguauuuuau

SEQ ID NO: 3734590 - RNA, 23 nt, Human
uaauauguuaaccucagugucau

SEQ ID NO: 3734591 - RNA, 17 nt, Human
uaauauuaaaagucaca

SEQ ID NO: 3734592 - RNA, 14 nt, Human
uaauauuaaagcca

SEQ ID NO: 3734593 - RNA, 16 nt, Human
uaauauuaaagccaug

SEQ ID NO: 3734594 - RNA, 21 nt, Human
uaauauuaaagccauguuuau

SEQ ID NO: 3734595 - RNA, 22 nt, Human
uaauauuaauuuucuacaaaua

SEQ ID NO: 3734596 - RNA, 19 nt, Human
uaauauuaccuaaugaaag

SEQ ID NO: 3734597 - RNA, 22 nt, Human
uaauauuaccuaaugaaaguga

SEQ ID NO: 3734598 - RNA, 17 nt, Human
uaauauugaaaauugaa

SEQ ID NO: 3734599 - RNA, 21 nt, Human
uaauauugaaaauugaaaagu

SEQ ID NO: 3734600 - RNA, 18 nt, Human
uaauauugacuuguauau

SEQ ID NO: 3734601 - RNA, 14 nt, Human
uaauauugagaaag

SEQ ID NO: 3734602 - RNA, 13 nt, Human
uaauauuuaaaca

SEQ ID NO: 3734603 - RNA, 13 nt, Human
uaauauuuaacau

SEQ ID NO: 3734604 - RNA, 14 nt, Human
uaauauuuaaugga

SEQ ID NO: 3734605 - RNA, 15 nt, Human
uaauauuuacaaugu

SEQ ID NO: 3734606 - RNA, 16 nt, Human
uaauauuuauauauuu

SEQ ID NO: 3734607 - RNA, 16 nt, Human
uaauauuuauugcuuu

SEQ ID NO: 3734608 - RNA, 14 nt, Human
uaauauuugcugac

SEQ ID NO: 3734609 - RNA, 13 nt, Human
uaauauuuugcac

SEQ ID NO: 3734610 - RNA, 17 nt, Human
uaauauuuuuacaugca

SEQ ID NO: 3734611 - RNA, 21 nt, Human
uaaucaaaagggaaaagaaga

SEQ ID NO: 3734612 - RNA, 18 nt, Human
uaaucaaagccagggucu

SEQ ID NO: 3734613 - RNA, 18 nt, Human
uaaucaagagccuuaaaa

SEQ ID NO: 3734614 - RNA, 23 nt, Human
uaaucaagagccuuaaaacauca

SEQ ID NO: 3734615 - RNA, 14 nt, Human
uaaucaaguugaau

SEQ ID NO: 3734616 - RNA, 22 nt, Human
uaaucaauaaacgauuuaauuc

SEQ ID NO: 3734617 - RNA, 18 nt, Human
uaaucaauguuucuucua

SEQ ID NO: 3734618 - RNA, 23 nt, Human
uaaucaauuaauuuuuuuauugu

SEQ ID NO: 3734619 - RNA, 20 nt, Human
uaaucaauuuaaacccauuu

SEQ ID NO: 3734620 - RNA, 15 nt, Human
uaaucaccauguaag

SEQ ID NO: 3734621 - RNA, 15 nt, Human
uaaucacgcuuuccu

SEQ ID NO: 3734622 - RNA, 13 nt, Human
uaaucacugugua

SEQ ID NO: 3734623 - RNA, 16 nt, Human
uaaucacuguguauau

SEQ ID NO: 3734624 - RNA, 20 nt, Human
uaaucacuguguauauuuga

SEQ ID NO: 3734625 - RNA, 21 nt, Human
uaaucacuguguauauuugau

SEQ ID NO: 3734626 - RNA, 20 nt, Human
uaaucagaaauuuuuaucag

SEQ ID NO: 3734627 - RNA, 22 nt, Human
uaaucagaauggaagagagaaa

SEQ ID NO: 3734628 - RNA, 15 nt, Human
uaaucaggcugaggu

SEQ ID NO: 3734629 - RNA, 20 nt, Human
uaaucagggaccaccagagg

SEQ ID NO: 3734630 - RNA, 15 nt, Human
uaaucagugucucac

SEQ ID NO: 3734631 - RNA, 16 nt, Human
uaaucagugucucaca

SEQ ID NO: 3734632 - RNA, 17 nt, Human
uaaucagugugucuaaa

SEQ ID NO: 3734633 - RNA, 18 nt, Human
uaaucagugugucuaaau

SEQ ID NO: 3734634 - RNA, 21 nt, Human
uaaucauauaaauagaaugua

SEQ ID NO: 3734635 - RNA, 23 nt, Human
uaaucaucuaagucaguacccac

SEQ ID NO: 3734636 - RNA, 17 nt, Human
uaaucaucuauaaagaa

SEQ ID NO: 3734637 - RNA, 21 nt, Human
uaaucaugaaauuacuuauca

SEQ ID NO: 3734638 - RNA, 13 nt, Human
uaaucaugaaugu

SEQ ID NO: 3734639 - RNA, 22 nt, Human
uaaucauucuuauuucaugaaa

SEQ ID NO: 3734640 - RNA, 15 nt, Human
uaaucauugccuggu

SEQ ID NO: 3734641 - RNA, 19 nt, Human
uaaucauuucuugggcccu

SEQ ID NO: 3734642 - RNA, 19 nt, Human
uaaucauuuguuuacauuu

SEQ ID NO: 3734643 - RNA, 21 nt, Human
uaaucauuuguuuacauuuga

SEQ ID NO: 3734644 - RNA, 13 nt, Human
uaaucauuuucau

SEQ ID NO: 3734645 - RNA, 18 nt, Human
uaaucauuuucauuccua

SEQ ID NO: 3734646 - RNA, 19 nt, Human
uaauccaauggguuuuucc

SEQ ID NO: 3734647 - RNA, 23 nt, Human
uaauccaggcagauccaggacua

SEQ ID NO: 3734648 - RNA, 14 nt, Human
uaaucccagcaauu

SEQ ID NO: 3734649 - RNA, 19 nt, Human
uaaucccagcacuuuggga

SEQ ID NO: 3734650 - RNA, 21 nt, Human
uaaucccagcaugcugagauu

SEQ ID NO: 3734651 - RNA, 20 nt, Human
uaaucccagcuacucaggag

SEQ ID NO: 3734652 - RNA, 17 nt, Human
uaauccccaguaaaauu

SEQ ID NO: 3734653 - RNA, 19 nt, Human
uaauccccaguucgccugg

SEQ ID NO: 3734654 - RNA, 14 nt, Human
uaauccccuucucc

SEQ ID NO: 3734655 - RNA, 13 nt, Human
uaaucccugcuuu

SEQ ID NO: 3734656 - RNA, 14 nt, Human
uaaucccugggcau

SEQ ID NO: 3734657 - RNA, 19 nt, Human
uaaucccugggcauugcuu

SEQ ID NO: 3734658 - RNA, 21 nt, Human
uaauccgaaucucuuuuugcu

SEQ ID NO: 3734659 - RNA, 16 nt, Human
uaauccgccaauauua

SEQ ID NO: 3734660 - RNA, 17 nt, Human
uaauccuagcugugugc

SEQ ID NO: 3734661 - RNA, 22 nt, Human
uaauccuguaggaagguacugu

SEQ ID NO: 3734662 - RNA, 19 nt, Human
uaauccuucuaguuuccca

SEQ ID NO: 3734663 - RNA, 18 nt, Human
uaaucgcuuaaagauguu

SEQ ID NO: 3734664 - RNA, 16 nt, Human
uaaucguuaugugugu

SEQ ID NO: 3734665 - RNA, 19 nt, Human
uaaucguuauguguguaua

SEQ ID NO: 3734666 - RNA, 16 nt, Human
uaaucuacugcauuua

SEQ ID NO: 3734667 - RNA, 22 nt, Human
uaaucuagaacacaggcaaaau

SEQ ID NO: 3734668 - RNA, 17 nt, Human
uaaucuagauaucgacu

SEQ ID NO: 3734669 - RNA, 17 nt, Human
uaaucuaguuuacagaa

SEQ ID NO: 3734670 - RNA, 18 nt, Human
uaaucuaguuuacagaaa

SEQ ID NO: 3734671 - RNA, 16 nt, Human
uaaucuauuggguuca

SEQ ID NO: 3734672 - RNA, 20 nt, Human
uaaucuauuggguucauuau

SEQ ID NO: 3734673 - RNA, 22 nt, Human
uaaucuauuggguucauuauug

SEQ ID NO: 3734674 - RNA, 17 nt, Human
uaaucuauuucuaugag

SEQ ID NO: 3734675 - RNA, 16 nt, Human
uaaucucagugcuuuc

SEQ ID NO: 3734676 - RNA, 19 nt, Human
uaaaugugauucaccucuu

SEQ ID NO: 3734677 - RNA, 19 nt, Human
uaaaugugcaauagaaggu

SEQ ID NO: 3734678 - RNA, 22 nt, Human
uaaaugugcaauagaaggugau

SEQ ID NO: 3734679 - RNA, 21 nt, Human
uaaaugugcauucuuuuaaaa

SEQ ID NO: 3734680 - RNA, 23 nt, Human
uaaaugugcauucuuuuaaaaga

SEQ ID NO: 3734681 - RNA, 16 nt, Human
uaaaugugccuucauu

SEQ ID NO: 3734682 - RNA, 14 nt, Human
uaaauguguacaau

SEQ ID NO: 3734683 - RNA, 20 nt, Human
uaaaugugugagugcaugua

SEQ ID NO: 3734684 - RNA, 18 nt, Human
uaaauguuaaagauguag

SEQ ID NO: 3734685 - RNA, 22 nt, Human
uaaauguuaauggauuucagaa

SEQ ID NO: 3734686 - RNA, 17 nt, Human
uaaauguuaccaaaaau

SEQ ID NO: 3734687 - RNA, 18 nt, Human
uaaauguuaguuucuugg

SEQ ID NO: 3734688 - RNA, 19 nt, Human
uaaauguuaguuucuuggu

SEQ ID NO: 3734689 - RNA, 20 nt, Human
uaaauguuaugacuauguaa

SEQ ID NO: 3734690 - RNA, 14 nt, Human
uaaauguuauguau

SEQ ID NO: 3734691 - RNA, 19 nt, Human
uaaauguuauguauauggu

SEQ ID NO: 3734692 - RNA, 15 nt, Human
uaaauguuauuucug

SEQ ID NO: 3734693 - RNA, 16 nt, Human
uaaauguuauuucugc

SEQ ID NO: 3734694 - RNA, 22 nt, Human
uaaauguucuaugguuaugaaa

SEQ ID NO: 3734695 - RNA, 15 nt, Human
uaaauguugaaagau

SEQ ID NO: 3734696 - RNA, 15 nt, Human
uaaauguugacaugg

SEQ ID NO: 3734697 - RNA, 19 nt, Human
uaaauguuucuuuuguuug

SEQ ID NO: 3734698 - RNA, 17 nt, Human
uaaauguuugacacaau

SEQ ID NO: 3734699 - RNA, 14 nt, Human
uaaauguuuuauaa

SEQ ID NO: 3734700 - RNA, 19 nt, Human
uaaauguuuuauaaguuca

SEQ ID NO: 3734701 - RNA, 14 nt, Human
uaaauguuuuguaa

SEQ ID NO: 3734702 - RNA, 16 nt, Human
uaaauguuuuguaaac

SEQ ID NO: 3734703 - RNA, 19 nt, Human
uaaauguuuuguaaacuuu

SEQ ID NO: 3734704 - RNA, 23 nt, Human
uaaauguuuuuuuuuaaagacuu

SEQ ID NO: 3734705 - RNA, 18 nt, Human
uaaauuaaaacugaauug

SEQ ID NO: 3734706 - RNA, 18 nt, Human
uaaauuaaagccuuuagu

SEQ ID NO: 3734707 - RNA, 14 nt, Human
uaaauuaaauauau

SEQ ID NO: 3734708 - RNA, 12 nt, Human
uaaauuaacuuu

SEQ ID NO: 3734709 - RNA, 15 nt, Human
uaaauuaagacaugc

SEQ ID NO: 3734710 - RNA, 12 nt, Human
uaaauuaauauc

SEQ ID NO: 3734711 - RNA, 14 nt, Human
uaaauuaauaucuu

SEQ ID NO: 3734712 - RNA, 13 nt, Human
uaaauuaaucuuu

SEQ ID NO: 3734713 - RNA, 15 nt, Human
uaaauuacauuugua

SEQ ID NO: 3734714 - RNA, 21 nt, Human
uaaauuacauuuguaauuuaa

SEQ ID NO: 3734715 - RNA, 22 nt, Human
uaaauuaccaguaaaguguaac

SEQ ID NO: 3734716 - RNA, 20 nt, Human
uaaauuacuauagcaaagua

SEQ ID NO: 3734717 - RNA, 18 nt, Human
uaaauuagaaaauauucu

SEQ ID NO: 3734718 - RNA, 21 nt, Human
uaaauuaggaauaaauaaaaa

SEQ ID NO: 3734719 - RNA, 22 nt, Human
uaaauuaggaauaaauaaaaau

SEQ ID NO: 3734720 - RNA, 23 nt, Human
uaaauuaggaggcucaacaauaa

SEQ ID NO: 3734721 - RNA, 16 nt, Human
uaaauuauaaggacug

SEQ ID NO: 3734722 - RNA, 17 nt, Human
uaaauuauaaggacugc

SEQ ID NO: 3734723 - RNA, 22 nt, Human
uaaauuauacaaauuaaaaaga

SEQ ID NO: 3734724 - RNA, 22 nt, Human
uaaauuaucaggcaaauuugca

SEQ ID NO: 3734725 - RNA, 21 nt, Human
uaaauuaugggaaucaagauu

SEQ ID NO: 3734726 - RNA, 15 nt, Human
uaaauuauguuuaua

SEQ ID NO: 3734727 - RNA, 20 nt, Human
uaaauuauguuuauauaaau

SEQ ID NO: 3734728 - RNA, 14 nt, Human
uaaauuauucaguu

SEQ ID NO: 3734729 - RNA, 17 nt, Human
uaaauuauucaguuaag

SEQ ID NO: 3734730 - RNA, 22 nt, Human
uaaauuauucaguuaagaaaaa

SEQ ID NO: 3734731 - RNA, 10 nt, Human
uaaauuauuu

SEQ ID NO: 3734732 - RNA, 20 nt, Human
uaaauucaaccacuguaaaa

SEQ ID NO: 3734733 - RNA, 23 nt, Human
uaaauucaaccacuguaaaauga

SEQ ID NO: 3734734 - RNA, 18 nt, Human
uaaauucacaaacuuuua

SEQ ID NO: 3734735 - RNA, 16 nt, Human
uaaauucacuuucauu

SEQ ID NO: 3734736 - RNA, 18 nt, Human
uaaauucacuuucauuuu

SEQ ID NO: 3734737 - RNA, 14 nt, Human
uaaauucaguccua

SEQ ID NO: 3734738 - RNA, 13 nt, Human
uaaauucauuuua

SEQ ID NO: 3734739 - RNA, 17 nt, Human
uaaauucccaacuucuc

SEQ ID NO: 3734740 - RNA, 14 nt, Human
uaaauuccucuuug

SEQ ID NO: 3734741 - RNA, 16 nt, Human
uaaauuccucuuugcu

SEQ ID NO: 3734742 - RNA, 18 nt, Human
uaaauuccucuuugcuuu

SEQ ID NO: 3734743 - RNA, 19 nt, Human
uaaauucgugauuuucaag

SEQ ID NO: 3734744 - RNA, 16 nt, Human
uaaauucuugcaaagu

SEQ ID NO: 3734745 - RNA, 18 nt, Human
uaaauucuuuuuuaaauu

SEQ ID NO: 3734746 - RNA, 13 nt, Human
uaaauugaaauau

SEQ ID NO: 3734747 - RNA, 12 nt, Human
uaaauugaauaa

SEQ ID NO: 3734748 - RNA, 17 nt, Human
uaaauugaauaauggua

SEQ ID NO: 3734749 - RNA, 12 nt, Human
uaaauugacugu

SEQ ID NO: 3734750 - RNA, 14 nt, Human
uaaauugauguuga

SEQ ID NO: 3734751 - RNA, 15 nt, Human
uaaauugauguugau

SEQ ID NO: 3734752 - RNA, 20 nt, Human
uaaauugauguugaugcaau

SEQ ID NO: 3734753 - RNA, 21 nt, Human
uaaauugauuuuuauaaauac

SEQ ID NO: 3734754 - RNA, 16 nt, Human
uaaauugcauaaagca

SEQ ID NO: 3734755 - RNA, 17 nt, Human
uaaauugcauaaagcau

SEQ ID NO: 3734756 - RNA, 19 nt, Human
uaaauugcaucacuguauc

SEQ ID NO: 3734757 - RNA, 17 nt, Human
uaaauugcuaauguugc

SEQ ID NO: 3734758 - RNA, 15 nt, Human
uaaauugcuccuuga

SEQ ID NO: 3734759 - RNA, 21 nt, Human
uaaauuggcauggaaauuuaa

SEQ ID NO: 3734760 - RNA, 23 nt, Human
uaaauugggguuuauuucagcaa

SEQ ID NO: 3734761 - RNA, 16 nt, Human
uaaauuggguucauga

SEQ ID NO: 3734762 - RNA, 21 nt, Human
uaaauuggguucaugaugcag

SEQ ID NO: 3734763 - RNA, 13 nt, Human
uaaauuguaaaac

SEQ ID NO: 3734764 - RNA, 17 nt, Human
uaaauuguauauucacu

SEQ ID NO: 3734765 - RNA, 15 nt, Human
uaaauugucuuuaaa

SEQ ID NO: 3734766 - RNA, 21 nt, Human
uaaauuguuagcuuccuuaag

SEQ ID NO: 3734767 - RNA, 20 nt, Human
uaaauuguuuaguggaaaau

SEQ ID NO: 3734768 - RNA, 14 nt, Human
uaaauuuaaagaua

SEQ ID NO: 3734769 - RNA, 22 nt, Human
uaaauuuaaagauauuguucaa

SEQ ID NO: 3734770 - RNA, 13 nt, Human
uaaauuuaaauuu

SEQ ID NO: 3734771 - RNA, 16 nt, Human
uaaauuuaaugcugcc

SEQ ID NO: 3734772 - RNA, 15 nt, Human
uaaauuuaauucuuc

SEQ ID NO: 3734773 - RNA, 13 nt, Human
uaaauuuaguguu

SEQ ID NO: 3734774 - RNA, 15 nt, Human
uaaauuuauuucaaa

SEQ ID NO: 3734775 - RNA, 17 nt, Human
uaaauuuauuucaaaaa

SEQ ID NO: 3734776 - RNA, 19 nt, Human
uaaauuuccccaacagugu

SEQ ID NO: 3734777 - RNA, 21 nt, Human
uaaauuuccccaacaguguga

SEQ ID NO: 3734778 - RNA, 18 nt, Human
uaaauuucuuaugugaca

SEQ ID NO: 3734779 - RNA, 17 nt, Human
uaaauuugacuuuucug

SEQ ID NO: 3734780 - RNA, 18 nt, Human
uaaauuugacuuuucugu

SEQ ID NO: 3734781 - RNA, 17 nt, Human
uaaauuugauacuuaua

SEQ ID NO: 3734782 - RNA, 13 nt, Human
uaaauuugcuagc

SEQ ID NO: 3734783 - RNA, 14 nt, Human
uaaauuuggcuucu

SEQ ID NO: 3734784 - RNA, 20 nt, Human
uaaauuuggggacagauuca

SEQ ID NO: 3734785 - RNA, 12 nt, Human
uaaauuuguaag

SEQ ID NO: 3734786 - RNA, 15 nt, Human
uaaauuuguaaguuu

SEQ ID NO: 3734787 - RNA, 16 nt, Human
uaaauuuguaaguuuc

SEQ ID NO: 3734788 - RNA, 14 nt, Human
uaaauuuguacuau

SEQ ID NO: 3734789 - RNA, 22 nt, Human
uaaauuuguacuauuuaacuga

SEQ ID NO: 3734790 - RNA, 12 nt, Human
uaaauuuuaaag

SEQ ID NO: 3734791 - RNA, 14 nt, Human
uaaauuuuaaagcc

SEQ ID NO: 3734792 - RNA, 15 nt, Human
uaaauuuuaauuuau

SEQ ID NO: 3734793 - RNA, 18 nt, Human
uaaauuuuacccuuuaga

SEQ ID NO: 3734794 - RNA, 14 nt, Human
uaaauuuuauaucu

SEQ ID NO: 3734795 - RNA, 16 nt, Human
uaaauuuuccuguccu

SEQ ID NO: 3734796 - RNA, 15 nt, Human
uaaauuuucugaaac

SEQ ID NO: 3734797 - RNA, 15 nt, Human
uaaauuuucuucagu

SEQ ID NO: 3734798 - RNA, 16 nt, Human
uaaauuuucuucaguu

SEQ ID NO: 3734799 - RNA, 15 nt, Human
uaaauuuugaaaagu

SEQ ID NO: 3734800 - RNA, 16 nt, Human
uaaauuuugaguucua

SEQ ID NO: 3734801 - RNA, 17 nt, Human
uaaauuuugaguucuac

SEQ ID NO: 3734802 - RNA, 13 nt, Human
uaaauuuuguaau

SEQ ID NO: 3734803 - RNA, 15 nt, Human
uaaauuuuguaauga

SEQ ID NO: 3734804 - RNA, 20 nt, Human
uaaauuuugucuuuaacuca

SEQ ID NO: 3734805 - RNA, 13 nt, Human
uaaauuuugugau

SEQ ID NO: 3734806 - RNA, 16 nt, Human
uaaauuuuuuguugac

SEQ ID NO: 3734807 - RNA, 14 nt, Human
uaaauuuuuuuccu

SEQ ID NO: 3734808 - RNA, 15 nt, Human
uaacaaaagaugaaa

SEQ ID NO: 3734809 - RNA, 21 nt, Human
uaacaaaaguucccugaaaca

SEQ ID NO: 3734810 - RNA, 20 nt, Human
uaacaaaaucacuuccauag

SEQ ID NO: 3734811 - RNA, 13 nt, Human
uaacaaaauggac

SEQ ID NO: 3734812 - RNA, 15 nt, Human
uaacaaaauguaugu

SEQ ID NO: 3734813 - RNA, 13 nt, Human
uaacaaacaaauu

SEQ ID NO: 3734814 - RNA, 21 nt, Human
uaacaaacaucacucugcugc

SEQ ID NO: 3734815 - RNA, 20 nt, Human
uaacaaaugccaaauuaaaa

SEQ ID NO: 3734816 - RNA, 20 nt, Human
uaacaaaugcuauuaaagug

SEQ ID NO: 3734817 - RNA, 13 nt, Human
uaacaaauucuga

SEQ ID NO: 3734818 - RNA, 16 nt, Human
uaacaacuaugauuug

SEQ ID NO: 3734819 - RNA, 21 nt, Human
uaacaacuaugauuuggaaaa

SEQ ID NO: 3734820 - RNA, 22 nt, Human
uaacaacuaugauuuggaaaau

SEQ ID NO: 3734821 - RNA, 15 nt, Human
uaacaacugcccagu

SEQ ID NO: 3734822 - RNA, 14 nt, Human
uaacaagaaacuca

SEQ ID NO: 3734823 - RNA, 13 nt, Human
uaacaagaaagga

SEQ ID NO: 3734824 - RNA, 15 nt, Human
uaacaagaaaggaga

SEQ ID NO: 3734825 - RNA, 19 nt, Human
uaacaagaacuuuaaauug

SEQ ID NO: 3734826 - RNA, 18 nt, Human
uaacaagaagaugaaugg

SEQ ID NO: 3734827 - RNA, 20 nt, Human
uaaucucucugcagcugccg

SEQ ID NO: 3734828 - RNA, 16 nt, Human
uaaucucuguuaugua

SEQ ID NO: 3734829 - RNA, 17 nt, Human
uaaucucuguuauguac

SEQ ID NO: 3734830 - RNA, 24 nt, Human
uaaucucuguuauguacuguacua

SEQ ID NO: 3734831 - RNA, 15 nt, Human
uaaucugaaauucua

SEQ ID NO: 3734832 - RNA, 22 nt, Human
uaaucugaaauucuaaagagca

SEQ ID NO: 3734833 - RNA, 17 nt, Human
uaaucugaauaaagugu

SEQ ID NO: 3734834 - RNA, 23 nt, Human
uaaucugaauaaaguguaacaau

SEQ ID NO: 3734835 - RNA, 21 nt, Human
uaaucugcaaagaaugagaag

SEQ ID NO: 3734836 - RNA, 16 nt, Human
uaaucuggacuccucu

SEQ ID NO: 3734837 - RNA, 19 nt, Human
uaaucuggacuccucuguc

SEQ ID NO: 3734838 - RNA, 17 nt, Human
uaaucugggaagggaag

SEQ ID NO: 3734839 - RNA, 22 nt, Human
uaaucuguacauuuuguuguaa

SEQ ID NO: 3734840 - RNA, 17 nt, Human
uaaucuguagggcugga

SEQ ID NO: 3734841 - RNA, 15 nt, Human
uaaucugucaaaaca

SEQ ID NO: 3734842 - RNA, 20 nt, Human
uaaucugucaaaacacugug

SEQ ID NO: 3734843 - RNA, 21 nt, Human
uaaucugucaaaacacugugg

SEQ ID NO: 3734844 - RNA, 21 nt, Human
uaaucugugcuguuucaaagu

SEQ ID NO: 3734845 - RNA, 23 nt, Human
uaaucugugcuguuucaaaguuc

SEQ ID NO: 3734846 - RNA, 19 nt, Human
uaaucuguguacaaagaaa

SEQ ID NO: 3734847 - RNA, 17 nt, Human
uaaucuuaaucuguuua

SEQ ID NO: 3734848 - RNA, 13 nt, Human
uaaucuuagugua

SEQ ID NO: 3734849 - RNA, 21 nt, Human
uaaucuuauuagggagaaaau

SEQ ID NO: 3734850 - RNA, 22 nt, Human
uaaucuuauucauuuucucuaa

SEQ ID NO: 3734851 - RNA, 16 nt, Human
uaaucuucaaagccuu

SEQ ID NO: 3734852 - RNA, 17 nt, Human
uaaucuucaaagccuuc

SEQ ID NO: 3734853 - RNA, 19 nt, Human
uaaucuugugaaaauaauu

SEQ ID NO: 3734854 - RNA, 17 nt, Human
uaaucuuguuucugaaa

SEQ ID NO: 3734855 - RNA, 17 nt, Human
uaaucuuuaauuuuaca

SEQ ID NO: 3734856 - RNA, 14 nt, Human
uaaucuuucaaacc

SEQ ID NO: 3734857 - RNA, 16 nt, Human
uaaucuuucaaaccag

SEQ ID NO: 3734858 - RNA, 21 nt, Human
uaaucuuucuuuaccugagac

SEQ ID NO: 3734859 - RNA, 23 nt, Human
uaaucuuucuuuaccugagacca

SEQ ID NO: 3734860 - RNA, 14 nt, Human
uaaucuuuucugaa

SEQ ID NO: 3734861 - RNA, 13 nt, Human
uaaugaaaacaau

SEQ ID NO: 3734862 - RNA, 15 nt, Human
uaaugaaaaugucag

SEQ ID NO: 3734863 - RNA, 14 nt, Human
uaaugaaacuugga

SEQ ID NO: 3734864 - RNA, 14 nt, Human
uaaugaacaaaugg

SEQ ID NO: 3734865 - RNA, 16 nt, Human
uaaugaagaaagugga

SEQ ID NO: 3734866 - RNA, 16 nt, Human
uaaugaagaucuaaau

SEQ ID NO: 3734867 - RNA, 12 nt, Human
uaaugaauaccu

SEQ ID NO: 3734868 - RNA, 13 nt, Human
uaaugaauaccuu

SEQ ID NO: 3734869 - RNA, 18 nt, Human
uaaugaauaccuuagugc

SEQ ID NO: 3734870 - RNA, 12 nt, Human
uaaugaaugacu

SEQ ID NO: 3734871 - RNA, 15 nt, Human
uaaugaaugcauaaa

SEQ ID NO: 3734872 - RNA, 16 nt, Human
uaaugacaugccuaua

SEQ ID NO: 3734873 - RNA, 15 nt, Human
uaaugacuuaagcac

SEQ ID NO: 3734874 - RNA, 17 nt, Human
uaaugagcaauaucugc

SEQ ID NO: 3734875 - RNA, 13 nt, Human
uaaugaggaaacu

SEQ ID NO: 3734876 - RNA, 16 nt, Human
uaaugaguuucuuuua

SEQ ID NO: 3734877 - RNA, 23 nt, Human
uaaugauaacuggaaacuucagc

SEQ ID NO: 3734878 - RNA, 23 nt, Human
uaaugaugucguuugaaucacag

SEQ ID NO: 3734879 - RNA, 11 nt, Human
uaaugauguuu

SEQ ID NO: 3734880 - RNA, 14 nt, Human
uaaugcaaagaauc

SEQ ID NO: 3734881 - RNA, 21 nt, Human
uaaugcaguaugguacauuuu

SEQ ID NO: 3734882 - RNA, 17 nt, Human
uaaugcauguuaggaaa

SEQ ID NO: 3734883 - RNA, 16 nt, Human
uaaugcauuaaaccug

SEQ ID NO: 3734884 - RNA, 17 nt, Human
uaaugcauuaaaccugu

SEQ ID NO: 3734885 - RNA, 18 nt, Human
uaaugcauuaaaccuguc

SEQ ID NO: 3734886 - RNA, 15 nt, Human
uaaugccuuuguaac

SEQ ID NO: 3734887 - RNA, 18 nt, Human
uaaugcgauuuuauuacu

SEQ ID NO: 3734888 - RNA, 19 nt, Human
uaaugcgugcauaccacuu

SEQ ID NO: 3734889 - RNA, 17 nt, Human
uaaugcuaaucuuguga

SEQ ID NO: 3734890 - RNA, 19 nt, Human
uaaugcuaauuuaaagaga

SEQ ID NO: 3734891 - RNA, 14 nt, Human
uaaugcuacaauuu

SEQ ID NO: 3734892 - RNA, 15 nt, Human
uaaugcuacaauuuu

SEQ ID NO: 3734893 - RNA, 16 nt, Human
uaaugcuauuugaaca

SEQ ID NO: 3734894 - RNA, 17 nt, Human
uaaugcuauuugaacaa

SEQ ID NO: 3734895 - RNA, 24 nt, Human
uaaugcugcaaacuuaauguucuu

SEQ ID NO: 3734896 - RNA, 20 nt, Human
uaaugcuuaagggaguuuaa

SEQ ID NO: 3734897 - RNA, 16 nt, Human
uaaugcuuaauuucua

SEQ ID NO: 3734898 - RNA, 19 nt, Human
uaaugcuuagagaauguuc

SEQ ID NO: 3734899 - RNA, 20 nt, Human
uaaugcuucauucaauauug

SEQ ID NO: 3734900 - RNA, 21 nt, Human
uaaugcuucuuucauuuucug

SEQ ID NO: 3734901 - RNA, 19 nt, Human
uaaugcuuucacaacauuu

SEQ ID NO: 3734902 - RNA, 21 nt, Human
uaauggaaaaaaaaaaaagag

SEQ ID NO: 3734903 - RNA, 20 nt, Human
uaauggaaaaugauuuuacu

SEQ ID NO: 3734904 - RNA, 21 nt, Human
uaauggaaaaugccaugaauu

SEQ ID NO: 3734905 - RNA, 17 nt, Human
uaauggaagagaaaucu

SEQ ID NO: 3734906 - RNA, 13 nt, Human
uaauggacacuuu

SEQ ID NO: 3734907 - RNA, 23 nt, Human
uaauggacaugagauaauguuag

SEQ ID NO: 3734908 - RNA, 16 nt, Human
uaauggaugaaaucau

SEQ ID NO: 3734909 - RNA, 14 nt, Human
uaauggauuaaauu

SEQ ID NO: 3734910 - RNA, 22 nt, Human
uaauggauuaaauuuaauucuu

SEQ ID NO: 3734911 - RNA, 15 nt, Human
uaauggauuguuaau

SEQ ID NO: 3734912 - RNA, 13 nt, Human
uaauggcacugau

SEQ ID NO: 3734913 - RNA, 12 nt, Human
uaauggcagcag

SEQ ID NO: 3734914 - RNA, 14 nt, Human
uaauggcagcagaa

SEQ ID NO: 3734915 - RNA, 16 nt, Human
uaauggcaugucagac

SEQ ID NO: 3734916 - RNA, 19 nt, Human
uaauggccaugguaccccc

SEQ ID NO: 3734917 - RNA, 21 nt, Human
uaauggccaugguacccccuu

SEQ ID NO: 3734918 - RNA, 15 nt, Human
uaaugggauuuucuu

SEQ ID NO: 3734919 - RNA, 15 nt, Human
uaauggggguagcag

SEQ ID NO: 3734920 - RNA, 20 nt, Human
uaauggggguagcagcugga

SEQ ID NO: 3734921 - RNA, 21 nt, Human
uaauggggguagcagcuggac

SEQ ID NO: 3734922 - RNA, 18 nt, Human
uaaugguccacacccaau

SEQ ID NO: 3734923 - RNA, 14 nt, Human
uaauggucccaucc

SEQ ID NO: 3734924 - RNA, 16 nt, Human
uaauggucccauccag

SEQ ID NO: 3734925 - RNA, 21 nt, Human
uaauggucccauccaggcagu

SEQ ID NO: 3734926 - RNA, 16 nt, Human
uaauggugccuucauu

SEQ ID NO: 3734927 - RNA, 18 nt, Human
uaaugguguaaccugaga

SEQ ID NO: 3734928 - RNA, 15 nt, Human
uaaugguuugaauau

SEQ ID NO: 3734929 - RNA, 18 nt, Human
uaauguaaagauuugcuu

SEQ ID NO: 3734930 - RNA, 21 nt, Human
uaauguaacugcucuugggca

SEQ ID NO: 3734931 - RNA, 15 nt, Human
uaauguaagacaaau

SEQ ID NO: 3734932 - RNA, 13 nt, Human
uaauguacugcau

SEQ ID NO: 3734933 - RNA, 14 nt, Human
uaauguagccaugg

SEQ ID NO: 3734934 - RNA, 23 nt, Human
uaauguagcguguuuacaugugu

SEQ ID NO: 3734935 - RNA, 17 nt, Human
uaauguauguuaccaaa

SEQ ID NO: 3734936 - RNA, 14 nt, Human
uaauguauucauau

SEQ ID NO: 3734937 - RNA, 19 nt, Human
uaauguauuuuauuguaac

SEQ ID NO: 3734938 - RNA, 13 nt, Human
uaaugucaaacuu

SEQ ID NO: 3734939 - RNA, 15 nt, Human
uaaugucacaggcag

SEQ ID NO: 3734940 - RNA, 16 nt, Human
uaaugucacaggcagg

SEQ ID NO: 3734941 - RNA, 17 nt, Human
uaaugucacaggcaggu

SEQ ID NO: 3734942 - RNA, 22 nt, Human
uaaugucaccaccuucccagcu

SEQ ID NO: 3734943 - RNA, 16 nt, Human
uaaugucauaaaguga

SEQ ID NO: 3734944 - RNA, 19 nt, Human
uaaugucucugugagacuc

SEQ ID NO: 3734945 - RNA, 13 nt, Human
uaaugucuucauu

SEQ ID NO: 3734946 - RNA, 13 nt, Human
uaaugucuugagc

SEQ ID NO: 3734947 - RNA, 13 nt, Human
uaaugucuuguua

SEQ ID NO: 3734948 - RNA, 14 nt, Human
uaaugucuuguuaa

SEQ ID NO: 3734949 - RNA, 20 nt, Human
uaaugucuuguuaauauucu

SEQ ID NO: 3734950 - RNA, 22 nt, Human
uaaugucuuguuaauauucuuu

SEQ ID NO: 3734951 - RNA, 13 nt, Human
uaaugugaaaugu

SEQ ID NO: 3734952 - RNA, 14 nt, Human
uaaugugaaaugua

SEQ ID NO: 3734953 - RNA, 19 nt, Human
uaaugugaaauguaacugu

SEQ ID NO: 3734954 - RNA, 23 nt, Human
uaaugugaaauguaacuguccgu

SEQ ID NO: 3734955 - RNA, 10 nt, Human
uaaugugaac

SEQ ID NO: 3734956 - RNA, 12 nt, Human
uaaugugaacuu

SEQ ID NO: 3734957 - RNA, 20 nt, Human
uaaugugaugauguaauuga

SEQ ID NO: 3734958 - RNA, 18 nt, Human
uaaugugcuguguaaagu

SEQ ID NO: 3734959 - RNA, 22 nt, Human
uaaugugcuguguaaaguuagu

SEQ ID NO: 3734960 - RNA, 19 nt, Human
uaauguggaagaaaauggu

SEQ ID NO: 3734961 - RNA, 17 nt, Human
uaaugugggaagaaaca

SEQ ID NO: 3734962 - RNA, 19 nt, Human
uaaugugucaucuagcauu

SEQ ID NO: 3734963 - RNA, 19 nt, Human
uaaugugugguggccucag

SEQ ID NO: 3734964 - RNA, 14 nt, Human
uaauguguguaugu

SEQ ID NO: 3734965 - RNA, 15 nt, Human
uaauguguguaugug

SEQ ID NO: 3734966 - RNA, 17 nt, Human
uaauguguguaugugua

SEQ ID NO: 3734967 - RNA, 13 nt, Human
uaauguuaaauuu

SEQ ID NO: 3734968 - RNA, 16 nt, Human
uaauguuaaauuugua

SEQ ID NO: 3734969 - RNA, 20 nt, Human
uaauguuaaauuuguaaguu

SEQ ID NO: 3734970 - RNA, 22 nt, Human
uaauguuaaauuuguaaguuuc

SEQ ID NO: 3734971 - RNA, 13 nt, Human
uaauguuaauauu

SEQ ID NO: 3734972 - RNA, 13 nt, Human
uaauguuacugau

SEQ ID NO: 3734973 - RNA, 22 nt, Human
uaauguucugaauaauuucuua

SEQ ID NO: 3734974 - RNA, 18 nt, Human
uaauguugaacaaaauaa

SEQ ID NO: 3734975 - RNA, 13 nt, Human
uaauguugauuuc

SEQ ID NO: 3734976 - RNA, 18 nt, Human
uaauguugauuucuaguu

SEQ ID NO: 3734977 - RNA, 22 nt, Human
uaauguugcuggaucaggaagc

SEQ ID NO: 3734978 - RNA, 15 nt, Human
uaauguuuaaaacau

SEQ ID NO: 3734979 - RNA, 20 nt, Human
uaauguuuaaaauuucuuag

SEQ ID NO: 3734980 - RNA, 22 nt, Human
uaauguuuaagcagaauuggaa

SEQ ID NO: 3734981 - RNA, 17 nt, Human
uaauguuuaugagccag

SEQ ID NO: 3734982 - RNA, 16 nt, Human
uaauguuuauuaaaug

SEQ ID NO: 3734983 - RNA, 15 nt, Human
uaauguuucaaacau

SEQ ID NO: 3734984 - RNA, 22 nt, Human
uaauguuucaaacauauauaac

SEQ ID NO: 3734985 - RNA, 11 nt, Human
uaauguuuccu

SEQ ID NO: 3734986 - RNA, 13 nt, Human
uaauguuugcuau

SEQ ID NO: 3734987 - RNA, 16 nt, Human
uaauguuuuaaaugua

SEQ ID NO: 3734988 - RNA, 17 nt, Human
uaauguuuuaaauguac

SEQ ID NO: 3734989 - RNA, 19 nt, Human
uaauguuuucuuugcaaag

SEQ ID NO: 3734990 - RNA, 23 nt, Human
uaauguuuuuugccacagcuuuu

SEQ ID NO: 3734991 - RNA, 14 nt, Human
uaauuaaaaaauuu

SEQ ID NO: 3734992 - RNA, 15 nt, Human
uaauuaaaaaguuaa

SEQ ID NO: 3734993 - RNA, 20 nt, Human
uaauuaaaagaauauuuuaa

SEQ ID NO: 3734994 - RNA, 21 nt, Human
uaauuaaacauugugaucauu

SEQ ID NO: 3734995 - RNA, 15 nt, Human
uaauuaaacuguuaa

SEQ ID NO: 3734996 - RNA, 21 nt, Human
uaauuaaauaaaaaucugugg

SEQ ID NO: 3734997 - RNA, 19 nt, Human
uaauuaaauuaugguauua

SEQ ID NO: 3734998 - RNA, 14 nt, Human
uaauuaacauauaa

SEQ ID NO: 3734999 - RNA, 14 nt, Human
uaauuaacauguua

SEQ ID NO: 3735000 - RNA, 19 nt, Human
uaauuaacauguuaaacca

SEQ ID NO: 3735001 - RNA, 18 nt, Human
uaauuaaccuuacuaauu

SEQ ID NO: 3735002 - RNA, 18 nt, Human
uaauuaagacugaaaaua

SEQ ID NO: 3735003 - RNA, 14 nt, Human
uaauuaaguacuau

SEQ ID NO: 3735004 - RNA, 20 nt, Human
uaauuaauauauuaaaauuc

SEQ ID NO: 3735005 - RNA, 22 nt, Human
uaauuaauauauuaaaauucca

SEQ ID NO: 3735006 - RNA, 17 nt, Human
uaauuaaugaaauaucu

SEQ ID NO: 3735007 - RNA, 14 nt, Human
uaauuaauuucagu

SEQ ID NO: 3735008 - RNA, 13 nt, Human
uaauuaauuugau

SEQ ID NO: 3735009 - RNA, 23 nt, Human
uaauuaauuugauuaacaaauau

SEQ ID NO: 3735010 - RNA, 21 nt, Human
uaauuaccaaccuguuaccua

SEQ ID NO: 3735011 - RNA, 16 nt, Human
uaauuaccuacucugg

SEQ ID NO: 3735012 - RNA, 23 nt, Human
uaauuagauccauuaauuuaaau

SEQ ID NO: 3735013 - RNA, 13 nt, Human
uaauuagcauucu

SEQ ID NO: 3735014 - RNA, 14 nt, Human
uaauuagcauucug

SEQ ID NO: 3735015 - RNA, 14 nt, Human
uaauuaggaaaaaa

SEQ ID NO: 3735016 - RNA, 15 nt, Human
uaauuaggguacauu

SEQ ID NO: 3735017 - RNA, 21 nt, Human
uaauuaggguacauuuauaau

SEQ ID NO: 3735018 - RNA, 22 nt, Human
uaauuagguuaacuauguacaa

SEQ ID NO: 3735019 - RNA, 14 nt, Human
uaauuagugcuaag

SEQ ID NO: 3735020 - RNA, 15 nt, Human
uaauuauaaucucuu

SEQ ID NO: 3735021 - RNA, 20 nt, Human
uaauuauacccccugcaaag

SEQ ID NO: 3735022 - RNA, 23 nt, Human
uaauuauaccgcuaucauuccaa

SEQ ID NO: 3735023 - RNA, 16 nt, Human
uaauuauauaacugua

SEQ ID NO: 3735024 - RNA, 17 nt, Human
uaauuauauaacuguau

SEQ ID NO: 3735025 - RNA, 20 nt, Human
uaauuauauaacuguauuug

SEQ ID NO: 3735026 - RNA, 13 nt, Human
uaauuauaucuga

SEQ ID NO: 3735027 - RNA, 15 nt, Human
uaauuauauguugua

SEQ ID NO: 3735028 - RNA, 21 nt, Human
uaauuaugacaguuauacugu

SEQ ID NO: 3735029 - RNA, 14 nt, Human
uaauuaugauuugg

SEQ ID NO: 3735030 - RNA, 22 nt, Human
uaauuaugggaauaauugcuuu

SEQ ID NO: 3735031 - RNA, 21 nt, Human
uaauuaugguuaguagaggua

SEQ ID NO: 3735032 - RNA, 15 nt, Human
uaauuauguagcucu

SEQ ID NO: 3735033 - RNA, 16 nt, Human
uaauuauguagcucuu

SEQ ID NO: 3735034 - RNA, 19 nt, Human
uaauuauuaacuacauuua

SEQ ID NO: 3735035 - RNA, 16 nt, Human
uaauuauuauaaaaau

SEQ ID NO: 3735036 - RNA, 12 nt, Human
uaauuauuauuc

SEQ ID NO: 3735037 - RNA, 14 nt, Human
uaauuauuauucuu

SEQ ID NO: 3735038 - RNA, 16 nt, Human
uaauuauugauguuuu

SEQ ID NO: 3735039 - RNA, 15 nt, Human
uaauuauuguuuaua

SEQ ID NO: 3735040 - RNA, 18 nt, Human
uaauuauuucacuuuaga

SEQ ID NO: 3735041 - RNA, 12 nt, Human
uaauuauuugaa

SEQ ID NO: 3735042 - RNA, 14 nt, Human
uaauuauuuuaauu

SEQ ID NO: 3735043 - RNA, 15 nt, Human
uaauuauuuuaauua

SEQ ID NO: 3735044 - RNA, 13 nt, Human
uaauuauuuuggu

SEQ ID NO: 3735045 - RNA, 20 nt, Human
uaauuauuuugguacuuuua

SEQ ID NO: 3735046 - RNA, 19 nt, Human
uaauucaaagcaccaaaau

SEQ ID NO: 3735047 - RNA, 16 nt, Human
uaauucaauucaaagc

SEQ ID NO: 3735048 - RNA, 18 nt, Human
uaauucagcacugauuuc

SEQ ID NO: 3735049 - RNA, 19 nt, Human
uaauucagcacugauuuca

SEQ ID NO: 3735050 - RNA, 18 nt, Human
uaauucagccauguacag

SEQ ID NO: 3735051 - RNA, 14 nt, Human
uaauucauguuucu

SEQ ID NO: 3735052 - RNA, 16 nt, Human
uaauuccaauaugaug

SEQ ID NO: 3735053 - RNA, 17 nt, Human
uaauuccacagcugcuc

SEQ ID NO: 3735054 - RNA, 11 nt, Human
uaauuccauga

SEQ ID NO: 3735055 - RNA, 18 nt, Human
uaauucccauuuugcaaa

SEQ ID NO: 3735056 - RNA, 19 nt, Human
uaauuccuaccucccugca

SEQ ID NO: 3735057 - RNA, 21 nt, Human
uaauuccuauauccugugacu

SEQ ID NO: 3735058 - RNA, 18 nt, Human
uaauuccuguuuuuauua

SEQ ID NO: 3735059 - RNA, 14 nt, Human
uaauuccuucagca

SEQ ID NO: 3735060 - RNA, 13 nt, Human
uaauucuaaccag

SEQ ID NO: 3735061 - RNA, 19 nt, Human
uaauucuaaccagagcaag

SEQ ID NO: 3735062 - RNA, 23 nt, Human
uaauucuaaccagagcaagcuuu

SEQ ID NO: 3735063 - RNA, 12 nt, Human
uaauucucaggc

SEQ ID NO: 3735064 - RNA, 12 nt, Human
uaauucucuuga

SEQ ID NO: 3735065 - RNA, 13 nt, Human
uaauucucuugaa

SEQ ID NO: 3735066 - RNA, 17 nt, Human
uaauucuggagauacug

SEQ ID NO: 3735067 - RNA, 12 nt, Human
uaauucugggaa

SEQ ID NO: 3735068 - RNA, 10 nt, Human
uaauucugua

SEQ ID NO: 3735069 - RNA, 12 nt, Human
uaauucuguaca

SEQ ID NO: 3735070 - RNA, 14 nt, Human
uaauucuguacaua

SEQ ID NO: 3735071 - RNA, 15 nt, Human
uaauucuguacugau

SEQ ID NO: 3735072 - RNA, 23 nt, Human
uaauucuguacugauuuuuguaa

SEQ ID NO: 3735073 - RNA, 21 nt, Human
uaauucuguucugauauuaau

SEQ ID NO: 3735074 - RNA, 22 nt, Human
uaauucuuacacugccuguaua

SEQ ID NO: 3735075 - RNA, 22 nt, Human
uaauucuuauuccauauuagaa

SEQ ID NO: 3735076 - RNA, 18 nt, Human
uaauucuuauuuugugga

SEQ ID NO: 3735077 - RNA, 19 nt, Human
uaauucuucagcguaaaau

SEQ ID NO: 3735078 - RNA, 15 nt, Human
uaauucuugcauauu

SEQ ID NO: 3735079 - RNA, 19 nt, Human
uaauucuugcauauuuugu

SEQ ID NO: 3735080 - RNA, 13 nt, Human
uaauucuuugcaa

SEQ ID NO: 3735081 - RNA, 14 nt, Human
uaauucuuugcaaa

SEQ ID NO: 3735082 - RNA, 13 nt, Human
uaauugaaggaaa

SEQ ID NO: 3735083 - RNA, 15 nt, Human
uaauugaaggaaaga

SEQ ID NO: 3735084 - RNA, 19 nt, Human
uaauugacaggcgaaagaa

SEQ ID NO: 3735085 - RNA, 12 nt, Human
uaauugagaagc

SEQ ID NO: 3735086 - RNA, 14 nt, Human
uaauugauuucaag

SEQ ID NO: 3735087 - RNA, 23 nt, Human
uaauugcagauaacuuugacuuu

SEQ ID NO: 3735088 - RNA, 22 nt, Human
uaauugccaaaaagugaaauaa

SEQ ID NO: 3735089 - RNA, 14 nt, Human
uaauugccaccucu

SEQ ID NO: 3735090 - RNA, 14 nt, Human
uaauugcugugugu

SEQ ID NO: 3735091 - RNA, 22 nt, Human
uaauuggaaaggcagcucuaaa

SEQ ID NO: 3735092 - RNA, 21 nt, Human
uaauuggaagaaauuccugua

SEQ ID NO: 3735093 - RNA, 15 nt, Human
uaauuggauuuccua

SEQ ID NO: 3735094 - RNA, 15 nt, Human
uaauuggcagcagau

SEQ ID NO: 3735095 - RNA, 20 nt, Human
uaauuggcuuuacuauuuuu

SEQ ID NO: 3735096 - RNA, 20 nt, Human
uaauugggcacuauuuauuu

SEQ ID NO: 3735097 - RNA, 23 nt, Human
uaauugguacuuuuaaaaacaua

SEQ ID NO: 3735098 - RNA, 12 nt, Human
uaauuguaaacu

SEQ ID NO: 3735099 - RNA, 13 nt, Human
uaauuguaaacug

SEQ ID NO: 3735100 - RNA, 16 nt, Human
uaauuguaaacuguac

SEQ ID NO: 3735101 - RNA, 18 nt, Human
uaauuguaaacuguacua

SEQ ID NO: 3735102 - RNA, 17 nt, Human
uaauuguauaacagguu

SEQ ID NO: 3735103 - RNA, 18 nt, Human
uaauuguauaacagguua

SEQ ID NO: 3735104 - RNA, 13 nt, Human
uaauuguaucgua

SEQ ID NO: 3735105 - RNA, 15 nt, Human
uaauuguaucguaua

SEQ ID NO: 3735106 - RNA, 20 nt, Human
uaauuguaucguauagcugu

SEQ ID NO: 3735107 - RNA, 21 nt, Human
uaauuguaucguauagcugua

SEQ ID NO: 3735108 - RNA, 19 nt, Human
uaauugugugaacuuggaa

SEQ ID NO: 3735109 - RNA, 22 nt, Human
uaauugugugaacuuggaagca

SEQ ID NO: 3735110 - RNA, 20 nt, Human
uaauugugugauauuucaga

SEQ ID NO: 3735111 - RNA, 20 nt, Human
uaauuguguggauucuuuaa

SEQ ID NO: 3735112 - RNA, 21 nt, Human
uaauuguguuuacauuuuaug

SEQ ID NO: 3735113 - RNA, 16 nt, Human
uaauuguucucagaau

SEQ ID NO: 3735114 - RNA, 17 nt, Human
uaauuguucucagaauc

SEQ ID NO: 3735115 - RNA, 22 nt, Human
uaauuguugaaauuuugcaaau

SEQ ID NO: 3735116 - RNA, 16 nt, Human
uaauuguugcuaaucu

SEQ ID NO: 3735117 - RNA, 15 nt, Human
uaauuguuguucugu

SEQ ID NO: 3735118 - RNA, 17 nt, Human
uaauuguuguucuguua

SEQ ID NO: 3735119 - RNA, 19 nt, Human
uaauuguuguucuguuaac

SEQ ID NO: 3735120 - RNA, 16 nt, Human
uaauuguuguuucuuu

SEQ ID NO: 3735121 - RNA, 15 nt, Human
uaauuguuguuugua

SEQ ID NO: 3735122 - RNA, 13 nt, Human
uaauuguuuaaaa

SEQ ID NO: 3735123 - RNA, 17 nt, Human
uaauuguuugucuuuaa

SEQ ID NO: 3735124 - RNA, 21 nt, Human
uaauuguuuuuuaucuuuucu

SEQ ID NO: 3735125 - RNA, 22 nt, Human
uaauuguuuuuuaucuuuucua

SEQ ID NO: 3735126 - RNA, 15 nt, Human
uaauuuaaaaaauaa

SEQ ID NO: 3735127 - RNA, 12 nt, Human
gcagaagagggu

SEQ ID NO: 3735128 - RNA, 20 nt, Human
gcagaaggaaaaauguguaa

SEQ ID NO: 3735129 - RNA, 21 nt, Human
gcagaaggaaaaauguguaau

SEQ ID NO: 3735130 - RNA, 18 nt, Human
gcagaaggaagacuucau

SEQ ID NO: 3735131 - RNA, 22 nt, Human
gcagaaggaagggcauccuucu

SEQ ID NO: 3735132 - RNA, 15 nt, Human
gcagaaggccaagaa

SEQ ID NO: 3735133 - RNA, 14 nt, Human
gcagaaguguuuca

SEQ ID NO: 3735134 - RNA, 11 nt, Human
gcagaauaaag

SEQ ID NO: 3735135 - RNA, 12 nt, Human
gcagaauaaagc

SEQ ID NO: 3735136 - RNA, 15 nt, Human
gcagaauaaagcaau

SEQ ID NO: 3735137 - RNA, 18 nt, Human
gcagaauaaagcaauuuu

SEQ ID NO: 3735138 - RNA, 21 nt, Human
gcagaauaaagcaauuuuccu

SEQ ID NO: 3735139 - RNA, 22 nt, Human
gcagaauaaagcaauuuuccuu

SEQ ID NO: 3735140 - RNA, 14 nt, Human
gcagaauaguauuu

SEQ ID NO: 3735141 - RNA, 16 nt, Human
gcagaaugaaucuaug

SEQ ID NO: 3735142 - RNA, 13 nt, Human
gcagaauguuuuu

SEQ ID NO: 3735143 - RNA, 14 nt, Human
gcagaauuggaaaa

SEQ ID NO: 3735144 - RNA, 21 nt, Human
gcagacaauaaacccucagag

SEQ ID NO: 3735145 - RNA, 15 nt, Human
gcagacaaucuucug

SEQ ID NO: 3735146 - RNA, 16 nt, Human
gcagacacagggacuu

SEQ ID NO: 3735147 - RNA, 19 nt, Human
gcagacacagggacuugaa

SEQ ID NO: 3735148 - RNA, 16 nt, Human
gcagacacggaucuga

SEQ ID NO: 3735149 - RNA, 17 nt, Human
gcagacagaagucuccu

SEQ ID NO: 3735150 - RNA, 14 nt, Human
gcagacagagccag

SEQ ID NO: 3735151 - RNA, 17 nt, Human
gcagacagagccaggag

SEQ ID NO: 3735152 - RNA, 13 nt, Human
gcagacagcagcu

SEQ ID NO: 3735153 - RNA, 20 nt, Human
gcagacagcagcucaggcac

SEQ ID NO: 3735154 - RNA, 19 nt, Human
gcagacagcaggcagcgcc

SEQ ID NO: 3735155 - RNA, 13 nt, Human
gcagacaggacca

SEQ ID NO: 3735156 - RNA, 18 nt, Human
gcagacaggaccagggau

SEQ ID NO: 3735157 - RNA, 13 nt, Human
gcagacaggcaag

SEQ ID NO: 3735158 - RNA, 19 nt, Human
gcagacaggcaagcaccuc

SEQ ID NO: 3735159 - RNA, 19 nt, Human
gcagacaugugcacuugaa

SEQ ID NO: 3735160 - RNA, 15 nt, Human
gcagacauugucagc

SEQ ID NO: 3735161 - RNA, 17 nt, Human
gcagacauuuuaaaaaa

SEQ ID NO: 3735162 - RNA, 17 nt, Human
gcagaccacauugcuuu

SEQ ID NO: 3735163 - RNA, 13 nt, Human
gcagaccaccccg

SEQ ID NO: 3735164 - RNA, 21 nt, Human
gcagaccauuggggcucccag

SEQ ID NO: 3735165 - RNA, 18 nt, Human
gcagaccccuuggccagc

SEQ ID NO: 3735166 - RNA, 15 nt, Human
gcagacccugcccuu

SEQ ID NO: 3735167 - RNA, 14 nt, Human
gcagaccuguccuc

SEQ ID NO: 3735168 - RNA, 13 nt, Human
gcagacgcccaga

SEQ ID NO: 3735169 - RNA, 21 nt, Human
gcagacuagaauucuagugcu

SEQ ID NO: 3735170 - RNA, 13 nt, Human
gcagacucacugu

SEQ ID NO: 3735171 - RNA, 16 nt, Human
gcagacucagcucuga

SEQ ID NO: 3735172 - RNA, 21 nt, Human
gcagacugcugcuagagccag

SEQ ID NO: 3735173 - RNA, 11 nt, Human
gcagacuggcg

SEQ ID NO: 3735174 - RNA, 23 nt, Human
gcagacuguguaaaauguaaugc

SEQ ID NO: 3735175 - RNA, 17 nt, Human
gcagacuuuuaaagacu

SEQ ID NO: 3735176 - RNA, 20 nt, Human
gcagacuuuuaaagacuugc

SEQ ID NO: 3735177 - RNA, 16 nt, Human
gcagagaaagaagaga

SEQ ID NO: 3735178 - RNA, 16 nt, Human
gcagagaagccuuggu

SEQ ID NO: 3735179 - RNA, 23 nt, Human
gcagagaauauaacaugaaauga

SEQ ID NO: 3735180 - RNA, 22 nt, Human
gcagagaaugaaagggcccaga

SEQ ID NO: 3735181 - RNA, 13 nt, Human
gcagagacacuaa

SEQ ID NO: 3735182 - RNA, 15 nt, Human
gcagagaccaucccu

SEQ ID NO: 3735183 - RNA, 17 nt, Human
gcagagaccaucccuga

SEQ ID NO: 3735184 - RNA, 20 nt, Human
gcagagaccaucccugaagg

SEQ ID NO: 3735185 - RNA, 17 nt, Human
gcagagagagagaaaga

SEQ ID NO: 3735186 - RNA, 20 nt, Human
gcagagagaugcggccaaga

SEQ ID NO: 3735187 - RNA, 13 nt, Human
gcagagaggcugu

SEQ ID NO: 3735188 - RNA, 21 nt, Human
gcagagagguuugcaguccca

SEQ ID NO: 3735189 - RNA, 14 nt, Human
gcagagcaggggca

SEQ ID NO: 3735190 - RNA, 16 nt, Human
gcagagccaggaagau

SEQ ID NO: 3735191 - RNA, 16 nt, Human
gcagagcccaagggaa

SEQ ID NO: 3735192 - RNA, 20 nt, Human
gcagagcgccgugaguucuc

SEQ ID NO: 3735193 - RNA, 19 nt, Human
gcagagcgcgccccuagcc

SEQ ID NO: 3735194 - RNA, 19 nt, Human
gcagagcugcgggcugggu

SEQ ID NO: 3735195 - RNA, 13 nt, Human
gcagagcuggcuc

SEQ ID NO: 3735196 - RNA, 14 nt, Human
gcagagcuggcucu

SEQ ID NO: 3735197 - RNA, 17 nt, Human
gcagagcuggcucugag

SEQ ID NO: 3735198 - RNA, 13 nt, Human
gcagagcuggugc

SEQ ID NO: 3735199 - RNA, 17 nt, Human
gcagagcuuggacugga

SEQ ID NO: 3735200 - RNA, 16 nt, Human
gcagagcuuuucagau

SEQ ID NO: 3735201 - RNA, 14 nt, Human
gcagaggaccaggg

SEQ ID NO: 3735202 - RNA, 16 nt, Human
gcagaggaccagggcc

SEQ ID NO: 3735203 - RNA, 17 nt, Human
gcagaggaccagggccu

SEQ ID NO: 3735204 - RNA, 19 nt, Human
gcagaggagaacuugcugc

SEQ ID NO: 3735205 - RNA, 22 nt, Human
gcagaggagaacuugcugccuc

SEQ ID NO: 3735206 - RNA, 14 nt, Human
gcagaggaggggcc

SEQ ID NO: 3735207 - RNA, 16 nt, Human
gcagaggauguucaua

SEQ ID NO: 3735208 - RNA, 21 nt, Human
gcagaggcccacauuggaaga

SEQ ID NO: 3735209 - RNA, 20 nt, Human
gcagaggcccaggcugccgu

SEQ ID NO: 3735210 - RNA, 14 nt, Human
gcagaggccugggc

SEQ ID NO: 3735211 - RNA, 20 nt, Human
gcagaggccugggcugggaa

SEQ ID NO: 3735212 - RNA, 19 nt, Human
gcagaggcuggaggcaggg

SEQ ID NO: 3735213 - RNA, 12 nt, Human
gcagaggcuggc

SEQ ID NO: 3735214 - RNA, 15 nt, Human
gcagaggcuguggcu

SEQ ID NO: 3735215 - RNA, 18 nt, Human
gcagaggcuguggcuggu

SEQ ID NO: 3735216 - RNA, 16 nt, Human
gcagagggcagaggcu

SEQ ID NO: 3735217 - RNA, 14 nt, Human
gcagagggcuggag

SEQ ID NO: 3735218 - RNA, 16 nt, Human
gcagagggcuggaggc

SEQ ID NO: 3735219 - RNA, 17 nt, Human
gcagagggcuggaggcc

SEQ ID NO: 3735220 - RNA, 23 nt, Human
gcagagggcuggaggcccaggcu

SEQ ID NO: 3735221 - RNA, 11 nt, Human
gcagaggggca

SEQ ID NO: 3735222 - RNA, 16 nt, Human
gcagaggggcuuucug

SEQ ID NO: 3735223 - RNA, 21 nt, Human
gcagaggggcuuucuggagag

SEQ ID NO: 3735224 - RNA, 19 nt, Human
gcagagggguaggcagagc

SEQ ID NO: 3735225 - RNA, 21 nt, Human
gcagagguccacaacacacag

SEQ ID NO: 3735226 - RNA, 14 nt, Human
gcagagguggccag

SEQ ID NO: 3735227 - RNA, 23 nt, Human
gcagagucacacgggggcagcug

SEQ ID NO: 3735228 - RNA, 12 nt, Human
gcagagucagca

SEQ ID NO: 3735229 - RNA, 13 nt, Human
gcagagucagcag

SEQ ID NO: 3735230 - RNA, 22 nt, Human
gcagaguccugcacaguuuucu

SEQ ID NO: 3735231 - RNA, 15 nt, Human
gcagagucuugcuac

SEQ ID NO: 3735232 - RNA, 23 nt, Human
gcagagucuugcuaccucaguca

SEQ ID NO: 3735233 - RNA, 17 nt, Human
gcagagugcacagcugu

SEQ ID NO: 3735234 - RNA, 17 nt, Human
gcagagugccccaccug

SEQ ID NO: 3735235 - RNA, 22 nt, Human
gcagaguggcagucuucaguuu

SEQ ID NO: 3735236 - RNA, 14 nt, Human
gcagaguucaggga

SEQ ID NO: 3735237 - RNA, 20 nt, Human
gcagaguugaagacagagcu

SEQ ID NO: 3735238 - RNA, 22 nt, Human
gcagauacaggaaaagcugcug

SEQ ID NO: 3735239 - RNA, 18 nt, Human
gcagauacugcuguguaa

SEQ ID NO: 3735240 - RNA, 14 nt, Human
gcagaucccagcuc

SEQ ID NO: 3735241 - RNA, 19 nt, Human
gcagaugagguugcuagag

SEQ ID NO: 3735242 - RNA, 18 nt, Human
gcagaugcaaagaggcaa

SEQ ID NO: 3735243 - RNA, 22 nt, Human
gcagaugcaaagaggcaagagg

SEQ ID NO: 3735244 - RNA, 15 nt, Human
gcagaugcagagagc

SEQ ID NO: 3735245 - RNA, 13 nt, Human
gcagaugccagag

SEQ ID NO: 3735246 - RNA, 18 nt, Human
gcagauggaaugcugugu

SEQ ID NO: 3735247 - RNA, 20 nt, Human
gcagauguaaaguuauucuu

SEQ ID NO: 3735248 - RNA, 16 nt, Human
gcagauguaggaggga

SEQ ID NO: 3735249 - RNA, 13 nt, Human
gcagauuauucac

SEQ ID NO: 3735250 - RNA, 23 nt, Human
gcagauugagaccuacaggcuga

SEQ ID NO: 3735251 - RNA, 14 nt, Human
gcagauuggagaaa

SEQ ID NO: 3735252 - RNA, 19 nt, Human
gcagauuggagaaacccuu

SEQ ID NO: 3735253 - RNA, 20 nt, Human
gcagauuuuacaaaagaugu

SEQ ID NO: 3735254 - RNA, 21 nt, Human
gcagauuuuacaaaagaugua

SEQ ID NO: 3735255 - RNA, 15 nt, Human
gcagcaaccagagca

SEQ ID NO: 3735256 - RNA, 17 nt, Human
gcagcaaccagagcacu

SEQ ID NO: 3735257 - RNA, 18 nt, Human
gcagcaaccagagcacug

SEQ ID NO: 3735258 - RNA, 19 nt, Human
gcagcaaccagagcacugu

SEQ ID NO: 3735259 - RNA, 16 nt, Human
gcagcaacuuguccua

SEQ ID NO: 3735260 - RNA, 17 nt, Human
gcagcaaggcccugcug

SEQ ID NO: 3735261 - RNA, 21 nt, Human
gcagcaaggucuugcucuccu

SEQ ID NO: 3735262 - RNA, 16 nt, Human
gcagcaauaaagcagc

SEQ ID NO: 3735263 - RNA, 23 nt, Human
gcagcaauaaagcagcguuucua

SEQ ID NO: 3735264 - RNA, 17 nt, Human
gcagcaauaauuucugu

SEQ ID NO: 3735265 - RNA, 14 nt, Human
gcagcaaucuuuga

SEQ ID NO: 3735266 - RNA, 12 nt, Human
gcagcacagcaa

SEQ ID NO: 3735267 - RNA, 20 nt, Human
gcagcaccgaggggccuuug

SEQ ID NO: 3735268 - RNA, 19 nt, Human
gcagcaccgccucuucccg

SEQ ID NO: 3735269 - RNA, 17 nt, Human
gcagcaccguucugugc

SEQ ID NO: 3735270 - RNA, 15 nt, Human
gcagcaccuccaggc

SEQ ID NO: 3735271 - RNA, 18 nt, Human
gcagcacggacaauaaac

SEQ ID NO: 3735272 - RNA, 18 nt, Human
gcagcacucacacaggac

SEQ ID NO: 3735273 - RNA, 13 nt, Human
gcagcagaaaacu

SEQ ID NO: 3735274 - RNA, 14 nt, Human
gcagcagaaaacuu

SEQ ID NO: 3735275 - RNA, 13 nt, Human
gcagcagaagggg

SEQ ID NO: 3735276 - RNA, 13 nt, Human
gcagcagagccug

SEQ ID NO: 3735277 - RNA, 12 nt, Human
gcagcagaggca

SEQ ID NO: 3735278 - RNA, 13 nt, Human
uaacaagagugau

SEQ ID NO: 3735279 - RNA, 13 nt, Human
uaacaagccaccc

SEQ ID NO: 3735280 - RNA, 23 nt, Human
uaacaauaacuacuguguuccug

SEQ ID NO: 3735281 - RNA, 16 nt, Human
uaacaauacaaaugga

SEQ ID NO: 3735282 - RNA, 18 nt, Human
uaacaauacaaauggauu

SEQ ID NO: 3735283 - RNA, 19 nt, Human
uaacaauacaaauggauuu

SEQ ID NO: 3735284 - RNA, 22 nt, Human
uaacaaugauauauggauaaug

SEQ ID NO: 3735285 - RNA, 20 nt, Human
uaacaaugcagcaaggcccu

SEQ ID NO: 3735286 - RNA, 21 nt, Human
uaacaaugccuauuguaauau

SEQ ID NO: 3735287 - RNA, 15 nt, Human
uaacaaugcuguauu

SEQ ID NO: 3735288 - RNA, 12 nt, Human
uaacaaugucuu

SEQ ID NO: 3735289 - RNA, 14 nt, Human
uaacaauguuaagg

SEQ ID NO: 3735290 - RNA, 15 nt, Human
uaacaauguuaagga

SEQ ID NO: 3735291 - RNA, 19 nt, Human
uaacaauguuaaggaaacu

SEQ ID NO: 3735292 - RNA, 23 nt, Human
uaacaauguuaaggaaacucuua

SEQ ID NO: 3735293 - RNA, 17 nt, Human
uaacaauuaauugucuu

SEQ ID NO: 3735294 - RNA, 14 nt, Human
uaacaauuguguag

SEQ ID NO: 3735295 - RNA, 21 nt, Human
uaacaauuuccuuuauauuua

SEQ ID NO: 3735296 - RNA, 14 nt, Human
uaacaauuucuguc

SEQ ID NO: 3735297 - RNA, 16 nt, Human
uaacaauuucuguccu

SEQ ID NO: 3735298 - RNA, 16 nt, Human
uaacacacauaaagga

SEQ ID NO: 3735299 - RNA, 20 nt, Human
uaacacacuaccgaaugugu

SEQ ID NO: 3735300 - RNA, 16 nt, Human
uaacacagagagacag

SEQ ID NO: 3735301 - RNA, 21 nt, Human
uaacacagcauuguauaugug

SEQ ID NO: 3735302 - RNA, 20 nt, Human
uaacacagugccuucaauaa

SEQ ID NO: 3735303 - RNA, 21 nt, Human
uaacacagugccuucaauaaa

SEQ ID NO: 3735304 - RNA, 14 nt, Human
uaacacauguccuu

SEQ ID NO: 3735305 - RNA, 22 nt, Human
uaacacauuaucgggagcagug

SEQ ID NO: 3735306 - RNA, 17 nt, Human
uaacacauuugauucug

SEQ ID NO: 3735307 - RNA, 18 nt, Human
uaacacauuuuguauaau

SEQ ID NO: 3735308 - RNA, 12 nt, Human
uaacacauuuuu

SEQ ID NO: 3735309 - RNA, 20 nt, Human
uaacacauuuuuuugcaugc

SEQ ID NO: 3735310 - RNA, 21 nt, Human
uaacacauuuuuuugcaugca

SEQ ID NO: 3735311 - RNA, 17 nt, Human
uaacaccugauguguac

SEQ ID NO: 3735312 - RNA, 16 nt, Human
uaacacgugaugugau

SEQ ID NO: 3735313 - RNA, 16 nt, Human
uaacacuaauauauuu

SEQ ID NO: 3735314 - RNA, 17 nt, Human
uaacacuagucugugug

SEQ ID NO: 3735315 - RNA, 18 nt, Human
uaacacuagucugugugc

SEQ ID NO: 3735316 - RNA, 14 nt, Human
uaacacucagaagc

SEQ ID NO: 3735317 - RNA, 22 nt, Human
uaacacucuaggauguauauuu

SEQ ID NO: 3735318 - RNA, 15 nt, Human
uaacacuggccccua

SEQ ID NO: 3735319 - RNA, 15 nt, Human
uaacacugugaagag

SEQ ID NO: 3735320 - RNA, 12 nt, Human
uaacagaaaugu

SEQ ID NO: 3735321 - RNA, 15 nt, Human
uaacagaaauguaca

SEQ ID NO: 3735322 - RNA, 14 nt, Human
uaacagaaauugua

SEQ ID NO: 3735323 - RNA, 22 nt, Human
uaacagaaauuguauauuguaa

SEQ ID NO: 3735324 - RNA, 21 nt, Human
uaacagaacagcuucagguua

SEQ ID NO: 3735325 - RNA, 15 nt, Human
uaacagaagaaaaua

SEQ ID NO: 3735326 - RNA, 22 nt, Human
uaacagauuuugggguuguguu

SEQ ID NO: 3735327 - RNA, 23 nt, Human
uaacagcauucuugucacaauaa

SEQ ID NO: 3735328 - RNA, 20 nt, Human
uaacagcccuccucugcacu

SEQ ID NO: 3735329 - RNA, 14 nt, Human
uaacagcucaggau

SEQ ID NO: 3735330 - RNA, 17 nt, Human
uaacagcuccuugggag

SEQ ID NO: 3735331 - RNA, 23 nt, Human
uaacagcuccuugggaggaagca

SEQ ID NO: 3735332 - RNA, 15 nt, Human
uaacagcugaggucu

SEQ ID NO: 3735333 - RNA, 16 nt, Human
uaacaggauuagacag

SEQ ID NO: 3735334 - RNA, 22 nt, Human
uaacaggcaaacauuuucucuu

SEQ ID NO: 3735335 - RNA, 22 nt, Human
uaacaggcucaauauuccugaa

SEQ ID NO: 3735336 - RNA, 23 nt, Human
uaacaggcucaauauuccugaau

SEQ ID NO: 3735337 - RNA, 21 nt, Human
uaacaggcuuagugauguaau

SEQ ID NO: 3735338 - RNA, 15 nt, Human
uaacagggaacguga

SEQ ID NO: 3735339 - RNA, 18 nt, Human
uaacagggauugauuuua

SEQ ID NO: 3735340 - RNA, 15 nt, Human
uaacagggccuugcu

SEQ ID NO: 3735341 - RNA, 17 nt, Human
uaacagggccuugcuaa

SEQ ID NO: 3735342 - RNA, 15 nt, Human
uaacaggguaaauua

SEQ ID NO: 3735343 - RNA, 19 nt, Human
uaacaggguaaauuauuca

SEQ ID NO: 3735344 - RNA, 20 nt, Human
uaacaggguaaauuauucag

SEQ ID NO: 3735345 - RNA, 22 nt, Human
uaacaggucuagaaaaccagcu

SEQ ID NO: 3735346 - RNA, 18 nt, Human
uaacaggucuccucuuaa

SEQ ID NO: 3735347 - RNA, 15 nt, Human
uaacaguaacgcagg

SEQ ID NO: 3735348 - RNA, 14 nt, Human
uaacagucauuuaa

SEQ ID NO: 3735349 - RNA, 21 nt, Human
uaacaguccuaacugguauag

SEQ ID NO: 3735350 - RNA, 21 nt, Human
uaacagugcagggcaaaauau

SEQ ID NO: 3735351 - RNA, 21 nt, Human
uaacagugcauauuccuuucu

SEQ ID NO: 3735352 - RNA, 17 nt, Human
uaacagugccauugucu

SEQ ID NO: 3735353 - RNA, 18 nt, Human
uaacagugccauugucuu

SEQ ID NO: 3735354 - RNA, 15 nt, Human
uaacaguuuuccaug

SEQ ID NO: 3735355 - RNA, 17 nt, Human
uaacaguuuuccaugaa

SEQ ID NO: 3735356 - RNA, 14 nt, Human
uaacauaagcuauu

SEQ ID NO: 3735357 - RNA, 15 nt, Human
uaacauaauaaauua

SEQ ID NO: 3735358 - RNA, 17 nt, Human
uaacauaauaaauuaaa

SEQ ID NO: 3735359 - RNA, 16 nt, Human
uaacauaauuuguaca

SEQ ID NO: 3735360 - RNA, 14 nt, Human
uaacauauaauguu

SEQ ID NO: 3735361 - RNA, 20 nt, Human
uaacauauucuguaugaacu

SEQ ID NO: 3735362 - RNA, 14 nt, Human
uaacauauuuacua

SEQ ID NO: 3735363 - RNA, 14 nt, Human
uaacaucaaagauu

SEQ ID NO: 3735364 - RNA, 20 nt, Human
uaacaucacuauccaugcac

SEQ ID NO: 3735365 - RNA, 21 nt, Human
uaacaucacuauccaugcacc

SEQ ID NO: 3735366 - RNA, 20 nt, Human
uaacaucauuuuguuuucca

SEQ ID NO: 3735367 - RNA, 23 nt, Human
uaacauccaauaggaaugcuaac

SEQ ID NO: 3735368 - RNA, 20 nt, Human
uaacaucuaaaaauagacuu

SEQ ID NO: 3735369 - RNA, 18 nt, Human
uaacaugaaaugauagau

SEQ ID NO: 3735370 - RNA, 19 nt, Human
uaacaugaaaugauagauu

SEQ ID NO: 3735371 - RNA, 21 nt, Human
uaacaugaauauuuaguguuc

SEQ ID NO: 3735372 - RNA, 20 nt, Human
uaacaugaggggacauuuug

SEQ ID NO: 3735373 - RNA, 23 nt, Human
uaacaugaggggacauuuuggug

SEQ ID NO: 3735374 - RNA, 20 nt, Human
uaacaugcccauauuuuacu

SEQ ID NO: 3735375 - RNA, 15 nt, Human
uaacaugcuguguaa

SEQ ID NO: 3735376 - RNA, 18 nt, Human
uaacauggaagggaagaa

SEQ ID NO: 3735377 - RNA, 16 nt, Human
uaacauggaaguacua

SEQ ID NO: 3735378 - RNA, 21 nt, Human
uaacaugggcucuucacuagu

SEQ ID NO: 3735379 - RNA, 17 nt, Human
uaacauguaauuaagua

SEQ ID NO: 3735380 - RNA, 15 nt, Human
uaacauguaggaagu

SEQ ID NO: 3735381 - RNA, 15 nt, Human
uaacauguaucccaa

SEQ ID NO: 3735382 - RNA, 16 nt, Human
uaacauguuaaaccau

SEQ ID NO: 3735383 - RNA, 12 nt, Human
uaacauuaccuu

SEQ ID NO: 3735384 - RNA, 13 nt, Human
uaacauuccaaga

SEQ ID NO: 3735385 - RNA, 17 nt, Human
uaacauuccuaaaaugc

SEQ ID NO: 3735386 - RNA, 23 nt, Human
uaacauuccucaugaauguaaau

SEQ ID NO: 3735387 - RNA, 16 nt, Human
uaacauucgaucucau

SEQ ID NO: 3735388 - RNA, 15 nt, Human
uaacauucuauuuca

SEQ ID NO: 3735389 - RNA, 15 nt, Human
uaacauugaccaaga

SEQ ID NO: 3735390 - RNA, 23 nt, Human
uaacauugaccaagaacugcaug

SEQ ID NO: 3735391 - RNA, 18 nt, Human
uaacauuugagucccuuc

SEQ ID NO: 3735392 - RNA, 11 nt, Human
uaacauuugcc

SEQ ID NO: 3735393 - RNA, 23 nt, Human
uaacauuugccuugcagaacugc

SEQ ID NO: 3735394 - RNA, 13 nt, Human
uaacauuugcugu

SEQ ID NO: 3735395 - RNA, 16 nt, Human
uaacauuugcuguuuu

SEQ ID NO: 3735396 - RNA, 17 nt, Human
uaacauuugcuguuuua

SEQ ID NO: 3735397 - RNA, 21 nt, Human
uaacauuuuaaauaaaagaaa

SEQ ID NO: 3735398 - RNA, 11 nt, Human
uaacauuuugu

SEQ ID NO: 3735399 - RNA, 21 nt, Human
uaacauuuuguucuuacacau

SEQ ID NO: 3735400 - RNA, 19 nt, Human
uaacauuuuucaauagcgu

SEQ ID NO: 3735401 - RNA, 20 nt, Human
uaaccaaaaagaccagacua

SEQ ID NO: 3735402 - RNA, 18 nt, Human
uaaccaaaggugaaggaa

SEQ ID NO: 3735403 - RNA, 14 nt, Human
uaaccaaaugcauc

SEQ ID NO: 3735404 - RNA, 22 nt, Human
uaaccaaaugcaucaauccugu

SEQ ID NO: 3735405 - RNA, 15 nt, Human
uaaccaagaggcugg

SEQ ID NO: 3735406 - RNA, 16 nt, Human
uaaccaagaggcuggu

SEQ ID NO: 3735407 - RNA, 16 nt, Human
uaaccaagcugaguuu

SEQ ID NO: 3735408 - RNA, 11 nt, Human
uaaccaaguuc

SEQ ID NO: 3735409 - RNA, 15 nt, Human
uaaccaaucuacaau

SEQ ID NO: 3735410 - RNA, 19 nt, Human
uaaccacaaagcacaguuu

SEQ ID NO: 3735411 - RNA, 21 nt, Human
uaaccacaacuuucacuauaa

SEQ ID NO: 3735412 - RNA, 13 nt, Human
uaaccacagcucc

SEQ ID NO: 3735413 - RNA, 21 nt, Human
uaaccacagcuccuuuuccag

SEQ ID NO: 3735414 - RNA, 18 nt, Human
uaaccacaucaauauugu

SEQ ID NO: 3735415 - RNA, 16 nt, Human
uaaccaccccaucugc

SEQ ID NO: 3735416 - RNA, 13 nt, Human
uaaccacggaaaa

SEQ ID NO: 3735417 - RNA, 15 nt, Human
uaaccacggaaaaga

SEQ ID NO: 3735418 - RNA, 22 nt, Human
uaaccacgucugucuucacagc

SEQ ID NO: 3735419 - RNA, 12 nt, Human
uaaccacugcuu

SEQ ID NO: 3735420 - RNA, 13 nt, Human
uaaccacugcuuc

SEQ ID NO: 3735421 - RNA, 16 nt, Human
uaaccagacacaaacu

SEQ ID NO: 3735422 - RNA, 20 nt, Human
uaaccagacacauacucauu

SEQ ID NO: 3735423 - RNA, 13 nt, Human
uaaccagagcaag

SEQ ID NO: 3735424 - RNA, 21 nt, Human
uaaccagagcaagcuuuuuua

SEQ ID NO: 3735425 - RNA, 12 nt, Human
uaaccagcagaa

SEQ ID NO: 3735426 - RNA, 16 nt, Human
uaaccagcagaaaugc

SEQ ID NO: 3735427 - RNA, 22 nt, Human
uaauuuaaaaauauauuuauaa

SEQ ID NO: 3735428 - RNA, 19 nt, Human
uaauuuaaaauugugaugu

SEQ ID NO: 3735429 - RNA, 11 nt, Human
uaauuuaaaca

SEQ ID NO: 3735430 - RNA, 17 nt, Human
uaauuuaaacaccuccu

SEQ ID NO: 3735431 - RNA, 14 nt, Human
uaauuuaaagagac

SEQ ID NO: 3735432 - RNA, 22 nt, Human
uaauuuaaggucuguuugcugu

SEQ ID NO: 3735433 - RNA, 20 nt, Human
uaauuuaaguuuugacaagc

SEQ ID NO: 3735434 - RNA, 19 nt, Human
uaauuuacaaaaauauaaa

SEQ ID NO: 3735435 - RNA, 21 nt, Human
uaauuuaccuaagauuacaaa

SEQ ID NO: 3735436 - RNA, 22 nt, Human
uaauuuaccuaagauuacaaau

SEQ ID NO: 3735437 - RNA, 15 nt, Human
uaauuuagaaaacuu

SEQ ID NO: 3735438 - RNA, 17 nt, Human
uaauuuagaaaacuuua

SEQ ID NO: 3735439 - RNA, 21 nt, Human
uaauuuagaaaacuuuaaagc

SEQ ID NO: 3735440 - RNA, 15 nt, Human
uaauuuagaaaucau

SEQ ID NO: 3735441 - RNA, 21 nt, Human
uaauuuagacuuggauucuuu

SEQ ID NO: 3735442 - RNA, 16 nt, Human
uaauuuagauuguaaa

SEQ ID NO: 3735443 - RNA, 16 nt, Human
uaauuuaguaaauguu

SEQ ID NO: 3735444 - RNA, 17 nt, Human
uaauuuaguuucauaua

SEQ ID NO: 3735445 - RNA, 13 nt, Human
uaauuuauaaaaa

SEQ ID NO: 3735446 - RNA, 14 nt, Human
uaauuuauacuggc

SEQ ID NO: 3735447 - RNA, 19 nt, Human
uaauuuauacuggcaugcu

SEQ ID NO: 3735448 - RNA, 22 nt, Human
uaauuuauaguaaugaguuuaa

SEQ ID NO: 3735449 - RNA, 14 nt, Human
uaauuuaucuaaau

SEQ ID NO: 3735450 - RNA, 17 nt, Human
uaauuuauuaauugcuu

SEQ ID NO: 3735451 - RNA, 20 nt, Human
uaauuuauuaauugcuuuga

SEQ ID NO: 3735452 - RNA, 14 nt, Human
uaauuuauuauuga

SEQ ID NO: 3735453 - RNA, 14 nt, Human
uaauuuauuuauua

SEQ ID NO: 3735454 - RNA, 17 nt, Human
uaauuucaaaaauauaa

SEQ ID NO: 3735455 - RNA, 16 nt, Human
uaauuucaaaaugcuu

SEQ ID NO: 3735456 - RNA, 11 nt, Human
uaauuucaagc

SEQ ID NO: 3735457 - RNA, 12 nt, Human
uaauuucagggu

SEQ ID NO: 3735458 - RNA, 17 nt, Human
uaauuuccuuuuugaca

SEQ ID NO: 3735459 - RNA, 17 nt, Human
uaauuucuaaagauaau

SEQ ID NO: 3735460 - RNA, 22 nt, Human
uaauuucuaaagauaauauuac

SEQ ID NO: 3735461 - RNA, 20 nt, Human
uaauuucuagaaacaaacau

SEQ ID NO: 3735462 - RNA, 14 nt, Human
uaauuucuccuccc

SEQ ID NO: 3735463 - RNA, 19 nt, Human
uaauuucuccucccuuccu

SEQ ID NO: 3735464 - RNA, 19 nt, Human
uaauuucuuacuaaacauu

SEQ ID NO: 3735465 - RNA, 11 nt, Human
uaauuucuuca

SEQ ID NO: 3735466 - RNA, 23 nt, Human
uaauuucuucaaaauguauauau

SEQ ID NO: 3735467 - RNA, 17 nt, Human
uaauuucuuuuuuuccu

SEQ ID NO: 3735468 - RNA, 13 nt, Human
uaauuugaagauu

SEQ ID NO: 3735469 - RNA, 15 nt, Human
uaauuugacuagaaa

SEQ ID NO: 3735470 - RNA, 18 nt, Human
uaauuugaggacaaccau

SEQ ID NO: 3735471 - RNA, 22 nt, Human
uaauuugaggacaaccauucca

SEQ ID NO: 3735472 - RNA, 16 nt, Human
uaauuugaugaaagcu

SEQ ID NO: 3735473 - RNA, 19 nt, Human
uaauuugaugaaagcugau

SEQ ID NO: 3735474 - RNA, 15 nt, Human
uaauuugauuaacaa

SEQ ID NO: 3735475 - RNA, 16 nt, Human
uaauuugcauuaaauu

SEQ ID NO: 3735476 - RNA, 20 nt, Human
uaauuugcauuaaauucaca

SEQ ID NO: 3735477 - RNA, 17 nt, Human
uaauuugccaaaauaau

SEQ ID NO: 3735478 - RNA, 19 nt, Human
uaauuugccaaaauaaugu

SEQ ID NO: 3735479 - RNA, 14 nt, Human
uaauuugcugcuga

SEQ ID NO: 3735480 - RNA, 15 nt, Human
uaauuuggaaacuaa

SEQ ID NO: 3735481 - RNA, 17 nt, Human
uaauuuggaaacuaaua

SEQ ID NO: 3735482 - RNA, 22 nt, Human
uaauuuggaaacuaauaaaaua

SEQ ID NO: 3735483 - RNA, 19 nt, Human
uaauuuggaccauuuuccu

SEQ ID NO: 3735484 - RNA, 23 nt, Human
uaauuuggagcacaaaauucaaa

SEQ ID NO: 3735485 - RNA, 13 nt, Human
uaauuuguaucug

SEQ ID NO: 3735486 - RNA, 15 nt, Human
uaauuugugauacaa

SEQ ID NO: 3735487 - RNA, 22 nt, Human
uaauuugugauacaaugcugug

SEQ ID NO: 3735488 - RNA, 16 nt, Human
uaauuuguuuccagca

SEQ ID NO: 3735489 - RNA, 13 nt, Human
uaauuuuaaauaa

SEQ ID NO: 3735490 - RNA, 13 nt, Human
uaauuuuaagaaa

SEQ ID NO: 3735491 - RNA, 12 nt, Human
uaauuuuaauau

SEQ ID NO: 3735492 - RNA, 20 nt, Human
uaauuuuacacgcuuuugug

SEQ ID NO: 3735493 - RNA, 14 nt, Human
uaauuuuaguuuuu

SEQ ID NO: 3735494 - RNA, 20 nt, Human
uaauuuuaugaacugcaugu

SEQ ID NO: 3735495 - RNA, 18 nt, Human
uaauuuuauuuuaaaauu

SEQ ID NO: 3735496 - RNA, 14 nt, Human
uaauuuucuucaug

SEQ ID NO: 3735497 - RNA, 23 nt, Human
uaauuuucuucaugcaaugacau

SEQ ID NO: 3735498 - RNA, 17 nt, Human
uaauuuucuugaugacu

SEQ ID NO: 3735499 - RNA, 22 nt, Human
uaauuuugaagugcuguuuauu

SEQ ID NO: 3735500 - RNA, 20 nt, Human
uaauuuugacacugaaauaa

SEQ ID NO: 3735501 - RNA, 18 nt, Human
uaauuuugauagugggac

SEQ ID NO: 3735502 - RNA, 13 nt, Human
uaauuuuggauuu

SEQ ID NO: 3735503 - RNA, 21 nt, Human
uaauuuugguuguauucuuug

SEQ ID NO: 3735504 - RNA, 19 nt, Human
uaauuuuguaauguaucaa

SEQ ID NO: 3735505 - RNA, 14 nt, Human
uaauuuuguauuuu

SEQ ID NO: 3735506 - RNA, 18 nt, Human
uaauuuuguauuuuccaa

SEQ ID NO: 3735507 - RNA, 19 nt, Human
uaauuuuguucuaguuuuc

SEQ ID NO: 3735508 - RNA, 13 nt, Human
uaauuuuuaaagu

SEQ ID NO: 3735509 - RNA, 13 nt, Human
uaauuuuuaaaug

SEQ ID NO: 3735510 - RNA, 16 nt, Human
uaauuuuugcucuaga

SEQ ID NO: 3735511 - RNA, 20 nt, Human
uaauuuuugcuuuuagaaaa

SEQ ID NO: 3735512 - RNA, 15 nt, Human
uaauuuuuguauuuu

SEQ ID NO: 3735513 - RNA, 22 nt, Human
uaauuuuuguguuuuuaauaaa

SEQ ID NO: 3735514 - RNA, 15 nt, Human
uaauuuuuugguaca

SEQ ID NO: 3735515 - RNA, 17 nt, Human
uaauuuuuugguacaaa

SEQ ID NO: 3735516 - RNA, 20 nt, Human
uaauuuuuuuaaccaaaggu

SEQ ID NO: 3735517 - RNA, 21 nt, Human
uaauuuuuuucaccuagauuu

SEQ ID NO: 3735518 - RNA, 16 nt, Human
uaauuuuuuuuaguau

SEQ ID NO: 3735519 - RNA, 19 nt, Human
uacaaaaaaaaaguuuuau

SEQ ID NO: 3735520 - RNA, 17 nt, Human
uacaaaaacacagcaag

SEQ ID NO: 3735521 - RNA, 16 nt, Human
uacaaaaacauggccu

SEQ ID NO: 3735522 - RNA, 13 nt, Human
uacaaaaagaaaa

SEQ ID NO: 3735523 - RNA, 20 nt, Human
uacaaaaagcauaaaaauua

SEQ ID NO: 3735524 - RNA, 17 nt, Human
uacaaaaauaaauuuau

SEQ ID NO: 3735525 - RNA, 18 nt, Human
uacaaaaauauaaaauau

SEQ ID NO: 3735526 - RNA, 20 nt, Human
uacaaaaauauaaaauauga

SEQ ID NO: 3735527 - RNA, 16 nt, Human
uacaaaaaucagccag

SEQ ID NO: 3735528 - RNA, 17 nt, Human
uacaaaaaucagccaga

SEQ ID NO: 3735529 - RNA, 13 nt, Human
uacaaaaauuccu

SEQ ID NO: 3735530 - RNA, 14 nt, Human
uacaaaacaaacuc

SEQ ID NO: 3735531 - RNA, 22 nt, Human
uacaaaacaaacucauucauua

SEQ ID NO: 3735532 - RNA, 21 nt, Human
uacaaaaccacaguguaccau

SEQ ID NO: 3735533 - RNA, 17 nt, Human
uacaaaacgcgcagaug

SEQ ID NO: 3735534 - RNA, 12 nt, Human
uacaaaacuuua

SEQ ID NO: 3735535 - RNA, 16 nt, Human
uacaaaagaagaugaa

SEQ ID NO: 3735536 - RNA, 21 nt, Human
uacaaaagaagggcugguauu

SEQ ID NO: 3735537 - RNA, 13 nt, Human
uacaaaaggcucc

SEQ ID NO: 3735538 - RNA, 18 nt, Human
uacaaaauaaaguuacau

SEQ ID NO: 3735539 - RNA, 15 nt, Human
uacaaaauguaacug

SEQ ID NO: 3735540 - RNA, 15 nt, Human
uacaaaauuaagcaa

SEQ ID NO: 3735541 - RNA, 19 nt, Human
uacaaaauuugaaauuuag

SEQ ID NO: 3735542 - RNA, 18 nt, Human
uacaaacaagcauauaaa

SEQ ID NO: 3735543 - RNA, 17 nt, Human
uacaaacaccuggacuu

SEQ ID NO: 3735544 - RNA, 12 nt, Human
uacaaacauauu

SEQ ID NO: 3735545 - RNA, 15 nt, Human
uacaaacauauuugu

SEQ ID NO: 3735546 - RNA, 16 nt, Human
uacaaacuaaggugcu

SEQ ID NO: 3735547 - RNA, 11 nt, Human
uacaaacugca

SEQ ID NO: 3735548 - RNA, 12 nt, Human
uacaaacugcaa

SEQ ID NO: 3735549 - RNA, 13 nt, Human
uacaaacugcaau

SEQ ID NO: 3735550 - RNA, 17 nt, Human
uacaaacugcaauagag

SEQ ID NO: 3735551 - RNA, 22 nt, Human
uacaaagaagacauguuuuaga

SEQ ID NO: 3735552 - RNA, 16 nt, Human
uacaaagauucucuau

SEQ ID NO: 3735553 - RNA, 16 nt, Human
uacaaagcgugcacaa

SEQ ID NO: 3735554 - RNA, 23 nt, Human
uacaaaggggaaagaacauaaag

SEQ ID NO: 3735555 - RNA, 15 nt, Human
uacaaagguuuaaau

SEQ ID NO: 3735556 - RNA, 17 nt, Human
uacaaagguuuaaauga

SEQ ID NO: 3735557 - RNA, 15 nt, Human
uacaaaguguguauu

SEQ ID NO: 3735558 - RNA, 12 nt, Human
uacaaauacucu

SEQ ID NO: 3735559 - RNA, 19 nt, Human
uacaaauacucuuaggaag

SEQ ID NO: 3735560 - RNA, 17 nt, Human
uacaaauauaaaucuua

SEQ ID NO: 3735561 - RNA, 14 nt, Human
uacaaauauaagaa

SEQ ID NO: 3735562 - RNA, 17 nt, Human
uacaaauauaagaauaa

SEQ ID NO: 3735563 - RNA, 15 nt, Human
uacaaauauauuguu

SEQ ID NO: 3735564 - RNA, 17 nt, Human
uacaaauauauuguuaa

SEQ ID NO: 3735565 - RNA, 16 nt, Human
uacaaaucagaaguca

SEQ ID NO: 3735566 - RNA, 17 nt, Human
uacaaaucagaagucau

SEQ ID NO: 3735567 - RNA, 19 nt, Human
uacaaaucagaagucaucu

SEQ ID NO: 3735568 - RNA, 12 nt, Human
uacaaaugaaaa

SEQ ID NO: 3735569 - RNA, 23 nt, Human
uacaaaugauugcuuuuaaaauu

SEQ ID NO: 3735570 - RNA, 19 nt, Human
uacaaaugcaucuuugaug

SEQ ID NO: 3735571 - RNA, 19 nt, Human
uacaaaugccuuaaaaugg

SEQ ID NO: 3735572 - RNA, 21 nt, Human
uacaaaugccuuaaaauggaa

SEQ ID NO: 3735573 - RNA, 22 nt, Human
uacaaaugccuuaaaauggaau

SEQ ID NO: 3735574 - RNA, 12 nt, Human
uacaaauguuuu

SEQ ID NO: 3735575 - RNA, 19 nt, Human
uacaaauuaaaaagauucu

SEQ ID NO: 3735576 - RNA, 15 nt, Human
uacaaauuagaaaau

SEQ ID NO: 3735577 - RNA, 19 nt, Human
uacaaauuauaaaaagcca

SEQ ID NO: 3735578 - RNA, 19 nt, Human
uaaccagcagaaaugccuu

SEQ ID NO: 3735579 - RNA, 15 nt, Human
uaaccagcuguaaca

SEQ ID NO: 3735580 - RNA, 17 nt, Human
uaaccaggggccaugaa

SEQ ID NO: 3735581 - RNA, 22 nt, Human
uaaccaguuaccacacaucuau

SEQ ID NO: 3735582 - RNA, 17 nt, Human
uaaccaucacugguugc

SEQ ID NO: 3735583 - RNA, 17 nt, Human
uaaccauggugcuuguu

SEQ ID NO: 3735584 - RNA, 18 nt, Human
uaaccauugucuuguucu

SEQ ID NO: 3735585 - RNA, 20 nt, Human
uaaccauugucuuguucugu

SEQ ID NO: 3735586 - RNA, 23 nt, Human
uaaccauugucuuguucugugau

SEQ ID NO: 3735587 - RNA, 12 nt, Human
uaacccaaggag

SEQ ID NO: 3735588 - RNA, 24 nt, Human
uaacccacuugucacugacacaaa

SEQ ID NO: 3735589 - RNA, 13 nt, Human
uaacccagaaaau

SEQ ID NO: 3735590 - RNA, 13 nt, Human
uaacccagauuuu

SEQ ID NO: 3735591 - RNA, 15 nt, Human
uaaccccaaaaugaa

SEQ ID NO: 3735592 - RNA, 15 nt, Human
uaaccccauucuuug

SEQ ID NO: 3735593 - RNA, 16 nt, Human
uaaccccauucuuugc

SEQ ID NO: 3735594 - RNA, 14 nt, Human
uaacccuacaccca

SEQ ID NO: 3735595 - RNA, 17 nt, Human
uaacccuuugugugcuc

SEQ ID NO: 3735596 - RNA, 23 nt, Human
uaaccgagaucaguauuuaacua

SEQ ID NO: 3735597 - RNA, 15 nt, Human
uaaccgaugcuuuac

SEQ ID NO: 3735598 - RNA, 19 nt, Human
uaaccgcacaugcacacac

SEQ ID NO: 3735599 - RNA, 17 nt, Human
uaaccuaguuaaagaaa

SEQ ID NO: 3735600 - RNA, 20 nt, Human
uaaccuaguuaaagaaagga

SEQ ID NO: 3735601 - RNA, 15 nt, Human
uaaccucagcucugg

SEQ ID NO: 3735602 - RNA, 16 nt, Human
uaaccucagcucuggg

SEQ ID NO: 3735603 - RNA, 19 nt, Human
uaaccucagugucauuuau

SEQ ID NO: 3735604 - RNA, 14 nt, Human
uaaccucaucuucu

SEQ ID NO: 3735605 - RNA, 18 nt, Human
uaaccucaucuucuucac

SEQ ID NO: 3735606 - RNA, 16 nt, Human
uaaccucgcccucucc

SEQ ID NO: 3735607 - RNA, 16 nt, Human
uaaccucuaaauucuu

SEQ ID NO: 3735608 - RNA, 17 nt, Human
uaaccucuucagaggcc

SEQ ID NO: 3735609 - RNA, 18 nt, Human
uaaccugagauggcccuc

SEQ ID NO: 3735610 - RNA, 16 nt, Human
uaaccugcaaaaucug

SEQ ID NO: 3735611 - RNA, 19 nt, Human
uaaccugccagggagacag

SEQ ID NO: 3735612 - RNA, 15 nt, Human
uaaccuggugcugga

SEQ ID NO: 3735613 - RNA, 13 nt, Human
uaaccugugucug

SEQ ID NO: 3735614 - RNA, 22 nt, Human
uaaccugugucugcgaaguccu

SEQ ID NO: 3735615 - RNA, 17 nt, Human
uaaccuuaucauaaauu

SEQ ID NO: 3735616 - RNA, 18 nt, Human
uaaccuuauccugcauug

SEQ ID NO: 3735617 - RNA, 19 nt, Human
uaaccuugaaugcugccag

SEQ ID NO: 3735618 - RNA, 20 nt, Human
uaaccuugaaugcugccagu

SEQ ID NO: 3735619 - RNA, 16 nt, Human
uaaccuugccugguac

SEQ ID NO: 3735620 - RNA, 14 nt, Human
uaaccuuuacauga

SEQ ID NO: 3735621 - RNA, 20 nt, Human
uaacgcccuauuuuugcaau

SEQ ID NO: 3735622 - RNA, 14 nt, Human
uaacgccugagccc

SEQ ID NO: 3735623 - RNA, 15 nt, Human
uaacgcgucuuccug

SEQ ID NO: 3735624 - RNA, 14 nt, Human
uaacggaucagaaa

SEQ ID NO: 3735625 - RNA, 22 nt, Human
uaacggucuguucuguuucaag

SEQ ID NO: 3735626 - RNA, 15 nt, Human
uaacguaaauacaca

SEQ ID NO: 3735627 - RNA, 13 nt, Human
uaacguauaaaag

SEQ ID NO: 3735628 - RNA, 22 nt, Human
uaacguguaucuuuaagaaaaa

SEQ ID NO: 3735629 - RNA, 16 nt, Human
uaacguugagccccug

SEQ ID NO: 3735630 - RNA, 14 nt, Human
uaacguugcugugg

SEQ ID NO: 3735631 - RNA, 17 nt, Human
uaacguuuaagccaaaa

SEQ ID NO: 3735632 - RNA, 15 nt, Human
uaacguuuuuccuuu

SEQ ID NO: 3735633 - RNA, 18 nt, Human
uaacguuuuuccuuuaaa

SEQ ID NO: 3735634 - RNA, 20 nt, Human
uaacuaaaacaaagccacuu

SEQ ID NO: 3735635 - RNA, 21 nt, Human
uaacuaaaauaauuuuguaau

SEQ ID NO: 3735636 - RNA, 16 nt, Human
uaacuaaaauguaucu

SEQ ID NO: 3735637 - RNA, 17 nt, Human
uaacuaaaauguaucua

SEQ ID NO: 3735638 - RNA, 23 nt, Human
uaacuaaaauguaucuaagaaua

SEQ ID NO: 3735639 - RNA, 17 nt, Human
uaacuaaauuugauacu

SEQ ID NO: 3735640 - RNA, 16 nt, Human
uaacuaacauguccug

SEQ ID NO: 3735641 - RNA, 18 nt, Human
uaacuaacugcauacacu

SEQ ID NO: 3735642 - RNA, 15 nt, Human
uaacuacaaaugauc

SEQ ID NO: 3735643 - RNA, 14 nt, Human
uaacuacauuuaug

SEQ ID NO: 3735644 - RNA, 20 nt, Human
uaacuacccuuaauuacuua

SEQ ID NO: 3735645 - RNA, 22 nt, Human
uaacuacccuuaauuacuuaaa

SEQ ID NO: 3735646 - RNA, 17 nt, Human
uaacuaccuuuggcuua

SEQ ID NO: 3735647 - RNA, 15 nt, Human
uaacuacuaguuuuu

SEQ ID NO: 3735648 - RNA, 22 nt, Human
uaacuacuauauugauuguccu

SEQ ID NO: 3735649 - RNA, 15 nt, Human
uaacuacuguguucc

SEQ ID NO: 3735650 - RNA, 17 nt, Human
uaacuacuguguuccug

SEQ ID NO: 3735651 - RNA, 16 nt, Human
uaacuacuuuauaacu

SEQ ID NO: 3735652 - RNA, 18 nt, Human
uaacuagaauuuauucaa

SEQ ID NO: 3735653 - RNA, 18 nt, Human
uaacuagacaccaaaguu

SEQ ID NO: 3735654 - RNA, 21 nt, Human
uaacuagagcagcccuggagu

SEQ ID NO: 3735655 - RNA, 22 nt, Human
uaacuagagcagcccuggaguc

SEQ ID NO: 3735656 - RNA, 19 nt, Human
uaacuagauggugcugaga

SEQ ID NO: 3735657 - RNA, 21 nt, Human
uaacuagauggugcugagaag

SEQ ID NO: 3735658 - RNA, 13 nt, Human
uaacuaguggcuc

SEQ ID NO: 3735659 - RNA, 17 nt, Human
uaacuaguguugcuugg

SEQ ID NO: 3735660 - RNA, 18 nt, Human
uaacuauauuugcuuuuu

SEQ ID NO: 3735661 - RNA, 14 nt, Human
uaacuauguacaau

SEQ ID NO: 3735662 - RNA, 14 nt, Human
uaacuauucaguug

SEQ ID NO: 3735663 - RNA, 23 nt, Human
uaacuauugcauuuauauguacc

SEQ ID NO: 3735664 - RNA, 19 nt, Human
uaacuauuuuauuuucuaa

SEQ ID NO: 3735665 - RNA, 20 nt, Human
uaacucaaauacacauuugc

SEQ ID NO: 3735666 - RNA, 22 nt, Human
uaacucaauauuuuccaugaaa

SEQ ID NO: 3735667 - RNA, 14 nt, Human
uaacucagaucacu

SEQ ID NO: 3735668 - RNA, 20 nt, Human
uaacucagaucacuacugca

SEQ ID NO: 3735669 - RNA, 18 nt, Human
uaacucaggacuccagcc

SEQ ID NO: 3735670 - RNA, 19 nt, Human
uaacucauaccuuuaaagg

SEQ ID NO: 3735671 - RNA, 14 nt, Human
uaacucaucuguca

SEQ ID NO: 3735672 - RNA, 12 nt, Human
uaacucauuaga

SEQ ID NO: 3735673 - RNA, 15 nt, Human
uaacucauugcucug

SEQ ID NO: 3735674 - RNA, 15 nt, Human
uaacuccccacccca

SEQ ID NO: 3735675 - RNA, 23 nt, Human
uaacuccccuguuucaaucacug

SEQ ID NO: 3735676 - RNA, 17 nt, Human
uaacuccuaagaggagc

SEQ ID NO: 3735677 - RNA, 15 nt, Human
uaacuccucccaggg

SEQ ID NO: 3735678 - RNA, 18 nt, Human
uaacuccucccaggguuu

SEQ ID NO: 3735679 - RNA, 14 nt, Human
uaacuccuucuugu

SEQ ID NO: 3735680 - RNA, 16 nt, Human
uaacucuaaaagaucc

SEQ ID NO: 3735681 - RNA, 16 nt, Human
uaacucugauguaaau

SEQ ID NO: 3735682 - RNA, 17 nt, Human
uaacucugauguaaaug

SEQ ID NO: 3735683 - RNA, 18 nt, Human
uaacucuguaaaaacacu

SEQ ID NO: 3735684 - RNA, 22 nt, Human
uaacucuucuuucauuucuucu

SEQ ID NO: 3735685 - RNA, 13 nt, Human
uaacucuuuggau

SEQ ID NO: 3735686 - RNA, 14 nt, Human
uaacugaaaaugug

SEQ ID NO: 3735687 - RNA, 16 nt, Human
uaacugaaauaaaaaa

SEQ ID NO: 3735688 - RNA, 15 nt, Human
uaacugaacuuugaa

SEQ ID NO: 3735689 - RNA, 17 nt, Human
uaacugaagauguugag

SEQ ID NO: 3735690 - RNA, 15 nt, Human
uaacugaauaccacu

SEQ ID NO: 3735691 - RNA, 13 nt, Human
uaacugaauuugg

SEQ ID NO: 3735692 - RNA, 16 nt, Human
uaacugacaaaucaag

SEQ ID NO: 3735693 - RNA, 19 nt, Human
uaacugacaaaucaaguuu

SEQ ID NO: 3735694 - RNA, 11 nt, Human
uaacugacaag

SEQ ID NO: 3735695 - RNA, 22 nt, Human
uaacugacaagcuccauuuaaa

SEQ ID NO: 3735696 - RNA, 15 nt, Human
uaacugacuuaguuc

SEQ ID NO: 3735697 - RNA, 20 nt, Human
uaacugaguagcucuccuga

SEQ ID NO: 3735698 - RNA, 23 nt, Human
uaacugaguagcucuccugacuu

SEQ ID NO: 3735699 - RNA, 21 nt, Human
uaacugauuugcaauaaaaau

SEQ ID NO: 3735700 - RNA, 12 nt, Human
uaacugcaauuu

SEQ ID NO: 3735701 - RNA, 17 nt, Human
uaacugcccagcggaca

SEQ ID NO: 3735702 - RNA, 14 nt, Human
uaacugccuagaaa

SEQ ID NO: 3735703 - RNA, 22 nt, Human
uaacugccuugaaccugugagu

SEQ ID NO: 3735704 - RNA, 11 nt, Human
uaacugcucuu

SEQ ID NO: 3735705 - RNA, 16 nt, Human
uaacugcucuugggca

SEQ ID NO: 3735706 - RNA, 15 nt, Human
uaacuggaaaacaga

SEQ ID NO: 3735707 - RNA, 19 nt, Human
uaacuggaaaacagaacac

SEQ ID NO: 3735708 - RNA, 21 nt, Human
uaacuggaaaacagaacacuu

SEQ ID NO: 3735709 - RNA, 22 nt, Human
uaacuggaagcauguaggagaa

SEQ ID NO: 3735710 - RNA, 23 nt, Human
uaacuggcaguuuuccauugguu

SEQ ID NO: 3735711 - RNA, 13 nt, Human
uaacugguauaga

SEQ ID NO: 3735712 - RNA, 20 nt, Human
uaacuggugcacuuuguaaa

SEQ ID NO: 3735713 - RNA, 16 nt, Human
uaacuguaauuauuug

SEQ ID NO: 3735714 - RNA, 19 nt, Human
uaacuguauauuuguauga

SEQ ID NO: 3735715 - RNA, 20 nt, Human
uaacuguauauuuguaugau

SEQ ID NO: 3735716 - RNA, 11 nt, Human
uaacuguaucu

SEQ ID NO: 3735717 - RNA, 12 nt, Human
uaacuguauuug

SEQ ID NO: 3735718 - RNA, 14 nt, Human
uaacuguccugucc

SEQ ID NO: 3735719 - RNA, 15 nt, Human
uaacuguccuguccu

SEQ ID NO: 3735720 - RNA, 18 nt, Human
uaacugugaaguuuacau

SEQ ID NO: 3735721 - RNA, 15 nt, Human
uaacugugcugaaug

SEQ ID NO: 3735722 - RNA, 13 nt, Human
uaacugugguguu

SEQ ID NO: 3735723 - RNA, 22 nt, Human
uaacuguguauguacauauaua

SEQ ID NO: 3735724 - RNA, 14 nt, Human
uaacuguuacagua

SEQ ID NO: 3735725 - RNA, 17 nt, Human
uaacuguuacaguaaug

SEQ ID NO: 3735726 - RNA, 13 nt, Human
uaacuguuaccau

SEQ ID NO: 3735727 - RNA, 15 nt, Human
uaacuguuaccauug

SEQ ID NO: 3735728 - RNA, 18 nt, Human
uaacuguuaccauuggaa

SEQ ID NO: 3735729 - RNA, 15 nt, Human
gcagcagaggcacug

SEQ ID NO: 3735730 - RNA, 19 nt, Human
gcagcagauuggaaggaga

SEQ ID NO: 3735731 - RNA, 23 nt, Human
gcagcagauuggaaggagacaca

SEQ ID NO: 3735732 - RNA, 13 nt, Human
gcagcagauuuua

SEQ ID NO: 3735733 - RNA, 20 nt, Human
gcagcagauuuuaggaaaug

SEQ ID NO: 3735734 - RNA, 14 nt, Human
gcagcagcagcccu

SEQ ID NO: 3735735 - RNA, 15 nt, Human
gcagcagcagcccug

SEQ ID NO: 3735736 - RNA, 16 nt, Human
gcagcagcagcccugc

SEQ ID NO: 3735737 - RNA, 11 nt, Human
gcagcagccag

SEQ ID NO: 3735738 - RNA, 12 nt, Human
gcagcagccagc

SEQ ID NO: 3735739 - RNA, 18 nt, Human
gcagcagccagcccugcc

SEQ ID NO: 3735740 - RNA, 19 nt, Human
gcagcagccagcccugccu

SEQ ID NO: 3735741 - RNA, 22 nt, Human
gcagcagccagcccugccugga

SEQ ID NO: 3735742 - RNA, 13 nt, Human
gcagcagcccaag

SEQ ID NO: 3735743 - RNA, 11 nt, Human
gcagcagcccu

SEQ ID NO: 3735744 - RNA, 13 nt, Human
gcagcagcccugc

SEQ ID NO: 3735745 - RNA, 13 nt, Human
gcagcagcuugcu

SEQ ID NO: 3735746 - RNA, 23 nt, Human
gcagcagcuuuuaauacagggua

SEQ ID NO: 3735747 - RNA, 12 nt, Human
gcagcaggaggg

SEQ ID NO: 3735748 - RNA, 13 nt, Human
gcagcaggagggg

SEQ ID NO: 3735749 - RNA, 19 nt, Human
uaaguacuauguaucaaug

SEQ ID NO: 3735750 - RNA, 12 nt, Human
uaaguacuguaa

SEQ ID NO: 3735751 - RNA, 21 nt, Human
uaaguacuguaauaauaccuc

SEQ ID NO: 3735752 - RNA, 13 nt, Human
uaaguauacaguu

SEQ ID NO: 3735753 - RNA, 14 nt, Human
uaaguauuaaaaca

SEQ ID NO: 3735754 - RNA, 15 nt, Human
uaaguauuaaaacau

SEQ ID NO: 3735755 - RNA, 19 nt, Human
uaaguauuaaaacauugga

SEQ ID NO: 3735756 - RNA, 19 nt, Human
uaaguauucuuauuuaaug

SEQ ID NO: 3735757 - RNA, 12 nt, Human
uaaguauuuagg

SEQ ID NO: 3735758 - RNA, 14 nt, Human
uaaguauuuauaau

SEQ ID NO: 3735759 - RNA, 13 nt, Human
uaaguauuucaaa

SEQ ID NO: 3735760 - RNA, 21 nt, Human
uaaguauuucagaugcuuuag

SEQ ID NO: 3735761 - RNA, 17 nt, Human
uaaguauuugaaacuga

SEQ ID NO: 3735762 - RNA, 14 nt, Human
uaaguauuuggaau

SEQ ID NO: 3735763 - RNA, 20 nt, Human
uaaguauuuuccuguuguca

SEQ ID NO: 3735764 - RNA, 14 nt, Human
uaagucaacaguaa

SEQ ID NO: 3735765 - RNA, 22 nt, Human
uaagucacccuagcccucuccc

SEQ ID NO: 3735766 - RNA, 13 nt, Human
uaagucagaacag

SEQ ID NO: 3735767 - RNA, 16 nt, Human
uaagucaguguugaga

SEQ ID NO: 3735768 - RNA, 17 nt, Human
uaagucauguauguuuc

SEQ ID NO: 3735769 - RNA, 19 nt, Human
uaagucauguuccuucaag

SEQ ID NO: 3735770 - RNA, 18 nt, Human
uaagucauucauaaaccu

SEQ ID NO: 3735771 - RNA, 17 nt, Human
uacauucucaguuuuuc

SEQ ID NO: 3735772 - RNA, 20 nt, Human
uacauucucaguuuuucuua

SEQ ID NO: 3735773 - RNA, 13 nt, Human
uacauucuguuaa

SEQ ID NO: 3735774 - RNA, 17 nt, Human
uacauucuucaagaucc

SEQ ID NO: 3735775 - RNA, 21 nt, Human
uacauucuucaagaucccauu

SEQ ID NO: 3735776 - RNA, 22 nt, Human
uacauucuuuuugcucuaaaau

SEQ ID NO: 3735777 - RNA, 17 nt, Human
uacauugaauuagaaac

SEQ ID NO: 3735778 - RNA, 22 nt, Human
uacauugaguagacacauuuaa

SEQ ID NO: 3735779 - RNA, 21 nt, Human
uacauugcuggucuuguaaga

SEQ ID NO: 3735780 - RNA, 20 nt, Human
uacauuguacgaagaguauu

SEQ ID NO: 3735781 - RNA, 16 nt, Human
uacauugugaaacuuc

SEQ ID NO: 3735782 - RNA, 21 nt, Human
uacauuguuaccucuauauac

SEQ ID NO: 3735783 - RNA, 23 nt, Human
uacauuguugagcuauugcuguu

SEQ ID NO: 3735784 - RNA, 21 nt, Human
uacauuuaaaauugcuauguu

SEQ ID NO: 3735785 - RNA, 16 nt, Human
uacauuuaaagcauug

SEQ ID NO: 3735786 - RNA, 17 nt, Human
uacauuuaaagcauugc

SEQ ID NO: 3735787 - RNA, 15 nt, Human
uacauuuacaaacug

SEQ ID NO: 3735788 - RNA, 19 nt, Human
uacauuuauaauguuugcu

SEQ ID NO: 3735789 - RNA, 14 nt, Human
uacauuuaugauuu

SEQ ID NO: 3735790 - RNA, 23 nt, Human
uacauuuaugauuuaauaaaaua

SEQ ID NO: 3735791 - RNA, 17 nt, Human
uacauuuauuuauccag

SEQ ID NO: 3735792 - RNA, 20 nt, Human
uacauuuauuuauccagaaa

SEQ ID NO: 3735793 - RNA, 18 nt, Human
uacauuucacaggcuaau

SEQ ID NO: 3735794 - RNA, 16 nt, Human
uacauuuccaaaugaa

SEQ ID NO: 3735795 - RNA, 13 nt, Human
uacauuuccuaaa

SEQ ID NO: 3735796 - RNA, 23 nt, Human
uacauuucuccuuugauaaaaua

SEQ ID NO: 3735797 - RNA, 22 nt, Human
uacauuucuuagacuacauuua

SEQ ID NO: 3735798 - RNA, 16 nt, Human
uacauuugaacuugau

SEQ ID NO: 3735799 - RNA, 19 nt, Human
uacauuugaugcaugucuu

SEQ ID NO: 3735800 - RNA, 21 nt, Human
uacauuugaugcaugucuuuu

SEQ ID NO: 3735801 - RNA, 21 nt, Human
uacauuugggaguuuuuauga

SEQ ID NO: 3735802 - RNA, 16 nt, Human
uacauuuguauguugu

SEQ ID NO: 3735803 - RNA, 11 nt, Human
uacauuugugu

SEQ ID NO: 3735804 - RNA, 12 nt, Human
uacauuuuaaca

SEQ ID NO: 3735805 - RNA, 17 nt, Human
uacauuuuguaccaacc

SEQ ID NO: 3735806 - RNA, 17 nt, Human
uacauuuuuauuuauga

SEQ ID NO: 3735807 - RNA, 19 nt, Human
uacauuuuucaacuuugaa

SEQ ID NO: 3735808 - RNA, 21 nt, Human
uacauuuuucaacuuugaaua

SEQ ID NO: 3735809 - RNA, 15 nt, Human
uacauuuuuuaagcu

SEQ ID NO: 3735810 - RNA, 13 nt, Human
uacauuuuuugaa

SEQ ID NO: 3735811 - RNA, 15 nt, Human
uacauuuuuugaaau

SEQ ID NO: 3735812 - RNA, 20 nt, Human
uaccaaaaaaauuacaguuu

SEQ ID NO: 3735813 - RNA, 15 nt, Human
uaccaaaaauaaaua

SEQ ID NO: 3735814 - RNA, 17 nt, Human
uaccaaaauuauuucag

SEQ ID NO: 3735815 - RNA, 14 nt, Human
uaccaaacagcaaa

SEQ ID NO: 3735816 - RNA, 15 nt, Human
uaccaaacagcaaac

SEQ ID NO: 3735817 - RNA, 21 nt, Human
uaccaaacagcaaaccaagag

SEQ ID NO: 3735818 - RNA, 12 nt, Human
uaccaaagcaca

SEQ ID NO: 3735819 - RNA, 13 nt, Human
uaccaaauuaaaa

SEQ ID NO: 3735820 - RNA, 16 nt, Human
uaccaacacgagcagg

SEQ ID NO: 3735821 - RNA, 13 nt, Human
uaccaacuuucug

SEQ ID NO: 3735822 - RNA, 15 nt, Human
uaccaacuuucugua

SEQ ID NO: 3735823 - RNA, 20 nt, Human
uaccaaguauagccuauggc

SEQ ID NO: 3735824 - RNA, 16 nt, Human
uaccaaguuauauaaa

SEQ ID NO: 3735825 - RNA, 12 nt, Human
uaccaauaaagu

SEQ ID NO: 3735826 - RNA, 14 nt, Human
uaccaauaaaguga

SEQ ID NO: 3735827 - RNA, 16 nt, Human
uaccaauauuuaaucu

SEQ ID NO: 3735828 - RNA, 15 nt, Human
uaccaaucauuuuaa

SEQ ID NO: 3735829 - RNA, 13 nt, Human
uaccaaugaaaaa

SEQ ID NO: 3735830 - RNA, 11 nt, Human
uaccaaugcau

SEQ ID NO: 3735831 - RNA, 12 nt, Human
uaccaaugcaug

SEQ ID NO: 3735832 - RNA, 18 nt, Human
uaccacaaugcagugccu

SEQ ID NO: 3735833 - RNA, 12 nt, Human
uaccacagcagc

SEQ ID NO: 3735834 - RNA, 17 nt, Human
uaccacaucaaauaaga

SEQ ID NO: 3735835 - RNA, 15 nt, Human
uaccaccacgcccgg

SEQ ID NO: 3735836 - RNA, 13 nt, Human
uaccaccagcugu

SEQ ID NO: 3735837 - RNA, 14 nt, Human
uaccaccagcugug

SEQ ID NO: 3735838 - RNA, 21 nt, Human
uaccaccaucccgugcuuuua

SEQ ID NO: 3735839 - RNA, 15 nt, Human
uaccacccccacacc

SEQ ID NO: 3735840 - RNA, 15 nt, Human
uaccaccccuuccug

SEQ ID NO: 3735841 - RNA, 16 nt, Human
uaccaccccuuccugu

SEQ ID NO: 3735842 - RNA, 17 nt, Human
uaccaccccuuccuguc

SEQ ID NO: 3735843 - RNA, 14 nt, Human
uaccacucaggcca

SEQ ID NO: 3735844 - RNA, 13 nt, Human
uaccacuccugcc

SEQ ID NO: 3735845 - RNA, 18 nt, Human
uaccacugaagauagaag

SEQ ID NO: 3735846 - RNA, 19 nt, Human
uaccacugaagauagaaga

SEQ ID NO: 3735847 - RNA, 21 nt, Human
uaccacugaagauagaagaaa

SEQ ID NO: 3735848 - RNA, 20 nt, Human
uaccacugaaucuguacaga

SEQ ID NO: 3735849 - RNA, 13 nt, Human
uaccagaagggaa

SEQ ID NO: 3735850 - RNA, 15 nt, Human
uaccagacugcaggu

SEQ ID NO: 3735851 - RNA, 19 nt, Human
uaccagagaaaaagggagg

SEQ ID NO: 3735852 - RNA, 23 nt, Human
uaccagauaacuuuuuuuuuucu

SEQ ID NO: 3735853 - RNA, 12 nt, Human
uaccagaugcag

SEQ ID NO: 3735854 - RNA, 16 nt, Human
uaccagcccuggggcu

SEQ ID NO: 3735855 - RNA, 13 nt, Human
uaccagcgaggag

SEQ ID NO: 3735856 - RNA, 18 nt, Human
uaccagcgcccgcugggc

SEQ ID NO: 3735857 - RNA, 19 nt, Human
uaccagcgcccgcugggcu

SEQ ID NO: 3735858 - RNA, 20 nt, Human
uaccagcgcccgcugggcug

SEQ ID NO: 3735859 - RNA, 21 nt, Human
uaccagcguauauauaagaaa

SEQ ID NO: 3735860 - RNA, 22 nt, Human
uaccagcguauauauaagaaag

SEQ ID NO: 3735861 - RNA, 17 nt, Human
uaccagcuacccugugu

SEQ ID NO: 3735862 - RNA, 17 nt, Human
uaccagcuuuuaaccau

SEQ ID NO: 3735863 - RNA, 14 nt, Human
uaccaggauuuuuu

SEQ ID NO: 3735864 - RNA, 17 nt, Human
uaccaggcaccaaaaga

SEQ ID NO: 3735865 - RNA, 18 nt, Human
uaccaggcaccaaaagaa

SEQ ID NO: 3735866 - RNA, 21 nt, Human
uaccaggcaccaaaagaagua

SEQ ID NO: 3735867 - RNA, 20 nt, Human
uaccaggccgccccagccuc

SEQ ID NO: 3735868 - RNA, 19 nt, Human
uaccagguauuauuaucuu

SEQ ID NO: 3735869 - RNA, 14 nt, Human
uaccaggucuccuc

SEQ ID NO: 3735870 - RNA, 20 nt, Human
uaccaggucuccuccaccgc

SEQ ID NO: 3735871 - RNA, 22 nt, Human
uaccaggucuccuccaccgcca

SEQ ID NO: 3735872 - RNA, 14 nt, Human
uaccagguugaaag

SEQ ID NO: 3735873 - RNA, 16 nt, Human
uaccagguugaaagac

SEQ ID NO: 3735874 - RNA, 16 nt, Human
uaccaguaaaguguaa

SEQ ID NO: 3735875 - RNA, 19 nt, Human
uaccaguauuuagaagcca

SEQ ID NO: 3735876 - RNA, 20 nt, Human
uaccaguauuuagaagccaa

SEQ ID NO: 3735877 - RNA, 23 nt, Human
uaccagucuuuaaaggcccagcc

SEQ ID NO: 3735878 - RNA, 18 nt, Human
uaccagugaauuuuugca

SEQ ID NO: 3735879 - RNA, 20 nt, Human
uaccagugaauuuuugcaau

SEQ ID NO: 3735880 - RNA, 23 nt, Human
uaccagugaauuuuugcaauaau

SEQ ID NO: 3735881 - RNA, 19 nt, Human
uaccagugcaggcuggcca

SEQ ID NO: 3735882 - RNA, 11 nt, Human
uaccagugugg

SEQ ID NO: 3735883 - RNA, 15 nt, Human
uaccaguuaauuacu

SEQ ID NO: 3735884 - RNA, 12 nt, Human
uaccaguugccu

SEQ ID NO: 3735885 - RNA, 14 nt, Human
uaccaguuugcuga

SEQ ID NO: 3735886 - RNA, 20 nt, Human
uaccauaguaccauuuauac

SEQ ID NO: 3735887 - RNA, 15 nt, Human
uaccauauuuaucca

SEQ ID NO: 3735888 - RNA, 17 nt, Human
uaccaucacugaguuuu

SEQ ID NO: 3735889 - RNA, 20 nt, Human
uaccaucacugaguuuucca

SEQ ID NO: 3735890 - RNA, 18 nt, Human
uaccaucagggacaggau

SEQ ID NO: 3735891 - RNA, 17 nt, Human
uaccaucuuacuugagc

SEQ ID NO: 3735892 - RNA, 16 nt, Human
uaccaugccauuuaaa

SEQ ID NO: 3735893 - RNA, 18 nt, Human
uaccaugcuucacaaugu

SEQ ID NO: 3735894 - RNA, 14 nt, Human
uaccauuaaaacug

SEQ ID NO: 3735895 - RNA, 18 nt, Human
uaccauuaaaacugcuuu

SEQ ID NO: 3735896 - RNA, 20 nt, Human
uaccauuaaaacugcuuuuu

SEQ ID NO: 3735897 - RNA, 13 nt, Human
uaccauuaaaaua

SEQ ID NO: 3735898 - RNA, 14 nt, Human
uaccauuaaaccau

SEQ ID NO: 3735899 - RNA, 20 nt, Human
uaccauuaaaccaucucccu

SEQ ID NO: 3735900 - RNA, 20 nt, Human
uaccauucagaucacugaau

SEQ ID NO: 3735901 - RNA, 19 nt, Human
uaccauuuaguaagaauac

SEQ ID NO: 3735902 - RNA, 15 nt, Human
uaccauuuauacaaa

SEQ ID NO: 3735903 - RNA, 18 nt, Human
uaccauuuauacaaauua

SEQ ID NO: 3735904 - RNA, 22 nt, Human
uaccauuuccguaauucuuauu

SEQ ID NO: 3735905 - RNA, 21 nt, Human
uaccauuugcuacuguacaua

SEQ ID NO: 3735906 - RNA, 15 nt, Human
uaccauuuucugguu

SEQ ID NO: 3735907 - RNA, 14 nt, Human
uaccauuuuucauu

SEQ ID NO: 3735908 - RNA, 21 nt, Human
uaccauuuuuuaaggaaacaa

SEQ ID NO: 3735909 - RNA, 21 nt, Human
uacccaaccacucaaauuaau

SEQ ID NO: 3735910 - RNA, 18 nt, Human
uacccacaccucugccag

SEQ ID NO: 3735911 - RNA, 18 nt, Human
uacccacauguacagaca

SEQ ID NO: 3735912 - RNA, 12 nt, Human
uacccacccaga

SEQ ID NO: 3735913 - RNA, 22 nt, Human
uacccaccgggccacuccuucc

SEQ ID NO: 3735914 - RNA, 14 nt, Human
uacccaccucagcc

SEQ ID NO: 3735915 - RNA, 15 nt, Human
uacccaccucagccu

SEQ ID NO: 3735916 - RNA, 22 nt, Human
uacccagaaugucagauuccuu

SEQ ID NO: 3735917 - RNA, 20 nt, Human
uacccagccaucugcccagg

SEQ ID NO: 3735918 - RNA, 13 nt, Human
uacccagcccauc

SEQ ID NO: 3735919 - RNA, 14 nt, Human
uacccagcccaucu

SEQ ID NO: 3735920 - RNA, 18 nt, Human
uacccagcgagcccuggu

SEQ ID NO: 3735921 - RNA, 14 nt, Human
uaaguccaguccag

SEQ ID NO: 3735922 - RNA, 22 nt, Human
uaaguccaguccaguccuaucu

SEQ ID NO: 3735923 - RNA, 12 nt, Human
uaaguccagugu

SEQ ID NO: 3735924 - RNA, 18 nt, Human
uaagucccugcccccucc

SEQ ID NO: 3735925 - RNA, 23 nt, Human
uaagucccugcccccuccccuuc

SEQ ID NO: 3735926 - RNA, 19 nt, Human
uaagucccugucaccucuu

SEQ ID NO: 3735927 - RNA, 20 nt, Human
uaaguccuugcaagaaucag

SEQ ID NO: 3735928 - RNA, 15 nt, Human
uaaguccuuuaugug

SEQ ID NO: 3735929 - RNA, 18 nt, Human
uaagucuaaauauuuccu

SEQ ID NO: 3735930 - RNA, 14 nt, Human
uaagucucuuuuuu

SEQ ID NO: 3735931 - RNA, 16 nt, Human
uaagugaaaaggucau

SEQ ID NO: 3735932 - RNA, 15 nt, Human
uaagugaaaaucuua

SEQ ID NO: 3735933 - RNA, 19 nt, Human
uaagugaaagugaggaaau

SEQ ID NO: 3735934 - RNA, 11 nt, Human
uaagugaaauu

SEQ ID NO: 3735935 - RNA, 12 nt, Human
uaagugaaauuu

SEQ ID NO: 3735936 - RNA, 14 nt, Human
uaagugaauaauaa

SEQ ID NO: 3735937 - RNA, 13 nt, Human
uaagugaauuuau

SEQ ID NO: 3735938 - RNA, 24 nt, Human
uaagugagagagacaagaagcaaa

SEQ ID NO: 3735939 - RNA, 19 nt, Human
uaagugaggaaaucaaagu

SEQ ID NO: 3735940 - RNA, 20 nt, Human
uaagugagugugcugcugua

SEQ ID NO: 3735941 - RNA, 14 nt, Human
uaagugcacaacau

SEQ ID NO: 3735942 - RNA, 17 nt, Human
uaagugcacacagaaau

SEQ ID NO: 3735943 - RNA, 22 nt, Human
uaagugccaggauggaaugaug

SEQ ID NO: 3735944 - RNA, 16 nt, Human
uaagugcccucuccca

SEQ ID NO: 3735945 - RNA, 13 nt, Human
uaagugccuucca

SEQ ID NO: 3735946 - RNA, 18 nt, Human
uaagugcguguguagagu

SEQ ID NO: 3735947 - RNA, 16 nt, Human
uaagugcuacauaaau

SEQ ID NO: 3735948 - RNA, 22 nt, Human
uaagugcugcauuuaaaagaua

SEQ ID NO: 3735949 - RNA, 15 nt, Human
uaagugcuguauaaa

SEQ ID NO: 3735950 - RNA, 17 nt, Human
uaagugcuguauaaaau

SEQ ID NO: 3735951 - RNA, 15 nt, Human
uaaguggaggcacuu

SEQ ID NO: 3735952 - RNA, 20 nt, Human
uaagugggguugcaaccacu

SEQ ID NO: 3735953 - RNA, 21 nt, Human
uaagugggguugcaaccacug

SEQ ID NO: 3735954 - RNA, 22 nt, Human
uaagugguucuuugguuccagu

SEQ ID NO: 3735955 - RNA, 17 nt, Human
uaagugguuugaucauu

SEQ ID NO: 3735956 - RNA, 12 nt, Human
uaagugugaacu

SEQ ID NO: 3735957 - RNA, 14 nt, Human
uaaguguuggaaaa

SEQ ID NO: 3735958 - RNA, 14 nt, Human
uaaguuacuucacu

SEQ ID NO: 3735959 - RNA, 17 nt, Human
uaaguuaguuccacuga

SEQ ID NO: 3735960 - RNA, 20 nt, Human
uaaguuaguuccacugagac

SEQ ID NO: 3735961 - RNA, 14 nt, Human
uaaguuauaguaua

SEQ ID NO: 3735962 - RNA, 18 nt, Human
uaaguuauagugaauacu

SEQ ID NO: 3735963 - RNA, 23 nt, Human
uaaguuauuaagagguaagacuu

SEQ ID NO: 3735964 - RNA, 15 nt, Human
uaaguuauugcaguu

SEQ ID NO: 3735965 - RNA, 20 nt, Human
uaaguuauugcaguuuauca

SEQ ID NO: 3735966 - RNA, 17 nt, Human
uaaguuauuucuuguuu

SEQ ID NO: 3735967 - RNA, 18 nt, Human
uaaguuauuuuuguacau

SEQ ID NO: 3735968 - RNA, 17 nt, Human
uaaguugaauggccugc

SEQ ID NO: 3735969 - RNA, 16 nt, Human
uaaguuggaaacacua

SEQ ID NO: 3735970 - RNA, 17 nt, Human
uaaguuggaaacacuaa

SEQ ID NO: 3735971 - RNA, 22 nt, Human
uaaguuggaaacacuaaauguu

SEQ ID NO: 3735972 - RNA, 22 nt, Human
uaaguuggcuucuguuucuagu

SEQ ID NO: 3735973 - RNA, 13 nt, Human
uaaguuguuugca

SEQ ID NO: 3735974 - RNA, 15 nt, Human
uaaguuguuugcaug

SEQ ID NO: 3735975 - RNA, 19 nt, Human
uaaguuuaccuauguaaca

SEQ ID NO: 3735976 - RNA, 22 nt, Human
uaaguuucaggugacaugugaa

SEQ ID NO: 3735977 - RNA, 12 nt, Human
uaaguuucuaag

SEQ ID NO: 3735978 - RNA, 13 nt, Human
uaaguuucuaaga

SEQ ID NO: 3735979 - RNA, 18 nt, Human
uaaguuucuaagauucua

SEQ ID NO: 3735980 - RNA, 12 nt, Human
uaaguuugaagg

SEQ ID NO: 3735981 - RNA, 18 nt, Human
uaaguuugaaggaaacag

SEQ ID NO: 3735982 - RNA, 17 nt, Human
uaaguuugcacucaaau

SEQ ID NO: 3735983 - RNA, 17 nt, Human
uaauaaaaaaagaaagc

SEQ ID NO: 3735984 - RNA, 14 nt, Human
uaauaaaaaaugga

SEQ ID NO: 3735985 - RNA, 15 nt, Human
uaauaaaaagcuuuu

SEQ ID NO: 3735986 - RNA, 23 nt, Human
uaauaaaaaggaguauacaaaca

SEQ ID NO: 3735987 - RNA, 13 nt, Human
uaauaaaaauaaa

SEQ ID NO: 3735988 - RNA, 13 nt, Human
uaauaaaacaucu

SEQ ID NO: 3735989 - RNA, 15 nt, Human
uaauaaaacugaugu

SEQ ID NO: 3735990 - RNA, 19 nt, Human
uaauaaaacugaugugaaa

SEQ ID NO: 3735991 - RNA, 13 nt, Human
uaauaaaaggaaa

SEQ ID NO: 3735992 - RNA, 14 nt, Human
uaauaaaaggaaaa

SEQ ID NO: 3735993 - RNA, 17 nt, Human
uaauaaaaguacauguu

SEQ ID NO: 3735994 - RNA, 13 nt, Human
uaauaaaauaauu

SEQ ID NO: 3735995 - RNA, 16 nt, Human
uaauaaaauaauucua

SEQ ID NO: 3735996 - RNA, 21 nt, Human
uaauaaaauaucauucagcaa

SEQ ID NO: 3735997 - RNA, 18 nt, Human
uaauaaaauauuuucugu

SEQ ID NO: 3735998 - RNA, 19 nt, Human
uaauaaacauaaugaaaau

SEQ ID NO: 3735999 - RNA, 13 nt, Human
uaauaaacuaaua

SEQ ID NO: 3736000 - RNA, 19 nt, Human
uaauaaacuaauaauugca

SEQ ID NO: 3736001 - RNA, 17 nt, Human
uaauaaacuuagaauaa

SEQ ID NO: 3736002 - RNA, 18 nt, Human
uaauaaacuuagaauaaa

SEQ ID NO: 3736003 - RNA, 23 nt, Human
uaauaaacuuagaauaaaauugu

SEQ ID NO: 3736004 - RNA, 14 nt, Human
uaauaaagacucua

SEQ ID NO: 3736005 - RNA, 16 nt, Human
uaauaaagaucaugua

SEQ ID NO: 3736006 - RNA, 16 nt, Human
uaauaaagaugcucuu

SEQ ID NO: 3736007 - RNA, 22 nt, Human
uaauaaaguauuccaccuuaaa

SEQ ID NO: 3736008 - RNA, 15 nt, Human
uaauaaauaguucuu

SEQ ID NO: 3736009 - RNA, 12 nt, Human
uaauaaauauga

SEQ ID NO: 3736010 - RNA, 20 nt, Human
uaauaaauauguuucacaca

SEQ ID NO: 3736011 - RNA, 16 nt, Human
uaauaaauauuuaugu

SEQ ID NO: 3736012 - RNA, 15 nt, Human
uaauaaaucugguag

SEQ ID NO: 3736013 - RNA, 17 nt, Human
uaauaaauguacauuaa

SEQ ID NO: 3736014 - RNA, 13 nt, Human
uaauaaauucaga

SEQ ID NO: 3736015 - RNA, 13 nt, Human
uaauaaauugaaa

SEQ ID NO: 3736016 - RNA, 19 nt, Human
uaauaaauugaaauuguga

SEQ ID NO: 3736017 - RNA, 21 nt, Human
uaauaaauuguuuggcuuccu

SEQ ID NO: 3736018 - RNA, 12 nt, Human
uaauaacauuac

SEQ ID NO: 3736019 - RNA, 15 nt, Human
uaauaacauuaccuu

SEQ ID NO: 3736020 - RNA, 22 nt, Human
uaauaaccaaaugcaaugugaa

SEQ ID NO: 3736021 - RNA, 19 nt, Human
uaauaaccuuuaagucaga

SEQ ID NO: 3736022 - RNA, 16 nt, Human
uaauaaggaaaaguuu

SEQ ID NO: 3736023 - RNA, 20 nt, Human
uaauaaggaaaaguuuaaua

SEQ ID NO: 3736024 - RNA, 16 nt, Human
uaauaagggaaaaauc

SEQ ID NO: 3736025 - RNA, 18 nt, Human
uaauaagggaaaaaucaa

SEQ ID NO: 3736026 - RNA, 23 nt, Human
uaauaagggaaaaaucaaguauu

SEQ ID NO: 3736027 - RNA, 21 nt, Human
uaauaagguuuuaauuuagua

SEQ ID NO: 3736028 - RNA, 13 nt, Human
uaauaauaaauag

SEQ ID NO: 3736029 - RNA, 11 nt, Human
uaauaauacaa

SEQ ID NO: 3736030 - RNA, 12 nt, Human
uaauaauacaag

SEQ ID NO: 3736031 - RNA, 22 nt, Human
uaauaauauacuuguggacuaa

SEQ ID NO: 3736032 - RNA, 16 nt, Human
uaauaauauauguuua

SEQ ID NO: 3736033 - RNA, 12 nt, Human
uaauaaucaaga

SEQ ID NO: 3736034 - RNA, 16 nt, Human
uaauaauccugcaaag

SEQ ID NO: 3736035 - RNA, 15 nt, Human
uaauaauuauaugcu

SEQ ID NO: 3736036 - RNA, 16 nt, Human
uaauaauuauaugcua

SEQ ID NO: 3736037 - RNA, 17 nt, Human
uaauaauuauuauuaaa

SEQ ID NO: 3736038 - RNA, 13 nt, Human
uaauacaagguau

SEQ ID NO: 3736039 - RNA, 22 nt, Human
uaauacaagguauaauaaaauu

SEQ ID NO: 3736040 - RNA, 16 nt, Human
uaauacacaaaaucaa

SEQ ID NO: 3736041 - RNA, 19 nt, Human
uaauacaccacuacauucu

SEQ ID NO: 3736042 - RNA, 22 nt, Human
uaauacaccacuacauucuguu

SEQ ID NO: 3736043 - RNA, 20 nt, Human
uaauacacuaauuccuuucu

SEQ ID NO: 3736044 - RNA, 19 nt, Human
uaauacagcagugucauca

SEQ ID NO: 3736045 - RNA, 20 nt, Human
uaauacagccaaagauaauc

SEQ ID NO: 3736046 - RNA, 16 nt, Human
uaauacauuaaagcag

SEQ ID NO: 3736047 - RNA, 17 nt, Human
uaauacauuauauuucu

SEQ ID NO: 3736048 - RNA, 20 nt, Human
uaauacauuccaacucguau

SEQ ID NO: 3736049 - RNA, 22 nt, Human
uaauaccauuuuuuaaggaaac

SEQ ID NO: 3736050 - RNA, 15 nt, Human
uaauaccugggugau

SEQ ID NO: 3736051 - RNA, 17 nt, Human
uaauacuaaaauauguc

SEQ ID NO: 3736052 - RNA, 18 nt, Human
uaauacuaguugugaccu

SEQ ID NO: 3736053 - RNA, 15 nt, Human
uaauacucuguugua

SEQ ID NO: 3736054 - RNA, 20 nt, Human
uaauacuguuauucuuugca

SEQ ID NO: 3736055 - RNA, 22 nt, Human
uaauacuguuauucuuugcacu

SEQ ID NO: 3736056 - RNA, 20 nt, Human
uaauacuuuguauacaagua

SEQ ID NO: 3736057 - RNA, 16 nt, Human
uaauagaaaacugaaa

SEQ ID NO: 3736058 - RNA, 18 nt, Human
uaauagaaaacugaaaau

SEQ ID NO: 3736059 - RNA, 17 nt, Human
uaauagaaaaguauguu

SEQ ID NO: 3736060 - RNA, 14 nt, Human
uaauagaauaaagg

SEQ ID NO: 3736061 - RNA, 16 nt, Human
uaauagaauaaaggca

SEQ ID NO: 3736062 - RNA, 17 nt, Human
uaauagacuaaaugaaa

SEQ ID NO: 3736063 - RNA, 12 nt, Human
uaauagagcaaa

SEQ ID NO: 3736064 - RNA, 12 nt, Human
uaauagauucuc

SEQ ID NO: 3736065 - RNA, 13 nt, Human
uaauagcaaagaa

SEQ ID NO: 3736066 - RNA, 20 nt, Human
uaauagcaacuuuuguguaa

SEQ ID NO: 3736067 - RNA, 21 nt, Human
uaauagcaacuuuuguguaau

SEQ ID NO: 3736068 - RNA, 21 nt, Human
uaauagcagccuuucucucuu

SEQ ID NO: 3736069 - RNA, 19 nt, Human
uaauagcggguuacuuuca

SEQ ID NO: 3736070 - RNA, 18 nt, Human
uaauaggaaaaacggaag

SEQ ID NO: 3736071 - RNA, 14 nt, Human
uaauagggaauaua

SEQ ID NO: 3736072 - RNA, 11 nt, Human
gcaggcugggc

SEQ ID NO: 3736073 - RNA, 12 nt, Human
gcaggcugggcc

SEQ ID NO: 3736074 - RNA, 14 nt, Human
gcaggcugggccau

SEQ ID NO: 3736075 - RNA, 23 nt, Human
gcaggcugggccauguccaaaga

SEQ ID NO: 3736076 - RNA, 17 nt, Human
gcaggcugucuggccag

SEQ ID NO: 3736077 - RNA, 22 nt, Human
gcaggcuuaauaaaaaugacag

SEQ ID NO: 3736078 - RNA, 22 nt, Human
gcaggcuuuguuuauagcuugc

SEQ ID NO: 3736079 - RNA, 13 nt, Human
gcagggaaacagc

SEQ ID NO: 3736080 - RNA, 22 nt, Human
gcagggaaaggcucugaaagcc

SEQ ID NO: 3736081 - RNA, 21 nt, Human
gcagggaagaggggugcagag

SEQ ID NO: 3736082 - RNA, 18 nt, Human
gcagggaagccccacaug

SEQ ID NO: 3736083 - RNA, 17 nt, Human
gcagggagcugggcuuc

SEQ ID NO: 3736084 - RNA, 16 nt, Human
gcagggaggaagaagc

SEQ ID NO: 3736085 - RNA, 23 nt, Human
gcagggaggaagaagcuuaggca

SEQ ID NO: 3736086 - RNA, 13 nt, Human
gcagggaggcagc

SEQ ID NO: 3736087 - RNA, 14 nt, Human
gcagggagggcagu

SEQ ID NO: 3736088 - RNA, 14 nt, Human
gcagggaggggacu

SEQ ID NO: 3736089 - RNA, 18 nt, Human
gcagggaggucaggcccu

SEQ ID NO: 3736090 - RNA, 13 nt, Human
gcagggaugcccu

SEQ ID NO: 3736091 - RNA, 21 nt, Human
gcagggaugcccuggaggugg

SEQ ID NO: 3736092 - RNA, 23 nt, Human
gcagggaugcccuggagguggcu

SEQ ID NO: 3736093 - RNA, 13 nt, Human
gcagggauguggg

SEQ ID NO: 3736094 - RNA, 23 nt, Human
gcagggauguggguuccacagac

SEQ ID NO: 3736095 - RNA, 23 nt, Human
gcagggcaaaugacaugcacuga

SEQ ID NO: 3736096 - RNA, 15 nt, Human
gcagggcagccccac

SEQ ID NO: 3736097 - RNA, 17 nt, Human
gcagggcaggaccagcc

SEQ ID NO: 3736098 - RNA, 18 nt, Human
gcagggcaggaccagccc

SEQ ID NO: 3736099 - RNA, 19 nt, Human
gcagggcaucuccugugca

SEQ ID NO: 3736100 - RNA, 22 nt, Human
gcagggcaucuccugugcaugg

SEQ ID NO: 3736101 - RNA, 19 nt, Human
gcagggccaggacugagcc

SEQ ID NO: 3736102 - RNA, 22 nt, Human
gcagggccauggcucagggugg

SEQ ID NO: 3736103 - RNA, 21 nt, Human
gcagggccccaggcauugcca

SEQ ID NO: 3736104 - RNA, 15 nt, Human
gcagggccgccaggg

SEQ ID NO: 3736105 - RNA, 21 nt, Human
gcagggccgcccgggcccaga

SEQ ID NO: 3736106 - RNA, 20 nt, Human
gcagggcgggcagagggcug

SEQ ID NO: 3736107 - RNA, 20 nt, Human
gcagggcuacccugagcuga

SEQ ID NO: 3736108 - RNA, 14 nt, Human
gcagggcucagcgg

SEQ ID NO: 3736109 - RNA, 19 nt, Human
gcagggcucagcggggaca

SEQ ID NO: 3736110 - RNA, 12 nt, Human
gcagggcucagg

SEQ ID NO: 3736111 - RNA, 14 nt, Human
gcagggcucaggau

SEQ ID NO: 3736112 - RNA, 21 nt, Human
gcagggcucaggauuucgugg

SEQ ID NO: 3736113 - RNA, 15 nt, Human
gcagggcucuccugg

SEQ ID NO: 3736114 - RNA, 18 nt, Human
gcagggcucuccuggcuu

SEQ ID NO: 3736115 - RNA, 23 nt, Human
gcagggcucucuuuccuucuugc

SEQ ID NO: 3736116 - RNA, 14 nt, Human
gcagggcuuuaaaa

SEQ ID NO: 3736117 - RNA, 19 nt, Human
gcaggggaggccaucugga

SEQ ID NO: 3736118 - RNA, 20 nt, Human
gcaggggagggucagccagg

SEQ ID NO: 3736119 - RNA, 19 nt, Human
gcaggggcccugcagcucu

SEQ ID NO: 3736120 - RNA, 20 nt, Human
gcaggggccgggggcagucu

SEQ ID NO: 3736121 - RNA, 20 nt, Human
gcaggggcucuggagagaaa

SEQ ID NO: 3736122 - RNA, 21 nt, Human
gcaggggcucuggagagaaac

SEQ ID NO: 3736123 - RNA, 15 nt, Human
gcaggggcuuccugg

SEQ ID NO: 3736124 - RNA, 16 nt, Human
gcagggggcaugaugc

SEQ ID NO: 3736125 - RNA, 15 nt, Human
gcagggggcugcugc

SEQ ID NO: 3736126 - RNA, 16 nt, Human
gcagggggcugcugcu

SEQ ID NO: 3736127 - RNA, 19 nt, Human
gcagggguccuugguguga

SEQ ID NO: 3736128 - RNA, 22 nt, Human
gcagggguggcugccucauuua

SEQ ID NO: 3736129 - RNA, 20 nt, Human
gcagggguggggguggaggc

SEQ ID NO: 3736130 - RNA, 23 nt, Human
gcagggguggggguggaggcuuc

SEQ ID NO: 3736131 - RNA, 14 nt, Human
gcagggucaggaga

SEQ ID NO: 3736132 - RNA, 15 nt, Human
gcagggucaggagag

SEQ ID NO: 3736133 - RNA, 16 nt, Human
gcagggucaggagagg

SEQ ID NO: 3736134 - RNA, 16 nt, Human
gcagggucucacucug

SEQ ID NO: 3736135 - RNA, 18 nt, Human
gcagggucucacucuguc

SEQ ID NO: 3736136 - RNA, 20 nt, Human
gcagggucugggcaggacuc

SEQ ID NO: 3736137 - RNA, 15 nt, Human
gcagggucuuuucau

SEQ ID NO: 3736138 - RNA, 22 nt, Human
gcagggugcaguaucaugcccu

SEQ ID NO: 3736139 - RNA, 15 nt, Human
gcaggguggugcugg

SEQ ID NO: 3736140 - RNA, 19 nt, Human
gcaggguggugcugggacu

SEQ ID NO: 3736141 - RNA, 19 nt, Human
gcagggugucugcccccuc

SEQ ID NO: 3736142 - RNA, 23 nt, Human
gcagggugucugcccccuccuga

SEQ ID NO: 3736143 - RNA, 16 nt, Human
gcagguagccugcugg

SEQ ID NO: 3736144 - RNA, 21 nt, Human
gcaggucaacagcuaugcugg

SEQ ID NO: 3736145 - RNA, 13 nt, Human
gcaggucccuaau

SEQ ID NO: 3736146 - RNA, 18 nt, Human
gcaggucccuaauaaagc

SEQ ID NO: 3736147 - RNA, 21 nt, Human
gcaggucccuaauaaagcugu

SEQ ID NO: 3736148 - RNA, 20 nt, Human
gcaggucuugaacuccuggc

SEQ ID NO: 3736149 - RNA, 21 nt, Human
gcaggucuuuaaaucauuuua

SEQ ID NO: 3736150 - RNA, 16 nt, Human
gcaggugaaacccagu

SEQ ID NO: 3736151 - RNA, 17 nt, Human
gcaggugaaacccaguc

SEQ ID NO: 3736152 - RNA, 15 nt, Human
gcaggugacagugag

SEQ ID NO: 3736153 - RNA, 17 nt, Human
gcaggugagcaaccagu

SEQ ID NO: 3736154 - RNA, 18 nt, Human
gcaggugauuggaccagg

SEQ ID NO: 3736155 - RNA, 21 nt, Human
gcaggugauuggaccaggcca

SEQ ID NO: 3736156 - RNA, 13 nt, Human
gcaggugccucca

SEQ ID NO: 3736157 - RNA, 14 nt, Human
gcaggugccuggac

SEQ ID NO: 3736158 - RNA, 16 nt, Human
gcaggugcuauuguua

SEQ ID NO: 3736159 - RNA, 14 nt, Human
gcaggugcugcuac

SEQ ID NO: 3736160 - RNA, 23 nt, Human
gcaggugcugcuacccucccugc

SEQ ID NO: 3736161 - RNA, 15 nt, Human
gcaggugcugcugcg

SEQ ID NO: 3736162 - RNA, 16 nt, Human
gcaggugcuggagcac

SEQ ID NO: 3736163 - RNA, 21 nt, Human
gcaggugcuggagcacugggc

SEQ ID NO: 3736164 - RNA, 19 nt, Human
gcagguggaucuauuucau

SEQ ID NO: 3736165 - RNA, 18 nt, Human
gcagguggccaaguuccu

SEQ ID NO: 3736166 - RNA, 17 nt, Human
gcagguggggagacugg

SEQ ID NO: 3736167 - RNA, 17 nt, Human
gcagguggggagggggu

SEQ ID NO: 3736168 - RNA, 15 nt, Human
gcaggugguccugag

SEQ ID NO: 3736169 - RNA, 14 nt, Human
gcaggugguggcac

SEQ ID NO: 3736170 - RNA, 22 nt, Human
gcaggugguggcacugagcccc

SEQ ID NO: 3736171 - RNA, 18 nt, Human
gcaggugugagggcagug

SEQ ID NO: 3736172 - RNA, 15 nt, Human
gcagguuaaauguuu

SEQ ID NO: 3736173 - RNA, 18 nt, Human
gcagguuaaauguuuugu

SEQ ID NO: 3736174 - RNA, 19 nt, Human
gcagguuaaauguuuugua

SEQ ID NO: 3736175 - RNA, 14 nt, Human
gcagguucauggau

SEQ ID NO: 3736176 - RNA, 20 nt, Human
gcagguucuucuuccugaag

SEQ ID NO: 3736177 - RNA, 14 nt, Human
gcagguugaagcca

SEQ ID NO: 3736178 - RNA, 17 nt, Human
gcagguugaagccaugu

SEQ ID NO: 3736179 - RNA, 16 nt, Human
gcagguugaggggcuc

SEQ ID NO: 3736180 - RNA, 19 nt, Human
gcagguugaggggcuccug

SEQ ID NO: 3736181 - RNA, 20 nt, Human
gcagguugaggggcuccugg

SEQ ID NO: 3736182 - RNA, 19 nt, Human
gcagguugauaaaucauuu

SEQ ID NO: 3736183 - RNA, 22 nt, Human
gcaguaaaaaaugguguuuuau

SEQ ID NO: 3736184 - RNA, 15 nt, Human
gcaguaaagagaaac

SEQ ID NO: 3736185 - RNA, 18 nt, Human
gcaguaaagagaaacuuu

SEQ ID NO: 3736186 - RNA, 16 nt, Human
gcaguaacuugggagu

SEQ ID NO: 3736187 - RNA, 18 nt, Human
gcaguaagucuuuuuuga

SEQ ID NO: 3736188 - RNA, 16 nt, Human
gcaguaccuauaaagu

SEQ ID NO: 3736189 - RNA, 15 nt, Human
gcaguacuaacauuu

SEQ ID NO: 3736190 - RNA, 19 nt, Human
gcaguagaaauaauaugca

SEQ ID NO: 3736191 - RNA, 16 nt, Human
gcaguagacauuuuaa

SEQ ID NO: 3736192 - RNA, 18 nt, Human
gcaguagauuuucuuuaa

SEQ ID NO: 3736193 - RNA, 12 nt, Human
gcaguaucauga

SEQ ID NO: 3736194 - RNA, 15 nt, Human
gcaguaucaugaagc

SEQ ID NO: 3736195 - RNA, 21 nt, Human
gcaguaucaugcccugugcaa

SEQ ID NO: 3736196 - RNA, 15 nt, Human
gcaguaugaaaauaa

SEQ ID NO: 3736197 - RNA, 14 nt, Human
gcagucacuggagg

SEQ ID NO: 3736198 - RNA, 23 nt, Human
gcagucacuggagguugaagcca

SEQ ID NO: 3736199 - RNA, 23 nt, Human
gcagucaucuugaccaagcagga

SEQ ID NO: 3736200 - RNA, 12 nt, Human
gcagucauuuug

SEQ ID NO: 3736201 - RNA, 13 nt, Human
gcaguccaugcau

SEQ ID NO: 3736202 - RNA, 14 nt, Human
gcaguccaugcaug

SEQ ID NO: 3736203 - RNA, 21 nt, Human
gcaguccccuucccuccaaga

SEQ ID NO: 3736204 - RNA, 20 nt, Human
gcaguccuggaagccagcuu

SEQ ID NO: 3736205 - RNA, 14 nt, Human
gcaguccuuggccu

SEQ ID NO: 3736206 - RNA, 15 nt, Human
gcaguccuuggccug

SEQ ID NO: 3736207 - RNA, 18 nt, Human
gcaguccuuggccugcua

SEQ ID NO: 3736208 - RNA, 17 nt, Human
gcagucgggggcuggcc

SEQ ID NO: 3736209 - RNA, 15 nt, Human
gcagucgugccugug

SEQ ID NO: 3736210 - RNA, 16 nt, Human
gcagucgugccugugu

SEQ ID NO: 3736211 - RNA, 17 nt, Human
gcagucgugccuguguc

SEQ ID NO: 3736212 - RNA, 16 nt, Human
gcagucuccucuuuaa

SEQ ID NO: 3736213 - RNA, 17 nt, Human
gcagucuccucuuuaaa

SEQ ID NO: 3736214 - RNA, 22 nt, Human
gcagucuccucuuuaaaacaaa

SEQ ID NO: 3736215 - RNA, 22 nt, Human
gcagucucuauaccaauaaagu

SEQ ID NO: 3736216 - RNA, 15 nt, Human
gcagucucucuuacc

SEQ ID NO: 3736217 - RNA, 22 nt, Human
gcagucucucuuacccuucugu

SEQ ID NO: 3736218 - RNA, 12 nt, Human
gcagucugccug

SEQ ID NO: 3736219 - RNA, 14 nt, Human
gcagucugccugga

SEQ ID NO: 3736220 - RNA, 16 nt, Human
gcagucuggaggggca

SEQ ID NO: 3736221 - RNA, 19 nt, Human
uacccaguaacucaucugu

SEQ ID NO: 3736222 - RNA, 16 nt, Human
uacccauacacccccu

SEQ ID NO: 3736223 - RNA, 16 nt, Human
uacccauagacaugaa

SEQ ID NO: 3736224 - RNA, 18 nt, Human
uacccauagacaugaaag

SEQ ID NO: 3736225 - RNA, 20 nt, Human
uacccaucgguguccauuua

SEQ ID NO: 3736226 - RNA, 18 nt, Human
uacccaucuuaaaaacaa

SEQ ID NO: 3736227 - RNA, 18 nt, Human
uacccaugacuuuauaug

SEQ ID NO: 3736228 - RNA, 22 nt, Human
uacccauuuguucauauuaaga

SEQ ID NO: 3736229 - RNA, 19 nt, Human
uaccccaagacucccauga

SEQ ID NO: 3736230 - RNA, 16 nt, Human
uaccccaauuccuugu

SEQ ID NO: 3736231 - RNA, 22 nt, Human
uaccccaccacgauguggcccu

SEQ ID NO: 3736232 - RNA, 23 nt, Human
uaccccaccucccucaaccucau

SEQ ID NO: 3736233 - RNA, 21 nt, Human
uaccccagacuagauguagua

SEQ ID NO: 3736234 - RNA, 18 nt, Human
uaccccagcucugcuugc

SEQ ID NO: 3736235 - RNA, 16 nt, Human
uaccccaguuuuuuga

SEQ ID NO: 3736236 - RNA, 20 nt, Human
uaccccauggagcugggcua

SEQ ID NO: 3736237 - RNA, 16 nt, Human
uacccccaggguugag

SEQ ID NO: 3736238 - RNA, 12 nt, Human
uacccccgccca

SEQ ID NO: 3736239 - RNA, 16 nt, Human
uacccccgcccaggcu

SEQ ID NO: 3736240 - RNA, 16 nt, Human
uacccccuaagagcca

SEQ ID NO: 3736241 - RNA, 15 nt, Human
uacccccugcaaagc

SEQ ID NO: 3736242 - RNA, 23 nt, Human
uacccccugcaaagcccagcuug

SEQ ID NO: 3736243 - RNA, 17 nt, Human
uacccccuucugggcau

SEQ ID NO: 3736244 - RNA, 13 nt, Human
uaccccugaucug

SEQ ID NO: 3736245 - RNA, 17 nt, Human
uaccccuuacuuagcau

SEQ ID NO: 3736246 - RNA, 18 nt, Human
uaccccuuacuuagcaug

SEQ ID NO: 3736247 - RNA, 20 nt, Human
uacccgggaagggggcuggg

SEQ ID NO: 3736248 - RNA, 18 nt, Human
uacccggggcccagggca

SEQ ID NO: 3736249 - RNA, 16 nt, Human
uacccuaaccaaguuc

SEQ ID NO: 3736250 - RNA, 14 nt, Human
uacccuaaugucuu

SEQ ID NO: 3736251 - RNA, 22 nt, Human
uacccuaaugucuucauaaagu

SEQ ID NO: 3736252 - RNA, 14 nt, Human
uacccucccacccc

SEQ ID NO: 3736253 - RNA, 18 nt, Human
uacccucccugcuguccc

SEQ ID NO: 3736254 - RNA, 22 nt, Human
uacccucccugcuguccccucu

SEQ ID NO: 3736255 - RNA, 15 nt, Human
uacccuccuggcucu

SEQ ID NO: 3736256 - RNA, 15 nt, Human
uacccuccuguaaau

SEQ ID NO: 3736257 - RNA, 20 nt, Human
uacccucgggcccaccuggc

SEQ ID NO: 3736258 - RNA, 13 nt, Human
uacccucucagcu

SEQ ID NO: 3736259 - RNA, 17 nt, Human
uacccucucagcuccag

SEQ ID NO: 3736260 - RNA, 21 nt, Human
uacccucucagcuccaggugg

SEQ ID NO: 3736261 - RNA, 17 nt, Human
uacccucugaaauacau

SEQ ID NO: 3736262 - RNA, 14 nt, Human
uacccucuggaggg

SEQ ID NO: 3736263 - RNA, 22 nt, Human
uacccucuucauggauggggga

SEQ ID NO: 3736264 - RNA, 19 nt, Human
uacccucuuugcugcagag

SEQ ID NO: 3736265 - RNA, 12 nt, Human
uacccugccucc

SEQ ID NO: 3736266 - RNA, 20 nt, Human
uacccugcgauuuugccugu

SEQ ID NO: 3736267 - RNA, 21 nt, Human
uacccugcgcccaguccuucc

SEQ ID NO: 3736268 - RNA, 16 nt, Human
uacccuuagaauccac

SEQ ID NO: 3736269 - RNA, 20 nt, Human
uacccuucugugcccagcuc

SEQ ID NO: 3736270 - RNA, 14 nt, Human
uacccuucuuucca

SEQ ID NO: 3736271 - RNA, 20 nt, Human
uacccuuggcucaauccucu

SEQ ID NO: 3736272 - RNA, 15 nt, Human
uacccuuuucugggg

SEQ ID NO: 3736273 - RNA, 19 nt, Human
uaccgaaaccuugccuuuc

SEQ ID NO: 3736274 - RNA, 15 nt, Human
uaccgaaugugucuu

SEQ ID NO: 3736275 - RNA, 19 nt, Human
uaccgcgucuacccuggga

SEQ ID NO: 3736276 - RNA, 14 nt, Human
uaccgcguuguaaa

SEQ ID NO: 3736277 - RNA, 17 nt, Human
uaccggagagagaaugu

SEQ ID NO: 3736278 - RNA, 19 nt, Human
uaccuaaaaggaaaucuca

SEQ ID NO: 3736279 - RNA, 22 nt, Human
uaccuaaaaggaaaucucaccc

SEQ ID NO: 3736280 - RNA, 13 nt, Human
uaccuaacaucug

SEQ ID NO: 3736281 - RNA, 17 nt, Human
uaccuaagaaguacauu

SEQ ID NO: 3736282 - RNA, 17 nt, Human
uaccuaagauuacaaau

SEQ ID NO: 3736283 - RNA, 20 nt, Human
uaccuaagauuacaaaucag

SEQ ID NO: 3736284 - RNA, 22 nt, Human
uaccuaagauuacaaaucagaa

SEQ ID NO: 3736285 - RNA, 15 nt, Human
uaccuaaguacugua

SEQ ID NO: 3736286 - RNA, 17 nt, Human
uaccuaaguacuguaau

SEQ ID NO: 3736287 - RNA, 20 nt, Human
uaccuaagugacauuuguag

SEQ ID NO: 3736288 - RNA, 16 nt, Human
uaccuaccacaguguc

SEQ ID NO: 3736289 - RNA, 17 nt, Human
uaccuaccacagugucu

SEQ ID NO: 3736290 - RNA, 21 nt, Human
uaccuacuuugacuuuuugca

SEQ ID NO: 3736291 - RNA, 13 nt, Human
uaccuagauuuac

SEQ ID NO: 3736292 - RNA, 18 nt, Human
uaccuagcuaauuauuua

SEQ ID NO: 3736293 - RNA, 14 nt, Human
uaccuagugaaacu

SEQ ID NO: 3736294 - RNA, 19 nt, Human
uaccuagugaaacuuuucu

SEQ ID NO: 3736295 - RNA, 22 nt, Human
uaccuagugaaacuuuucuaga

SEQ ID NO: 3736296 - RNA, 14 nt, Human
uaccuauaaugugu

SEQ ID NO: 3736297 - RNA, 13 nt, Human
uaccuauuuucau

SEQ ID NO: 3736298 - RNA, 22 nt, Human
uaccucaacccccauuucuauu

SEQ ID NO: 3736299 - RNA, 17 nt, Human
uaccucaaccuauggua

SEQ ID NO: 3736300 - RNA, 16 nt, Human
uaccucaaccuguaaa

SEQ ID NO: 3736301 - RNA, 22 nt, Human
uaccucaaccuguaaauuauuu

SEQ ID NO: 3736302 - RNA, 20 nt, Human
uaccucaauuuucacugugu

SEQ ID NO: 3736303 - RNA, 21 nt, Human
uaccucaauuuucacuguguc

SEQ ID NO: 3736304 - RNA, 15 nt, Human
uaccucacccugcua

SEQ ID NO: 3736305 - RNA, 18 nt, Human
uaccucacccugcuacac

SEQ ID NO: 3736306 - RNA, 14 nt, Human
uaccucagccuggg

SEQ ID NO: 3736307 - RNA, 17 nt, Human
uaccucagccugggcgc

SEQ ID NO: 3736308 - RNA, 12 nt, Human
uaccucaggaaa

SEQ ID NO: 3736309 - RNA, 14 nt, Human
uaccucaggaaaga

SEQ ID NO: 3736310 - RNA, 16 nt, Human
uaccucaggaaagaau

SEQ ID NO: 3736311 - RNA, 18 nt, Human
uaccucaggaaagaauag

SEQ ID NO: 3736312 - RNA, 14 nt, Human
uaccucagguugcu

SEQ ID NO: 3736313 - RNA, 20 nt, Human
uaccucagguugcugguugc

SEQ ID NO: 3736314 - RNA, 21 nt, Human
uaccucccuccccgucucauu

SEQ ID NO: 3736315 - RNA, 13 nt, Human
uaccuccucucag

SEQ ID NO: 3736316 - RNA, 15 nt, Human
uaccuccucucagug

SEQ ID NO: 3736317 - RNA, 14 nt, Human
uaccuccugagaaa

SEQ ID NO: 3736318 - RNA, 13 nt, Human
uaccuccugccca

SEQ ID NO: 3736319 - RNA, 15 nt, Human
uaccuccugcccagg

SEQ ID NO: 3736320 - RNA, 21 nt, Human
uaccuccugucuuuacaaaua

SEQ ID NO: 3736321 - RNA, 16 nt, Human
uaccucuaauaguaua

SEQ ID NO: 3736322 - RNA, 18 nt, Human
uaccucuaauaguauaaa

SEQ ID NO: 3736323 - RNA, 14 nt, Human
uaccucucugucau

SEQ ID NO: 3736324 - RNA, 15 nt, Human
uaccucucugucccu

SEQ ID NO: 3736325 - RNA, 18 nt, Human
uaccucucugucccuugc

SEQ ID NO: 3736326 - RNA, 21 nt, Human
uaccucucugucccuugcugu

SEQ ID NO: 3736327 - RNA, 17 nt, Human
uaccucugaccaacagg

SEQ ID NO: 3736328 - RNA, 15 nt, Human
uaccucugauaccuc

SEQ ID NO: 3736329 - RNA, 17 nt, Human
uaccucuggcugacuaa

SEQ ID NO: 3736330 - RNA, 15 nt, Human
uaccucuuagcugag

SEQ ID NO: 3736331 - RNA, 21 nt, Human
uaccucuugagccuugaacuu

SEQ ID NO: 3736332 - RNA, 13 nt, Human
uaccucuuggcug

SEQ ID NO: 3736333 - RNA, 15 nt, Human
uaccucuuuggaaaa

SEQ ID NO: 3736334 - RNA, 13 nt, Human
uaccugaaaacac

SEQ ID NO: 3736335 - RNA, 19 nt, Human
uaccugaacacuuauugcu

SEQ ID NO: 3736336 - RNA, 21 nt, Human
uaccugaacacuuauugcuuu

SEQ ID NO: 3736337 - RNA, 17 nt, Human
uaccugacacucccuug

SEQ ID NO: 3736338 - RNA, 16 nt, Human
uaccugaccucuugcu

SEQ ID NO: 3736339 - RNA, 18 nt, Human
uaccugaccucuugcugu

SEQ ID NO: 3736340 - RNA, 20 nt, Human
uaccugaccucuugcugucu

SEQ ID NO: 3736341 - RNA, 13 nt, Human
uaccugagaccag

SEQ ID NO: 3736342 - RNA, 16 nt, Human
uaccugaggggccucu

SEQ ID NO: 3736343 - RNA, 11 nt, Human
uaccugagggu

SEQ ID NO: 3736344 - RNA, 18 nt, Human
uaccugaucaaugacaga

SEQ ID NO: 3736345 - RNA, 23 nt, Human
uaccugauggaaguaaagccuca

SEQ ID NO: 3736346 - RNA, 12 nt, Human
uaccugauuuuu

SEQ ID NO: 3736347 - RNA, 22 nt, Human
uaccugcaggcugagccacucu

SEQ ID NO: 3736348 - RNA, 19 nt, Human
uaccugccacucacacagc

SEQ ID NO: 3736349 - RNA, 21 nt, Human
uaccugccacucacacagcca

SEQ ID NO: 3736350 - RNA, 23 nt, Human
uaccugccaggaagccagcaggc

SEQ ID NO: 3736351 - RNA, 20 nt, Human
uaccugcgcuuguuuuaaag

SEQ ID NO: 3736352 - RNA, 14 nt, Human
uaccugcucuccaa

SEQ ID NO: 3736353 - RNA, 23 nt, Human
uaccugcucuccaagucucagug

SEQ ID NO: 3736354 - RNA, 19 nt, Human
uaccugcugcuucuccaaa

SEQ ID NO: 3736355 - RNA, 21 nt, Human
uaccuggaaucaaauaaaaau

SEQ ID NO: 3736356 - RNA, 17 nt, Human
uaccuggguccccagcc

SEQ ID NO: 3736357 - RNA, 21 nt, Human
uaccuggguccuuuucagaag

SEQ ID NO: 3736358 - RNA, 21 nt, Human
uaccugucacauugcauucua

SEQ ID NO: 3736359 - RNA, 16 nt, Human
uaccugugccucggcu

SEQ ID NO: 3736360 - RNA, 12 nt, Human
uaccugugccug

SEQ ID NO: 3736361 - RNA, 20 nt, Human
uaccugugcguuacuaauug

SEQ ID NO: 3736362 - RNA, 14 nt, Human
uaccuguguacaua

SEQ ID NO: 3736363 - RNA, 14 nt, Human
uaccuguguauaua

SEQ ID NO: 3736364 - RNA, 13 nt, Human
uaccugugugcuu

SEQ ID NO: 3736365 - RNA, 21 nt, Human
uaccugugugguacucugaaa

SEQ ID NO: 3736366 - RNA, 20 nt, Human
uaccuguguuucuugccuca

SEQ ID NO: 3736367 - RNA, 21 nt, Human
uaccuguguuucuugccucau

SEQ ID NO: 3736368 - RNA, 16 nt, Human
uaccuguucagugucc

SEQ ID NO: 3736369 - RNA, 13 nt, Human
uaccuguuuaaau

SEQ ID NO: 3736370 - RNA, 12 nt, Human
uaccuuaaaauu

SEQ ID NO: 3736371 - RNA, 19 nt, Human
gcagucuggcugagcccug

SEQ ID NO: 3736372 - RNA, 21 nt, Human
gcagucuuaugcuuccagaaa

SEQ ID NO: 3736373 - RNA, 21 nt, Human
gcagugaaaacaagugcuggc

SEQ ID NO: 3736374 - RNA, 21 nt, Human
gcagugaauugugaccaaguu

SEQ ID NO: 3736375 - RNA, 22 nt, Human
gcagugagagaguggcuggggc

SEQ ID NO: 3736376 - RNA, 23 nt, Human
gcagugagagaguggcuggggca

SEQ ID NO: 3736377 - RNA, 20 nt, Human
gcagugagccaagauugcgc

SEQ ID NO: 3736378 - RNA, 20 nt, Human
gcagugaguuacagcgagag

SEQ ID NO: 3736379 - RNA, 21 nt, Human
gcagugauauggcagaagaca

SEQ ID NO: 3736380 - RNA, 23 nt, Human
gcagugcaagagacucuggccuc

SEQ ID NO: 3736381 - RNA, 15 nt, Human
gcagugcaugcuguc

SEQ ID NO: 3736382 - RNA, 16 nt, Human
gcagugcaugcugucc

SEQ ID NO: 3736383 - RNA, 15 nt, Human
gcagugcccaggugg

SEQ ID NO: 3736384 - RNA, 16 nt, Human
gcagugccuuccauaa

SEQ ID NO: 3736385 - RNA, 15 nt, Human
gcagugccuugggga

SEQ ID NO: 3736386 - RNA, 19 nt, Human
gcagugcucgcuguugcug

SEQ ID NO: 3736387 - RNA, 21 nt, Human
gcagugcucgcuguugcugaa

SEQ ID NO: 3736388 - RNA, 15 nt, Human
gcagugcuucucaaa

SEQ ID NO: 3736389 - RNA, 23 nt, Human
gcaguggauggccgugaaugggu

SEQ ID NO: 3736390 - RNA, 15 nt, Human
gcaguggcaggcaga

SEQ ID NO: 3736391 - RNA, 20 nt, Human
gcaguggcgaaaucccugcu

SEQ ID NO: 3736392 - RNA, 22 nt, Human
gcaguggcgcgaucucagcuca

SEQ ID NO: 3736393 - RNA, 18 nt, Human
gcaguggcugguccaggg

SEQ ID NO: 3736394 - RNA, 19 nt, Human
gcaguggcugguccagggc

SEQ ID NO: 3736395 - RNA, 12 nt, Human
gcagugggagcu

SEQ ID NO: 3736396 - RNA, 16 nt, Human
gcagugggcuccuggc

SEQ ID NO: 3736397 - RNA, 22 nt, Human
gcagugggucccacuuccccuc

SEQ ID NO: 3736398 - RNA, 21 nt, Human
gcaguggugcgaucauggcuc

SEQ ID NO: 3736399 - RNA, 16 nt, Human
gcaguggugcgaucug

SEQ ID NO: 3736400 - RNA, 20 nt, Human
gcaguggugcgaucuggguu

SEQ ID NO: 3736401 - RNA, 19 nt, Human
gcaguggugguuuucuguu

SEQ ID NO: 3736402 - RNA, 20 nt, Human
gcaguggugguuuucuguuc

SEQ ID NO: 3736403 - RNA, 18 nt, Human
gcaguguagcccacacuu

SEQ ID NO: 3736404 - RNA, 20 nt, Human
gcaguguagggaguuguggg

SEQ ID NO: 3736405 - RNA, 23 nt, Human
gcagugucuguaaaagagccuag

SEQ ID NO: 3736406 - RNA, 12 nt, Human
gcagugugaaaa

SEQ ID NO: 3736407 - RNA, 21 nt, Human
gcagugugaggccagggcaga

SEQ ID NO: 3736408 - RNA, 21 nt, Human
gcagugugcacuaaggggccc

SEQ ID NO: 3736409 - RNA, 14 nt, Human
gcagugugcccccc

SEQ ID NO: 3736410 - RNA, 22 nt, Human
gcagugugccccccagccccgg

SEQ ID NO: 3736411 - RNA, 20 nt, Human
gcaguguuccccaucugggu

SEQ ID NO: 3736412 - RNA, 21 nt, Human
gcaguguuccuauuuggggcu

SEQ ID NO: 3736413 - RNA, 16 nt, Human
gcaguguucgcuuggc

SEQ ID NO: 3736414 - RNA, 17 nt, Human
gcaguuaauuagcauuc

SEQ ID NO: 3736415 - RNA, 21 nt, Human
gcaguuacaugcauacuucaa

SEQ ID NO: 3736416 - RNA, 14 nt, Human
gcaguuaccauuaa

SEQ ID NO: 3736417 - RNA, 15 nt, Human
gcaguuaccauuaaa

SEQ ID NO: 3736418 - RNA, 18 nt, Human
gcaguuaccauuaaacca

SEQ ID NO: 3736419 - RNA, 19 nt, Human
gcaguuaccauuaaaccau

SEQ ID NO: 3736420 - RNA, 17 nt, Human
gcaguuauuaacacuaa

SEQ ID NO: 3736421 - RNA, 12 nt, Human
gcaguuauuugc

SEQ ID NO: 3736422 - RNA, 16 nt, Human
gcaguucagagcugcc

SEQ ID NO: 3736423 - RNA, 22 nt, Human
gcaguucagagcugcccucucc

SEQ ID NO: 3736424 - RNA, 19 nt, Human
gcaguucagcaccacccua

SEQ ID NO: 3736425 - RNA, 23 nt, Human
gcaguuccccuggaagcagugcc

SEQ ID NO: 3736426 - RNA, 21 nt, Human
gcaguuccggauuggcuugug

SEQ ID NO: 3736427 - RNA, 18 nt, Human
gcaguucgaccagccagg

SEQ ID NO: 3736428 - RNA, 17 nt, Human
gcaguucgcagccaccc

SEQ ID NO: 3736429 - RNA, 20 nt, Human
gcaguucgcagccacccuga

SEQ ID NO: 3736430 - RNA, 19 nt, Human
gcaguucuacucaggcugg

SEQ ID NO: 3736431 - RNA, 11 nt, Human
gcaguucugca

SEQ ID NO: 3736432 - RNA, 18 nt, Human
gcaguucugcaaauagaa

SEQ ID NO: 3736433 - RNA, 19 nt, Human
gcaguucugcaaauagaaa

SEQ ID NO: 3736434 - RNA, 14 nt, Human
gcaguucuugaguu

SEQ ID NO: 3736435 - RNA, 16 nt, Human
gcaguugaaaagacuc

SEQ ID NO: 3736436 - RNA, 23 nt, Human
gcaguugccagucaccccggcca

SEQ ID NO: 3736437 - RNA, 18 nt, Human
gcaguugcugguaaaaug

SEQ ID NO: 3736438 - RNA, 19 nt, Human
gcaguugcugguaaaauga

SEQ ID NO: 3736439 - RNA, 15 nt, Human
gcaguuuauauuuaa

SEQ ID NO: 3736440 - RNA, 15 nt, Human
gcaguuuaucauuca

SEQ ID NO: 3736441 - RNA, 21 nt, Human
gcaguuugaaauucugaauuu

SEQ ID NO: 3736442 - RNA, 12 nt, Human
gcaguuugcaaa

SEQ ID NO: 3736443 - RNA, 12 nt, Human
gcaguuuuucag

SEQ ID NO: 3736444 - RNA, 22 nt, Human
gcaguuuuucagaguggaaugc

SEQ ID NO: 3736445 - RNA, 14 nt, Human
gcaguuuuucagga

SEQ ID NO: 3736446 - RNA, 18 nt, Human
gcaguuuuuugaaaaugg

SEQ ID NO: 3736447 - RNA, 11 nt, Human
gcaguuuuuuu

SEQ ID NO: 3736448 - RNA, 16 nt, Human
gcauaaaaacauuuua

SEQ ID NO: 3736449 - RNA, 12 nt, Human
gcauaaaacagc

SEQ ID NO: 3736450 - RNA, 13 nt, Human
gcauaaaacagcu

SEQ ID NO: 3736451 - RNA, 21 nt, Human
gcauaaagcucaaaugaaaug

SEQ ID NO: 3736452 - RNA, 13 nt, Human
gcauaaaguaaau

SEQ ID NO: 3736453 - RNA, 16 nt, Human
gcauaaaguaaauaca

SEQ ID NO: 3736454 - RNA, 13 nt, Human
gcauaaauaugca

SEQ ID NO: 3736455 - RNA, 13 nt, Human
gcauaaauuauug

SEQ ID NO: 3736456 - RNA, 15 nt, Human
gcauaaauugcauca

SEQ ID NO: 3736457 - RNA, 16 nt, Human
gcauaacaaauucuga

SEQ ID NO: 3736458 - RNA, 18 nt, Human
gcauaacaaauucugaau

SEQ ID NO: 3736459 - RNA, 19 nt, Human
gcauaaccugucucaccug

SEQ ID NO: 3736460 - RNA, 14 nt, Human
gcauaacugacaaa

SEQ ID NO: 3736461 - RNA, 15 nt, Human
gcauaacugacaaau

SEQ ID NO: 3736462 - RNA, 18 nt, Human
gcauaacugacaaaucaa

SEQ ID NO: 3736463 - RNA, 21 nt, Human
gcauaacugacaaaucaaguu

SEQ ID NO: 3736464 - RNA, 14 nt, Human
gcauaauaaaugcu

SEQ ID NO: 3736465 - RNA, 14 nt, Human
gcauaauaagcuaa

SEQ ID NO: 3736466 - RNA, 17 nt, Human
gcauaauaauccugcaa

SEQ ID NO: 3736467 - RNA, 16 nt, Human
gcauaauuuaaaaaua

SEQ ID NO: 3736468 - RNA, 20 nt, Human
gcauaauuuaaaaauauauu

SEQ ID NO: 3736469 - RNA, 13 nt, Human
gcauacaaucuga

SEQ ID NO: 3736470 - RNA, 22 nt, Human
gcauacacacacacacacagcc

SEQ ID NO: 3736471 - RNA, 17 nt, Human
gcauacauuuauaaugu

SEQ ID NO: 3736472 - RNA, 23 nt, Human
gcauaccagguuuuacacuugca

SEQ ID NO: 3736473 - RNA, 18 nt, Human
gcauacccaaaccaggug

SEQ ID NO: 3736474 - RNA, 16 nt, Human
gcauaccuuuauugug

SEQ ID NO: 3736475 - RNA, 20 nt, Human
gcauacgagagcagaggucu

SEQ ID NO: 3736476 - RNA, 16 nt, Human
gcauacguacacauuu

SEQ ID NO: 3736477 - RNA, 19 nt, Human
gcauacguacacauuuuau

SEQ ID NO: 3736478 - RNA, 14 nt, Human
gcauacuuuguaaa

SEQ ID NO: 3736479 - RNA, 15 nt, Human
gcauacuuuguaaau

SEQ ID NO: 3736480 - RNA, 12 nt, Human
gcauagaaggag

SEQ ID NO: 3736481 - RNA, 16 nt, Human
gcauagaggcuucucc

SEQ ID NO: 3736482 - RNA, 23 nt, Human
gcauagauaauauuguuugguaa

SEQ ID NO: 3736483 - RNA, 16 nt, Human
gcauagcaagacacau

SEQ ID NO: 3736484 - RNA, 16 nt, Human
gcauaggccugcuuug

SEQ ID NO: 3736485 - RNA, 17 nt, Human
gcauaggccugggugcu

SEQ ID NO: 3736486 - RNA, 20 nt, Human
gcauaggugauccauguaac

SEQ ID NO: 3736487 - RNA, 15 nt, Human
gcauaguuucuuuau

SEQ ID NO: 3736488 - RNA, 15 nt, Human
gcauauaaaauggca

SEQ ID NO: 3736489 - RNA, 16 nt, Human
gcauauaacuuauauu

SEQ ID NO: 3736490 - RNA, 15 nt, Human
gcauauaagggaagu

SEQ ID NO: 3736491 - RNA, 23 nt, Human
gcauauaagggaaguaguuauca

SEQ ID NO: 3736492 - RNA, 18 nt, Human
gcauauaaugaauaaauc

SEQ ID NO: 3736493 - RNA, 19 nt, Human
gcauauaaugaauaaauca

SEQ ID NO: 3736494 - RNA, 17 nt, Human
gcauauaggugauguuu

SEQ ID NO: 3736495 - RNA, 19 nt, Human
gcauauauuaaaagcaggc

SEQ ID NO: 3736496 - RNA, 14 nt, Human
gcauaucacuugau

SEQ ID NO: 3736497 - RNA, 18 nt, Human
gcauauccaccaccuccc

SEQ ID NO: 3736498 - RNA, 15 nt, Human
gcauauccugagcca

SEQ ID NO: 3736499 - RNA, 15 nt, Human
gcauaucugccuuua

SEQ ID NO: 3736500 - RNA, 16 nt, Human
gcauaucugccuuuau

SEQ ID NO: 3736501 - RNA, 15 nt, Human
gcauaugacaaaugu

SEQ ID NO: 3736502 - RNA, 18 nt, Human
gcauaugacaaauguuuc

SEQ ID NO: 3736503 - RNA, 19 nt, Human
gcauaugaguaagggcacu

SEQ ID NO: 3736504 - RNA, 22 nt, Human
gcauaugcuucuuuaaaaaagc

SEQ ID NO: 3736505 - RNA, 17 nt, Human
gcauauggguuagaugu

SEQ ID NO: 3736506 - RNA, 15 nt, Human
gcauauguaugacuc

SEQ ID NO: 3736507 - RNA, 21 nt, Human
gcauauguuucgcugauauau

SEQ ID NO: 3736508 - RNA, 18 nt, Human
gcauauucaggaagcuca

SEQ ID NO: 3736509 - RNA, 20 nt, Human
gcauauucaggaagcucagg

SEQ ID NO: 3736510 - RNA, 15 nt, Human
gcauauuccuuucua

SEQ ID NO: 3736511 - RNA, 22 nt, Human
gcauauucuaguaauaaagacu

SEQ ID NO: 3736512 - RNA, 23 nt, Human
gcauauucuaguaauaaagacuc

SEQ ID NO: 3736513 - RNA, 16 nt, Human
gcauauucuuauguau

SEQ ID NO: 3736514 - RNA, 15 nt, Human
gcauauuguacacuu

SEQ ID NO: 3736515 - RNA, 20 nt, Human
gcauauuguacacuuuuuug

SEQ ID NO: 3736516 - RNA, 19 nt, Human
gcauauuguuauuauauaa

SEQ ID NO: 3736517 - RNA, 19 nt, Human
gcauauuuauaaaaauaaa

SEQ ID NO: 3736518 - RNA, 18 nt, Human
gcauauuuguauaguugc

SEQ ID NO: 3736519 - RNA, 16 nt, Human
gcauauuuuucacaua

SEQ ID NO: 3736520 - RNA, 17 nt, Human
uaauaguaauuuguaaa

SEQ ID NO: 3736521 - RNA, 12 nt, Human
uaauaguuccug

SEQ ID NO: 3736522 - RNA, 13 nt, Human
uaauaguuccugc

SEQ ID NO: 3736523 - RNA, 13 nt, Human
uaauaguuugucu

SEQ ID NO: 3736524 - RNA, 18 nt, Human
uaauaguuugucuauuuu

SEQ ID NO: 3736525 - RNA, 20 nt, Human
uaauauaaaagaucuugcag

SEQ ID NO: 3736526 - RNA, 20 nt, Human
uaauauaaaguuuuauauau

SEQ ID NO: 3736527 - RNA, 18 nt, Human
uaauauaaauucacuuuc

SEQ ID NO: 3736528 - RNA, 13 nt, Human
uaauauaauggaa

SEQ ID NO: 3736529 - RNA, 17 nt, Human
uaauauacuuguggacu

SEQ ID NO: 3736530 - RNA, 21 nt, Human
uaauauacuuguggacuaaaa

SEQ ID NO: 3736531 - RNA, 19 nt, Human
uaauauagaaaaaaacauu

SEQ ID NO: 3736532 - RNA, 22 nt, Human
uaauauagaaaaaaacauucua

SEQ ID NO: 3736533 - RNA, 20 nt, Human
uaauauauauauauaucagu

SEQ ID NO: 3736534 - RNA, 14 nt, Human
uaauauauaugaau

SEQ ID NO: 3736535 - RNA, 16 nt, Human
uaauauauaugaauaa

SEQ ID NO: 3736536 - RNA, 18 nt, Human
uaauauauaugaauaaag

SEQ ID NO: 3736537 - RNA, 18 nt, Human
uaauauauauuaucuuuu

SEQ ID NO: 3736538 - RNA, 13 nt, Human
uaauauauguuua

SEQ ID NO: 3736539 - RNA, 14 nt, Human
uaauauauguuuac

SEQ ID NO: 3736540 - RNA, 14 nt, Human
uaauauauuuaaaa

SEQ ID NO: 3736541 - RNA, 15 nt, Human
uaauauauuuaaagg

SEQ ID NO: 3736542 - RNA, 19 nt, Human
uaauauauuuaaagggaaa

SEQ ID NO: 3736543 - RNA, 22 nt, Human
uaauauauuuaaagggaaauug

SEQ ID NO: 3736544 - RNA, 19 nt, Human
uaauauauuuguguauuua

SEQ ID NO: 3736545 - RNA, 22 nt, Human
uaauauauuuuuauauuuaguu

SEQ ID NO: 3736546 - RNA, 16 nt, Human
uaauaucacucauuaa

SEQ ID NO: 3736547 - RNA, 23 nt, Human
uaauaucaucaguauugaagcau

SEQ ID NO: 3736548 - RNA, 19 nt, Human
uaauauccaggucaacaga

SEQ ID NO: 3736549 - RNA, 24 nt, Human
uaauauccaggucaacagaaugaa

SEQ ID NO: 3736550 - RNA, 12 nt, Human
uaauauccuaaa

SEQ ID NO: 3736551 - RNA, 22 nt, Human
uaauaucuuucugcacacaaau

SEQ ID NO: 3736552 - RNA, 14 nt, Human
uaauaucuuuguga

SEQ ID NO: 3736553 - RNA, 23 nt, Human
uaauaugauuuuuuaaaagaaau

SEQ ID NO: 3736554 - RNA, 16 nt, Human
uaauaugcaaagucua

SEQ ID NO: 3736555 - RNA, 18 nt, Human
uaauaugcacacauuuuu

SEQ ID NO: 3736556 - RNA, 10 nt, Human
uaauaugcau

SEQ ID NO: 3736557 - RNA, 18 nt, Human
uaauaugcuuaaaauaag

SEQ ID NO: 3736558 - RNA, 20 nt, Human
uaauaugcuuauaaccuagu

SEQ ID NO: 3736559 - RNA, 15 nt, Human
uaauauggcaaaaau

SEQ ID NO: 3736560 - RNA, 22 nt, Human
uaauauggccacaguagucuug

SEQ ID NO: 3736561 - RNA, 22 nt, Human
uaauauggcucuucauaauucu

SEQ ID NO: 3736562 - RNA, 23 nt, Human
uaauauggcucuucauaauucua

SEQ ID NO: 3736563 - RNA, 18 nt, Human
uaauaugggcauuguagu

SEQ ID NO: 3736564 - RNA, 14 nt, Human
uaauauuaaaaaua

SEQ ID NO: 3736565 - RNA, 12 nt, Human
uaauauuaaagc

SEQ ID NO: 3736566 - RNA, 17 nt, Human
uaauauuaaagccaugu

SEQ ID NO: 3736567 - RNA, 16 nt, Human
uaauauuaaauauaug

SEQ ID NO: 3736568 - RNA, 22 nt, Human
uaauauuacuguuuauuucugu

SEQ ID NO: 3736569 - RNA, 21 nt, Human
uaauauucaggguaaauagga

SEQ ID NO: 3736570 - RNA, 22 nt, Human
uaauauugaaaauugaaaagua

SEQ ID NO: 3736571 - RNA, 16 nt, Human
uaauauugacuuguau

SEQ ID NO: 3736572 - RNA, 16 nt, Human
uaauauugauuuauua

SEQ ID NO: 3736573 - RNA, 19 nt, Human
uaauauuguuguauaauuu

SEQ ID NO: 3736574 - RNA, 15 nt, Human
uaauauuguuuuucu

SEQ ID NO: 3736575 - RNA, 20 nt, Human
uaauauuguuuuucuuucua

SEQ ID NO: 3736576 - RNA, 21 nt, Human
uaauauuuaacauuauuuaua

SEQ ID NO: 3736577 - RNA, 19 nt, Human
uaauauuuacaauguauua

SEQ ID NO: 3736578 - RNA, 13 nt, Human
uaauauuuauuaa

SEQ ID NO: 3736579 - RNA, 15 nt, Human
uaauauuuuguauua

SEQ ID NO: 3736580 - RNA, 21 nt, Human
uaaucaaguaaggauguaugu

SEQ ID NO: 3736581 - RNA, 17 nt, Human
uaaucaaguuguaacuu

SEQ ID NO: 3736582 - RNA, 16 nt, Human
uaaucaauaaacgauu

SEQ ID NO: 3736583 - RNA, 17 nt, Human
uaaucaaucaucugugu

SEQ ID NO: 3736584 - RNA, 20 nt, Human
uaaucaccauguaagcacuc

SEQ ID NO: 3736585 - RNA, 23 nt, Human
uaaucacccuaccaacuuuacug

SEQ ID NO: 3736586 - RNA, 22 nt, Human
uaaucacgaguaagauuaagag

SEQ ID NO: 3736587 - RNA, 12 nt, Human
uaaucacugugu

SEQ ID NO: 3736588 - RNA, 14 nt, Human
uaaucacuguguau

SEQ ID NO: 3736589 - RNA, 15 nt, Human
uaaucacuguguaua

SEQ ID NO: 3736590 - RNA, 18 nt, Human
uaaucagaaauuuuuauc

SEQ ID NO: 3736591 - RNA, 21 nt, Human
uaaucagcaagaauuugaucg

SEQ ID NO: 3736592 - RNA, 18 nt, Human
uaaucaguguagccccaa

SEQ ID NO: 3736593 - RNA, 17 nt, Human
uaaucagugucucacac

SEQ ID NO: 3736594 - RNA, 23 nt, Human
uaaucagugugucuaaauuugaa

SEQ ID NO: 3736595 - RNA, 13 nt, Human
uaaucauauaaau

SEQ ID NO: 3736596 - RNA, 17 nt, Human
uaaucauauaaauagaa

SEQ ID NO: 3736597 - RNA, 19 nt, Human
uaaucauauaaauagaaug

SEQ ID NO: 3736598 - RNA, 20 nt, Human
uaaucauauaaauagaaugu

SEQ ID NO: 3736599 - RNA, 15 nt, Human
uaaucauauaauaaa

SEQ ID NO: 3736600 - RNA, 20 nt, Human
uaaucauauaauaaauguac

SEQ ID NO: 3736601 - RNA, 22 nt, Human
uaaucauauuagacuucuguuu

SEQ ID NO: 3736602 - RNA, 18 nt, Human
uaaucaucaaguaauaca

SEQ ID NO: 3736603 - RNA, 16 nt, Human
uaaucaucuauaaaga

SEQ ID NO: 3736604 - RNA, 13 nt, Human
uaaucaugaaauu

SEQ ID NO: 3736605 - RNA, 17 nt, Human
uaaucaugaaauuacuu

SEQ ID NO: 3736606 - RNA, 18 nt, Human
uaaucaugaaauuacuua

SEQ ID NO: 3736607 - RNA, 17 nt, Human
uaaucaugaauguguaa

SEQ ID NO: 3736608 - RNA, 12 nt, Human
uaaucauuucuu

SEQ ID NO: 3736609 - RNA, 13 nt, Human
uaaucauuuguuu

SEQ ID NO: 3736610 - RNA, 14 nt, Human
uaaucauuuguuua

SEQ ID NO: 3736611 - RNA, 22 nt, Human
uaauccaagcaaaugugaauca

SEQ ID NO: 3736612 - RNA, 14 nt, Human
uaauccagaauaac

SEQ ID NO: 3736613 - RNA, 13 nt, Human
uaauccagcugau

SEQ ID NO: 3736614 - RNA, 19 nt, Human
uaauccaggcacagcugag

SEQ ID NO: 3736615 - RNA, 18 nt, Human
uaauccaggcagauccag

SEQ ID NO: 3736616 - RNA, 16 nt, Human
uaaucccagcacuuug

SEQ ID NO: 3736617 - RNA, 21 nt, Human
uaaucccagcacuuugggagg

SEQ ID NO: 3736618 - RNA, 19 nt, Human
uaauccccuaaaauaacag

SEQ ID NO: 3736619 - RNA, 15 nt, Human
uaauccccuucuccc

SEQ ID NO: 3736620 - RNA, 18 nt, Human
uaauccgccaauauuagu

SEQ ID NO: 3736621 - RNA, 20 nt, Human
uaauccucuaggaggucucu

SEQ ID NO: 3736622 - RNA, 18 nt, Human
uaauccuguaggaaggua

SEQ ID NO: 3736623 - RNA, 22 nt, Human
uaauccuuaaaucuuaauguuc

SEQ ID NO: 3736624 - RNA, 15 nt, Human
uaauccuugauaaua

SEQ ID NO: 3736625 - RNA, 17 nt, Human
uaauccuuucugccgac

SEQ ID NO: 3736626 - RNA, 14 nt, Human
uaauccuuuggaaa

SEQ ID NO: 3736627 - RNA, 23 nt, Human
uaauccuuuguuuucugacuaau

SEQ ID NO: 3736628 - RNA, 13 nt, Human
uaaucgaccugcc

SEQ ID NO: 3736629 - RNA, 17 nt, Human
uaaucgggguauaauag

SEQ ID NO: 3736630 - RNA, 11 nt, Human
uaaucuaaaug

SEQ ID NO: 3736631 - RNA, 22 nt, Human
uaaucuacuccuuguaaagacu

SEQ ID NO: 3736632 - RNA, 22 nt, Human
uaaucuagauaucgacuuguuu

SEQ ID NO: 3736633 - RNA, 20 nt, Human
uaaucuaguuuacagaaaaa

SEQ ID NO: 3736634 - RNA, 15 nt, Human
uaaucucguuucaaa

SEQ ID NO: 3736635 - RNA, 14 nt, Human
uaaucucuaggaag

SEQ ID NO: 3736636 - RNA, 19 nt, Human
uaaucucucugcagcugcc

SEQ ID NO: 3736637 - RNA, 18 nt, Human
uaaucucuguaaagcuaa

SEQ ID NO: 3736638 - RNA, 13 nt, Human
uaaucugaauaaa

SEQ ID NO: 3736639 - RNA, 14 nt, Human
uaaucugagaaaca

SEQ ID NO: 3736640 - RNA, 20 nt, Human
uaaucugauggcuucuccag

SEQ ID NO: 3736641 - RNA, 13 nt, Human
uaaucugccuccc

SEQ ID NO: 3736642 - RNA, 15 nt, Human
uaaucuggacuccuc

SEQ ID NO: 3736643 - RNA, 17 nt, Human
uaaucuggacuccucug

SEQ ID NO: 3736644 - RNA, 13 nt, Human
uaaucuguacauu

SEQ ID NO: 3736645 - RNA, 16 nt, Human
uaaucuguagggcugg

SEQ ID NO: 3736646 - RNA, 20 nt, Human
uaaucuguagggcuggaccu

SEQ ID NO: 3736647 - RNA, 18 nt, Human
uaaucuguauaauacuuu

SEQ ID NO: 3736648 - RNA, 11 nt, Human
uaaucugucaa

SEQ ID NO: 3736649 - RNA, 22 nt, Human
uaaucugucaaaacacugugga

SEQ ID NO: 3736650 - RNA, 23 nt, Human
uaaucugucaaaacacuguggaa

SEQ ID NO: 3736651 - RNA, 22 nt, Human
uaaucugugcuguuucaaaguu

SEQ ID NO: 3736652 - RNA, 13 nt, Human
uaaucuguguaca

SEQ ID NO: 3736653 - RNA, 14 nt, Human
uaaucuguguacaa

SEQ ID NO: 3736654 - RNA, 20 nt, Human
uaaucuguuauguacuagug

SEQ ID NO: 3736655 - RNA, 14 nt, Human
uaaucuuaauguau

SEQ ID NO: 3736656 - RNA, 15 nt, Human
uaaucuuaguguaug

SEQ ID NO: 3736657 - RNA, 18 nt, Human
uaaucuuaguguaugauu

SEQ ID NO: 3736658 - RNA, 18 nt, Human
uaaucuuauaauuguucu

SEQ ID NO: 3736659 - RNA, 22 nt, Human
uaaucuuauaauuguucucaga

SEQ ID NO: 3736660 - RNA, 13 nt, Human
uaaucuuauuagg

SEQ ID NO: 3736661 - RNA, 13 nt, Human
uaaucuucaguuu

SEQ ID NO: 3736662 - RNA, 14 nt, Human
uaaucuucugccuu

SEQ ID NO: 3736663 - RNA, 16 nt, Human
uaaucuugaauuguaa

SEQ ID NO: 3736664 - RNA, 14 nt, Human
uaaucuugcucugc

SEQ ID NO: 3736665 - RNA, 15 nt, Human
uaaucuugcucugcu

SEQ ID NO: 3736666 - RNA, 20 nt, Human
uaaucuugcucugcuugaca

SEQ ID NO: 3736667 - RNA, 14 nt, Human
uaaucuugcuuucu

SEQ ID NO: 3736668 - RNA, 15 nt, Human
uaaucuugcuuucuu

SEQ ID NO: 3736669 - RNA, 16 nt, Human
uaaucuugugaaaaua

SEQ ID NO: 3736670 - RNA, 12 nt, Human
uaccuuacugug

SEQ ID NO: 3736671 - RNA, 14 nt, Human
uaccuuagugcagu

SEQ ID NO: 3736672 - RNA, 16 nt, Human
uaccuuagugcaguua

SEQ ID NO: 3736673 - RNA, 17 nt, Human
uaccuuagugcaguuau

SEQ ID NO: 3736674 - RNA, 19 nt, Human
uaccuuagugcaguuauuu

SEQ ID NO: 3736675 - RNA, 16 nt, Human
uaccuuauaguuacug

SEQ ID NO: 3736676 - RNA, 18 nt, Human
uaccuuaucacugcauua

SEQ ID NO: 3736677 - RNA, 14 nt, Human
uaccuucaaacuuu

SEQ ID NO: 3736678 - RNA, 16 nt, Human
uaccuucaaacuuuag

SEQ ID NO: 3736679 - RNA, 13 nt, Human
uaccuucaauaaa

SEQ ID NO: 3736680 - RNA, 14 nt, Human
uaccuucaauaaag

SEQ ID NO: 3736681 - RNA, 16 nt, Human
uaccuucaauaaagua

SEQ ID NO: 3736682 - RNA, 17 nt, Human
uaccuucagauccuacc

SEQ ID NO: 3736683 - RNA, 16 nt, Human
uaccuucauaugcagu

SEQ ID NO: 3736684 - RNA, 14 nt, Human
uaccuucucccuca

SEQ ID NO: 3736685 - RNA, 22 nt, Human
uaccuucucccucauuucagga

SEQ ID NO: 3736686 - RNA, 14 nt, Human
uaccuucuguaguu

SEQ ID NO: 3736687 - RNA, 12 nt, Human
uaccuucuuuca

SEQ ID NO: 3736688 - RNA, 18 nt, Human
uaccuugaacacuggggg

SEQ ID NO: 3736689 - RNA, 16 nt, Human
uaccuugaccuuugua

SEQ ID NO: 3736690 - RNA, 16 nt, Human
uaccuugacuguugau

SEQ ID NO: 3736691 - RNA, 20 nt, Human
uaccuugccccaacccuucu

SEQ ID NO: 3736692 - RNA, 23 nt, Human
uaccuugccccaacccuucuuca

SEQ ID NO: 3736693 - RNA, 21 nt, Human
uaccuuucacagcuuuuauca

SEQ ID NO: 3736694 - RNA, 19 nt, Human
uaccuuucuccuucccaaa

SEQ ID NO: 3736695 - RNA, 16 nt, Human
uaccuuuuaauuaaug

SEQ ID NO: 3736696 - RNA, 13 nt, Human
uaccuuuuauuuu

SEQ ID NO: 3736697 - RNA, 14 nt, Human
uaccuuuucagggc

SEQ ID NO: 3736698 - RNA, 13 nt, Human
uaccuuuuuuaga

SEQ ID NO: 3736699 - RNA, 13 nt, Human
uaccuuuuuuaua

SEQ ID NO: 3736700 - RNA, 18 nt, Human
uaccuuuuuuauacauaa

SEQ ID NO: 3736701 - RNA, 21 nt, Human
uaccuuuuuuguuuuuucaaa

SEQ ID NO: 3736702 - RNA, 23 nt, Human
uaccuuuuuuguuuuuucaaaau

SEQ ID NO: 3736703 - RNA, 15 nt, Human
uacgaaacacaaacc

SEQ ID NO: 3736704 - RNA, 20 nt, Human
uacgaaauaauuguuguucu

SEQ ID NO: 3736705 - RNA, 12 nt, Human
uacgaacaaaac

SEQ ID NO: 3736706 - RNA, 16 nt, Human
uacgaacaaaacacac

SEQ ID NO: 3736707 - RNA, 21 nt, Human
uacgacaaaggacgcucccag

SEQ ID NO: 3736708 - RNA, 14 nt, Human
uacgacaacuugca

SEQ ID NO: 3736709 - RNA, 20 nt, Human
uacgagcaagcuuuuacaac

SEQ ID NO: 3736710 - RNA, 22 nt, Human
uacgagcaccuccagccugaac

SEQ ID NO: 3736711 - RNA, 21 nt, Human
uacgagugcuaaguguaggau

SEQ ID NO: 3736712 - RNA, 14 nt, Human
uacgauacgcuacu

SEQ ID NO: 3736713 - RNA, 22 nt, Human
uacgcagcgugcuuuaaaaaau

SEQ ID NO: 3736714 - RNA, 16 nt, Human
uacgcccaucucagga

SEQ ID NO: 3736715 - RNA, 13 nt, Human
uacgcucuccuuu

SEQ ID NO: 3736716 - RNA, 15 nt, Human
uacgcucuccuuucu

SEQ ID NO: 3736717 - RNA, 19 nt, Human
uacgcucuccuuucuuucu

SEQ ID NO: 3736718 - RNA, 21 nt, Human
uacgcucuccuuucuuucuaa

SEQ ID NO: 3736719 - RNA, 14 nt, Human
uacgcuguccagaa

SEQ ID NO: 3736720 - RNA, 13 nt, Human
uacggacaccccc

SEQ ID NO: 3736721 - RNA, 14 nt, Human
uacggacacccccu

SEQ ID NO: 3736722 - RNA, 17 nt, Human
uacggauuuucaguuac

SEQ ID NO: 3736723 - RNA, 13 nt, Human
uacggugggggua

SEQ ID NO: 3736724 - RNA, 20 nt, Human
uacgguuugccccuuuauaa

SEQ ID NO: 3736725 - RNA, 13 nt, Human
uacguacacauuu

SEQ ID NO: 3736726 - RNA, 14 nt, Human
uacguacacauuuu

SEQ ID NO: 3736727 - RNA, 15 nt, Human
uacguacacauuuua

SEQ ID NO: 3736728 - RNA, 16 nt, Human
uacguaguguagauuu

SEQ ID NO: 3736729 - RNA, 12 nt, Human
uacguaguucua

SEQ ID NO: 3736730 - RNA, 18 nt, Human
uacguaugucugguucuc

SEQ ID NO: 3736731 - RNA, 18 nt, Human
uacgucaaacaugaagug

SEQ ID NO: 3736732 - RNA, 15 nt, Human
uacgucugacaggca

SEQ ID NO: 3736733 - RNA, 21 nt, Human
uacgucugggagaaauugaca

SEQ ID NO: 3736734 - RNA, 14 nt, Human
uacgugagccaggu

SEQ ID NO: 3736735 - RNA, 15 nt, Human
uacguguagcuauau

SEQ ID NO: 3736736 - RNA, 14 nt, Human
uacgugucaaugug

SEQ ID NO: 3736737 - RNA, 17 nt, Human
uacgugucaaugugugc

SEQ ID NO: 3736738 - RNA, 16 nt, Human
uacguuauuguugacu

SEQ ID NO: 3736739 - RNA, 18 nt, Human
uacguuccuauugucauu

SEQ ID NO: 3736740 - RNA, 14 nt, Human
uacguugugcauuu

SEQ ID NO: 3736741 - RNA, 14 nt, Human
uacguuuguaugug

SEQ ID NO: 3736742 - RNA, 17 nt, Human
uacuaaaaagaaggaaa

SEQ ID NO: 3736743 - RNA, 14 nt, Human
uacuaaaaauacaa

SEQ ID NO: 3736744 - RNA, 15 nt, Human
uacuaaaaauacaaa

SEQ ID NO: 3736745 - RNA, 18 nt, Human
uacuaaaaauacaaacaa

SEQ ID NO: 3736746 - RNA, 19 nt, Human
uacuaaacaguaagauauc

SEQ ID NO: 3736747 - RNA, 12 nt, Human
uacuaaacauau

SEQ ID NO: 3736748 - RNA, 21 nt, Human
uacuaaauuuaaauuuaaaga

SEQ ID NO: 3736749 - RNA, 22 nt, Human
uacuaaauuuaaauuuaaagau

SEQ ID NO: 3736750 - RNA, 23 nt, Human
uacuaacaaucagcuccuuccug

SEQ ID NO: 3736751 - RNA, 17 nt, Human
uacuaacuucuaaaacu

SEQ ID NO: 3736752 - RNA, 19 nt, Human
uacuaacuucuaaaacugu

SEQ ID NO: 3736753 - RNA, 19 nt, Human
uacuaagaugacauugcua

SEQ ID NO: 3736754 - RNA, 19 nt, Human
uacuaaggauacaggcugg

SEQ ID NO: 3736755 - RNA, 15 nt, Human
uacuaaggcuuuccu

SEQ ID NO: 3736756 - RNA, 14 nt, Human
uacuaaguucacau

SEQ ID NO: 3736757 - RNA, 14 nt, Human
uacuaauaaacuaa

SEQ ID NO: 3736758 - RNA, 22 nt, Human
uacuaauaaacuaauaauugca

SEQ ID NO: 3736759 - RNA, 15 nt, Human
uacuaaugauguuuu

SEQ ID NO: 3736760 - RNA, 20 nt, Human
uacuaauguaaaaugauuug

SEQ ID NO: 3736761 - RNA, 15 nt, Human
uacuaauuaacauau

SEQ ID NO: 3736762 - RNA, 17 nt, Human
uacuaauuuuacacauu

SEQ ID NO: 3736763 - RNA, 16 nt, Human
uacuaauuuucuagau

SEQ ID NO: 3736764 - RNA, 16 nt, Human
uacuacaaaaaaguug

SEQ ID NO: 3736765 - RNA, 14 nt, Human
uacuacaauaugua

SEQ ID NO: 3736766 - RNA, 20 nt, Human
uacuacacuccaugucaggu

SEQ ID NO: 3736767 - RNA, 17 nt, Human
uacuacagucaagauag

SEQ ID NO: 3736768 - RNA, 20 nt, Human
uacuacaguccucccaucuc

SEQ ID NO: 3736769 - RNA, 18 nt, Human
uacuacaguucuuuuguu

SEQ ID NO: 3736770 - RNA, 23 nt, Human
uacuacaguuguuuuuugaaaac

SEQ ID NO: 3736771 - RNA, 13 nt, Human
uacuacaguuugu

SEQ ID NO: 3736772 - RNA, 20 nt, Human
uacuacaguuuguuaguaug

SEQ ID NO: 3736773 - RNA, 18 nt, Human
uacuacauugaguagaca

SEQ ID NO: 3736774 - RNA, 15 nt, Human
uacuaccuccucucc

SEQ ID NO: 3736775 - RNA, 14 nt, Human
uacuaccuugaaaa

SEQ ID NO: 3736776 - RNA, 16 nt, Human
uacuacuccuguaauu

SEQ ID NO: 3736777 - RNA, 20 nt, Human
uacuacugaaacagauuuca

SEQ ID NO: 3736778 - RNA, 21 nt, Human
uacuacugaaacagauuucau

SEQ ID NO: 3736779 - RNA, 17 nt, Human
uacuacuuaugaaaugu

SEQ ID NO: 3736780 - RNA, 12 nt, Human
uacuacuuuguu

SEQ ID NO: 3736781 - RNA, 22 nt, Human
uacuacuuuguuaggauuuuca

SEQ ID NO: 3736782 - RNA, 12 nt, Human
uacuagaacaca

SEQ ID NO: 3736783 - RNA, 18 nt, Human
uacuagaacacagaaagc

SEQ ID NO: 3736784 - RNA, 18 nt, Human
uacuagagauauuuugua

SEQ ID NO: 3736785 - RNA, 24 nt, Human
uacuagagauauuuuguaaaaugu

SEQ ID NO: 3736786 - RNA, 19 nt, Human
uacuagagucugaacagcu

SEQ ID NO: 3736787 - RNA, 15 nt, Human
uacuagaugucuuua

SEQ ID NO: 3736788 - RNA, 19 nt, Human
uacuagaugucuuuaggca

SEQ ID NO: 3736789 - RNA, 17 nt, Human
uacuagcaaaauaaaac

SEQ ID NO: 3736790 - RNA, 19 nt, Human
uacuagggagccauuugag

SEQ ID NO: 3736791 - RNA, 20 nt, Human
uacuagggagccauuugaga

SEQ ID NO: 3736792 - RNA, 18 nt, Human
uacuaguacuguguacug

SEQ ID NO: 3736793 - RNA, 22 nt, Human
uacuagucaccagagacuuuag

SEQ ID NO: 3736794 - RNA, 14 nt, Human
uacuaguuacacau

SEQ ID NO: 3736795 - RNA, 19 nt, Human
uacuaguuacacaucuuca

SEQ ID NO: 3736796 - RNA, 14 nt, Human
uacuauaaagagaa

SEQ ID NO: 3736797 - RNA, 16 nt, Human
uacuauaauuuaccug

SEQ ID NO: 3736798 - RNA, 16 nt, Human
uacuauagcaaaguag

SEQ ID NO: 3736799 - RNA, 19 nt, Human
uacuauauaugugaugauc

SEQ ID NO: 3736800 - RNA, 20 nt, Human
uacuauaucuguuuuacugc

SEQ ID NO: 3736801 - RNA, 13 nt, Human
uacuauauuugcu

SEQ ID NO: 3736802 - RNA, 21 nt, Human
uacuaucauacuacugaaaca

SEQ ID NO: 3736803 - RNA, 13 nt, Human
uacuauccuggcu

SEQ ID NO: 3736804 - RNA, 16 nt, Human
uacuauguaucaauga

SEQ ID NO: 3736805 - RNA, 12 nt, Human
uacuauuaaaaa

SEQ ID NO: 3736806 - RNA, 17 nt, Human
uacuauuaagcaguaaa

SEQ ID NO: 3736807 - RNA, 22 nt, Human
uacuauuguugcugaaacuugc

SEQ ID NO: 3736808 - RNA, 11 nt, Human
uacuauuuaaa

SEQ ID NO: 3736809 - RNA, 16 nt, Human
uacuauuuaacugacu

SEQ ID NO: 3736810 - RNA, 12 nt, Human
uacuauuuaaga

SEQ ID NO: 3736811 - RNA, 15 nt, Human
uacuauuuaagaugu

SEQ ID NO: 3736812 - RNA, 13 nt, Human
uacuauuucacaa

SEQ ID NO: 3736813 - RNA, 12 nt, Human
uacuauuucuug

SEQ ID NO: 3736814 - RNA, 21 nt, Human
uacuauuucuugugguuauaa

SEQ ID NO: 3736815 - RNA, 18 nt, Human
uacuauuuuacuucuaga

SEQ ID NO: 3736816 - RNA, 13 nt, Human
uacuauuuuuacu

SEQ ID NO: 3736817 - RNA, 19 nt, Human
uacucaagaggcugaggca

SEQ ID NO: 3736818 - RNA, 23 nt, Human
uacucaagagugguaucuugcag

SEQ ID NO: 3736819 - RNA, 19 nt, Human
uacucaaguagcauuuacu

SEQ ID NO: 3736820 - RNA, 22 nt, Human
uacucaauugauaaacauuuaa

SEQ ID NO: 3736821 - RNA, 15 nt, Human
gcauauuuuuuuucu

SEQ ID NO: 3736822 - RNA, 21 nt, Human
gcaucaaaagacaauucuuua

SEQ ID NO: 3736823 - RNA, 22 nt, Human
gcaucaaggggucacuuacaga

SEQ ID NO: 3736824 - RNA, 19 nt, Human
gcaucaauccugugugguu

SEQ ID NO: 3736825 - RNA, 12 nt, Human
gcaucacaguuu

SEQ ID NO: 3736826 - RNA, 16 nt, Human
gcaucacaugaacuug

SEQ ID NO: 3736827 - RNA, 15 nt, Human
gcaucaccucaggcc

SEQ ID NO: 3736828 - RNA, 15 nt, Human
gcaucaccuccacca

SEQ ID NO: 3736829 - RNA, 16 nt, Human
gcaucaccugccuguu

SEQ ID NO: 3736830 - RNA, 21 nt, Human
gcaucacuccccaaggaagag

SEQ ID NO: 3736831 - RNA, 16 nt, Human
gcaucacuuaaaacac

SEQ ID NO: 3736832 - RNA, 23 nt, Human
gcaucacuuaacggaccaaagca

SEQ ID NO: 3736833 - RNA, 10 nt, Human
gcaucagaaa

SEQ ID NO: 3736834 - RNA, 16 nt, Human
gcaucagaaagggagg

SEQ ID NO: 3736835 - RNA, 19 nt, Human
gcaucagaaagggagggcu

SEQ ID NO: 3736836 - RNA, 21 nt, Human
gcaucagaaagggagggcucu

SEQ ID NO: 3736837 - RNA, 22 nt, Human
gcaucagaaagggagggcucug

SEQ ID NO: 3736838 - RNA, 22 nt, Human
gcaucagacugugaaccccacg

SEQ ID NO: 3736839 - RNA, 12 nt, Human
gcaucagcugcu

SEQ ID NO: 3736840 - RNA, 23 nt, Human
gcaucagcugcugaaacaacaaa

SEQ ID NO: 3736841 - RNA, 17 nt, Human
gcaucagcuggcgucau

SEQ ID NO: 3736842 - RNA, 19 nt, Human
gcaucaggccuagaggccu

SEQ ID NO: 3736843 - RNA, 13 nt, Human
gcaucagggggaa

SEQ ID NO: 3736844 - RNA, 17 nt, Human
gcaucaguguuuuucaa

SEQ ID NO: 3736845 - RNA, 12 nt, Human
gcaucaugccuc

SEQ ID NO: 3736846 - RNA, 13 nt, Human
gcaucaugccucu

SEQ ID NO: 3736847 - RNA, 16 nt, Human
gcaucaugccucugag

SEQ ID NO: 3736848 - RNA, 17 nt, Human
gcaucaugccucugagg

SEQ ID NO: 3736849 - RNA, 18 nt, Human
gcaucaugccucugaggc

SEQ ID NO: 3736850 - RNA, 20 nt, Human
gcaucaugccucugaggcca

SEQ ID NO: 3736851 - RNA, 21 nt, Human
gcaucaugccucugaggccag

SEQ ID NO: 3736852 - RNA, 18 nt, Human
gcaucauuccaccauggc

SEQ ID NO: 3736853 - RNA, 15 nt, Human
gcaucauuccaggcc

SEQ ID NO: 3736854 - RNA, 20 nt, Human
gcaucauucuuguuaauuau

SEQ ID NO: 3736855 - RNA, 20 nt, Human
gcaucauuuugcauucaaau

SEQ ID NO: 3736856 - RNA, 15 nt, Human
gcauccaaaggugcu

SEQ ID NO: 3736857 - RNA, 12 nt, Human
gcauccaacuga

SEQ ID NO: 3736858 - RNA, 15 nt, Human
gcauccaaucucaag

SEQ ID NO: 3736859 - RNA, 12 nt, Human
gcauccaccucc

SEQ ID NO: 3736860 - RNA, 21 nt, Human
gcauccagagucccugccugg

SEQ ID NO: 3736861 - RNA, 19 nt, Human
gcauccagcagucucugcc

SEQ ID NO: 3736862 - RNA, 20 nt, Human
gcauccagcagucucugccu

SEQ ID NO: 3736863 - RNA, 12 nt, Human
gcauccaugggg

SEQ ID NO: 3736864 - RNA, 22 nt, Human
gcauccauggggucucucacag

SEQ ID NO: 3736865 - RNA, 23 nt, Human
gcauccauggggucucucacaga

SEQ ID NO: 3736866 - RNA, 15 nt, Human
gcauccauuccucag

SEQ ID NO: 3736867 - RNA, 16 nt, Human
gcauccauucuccuga

SEQ ID NO: 3736868 - RNA, 20 nt, Human
gcaucccagcaccugccucc

SEQ ID NO: 3736869 - RNA, 21 nt, Human
gcaucccaggggaccacaccu

SEQ ID NO: 3736870 - RNA, 14 nt, Human
gcaucccaguggcc

SEQ ID NO: 3736871 - RNA, 17 nt, Human
gcaucccaguggccuca

SEQ ID NO: 3736872 - RNA, 20 nt, Human
gcaucccaguggccucaacc

SEQ ID NO: 3736873 - RNA, 15 nt, Human
gcauccccugccucc

SEQ ID NO: 3736874 - RNA, 21 nt, Human
gcauccccuuggcugugaggc

SEQ ID NO: 3736875 - RNA, 18 nt, Human
gcaucccggaggaaaucu

SEQ ID NO: 3736876 - RNA, 12 nt, Human
gcaucccugaga

SEQ ID NO: 3736877 - RNA, 13 nt, Human
gcaucccugagac

SEQ ID NO: 3736878 - RNA, 15 nt, Human
gcaucccugggccuu

SEQ ID NO: 3736879 - RNA, 20 nt, Human
gcaucccugggccuugggcu

SEQ ID NO: 3736880 - RNA, 18 nt, Human
gcaucccuugaccaggcc

SEQ ID NO: 3736881 - RNA, 20 nt, Human
gcaucccuugaccaggccug

SEQ ID NO: 3736882 - RNA, 18 nt, Human
gcauccgcaggugcuggu

SEQ ID NO: 3736883 - RNA, 17 nt, Human
gcauccguaguucccug

SEQ ID NO: 3736884 - RNA, 19 nt, Human
gcauccuaaagauaaagcc

SEQ ID NO: 3736885 - RNA, 20 nt, Human
gcauccuaaagauaaagcca

SEQ ID NO: 3736886 - RNA, 19 nt, Human
gcauccuccaagaaucuau

SEQ ID NO: 3736887 - RNA, 12 nt, Human
gcauccuccagc

SEQ ID NO: 3736888 - RNA, 14 nt, Human
gcauccuccagccc

SEQ ID NO: 3736889 - RNA, 21 nt, Human
gcauccugagccccgcccucu

SEQ ID NO: 3736890 - RNA, 21 nt, Human
gcauccugccuuagagccagg

SEQ ID NO: 3736891 - RNA, 17 nt, Human
gcauccuggcacccggc

SEQ ID NO: 3736892 - RNA, 21 nt, Human
gcauccuggcacccggccccu

SEQ ID NO: 3736893 - RNA, 17 nt, Human
gcauccugugaaguccu

SEQ ID NO: 3736894 - RNA, 16 nt, Human
gcauccugugccacua

SEQ ID NO: 3736895 - RNA, 22 nt, Human
gcauccuuaaguaucagaaagc

SEQ ID NO: 3736896 - RNA, 13 nt, Human
gcauccuuccuau

SEQ ID NO: 3736897 - RNA, 15 nt, Human
gcauccuuccuauaa

SEQ ID NO: 3736898 - RNA, 13 nt, Human
gcauccuucugcc

SEQ ID NO: 3736899 - RNA, 23 nt, Human
gcauccuuuaggguucugccucu

SEQ ID NO: 3736900 - RNA, 13 nt, Human
gcaucgcaaugua

SEQ ID NO: 3736901 - RNA, 16 nt, Human
gcaucuaaacuuuaau

SEQ ID NO: 3736902 - RNA, 21 nt, Human
gcaucuaaacuuuaauaugua

SEQ ID NO: 3736903 - RNA, 22 nt, Human
gcaucuaaguuauaagacucuc

SEQ ID NO: 3736904 - RNA, 22 nt, Human
gcaucuagaggcuuccuucauu

SEQ ID NO: 3736905 - RNA, 20 nt, Human
gcaucuaguuccccuguuua

SEQ ID NO: 3736906 - RNA, 16 nt, Human
gcaucuaucugugcua

SEQ ID NO: 3736907 - RNA, 23 nt, Human
gcaucuaugggagagugucaacc

SEQ ID NO: 3736908 - RNA, 19 nt, Human
gugaaaaucuacacuccag

SEQ ID NO: 3736909 - RNA, 15 nt, Human
gugaaaaugguccag

SEQ ID NO: 3736910 - RNA, 21 nt, Human
gugaaacacaccaggcugugg

SEQ ID NO: 3736911 - RNA, 14 nt, Human
gugaaacacagcug

SEQ ID NO: 3736912 - RNA, 15 nt, Human
gugaaacacagcugu

SEQ ID NO: 3736913 - RNA, 24 nt, Human
gugaaacccagucacugugagcuc

SEQ ID NO: 3736914 - RNA, 12 nt, Human
gugaaacccugu

SEQ ID NO: 3736915 - RNA, 17 nt, Human
gugaaaccugugaagcu

SEQ ID NO: 3736916 - RNA, 18 nt, Human
gugaaaccuuuagggcag

SEQ ID NO: 3736917 - RNA, 19 nt, Human
gugaaaccuuuagggcagc

SEQ ID NO: 3736918 - RNA, 23 nt, Human
gugaaaccuuuagggcagcuugc

SEQ ID NO: 3736919 - RNA, 13 nt, Human
gugaaaccuuuuu

SEQ ID NO: 3736920 - RNA, 14 nt, Human
gugaaaccuuuuuu

SEQ ID NO: 3736921 - RNA, 21 nt, Human
gugaaaccuuuuuuaagauuu

SEQ ID NO: 3736922 - RNA, 21 nt, Human
gugaaacugcuuguuuccuag

SEQ ID NO: 3736923 - RNA, 23 nt, Human
gugaaacugcuuguuuccuagca

SEQ ID NO: 3736924 - RNA, 16 nt, Human
gugaaacuuccuaagu

SEQ ID NO: 3736925 - RNA, 14 nt, Human
gugaaacuuucauu

SEQ ID NO: 3736926 - RNA, 21 nt, Human
gugaaacuuuucuagaauuau

SEQ ID NO: 3736927 - RNA, 15 nt, Human
gugaaagaaaucaug

SEQ ID NO: 3736928 - RNA, 17 nt, Human
gugaaagaaaucauguu

SEQ ID NO: 3736929 - RNA, 19 nt, Human
gugaaagaaaucauguuau

SEQ ID NO: 3736930 - RNA, 20 nt, Human
gugaaagaaaucauguuaug

SEQ ID NO: 3736931 - RNA, 21 nt, Human
gugaaagaaaucauguuauga

SEQ ID NO: 3736932 - RNA, 13 nt, Human
gugaaagaaguaa

SEQ ID NO: 3736933 - RNA, 19 nt, Human
gugaaaggauaugaaucug

SEQ ID NO: 3736934 - RNA, 21 nt, Human
gugaaagggagcuaucaggaa

SEQ ID NO: 3736935 - RNA, 17 nt, Human
gugaaauaacaaaaugg

SEQ ID NO: 3736936 - RNA, 19 nt, Human
gugaaauaacaaaauggac

SEQ ID NO: 3736937 - RNA, 22 nt, Human
gugaaauaccaaccugaagaca

SEQ ID NO: 3736938 - RNA, 17 nt, Human
gugaaauaccagugugg

SEQ ID NO: 3736939 - RNA, 14 nt, Human
gugaaauguaacug

SEQ ID NO: 3736940 - RNA, 12 nt, Human
gugaaauuccca

SEQ ID NO: 3736941 - RNA, 23 nt, Human
gugaaauucccaacaaacauuga

SEQ ID NO: 3736942 - RNA, 20 nt, Human
gugaaauuuacaucauuucu

SEQ ID NO: 3736943 - RNA, 18 nt, Human
gugaaauuuuucauauuu

SEQ ID NO: 3736944 - RNA, 20 nt, Human
gugaaauuuuucauauuuua

SEQ ID NO: 3736945 - RNA, 18 nt, Human
gugaacaaaagaugcucu

SEQ ID NO: 3736946 - RNA, 18 nt, Human
gugaacaaagcagccacg

SEQ ID NO: 3736947 - RNA, 19 nt, Human
gugaacaagcaaacccaga

SEQ ID NO: 3736948 - RNA, 12 nt, Human
gugaaccaaaga

SEQ ID NO: 3736949 - RNA, 14 nt, Human
gugaaccaaugcaa

SEQ ID NO: 3736950 - RNA, 19 nt, Human
gugaaccaccacacccagc

SEQ ID NO: 3736951 - RNA, 22 nt, Human
gugaaccaccacacccagccca

SEQ ID NO: 3736952 - RNA, 23 nt, Human
gugaaccaccacacccagcccac

SEQ ID NO: 3736953 - RNA, 19 nt, Human
gucacacaguguuggaggu

SEQ ID NO: 3736954 - RNA, 20 nt, Human
gucacacaguguuggagguu

SEQ ID NO: 3736955 - RNA, 13 nt, Human
gucacaccagcca

SEQ ID NO: 3736956 - RNA, 12 nt, Human
gucacagccagg

SEQ ID NO: 3736957 - RNA, 13 nt, Human
gucacagccaggc

SEQ ID NO: 3736958 - RNA, 20 nt, Human
gucacaggaaguagaggagg

SEQ ID NO: 3736959 - RNA, 19 nt, Human
gucacaggacucugccucc

SEQ ID NO: 3736960 - RNA, 15 nt, Human
gucacaggcaggucc

SEQ ID NO: 3736961 - RNA, 21 nt, Human
gucacaguguuuacacuuugg

SEQ ID NO: 3736962 - RNA, 16 nt, Human
gucacaucagauaaga

SEQ ID NO: 3736963 - RNA, 13 nt, Human
gucacauugcauu

SEQ ID NO: 3736964 - RNA, 15 nt, Human
gucaccaagcccagu

SEQ ID NO: 3736965 - RNA, 16 nt, Human
gucaccaagcccaguu

SEQ ID NO: 3736966 - RNA, 13 nt, Human
gucaccaaggaaa

SEQ ID NO: 3736967 - RNA, 13 nt, Human
gucaccaccaccc

SEQ ID NO: 3736968 - RNA, 14 nt, Human
gucaccaccacccc

SEQ ID NO: 3736969 - RNA, 17 nt, Human
gucaccacccugcucau

SEQ ID NO: 3736970 - RNA, 11 nt, Human
gucaccaccuu

SEQ ID NO: 3736971 - RNA, 15 nt, Human
gucaccaccuuccca

SEQ ID NO: 3736972 - RNA, 16 nt, Human
gucaccacgacuggcc

SEQ ID NO: 3736973 - RNA, 17 nt, Human
gucaccacgacuggcca

SEQ ID NO: 3736974 - RNA, 19 nt, Human
gucaccacgacuggccagg

SEQ ID NO: 3736975 - RNA, 16 nt, Human
gucaccagcuccuccc

SEQ ID NO: 3736976 - RNA, 21 nt, Human
gucacccaaaccggcaggugc

SEQ ID NO: 3736977 - RNA, 20 nt, Human
gucacccaggcuggaguaca

SEQ ID NO: 3736978 - RNA, 20 nt, Human
gucacccagguuggagugca

SEQ ID NO: 3736979 - RNA, 13 nt, Human
gucaccccagagc

SEQ ID NO: 3736980 - RNA, 14 nt, Human
gucaccccagagcc

SEQ ID NO: 3736981 - RNA, 13 nt, Human
gucaccccggcca

SEQ ID NO: 3736982 - RNA, 18 nt, Human
gucaccccggccaccugc

SEQ ID NO: 3736983 - RNA, 22 nt, Human
gucaccccggccaccugcggug

SEQ ID NO: 3736984 - RNA, 20 nt, Human
gucaccccuccaggaaugau

SEQ ID NO: 3736985 - RNA, 14 nt, Human
gucacccuagcccu

SEQ ID NO: 3736986 - RNA, 23 nt, Human
gucaccggauccuggguggucug

SEQ ID NO: 3736987 - RNA, 19 nt, Human
gucaccguggaccuuccug

SEQ ID NO: 3736988 - RNA, 15 nt, Human
gucaccuagcaagcu

SEQ ID NO: 3736989 - RNA, 20 nt, Human
gucaccuaggaagccucaga

SEQ ID NO: 3736990 - RNA, 21 nt, Human
gucaccuaggaagccucagau

SEQ ID NO: 3736991 - RNA, 19 nt, Human
gucaccucacucagcacca

SEQ ID NO: 3736992 - RNA, 21 nt, Human
gucaccucacucagcaccacu

SEQ ID NO: 3736993 - RNA, 16 nt, Human
gucaccucagagacau

SEQ ID NO: 3736994 - RNA, 14 nt, Human
gucaccucauggaa

SEQ ID NO: 3736995 - RNA, 14 nt, Human
gucaccuuuuaaau

SEQ ID NO: 3736996 - RNA, 22 nt, Human
gucacguggaggagcagugcag

SEQ ID NO: 3736997 - RNA, 16 nt, Human
gucacuacgccuggcu

SEQ ID NO: 3736998 - RNA, 23 nt, Human
gucacuacgugacuguggcacac

SEQ ID NO: 3736999 - RNA, 17 nt, Human
gucacuacucacagucu

SEQ ID NO: 3737000 - RNA, 12 nt, Human
gucacuagaaug

SEQ ID NO: 3737001 - RNA, 23 nt, Human
gucacucaacaaaagugcuuugg

SEQ ID NO: 3737002 - RNA, 13 nt, Human
gucacucaaggcg

SEQ ID NO: 3737003 - RNA, 23 nt, Human
gucacucagauggaaccgcagga

SEQ ID NO: 3737004 - RNA, 15 nt, Human
gucacucaggcugga

SEQ ID NO: 3737005 - RNA, 20 nt, Human
gucacucauugcugagccuc

SEQ ID NO: 3737006 - RNA, 21 nt, Human
gucacucauugcugagccucu

SEQ ID NO: 3737007 - RNA, 24 nt, Human
gucacucauugcugagccucugcu

SEQ ID NO: 3737008 - RNA, 14 nt, Human
gucacucuggcagc

SEQ ID NO: 3737009 - RNA, 16 nt, Human
gucacucuggcagcuc

SEQ ID NO: 3737010 - RNA, 19 nt, Human
gucacucuggcagcucaga

SEQ ID NO: 3737011 - RNA, 22 nt, Human
gucacucuggcagcucagagag

SEQ ID NO: 3737012 - RNA, 16 nt, Human
gucacugacacaaagg

SEQ ID NO: 3737013 - RNA, 16 nt, Human
gucacugagacagccc

SEQ ID NO: 3737014 - RNA, 23 nt, Human
gucacugaggccugagacccagg

SEQ ID NO: 3737015 - RNA, 16 nt, Human
gucacugccauggagg

SEQ ID NO: 3737016 - RNA, 22 nt, Human
gucacugcugcuucauguuugc

SEQ ID NO: 3737017 - RNA, 12 nt, Human
gucacugcuguc

SEQ ID NO: 3737018 - RNA, 10 nt, Human
gucacugcuu

SEQ ID NO: 3737019 - RNA, 15 nt, Human
gucacugcuuaacuu

SEQ ID NO: 3737020 - RNA, 19 nt, Human
gucacugcuuuuggccugg

SEQ ID NO: 3737021 - RNA, 17 nt, Human
gucacuggcucuccaag

SEQ ID NO: 3737022 - RNA, 20 nt, Human
gucacuggcucuccaagugc

SEQ ID NO: 3737023 - RNA, 21 nt, Human
gucacuggcucuccaagugcc

SEQ ID NO: 3737024 - RNA, 22 nt, Human
gucacuggggcccaagagucug

SEQ ID NO: 3737025 - RNA, 18 nt, Human
gucacuuagguaguacca

SEQ ID NO: 3737026 - RNA, 24 nt, Human
gucacuucgcgugcccucgcugcu

SEQ ID NO: 3737027 - RNA, 13 nt, Human
gucacuucuucug

SEQ ID NO: 3737028 - RNA, 23 nt, Human
gucacuugaugugccauuuuaaa

SEQ ID NO: 3737029 - RNA, 18 nt, Human
gucacuugugcuuugcuc

SEQ ID NO: 3737030 - RNA, 17 nt, Human
gucacuuuguuuuacug

SEQ ID NO: 3737031 - RNA, 18 nt, Human
gucacuuuuugaggcaaa

SEQ ID NO: 3737032 - RNA, 19 nt, Human
gucacuuuuugaggcaaaa

SEQ ID NO: 3737033 - RNA, 16 nt, Human
gucagaaaguguaaau

SEQ ID NO: 3737034 - RNA, 18 nt, Human
gucagaaaguguaaaugu

SEQ ID NO: 3737035 - RNA, 15 nt, Human
gucagaacccugcca

SEQ ID NO: 3737036 - RNA, 19 nt, Human
gucagaauuagcugcuucu

SEQ ID NO: 3737037 - RNA, 16 nt, Human
gucagacauaaagcca

SEQ ID NO: 3737038 - RNA, 17 nt, Human
gucagacauaaagccau

SEQ ID NO: 3737039 - RNA, 18 nt, Human
gucagacauccauguuug

SEQ ID NO: 3737040 - RNA, 14 nt, Human
gucagacugcuggg

SEQ ID NO: 3737041 - RNA, 15 nt, Human
gucagacugcuggga

SEQ ID NO: 3737042 - RNA, 22 nt, Human
gucagacuggcuggcugcagug

SEQ ID NO: 3737043 - RNA, 16 nt, Human
gucagacuuuaaagaa

SEQ ID NO: 3737044 - RNA, 10 nt, Human
gucagagaca

SEQ ID NO: 3737045 - RNA, 16 nt, Human
gucagagacugcugug

SEQ ID NO: 3737046 - RNA, 17 nt, Human
gucagagaggagucaga

SEQ ID NO: 3737047 - RNA, 19 nt, Human
gucagagaggagucagaga

SEQ ID NO: 3737048 - RNA, 21 nt, Human
gucagagaggagucagagaga

SEQ ID NO: 3737049 - RNA, 14 nt, Human
gucagagccugcag

SEQ ID NO: 3737050 - RNA, 15 nt, Human
gucagagccugcagu

SEQ ID NO: 3737051 - RNA, 14 nt, Human
gucagagcugggag

SEQ ID NO: 3737052 - RNA, 15 nt, Human
gucagaggaccugua

SEQ ID NO: 3737053 - RNA, 23 nt, Human
gucagaggagagauagccugugg

SEQ ID NO: 3737054 - RNA, 14 nt, Human
gucagaggauggcc

SEQ ID NO: 3737055 - RNA, 19 nt, Human
gucagaguaagcugcuuuu

SEQ ID NO: 3737056 - RNA, 15 nt, Human
gucagaugagaacaa

SEQ ID NO: 3737057 - RNA, 13 nt, Human
gucagauguuuaa

SEQ ID NO: 3737058 - RNA, 17 nt, Human
gucagauguuuaaaaca

SEQ ID NO: 3737059 - RNA, 18 nt, Human
gucagauguuuaaaacac

SEQ ID NO: 3737060 - RNA, 15 nt, Human
gucagcaaaaagcaa

SEQ ID NO: 3737061 - RNA, 21 nt, Human
gucagcaaguccuaagccugu

SEQ ID NO: 3737062 - RNA, 14 nt, Human
gucagcaguugcug

SEQ ID NO: 3737063 - RNA, 15 nt, Human
gucagccaaauguaa

SEQ ID NO: 3737064 - RNA, 15 nt, Human
gucagccagggccag

SEQ ID NO: 3737065 - RNA, 13 nt, Human
gucagccauugca

SEQ ID NO: 3737066 - RNA, 23 nt, Human
gucagccauugcacccagcccag

SEQ ID NO: 3737067 - RNA, 20 nt, Human
gucagccgagccgggccugg

SEQ ID NO: 3737068 - RNA, 21 nt, Human
gucagccgagccgggccuggg

SEQ ID NO: 3737069 - RNA, 15 nt, Human
gucagccgggcccug

SEQ ID NO: 3737070 - RNA, 16 nt, Human
gucagccgggcccuga

SEQ ID NO: 3737071 - RNA, 16 nt, Human
gucagccuccagccuc

SEQ ID NO: 3737072 - RNA, 16 nt, Human
gucagccucgcaggcc

SEQ ID NO: 3737073 - RNA, 23 nt, Human
gucagccucgcaggccucccugc

SEQ ID NO: 3737074 - RNA, 16 nt, Human
gucagcguugcauguc

SEQ ID NO: 3737075 - RNA, 21 nt, Human
gucagcuccccucggagaaga

SEQ ID NO: 3737076 - RNA, 22 nt, Human
gucagcuccccucggagaagag

SEQ ID NO: 3737077 - RNA, 13 nt, Human
gucagcucucugc

SEQ ID NO: 3737078 - RNA, 12 nt, Human
gucagcugaggc

SEQ ID NO: 3737079 - RNA, 20 nt, Human
gucagcugcucccuggcauu

SEQ ID NO: 3737080 - RNA, 22 nt, Human
gucagcuguuucuagaguuccu

SEQ ID NO: 3737081 - RNA, 21 nt, Human
gucaggagaucgagaccaucc

SEQ ID NO: 3737082 - RNA, 22 nt, Human
gucaggaguuagaggccagccu

SEQ ID NO: 3737083 - RNA, 23 nt, Human
gucaggaguuagaggccagccug

SEQ ID NO: 3737084 - RNA, 13 nt, Human
gucaggaguuccu

SEQ ID NO: 3737085 - RNA, 12 nt, Human
gucaggaugacg

SEQ ID NO: 3737086 - RNA, 18 nt, Human
gucaggauugcgagagau

SEQ ID NO: 3737087 - RNA, 16 nt, Human
gucaggccacggcagc

SEQ ID NO: 3737088 - RNA, 11 nt, Human
gucaggcccug

SEQ ID NO: 3737089 - RNA, 12 nt, Human
gucaggcccugg

SEQ ID NO: 3737090 - RNA, 14 nt, Human
gucaggccgggcag

SEQ ID NO: 3737091 - RNA, 19 nt, Human
gucaggccgggcagagcac

SEQ ID NO: 3737092 - RNA, 23 nt, Human
gucaggccugugugugaaaggaa

SEQ ID NO: 3737093 - RNA, 16 nt, Human
gucaggcugaaaacaa

SEQ ID NO: 3737094 - RNA, 17 nt, Human
gucaggcugaaaacaau

SEQ ID NO: 3737095 - RNA, 14 nt, Human
gucaggcugcuggc

SEQ ID NO: 3737096 - RNA, 22 nt, Human
gucaggcugcuggcgccucugc

SEQ ID NO: 3737097 - RNA, 14 nt, Human
gucagggaccaagg

SEQ ID NO: 3737098 - RNA, 19 nt, Human
gucagggagugcuggcuca

SEQ ID NO: 3737099 - RNA, 17 nt, Human
gucagggaguguucccu

SEQ ID NO: 3737100 - RNA, 14 nt, Human
gucagggcccaagu

SEQ ID NO: 3737101 - RNA, 15 nt, Human
gucagggcccaaguc

SEQ ID NO: 3737102 - RNA, 18 nt, Human
gucaggggugacacagac

SEQ ID NO: 3737103 - RNA, 21 nt, Human
gagagccguggucccugagga

SEQ ID NO: 3737104 - RNA, 22 nt, Human
gagagccugcucccccaccccc

SEQ ID NO: 3737105 - RNA, 12 nt, Human
gagagccugcug

SEQ ID NO: 3737106 - RNA, 13 nt, Human
gagagccugcugc

SEQ ID NO: 3737107 - RNA, 14 nt, Human
gagagccugcuggc

SEQ ID NO: 3737108 - RNA, 11 nt, Human
gagagccuggu

SEQ ID NO: 3737109 - RNA, 14 nt, Human
gagagccuuccagg

SEQ ID NO: 3737110 - RNA, 15 nt, Human
gagagccuuccaggg

SEQ ID NO: 3737111 - RNA, 18 nt, Human
gagagccuuccaggggug

SEQ ID NO: 3737112 - RNA, 23 nt, Human
gagagcgugcuccagccuggcuc

SEQ ID NO: 3737113 - RNA, 17 nt, Human
gagagcuagaaccuaga

SEQ ID NO: 3737114 - RNA, 16 nt, Human
gagagcuagaaccugg

SEQ ID NO: 3737115 - RNA, 19 nt, Human
gagagcuagaaccuggaga

SEQ ID NO: 3737116 - RNA, 21 nt, Human
gagagcuagcagcagggaggg

SEQ ID NO: 3737117 - RNA, 23 nt, Human
gagagcuauggacagcauugcca

SEQ ID NO: 3737118 - RNA, 13 nt, Human
gagagcuggagcc

SEQ ID NO: 3737119 - RNA, 14 nt, Human
gagagcuggugccc

SEQ ID NO: 3737120 - RNA, 21 nt, Human
gagaggaaauauugcuggggu

SEQ ID NO: 3737121 - RNA, 22 nt, Human
gagaggaacuccuuggccuagc

SEQ ID NO: 3737122 - RNA, 19 nt, Human
gagaggaaugccuguguga

SEQ ID NO: 3737123 - RNA, 15 nt, Human
gagaggacccccuga

SEQ ID NO: 3737124 - RNA, 20 nt, Human
gagaggacuguagggagggc

SEQ ID NO: 3737125 - RNA, 14 nt, Human
gagaggagaaacac

SEQ ID NO: 3737126 - RNA, 18 nt, Human
gagaggagacggagggga

SEQ ID NO: 3737127 - RNA, 15 nt, Human
gagaggagagaggca

SEQ ID NO: 3737128 - RNA, 18 nt, Human
gagaggagaggagagagg

SEQ ID NO: 3737129 - RNA, 17 nt, Human
gagaggagccagacaga

SEQ ID NO: 3737130 - RNA, 15 nt, Human
gagaggagcccugcc

SEQ ID NO: 3737131 - RNA, 13 nt, Human
gagaggaggcaac

SEQ ID NO: 3737132 - RNA, 18 nt, Human
gagaggaguucaaugauc

SEQ ID NO: 3737133 - RNA, 20 nt, Human
gagaggaugagagcccagag

SEQ ID NO: 3737134 - RNA, 20 nt, Human
gagaggcagaagaacccugg

SEQ ID NO: 3737135 - RNA, 13 nt, Human
gagaggcagagag

SEQ ID NO: 3737136 - RNA, 16 nt, Human
gagaggcagagagcgg

SEQ ID NO: 3737137 - RNA, 11 nt, Human
gagaggcaggc

SEQ ID NO: 3737138 - RNA, 22 nt, Human
gagaggcauccaguaucuugaa

SEQ ID NO: 3737139 - RNA, 18 nt, Human
gagaggccaaaggcuggu

SEQ ID NO: 3737140 - RNA, 21 nt, Human
gagaggccaggugcagguugg

SEQ ID NO: 3737141 - RNA, 12 nt, Human
gagaggccauga

SEQ ID NO: 3737142 - RNA, 16 nt, Human
gagaggcccucuggag

SEQ ID NO: 3737143 - RNA, 20 nt, Human
gagaggcccucuggaguggc

SEQ ID NO: 3737144 - RNA, 21 nt, Human
gagaggcuaaaauguuuucag

SEQ ID NO: 3737145 - RNA, 18 nt, Human
gagagggaaacgugcccu

SEQ ID NO: 3737146 - RNA, 23 nt, Human
gagagggagaagaagucagagag

SEQ ID NO: 3737147 - RNA, 19 nt, Human
gagagggagagcagagaaa

SEQ ID NO: 3737148 - RNA, 18 nt, Human
gagagggaggcaagcccu

SEQ ID NO: 3737149 - RNA, 14 nt, Human
gagagggcagaggg

SEQ ID NO: 3737150 - RNA, 18 nt, Human
gagagggcaguguuuccu

SEQ ID NO: 3737151 - RNA, 17 nt, Human
gagagggcgcaggccgu

SEQ ID NO: 3737152 - RNA, 18 nt, Human
gagagggcgcaggccgug

SEQ ID NO: 3737153 - RNA, 11 nt, Human
gagagggcuuu

SEQ ID NO: 3737154 - RNA, 18 nt, Human
gagaggggaacagacugg

SEQ ID NO: 3737155 - RNA, 20 nt, Human
gagaggggaagaguguacug

SEQ ID NO: 3737156 - RNA, 21 nt, Human
gagaggggaagaguguacugg

SEQ ID NO: 3737157 - RNA, 16 nt, Human
gagaggggaagggcca

SEQ ID NO: 3737158 - RNA, 18 nt, Human
gagaggggaagggccagu

SEQ ID NO: 3737159 - RNA, 21 nt, Human
gagaggggaauaauagaagaa

SEQ ID NO: 3737160 - RNA, 18 nt, Human
gagagggggccaccuccc

SEQ ID NO: 3737161 - RNA, 19 nt, Human
gagagggggccugggacuu

SEQ ID NO: 3737162 - RNA, 23 nt, Human
gagagggugaguccuccagaacu

SEQ ID NO: 3737163 - RNA, 24 nt, Human
gagaggucaagcccaggaggacug

SEQ ID NO: 3737164 - RNA, 12 nt, Human
gagagguggagc

SEQ ID NO: 3737165 - RNA, 11 nt, Human
gagaguaacuu

SEQ ID NO: 3737166 - RNA, 19 nt, Human
gagaguacagugagccaag

SEQ ID NO: 3737167 - RNA, 15 nt, Human
gagaguagaacagau

SEQ ID NO: 3737168 - RNA, 20 nt, Human
gagaguagccgagagccugc

SEQ ID NO: 3737169 - RNA, 22 nt, Human
gagaguagccgagagccugcuc

SEQ ID NO: 3737170 - RNA, 15 nt, Human
gagaguauauuaugu

SEQ ID NO: 3737171 - RNA, 23 nt, Human
gagagucagcucucugcccugug

SEQ ID NO: 3737172 - RNA, 15 nt, Human
gagagucccagagca

SEQ ID NO: 3737173 - RNA, 17 nt, Human
gagagucccagagcagg

SEQ ID NO: 3737174 - RNA, 16 nt, Human
gagagucuagauucuc

SEQ ID NO: 3737175 - RNA, 16 nt, Human
gagagucucccaggga

SEQ ID NO: 3737176 - RNA, 14 nt, Human
gagagucugucuca

SEQ ID NO: 3737177 - RNA, 19 nt, Human
gagagugaacaaauuuaca

SEQ ID NO: 3737178 - RNA, 17 nt, Human
gagagugagcuacagag

SEQ ID NO: 3737179 - RNA, 15 nt, Human
gagagugagguggaa

SEQ ID NO: 3737180 - RNA, 13 nt, Human
gagaguggcuccu

SEQ ID NO: 3737181 - RNA, 18 nt, Human
gagagugucaaccagaca

SEQ ID NO: 3737182 - RNA, 20 nt, Human
gagagugucaaccagacaga

SEQ ID NO: 3737183 - RNA, 21 nt, Human
gagagugucuucacggcagga

SEQ ID NO: 3737184 - RNA, 20 nt, Human
gagagugugaaauagacauu

SEQ ID NO: 3737185 - RNA, 11 nt, Human
gagagugugac

SEQ ID NO: 3737186 - RNA, 22 nt, Human
gagaguucaauggcugcugaag

SEQ ID NO: 3737187 - RNA, 14 nt, Human
gagaguuuagcugu

SEQ ID NO: 3737188 - RNA, 14 nt, Human
gagaguuuccugaa

SEQ ID NO: 3737189 - RNA, 15 nt, Human
gagaguuuugucuug

SEQ ID NO: 3737190 - RNA, 17 nt, Human
gagaguuuugucuugaa

SEQ ID NO: 3737191 - RNA, 22 nt, Human
gagaguuuugucuugaaugucu

SEQ ID NO: 3737192 - RNA, 17 nt, Human
gagaguuuuuaauagaa

SEQ ID NO: 3737193 - RNA, 18 nt, Human
gagaguuuuuaauagaac

SEQ ID NO: 3737194 - RNA, 21 nt, Human
gagauaauguuagagguuuua

SEQ ID NO: 3737195 - RNA, 18 nt, Human
gagauacuuuuucuuuug

SEQ ID NO: 3737196 - RNA, 16 nt, Human
gagauagaagaacugc

SEQ ID NO: 3737197 - RNA, 20 nt, Human
gagauagcauugugaacuga

SEQ ID NO: 3737198 - RNA, 20 nt, Human
gagauagccaaggccaaagg

SEQ ID NO: 3737199 - RNA, 19 nt, Human
gagauagccuguggcccug

SEQ ID NO: 3737200 - RNA, 15 nt, Human
gagauaguuuucauc

SEQ ID NO: 3737201 - RNA, 11 nt, Human
gagauauuaau

SEQ ID NO: 3737202 - RNA, 22 nt, Human
gagauauuuauggggggagaac

SEQ ID NO: 3737203 - RNA, 20 nt, Human
gagauauuuuguaaaaugua

SEQ ID NO: 3737204 - RNA, 18 nt, Human
gagaucaaauggaaagga

SEQ ID NO: 3737205 - RNA, 16 nt, Human
gagaucacgccacugc

SEQ ID NO: 3737206 - RNA, 18 nt, Human
gagaucacgccacugcac

SEQ ID NO: 3737207 - RNA, 20 nt, Human
gagaucacgccacugcacuc

SEQ ID NO: 3737208 - RNA, 12 nt, Human
gagaucagaguc

SEQ ID NO: 3737209 - RNA, 13 nt, Human
gagaucaggaaga

SEQ ID NO: 3737210 - RNA, 13 nt, Human
gagaucaggcucu

SEQ ID NO: 3737211 - RNA, 14 nt, Human
gagaucaugagaaa

SEQ ID NO: 3737212 - RNA, 22 nt, Human
gagauccaaaagaagcccccag

SEQ ID NO: 3737213 - RNA, 13 nt, Human
gagauccaaagac

SEQ ID NO: 3737214 - RNA, 14 nt, Human
gagauccuccugca

SEQ ID NO: 3737215 - RNA, 17 nt, Human
gagauccuccugcagac

SEQ ID NO: 3737216 - RNA, 17 nt, Human
gagaucgagaccauccu

SEQ ID NO: 3737217 - RNA, 19 nt, Human
gagaucgagaccauccugg

SEQ ID NO: 3737218 - RNA, 21 nt, Human
gagaucgagaccauccuggcu

SEQ ID NO: 3737219 - RNA, 22 nt, Human
gagaucgagaccauccuggcua

SEQ ID NO: 3737220 - RNA, 20 nt, Human
gagaucgcgccacugcacuc

SEQ ID NO: 3737221 - RNA, 15 nt, Human
gagaucgugccacug

SEQ ID NO: 3737222 - RNA, 21 nt, Human
gagaucgugccauugcacucc

SEQ ID NO: 3737223 - RNA, 21 nt, Human
gagaucgugcuacugcacucc

SEQ ID NO: 3737224 - RNA, 20 nt, Human
gagaucuaagccuuuccaua

SEQ ID NO: 3737225 - RNA, 16 nt, Human
gagaugacugaguccu

SEQ ID NO: 3737226 - RNA, 18 nt, Human
gagaugaugaaaauauuu

SEQ ID NO: 3737227 - RNA, 19 nt, Human
gagaugaugaaaauauuua

SEQ ID NO: 3737228 - RNA, 21 nt, Human
gagaugaugccaugggcccuc

SEQ ID NO: 3737229 - RNA, 12 nt, Human
gagaugauuucc

SEQ ID NO: 3737230 - RNA, 18 nt, Human
gagaugcaccaccaagcc

SEQ ID NO: 3737231 - RNA, 12 nt, Human
gagaugcagagg

SEQ ID NO: 3737232 - RNA, 23 nt, Human
gagaugcauucuugguuggcugg

SEQ ID NO: 3737233 - RNA, 12 nt, Human
gagaugccuccc

SEQ ID NO: 3737234 - RNA, 15 nt, Human
gagaugccucccuga

SEQ ID NO: 3737235 - RNA, 14 nt, Human
gagaugcggccaag

SEQ ID NO: 3737236 - RNA, 18 nt, Human
gagaugcuggagaagaga

SEQ ID NO: 3737237 - RNA, 23 nt, Human
gagauggaacccuuuuggccccc

SEQ ID NO: 3737238 - RNA, 20 nt, Human
gagauggaaguugcagugag

SEQ ID NO: 3737239 - RNA, 15 nt, Human
gagauggaggaggag

SEQ ID NO: 3737240 - RNA, 18 nt, Human
gagauggaguucuugugc

SEQ ID NO: 3737241 - RNA, 23 nt, Human
gagauggaucaaucaaacccggc

SEQ ID NO: 3737242 - RNA, 17 nt, Human
gagauggcccucuggua

SEQ ID NO: 3737243 - RNA, 15 nt, Human
gagauggccugagaa

SEQ ID NO: 3737244 - RNA, 14 nt, Human
gagauggcucccag

SEQ ID NO: 3737245 - RNA, 15 nt, Human
gagauggcucccagg

SEQ ID NO: 3737246 - RNA, 16 nt, Human
gagaugggaaggcaca

SEQ ID NO: 3737247 - RNA, 21 nt, Human
gagaugggaaugaggugggag

SEQ ID NO: 3737248 - RNA, 19 nt, Human
gagaugggacugggagggc

SEQ ID NO: 3737249 - RNA, 14 nt, Human
gagauguaauuguu

SEQ ID NO: 3737250 - RNA, 16 nt, Human
gagauguaauuguuuu

SEQ ID NO: 3737251 - RNA, 14 nt, Human
gagauguagccccu

SEQ ID NO: 3737252 - RNA, 18 nt, Human
gagauguaugaaggcuuu

SEQ ID NO: 3737253 - RNA, 15 nt, Human
gugaaccaugucagc

SEQ ID NO: 3737254 - RNA, 22 nt, Human
gugaaccucaccccgaggcccu

SEQ ID NO: 3737255 - RNA, 23 nt, Human
gugaaccucaccccgaggcccug

SEQ ID NO: 3737256 - RNA, 14 nt, Human
gugaacgauuuaga

SEQ ID NO: 3737257 - RNA, 16 nt, Human
gugaacgauuuagaaa

SEQ ID NO: 3737258 - RNA, 24 nt, Human
gugaacgugggaguucagcugcuu

SEQ ID NO: 3737259 - RNA, 13 nt, Human
gugaacugaaauu

SEQ ID NO: 3737260 - RNA, 13 nt, Human
gugaacugacagg

SEQ ID NO: 3737261 - RNA, 17 nt, Human
gugaacugaucauguuu

SEQ ID NO: 3737262 - RNA, 18 nt, Human
gugaacuucuugaaucua

SEQ ID NO: 3737263 - RNA, 20 nt, Human
gugaacuuggggaacaaggg

SEQ ID NO: 3737264 - RNA, 13 nt, Human
gugaacuuguagc

SEQ ID NO: 3737265 - RNA, 18 nt, Human
gugaacuuguagcuguaa

SEQ ID NO: 3737266 - RNA, 15 nt, Human
gugaacuuuauuaaa

SEQ ID NO: 3737267 - RNA, 14 nt, Human
gugaacuuuuugua

SEQ ID NO: 3737268 - RNA, 13 nt, Human
gugaagaagccug

SEQ ID NO: 3737269 - RNA, 14 nt, Human
gugaagaauacuuc

SEQ ID NO: 3737270 - RNA, 21 nt, Human
gugaagaaugcacaagaaugg

SEQ ID NO: 3737271 - RNA, 18 nt, Human
gugaagacugggugagga

SEQ ID NO: 3737272 - RNA, 13 nt, Human
gugaagaggggca

SEQ ID NO: 3737273 - RNA, 14 nt, Human
gugaagaggggcag

SEQ ID NO: 3737274 - RNA, 18 nt, Human
gugaagauacuuuguauu

SEQ ID NO: 3737275 - RNA, 13 nt, Human
gugaagauguuug

SEQ ID NO: 3737276 - RNA, 18 nt, Human
gugaagauguuugcaaua

SEQ ID NO: 3737277 - RNA, 16 nt, Human
gugaagcauccaggca

SEQ ID NO: 3737278 - RNA, 16 nt, Human
gugaagccagggcccg

SEQ ID NO: 3737279 - RNA, 12 nt, Human
gugaagccuucc

SEQ ID NO: 3737280 - RNA, 15 nt, Human
gugaaggaauauaug

SEQ ID NO: 3737281 - RNA, 12 nt, Human
gugaaggacccu

SEQ ID NO: 3737282 - RNA, 13 nt, Human
gugaaggacccuu

SEQ ID NO: 3737283 - RNA, 21 nt, Human
gugaaggaccuucacucuaag

SEQ ID NO: 3737284 - RNA, 23 nt, Human
gugaaggaccuucacucuaagau

SEQ ID NO: 3737285 - RNA, 16 nt, Human
gugaaggaggcuccag

SEQ ID NO: 3737286 - RNA, 21 nt, Human
gugaaggaggcuccaggcagc

SEQ ID NO: 3737287 - RNA, 20 nt, Human
gugaaggccucgcaggaaga

SEQ ID NO: 3737288 - RNA, 12 nt, Human
gugaaggcuggc

SEQ ID NO: 3737289 - RNA, 13 nt, Human
gugaaggcuggca

SEQ ID NO: 3737290 - RNA, 14 nt, Human
gugaaggcuucucu

SEQ ID NO: 3737291 - RNA, 17 nt, Human
gugaaggugacagcagu

SEQ ID NO: 3737292 - RNA, 19 nt, Human
gugaaguacaauaauucau

SEQ ID NO: 3737293 - RNA, 23 nt, Human
gugaaguacaauaauucauauuc

SEQ ID NO: 3737294 - RNA, 17 nt, Human
gugaaguauacuguauu

SEQ ID NO: 3737295 - RNA, 21 nt, Human
gugaagucaugaccuccaggg

SEQ ID NO: 3737296 - RNA, 13 nt, Human
gugaagugcuugg

SEQ ID NO: 3737297 - RNA, 17 nt, Human
gugaaguuagaauuccu

SEQ ID NO: 3737298 - RNA, 13 nt, Human
gugaaguugcugc

SEQ ID NO: 3737299 - RNA, 15 nt, Human
gugaaguugcuucuu

SEQ ID NO: 3737300 - RNA, 18 nt, Human
gugaauaaacuucagcac

SEQ ID NO: 3737301 - RNA, 20 nt, Human
gugaauaaacuucagcacca

SEQ ID NO: 3737302 - RNA, 13 nt, Human
gugaauaaagugc

SEQ ID NO: 3737303 - RNA, 14 nt, Human
gugaauaaagugcu

SEQ ID NO: 3737304 - RNA, 14 nt, Human
gugaauaccccaag

SEQ ID NO: 3737305 - RNA, 23 nt, Human
gugaauaccccaagacucccaug

SEQ ID NO: 3737306 - RNA, 18 nt, Human
gugaauagccauauuugu

SEQ ID NO: 3737307 - RNA, 16 nt, Human
gugaauauaaaugugu

SEQ ID NO: 3737308 - RNA, 17 nt, Human
gugaauauaaaugugug

SEQ ID NO: 3737309 - RNA, 11 nt, Human
gugaaugaaag

SEQ ID NO: 3737310 - RNA, 12 nt, Human
gugaaugaaaga

SEQ ID NO: 3737311 - RNA, 21 nt, Human
gugaaugaugauccuaggcau

SEQ ID NO: 3737312 - RNA, 18 nt, Human
gugaaugauucauguuau

SEQ ID NO: 3737313 - RNA, 18 nt, Human
gugaaugccagugugcug

SEQ ID NO: 3737314 - RNA, 20 nt, Human
gugaaugcugggacucagcc

SEQ ID NO: 3737315 - RNA, 20 nt, Human
gugaauggauuggauuauuu

SEQ ID NO: 3737316 - RNA, 18 nt, Human
gugaauggcuuuguauag

SEQ ID NO: 3737317 - RNA, 19 nt, Human
gugaauggcuuuguauaga

SEQ ID NO: 3737318 - RNA, 21 nt, Human
gugaauuaauuaaacauugug

SEQ ID NO: 3737319 - RNA, 19 nt, Human
gugaauuacuaacuucuaa

SEQ ID NO: 3737320 - RNA, 18 nt, Human
gugaauuaggcuguaacu

SEQ ID NO: 3737321 - RNA, 19 nt, Human
gugaauuauugacacugaa

SEQ ID NO: 3737322 - RNA, 18 nt, Human
gugaauucuugaaggaaa

SEQ ID NO: 3737323 - RNA, 14 nt, Human
gugaauugauaaua

SEQ ID NO: 3737324 - RNA, 20 nt, Human
gugaauugccugcagagaga

SEQ ID NO: 3737325 - RNA, 15 nt, Human
gugaauuugaaucuc

SEQ ID NO: 3737326 - RNA, 16 nt, Human
gugaauuugaaugaaa

SEQ ID NO: 3737327 - RNA, 16 nt, Human
gugaauuuuuauuguu

SEQ ID NO: 3737328 - RNA, 19 nt, Human
gugaauuuuuauuguugua

SEQ ID NO: 3737329 - RNA, 14 nt, Human
gugaauuuuugcaa

SEQ ID NO: 3737330 - RNA, 16 nt, Human
gugaauuuuugcaaua

SEQ ID NO: 3737331 - RNA, 20 nt, Human
gugacaaaaaauuaaagcau

SEQ ID NO: 3737332 - RNA, 12 nt, Human
gugacaaaccau

SEQ ID NO: 3737333 - RNA, 19 nt, Human
gugacaaagauggcucaga

SEQ ID NO: 3737334 - RNA, 21 nt, Human
gugacaagcagauacugcugu

SEQ ID NO: 3737335 - RNA, 18 nt, Human
gugacaaggccccagaga

SEQ ID NO: 3737336 - RNA, 16 nt, Human
gugacaauucuguuuu

SEQ ID NO: 3737337 - RNA, 13 nt, Human
gugacacaaacac

SEQ ID NO: 3737338 - RNA, 20 nt, Human
gugacacacuacaccacaca

SEQ ID NO: 3737339 - RNA, 12 nt, Human
gugacacagacu

SEQ ID NO: 3737340 - RNA, 14 nt, Human
gugacacagacuca

SEQ ID NO: 3737341 - RNA, 22 nt, Human
gugacacagcagcuucaccaga

SEQ ID NO: 3737342 - RNA, 16 nt, Human
gugacacucuccuugc

SEQ ID NO: 3737343 - RNA, 20 nt, Human
gugacacucuccuugcaguu

SEQ ID NO: 3737344 - RNA, 18 nt, Human
gugacacuucagagagcu

SEQ ID NO: 3737345 - RNA, 15 nt, Human
gugacagacuccuga

SEQ ID NO: 3737346 - RNA, 20 nt, Human
gugacagacuccugaggaca

SEQ ID NO: 3737347 - RNA, 17 nt, Human
gugacagaguucacuau

SEQ ID NO: 3737348 - RNA, 16 nt, Human
gugacaggcagcagag

SEQ ID NO: 3737349 - RNA, 23 nt, Human
gugacagggccaguggggccugu

SEQ ID NO: 3737350 - RNA, 19 nt, Human
gugacagggcggggguggc

SEQ ID NO: 3737351 - RNA, 16 nt, Human
gugacagucaucauca

SEQ ID NO: 3737352 - RNA, 22 nt, Human
gugacaguugcagcccuuguga

SEQ ID NO: 3737353 - RNA, 23 nt, Human
gugacauaauauauucuauuuuu

SEQ ID NO: 3737354 - RNA, 18 nt, Human
gugacaucaguggcaugg

SEQ ID NO: 3737355 - RNA, 14 nt, Human
gugacauccaggag

SEQ ID NO: 3737356 - RNA, 20 nt, Human
gugacaucucuauuccccac

SEQ ID NO: 3737357 - RNA, 16 nt, Human
gugacauggugccuga

SEQ ID NO: 3737358 - RNA, 23 nt, Human
gugacauggugccugagaggcag

SEQ ID NO: 3737359 - RNA, 24 nt, Human
gugacauggugccugagaggcagg

SEQ ID NO: 3737360 - RNA, 17 nt, Human
gugacaugugaaaccuu

SEQ ID NO: 3737361 - RNA, 20 nt, Human
gugacaugugaaaccuuuuu

SEQ ID NO: 3737362 - RNA, 21 nt, Human
gugacauuuauuuuucucaug

SEQ ID NO: 3737363 - RNA, 17 nt, Human
gugacauuugucauuuu

SEQ ID NO: 3737364 - RNA, 21 nt, Human
gugacauuuuacauuaaauuu

SEQ ID NO: 3737365 - RNA, 15 nt, Human
gugaccaacuguguu

SEQ ID NO: 3737366 - RNA, 17 nt, Human
gugaccaaugaugguca

SEQ ID NO: 3737367 - RNA, 18 nt, Human
gugaccagcaccaucucu

SEQ ID NO: 3737368 - RNA, 21 nt, Human
gugaccagcaccaucucuccu

SEQ ID NO: 3737369 - RNA, 14 nt, Human
gugaccagggguga

SEQ ID NO: 3737370 - RNA, 14 nt, Human
gugacccagguccu

SEQ ID NO: 3737371 - RNA, 13 nt, Human
gugaccccagggc

SEQ ID NO: 3737372 - RNA, 14 nt, Human
gugaccccagggca

SEQ ID NO: 3737373 - RNA, 22 nt, Human
gugaccccagggcacaggagcu

SEQ ID NO: 3737374 - RNA, 14 nt, Human
gugaccccuccugg

SEQ ID NO: 3737375 - RNA, 20 nt, Human
gugaccccuccuggggccag

SEQ ID NO: 3737376 - RNA, 15 nt, Human
gugacccggaggcca

SEQ ID NO: 3737377 - RNA, 18 nt, Human
gugacccggaggccacau

SEQ ID NO: 3737378 - RNA, 21 nt, Human
gugacccggcacccccugcag

SEQ ID NO: 3737379 - RNA, 22 nt, Human
gugacccggcacccccugcagc

SEQ ID NO: 3737380 - RNA, 16 nt, Human
gugacccuggcuccuu

SEQ ID NO: 3737381 - RNA, 12 nt, Human
gugacccuuccc

SEQ ID NO: 3737382 - RNA, 15 nt, Human
gugaccggacuuuuc

SEQ ID NO: 3737383 - RNA, 21 nt, Human
gugaccggacuuuucugcaaa

SEQ ID NO: 3737384 - RNA, 18 nt, Human
gugaccuccacagcuacc

SEQ ID NO: 3737385 - RNA, 19 nt, Human
gugaccucuagcccugccc

SEQ ID NO: 3737386 - RNA, 13 nt, Human
gugaccucucucu

SEQ ID NO: 3737387 - RNA, 14 nt, Human
gugaccugaggaag

SEQ ID NO: 3737388 - RNA, 13 nt, Human
gugaccugagggc

SEQ ID NO: 3737389 - RNA, 18 nt, Human
gugaccugcuaggccaga

SEQ ID NO: 3737390 - RNA, 13 nt, Human
gugaccugcugag

SEQ ID NO: 3737391 - RNA, 14 nt, Human
gugaccugcugagc

SEQ ID NO: 3737392 - RNA, 15 nt, Human
gugaccugcugagcu

SEQ ID NO: 3737393 - RNA, 20 nt, Human
gugaccuuaguguuucugug

SEQ ID NO: 3737394 - RNA, 20 nt, Human
gugaccuuccaagagccuga

SEQ ID NO: 3737395 - RNA, 21 nt, Human
gugaccuuccaagagccugag

SEQ ID NO: 3737396 - RNA, 22 nt, Human
gugaccuuccaagagccugaga

SEQ ID NO: 3737397 - RNA, 14 nt, Human
gugacgaaaacauu

SEQ ID NO: 3737398 - RNA, 15 nt, Human
gugacgaaaacauug

SEQ ID NO: 3737399 - RNA, 17 nt, Human
gugacgcugaauaaaug

SEQ ID NO: 3737400 - RNA, 19 nt, Human
gugacggucccacacuggu

SEQ ID NO: 3737401 - RNA, 13 nt, Human
gugacgguuccua

SEQ ID NO: 3737402 - RNA, 15 nt, Human
gugacgucugggugg

SEQ ID NO: 3737403 - RNA, 20 nt, Human
gucaggggugacacagacuc

SEQ ID NO: 3737404 - RNA, 22 nt, Human
gucaggguuggugugcugaggu

SEQ ID NO: 3737405 - RNA, 13 nt, Human
gucagguugacag

SEQ ID NO: 3737406 - RNA, 19 nt, Human
gucaguacccaccugagcu

SEQ ID NO: 3737407 - RNA, 22 nt, Human
gucaguaccuucaaacuagggc

SEQ ID NO: 3737408 - RNA, 23 nt, Human
gucaguaucaggccugccagacg

SEQ ID NO: 3737409 - RNA, 14 nt, Human
gucaguaugacauu

SEQ ID NO: 3737410 - RNA, 21 nt, Human
gucaguauguggaaguguggg

SEQ ID NO: 3737411 - RNA, 14 nt, Human
gucagucacagcca

SEQ ID NO: 3737412 - RNA, 22 nt, Human
gucagucaugauggcaccacug

SEQ ID NO: 3737413 - RNA, 19 nt, Human
gucagucugcuuagaaaua

SEQ ID NO: 3737414 - RNA, 20 nt, Human
gucagucugcuuauccuucc

SEQ ID NO: 3737415 - RNA, 12 nt, Human
gucagucuugac

SEQ ID NO: 3737416 - RNA, 12 nt, Human
gucagucuuuag

SEQ ID NO: 3737417 - RNA, 21 nt, Human
gucagucuuuuucuguuguaa

SEQ ID NO: 3737418 - RNA, 14 nt, Human
gucagugaggccca

SEQ ID NO: 3737419 - RNA, 16 nt, Human
gucagugcagcccgug

SEQ ID NO: 3737420 - RNA, 17 nt, Human
gucagugccgccgccuc

SEQ ID NO: 3737421 - RNA, 14 nt, Human
gucagugcugccug

SEQ ID NO: 3737422 - RNA, 15 nt, Human
gucagugcugccugu

SEQ ID NO: 3737423 - RNA, 23 nt, Human
gucagugcugugcugugcuaugg

SEQ ID NO: 3737424 - RNA, 20 nt, Human
gucaguguccaaagcagggu

SEQ ID NO: 3737425 - RNA, 15 nt, Human
gucagugugacugau

SEQ ID NO: 3737426 - RNA, 19 nt, Human
gucaguuguguuuuuuaag

SEQ ID NO: 3737427 - RNA, 18 nt, Human
gucaguuguuauuuauug

SEQ ID NO: 3737428 - RNA, 17 nt, Human
gucaguuuauguuuugg

SEQ ID NO: 3737429 - RNA, 22 nt, Human
gucauaacuagaacugaauuuu

SEQ ID NO: 3737430 - RNA, 13 nt, Human
gucauacauagga

SEQ ID NO: 3737431 - RNA, 22 nt, Human
gucauacuaucuacucuccuca

SEQ ID NO: 3737432 - RNA, 19 nt, Human
gucauacucgagucugagg

SEQ ID NO: 3737433 - RNA, 20 nt, Human
gucauacucgagucugaggc

SEQ ID NO: 3737434 - RNA, 12 nt, Human
gucauagaaauu

SEQ ID NO: 3737435 - RNA, 22 nt, Human
gucauagaaauuacacccaaag

SEQ ID NO: 3737436 - RNA, 13 nt, Human
gucauagaagaac

SEQ ID NO: 3737437 - RNA, 15 nt, Human
gucauagguuaauau

SEQ ID NO: 3737438 - RNA, 14 nt, Human
gucauaucaaauaa

SEQ ID NO: 3737439 - RNA, 22 nt, Human
gucauaucaaauaaagagagaa

SEQ ID NO: 3737440 - RNA, 13 nt, Human
gucauaucuucac

SEQ ID NO: 3737441 - RNA, 18 nt, Human
gucauauguaggugucug

SEQ ID NO: 3737442 - RNA, 17 nt, Human
gucauauuuaaacagaa

SEQ ID NO: 3737443 - RNA, 12 nt, Human
gucauauuuuga

SEQ ID NO: 3737444 - RNA, 16 nt, Human
gucauauuuugauuau

SEQ ID NO: 3737445 - RNA, 15 nt, Human
gucaucacuuuucag

SEQ ID NO: 3737446 - RNA, 16 nt, Human
gucaucacuuuucagu

SEQ ID NO: 3737447 - RNA, 14 nt, Human
gucaucaucagggc

SEQ ID NO: 3737448 - RNA, 15 nt, Human
gucaucaucagggcc

SEQ ID NO: 3737449 - RNA, 20 nt, Human
gucaucaucagggccugggg

SEQ ID NO: 3737450 - RNA, 20 nt, Human
gucaucaucauggccagcug

SEQ ID NO: 3737451 - RNA, 22 nt, Human
gucauccucaaagaaaguguau

SEQ ID NO: 3737452 - RNA, 18 nt, Human
gucaucuaccuuuucucu

SEQ ID NO: 3737453 - RNA, 13 nt, Human
gucaucuagcauu

SEQ ID NO: 3737454 - RNA, 21 nt, Human
gucaucuagcauuagguauau

SEQ ID NO: 3737455 - RNA, 13 nt, Human
gucaucugagaau

SEQ ID NO: 3737456 - RNA, 15 nt, Human
gucaucugagaauga

SEQ ID NO: 3737457 - RNA, 19 nt, Human
gucaucugauuggacaggc

SEQ ID NO: 3737458 - RNA, 14 nt, Human
gucaucuugcuacc

SEQ ID NO: 3737459 - RNA, 18 nt, Human
gucaucuugcuaccagua

SEQ ID NO: 3737460 - RNA, 15 nt, Human
gucaucuuugaguuu

SEQ ID NO: 3737461 - RNA, 14 nt, Human
gucaugaagcccaa

SEQ ID NO: 3737462 - RNA, 20 nt, Human
gucaugaauucuuaugcuua

SEQ ID NO: 3737463 - RNA, 18 nt, Human
gucaugaucucccugccg

SEQ ID NO: 3737464 - RNA, 19 nt, Human
gucaugaucucccugccgc

SEQ ID NO: 3737465 - RNA, 20 nt, Human
gucaugaucucccugccgcc

SEQ ID NO: 3737466 - RNA, 13 nt, Human
gucaugauguuuu

SEQ ID NO: 3737467 - RNA, 14 nt, Human
gucaugauguuuuu

SEQ ID NO: 3737468 - RNA, 15 nt, Human
gucaugauguuuuua

SEQ ID NO: 3737469 - RNA, 16 nt, Human
gucaugauguuuuuaa

SEQ ID NO: 3737470 - RNA, 22 nt, Human
gucaugauguuuuuaaaaucuu

SEQ ID NO: 3737471 - RNA, 23 nt, Human
gucaugauguuuuuaaaaucuua

SEQ ID NO: 3737472 - RNA, 13 nt, Human
gucaugcauaaau

SEQ ID NO: 3737473 - RNA, 17 nt, Human
gucaugcauaaauaugc

SEQ ID NO: 3737474 - RNA, 15 nt, Human
gucaugccccccuca

SEQ ID NO: 3737475 - RNA, 17 nt, Human
gucaugcccuccucucc

SEQ ID NO: 3737476 - RNA, 15 nt, Human
gucaugcuccccugu

SEQ ID NO: 3737477 - RNA, 23 nt, Human
gucaugcuccccugugccagccc

SEQ ID NO: 3737478 - RNA, 15 nt, Human
gucaugcuuguguua

SEQ ID NO: 3737479 - RNA, 18 nt, Human
gucauggagaaccaccua

SEQ ID NO: 3737480 - RNA, 22 nt, Human
gucauggagaaccaccuacccc

SEQ ID NO: 3737481 - RNA, 15 nt, Human
gucauggcuuaaugu

SEQ ID NO: 3737482 - RNA, 21 nt, Human
gucaugguuucuuggagggcc

SEQ ID NO: 3737483 - RNA, 15 nt, Human
gucauguaaauacug

SEQ ID NO: 3737484 - RNA, 12 nt, Human
gucauguggcua

SEQ ID NO: 3737485 - RNA, 17 nt, Human
gucaugugggucuucca

SEQ ID NO: 3737486 - RNA, 20 nt, Human
gucaugugggucuuccaggg

SEQ ID NO: 3737487 - RNA, 21 nt, Human
gucaugugggucuuccagggg

SEQ ID NO: 3737488 - RNA, 17 nt, Human
gucauguuccuucaaga

SEQ ID NO: 3737489 - RNA, 16 nt, Human
gucauguuugcagggg

SEQ ID NO: 3737490 - RNA, 23 nt, Human
gucauguuugcaggggugacggc

SEQ ID NO: 3737491 - RNA, 17 nt, Human
gucauuaaauuacuaua

SEQ ID NO: 3737492 - RNA, 24 nt, Human
gucauuaaauuacuauagcaaagu

SEQ ID NO: 3737493 - RNA, 13 nt, Human
gucauuaaugugu

SEQ ID NO: 3737494 - RNA, 15 nt, Human
gucauucaauaaauu

SEQ ID NO: 3737495 - RNA, 14 nt, Human
gucauucagaaaaa

SEQ ID NO: 3737496 - RNA, 14 nt, Human
gucauucagaguca

SEQ ID NO: 3737497 - RNA, 17 nt, Human
gucauuccuucuuuuua

SEQ ID NO: 3737498 - RNA, 14 nt, Human
gucauucuucccua

SEQ ID NO: 3737499 - RNA, 11 nt, Human
gucauugcugu

SEQ ID NO: 3737500 - RNA, 22 nt, Human
gucauugcuguugucccucugc

SEQ ID NO: 3737501 - RNA, 22 nt, Human
gucauugcuucuucugaggccu

SEQ ID NO: 3737502 - RNA, 14 nt, Human
gucauuggcuuuau

SEQ ID NO: 3737503 - RNA, 13 nt, Human
gucauuguaaugu

SEQ ID NO: 3737504 - RNA, 21 nt, Human
gucauuguaauguugugaaua

SEQ ID NO: 3737505 - RNA, 15 nt, Human
gucauuuaaaugugu

SEQ ID NO: 3737506 - RNA, 23 nt, Human
gucauuuaacugaagauguugag

SEQ ID NO: 3737507 - RNA, 14 nt, Human
gucauuuauaaaac

SEQ ID NO: 3737508 - RNA, 23 nt, Human
gucauuuauauagauuauaacuu

SEQ ID NO: 3737509 - RNA, 15 nt, Human
gucauuucauuuccu

SEQ ID NO: 3737510 - RNA, 11 nt, Human
gucauuuccau

SEQ ID NO: 3737511 - RNA, 18 nt, Human
gucauuuccauguaugca

SEQ ID NO: 3737512 - RNA, 22 nt, Human
gucauuuccauguaugcauaau

SEQ ID NO: 3737513 - RNA, 19 nt, Human
gucauuugagcagggcuca

SEQ ID NO: 3737514 - RNA, 22 nt, Human
gucauuugagcagggcucagcg

SEQ ID NO: 3737515 - RNA, 22 nt, Human
gucauuugcugagcauguacug

SEQ ID NO: 3737516 - RNA, 21 nt, Human
gucauuuguugugaugucuuu

SEQ ID NO: 3737517 - RNA, 19 nt, Human
gucauuuugcagaggcuau

SEQ ID NO: 3737518 - RNA, 18 nt, Human
gucauuuuguguugaaga

SEQ ID NO: 3737519 - RNA, 20 nt, Human
gucauuuuguguugaagagc

SEQ ID NO: 3737520 - RNA, 13 nt, Human
gucauuuuuaugu

SEQ ID NO: 3737521 - RNA, 20 nt, Human
guccaaaaagcuccuggggc

SEQ ID NO: 3737522 - RNA, 21 nt, Human
guccaaaaccgccagcucugu

SEQ ID NO: 3737523 - RNA, 20 nt, Human
guccaaaauuuaagucucca

SEQ ID NO: 3737524 - RNA, 14 nt, Human
guccaaacugccua

SEQ ID NO: 3737525 - RNA, 15 nt, Human
guccaaagaggcugc

SEQ ID NO: 3737526 - RNA, 16 nt, Human
guccaaagaggcugcc

SEQ ID NO: 3737527 - RNA, 16 nt, Human
guccaaaggaggcugg

SEQ ID NO: 3737528 - RNA, 13 nt, Human
guccaaauaaaaa

SEQ ID NO: 3737529 - RNA, 20 nt, Human
guccaacccgaggcccgcau

SEQ ID NO: 3737530 - RNA, 17 nt, Human
guccaaccuaaccccuu

SEQ ID NO: 3737531 - RNA, 12 nt, Human
guccaacuccag

SEQ ID NO: 3737532 - RNA, 20 nt, Human
guccaagaagcccaggaaag

SEQ ID NO: 3737533 - RNA, 23 nt, Human
guccaagaauccacauuucuaaa

SEQ ID NO: 3737534 - RNA, 16 nt, Human
guccaagauuccggau

SEQ ID NO: 3737535 - RNA, 15 nt, Human
guccaagcugggaga

SEQ ID NO: 3737536 - RNA, 17 nt, Human
guccaaggaaaccacag

SEQ ID NO: 3737537 - RNA, 20 nt, Human
guccaagguuuaaagagucu

SEQ ID NO: 3737538 - RNA, 16 nt, Human
guccaaugagcuuucu

SEQ ID NO: 3737539 - RNA, 18 nt, Human
guccaaugagcuuucuga

SEQ ID NO: 3737540 - RNA, 23 nt, Human
guccaaugagcuuucugaacagc

SEQ ID NO: 3737541 - RNA, 17 nt, Human
guccaauuaguuuccuu

SEQ ID NO: 3737542 - RNA, 18 nt, Human
guccaauuuuaauuuagu

SEQ ID NO: 3737543 - RNA, 19 nt, Human
guccacacccaauuccacu

SEQ ID NO: 3737544 - RNA, 17 nt, Human
guccacagaugccucca

SEQ ID NO: 3737545 - RNA, 13 nt, Human
guccacaggaagu

SEQ ID NO: 3737546 - RNA, 22 nt, Human
guccacaggcuucugagcagcg

SEQ ID NO: 3737547 - RNA, 13 nt, Human
guccacagggcac

SEQ ID NO: 3737548 - RNA, 19 nt, Human
guccacaguggaaccagcc

SEQ ID NO: 3737549 - RNA, 21 nt, Human
guccacaguggaaccagccca

SEQ ID NO: 3737550 - RNA, 14 nt, Human
guccacccagcaaa

SEQ ID NO: 3737551 - RNA, 16 nt, Human
guccacccaggagccc

SEQ ID NO: 3737552 - RNA, 22 nt, Human
guccaccugagcugccauccag

SEQ ID NO: 3737553 - RNA, 21 nt, Human
gugacgucuggguggcccuua

SEQ ID NO: 3737554 - RNA, 22 nt, Human
gugacuaauuguauaacagguu

SEQ ID NO: 3737555 - RNA, 12 nt, Human
gugacuaggaaa

SEQ ID NO: 3737556 - RNA, 17 nt, Human
gugacuauauagagaug

SEQ ID NO: 3737557 - RNA, 21 nt, Human
gugacuauggagcugagcagg

SEQ ID NO: 3737558 - RNA, 20 nt, Human
gugacuauuauauuuccaag

SEQ ID NO: 3737559 - RNA, 18 nt, Human
gugacucauccucuugaa

SEQ ID NO: 3737560 - RNA, 14 nt, Human
gugacuccaggaga

SEQ ID NO: 3737561 - RNA, 18 nt, Human
gugacucgggcuccugug

SEQ ID NO: 3737562 - RNA, 20 nt, Human
gugacucgggcuccugugcc

SEQ ID NO: 3737563 - RNA, 22 nt, Human
gugacucuuuuuagggccaggc

SEQ ID NO: 3737564 - RNA, 23 nt, Human
gugacugagcaagacccugucuc

SEQ ID NO: 3737565 - RNA, 17 nt, Human
gugacugaucucucgug

SEQ ID NO: 3737566 - RNA, 21 nt, Human
gugacugauguuacaucacag

SEQ ID NO: 3737567 - RNA, 20 nt, Human
gugacugccccaacuccugg

SEQ ID NO: 3737568 - RNA, 17 nt, Human
gugacugcgaucuucag

SEQ ID NO: 3737569 - RNA, 20 nt, Human
gugacugguuaucacaccau

SEQ ID NO: 3737570 - RNA, 16 nt, Human
gugacuucagcucugu

SEQ ID NO: 3737571 - RNA, 21 nt, Human
gugacuuccucgccucuccca

SEQ ID NO: 3737572 - RNA, 15 nt, Human
gugacuucuccaggu

SEQ ID NO: 3737573 - RNA, 13 nt, Human
gugacuucugaga

SEQ ID NO: 3737574 - RNA, 21 nt, Human
gugacuugcaucguggagaca

SEQ ID NO: 3737575 - RNA, 23 nt, Human
gugacuugugucccaugaucccu

SEQ ID NO: 3737576 - RNA, 12 nt, Human
gugacuuugaaa

SEQ ID NO: 3737577 - RNA, 12 nt, Human
gugacuuuggau

SEQ ID NO: 3737578 - RNA, 18 nt, Human
gugacuuuggcugcaugc

SEQ ID NO: 3737579 - RNA, 13 nt, Human
gugacuuuugcuu

SEQ ID NO: 3737580 - RNA, 20 nt, Human
gugagaaauuucugugaaac

SEQ ID NO: 3737581 - RNA, 17 nt, Human
gugagaacccaguuucc

SEQ ID NO: 3737582 - RNA, 18 nt, Human
gugagaaucccuggcaaa

SEQ ID NO: 3737583 - RNA, 13 nt, Human
gugagacagcucu

SEQ ID NO: 3737584 - RNA, 18 nt, Human
gugagacaguccagccug

SEQ ID NO: 3737585 - RNA, 20 nt, Human
gugagacaguccagccugga

SEQ ID NO: 3737586 - RNA, 20 nt, Human
gugagacccagcccucaucc

SEQ ID NO: 3737587 - RNA, 15 nt, Human
gugagacccccacac

SEQ ID NO: 3737588 - RNA, 13 nt, Human
gugagaccugccc

SEQ ID NO: 3737589 - RNA, 23 nt, Human
gugagaccugccccuccucucug

SEQ ID NO: 3737590 - RNA, 19 nt, Human
gugagacgccaccauuccu

SEQ ID NO: 3737591 - RNA, 17 nt, Human
gugagacucgagaacuu

SEQ ID NO: 3737592 - RNA, 22 nt, Human
gugagacucgagaacuuucauu

SEQ ID NO: 3737593 - RNA, 14 nt, Human
gugagacucugucu

SEQ ID NO: 3737594 - RNA, 16 nt, Human
gugagacucugucuca

SEQ ID NO: 3737595 - RNA, 18 nt, Human
gugagacucugucucaaa

SEQ ID NO: 3737596 - RNA, 18 nt, Human
gugagagaguggcugggg

SEQ ID NO: 3737597 - RNA, 20 nt, Human
gugagagaguggcuggggca

SEQ ID NO: 3737598 - RNA, 16 nt, Human
gugagaggggaacaga

SEQ ID NO: 3737599 - RNA, 17 nt, Human
gugagaggggaggccaa

SEQ ID NO: 3737600 - RNA, 13 nt, Human
gugagagugagcu

SEQ ID NO: 3737601 - RNA, 19 nt, Human
gugagaugagggaugggcc

SEQ ID NO: 3737602 - RNA, 17 nt, Human
gugagaugcuggagaag

SEQ ID NO: 3737603 - RNA, 20 nt, Human
gugagaugcuggagaagaga

SEQ ID NO: 3737604 - RNA, 22 nt, Human
gugagaugcuggagaagagagg

SEQ ID NO: 3737605 - RNA, 19 nt, Human
gugagauuuuuuauugcua

SEQ ID NO: 3737606 - RNA, 15 nt, Human
gugagcaauccugca

SEQ ID NO: 3737607 - RNA, 19 nt, Human
gugagcacucccaagucua

SEQ ID NO: 3737608 - RNA, 19 nt, Human
gugagcagaaguggagcug

SEQ ID NO: 3737609 - RNA, 20 nt, Human
gugagcagaaguggagcugg

SEQ ID NO: 3737610 - RNA, 17 nt, Human
gugagcagacugguggg

SEQ ID NO: 3737611 - RNA, 17 nt, Human
gugagcaggaaggccug

SEQ ID NO: 3737612 - RNA, 17 nt, Human
gugagcaggcugugagu

SEQ ID NO: 3737613 - RNA, 22 nt, Human
gugagcauuguggcugucagca

SEQ ID NO: 3737614 - RNA, 18 nt, Human
gugagcccagcuggguca

SEQ ID NO: 3737615 - RNA, 17 nt, Human
gugagcccauggcccuc

SEQ ID NO: 3737616 - RNA, 14 nt, Human
gugagccccugguc

SEQ ID NO: 3737617 - RNA, 14 nt, Human
gugagcuacaaaug

SEQ ID NO: 3737618 - RNA, 15 nt, Human
gugagcuacagagcc

SEQ ID NO: 3737619 - RNA, 14 nt, Human
gugagcugagcagg

SEQ ID NO: 3737620 - RNA, 17 nt, Human
gugagcugcugccauga

SEQ ID NO: 3737621 - RNA, 11 nt, Human
gugagcuggag

SEQ ID NO: 3737622 - RNA, 14 nt, Human
gugaggaaaucaaa

SEQ ID NO: 3737623 - RNA, 11 nt, Human
gugaggaagcc

SEQ ID NO: 3737624 - RNA, 20 nt, Human
gugaggaauaguugagcccc

SEQ ID NO: 3737625 - RNA, 21 nt, Human
gugaggacaaauugagacagu

SEQ ID NO: 3737626 - RNA, 16 nt, Human
gugaggaccacuccug

SEQ ID NO: 3737627 - RNA, 21 nt, Human
gugaggagccccaucugucua

SEQ ID NO: 3737628 - RNA, 15 nt, Human
gugaggagcugcugg

SEQ ID NO: 3737629 - RNA, 13 nt, Human
gugaggagcuggg

SEQ ID NO: 3737630 - RNA, 16 nt, Human
gugaggcaggugacag

SEQ ID NO: 3737631 - RNA, 20 nt, Human
gugaggccacugaagaggag

SEQ ID NO: 3737632 - RNA, 14 nt, Human
gugaggccagggca

SEQ ID NO: 3737633 - RNA, 17 nt, Human
gugaggccagggcagag

SEQ ID NO: 3737634 - RNA, 13 nt, Human
gugaggccuggcc

SEQ ID NO: 3737635 - RNA, 14 nt, Human
gugaggccuggcca

SEQ ID NO: 3737636 - RNA, 16 nt, Human
gugaggccuggccagg

SEQ ID NO: 3737637 - RNA, 16 nt, Human
gugaggccugucugug

SEQ ID NO: 3737638 - RNA, 19 nt, Human
gugaggccugucugugacc

SEQ ID NO: 3737639 - RNA, 15 nt, Human
gugaggcucugcccu

SEQ ID NO: 3737640 - RNA, 17 nt, Human
gugaggcucugcccuug

SEQ ID NO: 3737641 - RNA, 18 nt, Human
gugaggcucugcccuugg

SEQ ID NO: 3737642 - RNA, 16 nt, Human
gugaggcuguccugua

SEQ ID NO: 3737643 - RNA, 21 nt, Human
gugagggaggggaaaagcauu

SEQ ID NO: 3737644 - RNA, 22 nt, Human
gugagggcuugucauuaccaga

SEQ ID NO: 3737645 - RNA, 15 nt, Human
gugaggguccugcag

SEQ ID NO: 3737646 - RNA, 18 nt, Human
gugaggguuucugagcug

SEQ ID NO: 3737647 - RNA, 19 nt, Human
gugaggguuucugagcugc

SEQ ID NO: 3737648 - RNA, 17 nt, Human
gugagguccugggggcc

SEQ ID NO: 3737649 - RNA, 20 nt, Human
gugagguuucccaauggugu

SEQ ID NO: 3737650 - RNA, 18 nt, Human
gugaguaauuuuggauuu

SEQ ID NO: 3737651 - RNA, 19 nt, Human
gugaguacuacaguccucc

SEQ ID NO: 3737652 - RNA, 21 nt, Human
gugaguacuacaguccuccca

SEQ ID NO: 3737653 - RNA, 22 nt, Human
gugagucaauacauagugcugc

SEQ ID NO: 3737654 - RNA, 14 nt, Human
gugagucaccacuu

SEQ ID NO: 3737655 - RNA, 17 nt, Human
gugagucauuuaaaugu

SEQ ID NO: 3737656 - RNA, 15 nt, Human
gugaguccauucucc

SEQ ID NO: 3737657 - RNA, 16 nt, Human
gugagucguuuccccu

SEQ ID NO: 3737658 - RNA, 17 nt, Human
gugagucuuggcggcag

SEQ ID NO: 3737659 - RNA, 17 nt, Human
gugagucuuugguucua

SEQ ID NO: 3737660 - RNA, 15 nt, Human
gugagugagccuggc

SEQ ID NO: 3737661 - RNA, 20 nt, Human
gugagugugaauauaaaugu

SEQ ID NO: 3737662 - RNA, 13 nt, Human
gugagugugacag

SEQ ID NO: 3737663 - RNA, 15 nt, Human
gugagugugacaggg

SEQ ID NO: 3737664 - RNA, 16 nt, Human
gugagugugacagggc

SEQ ID NO: 3737665 - RNA, 13 nt, Human
gugagugugugca

SEQ ID NO: 3737666 - RNA, 15 nt, Human
gugagugugugcaag

SEQ ID NO: 3737667 - RNA, 15 nt, Human
gugaguguuucuaug

SEQ ID NO: 3737668 - RNA, 23 nt, Human
gugaguguuucuaugaguggaaa

SEQ ID NO: 3737669 - RNA, 17 nt, Human
gugaguguuuuuaucuu

SEQ ID NO: 3737670 - RNA, 15 nt, Human
gugaguucucagggc

SEQ ID NO: 3737671 - RNA, 17 nt, Human
gugaguucucagggcuc

SEQ ID NO: 3737672 - RNA, 18 nt, Human
gugaguucucagggcucc

SEQ ID NO: 3737673 - RNA, 16 nt, Human
gugaguuggcuuaccu

SEQ ID NO: 3737674 - RNA, 18 nt, Human
gugaguuugagcugccuu

SEQ ID NO: 3737675 - RNA, 18 nt, Human
gugaguuuggucuggacu

SEQ ID NO: 3737676 - RNA, 22 nt, Human
gugaguuuguuucuuugaauuu

SEQ ID NO: 3737677 - RNA, 14 nt, Human
gugauaaacuuugc

SEQ ID NO: 3737678 - RNA, 20 nt, Human
gugauacaacuucaagugca

SEQ ID NO: 3737679 - RNA, 21 nt, Human
gugauacagaacucuuaaaaa

SEQ ID NO: 3737680 - RNA, 19 nt, Human
gugauagcauugcuuucgu

SEQ ID NO: 3737681 - RNA, 18 nt, Human
gugauagcuaacauuuua

SEQ ID NO: 3737682 - RNA, 22 nt, Human
gugauagucuuuugcuuuuggc

SEQ ID NO: 3737683 - RNA, 16 nt, Human
gugauauaaacagcuu

SEQ ID NO: 3737684 - RNA, 20 nt, Human
gugauauauuccuaaacuau

SEQ ID NO: 3737685 - RNA, 16 nt, Human
gugauauccugaaaaa

SEQ ID NO: 3737686 - RNA, 19 nt, Human
gugauauggcagaagacac

SEQ ID NO: 3737687 - RNA, 13 nt, Human
gugauauucuuug

SEQ ID NO: 3737688 - RNA, 18 nt, Human
gugauauuucagaaauac

SEQ ID NO: 3737689 - RNA, 18 nt, Human
gugaucaauaaaauguga

SEQ ID NO: 3737690 - RNA, 17 nt, Human
gugaucacagcagcuuc

SEQ ID NO: 3737691 - RNA, 23 nt, Human
gugaucacuuucugaaauucaca

SEQ ID NO: 3737692 - RNA, 20 nt, Human
gugaucagaccauaauguua

SEQ ID NO: 3737693 - RNA, 23 nt, Human
gugauccacccaacccuaucucc

SEQ ID NO: 3737694 - RNA, 15 nt, Human
gugauccacccaccu

SEQ ID NO: 3737695 - RNA, 22 nt, Human
gugauccacccaccucagccuc

SEQ ID NO: 3737696 - RNA, 22 nt, Human
gugaucccuagcugugaccucu

SEQ ID NO: 3737697 - RNA, 14 nt, Human
gugauccucccacc

SEQ ID NO: 3737698 - RNA, 20 nt, Human
gugauccucccaccucagcc

SEQ ID NO: 3737699 - RNA, 19 nt, Human
gugauccuuuuauguuauu

SEQ ID NO: 3737700 - RNA, 14 nt, Human
gugaucucagcuca

SEQ ID NO: 3737701 - RNA, 20 nt, Human
gugaucugcugcagagcagu

SEQ ID NO: 3737702 - RNA, 23 nt, Human
gagauguaugaaggcuuuugguc

SEQ ID NO: 3737703 - RNA, 16 nt, Human
gagaugucuuggaaca

SEQ ID NO: 3737704 - RNA, 16 nt, Human
gagauguguggacugu

SEQ ID NO: 3737705 - RNA, 17 nt, Human
gagauguguguugauac

SEQ ID NO: 3737706 - RNA, 22 nt, Human
gagauguguguugauacuguug

SEQ ID NO: 3737707 - RNA, 21 nt, Human
gagauguuuuuaaaaguuuca

SEQ ID NO: 3737708 - RNA, 17 nt, Human
gagauucaguuuucauu

SEQ ID NO: 3737709 - RNA, 14 nt, Human
gagauucccaagcc

SEQ ID NO: 3737710 - RNA, 16 nt, Human
gagauucccgcggguu

SEQ ID NO: 3737711 - RNA, 14 nt, Human
gagauucugccuuu

SEQ ID NO: 3737712 - RNA, 21 nt, Human
gagauucugccuuugccaggu

SEQ ID NO: 3737713 - RNA, 14 nt, Human
gagauugaccugga

SEQ ID NO: 3737714 - RNA, 21 nt, Human
gagauugcaccacugcacucc

SEQ ID NO: 3737715 - RNA, 23 nt, Human
gagauugcuguguguugccuggg

SEQ ID NO: 3737716 - RNA, 19 nt, Human
gagauuggaucaaguauua

SEQ ID NO: 3737717 - RNA, 21 nt, Human
gagauuggaucaaguauuacu

SEQ ID NO: 3737718 - RNA, 21 nt, Human
gagauugugccccugcacucc

SEQ ID NO: 3737719 - RNA, 23 nt, Human
gagauuguuguuugccauacuuu

SEQ ID NO: 3737720 - RNA, 15 nt, Human
gagauuucaagagau

SEQ ID NO: 3737721 - RNA, 23 nt, Human
gagauuucaucugcucuccuucc

SEQ ID NO: 3737722 - RNA, 16 nt, Human
gagauuuccuccuggc

SEQ ID NO: 3737723 - RNA, 18 nt, Human
gagauuucuuguugcuca

SEQ ID NO: 3737724 - RNA, 12 nt, Human
gagauuuuucau

SEQ ID NO: 3737725 - RNA, 19 nt, Human
gagcaaaaucgaugcagug

SEQ ID NO: 3737726 - RNA, 15 nt, Human
gagcaaaccugcccc

SEQ ID NO: 3737727 - RNA, 15 nt, Human
gagcaaacucugcug

SEQ ID NO: 3737728 - RNA, 22 nt, Human
gagcaaagccuguucauggcag

SEQ ID NO: 3737729 - RNA, 13 nt, Human
gagcaaagcugau

SEQ ID NO: 3737730 - RNA, 13 nt, Human
gagcaaaggcuga

SEQ ID NO: 3737731 - RNA, 16 nt, Human
gagcaaaggcugagaa

SEQ ID NO: 3737732 - RNA, 19 nt, Human
gagcaaauguuucugcagu

SEQ ID NO: 3737733 - RNA, 18 nt, Human
gagcaacaagaaucuaaa

SEQ ID NO: 3737734 - RNA, 20 nt, Human
gagcaacagagugagacccu

SEQ ID NO: 3737735 - RNA, 21 nt, Human
gagcaaccccuggaccccagc

SEQ ID NO: 3737736 - RNA, 16 nt, Human
gagcaaccguggcccu

SEQ ID NO: 3737737 - RNA, 20 nt, Human
gagcaaccguggcccuuccu

SEQ ID NO: 3737738 - RNA, 19 nt, Human
gagcaaccucucacucccc

SEQ ID NO: 3737739 - RNA, 15 nt, Human
gagcaagagagcagc

SEQ ID NO: 3737740 - RNA, 12 nt, Human
gagcaagagcug

SEQ ID NO: 3737741 - RNA, 13 nt, Human
gagcaagagcugg

SEQ ID NO: 3737742 - RNA, 15 nt, Human
gagcaagaggaggcc

SEQ ID NO: 3737743 - RNA, 18 nt, Human
gagcaagcaggaaucaga

SEQ ID NO: 3737744 - RNA, 20 nt, Human
gagcaagcauuuauguuuau

SEQ ID NO: 3737745 - RNA, 18 nt, Human
gagcaagggcagggacag

SEQ ID NO: 3737746 - RNA, 16 nt, Human
gagcaaugucugugcu

SEQ ID NO: 3737747 - RNA, 19 nt, Human
gagcacaaaaccuguccua

SEQ ID NO: 3737748 - RNA, 18 nt, Human
gagcacaaaagccucuca

SEQ ID NO: 3737749 - RNA, 22 nt, Human
gagcacaaaauucaaagcaugg

SEQ ID NO: 3737750 - RNA, 18 nt, Human
gagcacaaacauuuuuca

SEQ ID NO: 3737751 - RNA, 16 nt, Human
gagcacaaagacccug

SEQ ID NO: 3737752 - RNA, 22 nt, Human
gagcacaagaggagauccaggg

SEQ ID NO: 3737753 - RNA, 20 nt, Human
gagcacaauaaauggcugua

SEQ ID NO: 3737754 - RNA, 15 nt, Human
gagcacacccagccc

SEQ ID NO: 3737755 - RNA, 15 nt, Human
gagcacagcccuccc

SEQ ID NO: 3737756 - RNA, 14 nt, Human
gagcacaggcagcu

SEQ ID NO: 3737757 - RNA, 23 nt, Human
gagcacaggucccaccuccagcc

SEQ ID NO: 3737758 - RNA, 15 nt, Human
gagcacccucuggau

SEQ ID NO: 3737759 - RNA, 22 nt, Human
gagcaccgccugugaaauacca

SEQ ID NO: 3737760 - RNA, 12 nt, Human
gagcaccuccca

SEQ ID NO: 3737761 - RNA, 15 nt, Human
gagcaccucccagcc

SEQ ID NO: 3737762 - RNA, 12 nt, Human
gagcaccugcuu

SEQ ID NO: 3737763 - RNA, 17 nt, Human
gagcaccuuagacaguc

SEQ ID NO: 3737764 - RNA, 20 nt, Human
gagcaccuuagacagucccu

SEQ ID NO: 3737765 - RNA, 21 nt, Human
gagcaccuuagacagucccug

SEQ ID NO: 3737766 - RNA, 22 nt, Human
gagcaccuuagacagucccugc

SEQ ID NO: 3737767 - RNA, 17 nt, Human
gagcaccuuccucacuu

SEQ ID NO: 3737768 - RNA, 20 nt, Human
gagcaccuuccucacuucca

SEQ ID NO: 3737769 - RNA, 15 nt, Human
gagcacuaaggugug

SEQ ID NO: 3737770 - RNA, 14 nt, Human
gagcacugccagga

SEQ ID NO: 3737771 - RNA, 17 nt, Human
gagcacugccaggaggg

SEQ ID NO: 3737772 - RNA, 19 nt, Human
gagcacugccaggagggac

SEQ ID NO: 3737773 - RNA, 20 nt, Human
gagcacugccaggagggaca

SEQ ID NO: 3737774 - RNA, 13 nt, Human
gagcacugcucca

SEQ ID NO: 3737775 - RNA, 14 nt, Human
gagcacugggcucc

SEQ ID NO: 3737776 - RNA, 15 nt, Human
gagcacuguauaccc

SEQ ID NO: 3737777 - RNA, 16 nt, Human
gagcacuguauacccc

SEQ ID NO: 3737778 - RNA, 14 nt, Human
gagcacuguuuucu

SEQ ID NO: 3737779 - RNA, 16 nt, Human
gagcacuuaagagaau

SEQ ID NO: 3737780 - RNA, 18 nt, Human
gagcacuuaagagaauau

SEQ ID NO: 3737781 - RNA, 14 nt, Human
gagcacuugcugua

SEQ ID NO: 3737782 - RNA, 23 nt, Human
gagcagaaaacccuugggccaga

SEQ ID NO: 3737783 - RNA, 20 nt, Human
gagcagacacccuuggagcu

SEQ ID NO: 3737784 - RNA, 21 nt, Human
gagcagacaggaggaaucaug

SEQ ID NO: 3737785 - RNA, 12 nt, Human
gagcagagaagg

SEQ ID NO: 3737786 - RNA, 12 nt, Human
gagcagagacac

SEQ ID NO: 3737787 - RNA, 16 nt, Human
gagcagagaccauccc

SEQ ID NO: 3737788 - RNA, 20 nt, Human
gagcagagcugauggagaag

SEQ ID NO: 3737789 - RNA, 23 nt, Human
gagcagagcugauggagaaggaa

SEQ ID NO: 3737790 - RNA, 16 nt, Human
gagcagaggggcagag

SEQ ID NO: 3737791 - RNA, 16 nt, Human
gagcagaggggcugaa

SEQ ID NO: 3737792 - RNA, 20 nt, Human
gagcagagucuugcuaccuc

SEQ ID NO: 3737793 - RNA, 22 nt, Human
gagcagaugaggugaaaaggcc

SEQ ID NO: 3737794 - RNA, 18 nt, Human
gagcagaugcagagagcc

SEQ ID NO: 3737795 - RNA, 19 nt, Human
gagcagaugcagagagcca

SEQ ID NO: 3737796 - RNA, 15 nt, Human
gagcagcaccuccuc

SEQ ID NO: 3737797 - RNA, 20 nt, Human
gagcagcaccuccucagccu

SEQ ID NO: 3737798 - RNA, 18 nt, Human
gagcagccacauuccuga

SEQ ID NO: 3737799 - RNA, 21 nt, Human
gagcagccacauuccugaugc

SEQ ID NO: 3737800 - RNA, 21 nt, Human
gagcagccuggagcccuggag

SEQ ID NO: 3737801 - RNA, 11 nt, Human
gagcagccugu

SEQ ID NO: 3737802 - RNA, 15 nt, Human
gagcagccuguggca

SEQ ID NO: 3737803 - RNA, 16 nt, Human
gagcagccuguggcau

SEQ ID NO: 3737804 - RNA, 18 nt, Human
gagcagccuguggcaucu

SEQ ID NO: 3737805 - RNA, 14 nt, Human
gagcagcgagccug

SEQ ID NO: 3737806 - RNA, 18 nt, Human
gagcagcggacuucaaaa

SEQ ID NO: 3737807 - RNA, 17 nt, Human
gagcagcugagcagggc

SEQ ID NO: 3737808 - RNA, 19 nt, Human
gagcagcugagcagggccg

SEQ ID NO: 3737809 - RNA, 20 nt, Human
gagcagcuucugccacuucc

SEQ ID NO: 3737810 - RNA, 17 nt, Human
gagcagcuuuaaacuca

SEQ ID NO: 3737811 - RNA, 16 nt, Human
gagcaggaagcauuca

SEQ ID NO: 3737812 - RNA, 22 nt, Human
gagcaggaagcauucagagagc

SEQ ID NO: 3737813 - RNA, 23 nt, Human
gagcaggaagcauucagagagca

SEQ ID NO: 3737814 - RNA, 20 nt, Human
gagcaggaccucccuuccga

SEQ ID NO: 3737815 - RNA, 22 nt, Human
gagcaggaccucugaaacccug

SEQ ID NO: 3737816 - RNA, 19 nt, Human
gagcaggacuccaggccca

SEQ ID NO: 3737817 - RNA, 19 nt, Human
gagcaggacucuauuuuaa

SEQ ID NO: 3737818 - RNA, 18 nt, Human
gagcaggagauugagaag

SEQ ID NO: 3737819 - RNA, 16 nt, Human
gagcaggaggccccug

SEQ ID NO: 3737820 - RNA, 21 nt, Human
gagcaggaggccccuggccca

SEQ ID NO: 3737821 - RNA, 15 nt, Human
gagcaggcacaugga

SEQ ID NO: 3737822 - RNA, 19 nt, Human
gagcaggcacauggaggag

SEQ ID NO: 3737823 - RNA, 22 nt, Human
gagcaggcacgggugguccccg

SEQ ID NO: 3737824 - RNA, 19 nt, Human
gagcaggccuugcgcuguu

SEQ ID NO: 3737825 - RNA, 18 nt, Human
gagcaggcggugggcacc

SEQ ID NO: 3737826 - RNA, 22 nt, Human
gagcaggcggugggcacccacc

SEQ ID NO: 3737827 - RNA, 21 nt, Human
gagcaggcuacugucagcucc

SEQ ID NO: 3737828 - RNA, 18 nt, Human
gagcagggacagaucaua

SEQ ID NO: 3737829 - RNA, 20 nt, Human
gagcagggacagaucauaga

SEQ ID NO: 3737830 - RNA, 21 nt, Human
gagcagggauuaaccucugca

SEQ ID NO: 3737831 - RNA, 16 nt, Human
gagcagggccggggaa

SEQ ID NO: 3737832 - RNA, 21 nt, Human
gagcagggccggggaacuggc

SEQ ID NO: 3737833 - RNA, 14 nt, Human
gagcagggcucagc

SEQ ID NO: 3737834 - RNA, 13 nt, Human
gagcaggggcagg

SEQ ID NO: 3737835 - RNA, 15 nt, Human
gagcaggggcgugga

SEQ ID NO: 3737836 - RNA, 14 nt, Human
gagcagucaggaaa

SEQ ID NO: 3737837 - RNA, 18 nt, Human
gagcaguccaugcaugac

SEQ ID NO: 3737838 - RNA, 20 nt, Human
gagcaguccugccucagccu

SEQ ID NO: 3737839 - RNA, 14 nt, Human
gagcaguccuuggc

SEQ ID NO: 3737840 - RNA, 18 nt, Human
gagcaguccuuggccugc

SEQ ID NO: 3737841 - RNA, 15 nt, Human
gagcagugagcagaa

SEQ ID NO: 3737842 - RNA, 20 nt, Human
gagcagugauauucuuuguu

SEQ ID NO: 3737843 - RNA, 16 nt, Human
gagcagugcaggcaca

SEQ ID NO: 3737844 - RNA, 21 nt, Human
gagcagugcuuuuggcgggga

SEQ ID NO: 3737845 - RNA, 23 nt, Human
gagcaguggcugguccagggcua

SEQ ID NO: 3737846 - RNA, 17 nt, Human
gagcagugggccuggcc

SEQ ID NO: 3737847 - RNA, 18 nt, Human
gagcagugucuuccauaa

SEQ ID NO: 3737848 - RNA, 18 nt, Human
gagcagugugucuccugc

SEQ ID NO: 3737849 - RNA, 20 nt, Human
gagcaguuucuguccugcug

SEQ ID NO: 3737850 - RNA, 13 nt, Human
guccaccuguggg

SEQ ID NO: 3737851 - RNA, 14 nt, Human
guccaccugugggu

SEQ ID NO: 3737852 - RNA, 23 nt, Human
guccaccuguggguguagccagg

SEQ ID NO: 3737853 - RNA, 18 nt, Human
guccacgacugucuccau

SEQ ID NO: 3737854 - RNA, 16 nt, Human
guccacucccagugcu

SEQ ID NO: 3737855 - RNA, 17 nt, Human
guccacugguucuucuu

SEQ ID NO: 3737856 - RNA, 12 nt, Human
guccacugucac

SEQ ID NO: 3737857 - RNA, 17 nt, Human
guccacuucugacagcc

SEQ ID NO: 3737858 - RNA, 14 nt, Human
guccacuuuuccag

SEQ ID NO: 3737859 - RNA, 12 nt, Human
guccagaaaugg

SEQ ID NO: 3737860 - RNA, 15 nt, Human
guccagaagaauauu

SEQ ID NO: 3737861 - RNA, 19 nt, Human
guccagaagaauauucagg

SEQ ID NO: 3737862 - RNA, 16 nt, Human
guccagaaggagacag

SEQ ID NO: 3737863 - RNA, 21 nt, Human
guccagaaggagggggugacc

SEQ ID NO: 3737864 - RNA, 21 nt, Human
guccagacacaaagagacaaa

SEQ ID NO: 3737865 - RNA, 15 nt, Human
guccagacagccugu

SEQ ID NO: 3737866 - RNA, 18 nt, Human
guccagagagaccgagga

SEQ ID NO: 3737867 - RNA, 20 nt, Human
guccagagagaccgaggagg

SEQ ID NO: 3737868 - RNA, 21 nt, Human
guccagagcggaggcugugug

SEQ ID NO: 3737869 - RNA, 19 nt, Human
guccagcaccuugugccug

SEQ ID NO: 3737870 - RNA, 14 nt, Human
guccagcccuggcu

SEQ ID NO: 3737871 - RNA, 18 nt, Human
guccagcccuggcugaag

SEQ ID NO: 3737872 - RNA, 23 nt, Human
guccagcccuggcugaaggacug

SEQ ID NO: 3737873 - RNA, 20 nt, Human
guccagccgccauugccacc

SEQ ID NO: 3737874 - RNA, 14 nt, Human
guccagcuccaacc

SEQ ID NO: 3737875 - RNA, 21 nt, Human
guccagcucuggaggggaggg

SEQ ID NO: 3737876 - RNA, 17 nt, Human
guccagcugagcgccag

SEQ ID NO: 3737877 - RNA, 19 nt, Human
guccagcugcccuuccgca

SEQ ID NO: 3737878 - RNA, 14 nt, Human
guccagcuggccug

SEQ ID NO: 3737879 - RNA, 12 nt, Human
guccaggaacaa

SEQ ID NO: 3737880 - RNA, 13 nt, Human
guccagggaagag

SEQ ID NO: 3737881 - RNA, 13 nt, Human
guccagggaagcu

SEQ ID NO: 3737882 - RNA, 15 nt, Human
guccagggcccugag

SEQ ID NO: 3737883 - RNA, 20 nt, Human
guccagggcccugagcucgg

SEQ ID NO: 3737884 - RNA, 18 nt, Human
guccagggcuagugacuu

SEQ ID NO: 3737885 - RNA, 14 nt, Human
guccaggggccccu

SEQ ID NO: 3737886 - RNA, 19 nt, Human
guccaggggccccuccagc

SEQ ID NO: 3737887 - RNA, 17 nt, Human
guccagguccugguggg

SEQ ID NO: 3737888 - RNA, 22 nt, Human
guccagguccugguggggcagc

SEQ ID NO: 3737889 - RNA, 22 nt, Human
guccaggucgggcucagcucug

SEQ ID NO: 3737890 - RNA, 23 nt, Human
guccaggucgggcucagcucugg

SEQ ID NO: 3737891 - RNA, 14 nt, Human
guccaguaagauca

SEQ ID NO: 3737892 - RNA, 15 nt, Human
guccaguccaguccu

SEQ ID NO: 3737893 - RNA, 17 nt, Human
guccaguccuaucuggg

SEQ ID NO: 3737894 - RNA, 18 nt, Human
guccaguccuaucugggc

SEQ ID NO: 3737895 - RNA, 23 nt, Human
guccaguccuaucugggcuuccu

SEQ ID NO: 3737896 - RNA, 24 nt, Human
guccagugggaggugagaccaccu

SEQ ID NO: 3737897 - RNA, 19 nt, Human
guccaguucccagaaggca

SEQ ID NO: 3737898 - RNA, 13 nt, Human
guccauagcugug

SEQ ID NO: 3737899 - RNA, 19 nt, Human
guccaucugcccgccugcc

SEQ ID NO: 3737900 - RNA, 22 nt, Human
guccaucugcccgccugcccac

SEQ ID NO: 3737901 - RNA, 21 nt, Human
guccaugcagggggcuccugg

SEQ ID NO: 3737902 - RNA, 18 nt, Human
guccaugcuaacaaagac

SEQ ID NO: 3737903 - RNA, 14 nt, Human
guccaugcuucuca

SEQ ID NO: 3737904 - RNA, 21 nt, Human
guccauggaaugcuugaaaaa

SEQ ID NO: 3737905 - RNA, 13 nt, Human
guccaugggcaga

SEQ ID NO: 3737906 - RNA, 14 nt, Human
guccaugggcagag

SEQ ID NO: 3737907 - RNA, 16 nt, Human
guccaugggcagagcc

SEQ ID NO: 3737908 - RNA, 18 nt, Human
guccaugggcagagccca

SEQ ID NO: 3737909 - RNA, 13 nt, Human
guccaugugugug

SEQ ID NO: 3737910 - RNA, 13 nt, Human
guccauucucaag

SEQ ID NO: 3737911 - RNA, 13 nt, Human
guccauucuccca

SEQ ID NO: 3737912 - RNA, 14 nt, Human
guccauugacaugu

SEQ ID NO: 3737913 - RNA, 17 nt, Human
guccauugacauguaca

SEQ ID NO: 3737914 - RNA, 18 nt, Human
guccauugacauguacag

SEQ ID NO: 3737915 - RNA, 22 nt, Human
guccauugacauguacagagaa

SEQ ID NO: 3737916 - RNA, 16 nt, Human
guccauuguccaaucc

SEQ ID NO: 3737917 - RNA, 21 nt, Human
guccauuguccaauccuaugu

SEQ ID NO: 3737918 - RNA, 19 nt, Human
guccauuuauauaugaaaa

SEQ ID NO: 3737919 - RNA, 22 nt, Human
guccauuuggcagggguggcug

SEQ ID NO: 3737920 - RNA, 14 nt, Human
guccauuuugugaa

SEQ ID NO: 3737921 - RNA, 21 nt, Human
gucccaacaggaggacaauuc

SEQ ID NO: 3737922 - RNA, 23 nt, Human
gucccaacaggaggacaauucau

SEQ ID NO: 3737923 - RNA, 17 nt, Human
gucccaagguucugggu

SEQ ID NO: 3737924 - RNA, 14 nt, Human
gucccaagugccaa

SEQ ID NO: 3737925 - RNA, 20 nt, Human
gucccaaugguccugacuuu

SEQ ID NO: 3737926 - RNA, 14 nt, Human
gucccacagccacg

SEQ ID NO: 3737927 - RNA, 15 nt, Human
gucccacagccacgu

SEQ ID NO: 3737928 - RNA, 13 nt, Human
gucccacaucccu

SEQ ID NO: 3737929 - RNA, 14 nt, Human
gucccacaucccug

SEQ ID NO: 3737930 - RNA, 15 nt, Human
gucccacaucccugg

SEQ ID NO: 3737931 - RNA, 20 nt, Human
gucccaccaugcagugcccc

SEQ ID NO: 3737932 - RNA, 21 nt, Human
gucccaccccacacacgccag

SEQ ID NO: 3737933 - RNA, 19 nt, Human
gucccacccccacccccag

SEQ ID NO: 3737934 - RNA, 21 nt, Human
gucccacccccacccccagcu

SEQ ID NO: 3737935 - RNA, 17 nt, Human
gucccaccccucccucu

SEQ ID NO: 3737936 - RNA, 23 nt, Human
gucccaccucuucucuuccugua

SEQ ID NO: 3737937 - RNA, 14 nt, Human
gucccaccuuggcu

SEQ ID NO: 3737938 - RNA, 16 nt, Human
gucccaccuuggcugc

SEQ ID NO: 3737939 - RNA, 23 nt, Human
gucccaccuuggcugcagggagu

SEQ ID NO: 3737940 - RNA, 22 nt, Human
gucccacgaauuugcuggggaa

SEQ ID NO: 3737941 - RNA, 22 nt, Human
gucccacucaagccaagcagcc

SEQ ID NO: 3737942 - RNA, 21 nt, Human
gucccacucaguccauagcag

SEQ ID NO: 3737943 - RNA, 19 nt, Human
gucccacuccaagccagca

SEQ ID NO: 3737944 - RNA, 17 nt, Human
gucccacugccucaggu

SEQ ID NO: 3737945 - RNA, 16 nt, Human
gucccacuuccccucc

SEQ ID NO: 3737946 - RNA, 16 nt, Human
gucccagagcaggagg

SEQ ID NO: 3737947 - RNA, 18 nt, Human
gucccagagcaggaggcc

SEQ ID NO: 3737948 - RNA, 17 nt, Human
gucccagauacuugggg

SEQ ID NO: 3737949 - RNA, 20 nt, Human
gucccaggagcugcccagag

SEQ ID NO: 3737950 - RNA, 19 nt, Human
gucccaggcugagccucag

SEQ ID NO: 3737951 - RNA, 17 nt, Human
gucccagguuggcucug

SEQ ID NO: 3737952 - RNA, 22 nt, Human
gucccagguuggcucugccagu

SEQ ID NO: 3737953 - RNA, 11 nt, Human
gucccaguggg

SEQ ID NO: 3737954 - RNA, 18 nt, Human
gucccagugggaggcgcg

SEQ ID NO: 3737955 - RNA, 18 nt, Human
gucccagugggaggggca

SEQ ID NO: 3737956 - RNA, 23 nt, Human
gucccagugggaggggcaggcug

SEQ ID NO: 3737957 - RNA, 16 nt, Human
gucccauaggcccagu

SEQ ID NO: 3737958 - RNA, 16 nt, Human
gucccauagucccugc

SEQ ID NO: 3737959 - RNA, 17 nt, Human
gucccauagucccugcc

SEQ ID NO: 3737960 - RNA, 18 nt, Human
gucccauagucccugcca

SEQ ID NO: 3737961 - RNA, 14 nt, Human
gucccauccaggca

SEQ ID NO: 3737962 - RNA, 19 nt, Human
gucccaugacccaccccug

SEQ ID NO: 3737963 - RNA, 17 nt, Human
gucccaugugagcugcu

SEQ ID NO: 3737964 - RNA, 18 nt, Human
gucccaugugagcugcug

SEQ ID NO: 3737965 - RNA, 19 nt, Human
gucccauucccccagugcg

SEQ ID NO: 3737966 - RNA, 15 nt, Human
gucccauucccuggg

SEQ ID NO: 3737967 - RNA, 18 nt, Human
gucccauuucucacugag

SEQ ID NO: 3737968 - RNA, 17 nt, Human
guccccaaaccugcaag

SEQ ID NO: 3737969 - RNA, 15 nt, Human
guccccaacagcgcc

SEQ ID NO: 3737970 - RNA, 11 nt, Human
guccccacacu

SEQ ID NO: 3737971 - RNA, 16 nt, Human
guccccaccaucugcu

SEQ ID NO: 3737972 - RNA, 12 nt, Human
guccccaccccu

SEQ ID NO: 3737973 - RNA, 16 nt, Human
guccccacccuccacu

SEQ ID NO: 3737974 - RNA, 22 nt, Human
guccccagcccuuccucugcuc

SEQ ID NO: 3737975 - RNA, 13 nt, Human
guccccagccugg

SEQ ID NO: 3737976 - RNA, 19 nt, Human
guccccaggccccaggaag

SEQ ID NO: 3737977 - RNA, 23 nt, Human
guccccagggcugucaucugaau

SEQ ID NO: 3737978 - RNA, 18 nt, Human
guccccaguuugcagaaa

SEQ ID NO: 3737979 - RNA, 17 nt, Human
guccccaucaucccagc

SEQ ID NO: 3737980 - RNA, 20 nt, Human
guccccaucaucccagcugc

SEQ ID NO: 3737981 - RNA, 16 nt, Human
gucccccaacucugag

SEQ ID NO: 3737982 - RNA, 23 nt, Human
gucccccaacuucaucuggaagu

SEQ ID NO: 3737983 - RNA, 15 nt, Human
gucccccaacuugag

SEQ ID NO: 3737984 - RNA, 14 nt, Human
gucccccagcucug

SEQ ID NO: 3737985 - RNA, 11 nt, Human
guccccccacc

SEQ ID NO: 3737986 - RNA, 22 nt, Human
guccccccacccucauucuacu

SEQ ID NO: 3737987 - RNA, 12 nt, Human
guccccccacuc

SEQ ID NO: 3737988 - RNA, 17 nt, Human
guccccccacucccagc

SEQ ID NO: 3737989 - RNA, 13 nt, Human
gucccccucagca

SEQ ID NO: 3737990 - RNA, 19 nt, Human
gucccccucuguccaggca

SEQ ID NO: 3737991 - RNA, 22 nt, Human
gucccccuggggcuucuccuga

SEQ ID NO: 3737992 - RNA, 16 nt, Human
guccccgcugcugugc

SEQ ID NO: 3737993 - RNA, 15 nt, Human
guccccgugccccgc

SEQ ID NO: 3737994 - RNA, 14 nt, Human
guccccucccaucu

SEQ ID NO: 3737995 - RNA, 22 nt, Human
guccccucccccaccccugcug

SEQ ID NO: 3737996 - RNA, 16 nt, Human
guccccuccccggccc

SEQ ID NO: 3737997 - RNA, 22 nt, Human
guccccuccccggcccuaccag

SEQ ID NO: 3737998 - RNA, 13 nt, Human
guccccucuugcc

SEQ ID NO: 3737999 - RNA, 23 nt, Human
guccccugucgaguucggcucug

SEQ ID NO: 3738000 - RNA, 18 nt, Human
gugaucugggucucuaau

SEQ ID NO: 3738001 - RNA, 15 nt, Human
gugaucugucuugua

SEQ ID NO: 3738002 - RNA, 19 nt, Human
gugaucugucuuguaauau

SEQ ID NO: 3738003 - RNA, 20 nt, Human
gugaucuuuuguucccaucc

SEQ ID NO: 3738004 - RNA, 14 nt, Human
gugaugaacuuucu

SEQ ID NO: 3738005 - RNA, 22 nt, Human
gugaugacaacuggaauaguuu

SEQ ID NO: 3738006 - RNA, 16 nt, Human
gugaugagaggaaauc

SEQ ID NO: 3738007 - RNA, 20 nt, Human
gugaugagggcagcagccag

SEQ ID NO: 3738008 - RNA, 22 nt, Human
gugaugaucagcuguuugucau

SEQ ID NO: 3738009 - RNA, 15 nt, Human
gugaugauguaauug

SEQ ID NO: 3738010 - RNA, 17 nt, Human
gugaugccacacagagu

SEQ ID NO: 3738011 - RNA, 17 nt, Human
gugaugcgcaguugcug

SEQ ID NO: 3738012 - RNA, 19 nt, Human
gugaugcuugauauuuucu

SEQ ID NO: 3738013 - RNA, 16 nt, Human
gugauggagugcuguu

SEQ ID NO: 3738014 - RNA, 18 nt, Human
gugauggagugcuguuuu

SEQ ID NO: 3738015 - RNA, 19 nt, Human
gugauggcgaaagagggua

SEQ ID NO: 3738016 - RNA, 17 nt, Human
gugaugggaaagcauug

SEQ ID NO: 3738017 - RNA, 16 nt, Human
gugaugggcuuucucu

SEQ ID NO: 3738018 - RNA, 14 nt, Human
gugauggggcaagg

SEQ ID NO: 3738019 - RNA, 14 nt, Human
gugauggggcccug

SEQ ID NO: 3738020 - RNA, 19 nt, Human
gugauggggcccugccucc

SEQ ID NO: 3738021 - RNA, 23 nt, Human
gugaugguuccccuguucacucu

SEQ ID NO: 3738022 - RNA, 18 nt, Human
gugaugucauacagagaa

SEQ ID NO: 3738023 - RNA, 22 nt, Human
gugaugucauacagagaaguca

SEQ ID NO: 3738024 - RNA, 19 nt, Human
gugauguccuguaaacacu

SEQ ID NO: 3738025 - RNA, 18 nt, Human
gugaugucuuuucuuggc

SEQ ID NO: 3738026 - RNA, 18 nt, Human
gugaugugacauuuguca

SEQ ID NO: 3738027 - RNA, 15 nt, Human
gugauguucaugggu

SEQ ID NO: 3738028 - RNA, 14 nt, Human
gugauguuuguccu

SEQ ID NO: 3738029 - RNA, 15 nt, Human
gugauuaaacgugca

SEQ ID NO: 3738030 - RNA, 18 nt, Human
gugauuaaacgugcagac

SEQ ID NO: 3738031 - RNA, 19 nt, Human
gugauuaaagcuaaggacc

SEQ ID NO: 3738032 - RNA, 17 nt, Human
gugauuacauaaucugu

SEQ ID NO: 3738033 - RNA, 11 nt, Human
gugauuaccag

SEQ ID NO: 3738034 - RNA, 13 nt, Human
gugauuagugaaa

SEQ ID NO: 3738035 - RNA, 19 nt, Human
gugauuauuuguuauuugu

SEQ ID NO: 3738036 - RNA, 12 nt, Human
gugauucaaaug

SEQ ID NO: 3738037 - RNA, 21 nt, Human
gugauucagaaaauguucugu

SEQ ID NO: 3738038 - RNA, 17 nt, Human
gugauucuccugccuca

SEQ ID NO: 3738039 - RNA, 19 nt, Human
gugauucuccugccucagc

SEQ ID NO: 3738040 - RNA, 21 nt, Human
gugauugacagcuuugcugcu

SEQ ID NO: 3738041 - RNA, 18 nt, Human
gugauugcagcuuuaugu

SEQ ID NO: 3738042 - RNA, 23 nt, Human
gugauuguggaauggagauucag

SEQ ID NO: 3738043 - RNA, 20 nt, Human
gugauuuaauaguguuaauc

SEQ ID NO: 3738044 - RNA, 23 nt, Human
gugauuuagaacuguaugucaga

SEQ ID NO: 3738045 - RNA, 21 nt, Human
gugauuucuuuaaaagaauga

SEQ ID NO: 3738046 - RNA, 22 nt, Human
gugauuugaaaaauauaaaauu

SEQ ID NO: 3738047 - RNA, 18 nt, Human
gugauuuuaacucugucu

SEQ ID NO: 3738048 - RNA, 17 nt, Human
gugauuuucaagcagca

SEQ ID NO: 3738049 - RNA, 12 nt, Human
gugauuuucauu

SEQ ID NO: 3738050 - RNA, 16 nt, Human
gugauuuugcuguaga

SEQ ID NO: 3738051 - RNA, 16 nt, Human
gugauuuuuaugccac

SEQ ID NO: 3738052 - RNA, 17 nt, Human
gugauuuuuaugccacc

SEQ ID NO: 3738053 - RNA, 19 nt, Human
gugauuuuuaugccaccug

SEQ ID NO: 3738054 - RNA, 21 nt, Human
gugauuuuuaugccaccugaa

SEQ ID NO: 3738055 - RNA, 13 nt, Human
gugauuuuuguaa

SEQ ID NO: 3738056 - RNA, 14 nt, Human
gugauuuuuuucuu

SEQ ID NO: 3738057 - RNA, 14 nt, Human
gugcaaaaauuuuu

SEQ ID NO: 3738058 - RNA, 17 nt, Human
gugcaaaaccuuuuacu

SEQ ID NO: 3738059 - RNA, 15 nt, Human
gugcaacagcacugg

SEQ ID NO: 3738060 - RNA, 23 nt, Human
gugcaacagcacuggcucucucc

SEQ ID NO: 3738061 - RNA, 24 nt, Human
gugcaacaggguauggacuaucug

SEQ ID NO: 3738062 - RNA, 13 nt, Human
gugcaaccaggga

SEQ ID NO: 3738063 - RNA, 23 nt, Human
gugcaacccuuaccccuuagccu

SEQ ID NO: 3738064 - RNA, 23 nt, Human
gagcugcccuccuuguccaccca

SEQ ID NO: 3738065 - RNA, 15 nt, Human
gagcugccuggaccc

SEQ ID NO: 3738066 - RNA, 16 nt, Human
gagcugccuguucagc

SEQ ID NO: 3738067 - RNA, 21 nt, Human
gagcugccuguucagcuccag

SEQ ID NO: 3738068 - RNA, 23 nt, Human
gagcugccuguucagcuccagcu

SEQ ID NO: 3738069 - RNA, 13 nt, Human
gagcugccuuccc

SEQ ID NO: 3738070 - RNA, 14 nt, Human
gagcugccuucccu

SEQ ID NO: 3738071 - RNA, 18 nt, Human
gagcugcuauagccuggg

SEQ ID NO: 3738072 - RNA, 13 nt, Human
gagcugcucacua

SEQ ID NO: 3738073 - RNA, 16 nt, Human
gagcugcuggcuugca

SEQ ID NO: 3738074 - RNA, 21 nt, Human
gagcuggacaguggagugcaa

SEQ ID NO: 3738075 - RNA, 20 nt, Human
gagcuggagaugaggccaga

SEQ ID NO: 3738076 - RNA, 21 nt, Human
gagcuggagaugaggccagac

SEQ ID NO: 3738077 - RNA, 23 nt, Human
gagcuggagaugaggccagacca

SEQ ID NO: 3738078 - RNA, 13 nt, Human
gagcuggccccgc

SEQ ID NO: 3738079 - RNA, 17 nt, Human
gagcuggccccgccgcc

SEQ ID NO: 3738080 - RNA, 19 nt, Human
gagcuggccgugggccugg

SEQ ID NO: 3738081 - RNA, 11 nt, Human
gagcuggccuc

SEQ ID NO: 3738082 - RNA, 14 nt, Human
gagcuggcuccagc

SEQ ID NO: 3738083 - RNA, 23 nt, Human
gagcuggcucuauaaggcagccu

SEQ ID NO: 3738084 - RNA, 22 nt, Human
gagcuggcucugagcgccucca

SEQ ID NO: 3738085 - RNA, 13 nt, Human
gagcugggagccg

SEQ ID NO: 3738086 - RNA, 12 nt, Human
gagcugggaggc

SEQ ID NO: 3738087 - RNA, 17 nt, Human
gagcugggaggcauggc

SEQ ID NO: 3738088 - RNA, 19 nt, Human
gagcugggcccgacauggc

SEQ ID NO: 3738089 - RNA, 16 nt, Human
gagcugggccuggucu

SEQ ID NO: 3738090 - RNA, 21 nt, Human
gagcuggggaccagcagucug

SEQ ID NO: 3738091 - RNA, 20 nt, Human
gagcuggggagaauggggcu

SEQ ID NO: 3738092 - RNA, 19 nt, Human
gagcugggggccaugagcu

SEQ ID NO: 3738093 - RNA, 18 nt, Human
gagcugggugucaagagg

SEQ ID NO: 3738094 - RNA, 14 nt, Human
gagcuggugcauua

SEQ ID NO: 3738095 - RNA, 16 nt, Human
gagcuggugcccggag

SEQ ID NO: 3738096 - RNA, 17 nt, Human
gagcuggugcccggaga

SEQ ID NO: 3738097 - RNA, 21 nt, Human
gagcuggugcccggagauugg

SEQ ID NO: 3738098 - RNA, 20 nt, Human
gagcuggugcggcuggccau

SEQ ID NO: 3738099 - RNA, 17 nt, Human
gagcugucaccaaggaa

SEQ ID NO: 3738100 - RNA, 19 nt, Human
gagcugucaccaaggaaac

SEQ ID NO: 3738101 - RNA, 18 nt, Human
gagcuguccggcuggugg

SEQ ID NO: 3738102 - RNA, 17 nt, Human
gagcuguucacagccag

SEQ ID NO: 3738103 - RNA, 20 nt, Human
gagcuguucacagccagacu

SEQ ID NO: 3738104 - RNA, 22 nt, Human
gagcuguucacagccagacugg

SEQ ID NO: 3738105 - RNA, 19 nt, Human
gagcuguuuauggccucag

SEQ ID NO: 3738106 - RNA, 15 nt, Human
gagcuguuuauguuu

SEQ ID NO: 3738107 - RNA, 16 nt, Human
gagcuguuuauguuuu

SEQ ID NO: 3738108 - RNA, 17 nt, Human
gagcuuaaaauacaaga

SEQ ID NO: 3738109 - RNA, 17 nt, Human
gagcuuaagccacugcc

SEQ ID NO: 3738110 - RNA, 23 nt, Human
gagcuuaagccacugccucuccc

SEQ ID NO: 3738111 - RNA, 21 nt, Human
gagcuuaaucuuugaaagguu

SEQ ID NO: 3738112 - RNA, 22 nt, Human
gagcuuaaugcuacaugugagu

SEQ ID NO: 3738113 - RNA, 12 nt, Human
gagcuuagaaac

SEQ ID NO: 3738114 - RNA, 18 nt, Human
gagcuuagugaaauuacu

SEQ ID NO: 3738115 - RNA, 22 nt, Human
gagcuucaagucugugccugga

SEQ ID NO: 3738116 - RNA, 22 nt, Human
gagcuuccaaggggcaaauuuu

SEQ ID NO: 3738117 - RNA, 14 nt, Human
gagcuucucuguga

SEQ ID NO: 3738118 - RNA, 19 nt, Human
gagcuucucuuuaacucag

SEQ ID NO: 3738119 - RNA, 20 nt, Human
gagcuucugggguccccagg

SEQ ID NO: 3738120 - RNA, 18 nt, Human
gagcuucuguugcugccu

SEQ ID NO: 3738121 - RNA, 22 nt, Human
gagcuugaaacccguggcgcuu

SEQ ID NO: 3738122 - RNA, 15 nt, Human
gagcuugauuaaauc

SEQ ID NO: 3738123 - RNA, 19 nt, Human
gagcuugcuuugauuuaca

SEQ ID NO: 3738124 - RNA, 14 nt, Human
gagcuuggccagaa

SEQ ID NO: 3738125 - RNA, 11 nt, Human
gagcuuuaugg

SEQ ID NO: 3738126 - RNA, 21 nt, Human
gagcuuuaugguccuaaaagc

SEQ ID NO: 3738127 - RNA, 23 nt, Human
gagcuuucuguccuuuuggcacu

SEQ ID NO: 3738128 - RNA, 20 nt, Human
gagcuuugaaaauucagugg

SEQ ID NO: 3738129 - RNA, 14 nt, Human
gagcuuugcugcua

SEQ ID NO: 3738130 - RNA, 17 nt, Human
gagcuuugcugcuacag

SEQ ID NO: 3738131 - RNA, 18 nt, Human
gagcuuuggacgcacaca

SEQ ID NO: 3738132 - RNA, 14 nt, Human
gagcuuuuguagaa

SEQ ID NO: 3738133 - RNA, 18 nt, Human
gagcuuuuuucuuuaaga

SEQ ID NO: 3738134 - RNA, 14 nt, Human
gaggaaaaauaugu

SEQ ID NO: 3738135 - RNA, 13 nt, Human
gaggaaaauucuu

SEQ ID NO: 3738136 - RNA, 18 nt, Human
gaggaaacaacagcuuua

SEQ ID NO: 3738137 - RNA, 18 nt, Human
gaggaaacuacugccuuu

SEQ ID NO: 3738138 - RNA, 14 nt, Human
gaggaaacucaccu

SEQ ID NO: 3738139 - RNA, 20 nt, Human
gaggaaacucaccugcuggc

SEQ ID NO: 3738140 - RNA, 13 nt, Human
gaggaaaggccag

SEQ ID NO: 3738141 - RNA, 23 nt, Human
gaggaaaggccagcuggcagcag

SEQ ID NO: 3738142 - RNA, 20 nt, Human
gaggaaaguacauuuuuuga

SEQ ID NO: 3738143 - RNA, 12 nt, Human
gaggaaagucau

SEQ ID NO: 3738144 - RNA, 15 nt, Human
gaggaaaucccuuca

SEQ ID NO: 3738145 - RNA, 18 nt, Human
gaggaaaucugcagaggg

SEQ ID NO: 3738146 - RNA, 17 nt, Human
gaggaaauucuccacug

SEQ ID NO: 3738147 - RNA, 14 nt, Human
gaggaacaaggcaa

SEQ ID NO: 3738148 - RNA, 16 nt, Human
gaggaacaaggcaagg

SEQ ID NO: 3738149 - RNA, 22 nt, Human
gaggaaccagagccauggacuc

SEQ ID NO: 3738150 - RNA, 15 nt, Human
gaggaacuccuuggc

SEQ ID NO: 3738151 - RNA, 23 nt, Human
gaggaacuccuuggccuagccca

SEQ ID NO: 3738152 - RNA, 14 nt, Human
gaggaacugggccu

SEQ ID NO: 3738153 - RNA, 15 nt, Human
gaggaacuguacaga

SEQ ID NO: 3738154 - RNA, 16 nt, Human
gaggaacuguacagaa

SEQ ID NO: 3738155 - RNA, 19 nt, Human
gaggaacuguccagagagc

SEQ ID NO: 3738156 - RNA, 17 nt, Human
gaggaagaagcuuaggc

SEQ ID NO: 3738157 - RNA, 13 nt, Human
gaggaagagucuu

SEQ ID NO: 3738158 - RNA, 20 nt, Human
gaggaagcagaauaaagcaa

SEQ ID NO: 3738159 - RNA, 21 nt, Human
gaggaagcagaauaaagcaau

SEQ ID NO: 3738160 - RNA, 22 nt, Human
gaggaagcagaauaaagcaauu

SEQ ID NO: 3738161 - RNA, 14 nt, Human
gaggaagccgcugg

SEQ ID NO: 3738162 - RNA, 19 nt, Human
gaggaagccugauuaaaga

SEQ ID NO: 3738163 - RNA, 20 nt, Human
gaggaagcgugaaggccgag

SEQ ID NO: 3738164 - RNA, 18 nt, Human
gaggaaggaggacccagg

SEQ ID NO: 3738165 - RNA, 13 nt, Human
gaggaaggcaaga

SEQ ID NO: 3738166 - RNA, 19 nt, Human
gaggaaggggccagaggcu

SEQ ID NO: 3738167 - RNA, 13 nt, Human
gaggaaggggggu

SEQ ID NO: 3738168 - RNA, 14 nt, Human
gaggaaguucagau

SEQ ID NO: 3738169 - RNA, 19 nt, Human
gaggaauaguugagcccca

SEQ ID NO: 3738170 - RNA, 13 nt, Human
gaggaauaucaau

SEQ ID NO: 3738171 - RNA, 22 nt, Human
gaggaaucacucuuguggaugu

SEQ ID NO: 3738172 - RNA, 22 nt, Human
gaggaaucaugucaggccugug

SEQ ID NO: 3738173 - RNA, 15 nt, Human
gaggaauccagaccc

SEQ ID NO: 3738174 - RNA, 19 nt, Human
gaggaauccuggcagccca

SEQ ID NO: 3738175 - RNA, 20 nt, Human
gaggaauccuggcagcccag

SEQ ID NO: 3738176 - RNA, 17 nt, Human
gaggaaugaugaagcuu

SEQ ID NO: 3738177 - RNA, 13 nt, Human
gaggaaugcuccc

SEQ ID NO: 3738178 - RNA, 21 nt, Human
gaggaaugcucccccauccuc

SEQ ID NO: 3738179 - RNA, 14 nt, Human
gaggaauucuguau

SEQ ID NO: 3738180 - RNA, 22 nt, Human
gaggaauuuauaccucaaacua

SEQ ID NO: 3738181 - RNA, 14 nt, Human
gaggaauuucaccu

SEQ ID NO: 3738182 - RNA, 13 nt, Human
gaggaauuucuga

SEQ ID NO: 3738183 - RNA, 14 nt, Human
gaggacaaaacuuc

SEQ ID NO: 3738184 - RNA, 15 nt, Human
gaggacaaaacuucu

SEQ ID NO: 3738185 - RNA, 17 nt, Human
gaggacaaaacuucuug

SEQ ID NO: 3738186 - RNA, 12 nt, Human
gaggacacaugu

SEQ ID NO: 3738187 - RNA, 13 nt, Human
gaggacacucccg

SEQ ID NO: 3738188 - RNA, 17 nt, Human
gaggacagaugccuccu

SEQ ID NO: 3738189 - RNA, 20 nt, Human
gaggacagaugccuccuucc

SEQ ID NO: 3738190 - RNA, 16 nt, Human
gucucaaaaauacaaa

SEQ ID NO: 3738191 - RNA, 15 nt, Human
gucucaaacuccuga

SEQ ID NO: 3738192 - RNA, 22 nt, Human
gucucaagagggcacugguggc

SEQ ID NO: 3738193 - RNA, 14 nt, Human
gucucaaugaaaua

SEQ ID NO: 3738194 - RNA, 17 nt, Human
gucucaaugcucauaac

SEQ ID NO: 3738195 - RNA, 15 nt, Human
gucucacacuggcgu

SEQ ID NO: 3738196 - RNA, 19 nt, Human
gucucaccauuuccccagg

SEQ ID NO: 3738197 - RNA, 20 nt, Human
gucucaccauuuccccaggg

SEQ ID NO: 3738198 - RNA, 23 nt, Human
gucucaccauuuccccagggcac

SEQ ID NO: 3738199 - RNA, 18 nt, Human
gucucaccggcucucacc

SEQ ID NO: 3738200 - RNA, 19 nt, Human
gucucaccuggacuuaagc

SEQ ID NO: 3738201 - RNA, 23 nt, Human
gucucacgggcaugggcacuccc

SEQ ID NO: 3738202 - RNA, 19 nt, Human
gucucacuauguugcccag

SEQ ID NO: 3738203 - RNA, 11 nt, Human
gucucacucug

SEQ ID NO: 3738204 - RNA, 22 nt, Human
gucucacucugucgcccagucu

SEQ ID NO: 3738205 - RNA, 15 nt, Human
gucucacugaaacau

SEQ ID NO: 3738206 - RNA, 22 nt, Human
gucucacugagcacuguuuucu

SEQ ID NO: 3738207 - RNA, 13 nt, Human
gucucacuguugc

SEQ ID NO: 3738208 - RNA, 17 nt, Human
gucucacuguugcccag

SEQ ID NO: 3738209 - RNA, 19 nt, Human
gucucacuguugcccaggc

SEQ ID NO: 3738210 - RNA, 22 nt, Human
gucucacuugugcaguguugac

SEQ ID NO: 3738211 - RNA, 20 nt, Human
gucucagaaucuuuccuucc

SEQ ID NO: 3738212 - RNA, 19 nt, Human
gucucagccccuuucccuu

SEQ ID NO: 3738213 - RNA, 15 nt, Human
gucucaggcugccug

SEQ ID NO: 3738214 - RNA, 16 nt, Human
gucucaggcugccuga

SEQ ID NO: 3738215 - RNA, 18 nt, Human
gucucaggcuggugggag

SEQ ID NO: 3738216 - RNA, 15 nt, Human
gucucaggucccugc

SEQ ID NO: 3738217 - RNA, 16 nt, Human
gucucaguccaccuga

SEQ ID NO: 3738218 - RNA, 15 nt, Human
gucucagugaagacu

SEQ ID NO: 3738219 - RNA, 15 nt, Human
gucucaguuucacuu

SEQ ID NO: 3738220 - RNA, 21 nt, Human
gucucaguuugugugucuuaa

SEQ ID NO: 3738221 - RNA, 11 nt, Human
gucucauccca

SEQ ID NO: 3738222 - RNA, 15 nt, Human
gucucaucuggggag

SEQ ID NO: 3738223 - RNA, 22 nt, Human
gucucauuuuaauguaaagauu

SEQ ID NO: 3738224 - RNA, 20 nt, Human
gucuccaaccccccagcacu

SEQ ID NO: 3738225 - RNA, 16 nt, Human
gucuccaccaggaacc

SEQ ID NO: 3738226 - RNA, 20 nt, Human
gucuccaccaggaaccucuu

SEQ ID NO: 3738227 - RNA, 21 nt, Human
gucuccaccaggaaccucuuc

SEQ ID NO: 3738228 - RNA, 15 nt, Human
gucuccagaaagccc

SEQ ID NO: 3738229 - RNA, 16 nt, Human
gucuccaggggcugcu

SEQ ID NO: 3738230 - RNA, 20 nt, Human
gucuccaggggcugcuuccu

SEQ ID NO: 3738231 - RNA, 14 nt, Human
gucuccauggcccu

SEQ ID NO: 3738232 - RNA, 20 nt, Human
gucucccaguuaugaaucag

SEQ ID NO: 3738233 - RNA, 19 nt, Human
gucucccauaugcagaaau

SEQ ID NO: 3738234 - RNA, 18 nt, Human
gucucccaucuuaacucu

SEQ ID NO: 3738235 - RNA, 15 nt, Human
gucucccccacccuu

SEQ ID NO: 3738236 - RNA, 19 nt, Human
gucucccccguguuccccu

SEQ ID NO: 3738237 - RNA, 21 nt, Human
gucucccccguguuccccucu

SEQ ID NO: 3738238 - RNA, 23 nt, Human
gucucccccguguuccccucuug

SEQ ID NO: 3738239 - RNA, 15 nt, Human
gucuccccucugcug

SEQ ID NO: 3738240 - RNA, 16 nt, Human
gucucccucccuuggg

SEQ ID NO: 3738241 - RNA, 16 nt, Human
gucucccuggagugca

SEQ ID NO: 3738242 - RNA, 20 nt, Human
gucucccuggaucagaacag

SEQ ID NO: 3738243 - RNA, 13 nt, Human
gucucccuggccc

SEQ ID NO: 3738244 - RNA, 16 nt, Human
gucucccuggcccuca

SEQ ID NO: 3738245 - RNA, 18 nt, Human
gucucccuggcccucaag

SEQ ID NO: 3738246 - RNA, 12 nt, Human
gucucccuggcu

SEQ ID NO: 3738247 - RNA, 13 nt, Human
gucucccugggag

SEQ ID NO: 3738248 - RNA, 18 nt, Human
gucucccuuucccuucuu

SEQ ID NO: 3738249 - RNA, 18 nt, Human
gucuccgaaaugcugucu

SEQ ID NO: 3738250 - RNA, 19 nt, Human
gucuccggccucuccagcc

SEQ ID NO: 3738251 - RNA, 14 nt, Human
gucuccuauccugg

SEQ ID NO: 3738252 - RNA, 18 nt, Human
gucuccuauccugguuuu

SEQ ID NO: 3738253 - RNA, 15 nt, Human
gucuccucacucccu

SEQ ID NO: 3738254 - RNA, 13 nt, Human
gucuccucagccu

SEQ ID NO: 3738255 - RNA, 23 nt, Human
gucuccucagccuccucaucugg

SEQ ID NO: 3738256 - RNA, 12 nt, Human
gucuccuccacc

SEQ ID NO: 3738257 - RNA, 16 nt, Human
gucuccuccccuuccc

SEQ ID NO: 3738258 - RNA, 14 nt, Human
gucuccucuuaaaa

SEQ ID NO: 3738259 - RNA, 22 nt, Human
gucuccucuuaaaaaauaaaaa

SEQ ID NO: 3738260 - RNA, 20 nt, Human
gucuccugacuggugcugca

SEQ ID NO: 3738261 - RNA, 13 nt, Human
gucuccugccccc

SEQ ID NO: 3738262 - RNA, 13 nt, Human
gucuccuggcggu

SEQ ID NO: 3738263 - RNA, 16 nt, Human
gucuccuuaacacuga

SEQ ID NO: 3738264 - RNA, 22 nt, Human
gucuccuuaacacugagcuguc

SEQ ID NO: 3738265 - RNA, 19 nt, Human
gucucgaacuccugaccuu

SEQ ID NO: 3738266 - RNA, 14 nt, Human
gucucgagcgcccu

SEQ ID NO: 3738267 - RNA, 19 nt, Human
gucucgagcgcccugcaga

SEQ ID NO: 3738268 - RNA, 13 nt, Human
gucucgcucuguc

SEQ ID NO: 3738269 - RNA, 16 nt, Human
gucucgcuuuguugcc

SEQ ID NO: 3738270 - RNA, 23 nt, Human
gucucgcuuuguugcccaggcug

SEQ ID NO: 3738271 - RNA, 16 nt, Human
gucucguuugugauuc

SEQ ID NO: 3738272 - RNA, 21 nt, Human
gucucuaauucuauuaaagug

SEQ ID NO: 3738273 - RNA, 22 nt, Human
gucucuacuuuucccuguacuu

SEQ ID NO: 3738274 - RNA, 12 nt, Human
gucucuagagca

SEQ ID NO: 3738275 - RNA, 16 nt, Human
gucucuagccacuuug

SEQ ID NO: 3738276 - RNA, 17 nt, Human
gucucuaggcuggggaa

SEQ ID NO: 3738277 - RNA, 14 nt, Human
gucucuagugcugu

SEQ ID NO: 3738278 - RNA, 17 nt, Human
gucucuauaccaauaaa

SEQ ID NO: 3738279 - RNA, 20 nt, Human
gucucuauaccaauaaagug

SEQ ID NO: 3738280 - RNA, 21 nt, Human
gucucuauaccaauaaaguga

SEQ ID NO: 3738281 - RNA, 16 nt, Human
gucucuaucauuaaag

SEQ ID NO: 3738282 - RNA, 19 nt, Human
gucucuaucauuaaaguuc

SEQ ID NO: 3738283 - RNA, 17 nt, Human
gucucuauuuaaauucu

SEQ ID NO: 3738284 - RNA, 20 nt, Human
gucucuauuuaaauucuuuu

SEQ ID NO: 3738285 - RNA, 16 nt, Human
gucucucacagacagg

SEQ ID NO: 3738286 - RNA, 16 nt, Human
gucucucacagaugug

SEQ ID NO: 3738287 - RNA, 18 nt, Human
gucucucagggccaggcc

SEQ ID NO: 3738288 - RNA, 16 nt, Human
gucucucaugaaccuc

SEQ ID NO: 3738289 - RNA, 12 nt, Human
gucucuccuuuu

SEQ ID NO: 3738290 - RNA, 15 nt, Human
gucucuccuuuucuu

SEQ ID NO: 3738291 - RNA, 22 nt, Human
gucucuccuuuucuuuuguuac

SEQ ID NO: 3738292 - RNA, 23 nt, Human
gucucuccuuuucuuuuguuacu

SEQ ID NO: 3738293 - RNA, 18 nt, Human
gucucucuaugccucucu

SEQ ID NO: 3738294 - RNA, 22 nt, Human
gucucucuaugccucucuacag

SEQ ID NO: 3738295 - RNA, 14 nt, Human
gucucucucucucu

SEQ ID NO: 3738296 - RNA, 15 nt, Human
gucucucucucucua

SEQ ID NO: 3738297 - RNA, 19 nt, Human
gucucucucucucuacaaa

SEQ ID NO: 3738298 - RNA, 21 nt, Human
gucucucuucagacucucagc

SEQ ID NO: 3738299 - RNA, 19 nt, Human
gucucucuucucagagugg

SEQ ID NO: 3738300 - RNA, 14 nt, Human
gucucucuucucuc

SEQ ID NO: 3738301 - RNA, 11 nt, Human
gucucucuuug

SEQ ID NO: 3738302 - RNA, 19 nt, Human
gucucugaaguacuaacac

SEQ ID NO: 3738303 - RNA, 16 nt, Human
gucucugaugcagcuu

SEQ ID NO: 3738304 - RNA, 17 nt, Human
gucucugcaaacugccu

SEQ ID NO: 3738305 - RNA, 21 nt, Human
gucucugcauuuuucugcaga

SEQ ID NO: 3738306 - RNA, 21 nt, Human
gucucugccaugaacuggagg

SEQ ID NO: 3738307 - RNA, 15 nt, Human
gucucugccuugccu

SEQ ID NO: 3738308 - RNA, 14 nt, Human
gucucugcugcauu

SEQ ID NO: 3738309 - RNA, 15 nt, Human
gucucugcuggccca

SEQ ID NO: 3738310 - RNA, 20 nt, Human
gucucugcuggcccagccaa

SEQ ID NO: 3738311 - RNA, 21 nt, Human
gucucuggauuauauuaugaa

SEQ ID NO: 3738312 - RNA, 12 nt, Human
gucucuggccug

SEQ ID NO: 3738313 - RNA, 13 nt, Human
gucucugggccac

SEQ ID NO: 3738314 - RNA, 19 nt, Human
gucucugggccacuuggag

SEQ ID NO: 3738315 - RNA, 20 nt, Human
gucucugggccacuuggagu

SEQ ID NO: 3738316 - RNA, 19 nt, Human
gucucuggggcaggcugcu

SEQ ID NO: 3738317 - RNA, 16 nt, Human
gucucugguagccugc

SEQ ID NO: 3738318 - RNA, 17 nt, Human
gucucugguagccugca

SEQ ID NO: 3738319 - RNA, 14 nt, Human
gucucugugcuuug

SEQ ID NO: 3738320 - RNA, 11 nt, Human
gucucuucaga

SEQ ID NO: 3738321 - RNA, 14 nt, Human
gucucuucuccacu

SEQ ID NO: 3738322 - RNA, 15 nt, Human
gucucuucucccaga

SEQ ID NO: 3738323 - RNA, 16 nt, Human
gucucuucucccagaa

SEQ ID NO: 3738324 - RNA, 17 nt, Human
gucucuucucccagaau

SEQ ID NO: 3738325 - RNA, 23 nt, Human
gucucuucucccagaaucccagc

SEQ ID NO: 3738326 - RNA, 13 nt, Human
gucucuucuccuu

SEQ ID NO: 3738327 - RNA, 12 nt, Human
gucucuugcuug

SEQ ID NO: 3738328 - RNA, 18 nt, Human
gucucuugguccugcugc

SEQ ID NO: 3738329 - RNA, 19 nt, Human
gucucuugguccugcugca

SEQ ID NO: 3738330 - RNA, 20 nt, Human
gucucuugguccugcugcag

SEQ ID NO: 3738331 - RNA, 13 nt, Human
gucucuuguaauc

SEQ ID NO: 3738332 - RNA, 16 nt, Human
gucucuuguauuaaac

SEQ ID NO: 3738333 - RNA, 22 nt, Human
gucucuuuaaaaggaaagaaaa

SEQ ID NO: 3738334 - RNA, 17 nt, Human
gucucuuuaagggcaug

SEQ ID NO: 3738335 - RNA, 23 nt, Human
gucucuuuaaugucacaggcagg

SEQ ID NO: 3738336 - RNA, 17 nt, Human
gucucuuuuguaaauua

SEQ ID NO: 3738337 - RNA, 20 nt, Human
gucucuuuuuuuggcccagg

SEQ ID NO: 3738338 - RNA, 21 nt, Human
gucucuuuuuuuggcccaggc

SEQ ID NO: 3738339 - RNA, 14 nt, Human
gucugaaaauguug

SEQ ID NO: 3738340 - RNA, 17 nt, Human
guggcccugccaucuuc

SEQ ID NO: 3738341 - RNA, 21 nt, Human
guggcccugccaucuucccag

SEQ ID NO: 3738342 - RNA, 21 nt, Human
guggcccugcccucuccuucc

SEQ ID NO: 3738343 - RNA, 19 nt, Human
guggcccuggccugcuggg

SEQ ID NO: 3738344 - RNA, 16 nt, Human
guggcccugucccucc

SEQ ID NO: 3738345 - RNA, 20 nt, Human
guggcccuuaugacugccaa

SEQ ID NO: 3738346 - RNA, 15 nt, Human
guggcccuuccugga

SEQ ID NO: 3738347 - RNA, 16 nt, Human
guggcccuuccuggac

SEQ ID NO: 3738348 - RNA, 21 nt, Human
guggccucaacccucccucag

SEQ ID NO: 3738349 - RNA, 13 nt, Human
guggccucagaau

SEQ ID NO: 3738350 - RNA, 23 nt, Human
guggccucagcucccacaagccu

SEQ ID NO: 3738351 - RNA, 23 nt, Human
guggccucagcugaaugccuccu

SEQ ID NO: 3738352 - RNA, 13 nt, Human
guggccucccaac

SEQ ID NO: 3738353 - RNA, 21 nt, Human
guggccucuccuuguggccug

SEQ ID NO: 3738354 - RNA, 22 nt, Human
guggccucuccuuguggccugg

SEQ ID NO: 3738355 - RNA, 23 nt, Human
guggccucuccuuguggccuggg

SEQ ID NO: 3738356 - RNA, 20 nt, Human
guggccucugccccgucuca

SEQ ID NO: 3738357 - RNA, 13 nt, Human
guggccucuuugu

SEQ ID NO: 3738358 - RNA, 15 nt, Human
guggccuggucccug

SEQ ID NO: 3738359 - RNA, 15 nt, Human
guggccuguggccug

SEQ ID NO: 3738360 - RNA, 13 nt, Human
guggccugugugg

SEQ ID NO: 3738361 - RNA, 12 nt, Human
guggccuucccc

SEQ ID NO: 3738362 - RNA, 18 nt, Human
guggccuuccccagcaug

SEQ ID NO: 3738363 - RNA, 19 nt, Human
guggccuuccccagcaugc

SEQ ID NO: 3738364 - RNA, 21 nt, Human
guggccuuggccggcugugcu

SEQ ID NO: 3738365 - RNA, 20 nt, Human
guggccuuguucugucacca

SEQ ID NO: 3738366 - RNA, 19 nt, Human
guggccuuugcgcuccugg

SEQ ID NO: 3738367 - RNA, 22 nt, Human
guggcgcagcauauucaggaag

SEQ ID NO: 3738368 - RNA, 13 nt, Human
guggcggugccug

SEQ ID NO: 3738369 - RNA, 23 nt, Human
guggcuaaaggucccaaggcaag

SEQ ID NO: 3738370 - RNA, 18 nt, Human
guggcuacucugugccag

SEQ ID NO: 3738371 - RNA, 21 nt, Human
guggcuacucugugccagagc

SEQ ID NO: 3738372 - RNA, 23 nt, Human
guggcuacucugugccagagccu

SEQ ID NO: 3738373 - RNA, 22 nt, Human
guggcuagucaagcuccuccuc

SEQ ID NO: 3738374 - RNA, 20 nt, Human
guggcucaagucuggcccca

SEQ ID NO: 3738375 - RNA, 14 nt, Human
guggcucacgccug

SEQ ID NO: 3738376 - RNA, 23 nt, Human
guggcucacgccuguaaucccag

SEQ ID NO: 3738377 - RNA, 20 nt, Human
guggcucacgugugugacuc

SEQ ID NO: 3738378 - RNA, 14 nt, Human
guggcuccccucua

SEQ ID NO: 3738379 - RNA, 16 nt, Human
guggcucgggaggcga

SEQ ID NO: 3738380 - RNA, 19 nt, Human
guggcugacccagucccug

SEQ ID NO: 3738381 - RNA, 17 nt, Human
guggcugagccccuguc

SEQ ID NO: 3738382 - RNA, 17 nt, Human
guggcugaggaggccuc

SEQ ID NO: 3738383 - RNA, 17 nt, Human
guggcugaggccaccca

SEQ ID NO: 3738384 - RNA, 23 nt, Human
guggcugcagcagcgguggccuc

SEQ ID NO: 3738385 - RNA, 16 nt, Human
guggcugccucauuua

SEQ ID NO: 3738386 - RNA, 15 nt, Human
guggcugccuggagc

SEQ ID NO: 3738387 - RNA, 19 nt, Human
guggcugcuagcacuugga

SEQ ID NO: 3738388 - RNA, 12 nt, Human
guggcugcugcc

SEQ ID NO: 3738389 - RNA, 15 nt, Human
guggcugcugcccag

SEQ ID NO: 3738390 - RNA, 15 nt, Human
guggcugcuguggga

SEQ ID NO: 3738391 - RNA, 16 nt, Human
guggcugcuucaagga

SEQ ID NO: 3738392 - RNA, 22 nt, Human
guggcugcuucaaggauccuga

SEQ ID NO: 3738393 - RNA, 17 nt, Human
guggcuggaagauccug

SEQ ID NO: 3738394 - RNA, 20 nt, Human
guggcuggaagauccugcgg

SEQ ID NO: 3738395 - RNA, 11 nt, Human
guggcugggca

SEQ ID NO: 3738396 - RNA, 12 nt, Human
guggcugggcag

SEQ ID NO: 3738397 - RNA, 16 nt, Human
guggcugggggcagga

SEQ ID NO: 3738398 - RNA, 17 nt, Human
guggcugggggcaggag

SEQ ID NO: 3738399 - RNA, 22 nt, Human
guggcugggggcaggagggccc

SEQ ID NO: 3738400 - RNA, 18 nt, Human
guggcuggguuuacacgc

SEQ ID NO: 3738401 - RNA, 15 nt, Human
guggcugguccaggg

SEQ ID NO: 3738402 - RNA, 19 nt, Human
guggcuguccagugcccau

SEQ ID NO: 3738403 - RNA, 15 nt, Human
guggcugucuggaaa

SEQ ID NO: 3738404 - RNA, 23 nt, Human
guggcuguggagacaaugucugc

SEQ ID NO: 3738405 - RNA, 20 nt, Human
guggcuuacuacauguggga

SEQ ID NO: 3738406 - RNA, 19 nt, Human
guggcuucauuagagcagg

SEQ ID NO: 3738407 - RNA, 19 nt, Human
guggcuuuaggagcagugg

SEQ ID NO: 3738408 - RNA, 17 nt, Human
guggcuuucagagccuc

SEQ ID NO: 3738409 - RNA, 22 nt, Human
guggcuuugcauuuuaaaaaug

SEQ ID NO: 3738410 - RNA, 20 nt, Human
guggcuuuuuuccuccugug

SEQ ID NO: 3738411 - RNA, 12 nt, Human
gugggaaaacac

SEQ ID NO: 3738412 - RNA, 23 nt, Human
gugggaaagauuacuuuuucuuu

SEQ ID NO: 3738413 - RNA, 16 nt, Human
gugggaaaugguacug

SEQ ID NO: 3738414 - RNA, 20 nt, Human
gugggaacgagaggggaaga

SEQ ID NO: 3738415 - RNA, 21 nt, Human
gugggaacgagaggggaagag

SEQ ID NO: 3738416 - RNA, 17 nt, Human
gugggaagcgucugucc

SEQ ID NO: 3738417 - RNA, 20 nt, Human
gugggaaggacuuggcgcgc

SEQ ID NO: 3738418 - RNA, 14 nt, Human
gugggaagggagag

SEQ ID NO: 3738419 - RNA, 13 nt, Human
gugggacacccug

SEQ ID NO: 3738420 - RNA, 18 nt, Human
gugggacagcccagagcc

SEQ ID NO: 3738421 - RNA, 22 nt, Human
gugggacagcuuguaggggagg

SEQ ID NO: 3738422 - RNA, 21 nt, Human
gugggacagucaccucaugga

SEQ ID NO: 3738423 - RNA, 14 nt, Human
gugggaccccaggc

SEQ ID NO: 3738424 - RNA, 17 nt, Human
gugggaccccaggccca

SEQ ID NO: 3738425 - RNA, 17 nt, Human
gugggaccuagggaggc

SEQ ID NO: 3738426 - RNA, 22 nt, Human
gugggacuguacacacuuuauu

SEQ ID NO: 3738427 - RNA, 22 nt, Human
gugggagaccggccugccagga

SEQ ID NO: 3738428 - RNA, 14 nt, Human
gugggagagcccag

SEQ ID NO: 3738429 - RNA, 23 nt, Human
gugggagcaaacugcaugcccag

SEQ ID NO: 3738430 - RNA, 12 nt, Human
gugggagcagga

SEQ ID NO: 3738431 - RNA, 13 nt, Human
gugggagcaggag

SEQ ID NO: 3738432 - RNA, 15 nt, Human
gugggagcaggagau

SEQ ID NO: 3738433 - RNA, 18 nt, Human
gugggagcugccuguuca

SEQ ID NO: 3738434 - RNA, 17 nt, Human
gugggaggggcaggcug

SEQ ID NO: 3738435 - RNA, 21 nt, Human
gugggaggggcgcccaccucc

SEQ ID NO: 3738436 - RNA, 13 nt, Human
gugggagggggag

SEQ ID NO: 3738437 - RNA, 16 nt, Human
gugggaggucuugcua

SEQ ID NO: 3738438 - RNA, 13 nt, Human
gugggagugggcc

SEQ ID NO: 3738439 - RNA, 14 nt, Human
gugggagugggccc

SEQ ID NO: 3738440 - RNA, 17 nt, Human
gugggagugugugccug

SEQ ID NO: 3738441 - RNA, 15 nt, Human
gugggauccuccagg

SEQ ID NO: 3738442 - RNA, 18 nt, Human
gugggauccuccaggugc

SEQ ID NO: 3738443 - RNA, 19 nt, Human
gugggaucugccccucccu

SEQ ID NO: 3738444 - RNA, 16 nt, Human
gugggauggaggagaa

SEQ ID NO: 3738445 - RNA, 24 nt, Human
gugggauguucagcacugucccuu

SEQ ID NO: 3738446 - RNA, 22 nt, Human
gugggauuaugggucacaggaa

SEQ ID NO: 3738447 - RNA, 15 nt, Human
gugggauucagagaa

SEQ ID NO: 3738448 - RNA, 16 nt, Human
gugggcacuggcccag

SEQ ID NO: 3738449 - RNA, 18 nt, Human
gugggcaggugguggcac

SEQ ID NO: 3738450 - RNA, 17 nt, Human
gugggccaacaaagaac

SEQ ID NO: 3738451 - RNA, 13 nt, Human
gugggccagcccc

SEQ ID NO: 3738452 - RNA, 17 nt, Human
gugggccagccccuccc

SEQ ID NO: 3738453 - RNA, 19 nt, Human
gugggccagccccucccac

SEQ ID NO: 3738454 - RNA, 21 nt, Human
gugggccagggcugcccugag

SEQ ID NO: 3738455 - RNA, 17 nt, Human
gugggccagucugugga

SEQ ID NO: 3738456 - RNA, 19 nt, Human
gugggcccaggaccagcug

SEQ ID NO: 3738457 - RNA, 23 nt, Human
gugggcccaggaccagcuggggc

SEQ ID NO: 3738458 - RNA, 14 nt, Human
gugggccccacccu

SEQ ID NO: 3738459 - RNA, 19 nt, Human
gugggccucaaggacuuga

SEQ ID NO: 3738460 - RNA, 23 nt, Human
gugggccuccucuguccagggcc

SEQ ID NO: 3738461 - RNA, 18 nt, Human
gugggccugggcuccugg

SEQ ID NO: 3738462 - RNA, 20 nt, Human
gugggccugggcuccuggac

SEQ ID NO: 3738463 - RNA, 18 nt, Human
gugggccuugcuggggac

SEQ ID NO: 3738464 - RNA, 20 nt, Human
gugggccuuguccccugccu

SEQ ID NO: 3738465 - RNA, 22 nt, Human
gugggcgugagaccugccccuc

SEQ ID NO: 3738466 - RNA, 12 nt, Human
gugggcuaagca

SEQ ID NO: 3738467 - RNA, 15 nt, Human
gugggcuaguugggc

SEQ ID NO: 3738468 - RNA, 14 nt, Human
gugggcuccccucu

SEQ ID NO: 3738469 - RNA, 19 nt, Human
gugggcuccccucuuccuc

SEQ ID NO: 3738470 - RNA, 13 nt, Human
gugggcucccuuc

SEQ ID NO: 3738471 - RNA, 15 nt, Human
gugggcugagcccug

SEQ ID NO: 3738472 - RNA, 20 nt, Human
gugggcugcacucugugccc

SEQ ID NO: 3738473 - RNA, 16 nt, Human
gugggcuucccagugg

SEQ ID NO: 3738474 - RNA, 14 nt, Human
gugggcuugauucu

SEQ ID NO: 3738475 - RNA, 13 nt, Human
guggggacagggc

SEQ ID NO: 3738476 - RNA, 21 nt, Human
guggggacccaggcuccgccc

SEQ ID NO: 3738477 - RNA, 22 nt, Human
guggggagacaccucagagccc

SEQ ID NO: 3738478 - RNA, 13 nt, Human
guggggagggccg

SEQ ID NO: 3738479 - RNA, 12 nt, Human
guggggaguggg

SEQ ID NO: 3738480 - RNA, 15 nt, Human
guggggauugcccau

SEQ ID NO: 3738481 - RNA, 17 nt, Human
guggggauuucucccag

SEQ ID NO: 3738482 - RNA, 19 nt, Human
guggggcagcacagagagg

SEQ ID NO: 3738483 - RNA, 23 nt, Human
guggggcagcacagagagggggc

SEQ ID NO: 3738484 - RNA, 13 nt, Human
guggggcagggag

SEQ ID NO: 3738485 - RNA, 14 nt, Human
guggggcagugcuu

SEQ ID NO: 3738486 - RNA, 15 nt, Human
guggggccuagaucc

SEQ ID NO: 3738487 - RNA, 12 nt, Human
guggggccuggg

SEQ ID NO: 3738488 - RNA, 13 nt, Human
guggggccugugg

SEQ ID NO: 3738489 - RNA, 19 nt, Human
gucugaaaauguuguuaug

SEQ ID NO: 3738490 - RNA, 15 nt, Human
gucugaaacauuuca

SEQ ID NO: 3738491 - RNA, 16 nt, Human
gucugaaacauuucau

SEQ ID NO: 3738492 - RNA, 14 nt, Human
gucugaaggcuggg

SEQ ID NO: 3738493 - RNA, 16 nt, Human
gucugaagucacugca

SEQ ID NO: 3738494 - RNA, 17 nt, Human
gucugaagucacugcac

SEQ ID NO: 3738495 - RNA, 15 nt, Human
gucugaauguucuga

SEQ ID NO: 3738496 - RNA, 20 nt, Human
gucugaauguucugacauua

SEQ ID NO: 3738497 - RNA, 15 nt, Human
gucugacaggcaaug

SEQ ID NO: 3738498 - RNA, 14 nt, Human
gucugacccacugc

SEQ ID NO: 3738499 - RNA, 13 nt, Human
gucugacuguuuc

SEQ ID NO: 3738500 - RNA, 19 nt, Human
gucugacuuucuuuuuuga

SEQ ID NO: 3738501 - RNA, 22 nt, Human
gucugagacucacaggaaggag

SEQ ID NO: 3738502 - RNA, 13 nt, Human
gucugagagaggc

SEQ ID NO: 3738503 - RNA, 15 nt, Human
gucugagagaggcca

SEQ ID NO: 3738504 - RNA, 20 nt, Human
gucugagagcaaagugaccu

SEQ ID NO: 3738505 - RNA, 17 nt, Human
gucugagccaaagagaa

SEQ ID NO: 3738506 - RNA, 18 nt, Human
gucugagccaaagagaau

SEQ ID NO: 3738507 - RNA, 20 nt, Human
gucugagccacagcagcauu

SEQ ID NO: 3738508 - RNA, 14 nt, Human
gucugagguccuga

SEQ ID NO: 3738509 - RNA, 17 nt, Human
gucugagguccugagca

SEQ ID NO: 3738510 - RNA, 18 nt, Human
gucugagguccugagcac

SEQ ID NO: 3738511 - RNA, 19 nt, Human
gucugagguccugagcacu

SEQ ID NO: 3738512 - RNA, 23 nt, Human
gucugaguggcuucacuccugcu

SEQ ID NO: 3738513 - RNA, 19 nt, Human
gucugaucgugacgcugaa

SEQ ID NO: 3738514 - RNA, 17 nt, Human
gucugaucugugcuuuc

SEQ ID NO: 3738515 - RNA, 23 nt, Human
gucugaucugugcuuuccagcuc

SEQ ID NO: 3738516 - RNA, 21 nt, Human
gucugauucccaagcucugcu

SEQ ID NO: 3738517 - RNA, 13 nt, Human
gucugauuggcuu

SEQ ID NO: 3738518 - RNA, 18 nt, Human
gucugauuggcuuguaga

SEQ ID NO: 3738519 - RNA, 19 nt, Human
gucugauuggcuuguagaa

SEQ ID NO: 3738520 - RNA, 21 nt, Human
gucugcaaaaugaggaaugua

SEQ ID NO: 3738521 - RNA, 23 nt, Human
gucugcaacuuuaagcagcucuu

SEQ ID NO: 3738522 - RNA, 14 nt, Human
gucugcaagucaga

SEQ ID NO: 3738523 - RNA, 19 nt, Human
gucugcaagucagaggaug

SEQ ID NO: 3738524 - RNA, 16 nt, Human
gucugcacaugcagcu

SEQ ID NO: 3738525 - RNA, 15 nt, Human
gucugcacccagggg

SEQ ID NO: 3738526 - RNA, 22 nt, Human
gucugcacucuaacccuaggca

SEQ ID NO: 3738527 - RNA, 18 nt, Human
gucugcagcccggcgcca

SEQ ID NO: 3738528 - RNA, 12 nt, Human
gucugcaggcag

SEQ ID NO: 3738529 - RNA, 15 nt, Human
gucugcauuuucuga

SEQ ID NO: 3738530 - RNA, 17 nt, Human
gucugccacccaggauc

SEQ ID NO: 3738531 - RNA, 17 nt, Human
gucugccagccagcagc

SEQ ID NO: 3738532 - RNA, 18 nt, Human
gucugccagccagcagcc

SEQ ID NO: 3738533 - RNA, 14 nt, Human
gucugccaggcccc

SEQ ID NO: 3738534 - RNA, 21 nt, Human
gucugccauguugccccuuuc

SEQ ID NO: 3738535 - RNA, 12 nt, Human
gucugccccagc

SEQ ID NO: 3738536 - RNA, 17 nt, Human
gucugcccucugcaucc

SEQ ID NO: 3738537 - RNA, 23 nt, Human
gucugccggacccggaggccgag

SEQ ID NO: 3738538 - RNA, 14 nt, Human
gucugcgaaguccu

SEQ ID NO: 3738539 - RNA, 15 nt, Human
gucugcgaaguccua

SEQ ID NO: 3738540 - RNA, 15 nt, Human
gucugcgugggucag

SEQ ID NO: 3738541 - RNA, 15 nt, Human
gucugcuauauuuuc

SEQ ID NO: 3738542 - RNA, 21 nt, Human
gucugcucuagaugagcuggg

SEQ ID NO: 3738543 - RNA, 17 nt, Human
gucugcucuuucucugc

SEQ ID NO: 3738544 - RNA, 19 nt, Human
gucugcugcccuccauccc

SEQ ID NO: 3738545 - RNA, 20 nt, Human
gucugcuggucacuucuucu

SEQ ID NO: 3738546 - RNA, 16 nt, Human
gucugcuguuccagug

SEQ ID NO: 3738547 - RNA, 23 nt, Human
gucugcuucugcaccuuaucuua

SEQ ID NO: 3738548 - RNA, 22 nt, Human
gucugcuuuaaagggccugccu

SEQ ID NO: 3738549 - RNA, 19 nt, Human
gucuggaagaaagauaaaa

SEQ ID NO: 3738550 - RNA, 14 nt, Human
gucuggaaguccaa

SEQ ID NO: 3738551 - RNA, 18 nt, Human
gucuggacugacagcaug

SEQ ID NO: 3738552 - RNA, 17 nt, Human
gucuggagaagcaguga

SEQ ID NO: 3738553 - RNA, 19 nt, Human
gucuggagaagcagugagc

SEQ ID NO: 3738554 - RNA, 21 nt, Human
gucuggagaagcucccaggaa

SEQ ID NO: 3738555 - RNA, 22 nt, Human
gucuggagaagcucccaggaac

SEQ ID NO: 3738556 - RNA, 18 nt, Human
gucuggagaauaauucuu

SEQ ID NO: 3738557 - RNA, 10 nt, Human
gucuggaggg

SEQ ID NO: 3738558 - RNA, 14 nt, Human
gucuggagugggca

SEQ ID NO: 3738559 - RNA, 18 nt, Human
gucuggagugggcagagc

SEQ ID NO: 3738560 - RNA, 19 nt, Human
gucuggagugggcagagcc

SEQ ID NO: 3738561 - RNA, 16 nt, Human
gucuggcaaugccaca

SEQ ID NO: 3738562 - RNA, 18 nt, Human
gucuggcaaugccacagc

SEQ ID NO: 3738563 - RNA, 13 nt, Human
gucuggcacagcc

SEQ ID NO: 3738564 - RNA, 17 nt, Human
gucuggcacagccuggc

SEQ ID NO: 3738565 - RNA, 12 nt, Human
gucuggcagccu

SEQ ID NO: 3738566 - RNA, 19 nt, Human
gucuggcaguuuauauuua

SEQ ID NO: 3738567 - RNA, 12 nt, Human
gucuggcugcag

SEQ ID NO: 3738568 - RNA, 14 nt, Human
gucuggcugcagag

SEQ ID NO: 3738569 - RNA, 22 nt, Human
gucugggaaaugagcagggaug

SEQ ID NO: 3738570 - RNA, 14 nt, Human
gucugggacacaaa

SEQ ID NO: 3738571 - RNA, 16 nt, Human
gucugggagaaauuga

SEQ ID NO: 3738572 - RNA, 11 nt, Human
gucugggcuga

SEQ ID NO: 3738573 - RNA, 14 nt, Human
gucugggggucagg

SEQ ID NO: 3738574 - RNA, 20 nt, Human
gucugggugcuacuggggaa

SEQ ID NO: 3738575 - RNA, 20 nt, Human
gucuggucacacacaggugu

SEQ ID NO: 3738576 - RNA, 13 nt, Human
gucugguggcccc

SEQ ID NO: 3738577 - RNA, 18 nt, Human
gucugguucucaauucca

SEQ ID NO: 3738578 - RNA, 18 nt, Human
gucugguugggcagccag

SEQ ID NO: 3738579 - RNA, 22 nt, Human
gucugguuucaccgaggacaug

SEQ ID NO: 3738580 - RNA, 13 nt, Human
gucugguuucuag

SEQ ID NO: 3738581 - RNA, 21 nt, Human
gucugguuuuaacaauuuccu

SEQ ID NO: 3738582 - RNA, 14 nt, Human
gucuguaaaaucuu

SEQ ID NO: 3738583 - RNA, 14 nt, Human
gucuguagagggcc

SEQ ID NO: 3738584 - RNA, 18 nt, Human
gucuguagguugcacacu

SEQ ID NO: 3738585 - RNA, 13 nt, Human
gucuguccaucug

SEQ ID NO: 3738586 - RNA, 14 nt, Human
gucuguccaucugc

SEQ ID NO: 3738587 - RNA, 19 nt, Human
gucugucccaguuaacugu

SEQ ID NO: 3738588 - RNA, 23 nt, Human
gucugucccgggguccuguggca

SEQ ID NO: 3738589 - RNA, 17 nt, Human
gucuguccguguuauuu

SEQ ID NO: 3738590 - RNA, 14 nt, Human
gucugucuuccuuu

SEQ ID NO: 3738591 - RNA, 12 nt, Human
gucugucuucug

SEQ ID NO: 3738592 - RNA, 16 nt, Human
gucugucuuuccugaa

SEQ ID NO: 3738593 - RNA, 18 nt, Human
gucugugaacagagagac

SEQ ID NO: 3738594 - RNA, 22 nt, Human
gucugugaagugagaccuuccu

SEQ ID NO: 3738595 - RNA, 20 nt, Human
gucugugaccugcaucuaag

SEQ ID NO: 3738596 - RNA, 16 nt, Human
gucugugagaugcuag

SEQ ID NO: 3738597 - RNA, 23 nt, Human
gucugugagaugcuagaacuccc

SEQ ID NO: 3738598 - RNA, 22 nt, Human
gucugugccccuuccgccacug

SEQ ID NO: 3738599 - RNA, 16 nt, Human
gucugugccuggagcu

SEQ ID NO: 3738600 - RNA, 17 nt, Human
gucugugccuggagcuc

SEQ ID NO: 3738601 - RNA, 12 nt, Human
gucugugcuagg

SEQ ID NO: 3738602 - RNA, 14 nt, Human
gucugugcugaggc

SEQ ID NO: 3738603 - RNA, 14 nt, Human
gucugugugaaugu

SEQ ID NO: 3738604 - RNA, 16 nt, Human
gucugugugggacugu

SEQ ID NO: 3738605 - RNA, 21 nt, Human
gucugugugugugugugugcg

SEQ ID NO: 3738606 - RNA, 11 nt, Human
gucuguguguu

SEQ ID NO: 3738607 - RNA, 22 nt, Human
gucuguguugcgugucgugggu

SEQ ID NO: 3738608 - RNA, 15 nt, Human
gucuguuaccauguc

SEQ ID NO: 3738609 - RNA, 20 nt, Human
gucuguuaccaugucacugu

SEQ ID NO: 3738610 - RNA, 17 nt, Human
gucuguucacuuuuccu

SEQ ID NO: 3738611 - RNA, 21 nt, Human
gucuguuccccauggccacuu

SEQ ID NO: 3738612 - RNA, 17 nt, Human
gucuguucuuuccaaag

SEQ ID NO: 3738613 - RNA, 16 nt, Human
gucuguugauuaaaga

SEQ ID NO: 3738614 - RNA, 19 nt, Human
gucuguugauuaaagauga

SEQ ID NO: 3738615 - RNA, 14 nt, Human
gucuguuggcaggc

SEQ ID NO: 3738616 - RNA, 18 nt, Human
gucuguuggcaggcuggc

SEQ ID NO: 3738617 - RNA, 22 nt, Human
gucuguuggcaggcuggccagu

SEQ ID NO: 3738618 - RNA, 22 nt, Human
gucuguugugugucaugccagu

SEQ ID NO: 3738619 - RNA, 13 nt, Human
gucuguuuaaagu

SEQ ID NO: 3738620 - RNA, 14 nt, Human
gucuguuuaaagug

SEQ ID NO: 3738621 - RNA, 14 nt, Human
gucuguuuguuuca

SEQ ID NO: 3738622 - RNA, 17 nt, Human
gucuguuuguuucaaga

SEQ ID NO: 3738623 - RNA, 18 nt, Human
gucuguuuguuucaagaa

SEQ ID NO: 3738624 - RNA, 23 nt, Human
gucuguuuguuucaagaaccugg

SEQ ID NO: 3738625 - RNA, 20 nt, Human
gucuguuuuaaaaaccuguu

SEQ ID NO: 3738626 - RNA, 13 nt, Human
gucuuaaaaccug

SEQ ID NO: 3738627 - RNA, 15 nt, Human
gucuuaaaauaacuu

SEQ ID NO: 3738628 - RNA, 13 nt, Human
gucuuaaauaaaa

SEQ ID NO: 3738629 - RNA, 16 nt, Human
gucuuaaauaaaagaa

SEQ ID NO: 3738630 - RNA, 13 nt, Human
gucuuaaggacaa

SEQ ID NO: 3738631 - RNA, 20 nt, Human
gucuuaaugaaguuugaaug

SEQ ID NO: 3738632 - RNA, 18 nt, Human
gucuuaauuauuauuugu

SEQ ID NO: 3738633 - RNA, 19 nt, Human
gucuuaauuauuauuugug

SEQ ID NO: 3738634 - RNA, 22 nt, Human
gucuuaucugagcugagccagg

SEQ ID NO: 3738635 - RNA, 17 nt, Human
gucuucaaacugugaag

SEQ ID NO: 3738636 - RNA, 17 nt, Human
gucuucaacauccugcc

SEQ ID NO: 3738637 - RNA, 18 nt, Human
gucuucaacauccugcca

SEQ ID NO: 3738638 - RNA, 20 nt, Human
gucuucaacauccugccagc

SEQ ID NO: 3738639 - RNA, 15 nt, Human
gaggacagcuugagc

SEQ ID NO: 3738640 - RNA, 18 nt, Human
gaggacagcuugagccgg

SEQ ID NO: 3738641 - RNA, 23 nt, Human
gaggacagggaggugaccccagg

SEQ ID NO: 3738642 - RNA, 18 nt, Human
gaggacaugauggagcgc

SEQ ID NO: 3738643 - RNA, 21 nt, Human
gaggaccacaggugugagcca

SEQ ID NO: 3738644 - RNA, 13 nt, Human
gaggaccagcaca

SEQ ID NO: 3738645 - RNA, 19 nt, Human
gaggaccagggcagggcca

SEQ ID NO: 3738646 - RNA, 14 nt, Human
gaggacccaggaca

SEQ ID NO: 3738647 - RNA, 15 nt, Human
gaggacccagggcuc

SEQ ID NO: 3738648 - RNA, 13 nt, Human
gaggaccucuggg

SEQ ID NO: 3738649 - RNA, 14 nt, Human
gaggaccucugggc

SEQ ID NO: 3738650 - RNA, 12 nt, Human
gaggaccugagc

SEQ ID NO: 3738651 - RNA, 15 nt, Human
gaggaccugagccug

SEQ ID NO: 3738652 - RNA, 17 nt, Human
gaggaccugagccugcc

SEQ ID NO: 3738653 - RNA, 18 nt, Human
gaggaccugagccugccg

SEQ ID NO: 3738654 - RNA, 16 nt, Human
gaggaccuguauuuaa

SEQ ID NO: 3738655 - RNA, 22 nt, Human
gaggaccuguauuuaagcaaau

SEQ ID NO: 3738656 - RNA, 22 nt, Human
gaggacgagcgauugaggugua

SEQ ID NO: 3738657 - RNA, 18 nt, Human
gaggacucccaacccugg

SEQ ID NO: 3738658 - RNA, 23 nt, Human
gaggacugccccgugcagacugg

SEQ ID NO: 3738659 - RNA, 13 nt, Human
gaggacuguauuu

SEQ ID NO: 3738660 - RNA, 23 nt, Human
gaggacuguugacauccaagcuu

SEQ ID NO: 3738661 - RNA, 14 nt, Human
gaggacuugugucu

SEQ ID NO: 3738662 - RNA, 22 nt, Human
gaggacuugugucucugugcuu

SEQ ID NO: 3738663 - RNA, 23 nt, Human
gaggacuuugauugcacauuguu

SEQ ID NO: 3738664 - RNA, 15 nt, Human
gaggagacauuggcu

SEQ ID NO: 3738665 - RNA, 13 nt, Human
gaggagagaagaa

SEQ ID NO: 3738666 - RNA, 14 nt, Human
gaggagagaagaau

SEQ ID NO: 3738667 - RNA, 12 nt, Human
gaggagagagga

SEQ ID NO: 3738668 - RNA, 15 nt, Human
gaggagagucccaga

SEQ ID NO: 3738669 - RNA, 17 nt, Human
gaggagagucccagagc

SEQ ID NO: 3738670 - RNA, 16 nt, Human
gaggagcaaaggcuga

SEQ ID NO: 3738671 - RNA, 15 nt, Human
gaggagcagcaggag

SEQ ID NO: 3738672 - RNA, 21 nt, Human
gaggagcagcaggagggggga

SEQ ID NO: 3738673 - RNA, 16 nt, Human
gaggagccagacagac

SEQ ID NO: 3738674 - RNA, 23 nt, Human
gaggagcccacgacacugcagcc

SEQ ID NO: 3738675 - RNA, 14 nt, Human
gaggagccccagcu

SEQ ID NO: 3738676 - RNA, 18 nt, Human
gaggagccccaucugucu

SEQ ID NO: 3738677 - RNA, 21 nt, Human
gaggagcccccacccuguucc

SEQ ID NO: 3738678 - RNA, 11 nt, Human
gaggagccuuu

SEQ ID NO: 3738679 - RNA, 11 nt, Human
gaggagcugcu

SEQ ID NO: 3738680 - RNA, 13 nt, Human
gaggagcugcugg

SEQ ID NO: 3738681 - RNA, 15 nt, Human
gaggagcugcuggcu

SEQ ID NO: 3738682 - RNA, 19 nt, Human
gaggagcugggagccgggc

SEQ ID NO: 3738683 - RNA, 14 nt, Human
gaggagcuucuggg

SEQ ID NO: 3738684 - RNA, 16 nt, Human
gaggaggaaggcaaga

SEQ ID NO: 3738685 - RNA, 23 nt, Human
gaggaggaugucccugggccagg

SEQ ID NO: 3738686 - RNA, 18 nt, Human
gaggaggcaauugggaug

SEQ ID NO: 3738687 - RNA, 19 nt, Human
gaggaggccaccucuccaa

SEQ ID NO: 3738688 - RNA, 18 nt, Human
gaggaggcuccagagggc

SEQ ID NO: 3738689 - RNA, 17 nt, Human
gaggagggagagggagg

SEQ ID NO: 3738690 - RNA, 19 nt, Human
gaggagggaugcugccuga

SEQ ID NO: 3738691 - RNA, 11 nt, Human
gaggaggggag

SEQ ID NO: 3738692 - RNA, 21 nt, Human
gaggaggggccccccugcccu

SEQ ID NO: 3738693 - RNA, 20 nt, Human
gaggagggucggugccuuca

SEQ ID NO: 3738694 - RNA, 12 nt, Human
gaggaggguggg

SEQ ID NO: 3738695 - RNA, 22 nt, Human
gaggagguggcagcccuguagg

SEQ ID NO: 3738696 - RNA, 19 nt, Human
gaggaggugucucaggcug

SEQ ID NO: 3738697 - RNA, 22 nt, Human
gaggaggugucucaggcugccu

SEQ ID NO: 3738698 - RNA, 13 nt, Human
gaggagguuggga

SEQ ID NO: 3738699 - RNA, 12 nt, Human
gaggaguaacaa

SEQ ID NO: 3738700 - RNA, 20 nt, Human
gaggaguaacaauacaaaug

SEQ ID NO: 3738701 - RNA, 15 nt, Human
gaggaguacagguga

SEQ ID NO: 3738702 - RNA, 13 nt, Human
gaggagucugagg

SEQ ID NO: 3738703 - RNA, 18 nt, Human
gaggagucugagguccug

SEQ ID NO: 3738704 - RNA, 17 nt, Human
gaggagugguuuuucuu

SEQ ID NO: 3738705 - RNA, 18 nt, Human
gaggaguucaaugaucua

SEQ ID NO: 3738706 - RNA, 16 nt, Human
gaggaguuucgaggua

SEQ ID NO: 3738707 - RNA, 20 nt, Human
gaggaguuucgagguagagu

SEQ ID NO: 3738708 - RNA, 23 nt, Human
gaggaguuugggguaugggagag

SEQ ID NO: 3738709 - RNA, 23 nt, Human
gaggauaggaguucacuucaucu

SEQ ID NO: 3738710 - RNA, 17 nt, Human
gaggaucacuggagccc

SEQ ID NO: 3738711 - RNA, 14 nt, Human
gaggaucaguuuuu

SEQ ID NO: 3738712 - RNA, 17 nt, Human
gaggaucccucucugga

SEQ ID NO: 3738713 - RNA, 16 nt, Human
gaggaugagagcccag

SEQ ID NO: 3738714 - RNA, 20 nt, Human
gaggaugagagcccagaggu

SEQ ID NO: 3738715 - RNA, 17 nt, Human
gaggaugcuaaaaaugu

SEQ ID NO: 3738716 - RNA, 13 nt, Human
gaggauggagaga

SEQ ID NO: 3738717 - RNA, 15 nt, Human
gaggauggagagagg

SEQ ID NO: 3738718 - RNA, 13 nt, Human
gaggaugggcucg

SEQ ID NO: 3738719 - RNA, 22 nt, Human
gaggaugguagaaguuuggcug

SEQ ID NO: 3738720 - RNA, 20 nt, Human
gaggaugucccugggccagg

SEQ ID NO: 3738721 - RNA, 16 nt, Human
gaggaugugggcagcu

SEQ ID NO: 3738722 - RNA, 20 nt, Human
gaggauguucugggacacag

SEQ ID NO: 3738723 - RNA, 19 nt, Human
gaggauugcuugagcccag

SEQ ID NO: 3738724 - RNA, 20 nt, Human
gaggauuggcucccaucuuu

SEQ ID NO: 3738725 - RNA, 17 nt, Human
gaggauuguugaaucua

SEQ ID NO: 3738726 - RNA, 16 nt, Human
gaggcaaagcuggcuc

SEQ ID NO: 3738727 - RNA, 13 nt, Human
gaggcaagcccug

SEQ ID NO: 3738728 - RNA, 18 nt, Human
gaggcaagguuauaugca

SEQ ID NO: 3738729 - RNA, 21 nt, Human
gaggcaaugucaggaacagaa

SEQ ID NO: 3738730 - RNA, 13 nt, Human
gaggcacaagaau

SEQ ID NO: 3738731 - RNA, 11 nt, Human
gaggcacagca

SEQ ID NO: 3738732 - RNA, 14 nt, Human
gaggcacagcaaac

SEQ ID NO: 3738733 - RNA, 17 nt, Human
gaggcaccaggaagccg

SEQ ID NO: 3738734 - RNA, 23 nt, Human
gaggcagaaagcagaggcuggcc

SEQ ID NO: 3738735 - RNA, 23 nt, Human
gaggcagaagaauugaacccagg

SEQ ID NO: 3738736 - RNA, 19 nt, Human
gaggcagacagcagcucag

SEQ ID NO: 3738737 - RNA, 20 nt, Human
gaggcagacagcagcucagg

SEQ ID NO: 3738738 - RNA, 22 nt, Human
gaggcagacagcagcucaggca

SEQ ID NO: 3738739 - RNA, 18 nt, Human
gaggcagagaagaaagaa

SEQ ID NO: 3738740 - RNA, 11 nt, Human
gaggcagagag

SEQ ID NO: 3738741 - RNA, 13 nt, Human
gaggcagagagcg

SEQ ID NO: 3738742 - RNA, 13 nt, Human
gaggcagaggaca

SEQ ID NO: 3738743 - RNA, 14 nt, Human
gaggcagaggacag

SEQ ID NO: 3738744 - RNA, 16 nt, Human
gaggcagagugcccca

SEQ ID NO: 3738745 - RNA, 15 nt, Human
gaggcagcaggacug

SEQ ID NO: 3738746 - RNA, 17 nt, Human
gaggcagcaggacuguc

SEQ ID NO: 3738747 - RNA, 13 nt, Human
gaggcagccccau

SEQ ID NO: 3738748 - RNA, 18 nt, Human
gaggcagccccauucugc

SEQ ID NO: 3738749 - RNA, 12 nt, Human
gaggcagcccgc

SEQ ID NO: 3738750 - RNA, 21 nt, Human
gaggcagcgugaaagcagaug

SEQ ID NO: 3738751 - RNA, 19 nt, Human
gaggcaggcauggcccugg

SEQ ID NO: 3738752 - RNA, 14 nt, Human
gaggcagggaagga

SEQ ID NO: 3738753 - RNA, 17 nt, Human
gaggcagggaggcagcc

SEQ ID NO: 3738754 - RNA, 17 nt, Human
gaggcagggaggggacu

SEQ ID NO: 3738755 - RNA, 23 nt, Human
gaggcagggcaaaugacaugcac

SEQ ID NO: 3738756 - RNA, 20 nt, Human
gaggcagggccuugcccaga

SEQ ID NO: 3738757 - RNA, 22 nt, Human
gaggcagggccuugcccagaga

SEQ ID NO: 3738758 - RNA, 15 nt, Human
gaggcaggggcggag

SEQ ID NO: 3738759 - RNA, 16 nt, Human
gaggcaggggcuuccu

SEQ ID NO: 3738760 - RNA, 13 nt, Human
gaggcagggucag

SEQ ID NO: 3738761 - RNA, 16 nt, Human
gaggcagguccccaga

SEQ ID NO: 3738762 - RNA, 18 nt, Human
gaggcaggugacagugag

SEQ ID NO: 3738763 - RNA, 15 nt, Human
gaggcaggugagaga

SEQ ID NO: 3738764 - RNA, 22 nt, Human
gaggcaguaccugggcaagcug

SEQ ID NO: 3738765 - RNA, 14 nt, Human
gaggcagugggucc

SEQ ID NO: 3738766 - RNA, 20 nt, Human
gaggcaguugcccagccucu

SEQ ID NO: 3738767 - RNA, 14 nt, Human
gaggcauaaagacu

SEQ ID NO: 3738768 - RNA, 18 nt, Human
gaggcauccagcagucuc

SEQ ID NO: 3738769 - RNA, 19 nt, Human
gaggcauccuacccuuuuc

SEQ ID NO: 3738770 - RNA, 17 nt, Human
gaggcauggcccugggg

SEQ ID NO: 3738771 - RNA, 18 nt, Human
gaggccaaacaggcccuc

SEQ ID NO: 3738772 - RNA, 17 nt, Human
gaggccaaaggcuggug

SEQ ID NO: 3738773 - RNA, 18 nt, Human
gaggccaagaauauugca

SEQ ID NO: 3738774 - RNA, 16 nt, Human
gaggccaagaguggcc

SEQ ID NO: 3738775 - RNA, 17 nt, Human
gaggccaagaguggccc

SEQ ID NO: 3738776 - RNA, 22 nt, Human
gaggccaaggugggaggauugc

SEQ ID NO: 3738777 - RNA, 15 nt, Human
gaggccaagugcagg

SEQ ID NO: 3738778 - RNA, 16 nt, Human
gaggccacaugagucc

SEQ ID NO: 3738779 - RNA, 12 nt, Human
gaggccaccucc

SEQ ID NO: 3738780 - RNA, 14 nt, Human
gaggccaccucucc

SEQ ID NO: 3738781 - RNA, 16 nt, Human
gaggccaccucuccaa

SEQ ID NO: 3738782 - RNA, 17 nt, Human
gaggccaccucuccaag

SEQ ID NO: 3738783 - RNA, 15 nt, Human
gaggccacugaagag

SEQ ID NO: 3738784 - RNA, 17 nt, Human
gaggccacugaagagga

SEQ ID NO: 3738785 - RNA, 13 nt, Human
gaggccagagaca

SEQ ID NO: 3738786 - RNA, 16 nt, Human
gaggccagccccaccc

SEQ ID NO: 3738787 - RNA, 18 nt, Human
gaggccagccccacccag

SEQ ID NO: 3738788 - RNA, 22 nt, Human
gaggccagccccacccaggagg

SEQ ID NO: 3738789 - RNA, 11 nt, Human
gaggccagccu

SEQ ID NO: 3738790 - RNA, 19 nt, Human
guggggccuguggaaugag

SEQ ID NO: 3738791 - RNA, 15 nt, Human
guggggcucccgccu

SEQ ID NO: 3738792 - RNA, 17 nt, Human
guggggcucgccaugcc

SEQ ID NO: 3738793 - RNA, 12 nt, Human
guggggcugcuc

SEQ ID NO: 3738794 - RNA, 12 nt, Human
guggggcuuggc

SEQ ID NO: 3738795 - RNA, 13 nt, Human
guggggcuuggcg

SEQ ID NO: 3738796 - RNA, 15 nt, Human
guggggcuuggcgug

SEQ ID NO: 3738797 - RNA, 17 nt, Human
gugggggaagaccuggc

SEQ ID NO: 3738798 - RNA, 21 nt, Human
gugggggaagagcacagcccu

SEQ ID NO: 3738799 - RNA, 20 nt, Human
gugggggaucacagccucug

SEQ ID NO: 3738800 - RNA, 18 nt, Human
gugggggccaccugccug

SEQ ID NO: 3738801 - RNA, 12 nt, Human
gugggggcugca

SEQ ID NO: 3738802 - RNA, 12 nt, Human
guggggggaggc

SEQ ID NO: 3738803 - RNA, 23 nt, Human
guggggggggggcgcggcuggga

SEQ ID NO: 3738804 - RNA, 18 nt, Human
guggggggggugcugggc

SEQ ID NO: 3738805 - RNA, 13 nt, Human
gugggggguccuu

SEQ ID NO: 3738806 - RNA, 19 nt, Human
guggggguagagcugaucc

SEQ ID NO: 3738807 - RNA, 16 nt, Human
gugggggucugugugu

SEQ ID NO: 3738808 - RNA, 20 nt, Human
guggggguggaggcuuccug

SEQ ID NO: 3738809 - RNA, 14 nt, Human
guggggguggguca

SEQ ID NO: 3738810 - RNA, 21 nt, Human
guggggucacucuggcagcuc

SEQ ID NO: 3738811 - RNA, 22 nt, Human
guggggucacucuggcagcuca

SEQ ID NO: 3738812 - RNA, 15 nt, Human
guggggucaugcccu

SEQ ID NO: 3738813 - RNA, 20 nt, Human
guggggucuccucaggacca

SEQ ID NO: 3738814 - RNA, 13 nt, Human
gugggguggcugc

SEQ ID NO: 3738815 - RNA, 15 nt, Human
gugggguggcugcag

SEQ ID NO: 3738816 - RNA, 22 nt, Human
guggguaauccaggcacagcug

SEQ ID NO: 3738817 - RNA, 20 nt, Human
guggguacccccaggaccag

SEQ ID NO: 3738818 - RNA, 21 nt, Human
guggguagguuggacuggaaa

SEQ ID NO: 3738819 - RNA, 14 nt, Human
gugggucaaggaau

SEQ ID NO: 3738820 - RNA, 14 nt, Human
gugggucagaaccc

SEQ ID NO: 3738821 - RNA, 19 nt, Human
guggguccaggggccccuc

SEQ ID NO: 3738822 - RNA, 23 nt, Human
guggguccaggggccccuccagc

SEQ ID NO: 3738823 - RNA, 20 nt, Human
guggguccaugggcagagcc

SEQ ID NO: 3738824 - RNA, 21 nt, Human
gugggucccacuuccccuccu

SEQ ID NO: 3738825 - RNA, 18 nt, Human
gugggucccggcucugug

SEQ ID NO: 3738826 - RNA, 18 nt, Human
guggguccugaggccugc

SEQ ID NO: 3738827 - RNA, 13 nt, Human
gugggucugugug

SEQ ID NO: 3738828 - RNA, 13 nt, Human
gugggucuucagg

SEQ ID NO: 3738829 - RNA, 23 nt, Human
gugggugagaugcuggagaagag

SEQ ID NO: 3738830 - RNA, 15 nt, Human
guggguggggcagug

SEQ ID NO: 3738831 - RNA, 14 nt, Human
guggguggugggga

SEQ ID NO: 3738832 - RNA, 13 nt, Human
guggguugcuaac

SEQ ID NO: 3738833 - RNA, 18 nt, Human
guggguuuguggggggag

SEQ ID NO: 3738834 - RNA, 16 nt, Human
guggguuuucuuccca

SEQ ID NO: 3738835 - RNA, 18 nt, Human
gugguaagagaauguuau

SEQ ID NO: 3738836 - RNA, 21 nt, Human
gugguaagcaacauggcuuug

SEQ ID NO: 3738837 - RNA, 16 nt, Human
gugguaagcucuggcu

SEQ ID NO: 3738838 - RNA, 15 nt, Human
gugguacagagaagc

SEQ ID NO: 3738839 - RNA, 18 nt, Human
gugguacagagaagccag

SEQ ID NO: 3738840 - RNA, 13 nt, Human
gugguagagaagc

SEQ ID NO: 3738841 - RNA, 21 nt, Human
gugguagguacuuuuugugaa

SEQ ID NO: 3738842 - RNA, 18 nt, Human
gugguaguaaaacacaga

SEQ ID NO: 3738843 - RNA, 20 nt, Human
gugguaguaaaacacagagg

SEQ ID NO: 3738844 - RNA, 16 nt, Human
gugguauccugugaca

SEQ ID NO: 3738845 - RNA, 14 nt, Human
gugguaugucugcc

SEQ ID NO: 3738846 - RNA, 22 nt, Human
guggucacaacuugauggcugc

SEQ ID NO: 3738847 - RNA, 15 nt, Human
guggucacagcggag

SEQ ID NO: 3738848 - RNA, 14 nt, Human
guggucacagcugu

SEQ ID NO: 3738849 - RNA, 18 nt, Human
gugguccauggaaugcuu

SEQ ID NO: 3738850 - RNA, 14 nt, Human
guggucccacccca

SEQ ID NO: 3738851 - RNA, 16 nt, Human
guggucccaccccaca

SEQ ID NO: 3738852 - RNA, 17 nt, Human
guggucccaccccacac

SEQ ID NO: 3738853 - RNA, 18 nt, Human
gugguccuaaucuucuga

SEQ ID NO: 3738854 - RNA, 12 nt, Human
gugguccugacu

SEQ ID NO: 3738855 - RNA, 16 nt, Human
guggucggugggaccc

SEQ ID NO: 3738856 - RNA, 11 nt, Human
guggucucagg

SEQ ID NO: 3738857 - RNA, 12 nt, Human
guggucucagga

SEQ ID NO: 3738858 - RNA, 21 nt, Human
guggucucuucuuggggccca

SEQ ID NO: 3738859 - RNA, 17 nt, Human
guggucugaauguucug

SEQ ID NO: 3738860 - RNA, 14 nt, Human
guggucugcaggca

SEQ ID NO: 3738861 - RNA, 17 nt, Human
guggucuguuggcaggc

SEQ ID NO: 3738862 - RNA, 21 nt, Human
guggucuguuggcaggcuggc

SEQ ID NO: 3738863 - RNA, 23 nt, Human
guggucuguuggcaggcuggcca

SEQ ID NO: 3738864 - RNA, 17 nt, Human
guggugacaggacgcug

SEQ ID NO: 3738865 - RNA, 18 nt, Human
guggugaccccaggaggg

SEQ ID NO: 3738866 - RNA, 13 nt, Human
guggugagaucau

SEQ ID NO: 3738867 - RNA, 19 nt, Human
guggugaucaauuaaaugu

SEQ ID NO: 3738868 - RNA, 21 nt, Human
guggugauuugaaaaauauaa

SEQ ID NO: 3738869 - RNA, 14 nt, Human
guggugcagacaga

SEQ ID NO: 3738870 - RNA, 15 nt, Human
gugguggaaggguag

SEQ ID NO: 3738871 - RNA, 12 nt, Human
gugguggagcca

SEQ ID NO: 3738872 - RNA, 14 nt, Human
gugguggagccagu

SEQ ID NO: 3738873 - RNA, 23 nt, Human
gugguggcaggcaccuguagucc

SEQ ID NO: 3738874 - RNA, 17 nt, Human
gugguggcagggccuag

SEQ ID NO: 3738875 - RNA, 23 nt, Human
gugguggcagggccuagcugcua

SEQ ID NO: 3738876 - RNA, 22 nt, Human
gugguggcagugcagcaaccag

SEQ ID NO: 3738877 - RNA, 17 nt, Human
gugguggcaguggaggu

SEQ ID NO: 3738878 - RNA, 18 nt, Human
gugguggcccacgccugu

SEQ ID NO: 3738879 - RNA, 13 nt, Human
gugguggccuggu

SEQ ID NO: 3738880 - RNA, 18 nt, Human
gugguggcgggcgccugu

SEQ ID NO: 3738881 - RNA, 12 nt, Human
gugguggcucug

SEQ ID NO: 3738882 - RNA, 12 nt, Human
gugguggggagg

SEQ ID NO: 3738883 - RNA, 22 nt, Human
gugguggggaggggcgcuggcc

SEQ ID NO: 3738884 - RNA, 16 nt, Human
guggugguaacccugg

SEQ ID NO: 3738885 - RNA, 16 nt, Human
gugguggucccugggu

SEQ ID NO: 3738886 - RNA, 14 nt, Human
guggugguuuucug

SEQ ID NO: 3738887 - RNA, 12 nt, Human
gugguguaauuu

SEQ ID NO: 3738888 - RNA, 14 nt, Human
guggugugaucuua

SEQ ID NO: 3738889 - RNA, 20 nt, Human
gugguguuuccugcaggcca

SEQ ID NO: 3738890 - RNA, 23 nt, Human
gugguuaaugccauggacagaag

SEQ ID NO: 3738891 - RNA, 17 nt, Human
gugguuauaacuuaaug

SEQ ID NO: 3738892 - RNA, 14 nt, Human
gugguuauuucuca

SEQ ID NO: 3738893 - RNA, 22 nt, Human
gugguuauuucucaacaaagca

SEQ ID NO: 3738894 - RNA, 14 nt, Human
gugguuauuuuuau

SEQ ID NO: 3738895 - RNA, 23 nt, Human
gugguucacucuuggagccugca

SEQ ID NO: 3738896 - RNA, 16 nt, Human
gugguugaauaugauu

SEQ ID NO: 3738897 - RNA, 18 nt, Human
gugguugaauaugauuaa

SEQ ID NO: 3738898 - RNA, 18 nt, Human
gugguugcuguuuuccuc

SEQ ID NO: 3738899 - RNA, 20 nt, Human
gugguugcuguuuuccuccc

SEQ ID NO: 3738900 - RNA, 20 nt, Human
gugguuggggcccugcccug

SEQ ID NO: 3738901 - RNA, 20 nt, Human
gugguuuaguguaaaaauga

SEQ ID NO: 3738902 - RNA, 17 nt, Human
gugguuuauauauuuaa

SEQ ID NO: 3738903 - RNA, 15 nt, Human
gugguuucagaaaug

SEQ ID NO: 3738904 - RNA, 16 nt, Human
gugguuucagaaaugu

SEQ ID NO: 3738905 - RNA, 16 nt, Human
gugguuugagacacug

SEQ ID NO: 3738906 - RNA, 16 nt, Human
gugguuuguggcuuua

SEQ ID NO: 3738907 - RNA, 20 nt, Human
gugguuuuauacugaaggaa

SEQ ID NO: 3738908 - RNA, 16 nt, Human
gugguuuuccccuccc

SEQ ID NO: 3738909 - RNA, 21 nt, Human
gugguuuuccccucccugggu

SEQ ID NO: 3738910 - RNA, 17 nt, Human
gugguuuucuguucuuu

SEQ ID NO: 3738911 - RNA, 23 nt, Human
gugguuuucuuaaggugaggccu

SEQ ID NO: 3738912 - RNA, 15 nt, Human
guguaaaccaaagcc

SEQ ID NO: 3738913 - RNA, 13 nt, Human
guguaaauuaugu

SEQ ID NO: 3738914 - RNA, 15 nt, Human
guguaacagcuccuu

SEQ ID NO: 3738915 - RNA, 16 nt, Human
guguaacucccaguga

SEQ ID NO: 3738916 - RNA, 18 nt, Human
guguaacuggcaguuuuc

SEQ ID NO: 3738917 - RNA, 13 nt, Human
guguaauaaagug

SEQ ID NO: 3738918 - RNA, 18 nt, Human
guguaauaaaguguuuuc

SEQ ID NO: 3738919 - RNA, 20 nt, Human
guguaauaaaguguuuucag

SEQ ID NO: 3738920 - RNA, 14 nt, Human
guguaauauuacuu

SEQ ID NO: 3738921 - RNA, 19 nt, Human
guguaaucaauaaacgauu

SEQ ID NO: 3738922 - RNA, 12 nt, Human
guguaauuuaug

SEQ ID NO: 3738923 - RNA, 13 nt, Human
guguaauuucuuu

SEQ ID NO: 3738924 - RNA, 15 nt, Human
guguaauuugaagau

SEQ ID NO: 3738925 - RNA, 14 nt, Human
guguacaauguaca

SEQ ID NO: 3738926 - RNA, 23 nt, Human
guguacagaauuuuucuucauua

SEQ ID NO: 3738927 - RNA, 13 nt, Human
guguacagucuug

SEQ ID NO: 3738928 - RNA, 18 nt, Human
guguacauaguguaaugu

SEQ ID NO: 3738929 - RNA, 15 nt, Human
guguacauaugugcu

SEQ ID NO: 3738930 - RNA, 17 nt, Human
guguacauggaauaaca

SEQ ID NO: 3738931 - RNA, 17 nt, Human
guguacccccgcccagg

SEQ ID NO: 3738932 - RNA, 21 nt, Human
guguaccuccucucaguguuu

SEQ ID NO: 3738933 - RNA, 13 nt, Human
guguacucuggcc

SEQ ID NO: 3738934 - RNA, 16 nt, Human
guguacuggcuccucu

SEQ ID NO: 3738935 - RNA, 13 nt, Human
guguacuguguca

SEQ ID NO: 3738936 - RNA, 15 nt, Human
guguacuuaacuauu

SEQ ID NO: 3738937 - RNA, 19 nt, Human
guguacuucccgggccagg

SEQ ID NO: 3738938 - RNA, 15 nt, Human
guguagaacacuaau

SEQ ID NO: 3738939 - RNA, 17 nt, Human
guguagaagcauuccuu

SEQ ID NO: 3738940 - RNA, 18 nt, Human
guguagaguuaagaagcu

SEQ ID NO: 3738941 - RNA, 21 nt, Human
gucuucaaggcuucagucuca

SEQ ID NO: 3738942 - RNA, 14 nt, Human
gucuucaagggcug

SEQ ID NO: 3738943 - RNA, 15 nt, Human
gucuucacggcagga

SEQ ID NO: 3738944 - RNA, 12 nt, Human
gucuucacucuu

SEQ ID NO: 3738945 - RNA, 15 nt, Human
gucuucacucuuagg

SEQ ID NO: 3738946 - RNA, 18 nt, Human
gucuucagcauucccucc

SEQ ID NO: 3738947 - RNA, 13 nt, Human
gucuucagccuag

SEQ ID NO: 3738948 - RNA, 14 nt, Human
gucuucagccucuu

SEQ ID NO: 3738949 - RNA, 22 nt, Human
gucuucagccucuuucuguccc

SEQ ID NO: 3738950 - RNA, 13 nt, Human
gucuucaugaaau

SEQ ID NO: 3738951 - RNA, 15 nt, Human
gucuucaugaaaugc

SEQ ID NO: 3738952 - RNA, 17 nt, Human
gucuucauguucccacu

SEQ ID NO: 3738953 - RNA, 17 nt, Human
gucuuccacaaagaaaa

SEQ ID NO: 3738954 - RNA, 16 nt, Human
gucuuccaccuggaag

SEQ ID NO: 3738955 - RNA, 23 nt, Human
gucuuccagggggaaggccaagg

SEQ ID NO: 3738956 - RNA, 15 nt, Human
gucuuccauaaugua

SEQ ID NO: 3738957 - RNA, 15 nt, Human
gucuuccauuugcaa

SEQ ID NO: 3738958 - RNA, 15 nt, Human
gucuucccaggguag

SEQ ID NO: 3738959 - RNA, 18 nt, Human
gucuucccuaccucaggc

SEQ ID NO: 3738960 - RNA, 21 nt, Human
gucuucccuaccucaggcagg

SEQ ID NO: 3738961 - RNA, 23 nt, Human
gucuuccuauuucagaaguuuaa

SEQ ID NO: 3738962 - RNA, 23 nt, Human
gucuuccucaaaauaaagaagua

SEQ ID NO: 3738963 - RNA, 14 nt, Human
gucuuccucugucu

SEQ ID NO: 3738964 - RNA, 18 nt, Human
gucuuccugaaaugcagu

SEQ ID NO: 3738965 - RNA, 18 nt, Human
gucuuccugacacuuuaa

SEQ ID NO: 3738966 - RNA, 19 nt, Human
gucuuccugacacuuuaau

SEQ ID NO: 3738967 - RNA, 19 nt, Human
gucuuccugaguggugcca

SEQ ID NO: 3738968 - RNA, 17 nt, Human
gucuucggaaaccuugg

SEQ ID NO: 3738969 - RNA, 15 nt, Human
gucuucuaauuucaa

SEQ ID NO: 3738970 - RNA, 12 nt, Human
gucuucuauuua

SEQ ID NO: 3738971 - RNA, 19 nt, Human
gucuucucaggcucugccc

SEQ ID NO: 3738972 - RNA, 22 nt, Human
gucuucucaggcucugcccugc

SEQ ID NO: 3738973 - RNA, 19 nt, Human
gucuucucauagcauuaac

SEQ ID NO: 3738974 - RNA, 17 nt, Human
gucuucuccaccacgcu

SEQ ID NO: 3738975 - RNA, 20 nt, Human
gucuucuccaccacgcuggg

SEQ ID NO: 3738976 - RNA, 14 nt, Human
gucuucugccuguu

SEQ ID NO: 3738977 - RNA, 17 nt, Human
gucuucugccuguuaua

SEQ ID NO: 3738978 - RNA, 13 nt, Human
gucuucugcuuug

SEQ ID NO: 3738979 - RNA, 16 nt, Human
gucuucuuacaugcau

SEQ ID NO: 3738980 - RNA, 14 nt, Human
gucuucuucagggu

SEQ ID NO: 3738981 - RNA, 20 nt, Human
gucuucuuugcccacaaugc

SEQ ID NO: 3738982 - RNA, 17 nt, Human
gucuugaacuccuggcc

SEQ ID NO: 3738983 - RNA, 13 nt, Human
gucuugaaguccu

SEQ ID NO: 3738984 - RNA, 17 nt, Human
gucuugaaugucuuuug

SEQ ID NO: 3738985 - RNA, 19 nt, Human
gucuugaaugucuuuugaa

SEQ ID NO: 3738986 - RNA, 16 nt, Human
gucuugagcucuauua

SEQ ID NO: 3738987 - RNA, 17 nt, Human
gucuugauuuguuuuag

SEQ ID NO: 3738988 - RNA, 17 nt, Human
gucuugcaauggcagcc

SEQ ID NO: 3738989 - RNA, 18 nt, Human
gucuugcaauggcagccu

SEQ ID NO: 3738990 - RNA, 19 nt, Human
gucuugcagugauuaaggu

SEQ ID NO: 3738991 - RNA, 18 nt, Human
gucuuggagcugagccuc

SEQ ID NO: 3738992 - RNA, 23 nt, Human
gucuuggagcugagccucucacc

SEQ ID NO: 3738993 - RNA, 20 nt, Human
gucuuggcagcaccugucuc

SEQ ID NO: 3738994 - RNA, 16 nt, Human
gucuuggcggcagcag

SEQ ID NO: 3738995 - RNA, 16 nt, Human
gucuuggcuuucaugu

SEQ ID NO: 3738996 - RNA, 20 nt, Human
gucuuggcuuucauguuauu

SEQ ID NO: 3738997 - RNA, 20 nt, Human
gucuugggcagagcuggcuc

SEQ ID NO: 3738998 - RNA, 21 nt, Human
gucuugggcagagcuggcucu

SEQ ID NO: 3738999 - RNA, 16 nt, Human
gucuugguuccagccu

SEQ ID NO: 3739000 - RNA, 12 nt, Human
gucuuguaagag

SEQ ID NO: 3739001 - RNA, 19 nt, Human
gucuuguaauauuuuguau

SEQ ID NO: 3739002 - RNA, 15 nt, Human
gucuuguacaugugu

SEQ ID NO: 3739003 - RNA, 20 nt, Human
gucuugugacuagugcugaa

SEQ ID NO: 3739004 - RNA, 23 nt, Human
gucuuguguuuccacagccugca

SEQ ID NO: 3739005 - RNA, 20 nt, Human
gucuuguuaagugcagucug

SEQ ID NO: 3739006 - RNA, 21 nt, Human
gucuuguucugucacucaggc

SEQ ID NO: 3739007 - RNA, 19 nt, Human
gucuuuaaaggcccagccc

SEQ ID NO: 3739008 - RNA, 13 nt, Human
gucuuuaaaucau

SEQ ID NO: 3739009 - RNA, 17 nt, Human
gucuuuaaaugcugcuu

SEQ ID NO: 3739010 - RNA, 23 nt, Human
gucuuuaauuucugucagaaugc

SEQ ID NO: 3739011 - RNA, 16 nt, Human
gucuuuagcuauuacu

SEQ ID NO: 3739012 - RNA, 21 nt, Human
gucuuuaggucuuuguaagaa

SEQ ID NO: 3739013 - RNA, 16 nt, Human
gucuuucacagcuccu

SEQ ID NO: 3739014 - RNA, 21 nt, Human
gucuuucaggaccuuuugaag

SEQ ID NO: 3739015 - RNA, 13 nt, Human
gucuuucauggcu

SEQ ID NO: 3739016 - RNA, 22 nt, Human
gucuuuccacuccuccuagcca

SEQ ID NO: 3739017 - RNA, 14 nt, Human
gucuuuccacucug

SEQ ID NO: 3739018 - RNA, 16 nt, Human
gucuuucucaaagaaa

SEQ ID NO: 3739019 - RNA, 14 nt, Human
gucuuucuccaaag

SEQ ID NO: 3739020 - RNA, 16 nt, Human
gucuuucuccaaaguu

SEQ ID NO: 3739021 - RNA, 22 nt, Human
gucuuucuuuggugccuuuccu

SEQ ID NO: 3739022 - RNA, 13 nt, Human
gucuuugauaaag

SEQ ID NO: 3739023 - RNA, 15 nt, Human
gucuuugguucagcu

SEQ ID NO: 3739024 - RNA, 15 nt, Human
gucuuugguucuaag

SEQ ID NO: 3739025 - RNA, 15 nt, Human
gucuuuguaagagug

SEQ ID NO: 3739026 - RNA, 20 nt, Human
gucuuuguaagaguguagaa

SEQ ID NO: 3739027 - RNA, 21 nt, Human
gucuuuguaagaguguagaag

SEQ ID NO: 3739028 - RNA, 21 nt, Human
gucuuuguaagucaguguuga

SEQ ID NO: 3739029 - RNA, 19 nt, Human
gucuuuguaaugucaccac

SEQ ID NO: 3739030 - RNA, 19 nt, Human
gucuuuguuaagacugcug

SEQ ID NO: 3739031 - RNA, 23 nt, Human
gucuuuuaaaaaguauugccaaa

SEQ ID NO: 3739032 - RNA, 13 nt, Human
gucuuuuaaaaug

SEQ ID NO: 3739033 - RNA, 24 nt, Human
gucuuuuaggacccuucccuugag

SEQ ID NO: 3739034 - RNA, 13 nt, Human
gucuuuuauauuu

SEQ ID NO: 3739035 - RNA, 19 nt, Human
gucuuuuauauuuguaucg

SEQ ID NO: 3739036 - RNA, 14 nt, Human
gucuuuucaucugg

SEQ ID NO: 3739037 - RNA, 16 nt, Human
gucuuuucccauuuau

SEQ ID NO: 3739038 - RNA, 17 nt, Human
gucuuuuccucgcuucu

SEQ ID NO: 3739039 - RNA, 19 nt, Human
gucuuuucuugcaugaggc

SEQ ID NO: 3739040 - RNA, 23 nt, Human
gucuuuucuuggcaaaagccuug

SEQ ID NO: 3739041 - RNA, 14 nt, Human
gucuuuugacaugu

SEQ ID NO: 3739042 - RNA, 14 nt, Human
gucuuuuggaggac

SEQ ID NO: 3739043 - RNA, 16 nt, Human
gucuuuugguuaugaa

SEQ ID NO: 3739044 - RNA, 15 nt, Human
gucuuuuuaagcuua

SEQ ID NO: 3739045 - RNA, 16 nt, Human
gucuuuuucuggacug

SEQ ID NO: 3739046 - RNA, 17 nt, Human
gucuuuuucuguuguaa

SEQ ID NO: 3739047 - RNA, 19 nt, Human
gucuuuuucuguuguaacu

SEQ ID NO: 3739048 - RNA, 16 nt, Human
gucuuuuuuuguauag

SEQ ID NO: 3739049 - RNA, 17 nt, Human
gucuuuuuuuguauagu

SEQ ID NO: 3739050 - RNA, 18 nt, Human
gucuuuuuuuuaaugugc

SEQ ID NO: 3739051 - RNA, 19 nt, Human
gucuuuuuuuuaaugugcu

SEQ ID NO: 3739052 - RNA, 22 nt, Human
gucuuuuuuuuaaugugcugug

SEQ ID NO: 3739053 - RNA, 14 nt, Human
gucuuuuuuuuccu

SEQ ID NO: 3739054 - RNA, 15 nt, Human
gucuuuuuuuuccug

SEQ ID NO: 3739055 - RNA, 20 nt, Human
gucuuuuuuuuuuuugucua

SEQ ID NO: 3739056 - RNA, 15 nt, Human
gugaaaaaaaaaaug

SEQ ID NO: 3739057 - RNA, 19 nt, Human
gugaaaacaagugcuggca

SEQ ID NO: 3739058 - RNA, 17 nt, Human
gugaaaagaauagaagc

SEQ ID NO: 3739059 - RNA, 19 nt, Human
gugaaaaguccuugauugu

SEQ ID NO: 3739060 - RNA, 22 nt, Human
gugaaaauaagccaugagaaug

SEQ ID NO: 3739061 - RNA, 13 nt, Human
gugaaaauaauug

SEQ ID NO: 3739062 - RNA, 21 nt, Human
gugaaaauagguauacagugg

SEQ ID NO: 3739063 - RNA, 23 nt, Human
gugaaacacaccaggcugugggc

SEQ ID NO: 3739064 - RNA, 18 nt, Human
gugaaacauuuucucccu

SEQ ID NO: 3739065 - RNA, 19 nt, Human
gugaaacauuuucucccug

SEQ ID NO: 3739066 - RNA, 16 nt, Human
gugaaacccugucucu

SEQ ID NO: 3739067 - RNA, 22 nt, Human
gugaaaccuuuagggcagcuug

SEQ ID NO: 3739068 - RNA, 18 nt, Human
gugaaaccuuuuuuaaga

SEQ ID NO: 3739069 - RNA, 22 nt, Human
gugaaaccuuuuuuaagauuuu

SEQ ID NO: 3739070 - RNA, 12 nt, Human
gugaaacuggau

SEQ ID NO: 3739071 - RNA, 18 nt, Human
gugaaagaaaauaacaau

SEQ ID NO: 3739072 - RNA, 17 nt, Human
gugaaagcugagaacuc

SEQ ID NO: 3739073 - RNA, 21 nt, Human
gugaaagcugagaacuccuga

SEQ ID NO: 3739074 - RNA, 21 nt, Human
gugaaagucagaugcccagag

SEQ ID NO: 3739075 - RNA, 17 nt, Human
gugaaauaguucaaagc

SEQ ID NO: 3739076 - RNA, 16 nt, Human
gugaaauggccaggau

SEQ ID NO: 3739077 - RNA, 18 nt, Human
gugaaauuauucauaauu

SEQ ID NO: 3739078 - RNA, 20 nt, Human
gugaaauugcauacuuugua

SEQ ID NO: 3739079 - RNA, 12 nt, Human
gugaaauuuuuc

SEQ ID NO: 3739080 - RNA, 13 nt, Human
gugaaauuuuuca

SEQ ID NO: 3739081 - RNA, 14 nt, Human
gugaaauuuuucau

SEQ ID NO: 3739082 - RNA, 19 nt, Human
gugaacaaaagaugcucuu

SEQ ID NO: 3739083 - RNA, 17 nt, Human
gugaacaaagcagccac

SEQ ID NO: 3739084 - RNA, 22 nt, Human
gugaacacauaaauauauuuuu

SEQ ID NO: 3739085 - RNA, 15 nt, Human
gugaacacaucagcu

SEQ ID NO: 3739086 - RNA, 21 nt, Human
gugaacacuagccagacacuc

SEQ ID NO: 3739087 - RNA, 23 nt, Human
gugaaccaaagagacuggagcau

SEQ ID NO: 3739088 - RNA, 21 nt, Human
gugaaccaccacacccagccc

SEQ ID NO: 3739089 - RNA, 15 nt, Human
gugaacccaggacaa

SEQ ID NO: 3739090 - RNA, 20 nt, Human
guguagaguuaagaagcugu

SEQ ID NO: 3739091 - RNA, 17 nt, Human
guguagauuuguuuugu

SEQ ID NO: 3739092 - RNA, 18 nt, Human
guguagauuuuauagugu

SEQ ID NO: 3739093 - RNA, 23 nt, Human
guguagccagguauggcucugca

SEQ ID NO: 3739094 - RNA, 22 nt, Human
guguagccaggucccccugcag

SEQ ID NO: 3739095 - RNA, 16 nt, Human
guguagccuugcccgg

SEQ ID NO: 3739096 - RNA, 11 nt, Human
guguagccuuu

SEQ ID NO: 3739097 - RNA, 12 nt, Human
guguagccuuuu

SEQ ID NO: 3739098 - RNA, 16 nt, Human
guguagcuacagagaa

SEQ ID NO: 3739099 - RNA, 17 nt, Human
guguagcuacagagaaa

SEQ ID NO: 3739100 - RNA, 20 nt, Human
guguagcuacagagaaacca

SEQ ID NO: 3739101 - RNA, 17 nt, Human
guguagcugcaaaaaua

SEQ ID NO: 3739102 - RNA, 23 nt, Human
guguagcugcaaaaauaaucaug

SEQ ID NO: 3739103 - RNA, 18 nt, Human
guguagcugugaccugcu

SEQ ID NO: 3739104 - RNA, 19 nt, Human
guguagcugugaccugcug

SEQ ID NO: 3739105 - RNA, 20 nt, Human
guguagcugugaccugcuga

SEQ ID NO: 3739106 - RNA, 14 nt, Human
guguagcuuugcuc

SEQ ID NO: 3739107 - RNA, 12 nt, Human
guguaggcagac

SEQ ID NO: 3739108 - RNA, 14 nt, Human
guguaggcagacac

SEQ ID NO: 3739109 - RNA, 14 nt, Human
guguaguuaauuua

SEQ ID NO: 3739110 - RNA, 15 nt, Human
guguaguugaacuga

SEQ ID NO: 3739111 - RNA, 12 nt, Human
guguauaaaaau

SEQ ID NO: 3739112 - RNA, 14 nt, Human
guguauaaaaauaa

SEQ ID NO: 3739113 - RNA, 14 nt, Human
guguauaaacaaga

SEQ ID NO: 3739114 - RNA, 17 nt, Human
guguauaaacaagaaaa

SEQ ID NO: 3739115 - RNA, 17 nt, Human
guguauaagugcacaca

SEQ ID NO: 3739116 - RNA, 22 nt, Human
guguauagaagcgauuuaaguu

SEQ ID NO: 3739117 - RNA, 18 nt, Human
guguauagaaguagauua

SEQ ID NO: 3739118 - RNA, 15 nt, Human
guguauauauacaua

SEQ ID NO: 3739119 - RNA, 16 nt, Human
guguauauauacauac

SEQ ID NO: 3739120 - RNA, 13 nt, Human
guguauauaugug

SEQ ID NO: 3739121 - RNA, 18 nt, Human
guguauauauguguauau

SEQ ID NO: 3739122 - RNA, 22 nt, Human
guguauauauguguauauauac

SEQ ID NO: 3739123 - RNA, 13 nt, Human
guguauauggaca

SEQ ID NO: 3739124 - RNA, 17 nt, Human
guguauauguaugugug

SEQ ID NO: 3739125 - RNA, 14 nt, Human
guguauauuauuug

SEQ ID NO: 3739126 - RNA, 17 nt, Human
guguauauuauuuggca

SEQ ID NO: 3739127 - RNA, 12 nt, Human
guguauauuuga

SEQ ID NO: 3739128 - RNA, 13 nt, Human
guguauauuugau

SEQ ID NO: 3739129 - RNA, 14 nt, Human
guguauauuugauu

SEQ ID NO: 3739130 - RNA, 17 nt, Human
guguauauuugauuuau

SEQ ID NO: 3739131 - RNA, 15 nt, Human
guguaucaguguuua

SEQ ID NO: 3739132 - RNA, 19 nt, Human
guguaucaguguuuaugug

SEQ ID NO: 3739133 - RNA, 22 nt, Human
guguauccccccccuguauagu

SEQ ID NO: 3739134 - RNA, 14 nt, Human
guguaucucacacu

SEQ ID NO: 3739135 - RNA, 14 nt, Human
guguaugcacagua

SEQ ID NO: 3739136 - RNA, 21 nt, Human
guguauggaaaaaccauuuga

SEQ ID NO: 3739137 - RNA, 19 nt, Human
guguauggaaauaaaugua

SEQ ID NO: 3739138 - RNA, 20 nt, Human
guguauggagagaaaacaga

SEQ ID NO: 3739139 - RNA, 16 nt, Human
guguaugggugugugu

SEQ ID NO: 3739140 - RNA, 18 nt, Human
guguaugugcgugugugc

SEQ ID NO: 3739141 - RNA, 13 nt, Human
guguauguuuuuc

SEQ ID NO: 3739142 - RNA, 21 nt, Human
guguauguuuuucaguucaaa

SEQ ID NO: 3739143 - RNA, 16 nt, Human
guguauuaaaaaaaac

SEQ ID NO: 3739144 - RNA, 21 nt, Human
guguauucuuaaaaugcaaua

SEQ ID NO: 3739145 - RNA, 19 nt, Human
guguauuuauuuuacagcu

SEQ ID NO: 3739146 - RNA, 19 nt, Human
guguauuuauuuuccuccc

SEQ ID NO: 3739147 - RNA, 19 nt, Human
guguauuucuuauacgcuu

SEQ ID NO: 3739148 - RNA, 21 nt, Human
guguauuuggaaauaaaguca

SEQ ID NO: 3739149 - RNA, 21 nt, Human
gugucaacaccccugugugga

SEQ ID NO: 3739150 - RNA, 14 nt, Human
gugucaaccagaca

SEQ ID NO: 3739151 - RNA, 16 nt, Human
gugucaaccagacaga

SEQ ID NO: 3739152 - RNA, 21 nt, Human
gugucaagcugcucugagcca

SEQ ID NO: 3739153 - RNA, 15 nt, Human
gugucaagcuuccug

SEQ ID NO: 3739154 - RNA, 23 nt, Human
gugucaaguugugcuuguuuaca

SEQ ID NO: 3739155 - RNA, 19 nt, Human
gugucacccaaaccggcag

SEQ ID NO: 3739156 - RNA, 14 nt, Human
gugucaccccagag

SEQ ID NO: 3739157 - RNA, 21 nt, Human
gugucaccccagagccacaca

SEQ ID NO: 3739158 - RNA, 24 nt, Human
gugucaccccagagccacacaugg

SEQ ID NO: 3739159 - RNA, 14 nt, Human
gugucaccugugcu

SEQ ID NO: 3739160 - RNA, 17 nt, Human
gugucaccuuuucuugc

SEQ ID NO: 3739161 - RNA, 13 nt, Human
gugucacuggcug

SEQ ID NO: 3739162 - RNA, 14 nt, Human
gugucacuggcugc

SEQ ID NO: 3739163 - RNA, 18 nt, Human
gugucacuggcugccucc

SEQ ID NO: 3739164 - RNA, 19 nt, Human
gugucacuggcugccucca

SEQ ID NO: 3739165 - RNA, 20 nt, Human
gugucagacccuggaggccc

SEQ ID NO: 3739166 - RNA, 14 nt, Human
gugucaggcugcug

SEQ ID NO: 3739167 - RNA, 16 nt, Human
gugucaggcugcuggc

SEQ ID NO: 3739168 - RNA, 14 nt, Human
gugucagguggggc

SEQ ID NO: 3739169 - RNA, 18 nt, Human
gugucagguggggcagcu

SEQ ID NO: 3739170 - RNA, 18 nt, Human
gugucauaccaggccgcc

SEQ ID NO: 3739171 - RNA, 19 nt, Human
gugucauagaauagcaugu

SEQ ID NO: 3739172 - RNA, 23 nt, Human
gugucauauauggggggccaaca

SEQ ID NO: 3739173 - RNA, 21 nt, Human
gugucaugauucacccccaaa

SEQ ID NO: 3739174 - RNA, 18 nt, Human
gugucauuuaugaaaaga

SEQ ID NO: 3739175 - RNA, 16 nt, Human
gugucauuucucaucc

SEQ ID NO: 3739176 - RNA, 19 nt, Human
guguccaaaggaagacgug

SEQ ID NO: 3739177 - RNA, 15 nt, Human
guguccaacuccagu

SEQ ID NO: 3739178 - RNA, 12 nt, Human
guguccaccccc

SEQ ID NO: 3739179 - RNA, 19 nt, Human
guguccaugcgcucagggc

SEQ ID NO: 3739180 - RNA, 14 nt, Human
guguccaugugugu

SEQ ID NO: 3739181 - RNA, 21 nt, Human
guguccauugacauguacaga

SEQ ID NO: 3739182 - RNA, 23 nt, Human
guguccauugacauguacagaga

SEQ ID NO: 3739183 - RNA, 19 nt, Human
guguccauuuugugaagcc

SEQ ID NO: 3739184 - RNA, 20 nt, Human
guguccauuuugugaagccc

SEQ ID NO: 3739185 - RNA, 21 nt, Human
guguccauuuugugaagcccu

SEQ ID NO: 3739186 - RNA, 20 nt, Human
gugucccaaaaagaaaggag

SEQ ID NO: 3739187 - RNA, 19 nt, Human
gugucccaugacccacccc

SEQ ID NO: 3739188 - RNA, 22 nt, Human
guguccccagcccacuggauca

SEQ ID NO: 3739189 - RNA, 20 nt, Human
guguccccuccacugucaca

SEQ ID NO: 3739190 - RNA, 23 nt, Human
gugucccugcacuugcagacucu

SEQ ID NO: 3739191 - RNA, 14 nt, Human
guguccggucccug

SEQ ID NO: 3739192 - RNA, 14 nt, Human
guguccuacagaaa

SEQ ID NO: 3739193 - RNA, 15 nt, Human
guguccucacggugc

SEQ ID NO: 3739194 - RNA, 18 nt, Human
guguccucuucccucucu

SEQ ID NO: 3739195 - RNA, 16 nt, Human
guguccugaccacccu

SEQ ID NO: 3739196 - RNA, 18 nt, Human
guguccugaccacccucc

SEQ ID NO: 3739197 - RNA, 23 nt, Human
guguccugagccccagggagagg

SEQ ID NO: 3739198 - RNA, 15 nt, Human
guguccugagcucag

SEQ ID NO: 3739199 - RNA, 22 nt, Human
guguccugagcucagcguggag

SEQ ID NO: 3739200 - RNA, 21 nt, Human
guguccugcaccggggccugg

SEQ ID NO: 3739201 - RNA, 16 nt, Human
guguccugccugucug

SEQ ID NO: 3739202 - RNA, 16 nt, Human
guguccuggugcucuc

SEQ ID NO: 3739203 - RNA, 18 nt, Human
guguccuugcaccugcau

SEQ ID NO: 3739204 - RNA, 14 nt, Human
guguccuugugcau

SEQ ID NO: 3739205 - RNA, 16 nt, Human
guguccuuucccucca

SEQ ID NO: 3739206 - RNA, 17 nt, Human
guguccuuucccuccac

SEQ ID NO: 3739207 - RNA, 15 nt, Human
gugucguagccaagg

SEQ ID NO: 3739208 - RNA, 18 nt, Human
gugucuaagauucuagau

SEQ ID NO: 3739209 - RNA, 17 nt, Human
gugucucaggcugccug

SEQ ID NO: 3739210 - RNA, 13 nt, Human
gugucuccaaccc

SEQ ID NO: 3739211 - RNA, 21 nt, Human
gugucuccaaccccccagcac

SEQ ID NO: 3739212 - RNA, 15 nt, Human
gugucuccugcaugc

SEQ ID NO: 3739213 - RNA, 19 nt, Human
gugucucuugguccugcug

SEQ ID NO: 3739214 - RNA, 21 nt, Human
gugucucuugguccugcugca

SEQ ID NO: 3739215 - RNA, 19 nt, Human
gugucucuuuucucuuucu

SEQ ID NO: 3739216 - RNA, 14 nt, Human
gugucugcacccag

SEQ ID NO: 3739217 - RNA, 21 nt, Human
gugucugcacccagggguggg

SEQ ID NO: 3739218 - RNA, 21 nt, Human
gugucugcuuuaaagggccug

SEQ ID NO: 3739219 - RNA, 23 nt, Human
gugucuggaauuguggcuauccu

SEQ ID NO: 3739220 - RNA, 14 nt, Human
gugucuggcugcag

SEQ ID NO: 3739221 - RNA, 13 nt, Human
gugucugggcuga

SEQ ID NO: 3739222 - RNA, 21 nt, Human
gaguacuacaguccucccauc

SEQ ID NO: 3739223 - RNA, 23 nt, Human
gaguacuacaguccucccaucuc

SEQ ID NO: 3739224 - RNA, 16 nt, Human
gaguacuccacacugc

SEQ ID NO: 3739225 - RNA, 17 nt, Human
gaguacuccacacugca

SEQ ID NO: 3739226 - RNA, 15 nt, Human
gaguagaaaauguga

SEQ ID NO: 3739227 - RNA, 23 nt, Human
gaguagaaaggccuuuaaaauuu

SEQ ID NO: 3739228 - RNA, 17 nt, Human
gaguagagguauaauug

SEQ ID NO: 3739229 - RNA, 21 nt, Human
gaguagccaggguguggcccu

SEQ ID NO: 3739230 - RNA, 21 nt, Human
gaguagccagguucugccggu

SEQ ID NO: 3739231 - RNA, 14 nt, Human
gaguagcugggacu

SEQ ID NO: 3739232 - RNA, 19 nt, Human
gaguagcugggacuacagg

SEQ ID NO: 3739233 - RNA, 17 nt, Human
gaguagggcuuaguguu

SEQ ID NO: 3739234 - RNA, 21 nt, Human
gaguagugaagacuccagaaa

SEQ ID NO: 3739235 - RNA, 18 nt, Human
gaguauaagaaaugcaua

SEQ ID NO: 3739236 - RNA, 14 nt, Human
gaguauaugcacuu

SEQ ID NO: 3739237 - RNA, 23 nt, Human
gaguaucuccucgcaagcugggu

SEQ ID NO: 3739238 - RNA, 23 nt, Human
gaguaucucggaccuuucagcug

SEQ ID NO: 3739239 - RNA, 19 nt, Human
gaguauguguuugugugug

SEQ ID NO: 3739240 - RNA, 23 nt, Human
gaguauuaaaauguaugcauguu

SEQ ID NO: 3739241 - RNA, 21 nt, Human
gaguauucucggauaguugcu

SEQ ID NO: 3739242 - RNA, 14 nt, Human
gaguauuggucucc

SEQ ID NO: 3739243 - RNA, 20 nt, Human
gaguauuguuuaaaauguaa

SEQ ID NO: 3739244 - RNA, 17 nt, Human
gaguauuuuugacagaa

SEQ ID NO: 3739245 - RNA, 15 nt, Human
gagucaaaaauuaaa

SEQ ID NO: 3739246 - RNA, 20 nt, Human
gagucaaaacacuuguaauu

SEQ ID NO: 3739247 - RNA, 14 nt, Human
gagucaaggccugc

SEQ ID NO: 3739248 - RNA, 12 nt, Human
gagucacacagu

SEQ ID NO: 3739249 - RNA, 12 nt, Human
gagucacacuca

SEQ ID NO: 3739250 - RNA, 14 nt, Human
gagucaccaagccc

SEQ ID NO: 3739251 - RNA, 15 nt, Human
gagucaccaagccca

SEQ ID NO: 3739252 - RNA, 14 nt, Human
gagucaccuuccag

SEQ ID NO: 3739253 - RNA, 15 nt, Human
gagucaccuucccuu

SEQ ID NO: 3739254 - RNA, 15 nt, Human
gagucacugagacca

SEQ ID NO: 3739255 - RNA, 12 nt, Human
gagucacugccu

SEQ ID NO: 3739256 - RNA, 15 nt, Human
gagucacugccucuc

SEQ ID NO: 3739257 - RNA, 23 nt, Human
gagucacugccucucccuggccc

SEQ ID NO: 3739258 - RNA, 15 nt, Human
gagucagagccaugu

SEQ ID NO: 3739259 - RNA, 15 nt, Human
gagucagcucucugc

SEQ ID NO: 3739260 - RNA, 17 nt, Human
gagucagcucucugccc

SEQ ID NO: 3739261 - RNA, 15 nt, Human
gagucagcuguuucu

SEQ ID NO: 3739262 - RNA, 15 nt, Human
gagucagugccaggu

SEQ ID NO: 3739263 - RNA, 20 nt, Human
gagucauaaaccuuaaguaa

SEQ ID NO: 3739264 - RNA, 16 nt, Human
gagucaugaucucccu

SEQ ID NO: 3739265 - RNA, 18 nt, Human
gagucaugaucucccugc

SEQ ID NO: 3739266 - RNA, 20 nt, Human
gagucaugaucucccugccg

SEQ ID NO: 3739267 - RNA, 13 nt, Human
gagucauuugagu

SEQ ID NO: 3739268 - RNA, 16 nt, Human
gaguccaaacuggaau

SEQ ID NO: 3739269 - RNA, 11 nt, Human
gaguccacucc

SEQ ID NO: 3739270 - RNA, 13 nt, Human
gaguccacuuugu

SEQ ID NO: 3739271 - RNA, 14 nt, Human
gaguccaggcacag

SEQ ID NO: 3739272 - RNA, 15 nt, Human
gaguccaggcacagg

SEQ ID NO: 3739273 - RNA, 14 nt, Human
gaguccaggcccca

SEQ ID NO: 3739274 - RNA, 17 nt, Human
gaguccaucagccucca

SEQ ID NO: 3739275 - RNA, 16 nt, Human
gaguccauucucccag

SEQ ID NO: 3739276 - RNA, 18 nt, Human
gaguccauucucccaggu

SEQ ID NO: 3739277 - RNA, 20 nt, Human
gaguccauucucccagguac

SEQ ID NO: 3739278 - RNA, 19 nt, Human
gagucccacugccucaggu

SEQ ID NO: 3739279 - RNA, 18 nt, Human
gagucccagagcaggagg

SEQ ID NO: 3739280 - RNA, 21 nt, Human
gagucccagagcaggaggccc

SEQ ID NO: 3739281 - RNA, 22 nt, Human
guuacaugcauacuucaaaagu

SEQ ID NO: 3739282 - RNA, 16 nt, Human
guuacauuaauguuaa

SEQ ID NO: 3739283 - RNA, 22 nt, Human
guuacauugcuggucuuguaag

SEQ ID NO: 3739284 - RNA, 19 nt, Human
guuaccauuaaaccaucuc

SEQ ID NO: 3739285 - RNA, 21 nt, Human
guuaccauuaaaccaucuccc

SEQ ID NO: 3739286 - RNA, 21 nt, Human
guuaccauuggaaauuucacg

SEQ ID NO: 3739287 - RNA, 14 nt, Human
guuacccaugaaaa

SEQ ID NO: 3739288 - RNA, 22 nt, Human
guuaccuccaacagaacuaaau

SEQ ID NO: 3739289 - RNA, 17 nt, Human
guuaccucuauauacca

SEQ ID NO: 3739290 - RNA, 12 nt, Human
guuaccuuaaau

SEQ ID NO: 3739291 - RNA, 17 nt, Human
guuacuaacuaaacucu

SEQ ID NO: 3739292 - RNA, 13 nt, Human
guuacuaagaaga

SEQ ID NO: 3739293 - RNA, 23 nt, Human
guuacuaauuggccucuuuaaga

SEQ ID NO: 3739294 - RNA, 15 nt, Human
guuacuaccuccucu

SEQ ID NO: 3739295 - RNA, 16 nt, Human
guuacuagguaacuuc

SEQ ID NO: 3739296 - RNA, 16 nt, Human
guuacuauccuggcuu

SEQ ID NO: 3739297 - RNA, 12 nt, Human
guuacucagccc

SEQ ID NO: 3739298 - RNA, 20 nt, Human
guuacucagggcuccuccca

SEQ ID NO: 3739299 - RNA, 22 nt, Human
guuacucagggcuccucccagc

SEQ ID NO: 3739300 - RNA, 17 nt, Human
guuacugaucaugcauu

SEQ ID NO: 3739301 - RNA, 18 nt, Human
guuacuggauaaauuguu

SEQ ID NO: 3739302 - RNA, 17 nt, Human
guuacuguaaaaugcaa

SEQ ID NO: 3739303 - RNA, 19 nt, Human
guuacuguaaaaugcaaaa

SEQ ID NO: 3739304 - RNA, 13 nt, Human
guuacuguaauuc

SEQ ID NO: 3739305 - RNA, 15 nt, Human
guuacuguguaaacu

SEQ ID NO: 3739306 - RNA, 13 nt, Human
guuacuguguaau

SEQ ID NO: 3739307 - RNA, 18 nt, Human
guuacuguucuugcugcu

SEQ ID NO: 3739308 - RNA, 19 nt, Human
guuacuguucuugcugcua

SEQ ID NO: 3739309 - RNA, 20 nt, Human
guuacuguucuugcugcuag

SEQ ID NO: 3739310 - RNA, 23 nt, Human
guuacuguugugaccugaaguuc

SEQ ID NO: 3739311 - RNA, 16 nt, Human
guuacuucuucucuua

SEQ ID NO: 3739312 - RNA, 14 nt, Human
guuagaaaaaugga

SEQ ID NO: 3739313 - RNA, 13 nt, Human
guuagaacacuau

SEQ ID NO: 3739314 - RNA, 14 nt, Human
guuagaacacuauu

SEQ ID NO: 3739315 - RNA, 22 nt, Human
guuagaauauaggucucuucuc

SEQ ID NO: 3739316 - RNA, 14 nt, Human
guuagaaucuauuu

SEQ ID NO: 3739317 - RNA, 19 nt, Human
guuagaaucuauuuucuau

SEQ ID NO: 3739318 - RNA, 22 nt, Human
guuagaaucuauuuucuaugua

SEQ ID NO: 3739319 - RNA, 16 nt, Human
guuagaaugaggagga

SEQ ID NO: 3739320 - RNA, 13 nt, Human
guuagaauuccuu

SEQ ID NO: 3739321 - RNA, 13 nt, Human
guuagacagccaa

SEQ ID NO: 3739322 - RNA, 23 nt, Human
guuagaccgcucucuuuucugua

SEQ ID NO: 3739323 - RNA, 12 nt, Human
guuagacugcca

SEQ ID NO: 3739324 - RNA, 15 nt, Human
guuagacugccagcu

SEQ ID NO: 3739325 - RNA, 18 nt, Human
guuagagauuuuuuuguu

SEQ ID NO: 3739326 - RNA, 18 nt, Human
guuagagcaggacugaug

SEQ ID NO: 3739327 - RNA, 19 nt, Human
guuagagguucccuuugac

SEQ ID NO: 3739328 - RNA, 14 nt, Human
guuagaugcuacua

SEQ ID NO: 3739329 - RNA, 12 nt, Human
guuagauguuug

SEQ ID NO: 3739330 - RNA, 13 nt, Human
guuagauuaagaa

SEQ ID NO: 3739331 - RNA, 21 nt, Human
guuagcacuguugauguaucu

SEQ ID NO: 3739332 - RNA, 18 nt, Human
guuagcagacaggccccg

SEQ ID NO: 3739333 - RNA, 21 nt, Human
guuagcuaauaaaaagcuuuu

SEQ ID NO: 3739334 - RNA, 12 nt, Human
guuagcuccugu

SEQ ID NO: 3739335 - RNA, 19 nt, Human
guuagcuuuuuaaaacauu

SEQ ID NO: 3739336 - RNA, 13 nt, Human
guuaggagguccu

SEQ ID NO: 3739337 - RNA, 15 nt, Human
guuaggauggcagga

SEQ ID NO: 3739338 - RNA, 14 nt, Human
guuaggcaguauaa

SEQ ID NO: 3739339 - RNA, 19 nt, Human
guuaggccaaagacaaaua

SEQ ID NO: 3739340 - RNA, 22 nt, Human
guuaggccaaagacaaauagua

SEQ ID NO: 3739341 - RNA, 13 nt, Human
guuaggccuggca

SEQ ID NO: 3739342 - RNA, 15 nt, Human
guuaggccuggcaca

SEQ ID NO: 3739343 - RNA, 16 nt, Human
guuaggccuggcacag

SEQ ID NO: 3739344 - RNA, 13 nt, Human
guuaggcugggcc

SEQ ID NO: 3739345 - RNA, 23 nt, Human
guuagggaaaacauuccauccuu

SEQ ID NO: 3739346 - RNA, 13 nt, Human
guuagggaauggc

SEQ ID NO: 3739347 - RNA, 19 nt, Human
guuagggacugaccagcag

SEQ ID NO: 3739348 - RNA, 18 nt, Human
guuagguagagggaguug

SEQ ID NO: 3739349 - RNA, 21 nt, Human
guuagguagagggaguuguca

SEQ ID NO: 3739350 - RNA, 20 nt, Human
guuagguuuaacauaaaggu

SEQ ID NO: 3739351 - RNA, 17 nt, Human
guuaguaugaggcauuu

SEQ ID NO: 3739352 - RNA, 20 nt, Human
guuaguaugaggcauuuguu

SEQ ID NO: 3739353 - RNA, 18 nt, Human
guuagucgugagcucuug

SEQ ID NO: 3739354 - RNA, 21 nt, Human
guuagucuacucuuaagccau

SEQ ID NO: 3739355 - RNA, 22 nt, Human
guuagucuacucuuaagccauc

SEQ ID NO: 3739356 - RNA, 23 nt, Human
guuagucuacucuuaagccaucu

SEQ ID NO: 3739357 - RNA, 13 nt, Human
guuaguggcaccg

SEQ ID NO: 3739358 - RNA, 19 nt, Human
guuaguuauagaugucuag

SEQ ID NO: 3739359 - RNA, 24 nt, Human
guuaguucaaucuggauucauauu

SEQ ID NO: 3739360 - RNA, 19 nt, Human
guuaguuucuccaagcagg

SEQ ID NO: 3739361 - RNA, 22 nt, Human
guuauaaaagugauuguuggca

SEQ ID NO: 3739362 - RNA, 17 nt, Human
guuauaaagugugccac

SEQ ID NO: 3739363 - RNA, 17 nt, Human
guuauaaaucaauguca

SEQ ID NO: 3739364 - RNA, 13 nt, Human
guuauaagacucu

SEQ ID NO: 3739365 - RNA, 14 nt, Human
guuauaagacucuc

SEQ ID NO: 3739366 - RNA, 19 nt, Human
guuauaguauaucuggaca

SEQ ID NO: 3739367 - RNA, 17 nt, Human
guuauagugcaauauau

SEQ ID NO: 3739368 - RNA, 10 nt, Human
guuauauaaa

SEQ ID NO: 3739369 - RNA, 20 nt, Human
guuauauaaagagaaaauug

SEQ ID NO: 3739370 - RNA, 14 nt, Human
guuauauaauuuag

SEQ ID NO: 3739371 - RNA, 13 nt, Human
guuauauagguuu

SEQ ID NO: 3739372 - RNA, 14 nt, Human
guuauauauaaaua

SEQ ID NO: 3739373 - RNA, 19 nt, Human
guuauauauaaauauauua

SEQ ID NO: 3739374 - RNA, 15 nt, Human
guuauauuucagaug

SEQ ID NO: 3739375 - RNA, 23 nt, Human
guuauauuucagauguaauguuu

SEQ ID NO: 3739376 - RNA, 14 nt, Human
guuauauuuugcag

SEQ ID NO: 3739377 - RNA, 20 nt, Human
guuaucaccuagcugaaugu

SEQ ID NO: 3739378 - RNA, 13 nt, Human
guuaucagugcuu

SEQ ID NO: 3739379 - RNA, 17 nt, Human
guuaucaugaauuuuaa

SEQ ID NO: 3739380 - RNA, 22 nt, Human
guuaucaugaauuuuaaaguau

SEQ ID NO: 3739381 - RNA, 22 nt, Human
guuaucauguuaguaauaccuc

SEQ ID NO: 3739382 - RNA, 16 nt, Human
guuaucuaaaagaaau

SEQ ID NO: 3739383 - RNA, 19 nt, Human
guuaucugaagucagaucu

SEQ ID NO: 3739384 - RNA, 17 nt, Human
guuaucuggcuucaaau

SEQ ID NO: 3739385 - RNA, 19 nt, Human
guuaucugguuuuaaaaga

SEQ ID NO: 3739386 - RNA, 17 nt, Human
guuaucuguuugagaaa

SEQ ID NO: 3739387 - RNA, 19 nt, Human
guuaucuuauacuguacaa

SEQ ID NO: 3739388 - RNA, 20 nt, Human
guuaucuuauacuguacaau

SEQ ID NO: 3739389 - RNA, 21 nt, Human
guuaucuucucaaguucuaag

SEQ ID NO: 3739390 - RNA, 18 nt, Human
guuaugaaagaauauauu

SEQ ID NO: 3739391 - RNA, 18 nt, Human
guuaugauaaaaaauuuu

SEQ ID NO: 3739392 - RNA, 16 nt, Human
guuaugaugugcuuaa

SEQ ID NO: 3739393 - RNA, 16 nt, Human
guuaugcaaaagcaag

SEQ ID NO: 3739394 - RNA, 22 nt, Human
guuaugcaagggacuguguguu

SEQ ID NO: 3739395 - RNA, 13 nt, Human
guuaugcaucauu

SEQ ID NO: 3739396 - RNA, 21 nt, Human
guuauguaaaaggccaaaccu

SEQ ID NO: 3739397 - RNA, 13 nt, Human
guuauguacugua

SEQ ID NO: 3739398 - RNA, 14 nt, Human
guuauguacuguac

SEQ ID NO: 3739399 - RNA, 15 nt, Human
guuauguacuguacu

SEQ ID NO: 3739400 - RNA, 19 nt, Human
guuauguacuguacuaauu

SEQ ID NO: 3739401 - RNA, 18 nt, Human
guuaugucuguuuaagaa

SEQ ID NO: 3739402 - RNA, 22 nt, Human
guuaugugaaugaucucucuga

SEQ ID NO: 3739403 - RNA, 20 nt, Human
guuauguguaugugccauuu

SEQ ID NO: 3739404 - RNA, 11 nt, Human
guuaugugucu

SEQ ID NO: 3739405 - RNA, 19 nt, Human
guuauguguguauauguau

SEQ ID NO: 3739406 - RNA, 21 nt, Human
guuauuaacuuuaauguuuuu

SEQ ID NO: 3739407 - RNA, 14 nt, Human
guuauuauaauugu

SEQ ID NO: 3739408 - RNA, 18 nt, Human
guuauuauaauuguauca

SEQ ID NO: 3739409 - RNA, 22 nt, Human
guuauuaucugggcuuauaucu

SEQ ID NO: 3739410 - RNA, 23 nt, Human
guuauucauucugugaucauuua

SEQ ID NO: 3739411 - RNA, 14 nt, Human
guuauugaaaaaaa

SEQ ID NO: 3739412 - RNA, 19 nt, Human
guuauugagagagaugugu

SEQ ID NO: 3739413 - RNA, 21 nt, Human
guuauugagagagauguguaa

SEQ ID NO: 3739414 - RNA, 18 nt, Human
guuauugauaaguucaua

SEQ ID NO: 3739415 - RNA, 21 nt, Human
guuauugauaaguucauacau

SEQ ID NO: 3739416 - RNA, 13 nt, Human
guuauugcaguuu

SEQ ID NO: 3739417 - RNA, 23 nt, Human
guuauugcaguuuaucauucaag

SEQ ID NO: 3739418 - RNA, 20 nt, Human
guuauugggcaagugauuga

SEQ ID NO: 3739419 - RNA, 14 nt, Human
guuauugugaauga

SEQ ID NO: 3739420 - RNA, 23 nt, Human
guuauuuaacagcugaauuaucu

SEQ ID NO: 3739421 - RNA, 20 nt, Human
guuauuuauaaucacuuuuu

SEQ ID NO: 3739422 - RNA, 22 nt, Human
guuauuuauucugggaauguau

SEQ ID NO: 3739423 - RNA, 18 nt, Human
guuauuucccuuuagcug

SEQ ID NO: 3739424 - RNA, 14 nt, Human
guuauuucuuguuu

SEQ ID NO: 3739425 - RNA, 22 nt, Human
guuauuugaaaacauguuuauu

SEQ ID NO: 3739426 - RNA, 18 nt, Human
guuauuuguuauuuucag

SEQ ID NO: 3739427 - RNA, 17 nt, Human
guuauuuguuuaccacu

SEQ ID NO: 3739428 - RNA, 15 nt, Human
guuauuuuacuuuuu

SEQ ID NO: 3739429 - RNA, 13 nt, Human
guuauuuuaguuu

SEQ ID NO: 3739430 - RNA, 18 nt, Human
gugccagcaaagccccau

SEQ ID NO: 3739431 - RNA, 15 nt, Human
gugccagccugaggc

SEQ ID NO: 3739432 - RNA, 18 nt, Human
gugccaggacuccccagg

SEQ ID NO: 3739433 - RNA, 12 nt, Human
gugccaggcccg

SEQ ID NO: 3739434 - RNA, 13 nt, Human
gugccaggcccgg

SEQ ID NO: 3739435 - RNA, 16 nt, Human
gugccagggcagcacu

SEQ ID NO: 3739436 - RNA, 22 nt, Human
gugccaggugaggucagcacau

SEQ ID NO: 3739437 - RNA, 16 nt, Human
gugccaguauuuuaaa

SEQ ID NO: 3739438 - RNA, 17 nt, Human
gugccagucaagaagaa

SEQ ID NO: 3739439 - RNA, 18 nt, Human
gugccagucgcgcugccu

SEQ ID NO: 3739440 - RNA, 22 nt, Human
gugccagucgcgcugccugugu

SEQ ID NO: 3739441 - RNA, 20 nt, Human
gugcccaagaauagaugcug

SEQ ID NO: 3739442 - RNA, 12 nt, Human
gugcccaagcca

SEQ ID NO: 3739443 - RNA, 20 nt, Human
gugcccaagccagaggcugg

SEQ ID NO: 3739444 - RNA, 12 nt, Human
gugcccacagcc

SEQ ID NO: 3739445 - RNA, 15 nt, Human
gugcccacaucccag

SEQ ID NO: 3739446 - RNA, 21 nt, Human
gugcccacauguguccauccc

SEQ ID NO: 3739447 - RNA, 17 nt, Human
gugcccagaacuucccu

SEQ ID NO: 3739448 - RNA, 19 nt, Human
gugcccagaacuucccuga

SEQ ID NO: 3739449 - RNA, 20 nt, Human
gugcccagcuauaccugugc

SEQ ID NO: 3739450 - RNA, 12 nt, Human
gugcccagcuca

SEQ ID NO: 3739451 - RNA, 14 nt, Human
gugcccaugggcac

SEQ ID NO: 3739452 - RNA, 16 nt, Human
gugcccaugggcacug

SEQ ID NO: 3739453 - RNA, 19 nt, Human
gugcccaugggcacugcug

SEQ ID NO: 3739454 - RNA, 14 nt, Human
gugccccaggacca

SEQ ID NO: 3739455 - RNA, 16 nt, Human
gugccccaugccuguc

SEQ ID NO: 3739456 - RNA, 22 nt, Human
gugcccccaggguccugggagg

SEQ ID NO: 3739457 - RNA, 22 nt, Human
gugccccccauccuggcccauc

SEQ ID NO: 3739458 - RNA, 13 nt, Human
gugccccccuugc

SEQ ID NO: 3739459 - RNA, 17 nt, Human
gugcccccuccucuccc

SEQ ID NO: 3739460 - RNA, 17 nt, Human
gugcccccucuaccauu

SEQ ID NO: 3739461 - RNA, 21 nt, Human
gugccccucuccuucuuagcu

SEQ ID NO: 3739462 - RNA, 22 nt, Human
gugccccugcacuccagccuga

SEQ ID NO: 3739463 - RNA, 15 nt, Human
gugccccuuccgcca

SEQ ID NO: 3739464 - RNA, 17 nt, Human
gugccccuuccgccacu

SEQ ID NO: 3739465 - RNA, 19 nt, Human
gugccccuuccgccacugg

SEQ ID NO: 3739466 - RNA, 17 nt, Human
gugcccucaccacccac

SEQ ID NO: 3739467 - RNA, 20 nt, Human
gugcccuccacagccgcagc

SEQ ID NO: 3739468 - RNA, 14 nt, Human
gugcccuccacugc

SEQ ID NO: 3739469 - RNA, 20 nt, Human
gugcccuccacugcccucug

SEQ ID NO: 3739470 - RNA, 13 nt, Human
gugcccucuccca

SEQ ID NO: 3739471 - RNA, 15 nt, Human
gugcccucucccacc

SEQ ID NO: 3739472 - RNA, 17 nt, Human
gugcccucucccacccu

SEQ ID NO: 3739473 - RNA, 22 nt, Human
gugcccucucccacccucuucc

SEQ ID NO: 3739474 - RNA, 15 nt, Human
gugcccucugggcuc

SEQ ID NO: 3739475 - RNA, 17 nt, Human
gugcccucugggcucug

SEQ ID NO: 3739476 - RNA, 23 nt, Human
gugcccugguggagaaagcacug

SEQ ID NO: 3739477 - RNA, 17 nt, Human
gugccgccgccucgccc

SEQ ID NO: 3739478 - RNA, 22 nt, Human
gugccgccgccucgcccaccgc

SEQ ID NO: 3739479 - RNA, 21 nt, Human
gugccgccugcacuccucagg

SEQ ID NO: 3739480 - RNA, 13 nt, Human
gugccguggcacc

SEQ ID NO: 3739481 - RNA, 18 nt, Human
gugccgugugagugugac

SEQ ID NO: 3739482 - RNA, 19 nt, Human
gugccgugugagugugaca

SEQ ID NO: 3739483 - RNA, 21 nt, Human
gugccgugugagugugacagg

SEQ ID NO: 3739484 - RNA, 23 nt, Human
gugccgugugagugugacagggc

SEQ ID NO: 3739485 - RNA, 21 nt, Human
gugccguuacucuccaaccug

SEQ ID NO: 3739486 - RNA, 16 nt, Human
gugccuaaauaaguua

SEQ ID NO: 3739487 - RNA, 18 nt, Human
gugccuaggccugggcag

SEQ ID NO: 3739488 - RNA, 20 nt, Human
gugccuaggccugggcagug

SEQ ID NO: 3739489 - RNA, 16 nt, Human
gugccuaguauugaca

SEQ ID NO: 3739490 - RNA, 19 nt, Human
gugccuauugcuagagcuc

SEQ ID NO: 3739491 - RNA, 15 nt, Human
gugccucaagaggaa

SEQ ID NO: 3739492 - RNA, 22 nt, Human
gugccucaagaggaaugaaaaa

SEQ ID NO: 3739493 - RNA, 17 nt, Human
gugccuccaccaccacu

SEQ ID NO: 3739494 - RNA, 22 nt, Human
gugccuccaccaccacuggcca

SEQ ID NO: 3739495 - RNA, 16 nt, Human
gugccuccucccuccc

SEQ ID NO: 3739496 - RNA, 20 nt, Human
gugccucgcuccccacucug

SEQ ID NO: 3739497 - RNA, 12 nt, Human
gugccucucccu

SEQ ID NO: 3739498 - RNA, 22 nt, Human
gugccucucccugcugcuccua

SEQ ID NO: 3739499 - RNA, 23 nt, Human
gugccucucccugcugcuccuag

SEQ ID NO: 3739500 - RNA, 15 nt, Human
gugccucugccuguc

SEQ ID NO: 3739501 - RNA, 22 nt, Human
gugccucuggaggccucugggc

SEQ ID NO: 3739502 - RNA, 21 nt, Human
gugccugacacacuaaccaag

SEQ ID NO: 3739503 - RNA, 16 nt, Human
gugccugagaggcagg

SEQ ID NO: 3739504 - RNA, 17 nt, Human
gugccugagaggcaggc

SEQ ID NO: 3739505 - RNA, 12 nt, Human
gugccugagagu

SEQ ID NO: 3739506 - RNA, 14 nt, Human
gugccugcaccagg

SEQ ID NO: 3739507 - RNA, 18 nt, Human
gugccugcaccaggagac

SEQ ID NO: 3739508 - RNA, 23 nt, Human
gugccugccugggaguuuuguau

SEQ ID NO: 3739509 - RNA, 21 nt, Human
gugccugcuucagccucccac

SEQ ID NO: 3739510 - RNA, 12 nt, Human
gugccuggagcu

SEQ ID NO: 3739511 - RNA, 12 nt, Human
gugccuggccug

SEQ ID NO: 3739512 - RNA, 20 nt, Human
gugccuggcucagagccagu

SEQ ID NO: 3739513 - RNA, 22 nt, Human
gugccuggguggacauggcccc

SEQ ID NO: 3739514 - RNA, 15 nt, Human
gugccuuaccuccug

SEQ ID NO: 3739515 - RNA, 17 nt, Human
gugccuuaccuccugcc

SEQ ID NO: 3739516 - RNA, 20 nt, Human
gugccuuaccuccugcccag

SEQ ID NO: 3739517 - RNA, 23 nt, Human
gugccuuauggaacacucugaga

SEQ ID NO: 3739518 - RNA, 15 nt, Human
gugccuucagcucua

SEQ ID NO: 3739519 - RNA, 12 nt, Human
gugccuucauuu

SEQ ID NO: 3739520 - RNA, 22 nt, Human
gugccuuccagauccucucugg

SEQ ID NO: 3739521 - RNA, 23 nt, Human
gugccuuccagauccucucuggg

SEQ ID NO: 3739522 - RNA, 12 nt, Human
gugccuuccaua

SEQ ID NO: 3739523 - RNA, 22 nt, Human
gugccuuccauaauuaugacag

SEQ ID NO: 3739524 - RNA, 22 nt, Human
gugccuuccaugucggccucua

SEQ ID NO: 3739525 - RNA, 15 nt, Human
gugccuucucucucc

SEQ ID NO: 3739526 - RNA, 19 nt, Human
gugccuucuucagggccug

SEQ ID NO: 3739527 - RNA, 17 nt, Human
gugccuuugcagcucag

SEQ ID NO: 3739528 - RNA, 15 nt, Human
gugccuuuugcaccc

SEQ ID NO: 3739529 - RNA, 16 nt, Human
gugccuuuugcacccc

SEQ ID NO: 3739530 - RNA, 14 nt, Human
gugccuuuugccau

SEQ ID NO: 3739531 - RNA, 14 nt, Human
gugcgaauggacuu

SEQ ID NO: 3739532 - RNA, 18 nt, Human
gugcgaucucggcucagu

SEQ ID NO: 3739533 - RNA, 13 nt, Human
gugcgcccagggc

SEQ ID NO: 3739534 - RNA, 14 nt, Human
gugcgcccagggcu

SEQ ID NO: 3739535 - RNA, 21 nt, Human
gugcgcuaaacuuuucugaua

SEQ ID NO: 3739536 - RNA, 22 nt, Human
gugcgcucuguggaugccaggg

SEQ ID NO: 3739537 - RNA, 22 nt, Human
gugcgcugggcacuucccugcu

SEQ ID NO: 3739538 - RNA, 16 nt, Human
gugcggcuggccaugg

SEQ ID NO: 3739539 - RNA, 15 nt, Human
gugcgguggcucacg

SEQ ID NO: 3739540 - RNA, 19 nt, Human
gugcguaugcaguguagau

SEQ ID NO: 3739541 - RNA, 13 nt, Human
gugcgugaaugua

SEQ ID NO: 3739542 - RNA, 12 nt, Human
gugcgugcucag

SEQ ID NO: 3739543 - RNA, 21 nt, Human
gugcguggaaugcccuucacu

SEQ ID NO: 3739544 - RNA, 12 nt, Human
gugcguggguga

SEQ ID NO: 3739545 - RNA, 14 nt, Human
gugcgugggugaag

SEQ ID NO: 3739546 - RNA, 13 nt, Human
gugcguggugcga

SEQ ID NO: 3739547 - RNA, 15 nt, Human
gugcguggugguccc

SEQ ID NO: 3739548 - RNA, 19 nt, Human
gugcgugguggucccuggg

SEQ ID NO: 3739549 - RNA, 20 nt, Human
gugcgugguggucccugggu

SEQ ID NO: 3739550 - RNA, 13 nt, Human
gugcguguguaga

SEQ ID NO: 3739551 - RNA, 13 nt, Human
gugcgugugugca

SEQ ID NO: 3739552 - RNA, 13 nt, Human
gugcuaaaaaugg

SEQ ID NO: 3739553 - RNA, 21 nt, Human
gugcuaaaaaugggacuucuu

SEQ ID NO: 3739554 - RNA, 22 nt, Human
gugcuaaaaaugggacuucuuu

SEQ ID NO: 3739555 - RNA, 14 nt, Human
gugcuaaacgugua

SEQ ID NO: 3739556 - RNA, 13 nt, Human
gugcuaagguucu

SEQ ID NO: 3739557 - RNA, 14 nt, Human
gugcuaagguucua

SEQ ID NO: 3739558 - RNA, 16 nt, Human
gugcuaagguucuaag

SEQ ID NO: 3739559 - RNA, 13 nt, Human
gugcuaaguguga

SEQ ID NO: 3739560 - RNA, 16 nt, Human
gugcuaagugugaacu

SEQ ID NO: 3739561 - RNA, 17 nt, Human
gugcuaagugugaacug

SEQ ID NO: 3739562 - RNA, 15 nt, Human
gugcuaauuuugaaa

SEQ ID NO: 3739563 - RNA, 20 nt, Human
gugcuacaaaaacacagcaa

SEQ ID NO: 3739564 - RNA, 19 nt, Human
gugcuaccuggguccuuuu

SEQ ID NO: 3739565 - RNA, 19 nt, Human
gugcuacuggggaaacugg

SEQ ID NO: 3739566 - RNA, 20 nt, Human
gugcuacugucuuuggaaaa

SEQ ID NO: 3739567 - RNA, 22 nt, Human
gugcuaggaacacuccuucaca

SEQ ID NO: 3739568 - RNA, 20 nt, Human
gugcuagggaaacuucccgu

SEQ ID NO: 3739569 - RNA, 15 nt, Human
gugcuauaguauuug

SEQ ID NO: 3739570 - RNA, 20 nt, Human
gugcuauauauauaaauauu

SEQ ID NO: 3739571 - RNA, 22 nt, Human
gugcuaucucccccagccccau

SEQ ID NO: 3739572 - RNA, 12 nt, Human
gugcuauguucu

SEQ ID NO: 3739573 - RNA, 16 nt, Human
gugcuauuugucaucu

SEQ ID NO: 3739574 - RNA, 21 nt, Human
gugcuauuuuguuuguuuugu

SEQ ID NO: 3739575 - RNA, 13 nt, Human
gugcucaaggcca

SEQ ID NO: 3739576 - RNA, 16 nt, Human
gugcucagcccugagg

SEQ ID NO: 3739577 - RNA, 18 nt, Human
gugcucaggacucagaag

SEQ ID NO: 3739578 - RNA, 22 nt, Human
gugcucaggacucagaagccuc

SEQ ID NO: 3739579 - RNA, 13 nt, Human
gugcucagggcua

SEQ ID NO: 3739580 - RNA, 12 nt, Human
guuauuuucagu

SEQ ID NO: 3739581 - RNA, 12 nt, Human
guuauuuucuac

SEQ ID NO: 3739582 - RNA, 18 nt, Human
guuauuuugauguaaaga

SEQ ID NO: 3739583 - RNA, 20 nt, Human
guuauuuugauguaaagaug

SEQ ID NO: 3739584 - RNA, 17 nt, Human
guuauuuuguuuuuccu

SEQ ID NO: 3739585 - RNA, 20 nt, Human
guuauuuuuacauucugaau

SEQ ID NO: 3739586 - RNA, 15 nt, Human
guuauuuuuauacag

SEQ ID NO: 3739587 - RNA, 20 nt, Human
guuauuuuuauacaguagug

SEQ ID NO: 3739588 - RNA, 23 nt, Human
guuauuuuuauaucagccugagu

SEQ ID NO: 3739589 - RNA, 18 nt, Human
guuauuuuucaaggaagg

SEQ ID NO: 3739590 - RNA, 15 nt, Human
guuauuuuuguacau

SEQ ID NO: 3739591 - RNA, 22 nt, Human
guuauuuuuguuucuuccaaag

SEQ ID NO: 3739592 - RNA, 14 nt, Human
guucaaaauucuaa

SEQ ID NO: 3739593 - RNA, 21 nt, Human
guucaaagauauuuugcuuug

SEQ ID NO: 3739594 - RNA, 13 nt, Human
guucaaagucaug

SEQ ID NO: 3739595 - RNA, 19 nt, Human
guucaaagucaugauguuu

SEQ ID NO: 3739596 - RNA, 20 nt, Human
guucaaagucaugauguuuu

SEQ ID NO: 3739597 - RNA, 12 nt, Human
guucaaaugugu

SEQ ID NO: 3739598 - RNA, 14 nt, Human
guucaacuuauuaa

SEQ ID NO: 3739599 - RNA, 17 nt, Human
guucaagcgauucucuu

SEQ ID NO: 3739600 - RNA, 19 nt, Human
guucaagcgauucuucugc

SEQ ID NO: 3739601 - RNA, 14 nt, Human
guucaaggaccaac

SEQ ID NO: 3739602 - RNA, 23 nt, Human
guucaaggaccaacaagggcagu

SEQ ID NO: 3739603 - RNA, 22 nt, Human
guucaaggucacuguuuccugg

SEQ ID NO: 3739604 - RNA, 23 nt, Human
guucaagugauucucaugccuca

SEQ ID NO: 3739605 - RNA, 23 nt, Human
guucaauaaagcacugagcaagu

SEQ ID NO: 3739606 - RNA, 13 nt, Human
guucaauuagaau

SEQ ID NO: 3739607 - RNA, 19 nt, Human
guucaauuauuucccccau

SEQ ID NO: 3739608 - RNA, 23 nt, Human
guucaauucucauuugucacaca

SEQ ID NO: 3739609 - RNA, 14 nt, Human
guucacacccugca

SEQ ID NO: 3739610 - RNA, 15 nt, Human
guucacacccugcaa

SEQ ID NO: 3739611 - RNA, 15 nt, Human
guucacaccugcaga

SEQ ID NO: 3739612 - RNA, 17 nt, Human
guucacauuagaauuag

SEQ ID NO: 3739613 - RNA, 12 nt, Human
guucaccccucc

SEQ ID NO: 3739614 - RNA, 14 nt, Human
guucaccuuuguag

SEQ ID NO: 3739615 - RNA, 17 nt, Human
guucaccuuuguagcac

SEQ ID NO: 3739616 - RNA, 15 nt, Human
guucacgcaacuuga

SEQ ID NO: 3739617 - RNA, 19 nt, Human
guucacgugcagcucaagg

SEQ ID NO: 3739618 - RNA, 15 nt, Human
guucacuaaagcagu

SEQ ID NO: 3739619 - RNA, 24 nt, Human
guucacucuacuuagcaugucccu

SEQ ID NO: 3739620 - RNA, 19 nt, Human
guucacucuccauuuaaua

SEQ ID NO: 3739621 - RNA, 18 nt, Human
guucacucuuggagccug

SEQ ID NO: 3739622 - RNA, 20 nt, Human
guucacucuuggagccugca

SEQ ID NO: 3739623 - RNA, 14 nt, Human
guucacugaagacg

SEQ ID NO: 3739624 - RNA, 19 nt, Human
guucacugcaaccuccgcc

SEQ ID NO: 3739625 - RNA, 16 nt, Human
guucacuucaucuucu

SEQ ID NO: 3739626 - RNA, 21 nt, Human
guucacuucaucuucucagcu

SEQ ID NO: 3739627 - RNA, 16 nt, Human
guucacuuuugacaaa

SEQ ID NO: 3739628 - RNA, 20 nt, Human
guucacuuuugacaaaggca

SEQ ID NO: 3739629 - RNA, 21 nt, Human
guucagaaaugcugccugccu

SEQ ID NO: 3739630 - RNA, 14 nt, Human
guucagaagaaauu

SEQ ID NO: 3739631 - RNA, 13 nt, Human
guucagagcugcc

SEQ ID NO: 3739632 - RNA, 17 nt, Human
guucagagcugcccucu

SEQ ID NO: 3739633 - RNA, 20 nt, Human
guucagagcugcccucuccu

SEQ ID NO: 3739634 - RNA, 23 nt, Human
guucagagcugcccucuccuggg

SEQ ID NO: 3739635 - RNA, 13 nt, Human
guucagaguuuuc

SEQ ID NO: 3739636 - RNA, 20 nt, Human
guucagaucuuaauauaaau

SEQ ID NO: 3739637 - RNA, 19 nt, Human
guucagcauggcauccaag

SEQ ID NO: 3739638 - RNA, 17 nt, Human
guucagccccuccucug

SEQ ID NO: 3739639 - RNA, 22 nt, Human
guucagccccuccucugccacc

SEQ ID NO: 3739640 - RNA, 13 nt, Human
guucagccugccu

SEQ ID NO: 3739641 - RNA, 13 nt, Human
guucagcuccagc

SEQ ID NO: 3739642 - RNA, 18 nt, Human
guucagcuccagcucacc

SEQ ID NO: 3739643 - RNA, 21 nt, Human
guucagcuccagcucaccagc

SEQ ID NO: 3739644 - RNA, 12 nt, Human
guucagcuuggg

SEQ ID NO: 3739645 - RNA, 20 nt, Human
guucaggagucccaaggaaa

SEQ ID NO: 3739646 - RNA, 15 nt, Human
guucaggggacucag

SEQ ID NO: 3739647 - RNA, 20 nt, Human
guucaggggacucagcccug

SEQ ID NO: 3739648 - RNA, 17 nt, Human
guucaggguuggccccu

SEQ ID NO: 3739649 - RNA, 18 nt, Human
guucaggguuggccccug

SEQ ID NO: 3739650 - RNA, 19 nt, Human
guucaggguuggccccugc

SEQ ID NO: 3739651 - RNA, 14 nt, Human
guucaguaccacau

SEQ ID NO: 3739652 - RNA, 17 nt, Human
guucaguaccuggagga

SEQ ID NO: 3739653 - RNA, 13 nt, Human
guucagucuuuca

SEQ ID NO: 3739654 - RNA, 17 nt, Human
guucaguggcagggcuc

SEQ ID NO: 3739655 - RNA, 16 nt, Human
guucaguuacagaaag

SEQ ID NO: 3739656 - RNA, 17 nt, Human
guucaguuacagaaagu

SEQ ID NO: 3739657 - RNA, 19 nt, Human
guucauaacagugccauug

SEQ ID NO: 3739658 - RNA, 9 nt, Human
guucauaca

SEQ ID NO: 3739659 - RNA, 13 nt, Human
guucauacauauu

SEQ ID NO: 3739660 - RNA, 23 nt, Human
guucauacauauuuuuguagcac

SEQ ID NO: 3739661 - RNA, 13 nt, Human
guucauaccuaag

SEQ ID NO: 3739662 - RNA, 20 nt, Human
guucauagggucucuucagg

SEQ ID NO: 3739663 - RNA, 19 nt, Human
guucauauguaccauguac

SEQ ID NO: 3739664 - RNA, 22 nt, Human
guucauauguaccauguacaug

SEQ ID NO: 3739665 - RNA, 16 nt, Human
guucaucaaugaauga

SEQ ID NO: 3739666 - RNA, 13 nt, Human
guucaucaguguu

SEQ ID NO: 3739667 - RNA, 14 nt, Human
guucaucauccaga

SEQ ID NO: 3739668 - RNA, 19 nt, Human
guucauccaauccucacug

SEQ ID NO: 3739669 - RNA, 16 nt, Human
guucauccauucuauu

SEQ ID NO: 3739670 - RNA, 18 nt, Human
guucauccuauuguugau

SEQ ID NO: 3739671 - RNA, 12 nt, Human
guucaugaaaga

SEQ ID NO: 3739672 - RNA, 12 nt, Human
guucaugacaau

SEQ ID NO: 3739673 - RNA, 14 nt, Human
guucaugagaaucu

SEQ ID NO: 3739674 - RNA, 22 nt, Human
guucauggaacgcguugaaauu

SEQ ID NO: 3739675 - RNA, 18 nt, Human
guucauggauuacuucuc

SEQ ID NO: 3739676 - RNA, 16 nt, Human
guucauguagagaaaa

SEQ ID NO: 3739677 - RNA, 10 nt, Human
guucauguuu

SEQ ID NO: 3739678 - RNA, 14 nt, Human
guucauguuugcuu

SEQ ID NO: 3739679 - RNA, 16 nt, Human
guucauuaaagcauga

SEQ ID NO: 3739680 - RNA, 20 nt, Human
guucauuaaagcaugaaugg

SEQ ID NO: 3739681 - RNA, 19 nt, Human
guucauuagaaauauuuua

SEQ ID NO: 3739682 - RNA, 17 nt, Human
guucauucauauuacaa

SEQ ID NO: 3739683 - RNA, 15 nt, Human
guucauuccuccagg

SEQ ID NO: 3739684 - RNA, 18 nt, Human
guucauugcaauuaaacu

SEQ ID NO: 3739685 - RNA, 20 nt, Human
guucauuguaauguuacuga

SEQ ID NO: 3739686 - RNA, 21 nt, Human
guucauuguaauguuacugau

SEQ ID NO: 3739687 - RNA, 22 nt, Human
guucauuguaauguuacugauc

SEQ ID NO: 3739688 - RNA, 15 nt, Human
guucauuucauccuu

SEQ ID NO: 3739689 - RNA, 13 nt, Human
guucauuuccuca

SEQ ID NO: 3739690 - RNA, 13 nt, Human
guucauuugugua

SEQ ID NO: 3739691 - RNA, 17 nt, Human
guucauuugugugcuca

SEQ ID NO: 3739692 - RNA, 17 nt, Human
guucauuuugagcugaa

SEQ ID NO: 3739693 - RNA, 19 nt, Human
guuccaaaugaauguuguc

SEQ ID NO: 3739694 - RNA, 15 nt, Human
guuccaaauucaguu

SEQ ID NO: 3739695 - RNA, 14 nt, Human
guuccaagacauug

SEQ ID NO: 3739696 - RNA, 17 nt, Human
guuccaagacauuguca

SEQ ID NO: 3739697 - RNA, 20 nt, Human
guuccaagagucuaaagaug

SEQ ID NO: 3739698 - RNA, 18 nt, Human
guuccaagucuuugcuau

SEQ ID NO: 3739699 - RNA, 14 nt, Human
guuccaauaaacag

SEQ ID NO: 3739700 - RNA, 16 nt, Human
guuccaauccuggcuc

SEQ ID NO: 3739701 - RNA, 14 nt, Human
guuccacagaggac

SEQ ID NO: 3739702 - RNA, 21 nt, Human
guuccaccccaagagaacucg

SEQ ID NO: 3739703 - RNA, 21 nt, Human
guuccacgucccccuggggcu

SEQ ID NO: 3739704 - RNA, 16 nt, Human
guuccacguguuuuau

SEQ ID NO: 3739705 - RNA, 12 nt, Human
guuccacuaacc

SEQ ID NO: 3739706 - RNA, 12 nt, Human
guuccacugaga

SEQ ID NO: 3739707 - RNA, 19 nt, Human
guuccacuuauagccucug

SEQ ID NO: 3739708 - RNA, 17 nt, Human
guuccagaagugugacu

SEQ ID NO: 3739709 - RNA, 14 nt, Human
guuccagcaccaca

SEQ ID NO: 3739710 - RNA, 21 nt, Human
guuccagcagaugccacauaa

SEQ ID NO: 3739711 - RNA, 15 nt, Human
guuccagccugccac

SEQ ID NO: 3739712 - RNA, 12 nt, Human
guuccagcucuu

SEQ ID NO: 3739713 - RNA, 16 nt, Human
guuccagcucuuugaa

SEQ ID NO: 3739714 - RNA, 22 nt, Human
guuccaucuccuauaaucuguc

SEQ ID NO: 3739715 - RNA, 16 nt, Human
guuccaugaugcuggg

SEQ ID NO: 3739716 - RNA, 21 nt, Human
guuccauugaagccgacucug

SEQ ID NO: 3739717 - RNA, 23 nt, Human
guuccauugaagccgacucuggc

SEQ ID NO: 3739718 - RNA, 23 nt, Human
guucccaagagcaucaugccucu

SEQ ID NO: 3739719 - RNA, 21 nt, Human
guucccacauuaaagaagacc

SEQ ID NO: 3739720 - RNA, 19 nt, Human
guucccaccaggcugcuca

SEQ ID NO: 3739721 - RNA, 21 nt, Human
guucccagugacacuucagag

SEQ ID NO: 3739722 - RNA, 20 nt, Human
guucccaguuggagcuccag

SEQ ID NO: 3739723 - RNA, 16 nt, Human
guucccauuugcuccu

SEQ ID NO: 3739724 - RNA, 15 nt, Human
guuccccaagacauu

SEQ ID NO: 3739725 - RNA, 12 nt, Human
guuccccagaga

SEQ ID NO: 3739726 - RNA, 14 nt, Human
guuccccagagaaa

SEQ ID NO: 3739727 - RNA, 13 nt, Human
guucccccagccc

SEQ ID NO: 3739728 - RNA, 17 nt, Human
guucccccagcccugug

SEQ ID NO: 3739729 - RNA, 12 nt, Human
guucccccaucu

SEQ ID NO: 3739730 - RNA, 21 nt, Human
guuccccuaguaagugccuuc

SEQ ID NO: 3739731 - RNA, 23 nt, Human
gagucccagagcaggaggccccu

SEQ ID NO: 3739732 - RNA, 19 nt, Human
gagucccaggcugagccuc

SEQ ID NO: 3739733 - RNA, 18 nt, Human
gagucccagguuggcucu

SEQ ID NO: 3739734 - RNA, 21 nt, Human
gagucccagguuggcucugcc

SEQ ID NO: 3739735 - RNA, 16 nt, Human
gaguccccucaccucc

SEQ ID NO: 3739736 - RNA, 14 nt, Human
gaguccccuguuug

SEQ ID NO: 3739737 - RNA, 14 nt, Human
gagucccugccugg

SEQ ID NO: 3739738 - RNA, 15 nt, Human
gagucccugccugga

SEQ ID NO: 3739739 - RNA, 21 nt, Human
gaguccuacaguggcugucac

SEQ ID NO: 3739740 - RNA, 13 nt, Human
gaguccucugaau

SEQ ID NO: 3739741 - RNA, 16 nt, Human
gagucgaggacaggga

SEQ ID NO: 3739742 - RNA, 21 nt, Human
gagucgcaucucagugcagga

SEQ ID NO: 3739743 - RNA, 13 nt, Human
gagucggaagggc

SEQ ID NO: 3739744 - RNA, 23 nt, Human
gagucgucaucacuuuucaguga

SEQ ID NO: 3739745 - RNA, 17 nt, Human
gagucguggggugugcu

SEQ ID NO: 3739746 - RNA, 19 nt, Human
gagucguggggugugcugg

SEQ ID NO: 3739747 - RNA, 13 nt, Human
gagucuaaagaug

SEQ ID NO: 3739748 - RNA, 19 nt, Human
gagucuaauagucuuugcc

SEQ ID NO: 3739749 - RNA, 20 nt, Human
gagucuagcacucauuuucu

SEQ ID NO: 3739750 - RNA, 22 nt, Human
gagucuagcacucauuuucuau

SEQ ID NO: 3739751 - RNA, 21 nt, Human
gagucucacuguugcccaggc

SEQ ID NO: 3739752 - RNA, 14 nt, Human
gagucucccaaggc

SEQ ID NO: 3739753 - RNA, 21 nt, Human
gagucucgcucuguugcccag

SEQ ID NO: 3739754 - RNA, 13 nt, Human
gagucucucuggg

SEQ ID NO: 3739755 - RNA, 16 nt, Human
gagucucugaggggcu

SEQ ID NO: 3739756 - RNA, 12 nt, Human
gagucucuucuc

SEQ ID NO: 3739757 - RNA, 14 nt, Human
gagucucuucucca

SEQ ID NO: 3739758 - RNA, 23 nt, Human
gagucugaagcagaugcaaagag

SEQ ID NO: 3739759 - RNA, 23 nt, Human
gagucugaggccguugcugacuu

SEQ ID NO: 3739760 - RNA, 16 nt, Human
gagucugagguccuga

SEQ ID NO: 3739761 - RNA, 22 nt, Human
gagucugagguccugagcacug

SEQ ID NO: 3739762 - RNA, 12 nt, Human
gagucugccagg

SEQ ID NO: 3739763 - RNA, 20 nt, Human
gagucugccagggccccucu

SEQ ID NO: 3739764 - RNA, 18 nt, Human
gagucugcuauauuuuca

SEQ ID NO: 3739765 - RNA, 12 nt, Human
gagucugucucu

SEQ ID NO: 3739766 - RNA, 18 nt, Human
gagucugucucugucaug

SEQ ID NO: 3739767 - RNA, 22 nt, Human
gagucuugcuaccucagucagu

SEQ ID NO: 3739768 - RNA, 20 nt, Human
gagucuugcucugucgccca

SEQ ID NO: 3739769 - RNA, 20 nt, Human
gagucuuggcggcagcagcc

SEQ ID NO: 3739770 - RNA, 22 nt, Human
gagucuugguuucucucuacag

SEQ ID NO: 3739771 - RNA, 18 nt, Human
gagucuuugguucuaagg

SEQ ID NO: 3739772 - RNA, 22 nt, Human
gagucuuugguucuaaggaccu

SEQ ID NO: 3739773 - RNA, 21 nt, Human
gagugaaaccuuuagggcagc

SEQ ID NO: 3739774 - RNA, 19 nt, Human
gagugaaccccacgcccug

SEQ ID NO: 3739775 - RNA, 21 nt, Human
gagugaagaggggcagcccuu

SEQ ID NO: 3739776 - RNA, 16 nt, Human
gagugaauucccucac

SEQ ID NO: 3739777 - RNA, 19 nt, Human
gagugaggaauggcaguga

SEQ ID NO: 3739778 - RNA, 13 nt, Human
gagugagggccug

SEQ ID NO: 3739779 - RNA, 14 nt, Human
gagugagggccuga

SEQ ID NO: 3739780 - RNA, 22 nt, Human
gagugauacaacuucaagugca

SEQ ID NO: 3739781 - RNA, 10 nt, Human
gagugaucuu

SEQ ID NO: 3739782 - RNA, 20 nt, Human
gagugauugcagcuuuaugu

SEQ ID NO: 3739783 - RNA, 13 nt, Human
gagugcacagcug

SEQ ID NO: 3739784 - RNA, 14 nt, Human
gagugcacagcugu

SEQ ID NO: 3739785 - RNA, 16 nt, Human
gagugcacagcugucc

SEQ ID NO: 3739786 - RNA, 13 nt, Human
gagugcaggccca

SEQ ID NO: 3739787 - RNA, 19 nt, Human
gagugcaggccugcucagg

SEQ ID NO: 3739788 - RNA, 18 nt, Human
gagugcaguccugaucag

SEQ ID NO: 3739789 - RNA, 12 nt, Human
gagugcagugag

SEQ ID NO: 3739790 - RNA, 12 nt, Human
gagugccaggac

SEQ ID NO: 3739791 - RNA, 23 nt, Human
gagugcccacccugggagacaga

SEQ ID NO: 3739792 - RNA, 14 nt, Human
gagugcccagaacu

SEQ ID NO: 3739793 - RNA, 19 nt, Human
gagugccgcaucucacagc

SEQ ID NO: 3739794 - RNA, 14 nt, Human
gagugccuucugug

SEQ ID NO: 3739795 - RNA, 14 nt, Human
gagugcgugcucag

SEQ ID NO: 3739796 - RNA, 11 nt, Human
gagugcuaagu

SEQ ID NO: 3739797 - RNA, 14 nt, Human
gagugcuggcucac

SEQ ID NO: 3739798 - RNA, 18 nt, Human
gagugcuggcucacagua

SEQ ID NO: 3739799 - RNA, 20 nt, Human
gaguggaauaguauccucca

SEQ ID NO: 3739800 - RNA, 22 nt, Human
gaguggaauaguauccuccagg

SEQ ID NO: 3739801 - RNA, 23 nt, Human
gaguggaauaguauccuccaggu

SEQ ID NO: 3739802 - RNA, 11 nt, Human
gaguggaguua

SEQ ID NO: 3739803 - RNA, 22 nt, Human
gaguggaucuccaaggaccagg

SEQ ID NO: 3739804 - RNA, 15 nt, Human
gaguggcagcccagc

SEQ ID NO: 3739805 - RNA, 18 nt, Human
gaguggcagcccagccag

SEQ ID NO: 3739806 - RNA, 16 nt, Human
gaguggccccaccugg

SEQ ID NO: 3739807 - RNA, 19 nt, Human
gaguggccccaccuggccc

SEQ ID NO: 3739808 - RNA, 14 nt, Human
gaguggccuggcca

SEQ ID NO: 3739809 - RNA, 18 nt, Human
gaguggccuggccaggag

SEQ ID NO: 3739810 - RNA, 17 nt, Human
gaguggcuggggcaugg

SEQ ID NO: 3739811 - RNA, 15 nt, Human
gaguggcuucacucc

SEQ ID NO: 3739812 - RNA, 11 nt, Human
gagugggaagc

SEQ ID NO: 3739813 - RNA, 23 nt, Human
gagugggcagagcccccaggaag

SEQ ID NO: 3739814 - RNA, 13 nt, Human
gaguggggguggg

SEQ ID NO: 3739815 - RNA, 17 nt, Human
gaguggggguggggggu

SEQ ID NO: 3739816 - RNA, 15 nt, Human
gagugggugacaaga

SEQ ID NO: 3739817 - RNA, 19 nt, Human
gagugggugacaagagccu

SEQ ID NO: 3739818 - RNA, 20 nt, Human
gagugggugacaagagccug

SEQ ID NO: 3739819 - RNA, 21 nt, Human
gaguguaacaagaaaggagag

SEQ ID NO: 3739820 - RNA, 15 nt, Human
gaguguagaagcauu

SEQ ID NO: 3739821 - RNA, 18 nt, Human
gaguguagcaacuacagu

SEQ ID NO: 3739822 - RNA, 21 nt, Human
gagugucaaccagacagaggg

SEQ ID NO: 3739823 - RNA, 17 nt, Human
gagugucuggaauugug

SEQ ID NO: 3739824 - RNA, 22 nt, Human
gagugucuuuccacggagccac

SEQ ID NO: 3739825 - RNA, 18 nt, Human
gagugugaauauaaaugu

SEQ ID NO: 3739826 - RNA, 11 nt, Human
gagugugacag

SEQ ID NO: 3739827 - RNA, 12 nt, Human
gagugugacagg

SEQ ID NO: 3739828 - RNA, 15 nt, Human
gagugugacagggcc

SEQ ID NO: 3739829 - RNA, 21 nt, Human
gagugugaccaaaaguuacau

SEQ ID NO: 3739830 - RNA, 23 nt, Human
gagugugagccaccuaagaucuc

SEQ ID NO: 3739831 - RNA, 20 nt, Human
gagugugccugaagucccag

SEQ ID NO: 3739832 - RNA, 18 nt, Human
gagugugcggcugugugu

SEQ ID NO: 3739833 - RNA, 13 nt, Human
gaguguguaauuu

SEQ ID NO: 3739834 - RNA, 22 nt, Human
gaguguguaauuuaaaauugug

SEQ ID NO: 3739835 - RNA, 18 nt, Human
gaguguguauuguuccca

SEQ ID NO: 3739836 - RNA, 17 nt, Human
gagugugugauaaauca

SEQ ID NO: 3739837 - RNA, 18 nt, Human
gaguguguuuuauaaacu

SEQ ID NO: 3739838 - RNA, 15 nt, Human
gaguguuuaauaaag

SEQ ID NO: 3739839 - RNA, 23 nt, Human
gaguguuugggggacguuucuca

SEQ ID NO: 3739840 - RNA, 17 nt, Human
gaguuaaaaagggcagg

SEQ ID NO: 3739841 - RNA, 22 nt, Human
gaguuaaauagaguauaugcac

SEQ ID NO: 3739842 - RNA, 14 nt, Human
gaguuaagaccugg

SEQ ID NO: 3739843 - RNA, 13 nt, Human
gaguuacaguucu

SEQ ID NO: 3739844 - RNA, 16 nt, Human
gaguuacaguucugug

SEQ ID NO: 3739845 - RNA, 20 nt, Human
gaguuagaggccagccuggc

SEQ ID NO: 3739846 - RNA, 13 nt, Human
gaguuagccaucc

SEQ ID NO: 3739847 - RNA, 11 nt, Human
gaguuaggaac

SEQ ID NO: 3739848 - RNA, 20 nt, Human
gaguuaucaugaauuuuaaa

SEQ ID NO: 3739849 - RNA, 16 nt, Human
gaguuaucuaaaagaa

SEQ ID NO: 3739850 - RNA, 17 nt, Human
gaguuaugauguaaucu

SEQ ID NO: 3739851 - RNA, 22 nt, Human
gaguuaugauguaaucucucug

SEQ ID NO: 3739852 - RNA, 22 nt, Human
gaguucaauaaaugucuguuga

SEQ ID NO: 3739853 - RNA, 18 nt, Human
gaguucaaugaucuaggu

SEQ ID NO: 3739854 - RNA, 15 nt, Human
gaguucaauggcugc

SEQ ID NO: 3739855 - RNA, 19 nt, Human
gaguucaauggcugcugaa

SEQ ID NO: 3739856 - RNA, 16 nt, Human
gaguucagcugcuucu

SEQ ID NO: 3739857 - RNA, 21 nt, Human
gaguucagguagcugccccug

SEQ ID NO: 3739858 - RNA, 14 nt, Human
gaguucaguuuuac

SEQ ID NO: 3739859 - RNA, 14 nt, Human
gaguucauccaggc

SEQ ID NO: 3739860 - RNA, 14 nt, Human
gaguucaucuugaa

SEQ ID NO: 3739861 - RNA, 19 nt, Human
gaguucaucuugaauugua

SEQ ID NO: 3739862 - RNA, 18 nt, Human
gaguucauucauauuaca

SEQ ID NO: 3739863 - RNA, 15 nt, Human
gaguuccaguugaag

SEQ ID NO: 3739864 - RNA, 15 nt, Human
gaguuccaugaagac

SEQ ID NO: 3739865 - RNA, 18 nt, Human
gaguuccccaugcagaca

SEQ ID NO: 3739866 - RNA, 14 nt, Human
gaguuccugcaugc

SEQ ID NO: 3739867 - RNA, 18 nt, Human
gaguucgagaccagccug

SEQ ID NO: 3739868 - RNA, 21 nt, Human
gaguucgagaccagccuggcc

SEQ ID NO: 3739869 - RNA, 19 nt, Human
gaguucgaggcugcaguca

SEQ ID NO: 3739870 - RNA, 16 nt, Human
gaguucucagggcucc

SEQ ID NO: 3739871 - RNA, 16 nt, Human
gaguucugcucauucu

SEQ ID NO: 3739872 - RNA, 20 nt, Human
gaguucugcucauucuaaug

SEQ ID NO: 3739873 - RNA, 15 nt, Human
gaguucuuccuguaa

SEQ ID NO: 3739874 - RNA, 15 nt, Human
gaguucuugugccau

SEQ ID NO: 3739875 - RNA, 21 nt, Human
gaguucuuuuugaaguauuua

SEQ ID NO: 3739876 - RNA, 22 nt, Human
gaguugaaagaguuaagaaugu

SEQ ID NO: 3739877 - RNA, 19 nt, Human
gaguugaggaacuguacag

SEQ ID NO: 3739878 - RNA, 19 nt, Human
gaguugauacuacaguuug

SEQ ID NO: 3739879 - RNA, 19 nt, Human
gaguugaucuggaacccag

SEQ ID NO: 3739880 - RNA, 14 nt, Human
gaguugaugucucc

SEQ ID NO: 3739881 - RNA, 17 nt, Human
gugcucaguuguagaau

SEQ ID NO: 3739882 - RNA, 18 nt, Human
gugcuccauggcugccau

SEQ ID NO: 3739883 - RNA, 22 nt, Human
gugcuccauggcugccaucuca

SEQ ID NO: 3739884 - RNA, 15 nt, Human
gugcucccuaccacc

SEQ ID NO: 3739885 - RNA, 13 nt, Human
gugcuccgugccu

SEQ ID NO: 3739886 - RNA, 16 nt, Human
gugcuccgugccucca

SEQ ID NO: 3739887 - RNA, 22 nt, Human
gugcuccgugccuccaccacca

SEQ ID NO: 3739888 - RNA, 14 nt, Human
gugcucgcccugcg

SEQ ID NO: 3739889 - RNA, 22 nt, Human
gugcucgcuguugcugaauagg

SEQ ID NO: 3739890 - RNA, 13 nt, Human
gugcucucuuucu

SEQ ID NO: 3739891 - RNA, 16 nt, Human
gugcucucuuucuguc

SEQ ID NO: 3739892 - RNA, 14 nt, Human
gugcucuggacagg

SEQ ID NO: 3739893 - RNA, 15 nt, Human
gugcucuggacaggc

SEQ ID NO: 3739894 - RNA, 17 nt, Human
gugcucuucuucuuucu

SEQ ID NO: 3739895 - RNA, 22 nt, Human
gugcucuuuguuuugugucucu

SEQ ID NO: 3739896 - RNA, 23 nt, Human
gugcucuuuguuuugugucucuu

SEQ ID NO: 3739897 - RNA, 21 nt, Human
gugcugaacaguggaggaaga

SEQ ID NO: 3739898 - RNA, 23 nt, Human
gugcugaaugguuuucaaaauaa

SEQ ID NO: 3739899 - RNA, 16 nt, Human
gugcugacagcugcuc

SEQ ID NO: 3739900 - RNA, 21 nt, Human
gugcugacauggcucuggacu

SEQ ID NO: 3739901 - RNA, 14 nt, Human
gugcugacccuccu

SEQ ID NO: 3739902 - RNA, 14 nt, Human
gugcugaccucugg

SEQ ID NO: 3739903 - RNA, 16 nt, Human
gugcugacggccaggg

SEQ ID NO: 3739904 - RNA, 23 nt, Human
gugcugacggccagggagaagcu

SEQ ID NO: 3739905 - RNA, 11 nt, Human
gugcugagaag

SEQ ID NO: 3739906 - RNA, 14 nt, Human
gugcugagauuaca

SEQ ID NO: 3739907 - RNA, 22 nt, Human
gugcugaggccuuaucauucau

SEQ ID NO: 3739908 - RNA, 14 nt, Human
gugcugaguagaug

SEQ ID NO: 3739909 - RNA, 12 nt, Human
gugcugagucug

SEQ ID NO: 3739910 - RNA, 17 nt, Human
gugcugagucugaaggc

SEQ ID NO: 3739911 - RNA, 23 nt, Human
gugcugaguugguguugacaugu

SEQ ID NO: 3739912 - RNA, 22 nt, Human
gugcugcagcaccgaggggccu

SEQ ID NO: 3739913 - RNA, 12 nt, Human
gugcugcauuua

SEQ ID NO: 3739914 - RNA, 19 nt, Human
gugcugcauuuaaaagaua

SEQ ID NO: 3739915 - RNA, 20 nt, Human
gugcugcauuuaaaagauac

SEQ ID NO: 3739916 - RNA, 15 nt, Human
gugcugccauccagg

SEQ ID NO: 3739917 - RNA, 18 nt, Human
gugcugccauccagguuc

SEQ ID NO: 3739918 - RNA, 21 nt, Human
gugcugcccgucuucagccua

SEQ ID NO: 3739919 - RNA, 11 nt, Human
gugcugccucu

SEQ ID NO: 3739920 - RNA, 13 nt, Human
gugcugccugucc

SEQ ID NO: 3739921 - RNA, 15 nt, Human
gugcugcuaauucuu

SEQ ID NO: 3739922 - RNA, 19 nt, Human
gugcugcuaauucuuugca

SEQ ID NO: 3739923 - RNA, 17 nt, Human
gugcugcuacccucccu

SEQ ID NO: 3739924 - RNA, 23 nt, Human
gugcugcuacccucccugcuguc

SEQ ID NO: 3739925 - RNA, 15 nt, Human
gugcugcugcugcug

SEQ ID NO: 3739926 - RNA, 13 nt, Human
gugcugcuuugau

SEQ ID NO: 3739927 - RNA, 17 nt, Human
gugcuggagcacugggc

SEQ ID NO: 3739928 - RNA, 19 nt, Human
gugcuggagcacugggcuc

SEQ ID NO: 3739929 - RNA, 18 nt, Human
gugcuggagccacuaacu

SEQ ID NO: 3739930 - RNA, 24 nt, Human
gugcuggaggugggagcaggagau

SEQ ID NO: 3739931 - RNA, 18 nt, Human
gugcuggauggagcccag

SEQ ID NO: 3739932 - RNA, 22 nt, Human
gugcugggaaccucaggguauu

SEQ ID NO: 3739933 - RNA, 17 nt, Human
gugcugggacugagcca

SEQ ID NO: 3739934 - RNA, 17 nt, Human
gugcugggagaggcagc

SEQ ID NO: 3739935 - RNA, 18 nt, Human
gugcugggagaggcagcc

SEQ ID NO: 3739936 - RNA, 22 nt, Human
gugcugggagcuccacucugcu

SEQ ID NO: 3739937 - RNA, 15 nt, Human
gugcugggaggaggg

SEQ ID NO: 3739938 - RNA, 22 nt, Human
gugcugggauuacaagcgugag

SEQ ID NO: 3739939 - RNA, 20 nt, Human
gugcugggauuacaggugua

SEQ ID NO: 3739940 - RNA, 19 nt, Human
gugcugggccccugccucu

SEQ ID NO: 3739941 - RNA, 15 nt, Human
gugcugguguccuga

SEQ ID NO: 3739942 - RNA, 16 nt, Human
gugcuguauaaaauca

SEQ ID NO: 3739943 - RNA, 17 nt, Human
gugcuguauaaaaucag

SEQ ID NO: 3739944 - RNA, 15 nt, Human
gugcugugaccauuu

SEQ ID NO: 3739945 - RNA, 16 nt, Human
gugcugugcccaaguu

SEQ ID NO: 3739946 - RNA, 14 nt, Human
gugcuguggccagg

SEQ ID NO: 3739947 - RNA, 19 nt, Human
gugcuguggggcugguagc

SEQ ID NO: 3739948 - RNA, 23 nt, Human
gugcuguggggcugguagcucag

SEQ ID NO: 3739949 - RNA, 19 nt, Human
gugcuguuuauuaaucuua

SEQ ID NO: 3739950 - RNA, 14 nt, Human
gugcuguuucaaag

SEQ ID NO: 3739951 - RNA, 16 nt, Human
gugcuguuucaaaguu

SEQ ID NO: 3739952 - RNA, 16 nt, Human
gugcuguuuuguuaua

SEQ ID NO: 3739953 - RNA, 19 nt, Human
gugcuguuuuguuauauaa

SEQ ID NO: 3739954 - RNA, 13 nt, Human
gugcuuaaguucc

SEQ ID NO: 3739955 - RNA, 21 nt, Human
gugcuuaugcucuuaauugcc

SEQ ID NO: 3739956 - RNA, 16 nt, Human
gugcuucaacauucuu

SEQ ID NO: 3739957 - RNA, 13 nt, Human
gugcuuccuugua

SEQ ID NO: 3739958 - RNA, 22 nt, Human
gugcuucuaguucugccaggag

SEQ ID NO: 3739959 - RNA, 22 nt, Human
gugcuucugccacccugcugag

SEQ ID NO: 3739960 - RNA, 18 nt, Human
gugcuugaaggcccugcu

SEQ ID NO: 3739961 - RNA, 19 nt, Human
gugcuugaaggcccugcug

SEQ ID NO: 3739962 - RNA, 20 nt, Human
gugcuugaaggcccugcuga

SEQ ID NO: 3739963 - RNA, 16 nt, Human
gugcuugccacagagc

SEQ ID NO: 3739964 - RNA, 14 nt, Human
gugcuuggcccagg

SEQ ID NO: 3739965 - RNA, 15 nt, Human
gugcuuggcccagga

SEQ ID NO: 3739966 - RNA, 17 nt, Human
gugcuuggcccaggagu

SEQ ID NO: 3739967 - RNA, 24 nt, Human
gugcuuggcccaggaguuuggcca

SEQ ID NO: 3739968 - RNA, 18 nt, Human
gugcuuguguaauuuaug

SEQ ID NO: 3739969 - RNA, 15 nt, Human
gugcuugugugugug

SEQ ID NO: 3739970 - RNA, 20 nt, Human
gugcuuguucccucucccug

SEQ ID NO: 3739971 - RNA, 21 nt, Human
gugcuuguuugcucaccuggg

SEQ ID NO: 3739972 - RNA, 23 nt, Human
gugcuuguuugcucaccuggggu

SEQ ID NO: 3739973 - RNA, 13 nt, Human
gugcuuguuuuau

SEQ ID NO: 3739974 - RNA, 15 nt, Human
gugcuuuccagcuca

SEQ ID NO: 3739975 - RNA, 12 nt, Human
gugcuuucuauu

SEQ ID NO: 3739976 - RNA, 17 nt, Human
gugcuuucuauuguaca

SEQ ID NO: 3739977 - RNA, 22 nt, Human
gugcuuucuauuguacagaagc

SEQ ID NO: 3739978 - RNA, 15 nt, Human
gugcuuuuaaaugca

SEQ ID NO: 3739979 - RNA, 17 nt, Human
gugcuuuuccuauuugu

SEQ ID NO: 3739980 - RNA, 14 nt, Human
gugcuuuucuccaa

SEQ ID NO: 3739981 - RNA, 16 nt, Human
gugcuuuuuauaaaaa

SEQ ID NO: 3739982 - RNA, 16 nt, Human
gugcuuuuuuugugug

SEQ ID NO: 3739983 - RNA, 12 nt, Human
guggaaaaacac

SEQ ID NO: 3739984 - RNA, 13 nt, Human
guggaaaaauauu

SEQ ID NO: 3739985 - RNA, 21 nt, Human
guggaaaacuuaugcugauuu

SEQ ID NO: 3739986 - RNA, 14 nt, Human
guggaaagccucug

SEQ ID NO: 3739987 - RNA, 16 nt, Human
guggaaagugaauuug

SEQ ID NO: 3739988 - RNA, 16 nt, Human
guggaaaguguaaagc

SEQ ID NO: 3739989 - RNA, 20 nt, Human
guggaaauuaagaagaaacu

SEQ ID NO: 3739990 - RNA, 19 nt, Human
guggaacauaaaaaggaca

SEQ ID NO: 3739991 - RNA, 15 nt, Human
guggaaccaggaacc

SEQ ID NO: 3739992 - RNA, 17 nt, Human
guggaagaagagggaga

SEQ ID NO: 3739993 - RNA, 16 nt, Human
guggaagaagggagaa

SEQ ID NO: 3739994 - RNA, 14 nt, Human
guggaagagggcug

SEQ ID NO: 3739995 - RNA, 16 nt, Human
guggaagaggggacag

SEQ ID NO: 3739996 - RNA, 17 nt, Human
guggaagaggggacagg

SEQ ID NO: 3739997 - RNA, 15 nt, Human
guggaagagugugug

SEQ ID NO: 3739998 - RNA, 16 nt, Human
guggaagcccuccuuc

SEQ ID NO: 3739999 - RNA, 16 nt, Human
guggaagcuuggggaa

SEQ ID NO: 3740000 - RNA, 19 nt, Human
guggaagcuuggggaagac

SEQ ID NO: 3740001 - RNA, 16 nt, Human
guggaaggcaagccag

SEQ ID NO: 3740002 - RNA, 21 nt, Human
guggaagugugggucugugug

SEQ ID NO: 3740003 - RNA, 18 nt, Human
guggaaguuccaagucca

SEQ ID NO: 3740004 - RNA, 20 nt, Human
guggaauaguauccuccagg

SEQ ID NO: 3740005 - RNA, 22 nt, Human
guggaauaguauccuccagguu

SEQ ID NO: 3740006 - RNA, 18 nt, Human
guggaauauaaggaaagc

SEQ ID NO: 3740007 - RNA, 16 nt, Human
guggaauguuggauaa

SEQ ID NO: 3740008 - RNA, 16 nt, Human
guggaauuauuuuaaa

SEQ ID NO: 3740009 - RNA, 17 nt, Human
guggacaaacuggaguc

SEQ ID NO: 3740010 - RNA, 14 nt, Human
guggacacagcucu

SEQ ID NO: 3740011 - RNA, 16 nt, Human
guggacaccugcccug

SEQ ID NO: 3740012 - RNA, 17 nt, Human
guggacaccugcccugc

SEQ ID NO: 3740013 - RNA, 12 nt, Human
guggacaggacu

SEQ ID NO: 3740014 - RNA, 22 nt, Human
guggacagucugcucuagauga

SEQ ID NO: 3740015 - RNA, 14 nt, Human
guggaccaggacag

SEQ ID NO: 3740016 - RNA, 22 nt, Human
guggaccaucgcugucaugagu

SEQ ID NO: 3740017 - RNA, 19 nt, Human
guggacccagcgggcaggu

SEQ ID NO: 3740018 - RNA, 22 nt, Human
guggacccagggaugacauguc

SEQ ID NO: 3740019 - RNA, 16 nt, Human
guggacccugaaaugu

SEQ ID NO: 3740020 - RNA, 23 nt, Human
guggacccugaaaugugugugau

SEQ ID NO: 3740021 - RNA, 17 nt, Human
guggaccuuaggccuuc

SEQ ID NO: 3740022 - RNA, 18 nt, Human
guggacucuuugguggcu

SEQ ID NO: 3740023 - RNA, 17 nt, Human
guggacugagugggaag

SEQ ID NO: 3740024 - RNA, 18 nt, Human
guggacugagugggaagc

SEQ ID NO: 3740025 - RNA, 20 nt, Human
guggacugagugggaagccc

SEQ ID NO: 3740026 - RNA, 13 nt, Human
guggacuggaagg

SEQ ID NO: 3740027 - RNA, 16 nt, Human
guggacuggccccugg

SEQ ID NO: 3740028 - RNA, 22 nt, Human
guggacuguggcacuugccugg

SEQ ID NO: 3740029 - RNA, 16 nt, Human
guggacuuuccacccc

SEQ ID NO: 3740030 - RNA, 16 nt, Human
guggagaacuccuagg

SEQ ID NO: 3740031 - RNA, 23 nt, Human
guuccccucagaaaaaaauucau

SEQ ID NO: 3740032 - RNA, 12 nt, Human
guuccccucucc

SEQ ID NO: 3740033 - RNA, 16 nt, Human
guuccccucucccuuc

SEQ ID NO: 3740034 - RNA, 19 nt, Human
guuccccucucccuucccu

SEQ ID NO: 3740035 - RNA, 21 nt, Human
guuccccucuugucuccccug

SEQ ID NO: 3740036 - RNA, 21 nt, Human
guuccccuggaagcagugccc

SEQ ID NO: 3740037 - RNA, 15 nt, Human
guuccccuuccacug

SEQ ID NO: 3740038 - RNA, 22 nt, Human
guuccccuuccacugagggcag

SEQ ID NO: 3740039 - RNA, 16 nt, Human
guucccgcggggcugu

SEQ ID NO: 3740040 - RNA, 14 nt, Human
guucccggcuggac

SEQ ID NO: 3740041 - RNA, 15 nt, Human
guucccggucccgag

SEQ ID NO: 3740042 - RNA, 16 nt, Human
guucccguuucuccac

SEQ ID NO: 3740043 - RNA, 13 nt, Human
guucccucccaga

SEQ ID NO: 3740044 - RNA, 14 nt, Human
guucccucugagaa

SEQ ID NO: 3740045 - RNA, 22 nt, Human
guucccucugagaauuccaagg

SEQ ID NO: 3740046 - RNA, 19 nt, Human
guucccugaaaacccagag

SEQ ID NO: 3740047 - RNA, 21 nt, Human
guucccugaaaacccagagag

SEQ ID NO: 3740048 - RNA, 16 nt, Human
guucccugaaacacga

SEQ ID NO: 3740049 - RNA, 17 nt, Human
guucccuguucuuccuc

SEQ ID NO: 3740050 - RNA, 20 nt, Human
guucccuugagggcugcagu

SEQ ID NO: 3740051 - RNA, 16 nt, Human
guucccuuggccucag

SEQ ID NO: 3740052 - RNA, 19 nt, Human
guucccuuggccucagaau

SEQ ID NO: 3740053 - RNA, 20 nt, Human
guucccuuugcuccacccca

SEQ ID NO: 3740054 - RNA, 19 nt, Human
guucccuuugucuuucaaa

SEQ ID NO: 3740055 - RNA, 21 nt, Human
guucccuuuuuuggcugcuga

SEQ ID NO: 3740056 - RNA, 23 nt, Human
guuccgcacuuuccacuucuucc

SEQ ID NO: 3740057 - RNA, 19 nt, Human
guuccggaauccuguccuc

SEQ ID NO: 3740058 - RNA, 14 nt, Human
guuccggcauggac

SEQ ID NO: 3740059 - RNA, 17 nt, Human
guuccuacacaggacag

SEQ ID NO: 3740060 - RNA, 14 nt, Human
guuccuagagaaga

SEQ ID NO: 3740061 - RNA, 18 nt, Human
guuccuaggggaaugagg

SEQ ID NO: 3740062 - RNA, 20 nt, Human
guuccuaggggaaugagggg

SEQ ID NO: 3740063 - RNA, 15 nt, Human
guuccuauugucauu

SEQ ID NO: 3740064 - RNA, 20 nt, Human
guuccucaaagcuuggauua

SEQ ID NO: 3740065 - RNA, 22 nt, Human
guuccucauuagcauuuugcua

SEQ ID NO: 3740066 - RNA, 23 nt, Human
guuccuccccuccagcucccugu

SEQ ID NO: 3740067 - RNA, 16 nt, Human
guuccucgcccugggu

SEQ ID NO: 3740068 - RNA, 17 nt, Human
guuccucguucucccug

SEQ ID NO: 3740069 - RNA, 20 nt, Human
guuccucguucucccuggga

SEQ ID NO: 3740070 - RNA, 12 nt, Human
guuccucucugg

SEQ ID NO: 3740071 - RNA, 14 nt, Human
guuccucugccugc

SEQ ID NO: 3740072 - RNA, 15 nt, Human
guuccucugccugcc

SEQ ID NO: 3740073 - RNA, 16 nt, Human
guuccugaaccugaug

SEQ ID NO: 3740074 - RNA, 20 nt, Human
guuccugacaucacagcagc

SEQ ID NO: 3740075 - RNA, 22 nt, Human
guuccugaugacccaggcugcc

SEQ ID NO: 3740076 - RNA, 12 nt, Human
guuccugcagca

SEQ ID NO: 3740077 - RNA, 18 nt, Human
guuccugcagcagagccu

SEQ ID NO: 3740078 - RNA, 15 nt, Human
guuccugcugcuguc

SEQ ID NO: 3740079 - RNA, 21 nt, Human
guuccuggcaauaguguguuc

SEQ ID NO: 3740080 - RNA, 13 nt, Human
guuccugucccug

SEQ ID NO: 3740081 - RNA, 15 nt, Human
guuccugucccugcg

SEQ ID NO: 3740082 - RNA, 17 nt, Human
guuccuucccaauccag

SEQ ID NO: 3740083 - RNA, 17 nt, Human
guuccuuccucugagcc

SEQ ID NO: 3740084 - RNA, 23 nt, Human
guuccuuuccuuuucuuuaaaga

SEQ ID NO: 3740085 - RNA, 18 nt, Human
guuccuuuguguguacuc

SEQ ID NO: 3740086 - RNA, 19 nt, Human
guuccuuuguguguacuca

SEQ ID NO: 3740087 - RNA, 22 nt, Human
guucgacgagacggucgagcag

SEQ ID NO: 3740088 - RNA, 16 nt, Human
guucgacucagccuca

SEQ ID NO: 3740089 - RNA, 19 nt, Human
guucgagaccaaccugacc

SEQ ID NO: 3740090 - RNA, 15 nt, Human
guucgagaccagccu

SEQ ID NO: 3740091 - RNA, 18 nt, Human
guucgagaccagccuggc

SEQ ID NO: 3740092 - RNA, 22 nt, Human
guucgaggacuacaaccaauuu

SEQ ID NO: 3740093 - RNA, 16 nt, Human
guucgcagccacccug

SEQ ID NO: 3740094 - RNA, 15 nt, Human
guucgccuggagccc

SEQ ID NO: 3740095 - RNA, 13 nt, Human
guucguagcuuuc

SEQ ID NO: 3740096 - RNA, 14 nt, Human
guucguugguuaua

SEQ ID NO: 3740097 - RNA, 16 nt, Human
guucuaaaagguguga

SEQ ID NO: 3740098 - RNA, 14 nt, Human
guucuaaagcucug

SEQ ID NO: 3740099 - RNA, 14 nt, Human
guucuaaaguucua

SEQ ID NO: 3740100 - RNA, 15 nt, Human
guucuaaaguucuaa

SEQ ID NO: 3740101 - RNA, 20 nt, Human
guucuaagacucaaauguuc

SEQ ID NO: 3740102 - RNA, 14 nt, Human
guucuaagauucua

SEQ ID NO: 3740103 - RNA, 23 nt, Human
guucuaaggccuaggauucuaaa

SEQ ID NO: 3740104 - RNA, 12 nt, Human
guucuaaggcuc

SEQ ID NO: 3740105 - RNA, 13 nt, Human
guucuaaggcucu

SEQ ID NO: 3740106 - RNA, 16 nt, Human
guucuaaggcucugag

SEQ ID NO: 3740107 - RNA, 17 nt, Human
guucuaagucuuuccau

SEQ ID NO: 3740108 - RNA, 14 nt, Human
guucuaaguuucua

SEQ ID NO: 3740109 - RNA, 17 nt, Human
guucuaaguuucuaaga

SEQ ID NO: 3740110 - RNA, 18 nt, Human
guucuaaguuucuaagau

SEQ ID NO: 3740111 - RNA, 19 nt, Human
guucuaaguuucuaagauu

SEQ ID NO: 3740112 - RNA, 16 nt, Human
guucuacccaggugcu

SEQ ID NO: 3740113 - RNA, 21 nt, Human
guucuaccucaggcagcucaa

SEQ ID NO: 3740114 - RNA, 13 nt, Human
guucuacucaggc

SEQ ID NO: 3740115 - RNA, 12 nt, Human
guucuagaaaaa

SEQ ID NO: 3740116 - RNA, 14 nt, Human
guucuagaaaaaca

SEQ ID NO: 3740117 - RNA, 18 nt, Human
guucuagaaaaacaggca

SEQ ID NO: 3740118 - RNA, 18 nt, Human
guucuagcauggcauauu

SEQ ID NO: 3740119 - RNA, 17 nt, Human
guucuagcgcaguuuuu

SEQ ID NO: 3740120 - RNA, 17 nt, Human
guucuaggaaaauaaaa

SEQ ID NO: 3740121 - RNA, 21 nt, Human
guucuagucuccuuugcacug

SEQ ID NO: 3740122 - RNA, 23 nt, Human
guucuagucuccuuugcacugag

SEQ ID NO: 3740123 - RNA, 14 nt, Human
guucuaguuugcau

SEQ ID NO: 3740124 - RNA, 12 nt, Human
guucuauccaaa

SEQ ID NO: 3740125 - RNA, 22 nt, Human
guucuauccaaacauguauuua

SEQ ID NO: 3740126 - RNA, 17 nt, Human
guucuauuucuauccca

SEQ ID NO: 3740127 - RNA, 18 nt, Human
guucuauuucuaucccaa

SEQ ID NO: 3740128 - RNA, 14 nt, Human
guucuauuuggaau

SEQ ID NO: 3740129 - RNA, 16 nt, Human
guucucacuguucccu

SEQ ID NO: 3740130 - RNA, 15 nt, Human
guucucagggcuccu

SEQ ID NO: 3740131 - RNA, 16 nt, Human
guucucaucuuucuug

SEQ ID NO: 3740132 - RNA, 21 nt, Human
guucuccaacaucacagccca

SEQ ID NO: 3740133 - RNA, 21 nt, Human
guucuccguuagcuccugugg

SEQ ID NO: 3740134 - RNA, 18 nt, Human
guucuccucuccccucua

SEQ ID NO: 3740135 - RNA, 14 nt, Human
guucucuagaaaga

SEQ ID NO: 3740136 - RNA, 16 nt, Human
guucucuccuccccaa

SEQ ID NO: 3740137 - RNA, 18 nt, Human
guucucucuaugguaaag

SEQ ID NO: 3740138 - RNA, 13 nt, Human
guucucucugccu

SEQ ID NO: 3740139 - RNA, 15 nt, Human
guucucucuucucca

SEQ ID NO: 3740140 - RNA, 12 nt, Human
guucucugagga

SEQ ID NO: 3740141 - RNA, 17 nt, Human
guucucugcccuccaag

SEQ ID NO: 3740142 - RNA, 13 nt, Human
guucucugggaga

SEQ ID NO: 3740143 - RNA, 19 nt, Human
guucucugggagaaaauca

SEQ ID NO: 3740144 - RNA, 21 nt, Human
guucucugggagaaaaucauc

SEQ ID NO: 3740145 - RNA, 13 nt, Human
guucugaaauauu

SEQ ID NO: 3740146 - RNA, 13 nt, Human
guucugaagaaga

SEQ ID NO: 3740147 - RNA, 20 nt, Human
guucugaauaugcugcucau

SEQ ID NO: 3740148 - RNA, 15 nt, Human
guucugacauuaaca

SEQ ID NO: 3740149 - RNA, 16 nt, Human
guucugacauuaacag

SEQ ID NO: 3740150 - RNA, 21 nt, Human
guucugacauuaacaguuuuc

SEQ ID NO: 3740151 - RNA, 17 nt, Human
guucugaugaugugccu

SEQ ID NO: 3740152 - RNA, 14 nt, Human
guucugcaaauaga

SEQ ID NO: 3740153 - RNA, 21 nt, Human
guucugcaaauagaaaacagg

SEQ ID NO: 3740154 - RNA, 15 nt, Human
guucugcacugaaaa

SEQ ID NO: 3740155 - RNA, 20 nt, Human
guucugcagacacgccuucc

SEQ ID NO: 3740156 - RNA, 15 nt, Human
guucugccagaucuu

SEQ ID NO: 3740157 - RNA, 13 nt, Human
guucugccaggag

SEQ ID NO: 3740158 - RNA, 15 nt, Human
guucugcccccagcc

SEQ ID NO: 3740159 - RNA, 16 nt, Human
guucugcccccagccc

SEQ ID NO: 3740160 - RNA, 20 nt, Human
guucugcccccagcccaaag

SEQ ID NO: 3740161 - RNA, 11 nt, Human
guucugccucu

SEQ ID NO: 3740162 - RNA, 13 nt, Human
guucugccugcca

SEQ ID NO: 3740163 - RNA, 22 nt, Human
guucugccugccagcugcacug

SEQ ID NO: 3740164 - RNA, 17 nt, Human
guucugcuaaauuucaa

SEQ ID NO: 3740165 - RNA, 19 nt, Human
guucugcuaaauuucaaau

SEQ ID NO: 3740166 - RNA, 17 nt, Human
guucugcuccagacagg

SEQ ID NO: 3740167 - RNA, 11 nt, Human
guucugcuccu

SEQ ID NO: 3740168 - RNA, 19 nt, Human
guucugcuccucuccaggc

SEQ ID NO: 3740169 - RNA, 13 nt, Human
guucugcuggccu

SEQ ID NO: 3740170 - RNA, 23 nt, Human
guucugcuucaaggcuuccacug

SEQ ID NO: 3740171 - RNA, 16 nt, Human
guucuggccagaaugc

SEQ ID NO: 3740172 - RNA, 15 nt, Human
guucuggcccucacc

SEQ ID NO: 3740173 - RNA, 16 nt, Human
guucuggcuguuugag

SEQ ID NO: 3740174 - RNA, 16 nt, Human
guucuggggggaccca

SEQ ID NO: 3740175 - RNA, 23 nt, Human
guucugguaugaacuugaggaca

SEQ ID NO: 3740176 - RNA, 14 nt, Human
guucuggugaggcc

SEQ ID NO: 3740177 - RNA, 15 nt, Human
guucuggugaggccu

SEQ ID NO: 3740178 - RNA, 17 nt, Human
guucugguuagcucagc

SEQ ID NO: 3740179 - RNA, 14 nt, Human
guucuguagaaaug

SEQ ID NO: 3740180 - RNA, 22 nt, Human
guucuguagaaaugguuguauu

SEQ ID NO: 3740181 - RNA, 20 nt, Human
guucuguauuugaaagugcc

SEQ ID NO: 3740182 - RNA, 15 nt, Human
gaguugauucagcuc

SEQ ID NO: 3740183 - RNA, 16 nt, Human
gaguugauucagcucu

SEQ ID NO: 3740184 - RNA, 16 nt, Human
gaguugcauugauuca

SEQ ID NO: 3740185 - RNA, 18 nt, Human
gaguugcugcaaaccuga

SEQ ID NO: 3740186 - RNA, 20 nt, Human
gaguuggagacccgccuggc

SEQ ID NO: 3740187 - RNA, 20 nt, Human
gaguuggaguagaauguagu

SEQ ID NO: 3740188 - RNA, 12 nt, Human
gaguuguaaaua

SEQ ID NO: 3740189 - RNA, 19 nt, Human
gaguuguaaauauauaaau

SEQ ID NO: 3740190 - RNA, 15 nt, Human
gaguuguggguagug

SEQ ID NO: 3740191 - RNA, 22 nt, Human
gaguuguuacauuuuuaagugc

SEQ ID NO: 3740192 - RNA, 16 nt, Human
gaguuguuuuuguaua

SEQ ID NO: 3740193 - RNA, 13 nt, Human
gaguuuaaaaauc

SEQ ID NO: 3740194 - RNA, 16 nt, Human
gaguuuaaauuguaau

SEQ ID NO: 3740195 - RNA, 20 nt, Human
gaguuuagggaacaauuugg

SEQ ID NO: 3740196 - RNA, 14 nt, Human
gaguuuaggguggg

SEQ ID NO: 3740197 - RNA, 15 nt, Human
gaguuucauguacaa

SEQ ID NO: 3740198 - RNA, 19 nt, Human
gaguuucauucuccugccu

SEQ ID NO: 3740199 - RNA, 15 nt, Human
gaguuuccuaaaagu

SEQ ID NO: 3740200 - RNA, 17 nt, Human
gaguuuccuaugggaac

SEQ ID NO: 3740201 - RNA, 21 nt, Human
gaguuuccucaggcugcugga

SEQ ID NO: 3740202 - RNA, 13 nt, Human
gaguuucuaaggu

SEQ ID NO: 3740203 - RNA, 15 nt, Human
gaguuucuguuugau

SEQ ID NO: 3740204 - RNA, 20 nt, Human
gaguuugagaccagccuggc

SEQ ID NO: 3740205 - RNA, 19 nt, Human
gaguuuggagagagcagac

SEQ ID NO: 3740206 - RNA, 22 nt, Human
gaguuuggagagagcagacugg

SEQ ID NO: 3740207 - RNA, 12 nt, Human
gaguuuggccag

SEQ ID NO: 3740208 - RNA, 20 nt, Human
gaguuugggguaugggagag

SEQ ID NO: 3740209 - RNA, 12 nt, Human
gaguuugguccc

SEQ ID NO: 3740210 - RNA, 11 nt, Human
gaguuuguagg

SEQ ID NO: 3740211 - RNA, 18 nt, Human
gaguuugucgcucaugug

SEQ ID NO: 3740212 - RNA, 15 nt, Human
gaguuuuguguuugu

SEQ ID NO: 3740213 - RNA, 13 nt, Human
gauaaaaaauuuu

SEQ ID NO: 3740214 - RNA, 18 nt, Human
gauaaaaaauuuuguaau

SEQ ID NO: 3740215 - RNA, 19 nt, Human
gauaaaagacagugaaaga

SEQ ID NO: 3740216 - RNA, 23 nt, Human
gauaaaagauacauuuguauguu

SEQ ID NO: 3740217 - RNA, 19 nt, Human
gauaaaagggcaaaucugc

SEQ ID NO: 3740218 - RNA, 13 nt, Human
gauaaaaucauaa

SEQ ID NO: 3740219 - RNA, 23 nt, Human
gauaaaaucauaaguauuuggaa

SEQ ID NO: 3740220 - RNA, 16 nt, Human
gauaaaaugacuacuu

SEQ ID NO: 3740221 - RNA, 19 nt, Human
gauaaaauuauagauggga

SEQ ID NO: 3740222 - RNA, 16 nt, Human
gauaaacaacaaggug

SEQ ID NO: 3740223 - RNA, 14 nt, Human
gauaaacacaagau

SEQ ID NO: 3740224 - RNA, 22 nt, Human
gauaaacacaagauugguguuu

SEQ ID NO: 3740225 - RNA, 18 nt, Human
gauaaaccuagauaaaga

SEQ ID NO: 3740226 - RNA, 18 nt, Human
gauaaacuuuuagaaacu

SEQ ID NO: 3740227 - RNA, 15 nt, Human
gauaaagauaucaau

SEQ ID NO: 3740228 - RNA, 16 nt, Human
gauaaagauugugugg

SEQ ID NO: 3740229 - RNA, 21 nt, Human
gauaaagauugugugguguuu

SEQ ID NO: 3740230 - RNA, 19 nt, Human
gauaaagauuuuuuaauaa

SEQ ID NO: 3740231 - RNA, 16 nt, Human
gauaaagcagcucagg

SEQ ID NO: 3740232 - RNA, 17 nt, Human
gauaaagccacugaaaa

SEQ ID NO: 3740233 - RNA, 18 nt, Human
gauaaagguucaugcaaa

SEQ ID NO: 3740234 - RNA, 17 nt, Human
gauaaaguaguaaaaau

SEQ ID NO: 3740235 - RNA, 19 nt, Human
gauaaaguugguaaaccuu

SEQ ID NO: 3740236 - RNA, 18 nt, Human
gauaaauaaucggcccac

SEQ ID NO: 3740237 - RNA, 17 nt, Human
gauaaauaguguuauug

SEQ ID NO: 3740238 - RNA, 22 nt, Human
gauaaauaguuuaugauuccac

SEQ ID NO: 3740239 - RNA, 15 nt, Human
gauaaauauuauauu

SEQ ID NO: 3740240 - RNA, 19 nt, Human
gauaaaucauaaagucagu

SEQ ID NO: 3740241 - RNA, 11 nt, Human
gauaaaugcca

SEQ ID NO: 3740242 - RNA, 15 nt, Human
gauaaaugccaucaa

SEQ ID NO: 3740243 - RNA, 12 nt, Human
gauaaauuauaa

SEQ ID NO: 3740244 - RNA, 16 nt, Human
gauaaauuccacugga

SEQ ID NO: 3740245 - RNA, 11 nt, Human
gauaacaaaga

SEQ ID NO: 3740246 - RNA, 11 nt, Human
gauaacagcua

SEQ ID NO: 3740247 - RNA, 17 nt, Human
gauaaccuauaugauuu

SEQ ID NO: 3740248 - RNA, 21 nt, Human
gauaacgcuuaaaggaaguca

SEQ ID NO: 3740249 - RNA, 20 nt, Human
gauaacuagauggugcugag

SEQ ID NO: 3740250 - RNA, 17 nt, Human
gauaacuguuauuuaua

SEQ ID NO: 3740251 - RNA, 16 nt, Human
gauaacuuuacagaaa

SEQ ID NO: 3740252 - RNA, 19 nt, Human
gauaacuuuacagaaaugg

SEQ ID NO: 3740253 - RNA, 11 nt, Human
gauaagaaaac

SEQ ID NO: 3740254 - RNA, 20 nt, Human
gauaagagggcacacacugu

SEQ ID NO: 3740255 - RNA, 22 nt, Human
gauaagaguagaaacugcaggg

SEQ ID NO: 3740256 - RNA, 16 nt, Human
gauaagaguuggcugg

SEQ ID NO: 3740257 - RNA, 20 nt, Human
gauaaggacaugaugcuuuu

SEQ ID NO: 3740258 - RNA, 20 nt, Human
gauaagguaaaaugccauga

SEQ ID NO: 3740259 - RNA, 22 nt, Human
gauaaguguucugucugacuuu

SEQ ID NO: 3740260 - RNA, 14 nt, Human
gauaaguucauaca

SEQ ID NO: 3740261 - RNA, 23 nt, Human
gauaaguucuuaugccauguuaa

SEQ ID NO: 3740262 - RNA, 21 nt, Human
gauaauaaggaaaaguuuaau

SEQ ID NO: 3740263 - RNA, 22 nt, Human
gauaauaaggaaaaguuuaaua

SEQ ID NO: 3740264 - RNA, 17 nt, Human
gauaauaauauuguuuu

SEQ ID NO: 3740265 - RNA, 20 nt, Human
gauaauaauauuguuuuucu

SEQ ID NO: 3740266 - RNA, 12 nt, Human
gauaauacacca

SEQ ID NO: 3740267 - RNA, 22 nt, Human
gauaauacaccacuacauucug

SEQ ID NO: 3740268 - RNA, 24 nt, Human
gauaauacaccacuacauucuguu

SEQ ID NO: 3740269 - RNA, 22 nt, Human
gauaauauuguuugguaaaugu

SEQ ID NO: 3740270 - RNA, 15 nt, Human
gauaaucagccucuu

SEQ ID NO: 3740271 - RNA, 20 nt, Human
gauaaucucagugcuuuccu

SEQ ID NO: 3740272 - RNA, 18 nt, Human
gauaaucuuagcugccaa

SEQ ID NO: 3740273 - RNA, 15 nt, Human
gauaaugauaaaaca

SEQ ID NO: 3740274 - RNA, 19 nt, Human
gauaaugguguuuuuuaga

SEQ ID NO: 3740275 - RNA, 15 nt, Human
gauaauguauuuuaa

SEQ ID NO: 3740276 - RNA, 17 nt, Human
gauaauuccaguggucc

SEQ ID NO: 3740277 - RNA, 18 nt, Human
gauaauucuagcuuugag

SEQ ID NO: 3740278 - RNA, 11 nt, Human
gauaauugcua

SEQ ID NO: 3740279 - RNA, 12 nt, Human
gauaauuuuaaa

SEQ ID NO: 3740280 - RNA, 22 nt, Human
gauaauuuuccuuuaauaugaa

SEQ ID NO: 3740281 - RNA, 16 nt, Human
gauacaaaagcaugug

SEQ ID NO: 3740282 - RNA, 19 nt, Human
gauacaaacacuacagaca

SEQ ID NO: 3740283 - RNA, 16 nt, Human
gauacaaaugucuauc

SEQ ID NO: 3740284 - RNA, 17 nt, Human
gauacaaaugucuauca

SEQ ID NO: 3740285 - RNA, 16 nt, Human
gauacaaccucccucu

SEQ ID NO: 3740286 - RNA, 16 nt, Human
gauacaaucagcugcu

SEQ ID NO: 3740287 - RNA, 18 nt, Human
gauacaaugcugugcccu

SEQ ID NO: 3740288 - RNA, 18 nt, Human
gauacacucaagcaugaa

SEQ ID NO: 3740289 - RNA, 23 nt, Human
gauacacucaagcaugaagauaa

SEQ ID NO: 3740290 - RNA, 20 nt, Human
gauacacugaaguuaacaga

SEQ ID NO: 3740291 - RNA, 16 nt, Human
gauacagcaguagaca

SEQ ID NO: 3740292 - RNA, 18 nt, Human
gauacagcaguagacauu

SEQ ID NO: 3740293 - RNA, 20 nt, Human
gauacaggaaaagcugcuga

SEQ ID NO: 3740294 - RNA, 21 nt, Human
gauacauaacuaaauuugaua

SEQ ID NO: 3740295 - RNA, 17 nt, Human
gauacaugucuuucucc

SEQ ID NO: 3740296 - RNA, 21 nt, Human
gauacauuuguauguugugaa

SEQ ID NO: 3740297 - RNA, 21 nt, Human
gauaccaucagcaaagaauuu

SEQ ID NO: 3740298 - RNA, 13 nt, Human
gauacccauccca

SEQ ID NO: 3740299 - RNA, 21 nt, Human
gauaccuuaaaauuugaaaca

SEQ ID NO: 3740300 - RNA, 20 nt, Human
gauaccuucuuauuuaaucu

SEQ ID NO: 3740301 - RNA, 16 nt, Human
gauacgacaguacacu

SEQ ID NO: 3740302 - RNA, 21 nt, Human
gauacgaguuuuggccgggug

SEQ ID NO: 3740303 - RNA, 22 nt, Human
gauacgaguuuuggccgggugc

SEQ ID NO: 3740304 - RNA, 16 nt, Human
gauacgcaucagacag

SEQ ID NO: 3740305 - RNA, 15 nt, Human
gauacgugucaaugu

SEQ ID NO: 3740306 - RNA, 20 nt, Human
gauacuaaaaguucuucucc

SEQ ID NO: 3740307 - RNA, 22 nt, Human
gauacuaaaaguucuucuccaa

SEQ ID NO: 3740308 - RNA, 22 nt, Human
gauacuaauaaacuaauaauug

SEQ ID NO: 3740309 - RNA, 11 nt, Human
gauacuacagu

SEQ ID NO: 3740310 - RNA, 14 nt, Human
gauacucauuucuu

SEQ ID NO: 3740311 - RNA, 12 nt, Human
gauacucucuuc

SEQ ID NO: 3740312 - RNA, 13 nt, Human
gauacucugggaa

SEQ ID NO: 3740313 - RNA, 13 nt, Human
gauacugccuccc

SEQ ID NO: 3740314 - RNA, 17 nt, Human
gauacugccucccccag

SEQ ID NO: 3740315 - RNA, 15 nt, Human
gauacugcuguguaa

SEQ ID NO: 3740316 - RNA, 22 nt, Human
gauacuguaacacuuuacaaug

SEQ ID NO: 3740317 - RNA, 21 nt, Human
gauacuguaucaugacaaaga

SEQ ID NO: 3740318 - RNA, 22 nt, Human
gauacuuauauuuucguaugaa

SEQ ID NO: 3740319 - RNA, 22 nt, Human
gauacuucgacacuguucuuag

SEQ ID NO: 3740320 - RNA, 16 nt, Human
gauacuugaauaacca

SEQ ID NO: 3740321 - RNA, 22 nt, Human
gauacuuggucacagccaggcg

SEQ ID NO: 3740322 - RNA, 18 nt, Human
gauacuuugauauuuuca

SEQ ID NO: 3740323 - RNA, 20 nt, Human
gauagaaauaaauagcuaua

SEQ ID NO: 3740324 - RNA, 22 nt, Human
gauagaggaagccugauuaaag

SEQ ID NO: 3740325 - RNA, 14 nt, Human
gauagauaacucuu

SEQ ID NO: 3740326 - RNA, 16 nt, Human
gauagaugcuggccca

SEQ ID NO: 3740327 - RNA, 23 nt, Human
gauagcaaagcgacguuagucgu

SEQ ID NO: 3740328 - RNA, 20 nt, Human
gauagcaagugaauuuuucu

SEQ ID NO: 3740329 - RNA, 18 nt, Human
gauagcacagacccugcc

SEQ ID NO: 3740330 - RNA, 14 nt, Human
gauagcacuuucua

SEQ ID NO: 3740331 - RNA, 16 nt, Human
guucugucccuugccc

SEQ ID NO: 3740332 - RNA, 16 nt, Human
guucugugacuaggaa

SEQ ID NO: 3740333 - RNA, 11 nt, Human
guucuguggaa

SEQ ID NO: 3740334 - RNA, 20 nt, Human
guucuguggaaaguguaaag

SEQ ID NO: 3740335 - RNA, 22 nt, Human
guucuguggaaaguguaaagca

SEQ ID NO: 3740336 - RNA, 21 nt, Human
guucugugguuucauguuagu

SEQ ID NO: 3740337 - RNA, 19 nt, Human
guucugugguuuuccccuc

SEQ ID NO: 3740338 - RNA, 13 nt, Human
guucuguguauuu

SEQ ID NO: 3740339 - RNA, 15 nt, Human
guucugugucugugu

SEQ ID NO: 3740340 - RNA, 13 nt, Human
guucugugucuuu

SEQ ID NO: 3740341 - RNA, 22 nt, Human
guucugugucuuucacagcucc

SEQ ID NO: 3740342 - RNA, 21 nt, Human
guucuguguuuaauuucuuca

SEQ ID NO: 3740343 - RNA, 17 nt, Human
guucuguuaacugaaua

SEQ ID NO: 3740344 - RNA, 18 nt, Human
guucuguuaacugaauac

SEQ ID NO: 3740345 - RNA, 19 nt, Human
guucuguuaacugaauacc

SEQ ID NO: 3740346 - RNA, 14 nt, Human
guucuguuacaaaa

SEQ ID NO: 3740347 - RNA, 18 nt, Human
guucuguuacaaaaugua

SEQ ID NO: 3740348 - RNA, 19 nt, Human
guucuguuuacaucaguuu

SEQ ID NO: 3740349 - RNA, 14 nt, Human
guucuguuuguuau

SEQ ID NO: 3740350 - RNA, 16 nt, Human
guucuguuuugccuga

SEQ ID NO: 3740351 - RNA, 14 nt, Human
guucuuaauucuua

SEQ ID NO: 3740352 - RNA, 14 nt, Human
guucuuacugcuug

SEQ ID NO: 3740353 - RNA, 19 nt, Human
guucuuagcucaaugagca

SEQ ID NO: 3740354 - RNA, 15 nt, Human
guucuuaggcugcug

SEQ ID NO: 3740355 - RNA, 18 nt, Human
guucuuaggcugcuggga

SEQ ID NO: 3740356 - RNA, 18 nt, Human
guucuuaugcaaaaugga

SEQ ID NO: 3740357 - RNA, 17 nt, Human
guucuuauuuuuauaac

SEQ ID NO: 3740358 - RNA, 11 nt, Human
guucuucauga

SEQ ID NO: 3740359 - RNA, 15 nt, Human
guucuuccaaagcag

SEQ ID NO: 3740360 - RNA, 14 nt, Human
guucuuccucagcc

SEQ ID NO: 3740361 - RNA, 15 nt, Human
guucuuccucagcca

SEQ ID NO: 3740362 - RNA, 19 nt, Human
guucuucgacuguuguuau

SEQ ID NO: 3740363 - RNA, 14 nt, Human
guucuucgaggugg

SEQ ID NO: 3740364 - RNA, 22 nt, Human
guucuucgggaagagaggaguu

SEQ ID NO: 3740365 - RNA, 19 nt, Human
guucuucuaccacccacca

SEQ ID NO: 3740366 - RNA, 16 nt, Human
guucuucucaaaagaa

SEQ ID NO: 3740367 - RNA, 20 nt, Human
guucuucuuccugaagcuga

SEQ ID NO: 3740368 - RNA, 22 nt, Human
guucuucuuguucugagauuca

SEQ ID NO: 3740369 - RNA, 15 nt, Human
guucuugaagcagua

SEQ ID NO: 3740370 - RNA, 21 nt, Human
guucuugaggggaccaggagu

SEQ ID NO: 3740371 - RNA, 21 nt, Human
guucuugcagucaucagaagu

SEQ ID NO: 3740372 - RNA, 17 nt, Human
guucuugccacuuuuuu

SEQ ID NO: 3740373 - RNA, 16 nt, Human
guucuugcugcuagaa

SEQ ID NO: 3740374 - RNA, 19 nt, Human
guucuugcugcuagaacuu

SEQ ID NO: 3740375 - RNA, 20 nt, Human
guucuugcugcuagaacuuu

SEQ ID NO: 3740376 - RNA, 21 nt, Human
guucuugcugcuagaacuuuu

SEQ ID NO: 3740377 - RNA, 21 nt, Human
guucuuguauuaagaaugaaa

SEQ ID NO: 3740378 - RNA, 13 nt, Human
guucuuguuggug

SEQ ID NO: 3740379 - RNA, 18 nt, Human
guguauguuugcacacuu

SEQ ID NO: 3740380 - RNA, 22 nt, Human
guguauguuugcacacuugugu

SEQ ID NO: 3740381 - RNA, 15 nt, Human
guguauguuuuucag

SEQ ID NO: 3740382 - RNA, 17 nt, Human
guguauuuaauuguaaa

SEQ ID NO: 3740383 - RNA, 19 nt, Human
guguauuuaauuguaaacu

SEQ ID NO: 3740384 - RNA, 22 nt, Human
guguauuuaauuguaaacugua

SEQ ID NO: 3740385 - RNA, 21 nt, Human
guguauuuacgcuuugauuca

SEQ ID NO: 3740386 - RNA, 13 nt, Human
guguauuucaguu

SEQ ID NO: 3740387 - RNA, 14 nt, Human
guguauuugcuuuu

SEQ ID NO: 3740388 - RNA, 18 nt, Human
guguauuuuauaaaauua

SEQ ID NO: 3740389 - RNA, 23 nt, Human
guguauuuuucaauaaagcauuu

SEQ ID NO: 3740390 - RNA, 19 nt, Human
gugucaaauaaacacugug

SEQ ID NO: 3740391 - RNA, 16 nt, Human
gugucaagcugcucug

SEQ ID NO: 3740392 - RNA, 17 nt, Human
gugucaagcugcucuga

SEQ ID NO: 3740393 - RNA, 17 nt, Human
gugucaaguggcaaagc

SEQ ID NO: 3740394 - RNA, 13 nt, Human
gugucacaaagaa

SEQ ID NO: 3740395 - RNA, 18 nt, Human
gugucaccuuuucuugcc

SEQ ID NO: 3740396 - RNA, 23 nt, Human
gugucacuacucacagucucuuu

SEQ ID NO: 3740397 - RNA, 15 nt, Human
gugucacucaaggcg

SEQ ID NO: 3740398 - RNA, 15 nt, Human
gugucacuggcugcc

SEQ ID NO: 3740399 - RNA, 17 nt, Human
gugucacuggcugccuc

SEQ ID NO: 3740400 - RNA, 18 nt, Human
gugucacugucccuccug

SEQ ID NO: 3740401 - RNA, 19 nt, Human
gugucacuuacuguuucug

SEQ ID NO: 3740402 - RNA, 12 nt, Human
gugucagccauu

SEQ ID NO: 3740403 - RNA, 16 nt, Human
gugucagcugaggcug

SEQ ID NO: 3740404 - RNA, 17 nt, Human
gugucagcugaggcugg

SEQ ID NO: 3740405 - RNA, 18 nt, Human
gugucagcugaggcuggg

SEQ ID NO: 3740406 - RNA, 15 nt, Human
gugucaggcugcugg

SEQ ID NO: 3740407 - RNA, 22 nt, Human
gugucaggcugcuggcgccucu

SEQ ID NO: 3740408 - RNA, 20 nt, Human
gugucagguggggcagcuug

SEQ ID NO: 3740409 - RNA, 16 nt, Human
gugucaucagaagaua

SEQ ID NO: 3740410 - RNA, 20 nt, Human
gugucauccucacagugaac

SEQ ID NO: 3740411 - RNA, 23 nt, Human
gugucauuuggcuuuccagucau

SEQ ID NO: 3740412 - RNA, 14 nt, Human
guguccaacuccag

SEQ ID NO: 3740413 - RNA, 23 nt, Human
guguccaacuccaguacuggagc

SEQ ID NO: 3740414 - RNA, 17 nt, Human
guguccaagugugugug

SEQ ID NO: 3740415 - RNA, 13 nt, Human
guguccaccuggc

SEQ ID NO: 3740416 - RNA, 18 nt, Human
guguccacgacugucucc

SEQ ID NO: 3740417 - RNA, 18 nt, Human
guguccaugcgcucaggg

SEQ ID NO: 3740418 - RNA, 20 nt, Human
guguccaugcgcucagggcc

SEQ ID NO: 3740419 - RNA, 19 nt, Human
guguccauugacauguaca

SEQ ID NO: 3740420 - RNA, 14 nt, Human
gugucccaggcagg

SEQ ID NO: 3740421 - RNA, 21 nt, Human
gugucccaugacccaccccug

SEQ ID NO: 3740422 - RNA, 23 nt, Human
gugucccaugacccaccccugug

SEQ ID NO: 3740423 - RNA, 12 nt, Human
guguccccaaca

SEQ ID NO: 3740424 - RNA, 18 nt, Human
guguccccaacagcgccc

SEQ ID NO: 3740425 - RNA, 22 nt, Human
guguccccaccaucugcugucu

SEQ ID NO: 3740426 - RNA, 18 nt, Human
gugucccccucuguccag

SEQ ID NO: 3740427 - RNA, 21 nt, Human
guguccccgcugcugugcaac

SEQ ID NO: 3740428 - RNA, 16 nt, Human
gugucccucucucugg

SEQ ID NO: 3740429 - RNA, 13 nt, Human
gugucccugcacu

SEQ ID NO: 3740430 - RNA, 12 nt, Human
guguccuacaga

SEQ ID NO: 3740431 - RNA, 16 nt, Human
guguccuccaggagcu

SEQ ID NO: 3740432 - RNA, 18 nt, Human
guguccuccccucaagga

SEQ ID NO: 3740433 - RNA, 13 nt, Human
guguccugaccac

SEQ ID NO: 3740434 - RNA, 20 nt, Human
guguccugaccacccucccc

SEQ ID NO: 3740435 - RNA, 13 nt, Human
guguccugagcuc

SEQ ID NO: 3740436 - RNA, 13 nt, Human
guguccugccugu

SEQ ID NO: 3740437 - RNA, 23 nt, Human
guguccuggugcucucugccacu

SEQ ID NO: 3740438 - RNA, 16 nt, Human
guguccuuagaacauu

SEQ ID NO: 3740439 - RNA, 17 nt, Human
guguccuugcaccugca

SEQ ID NO: 3740440 - RNA, 14 nt, Human
gugucuaaaaacac

SEQ ID NO: 3740441 - RNA, 14 nt, Human
gugucuaagauucu

SEQ ID NO: 3740442 - RNA, 19 nt, Human
gugucuaagauucuagauc

SEQ ID NO: 3740443 - RNA, 14 nt, Human
gugucuacagagaa

SEQ ID NO: 3740444 - RNA, 19 nt, Human
gugucuaggcaggaccugu

SEQ ID NO: 3740445 - RNA, 15 nt, Human
gugucucaggcugcc

SEQ ID NO: 3740446 - RNA, 20 nt, Human
gugucucaggcugccugagu

SEQ ID NO: 3740447 - RNA, 17 nt, Human
gugucuccaacccccca

SEQ ID NO: 3740448 - RNA, 19 nt, Human
gugucuccaaccccccagc

SEQ ID NO: 3740449 - RNA, 22 nt, Human
gugucuccuuaagcugcagaga

SEQ ID NO: 3740450 - RNA, 21 nt, Human
gugucucggagggauuccccu

SEQ ID NO: 3740451 - RNA, 18 nt, Human
gugucucuuuucucuuuc

SEQ ID NO: 3740452 - RNA, 17 nt, Human
gugucugcgaaguccua

SEQ ID NO: 3740453 - RNA, 15 nt, Human
gugucugcucaguaa

SEQ ID NO: 3740454 - RNA, 19 nt, Human
gugucuggaauuguggcua

SEQ ID NO: 3740455 - RNA, 22 nt, Human
gugucuggacauucagaacacc

SEQ ID NO: 3740456 - RNA, 21 nt, Human
gugucuggauucccaggauga

SEQ ID NO: 3740457 - RNA, 21 nt, Human
gugucuguacacguguccugu

SEQ ID NO: 3740458 - RNA, 22 nt, Human
gugucuguacacguguccugua

SEQ ID NO: 3740459 - RNA, 13 nt, Human
gugucuguauuua

SEQ ID NO: 3740460 - RNA, 16 nt, Human
gugucuguuuugagcu

SEQ ID NO: 3740461 - RNA, 19 nt, Human
gugucuuaauuauuauuug

SEQ ID NO: 3740462 - RNA, 17 nt, Human
gugucuuccacuuugca

SEQ ID NO: 3740463 - RNA, 13 nt, Human
gugucuuccugug

SEQ ID NO: 3740464 - RNA, 18 nt, Human
gugucuugcaauggcagc

SEQ ID NO: 3740465 - RNA, 16 nt, Human
gugucuugggcagagc

SEQ ID NO: 3740466 - RNA, 20 nt, Human
gugucuugggcagagcuggc

SEQ ID NO: 3740467 - RNA, 19 nt, Human
gugucuuuaaaugcugcuu

SEQ ID NO: 3740468 - RNA, 18 nt, Human
gugucuuucacagcuccu

SEQ ID NO: 3740469 - RNA, 16 nt, Human
gugucuuucuaagaaa

SEQ ID NO: 3740470 - RNA, 12 nt, Human
gugucuuuggag

SEQ ID NO: 3740471 - RNA, 18 nt, Human
gugugaaagucagaugcc

SEQ ID NO: 3740472 - RNA, 13 nt, Human
gugugaaauauau

SEQ ID NO: 3740473 - RNA, 17 nt, Human
gugugaacuggacccug

SEQ ID NO: 3740474 - RNA, 18 nt, Human
gugugaagguccugcuau

SEQ ID NO: 3740475 - RNA, 12 nt, Human
gugugaaguuag

SEQ ID NO: 3740476 - RNA, 16 nt, Human
gugugaauaaagugcu

SEQ ID NO: 3740477 - RNA, 13 nt, Human
gugugaaugaaca

SEQ ID NO: 3740478 - RNA, 19 nt, Human
gugugaaugugggcacugg

SEQ ID NO: 3740479 - RNA, 21 nt, Human
gugugaaugugggcacuggcc

SEQ ID NO: 3740480 - RNA, 13 nt, Human
gugugacagggcc

SEQ ID NO: 3740481 - RNA, 14 nt, Human
gugugacagggcca

SEQ ID NO: 3740482 - RNA, 14 nt, Human
gugugacauuccag

SEQ ID NO: 3740483 - RNA, 18 nt, Human
gugugacauuuggagagg

SEQ ID NO: 3740484 - RNA, 15 nt, Human
gugugaccaacugug

SEQ ID NO: 3740485 - RNA, 15 nt, Human
gugugaccccuccug

SEQ ID NO: 3740486 - RNA, 17 nt, Human
gugugaccccuccuggg

SEQ ID NO: 3740487 - RNA, 22 nt, Human
gugugagaagugaaugcuggga

SEQ ID NO: 3740488 - RNA, 16 nt, Human
gugugaggagcugcug

SEQ ID NO: 3740489 - RNA, 19 nt, Human
gugugaggagcugcuggcu

SEQ ID NO: 3740490 - RNA, 17 nt, Human
gugugaggccagggcag

SEQ ID NO: 3740491 - RNA, 14 nt, Human
gugugagugugaca

SEQ ID NO: 3740492 - RNA, 19 nt, Human
gugugagugugacagggcc

SEQ ID NO: 3740493 - RNA, 22 nt, Human
gugugauauuucagaaauacag

SEQ ID NO: 3740494 - RNA, 18 nt, Human
gugugaucucuucagggu

SEQ ID NO: 3740495 - RNA, 16 nt, Human
gugugauugacagcuu

SEQ ID NO: 3740496 - RNA, 14 nt, Human
gugugauuuuucug

SEQ ID NO: 3740497 - RNA, 14 nt, Human
gugugcaaggcagc

SEQ ID NO: 3740498 - RNA, 19 nt, Human
gugugcaaugucugaguga

SEQ ID NO: 3740499 - RNA, 17 nt, Human
gugugcacuaaggggcc

SEQ ID NO: 3740500 - RNA, 14 nt, Human
gugugcauauugua

SEQ ID NO: 3740501 - RNA, 15 nt, Human
gugugcauauuguac

SEQ ID NO: 3740502 - RNA, 22 nt, Human
gugugcauggaggcccuccugu

SEQ ID NO: 3740503 - RNA, 12 nt, Human
gugugcaugugu

SEQ ID NO: 3740504 - RNA, 18 nt, Human
gugugcaugugugugcuc

SEQ ID NO: 3740505 - RNA, 20 nt, Human
gugugcaugugugugcucag

SEQ ID NO: 3740506 - RNA, 21 nt, Human
gugugccauagaguuuaacac

SEQ ID NO: 3740507 - RNA, 16 nt, Human
gugugccccccauccu

SEQ ID NO: 3740508 - RNA, 17 nt, Human
gugugccccccauccug

SEQ ID NO: 3740509 - RNA, 21 nt, Human
gugugccccccauccuggccc

SEQ ID NO: 3740510 - RNA, 23 nt, Human
gugugccccccauccuggcccau

SEQ ID NO: 3740511 - RNA, 19 nt, Human
gugugccucaguauauuua

SEQ ID NO: 3740512 - RNA, 11 nt, Human
gugugccucua

SEQ ID NO: 3740513 - RNA, 17 nt, Human
gugugccucuagcugaa

SEQ ID NO: 3740514 - RNA, 18 nt, Human
gugugccugacugcccag

SEQ ID NO: 3740515 - RNA, 18 nt, Human
gugugccugcagccccgc

SEQ ID NO: 3740516 - RNA, 16 nt, Human
gugugccugggggagu

SEQ ID NO: 3740517 - RNA, 22 nt, Human
gugugccugucuguuacacugg

SEQ ID NO: 3740518 - RNA, 12 nt, Human
gugugccuucca

SEQ ID NO: 3740519 - RNA, 16 nt, Human
gugugcguccugucgg

SEQ ID NO: 3740520 - RNA, 18 nt, Human
guuuauuaacaaauuaug

SEQ ID NO: 3740521 - RNA, 22 nt, Human
guuuauuaaucuuaguguauga

SEQ ID NO: 3740522 - RNA, 13 nt, Human
guuuauuacagua

SEQ ID NO: 3740523 - RNA, 17 nt, Human
guuuauuacaguauaau

SEQ ID NO: 3740524 - RNA, 13 nt, Human
guuuauuacguau

SEQ ID NO: 3740525 - RNA, 17 nt, Human
guuuauuacuuauuugg

SEQ ID NO: 3740526 - RNA, 21 nt, Human
guuuauuacuuccaugaauuu

SEQ ID NO: 3740527 - RNA, 13 nt, Human
guuuauucauaug

SEQ ID NO: 3740528 - RNA, 20 nt, Human
guuuauuccagagcugccag

SEQ ID NO: 3740529 - RNA, 18 nt, Human
guuuauucuugaugaaaa

SEQ ID NO: 3740530 - RNA, 14 nt, Human
guuuauuucuuaaa

SEQ ID NO: 3740531 - RNA, 13 nt, Human
guuuauuuuaaga

SEQ ID NO: 3740532 - RNA, 14 nt, Human
guuuauuuuauauu

SEQ ID NO: 3740533 - RNA, 17 nt, Human
guuuauuuucuacguuu

SEQ ID NO: 3740534 - RNA, 18 nt, Human
guuuauuuuuauauagcu

SEQ ID NO: 3740535 - RNA, 19 nt, Human
guuucaaaaacacaguguu

SEQ ID NO: 3740536 - RNA, 16 nt, Human
guuucaaaaaucugaa

SEQ ID NO: 3740537 - RNA, 19 nt, Human
guuucaaacacaaaugcag

SEQ ID NO: 3740538 - RNA, 21 nt, Human
guuucaaacauauauaacaau

SEQ ID NO: 3740539 - RNA, 17 nt, Human
guuucaaacuuuacuau

SEQ ID NO: 3740540 - RNA, 23 nt, Human
guuucaaccaagucaugugcauu

SEQ ID NO: 3740541 - RNA, 13 nt, Human
guuucaagaggag

SEQ ID NO: 3740542 - RNA, 18 nt, Human
guuucaauaaaguuugau

SEQ ID NO: 3740543 - RNA, 16 nt, Human
guuucaauugcaucuc

SEQ ID NO: 3740544 - RNA, 14 nt, Human
guuucacagaaaau

SEQ ID NO: 3740545 - RNA, 16 nt, Human
guuucacaguuugaaa

SEQ ID NO: 3740546 - RNA, 19 nt, Human
guuucacaguuugaaauaa

SEQ ID NO: 3740547 - RNA, 16 nt, Human
guuucacccuuaaccc

SEQ ID NO: 3740548 - RNA, 20 nt, Human
guuucacugacuuagaacca

SEQ ID NO: 3740549 - RNA, 16 nt, Human
guuucagauauauauc

SEQ ID NO: 3740550 - RNA, 18 nt, Human
guuucagcgacuccguug

SEQ ID NO: 3740551 - RNA, 23 nt, Human
guuucagcuaagggaagacauuu

SEQ ID NO: 3740552 - RNA, 22 nt, Human
guuucaggagagaguugaaccu

SEQ ID NO: 3740553 - RNA, 19 nt, Human
guuucagguagaggugcau

SEQ ID NO: 3740554 - RNA, 23 nt, Human
guuucagguagaggugcaugccu

SEQ ID NO: 3740555 - RNA, 16 nt, Human
guuucaggugacaugu

SEQ ID NO: 3740556 - RNA, 18 nt, Human
guuucauacucuagauuu

SEQ ID NO: 3740557 - RNA, 17 nt, Human
guuucauguuaguuacc

SEQ ID NO: 3740558 - RNA, 21 nt, Human
guuucauguuaguuaccuuau

SEQ ID NO: 3740559 - RNA, 19 nt, Human
guuucauguuuugugacua

SEQ ID NO: 3740560 - RNA, 15 nt, Human
guuucauucuccugc

SEQ ID NO: 3740561 - RNA, 19 nt, Human
guuucauucuccugccugu

SEQ ID NO: 3740562 - RNA, 21 nt, Human
guuucauuuagucaugugacc

SEQ ID NO: 3740563 - RNA, 16 nt, Human
guuuccaaccuggagu

SEQ ID NO: 3740564 - RNA, 14 nt, Human
guuuccaagcaaau

SEQ ID NO: 3740565 - RNA, 19 nt, Human
guuuccaaggagcugagaa

SEQ ID NO: 3740566 - RNA, 20 nt, Human
guuuccaaggagcugagaau

SEQ ID NO: 3740567 - RNA, 23 nt, Human
guuuccaauguuuagcaaauaca

SEQ ID NO: 3740568 - RNA, 17 nt, Human
guuuccagcagaagaca

SEQ ID NO: 3740569 - RNA, 19 nt, Human
guuuccagcauucccaggu

SEQ ID NO: 3740570 - RNA, 21 nt, Human
guuuccauagcaacaggaaaa

SEQ ID NO: 3740571 - RNA, 18 nt, Human
guuuccauuuuuuguucc

SEQ ID NO: 3740572 - RNA, 16 nt, Human
guuucccaagagcuac

SEQ ID NO: 3740573 - RNA, 19 nt, Human
guuucccaaugguguuuuu

SEQ ID NO: 3740574 - RNA, 21 nt, Human
guuucccauaauuuucuucau

SEQ ID NO: 3740575 - RNA, 17 nt, Human
guuuccccaccagugaa

SEQ ID NO: 3740576 - RNA, 13 nt, Human
guuuccgugcgug

SEQ ID NO: 3740577 - RNA, 15 nt, Human
guuuccuaaaaguuc

SEQ ID NO: 3740578 - RNA, 19 nt, Human
guuuccucaggcugcugga

SEQ ID NO: 3740579 - RNA, 20 nt, Human
guuuccucauuccugaaaga

SEQ ID NO: 3740580 - RNA, 18 nt, Human
guuuccucuaguucuuug

SEQ ID NO: 3740581 - RNA, 22 nt, Human
guuuccucuaguucuuuguuca

SEQ ID NO: 3740582 - RNA, 14 nt, Human
guuuccucuuccaa

SEQ ID NO: 3740583 - RNA, 16 nt, Human
guuuccugcaggccag

SEQ ID NO: 3740584 - RNA, 13 nt, Human
guuuccugcccug

SEQ ID NO: 3740585 - RNA, 22 nt, Human
guuuccugcccugggaggcagu

SEQ ID NO: 3740586 - RNA, 16 nt, Human
guuuccuggcacugcu

SEQ ID NO: 3740587 - RNA, 17 nt, Human
guuuccuggcacuggac

SEQ ID NO: 3740588 - RNA, 16 nt, Human
guuuccuuauauuaug

SEQ ID NO: 3740589 - RNA, 13 nt, Human
guuuccuucccuc

SEQ ID NO: 3740590 - RNA, 17 nt, Human
guuucgaagucauuaaa

SEQ ID NO: 3740591 - RNA, 17 nt, Human
guuucgagaagcugcuc

SEQ ID NO: 3740592 - RNA, 22 nt, Human
guuucggccuucauaauggccu

SEQ ID NO: 3740593 - RNA, 20 nt, Human
guuucgugaaguauacugua

SEQ ID NO: 3740594 - RNA, 23 nt, Human
guuucguggggaggucuaaucua

SEQ ID NO: 3740595 - RNA, 15 nt, Human
guuucguuauauuaa

SEQ ID NO: 3740596 - RNA, 16 nt, Human
guuucguuucuguaua

SEQ ID NO: 3740597 - RNA, 19 nt, Human
guuucuaaaggcuaccuuu

SEQ ID NO: 3740598 - RNA, 23 nt, Human
guuucuaacacuagucugugugc

SEQ ID NO: 3740599 - RNA, 18 nt, Human
guuucuaagauucuaaag

SEQ ID NO: 3740600 - RNA, 21 nt, Human
guuucuaagauucuaaagguc

SEQ ID NO: 3740601 - RNA, 11 nt, Human
guuucuaaggu

SEQ ID NO: 3740602 - RNA, 18 nt, Human
guuucuaauaaacuugga

SEQ ID NO: 3740603 - RNA, 18 nt, Human
guuucuaauuugcugcug

SEQ ID NO: 3740604 - RNA, 21 nt, Human
guuucuagcaugaagacagag

SEQ ID NO: 3740605 - RNA, 18 nt, Human
guuucuagcuagaaauau

SEQ ID NO: 3740606 - RNA, 23 nt, Human
guuucuagcuagaaauaugauuu

SEQ ID NO: 3740607 - RNA, 19 nt, Human
guuucuauguguagggcgg

SEQ ID NO: 3740608 - RNA, 23 nt, Human
guuucuauuuucucugauacuuu

SEQ ID NO: 3740609 - RNA, 11 nt, Human
guuucuccccc

SEQ ID NO: 3740610 - RNA, 17 nt, Human
guuucucccccugggcu

SEQ ID NO: 3740611 - RNA, 22 nt, Human
guuucucccccugggcucugcc

SEQ ID NO: 3740612 - RNA, 23 nt, Human
guuucucccccugggcucugccc

SEQ ID NO: 3740613 - RNA, 22 nt, Human
guuucucccucucacugucuga

SEQ ID NO: 3740614 - RNA, 15 nt, Human
guuucucugcuguug

SEQ ID NO: 3740615 - RNA, 17 nt, Human
guuucucuugagcuggc

SEQ ID NO: 3740616 - RNA, 21 nt, Human
guuucucuuugauuauuugca

SEQ ID NO: 3740617 - RNA, 21 nt, Human
guuucugaaaauuaacacugc

SEQ ID NO: 3740618 - RNA, 21 nt, Human
guuucugauuugcugcucuuc

SEQ ID NO: 3740619 - RNA, 22 nt, Human
guuucugcaguagucucugugc

SEQ ID NO: 3740620 - RNA, 20 nt, Human
guuucugcauucauuuuuau

SEQ ID NO: 3740621 - RNA, 16 nt, Human
guuucuggguccugaa

SEQ ID NO: 3740622 - RNA, 20 nt, Human
guuucuggucucuaggcugg

SEQ ID NO: 3740623 - RNA, 17 nt, Human
guuucugucguuaaaaa

SEQ ID NO: 3740624 - RNA, 14 nt, Human
guuucugucuccuc

SEQ ID NO: 3740625 - RNA, 13 nt, Human
guuucugucugua

SEQ ID NO: 3740626 - RNA, 22 nt, Human
guuucugugguuggcugggaaa

SEQ ID NO: 3740627 - RNA, 14 nt, Human
guuucuguuccaaa

SEQ ID NO: 3740628 - RNA, 15 nt, Human
guuucuguuccaaau

SEQ ID NO: 3740629 - RNA, 18 nt, Human
guuucuguucuguggaaa

SEQ ID NO: 3740630 - RNA, 17 nt, Human
guuucuguuugauucuu

SEQ ID NO: 3740631 - RNA, 20 nt, Human
guuucuucaacaggagaauu

SEQ ID NO: 3740632 - RNA, 14 nt, Human
guuucuuccuguua

SEQ ID NO: 3740633 - RNA, 20 nt, Human
guuucuuccuguuaauguau

SEQ ID NO: 3740634 - RNA, 22 nt, Human
guuucuugccucauuuuuuucc

SEQ ID NO: 3740635 - RNA, 23 nt, Human
guuucuugccucauuuuuuuccu

SEQ ID NO: 3740636 - RNA, 18 nt, Human
guuucuugcuuguaccuc

SEQ ID NO: 3740637 - RNA, 19 nt, Human
guuucuugcuuguaccucu

SEQ ID NO: 3740638 - RNA, 20 nt, Human
guuucuuuauuuuguguaaa

SEQ ID NO: 3740639 - RNA, 19 nt, Human
guuucuuuccugccuucuu

SEQ ID NO: 3740640 - RNA, 21 nt, Human
guuucuuuccugccuucuucu

SEQ ID NO: 3740641 - RNA, 18 nt, Human
guuucuuucuaguggucu

SEQ ID NO: 3740642 - RNA, 20 nt, Human
guuucuuugaucaugaauaa

SEQ ID NO: 3740643 - RNA, 17 nt, Human
guuucuuuuguauguaa

SEQ ID NO: 3740644 - RNA, 16 nt, Human
guuugaaacaaagaag

SEQ ID NO: 3740645 - RNA, 14 nt, Human
guuugaaaucuuuu

SEQ ID NO: 3740646 - RNA, 11 nt, Human
guuugaaauuc

SEQ ID NO: 3740647 - RNA, 16 nt, Human
guuugaaauucugaau

SEQ ID NO: 3740648 - RNA, 17 nt, Human
guuugaaauucugaauu

SEQ ID NO: 3740649 - RNA, 21 nt, Human
guuugaacacgaaagaaaugu

SEQ ID NO: 3740650 - RNA, 17 nt, Human
guuugaaggaggugagg

SEQ ID NO: 3740651 - RNA, 17 nt, Human
guuugaauauaaacacu

SEQ ID NO: 3740652 - RNA, 13 nt, Human
guuugaauaugga

SEQ ID NO: 3740653 - RNA, 14 nt, Human
guuugaauauggac

SEQ ID NO: 3740654 - RNA, 13 nt, Human
guuugaccucaca

SEQ ID NO: 3740655 - RNA, 21 nt, Human
guuugaccucacagugacccu

SEQ ID NO: 3740656 - RNA, 20 nt, Human
guuugagaagaaaacaucua

SEQ ID NO: 3740657 - RNA, 18 nt, Human
guuugagacacugguuua

SEQ ID NO: 3740658 - RNA, 22 nt, Human
guuugaggagcauguuuuguau

SEQ ID NO: 3740659 - RNA, 22 nt, Human
guuugaggauuaguuuagaaca

SEQ ID NO: 3740660 - RNA, 22 nt, Human
guuugaucuuccucugcuaaau

SEQ ID NO: 3740661 - RNA, 15 nt, Human
guuugaugaggcccu

SEQ ID NO: 3740662 - RNA, 20 nt, Human
guuugaugucauuaaugugu

SEQ ID NO: 3740663 - RNA, 20 nt, Human
guuugauucagacagcugcc

SEQ ID NO: 3740664 - RNA, 22 nt, Human
guuugcacguuaugguguuucu

SEQ ID NO: 3740665 - RNA, 22 nt, Human
guuugcacucaaaucuuaagaa

SEQ ID NO: 3740666 - RNA, 14 nt, Human
guuugcacuuccuc

SEQ ID NO: 3740667 - RNA, 22 nt, Human
guuugcagaaaagcaccugccg

SEQ ID NO: 3740668 - RNA, 19 nt, Human
gaucugcucagcccuggag

SEQ ID NO: 3740669 - RNA, 20 nt, Human
gaucugcucagcccuggagg

SEQ ID NO: 3740670 - RNA, 17 nt, Human
gaucugcugcagagcag

SEQ ID NO: 3740671 - RNA, 14 nt, Human
gaucuggaacccag

SEQ ID NO: 3740672 - RNA, 16 nt, Human
gaucuggaacccagac

SEQ ID NO: 3740673 - RNA, 17 nt, Human
gaucuggaacccagacu

SEQ ID NO: 3740674 - RNA, 22 nt, Human
gaucuggaagggccaaggucug

SEQ ID NO: 3740675 - RNA, 12 nt, Human
gaucuggcaugu

SEQ ID NO: 3740676 - RNA, 22 nt, Human
gaucugggacccuuuccuuccu

SEQ ID NO: 3740677 - RNA, 20 nt, Human
gaucuggguucacugcaacc

SEQ ID NO: 3740678 - RNA, 24 nt, Human
gaucugguuuugcuauuagacugu

SEQ ID NO: 3740679 - RNA, 15 nt, Human
gaucuguauauacaa

SEQ ID NO: 3740680 - RNA, 23 nt, Human
gaucuguauauuuuuuucuaaga

SEQ ID NO: 3740681 - RNA, 16 nt, Human
gaucugucacaccagc

SEQ ID NO: 3740682 - RNA, 15 nt, Human
gaucuguccaaggaa

SEQ ID NO: 3740683 - RNA, 12 nt, Human
gaucugucuugu

SEQ ID NO: 3740684 - RNA, 22 nt, Human
gaucugucuuguaauauuuugu

SEQ ID NO: 3740685 - RNA, 21 nt, Human
gaucugugaggggcucucuca

SEQ ID NO: 3740686 - RNA, 20 nt, Human
gaucugugcuuuccagcuca

SEQ ID NO: 3740687 - RNA, 13 nt, Human
gaucuguuuugaa

SEQ ID NO: 3740688 - RNA, 12 nt, Human
gaucuuaaauuu

SEQ ID NO: 3740689 - RNA, 13 nt, Human
gaucuuaaauuuu

SEQ ID NO: 3740690 - RNA, 19 nt, Human
gaucuuaagaggcugacag

SEQ ID NO: 3740691 - RNA, 14 nt, Human
gaucuuagauucuc

SEQ ID NO: 3740692 - RNA, 19 nt, Human
gaucuuauuuuucuaaacg

SEQ ID NO: 3740693 - RNA, 21 nt, Human
gaucuuauuuuucuaaacgua

SEQ ID NO: 3740694 - RNA, 24 nt, Human
gaucuucaaaaguaaugccucugu

SEQ ID NO: 3740695 - RNA, 13 nt, Human
gaucuucaacaaa

SEQ ID NO: 3740696 - RNA, 16 nt, Human
gaucuucaacaaauug

SEQ ID NO: 3740697 - RNA, 14 nt, Human
gaucuucaauggcu

SEQ ID NO: 3740698 - RNA, 15 nt, Human
gaucuucaauggcuu

SEQ ID NO: 3740699 - RNA, 16 nt, Human
gaucuucaucugacua

SEQ ID NO: 3740700 - RNA, 23 nt, Human
gaucuucaucugacuaugacaua

SEQ ID NO: 3740701 - RNA, 14 nt, Human
gaucuugaaugugg

SEQ ID NO: 3740702 - RNA, 22 nt, Human
gaucuugaauguggucucagga

SEQ ID NO: 3740703 - RNA, 15 nt, Human
gaucuuucagaaaua

SEQ ID NO: 3740704 - RNA, 16 nt, Human
gaucuuucagaaauau

SEQ ID NO: 3740705 - RNA, 11 nt, Human
gaucuuucagg

SEQ ID NO: 3740706 - RNA, 12 nt, Human
gaucuuucagga

SEQ ID NO: 3740707 - RNA, 14 nt, Human
gaucuuugcagaca

SEQ ID NO: 3740708 - RNA, 17 nt, Human
gaucuuugcagacaggc

SEQ ID NO: 3740709 - RNA, 13 nt, Human
gaucuuuggacag

SEQ ID NO: 3740710 - RNA, 14 nt, Human
gaucuuuguggcca

SEQ ID NO: 3740711 - RNA, 15 nt, Human
gaucuuuguggccaa

SEQ ID NO: 3740712 - RNA, 16 nt, Human
gaucuuuguggccaag

SEQ ID NO: 3740713 - RNA, 20 nt, Human
gaucuuuuaaaguguuacuu

SEQ ID NO: 3740714 - RNA, 24 nt, Human
gaucuuuuguucccauccucuucu

SEQ ID NO: 3740715 - RNA, 19 nt, Human
gaugaaaaagcauguacag

SEQ ID NO: 3740716 - RNA, 18 nt, Human
gaugaaaaauugcugacu

SEQ ID NO: 3740717 - RNA, 21 nt, Human
gaugaaaaguauauugauaac

SEQ ID NO: 3740718 - RNA, 18 nt, Human
gaugaaaauaaagaaugg

SEQ ID NO: 3740719 - RNA, 15 nt, Human
gaugaaaauauuuaa

SEQ ID NO: 3740720 - RNA, 17 nt, Human
gaugaaacuaaagcaau

SEQ ID NO: 3740721 - RNA, 19 nt, Human
gaugaaacuaaagcaauag

SEQ ID NO: 3740722 - RNA, 16 nt, Human
gaugaaacucacaaau

SEQ ID NO: 3740723 - RNA, 19 nt, Human
gaugaaagagaaggugggu

SEQ ID NO: 3740724 - RNA, 14 nt, Human
gaugaaagaggagg

SEQ ID NO: 3740725 - RNA, 19 nt, Human
gaugaaaucuuacagcugg

SEQ ID NO: 3740726 - RNA, 16 nt, Human
gaugaaauguaaauac

SEQ ID NO: 3740727 - RNA, 23 nt, Human
gaugaaauuuucuagacuuucug

SEQ ID NO: 3740728 - RNA, 13 nt, Human
gaugaacagacug

SEQ ID NO: 3740729 - RNA, 18 nt, Human
gaugaaccacauuauaaa

SEQ ID NO: 3740730 - RNA, 19 nt, Human
gaugaacucuuucuggccu

SEQ ID NO: 3740731 - RNA, 19 nt, Human
gaugaacuuauucuguaga

SEQ ID NO: 3740732 - RNA, 21 nt, Human
gaugaagagugagagggcaug

SEQ ID NO: 3740733 - RNA, 15 nt, Human
gaugaagcaaacaca

SEQ ID NO: 3740734 - RNA, 21 nt, Human
gaugaagcaaggaagauauac

SEQ ID NO: 3740735 - RNA, 23 nt, Human
gaugaagcaaggaagauauacau

SEQ ID NO: 3740736 - RNA, 15 nt, Human
gaugaagcauuuaca

SEQ ID NO: 3740737 - RNA, 19 nt, Human
gaugaagccgaccuuagau

SEQ ID NO: 3740738 - RNA, 16 nt, Human
gaugaaguuuuacauu

SEQ ID NO: 3740739 - RNA, 17 nt, Human
gaugaaguuuuacauug

SEQ ID NO: 3740740 - RNA, 23 nt, Human
gaugaaguuuuacauuguugagc

SEQ ID NO: 3740741 - RNA, 13 nt, Human
gaugaaucacugu

SEQ ID NO: 3740742 - RNA, 13 nt, Human
gaugaaugagaau

SEQ ID NO: 3740743 - RNA, 23 nt, Human
gaugaaugaggucccaggcagag

SEQ ID NO: 3740744 - RNA, 16 nt, Human
gaugaaugccguggau

SEQ ID NO: 3740745 - RNA, 14 nt, Human
gaugaauguauuua

SEQ ID NO: 3740746 - RNA, 22 nt, Human
gaugaaugucaguuguuauuua

SEQ ID NO: 3740747 - RNA, 18 nt, Human
gaugacaacuacagaaaa

SEQ ID NO: 3740748 - RNA, 19 nt, Human
gaugacaacuacagaaaaa

SEQ ID NO: 3740749 - RNA, 22 nt, Human
gaugacaagaaaggcugcugua

SEQ ID NO: 3740750 - RNA, 15 nt, Human
gaugacaauaaagcu

SEQ ID NO: 3740751 - RNA, 15 nt, Human
gaugacauucccugc

SEQ ID NO: 3740752 - RNA, 21 nt, Human
gaugacauugacuauuuuugu

SEQ ID NO: 3740753 - RNA, 23 nt, Human
gaugacauugacuauuuuuguuu

SEQ ID NO: 3740754 - RNA, 12 nt, Human
gaugaccccucc

SEQ ID NO: 3740755 - RNA, 15 nt, Human
gaugaccccugccca

SEQ ID NO: 3740756 - RNA, 17 nt, Human
gaugacccuuuucauga

SEQ ID NO: 3740757 - RNA, 17 nt, Human
gaugaccucauuaaccg

SEQ ID NO: 3740758 - RNA, 18 nt, Human
gaugaccuugaaugaugc

SEQ ID NO: 3740759 - RNA, 19 nt, Human
gaugacgguauuaugcuuc

SEQ ID NO: 3740760 - RNA, 21 nt, Human
gaugacguacaaguaguucug

SEQ ID NO: 3740761 - RNA, 14 nt, Human
gaugacugaguccu

SEQ ID NO: 3740762 - RNA, 11 nt, Human
gaugagaaagg

SEQ ID NO: 3740763 - RNA, 22 nt, Human
gaugagaaagguugaagcacca

SEQ ID NO: 3740764 - RNA, 14 nt, Human
gaugagaacaaagc

SEQ ID NO: 3740765 - RNA, 22 nt, Human
gaugagaacaaagcuguuaaac

SEQ ID NO: 3740766 - RNA, 15 nt, Human
gaugagagcccagag

SEQ ID NO: 3740767 - RNA, 18 nt, Human
gaugagagcccagaggua

SEQ ID NO: 3740768 - RNA, 14 nt, Human
gaugagaggaaauc

SEQ ID NO: 3740769 - RNA, 13 nt, Human
gaugagaguuuug

SEQ ID NO: 3740770 - RNA, 16 nt, Human
gaugagauuuuuaaaa

SEQ ID NO: 3740771 - RNA, 16 nt, Human
gaugagcauggagcug

SEQ ID NO: 3740772 - RNA, 12 nt, Human
gaugagcauuua

SEQ ID NO: 3740773 - RNA, 22 nt, Human
gaugagcauuuagggcaaggag

SEQ ID NO: 3740774 - RNA, 20 nt, Human
gaugagcucccacaagccug

SEQ ID NO: 3740775 - RNA, 20 nt, Human
gaugagcucuacccagggcc

SEQ ID NO: 3740776 - RNA, 14 nt, Human
gaugagcugggccg

SEQ ID NO: 3740777 - RNA, 15 nt, Human
gaugagcuuucuuuu

SEQ ID NO: 3740778 - RNA, 16 nt, Human
gaugagcuuucuuuuu

SEQ ID NO: 3740779 - RNA, 22 nt, Human
gaugaggccagaccauggacac

SEQ ID NO: 3740780 - RNA, 19 nt, Human
gaugaggccgcuagaggcc

SEQ ID NO: 3740781 - RNA, 14 nt, Human
gaugaggccucuug

SEQ ID NO: 3740782 - RNA, 22 nt, Human
gaugaggccucuuggaccucug

SEQ ID NO: 3740783 - RNA, 16 nt, Human
gaugagggaugggccu

SEQ ID NO: 3740784 - RNA, 18 nt, Human
gaugagggaugggccugg

SEQ ID NO: 3740785 - RNA, 14 nt, Human
gaugagggcagcag

SEQ ID NO: 3740786 - RNA, 17 nt, Human
gaugagggcagcagcca

SEQ ID NO: 3740787 - RNA, 20 nt, Human
gaugagggcagcagccagcc

SEQ ID NO: 3740788 - RNA, 16 nt, Human
gaugagguauuuuuuc

SEQ ID NO: 3740789 - RNA, 16 nt, Human
gaugaggugcugggag

SEQ ID NO: 3740790 - RNA, 17 nt, Human
gaugaggugcugggagg

SEQ ID NO: 3740791 - RNA, 20 nt, Human
gaugaguccccugugagauu

SEQ ID NO: 3740792 - RNA, 21 nt, Human
gaugaguguaacaagaaagga

SEQ ID NO: 3740793 - RNA, 18 nt, Human
gaugauacaagauuagaa

SEQ ID NO: 3740794 - RNA, 15 nt, Human
gaugauacuuggaug

SEQ ID NO: 3740795 - RNA, 18 nt, Human
gaugauauaaugcgggug

SEQ ID NO: 3740796 - RNA, 18 nt, Human
gaugaucaauccuuuauu

SEQ ID NO: 3740797 - RNA, 13 nt, Human
gaugaucaauuau

SEQ ID NO: 3740798 - RNA, 19 nt, Human
gaugaucagcuguuuguca

SEQ ID NO: 3740799 - RNA, 22 nt, Human
gaugauccaugaguuugcccug

SEQ ID NO: 3740800 - RNA, 15 nt, Human
gaugauccccacgcc

SEQ ID NO: 3740801 - RNA, 21 nt, Human
gaugauccggauuuaauuuga

SEQ ID NO: 3740802 - RNA, 13 nt, Human
gaugauccuaggc

SEQ ID NO: 3740803 - RNA, 14 nt, Human
gaugauccuaggca

SEQ ID NO: 3740804 - RNA, 16 nt, Human
gaugaucuuuaaaaua

SEQ ID NO: 3740805 - RNA, 21 nt, Human
gaugaugaaaugaggucagag

SEQ ID NO: 3740806 - RNA, 21 nt, Human
gaugauggucuucagccucuu

SEQ ID NO: 3740807 - RNA, 15 nt, Human
gaugaugguguuuug

SEQ ID NO: 3740808 - RNA, 14 nt, Human
gaugaugugccugg

SEQ ID NO: 3740809 - RNA, 13 nt, Human
gaugauucaagcc

SEQ ID NO: 3740810 - RNA, 15 nt, Human
gaugauucaggugca

SEQ ID NO: 3740811 - RNA, 16 nt, Human
gaugauucaggugcag

SEQ ID NO: 3740812 - RNA, 19 nt, Human
gaugauugacaacacccau

SEQ ID NO: 3740813 - RNA, 17 nt, Human
gaugauuuaaaagggaa

SEQ ID NO: 3740814 - RNA, 16 nt, Human
gaugauuucaguucua

SEQ ID NO: 3740815 - RNA, 19 nt, Human
gaugauuucaguucuagga

SEQ ID NO: 3740816 - RNA, 22 nt, Human
gaugauuucaguucuaggaaaa

SEQ ID NO: 3740817 - RNA, 23 nt, Human
gaugauuucaguucuaggaaaau

SEQ ID NO: 3740818 - RNA, 16 nt, Human
gugugcguguuugcac

SEQ ID NO: 3740819 - RNA, 22 nt, Human
gugugcucuccauucugcuccu

SEQ ID NO: 3740820 - RNA, 23 nt, Human
gugugcucuccauucugcuccuu

SEQ ID NO: 3740821 - RNA, 22 nt, Human
gugugcucugaucauccacugu

SEQ ID NO: 3740822 - RNA, 14 nt, Human
gugugcuggaggac

SEQ ID NO: 3740823 - RNA, 19 nt, Human
gugugcugggagcuccacu

SEQ ID NO: 3740824 - RNA, 13 nt, Human
guguggacaggac

SEQ ID NO: 3740825 - RNA, 21 nt, Human
guguggacuguggcacuugcc

SEQ ID NO: 3740826 - RNA, 19 nt, Human
guguggauugccucugaaa

SEQ ID NO: 3740827 - RNA, 15 nt, Human
guguggccccuucac

SEQ ID NO: 3740828 - RNA, 14 nt, Human
guguggcuccuucc

SEQ ID NO: 3740829 - RNA, 12 nt, Human
gugugggaaagc

SEQ ID NO: 3740830 - RNA, 15 nt, Human
gugugggacuguaca

SEQ ID NO: 3740831 - RNA, 11 nt, Human
gugugggagac

SEQ ID NO: 3740832 - RNA, 14 nt, Human
gugugggggccccg

SEQ ID NO: 3740833 - RNA, 21 nt, Human
gugugggggccccgucucagg

SEQ ID NO: 3740834 - RNA, 16 nt, Human
gugugggggcugcagc

SEQ ID NO: 3740835 - RNA, 17 nt, Human
guguggguaccuguauu

SEQ ID NO: 3740836 - RNA, 23 nt, Human
guguggguguccugccugucugc

SEQ ID NO: 3740837 - RNA, 17 nt, Human
gugugguacagagaagc

SEQ ID NO: 3740838 - RNA, 16 nt, Human
gugugguagagugugc

SEQ ID NO: 3740839 - RNA, 14 nt, Human
guguggugcagugu

SEQ ID NO: 3740840 - RNA, 18 nt, Human
guguggugcagugugaaa

SEQ ID NO: 3740841 - RNA, 19 nt, Human
guguggugcagugugaaaa

SEQ ID NO: 3740842 - RNA, 15 nt, Human
gugugguggccucag

SEQ ID NO: 3740843 - RNA, 21 nt, Human
gugugguguuagggugcagcc

SEQ ID NO: 3740844 - RNA, 19 nt, Human
gugugguguuuccuggcac

SEQ ID NO: 3740845 - RNA, 15 nt, Human
gugugguuuagugua

SEQ ID NO: 3740846 - RNA, 18 nt, Human
gugugguuuaguguaaaa

SEQ ID NO: 3740847 - RNA, 22 nt, Human
gugugguuuaguguaaaaauga

SEQ ID NO: 3740848 - RNA, 17 nt, Human
guguguacucuguccag

SEQ ID NO: 3740849 - RNA, 17 nt, Human
guguguagacaaauauu

SEQ ID NO: 3740850 - RNA, 19 nt, Human
guguguagacaaauauuug

SEQ ID NO: 3740851 - RNA, 22 nt, Human
guguguauaagugcacacagaa

SEQ ID NO: 3740852 - RNA, 18 nt, Human
guguguaugcgugugugu

SEQ ID NO: 3740853 - RNA, 15 nt, Human
guguguaugcugcuu

SEQ ID NO: 3740854 - RNA, 13 nt, Human
guguguaugugua

SEQ ID NO: 3740855 - RNA, 11 nt, Human
guguguauuaa

SEQ ID NO: 3740856 - RNA, 14 nt, Human
guguguauuaaaaa

SEQ ID NO: 3740857 - RNA, 22 nt, Human
guguguauucuuaaaaugcaau

SEQ ID NO: 3740858 - RNA, 20 nt, Human
guguguccacgacugucucc

SEQ ID NO: 3740859 - RNA, 18 nt, Human
guguguccuugugcauga

SEQ ID NO: 3740860 - RNA, 20 nt, Human
guguguccuugugcaugagc

SEQ ID NO: 3740861 - RNA, 16 nt, Human
gugugucuccugcaug

SEQ ID NO: 3740862 - RNA, 16 nt, Human
gugugucugcucagua

SEQ ID NO: 3740863 - RNA, 20 nt, Human
gugugucuuuccucccugaa

SEQ ID NO: 3740864 - RNA, 14 nt, Human
gugugugcagagcu

SEQ ID NO: 3740865 - RNA, 17 nt, Human
gugugugcagagcugaa

SEQ ID NO: 3740866 - RNA, 19 nt, Human
gugugugcccucugggcuc

SEQ ID NO: 3740867 - RNA, 16 nt, Human
gugugugggagugugu

SEQ ID NO: 3740868 - RNA, 23 nt, Human
guguguggucaacauuucucaug

SEQ ID NO: 3740869 - RNA, 13 nt, Human
gugugugugaaug

SEQ ID NO: 3740870 - RNA, 15 nt, Human
gugugugugcguguu

SEQ ID NO: 3740871 - RNA, 10 nt, Human
gugugugugu

SEQ ID NO: 3740872 - RNA, 12 nt, Human
guguguguguau

SEQ ID NO: 3740873 - RNA, 11 nt, Human
gugugugugug

SEQ ID NO: 3740874 - RNA, 14 nt, Human
gugugugugugcac

SEQ ID NO: 3740875 - RNA, 12 nt, Human
gugugugugugu

SEQ ID NO: 3740876 - RNA, 15 nt, Human
gugugugugugugca

SEQ ID NO: 3740877 - RNA, 17 nt, Human
guguguuaagcucugcu

SEQ ID NO: 3740878 - RNA, 14 nt, Human
guguguuauuuaaa

SEQ ID NO: 3740879 - RNA, 15 nt, Human
guguguuccaacugc

SEQ ID NO: 3740880 - RNA, 18 nt, Human
guguguucugauuagaaa

SEQ ID NO: 3740881 - RNA, 16 nt, Human
guguguugauacuguu

SEQ ID NO: 3740882 - RNA, 23 nt, Human
guguguugauacuguugcacgug

SEQ ID NO: 3740883 - RNA, 13 nt, Human
guguguuggacag

SEQ ID NO: 3740884 - RNA, 13 nt, Human
guguguugucuug

SEQ ID NO: 3740885 - RNA, 18 nt, Human
guguguugucuugaaaga

SEQ ID NO: 3740886 - RNA, 19 nt, Human
guguguugugcuuucaaga

SEQ ID NO: 3740887 - RNA, 12 nt, Human
guguguugugug

SEQ ID NO: 3740888 - RNA, 14 nt, Human
guguguuuaugugu

SEQ ID NO: 3740889 - RNA, 15 nt, Human
guguguuucuguccu

SEQ ID NO: 3740890 - RNA, 14 nt, Human
guguguuugugauu

SEQ ID NO: 3740891 - RNA, 14 nt, Human
guguguuuguguga

SEQ ID NO: 3740892 - RNA, 20 nt, Human
guguguuuugagaguauauu

SEQ ID NO: 3740893 - RNA, 14 nt, Human
guguguuuuucaua

SEQ ID NO: 3740894 - RNA, 20 nt, Human
guguguuuuucuauuaaaag

SEQ ID NO: 3740895 - RNA, 19 nt, Human
guguguuuuugggaugucu

SEQ ID NO: 3740896 - RNA, 23 nt, Human
guguuaacagaagggagggcaga

SEQ ID NO: 3740897 - RNA, 14 nt, Human
guguuaagauugca

SEQ ID NO: 3740898 - RNA, 20 nt, Human
guguuaaucuuaauguauau

SEQ ID NO: 3740899 - RNA, 13 nt, Human
guguuaauuuaag

SEQ ID NO: 3740900 - RNA, 12 nt, Human
guguuaauuuuu

SEQ ID NO: 3740901 - RNA, 16 nt, Human
guguuaccugugugcu

SEQ ID NO: 3740902 - RNA, 14 nt, Human
guguuacuaaguuu

SEQ ID NO: 3740903 - RNA, 23 nt, Human
guguuacuagccucaaaauacau

SEQ ID NO: 3740904 - RNA, 16 nt, Human
guguuacugcaguuga

SEQ ID NO: 3740905 - RNA, 19 nt, Human
guguuacuguaauuccuca

SEQ ID NO: 3740906 - RNA, 16 nt, Human
guguuacuuauggaag

SEQ ID NO: 3740907 - RNA, 21 nt, Human
guguuagccuuuuuuccccag

SEQ ID NO: 3740908 - RNA, 15 nt, Human
guguuaggccuggca

SEQ ID NO: 3740909 - RNA, 18 nt, Human
guguuaggccuggcacag

SEQ ID NO: 3740910 - RNA, 19 nt, Human
guguuaggccuggcacagu

SEQ ID NO: 3740911 - RNA, 12 nt, Human
guguuaguuccc

SEQ ID NO: 3740912 - RNA, 17 nt, Human
guguuauaugaacauac

SEQ ID NO: 3740913 - RNA, 13 nt, Human
guguuauguauuu

SEQ ID NO: 3740914 - RNA, 21 nt, Human
guguuauuuauugcuacuucc

SEQ ID NO: 3740915 - RNA, 13 nt, Human
guguuauuuuuca

SEQ ID NO: 3740916 - RNA, 23 nt, Human
guguucaaggccauccuucccug

SEQ ID NO: 3740917 - RNA, 17 nt, Human
guguucauacauuugag

SEQ ID NO: 3740918 - RNA, 15 nt, Human
guguucccuauccaa

SEQ ID NO: 3740919 - RNA, 20 nt, Human
guguucccuuugucuuucaa

SEQ ID NO: 3740920 - RNA, 11 nt, Human
guguuccuggc

SEQ ID NO: 3740921 - RNA, 15 nt, Human
guguuccuggcaaua

SEQ ID NO: 3740922 - RNA, 14 nt, Human
guguuccuuccgcu

SEQ ID NO: 3740923 - RNA, 21 nt, Human
guguucguucuuguucuguuu

SEQ ID NO: 3740924 - RNA, 20 nt, Human
guguucuccugcugcucccu

SEQ ID NO: 3740925 - RNA, 23 nt, Human
guguucuccugcugcucccucag

SEQ ID NO: 3740926 - RNA, 16 nt, Human
guguucugauuagaaa

SEQ ID NO: 3740927 - RNA, 15 nt, Human
guguucuguuacaaa

SEQ ID NO: 3740928 - RNA, 17 nt, Human
guguucuguuacaaaau

SEQ ID NO: 3740929 - RNA, 18 nt, Human
guguucuguuacaaaaug

SEQ ID NO: 3740930 - RNA, 14 nt, Human
guguucuguuguuu

SEQ ID NO: 3740931 - RNA, 13 nt, Human
guguucuguuuug

SEQ ID NO: 3740932 - RNA, 13 nt, Human
guguugaaaacca

SEQ ID NO: 3740933 - RNA, 15 nt, Human
guguugaaaaccaaa

SEQ ID NO: 3740934 - RNA, 21 nt, Human
guguugaaaaccaaaaugaca

SEQ ID NO: 3740935 - RNA, 21 nt, Human
guguugaaacggaugauuucu

SEQ ID NO: 3740936 - RNA, 11 nt, Human
guguugacauu

SEQ ID NO: 3740937 - RNA, 13 nt, Human
guguugauacugu

SEQ ID NO: 3740938 - RNA, 16 nt, Human
guguugauacuguugc

SEQ ID NO: 3740939 - RNA, 18 nt, Human
guguugauacuguugcac

SEQ ID NO: 3740940 - RNA, 17 nt, Human
guguugccaaauauguc

SEQ ID NO: 3740941 - RNA, 14 nt, Human
guguugccaagcuc

SEQ ID NO: 3740942 - RNA, 18 nt, Human
guguugccaagcuccaag

SEQ ID NO: 3740943 - RNA, 20 nt, Human
guguugcccaggcuggucuc

SEQ ID NO: 3740944 - RNA, 18 nt, Human
guguugcgugucgugggu

SEQ ID NO: 3740945 - RNA, 16 nt, Human
guguugcuuauguugu

SEQ ID NO: 3740946 - RNA, 12 nt, Human
guguuggaaaaa

SEQ ID NO: 3740947 - RNA, 16 nt, Human
guguuggacaaaugug

SEQ ID NO: 3740948 - RNA, 14 nt, Human
guguuggacagaga

SEQ ID NO: 3740949 - RNA, 17 nt, Human
guguuggcccaagcucu

SEQ ID NO: 3740950 - RNA, 21 nt, Human
guguuggcuugugaucuggga

SEQ ID NO: 3740951 - RNA, 14 nt, Human
guguuggguaaauu

SEQ ID NO: 3740952 - RNA, 18 nt, Human
guguuguaauucuucagu

SEQ ID NO: 3740953 - RNA, 19 nt, Human
guguuguauuaacaaaagu

SEQ ID NO: 3740954 - RNA, 19 nt, Human
guguugucagcaucuucuc

SEQ ID NO: 3740955 - RNA, 17 nt, Human
guguugucauuguaaac

SEQ ID NO: 3740956 - RNA, 12 nt, Human
guguugucucua

SEQ ID NO: 3740957 - RNA, 16 nt, Human
guguugucuugaaaga

SEQ ID NO: 3740958 - RNA, 17 nt, Human
guguuguugcucuagga

SEQ ID NO: 3740959 - RNA, 13 nt, Human
guguuuaagacau

SEQ ID NO: 3740960 - RNA, 16 nt, Human
guguuuaauuucuuca

SEQ ID NO: 3740961 - RNA, 17 nt, Human
guguuuaauuucuucaa

SEQ ID NO: 3740962 - RNA, 14 nt, Human
guguuuacauuuua

SEQ ID NO: 3740963 - RNA, 18 nt, Human
guguuuagaauugaaggu

SEQ ID NO: 3740964 - RNA, 22 nt, Human
guguuuauaaaauauaaacaaa

SEQ ID NO: 3740965 - RNA, 22 nt, Human
guguuuauccuaucucuccaac

SEQ ID NO: 3740966 - RNA, 15 nt, Human
guguuuauccuuuca

SEQ ID NO: 3740967 - RNA, 13 nt, Human
guguuuauuguca

SEQ ID NO: 3740968 - RNA, 10 nt, Human
guguuuauuu

SEQ ID NO: 3740969 - RNA, 12 nt, Human
guguuucccaua

SEQ ID NO: 3740970 - RNA, 21 nt, Human
guuugcagaagggggucucuu

SEQ ID NO: 3740971 - RNA, 16 nt, Human
guuugcagucccaagc

SEQ ID NO: 3740972 - RNA, 19 nt, Human
guuugcauaaacauucuuu

SEQ ID NO: 3740973 - RNA, 15 nt, Human
guuugccauacuuug

SEQ ID NO: 3740974 - RNA, 18 nt, Human
guuugccgguggugcagg

SEQ ID NO: 3740975 - RNA, 14 nt, Human
guuugccugagggc

SEQ ID NO: 3740976 - RNA, 13 nt, Human
guuugcuaauguu

SEQ ID NO: 3740977 - RNA, 20 nt, Human
guuugcuaauguuuccauag

SEQ ID NO: 3740978 - RNA, 15 nt, Human
guuugcucagaacac

SEQ ID NO: 3740979 - RNA, 14 nt, Human
guuugcuccccuuc

SEQ ID NO: 3740980 - RNA, 23 nt, Human
guuugcuccccuuccccuuccuu

SEQ ID NO: 3740981 - RNA, 18 nt, Human
guuugcuguugauuucuu

SEQ ID NO: 3740982 - RNA, 15 nt, Human
guuugcuuauuguuc

SEQ ID NO: 3740983 - RNA, 17 nt, Human
guuugcuuauuguucca

SEQ ID NO: 3740984 - RNA, 19 nt, Human
guuugcuucaacugucucc

SEQ ID NO: 3740985 - RNA, 17 nt, Human
guuugcuucauaaauga

SEQ ID NO: 3740986 - RNA, 20 nt, Human
guuugcuucaugugucccag

SEQ ID NO: 3740987 - RNA, 21 nt, Human
guuuggaaauugauuuugaac

SEQ ID NO: 3740988 - RNA, 13 nt, Human
guuuggaaugcuu

SEQ ID NO: 3740989 - RNA, 19 nt, Human
guuuggaccccagcuggga

SEQ ID NO: 3740990 - RNA, 13 nt, Human
guuuggagacaga

SEQ ID NO: 3740991 - RNA, 18 nt, Human
guuuggauucuuauguag

SEQ ID NO: 3740992 - RNA, 21 nt, Human
guuuggauuuuuaauuaaaaa

SEQ ID NO: 3740993 - RNA, 14 nt, Human
guuuggcaaggaaa

SEQ ID NO: 3740994 - RNA, 15 nt, Human
guuuggcaauaguuu

SEQ ID NO: 3740995 - RNA, 12 nt, Human
guuuggccagaa

SEQ ID NO: 3740996 - RNA, 23 nt, Human
guuuggccagaagucaaggcuua

SEQ ID NO: 3740997 - RNA, 16 nt, Human
guuuggcgggccaagg

SEQ ID NO: 3740998 - RNA, 20 nt, Human
guuuggcugugucuaaacug

SEQ ID NO: 3740999 - RNA, 21 nt, Human
guuuggcugugucuaaacugc

SEQ ID NO: 3741000 - RNA, 23 nt, Human
guuuggcugugucuaaacugcau

SEQ ID NO: 3741001 - RNA, 16 nt, Human
guuuggcuuccuccug

SEQ ID NO: 3741002 - RNA, 21 nt, Human
guuugggaagagcuuagaaac

SEQ ID NO: 3741003 - RNA, 22 nt, Human
guuugggaccccuggugguuca

SEQ ID NO: 3741004 - RNA, 19 nt, Human
guuuggggcagaaaggacu

SEQ ID NO: 3741005 - RNA, 16 nt, Human
guuuggggcgaggcag

SEQ ID NO: 3741006 - RNA, 17 nt, Human
guuugggugauuccuaa

SEQ ID NO: 3741007 - RNA, 16 nt, Human
guuugguaaauguuuc

SEQ ID NO: 3741008 - RNA, 19 nt, Human
guuugguaaauguuucuuu

SEQ ID NO: 3741009 - RNA, 15 nt, Human
guuugguauuguauu

SEQ ID NO: 3741010 - RNA, 15 nt, Human
guuuggucuggacug

SEQ ID NO: 3741011 - RNA, 14 nt, Human
guuugguucugggg

SEQ ID NO: 3741012 - RNA, 17 nt, Human
guuuguaaauuaacuuu

SEQ ID NO: 3741013 - RNA, 13 nt, Human
guuuguaagaaaa

SEQ ID NO: 3741014 - RNA, 15 nt, Human
guuuguauaacuucu

SEQ ID NO: 3741015 - RNA, 13 nt, Human
guuuguauauugu

SEQ ID NO: 3741016 - RNA, 14 nt, Human
guuuguauguauaa

SEQ ID NO: 3741017 - RNA, 12 nt, Human
guuuguauuugg

SEQ ID NO: 3741018 - RNA, 13 nt, Human
guuugucauuagc

SEQ ID NO: 3741019 - RNA, 13 nt, Human
guuugucuauuuu

SEQ ID NO: 3741020 - RNA, 16 nt, Human
guuugucuauuuuaaa

SEQ ID NO: 3741021 - RNA, 16 nt, Human
guuugucucuccuuuu

SEQ ID NO: 3741022 - RNA, 13 nt, Human
guuugucucuucu

SEQ ID NO: 3741023 - RNA, 16 nt, Human
guuugucuguuuguuu

SEQ ID NO: 3741024 - RNA, 23 nt, Human
guuugugccuuuuuauuuuuguu

SEQ ID NO: 3741025 - RNA, 23 nt, Human
guuugugcugguguaugugugaa

SEQ ID NO: 3741026 - RNA, 13 nt, Human
guuugugcuucua

SEQ ID NO: 3741027 - RNA, 16 nt, Human
guuuguggccucagaa

SEQ ID NO: 3741028 - RNA, 18 nt, Human
guuuguggcuauuaaaac

SEQ ID NO: 3741029 - RNA, 13 nt, Human
guuugugugucuu

SEQ ID NO: 3741030 - RNA, 15 nt, Human
guuuguguguugucu

SEQ ID NO: 3741031 - RNA, 17 nt, Human
guuuguguucuguuuug

SEQ ID NO: 3741032 - RNA, 16 nt, Human
guuuguuaaaaauaaa

SEQ ID NO: 3741033 - RNA, 19 nt, Human
guuuguuaaaaauaaaucc

SEQ ID NO: 3741034 - RNA, 13 nt, Human
guuuguuaaaacu

SEQ ID NO: 3741035 - RNA, 17 nt, Human
guuuguuacauagguau

SEQ ID NO: 3741036 - RNA, 14 nt, Human
guuuguuauauccu

SEQ ID NO: 3741037 - RNA, 19 nt, Human
guuuguuggaucuucaaug

SEQ ID NO: 3741038 - RNA, 22 nt, Human
guuuguugguugguuuucuucu

SEQ ID NO: 3741039 - RNA, 18 nt, Human
guuuguuuauuagaugaa

SEQ ID NO: 3741040 - RNA, 23 nt, Human
guuuguuucauauauacaggcau

SEQ ID NO: 3741041 - RNA, 11 nt, Human
guuuguuuguu

SEQ ID NO: 3741042 - RNA, 16 nt, Human
guuuguuuguuuuguu

SEQ ID NO: 3741043 - RNA, 17 nt, Human
guuuguuuuguuuuuua

SEQ ID NO: 3741044 - RNA, 14 nt, Human
guuuguuuuugcgu

SEQ ID NO: 3741045 - RNA, 12 nt, Human
guuuguuuuugg

SEQ ID NO: 3741046 - RNA, 15 nt, Human
guuuguuuuuuugcc

SEQ ID NO: 3741047 - RNA, 15 nt, Human
guuuuaaaaaaauaa

SEQ ID NO: 3741048 - RNA, 21 nt, Human
guuuuaaaaaaauaaaacauu

SEQ ID NO: 3741049 - RNA, 15 nt, Human
guuuuaaaaagccag

SEQ ID NO: 3741050 - RNA, 16 nt, Human
guuuuaaaaagccagu

SEQ ID NO: 3741051 - RNA, 21 nt, Human
guuuuaaaaaggaacugcagc

SEQ ID NO: 3741052 - RNA, 16 nt, Human
guuuuaaaagccuugg

SEQ ID NO: 3741053 - RNA, 14 nt, Human
guuuuaaaauacug

SEQ ID NO: 3741054 - RNA, 18 nt, Human
guuuuaaaauacuguaga

SEQ ID NO: 3741055 - RNA, 19 nt, Human
guuuuaaaauacuguagau

SEQ ID NO: 3741056 - RNA, 21 nt, Human
guuuuaaaauacuguagauaa

SEQ ID NO: 3741057 - RNA, 16 nt, Human
guuuuaaaaugagaaa

SEQ ID NO: 3741058 - RNA, 17 nt, Human
guuuuaaaaugagaaau

SEQ ID NO: 3741059 - RNA, 22 nt, Human
guuuuaaauacgcacuacaugu

SEQ ID NO: 3741060 - RNA, 15 nt, Human
guuuuaaauguacag

SEQ ID NO: 3741061 - RNA, 22 nt, Human
guuuuaaauguacagacauauu

SEQ ID NO: 3741062 - RNA, 16 nt, Human
guuuuaaauguacagu

SEQ ID NO: 3741063 - RNA, 17 nt, Human
guuuuaacaagaagcaa

SEQ ID NO: 3741064 - RNA, 13 nt, Human
guuuuaacuuugu

SEQ ID NO: 3741065 - RNA, 15 nt, Human
guuuuaagaaaugua

SEQ ID NO: 3741066 - RNA, 16 nt, Human
guuuuaagaaauguag

SEQ ID NO: 3741067 - RNA, 16 nt, Human
guuuuaagaggcaggg

SEQ ID NO: 3741068 - RNA, 18 nt, Human
guuuuaaggaagaaaaau

SEQ ID NO: 3741069 - RNA, 14 nt, Human
guuuuaaucugaaa

SEQ ID NO: 3741070 - RNA, 16 nt, Human
guuuuaaucugaaauu

SEQ ID NO: 3741071 - RNA, 20 nt, Human
guuuuaauuccaauaugaug

SEQ ID NO: 3741072 - RNA, 22 nt, Human
guuuuaauuccaugaaucgcuu

SEQ ID NO: 3741073 - RNA, 16 nt, Human
guuuuaauugaaggaa

SEQ ID NO: 3741074 - RNA, 17 nt, Human
guuuuaauugaaggaaa

SEQ ID NO: 3741075 - RNA, 20 nt, Human
guuuuaauuuaguaaaccaa

SEQ ID NO: 3741076 - RNA, 19 nt, Human
guuuuaauuuauacuggca

SEQ ID NO: 3741077 - RNA, 12 nt, Human
guuuuacauugu

SEQ ID NO: 3741078 - RNA, 21 nt, Human
guuuuacauuguugagcuauu

SEQ ID NO: 3741079 - RNA, 13 nt, Human
guuuuacuuuuaa

SEQ ID NO: 3741080 - RNA, 21 nt, Human
guuuuacuuuuaaacugugua

SEQ ID NO: 3741081 - RNA, 13 nt, Human
guuuuagaaaaca

SEQ ID NO: 3741082 - RNA, 16 nt, Human
guuuuagaagguucuc

SEQ ID NO: 3741083 - RNA, 23 nt, Human
guuuuagacaaauacucaugugu

SEQ ID NO: 3741084 - RNA, 19 nt, Human
guuuuagaguuaacaauga

SEQ ID NO: 3741085 - RNA, 20 nt, Human
guuuuagcuccuugacuccu

SEQ ID NO: 3741086 - RNA, 15 nt, Human
guuuuagguucuaaa

SEQ ID NO: 3741087 - RNA, 16 nt, Human
guuuuagguucuaaag

SEQ ID NO: 3741088 - RNA, 21 nt, Human
guuuuagguucuaaaguucua

SEQ ID NO: 3741089 - RNA, 15 nt, Human
guuuuaguuaaauuu

SEQ ID NO: 3741090 - RNA, 16 nt, Human
guuuuauaaaaucaag

SEQ ID NO: 3741091 - RNA, 23 nt, Human
guuuuauaagcaucauuauuuau

SEQ ID NO: 3741092 - RNA, 15 nt, Human
guuuuauaauuuugu

SEQ ID NO: 3741093 - RNA, 21 nt, Human
guuuuauacugaaggaaaaac

SEQ ID NO: 3741094 - RNA, 19 nt, Human
guuuuauauauuauaugga

SEQ ID NO: 3741095 - RNA, 15 nt, Human
guuuuauauccauuu

SEQ ID NO: 3741096 - RNA, 22 nt, Human
guuuuaucacauguauguuuug

SEQ ID NO: 3741097 - RNA, 21 nt, Human
guuuuaucguccagugacuuu

SEQ ID NO: 3741098 - RNA, 13 nt, Human
guuuuaugacuuc

SEQ ID NO: 3741099 - RNA, 21 nt, Human
guuuuauuauuucuauuaaau

SEQ ID NO: 3741100 - RNA, 18 nt, Human
guuuuauuuauauuuauu

SEQ ID NO: 3741101 - RNA, 17 nt, Human
guuuuauuuuauguuua

SEQ ID NO: 3741102 - RNA, 17 nt, Human
guuuucaaaauaaaaau

SEQ ID NO: 3741103 - RNA, 13 nt, Human
guuuucaaaugga

SEQ ID NO: 3741104 - RNA, 16 nt, Human
guuuucaaauggaguu

SEQ ID NO: 3741105 - RNA, 18 nt, Human
guuuucaaccucuagaau

SEQ ID NO: 3741106 - RNA, 13 nt, Human
guuuucaaugaug

SEQ ID NO: 3741107 - RNA, 20 nt, Human
guuuucaauuuuaaacauau

SEQ ID NO: 3741108 - RNA, 20 nt, Human
guuuucacauaaaugcagcc

SEQ ID NO: 3741109 - RNA, 22 nt, Human
guuuucacauaaaugcagccca

SEQ ID NO: 3741110 - RNA, 23 nt, Human
guuuucacauaaaugcagcccau

SEQ ID NO: 3741111 - RNA, 12 nt, Human
guuuucagaaaa

SEQ ID NO: 3741112 - RNA, 18 nt, Human
guuuucagaagaaauaaa

SEQ ID NO: 3741113 - RNA, 14 nt, Human
guuuucagacucag

SEQ ID NO: 3741114 - RNA, 10 nt, Human
guuuucaugg

SEQ ID NO: 3741115 - RNA, 21 nt, Human
guuuucauggugaaaauguac

SEQ ID NO: 3741116 - RNA, 16 nt, Human
guuuucauuaucucaa

SEQ ID NO: 3741117 - RNA, 14 nt, Human
guuuuccacccugg

SEQ ID NO: 3741118 - RNA, 16 nt, Human
guuuuccacccuggaa

SEQ ID NO: 3741119 - RNA, 14 nt, Human
guuuuccaugaaaa

SEQ ID NO: 3741120 - RNA, 17 nt, Human
guuuuccauuguuugaa

SEQ ID NO: 3741121 - RNA, 15 nt, Human
guguuucccauaauu

SEQ ID NO: 3741122 - RNA, 20 nt, Human
guguuuccuucauuucugau

SEQ ID NO: 3741123 - RNA, 16 nt, Human
guguuucuagcacugg

SEQ ID NO: 3741124 - RNA, 15 nt, Human
guguuucuagggaaa

SEQ ID NO: 3741125 - RNA, 21 nt, Human
guguuucucccucucacuguc

SEQ ID NO: 3741126 - RNA, 22 nt, Human
guguuucucccucucacugucu

SEQ ID NO: 3741127 - RNA, 12 nt, Human
guguuucuguau

SEQ ID NO: 3741128 - RNA, 19 nt, Human
guguuugcuccccuucccc

SEQ ID NO: 3741129 - RNA, 13 nt, Human
guguuugcuuucu

SEQ ID NO: 3741130 - RNA, 15 nt, Human
guguuugguuuacau

SEQ ID NO: 3741131 - RNA, 20 nt, Human
guguuugguuuacauuuaaa

SEQ ID NO: 3741132 - RNA, 12 nt, Human
guguuugucucu

SEQ ID NO: 3741133 - RNA, 17 nt, Human
guguuugucucuucugg

SEQ ID NO: 3741134 - RNA, 16 nt, Human
guguuuuaaagagaau

SEQ ID NO: 3741135 - RNA, 18 nt, Human
guguuuuaaagagaaugu

SEQ ID NO: 3741136 - RNA, 14 nt, Human
guguuuuaauuuaa

SEQ ID NO: 3741137 - RNA, 15 nt, Human
guguuuuauaaaaua

SEQ ID NO: 3741138 - RNA, 12 nt, Human
guguuuucagag

SEQ ID NO: 3741139 - RNA, 14 nt, Human
guguuuucauaaua

SEQ ID NO: 3741140 - RNA, 15 nt, Human
guguuuucauaauaa

SEQ ID NO: 3741141 - RNA, 13 nt, Human
guguuuucugaau

SEQ ID NO: 3741142 - RNA, 16 nt, Human
guguuuucuguguaac

SEQ ID NO: 3741143 - RNA, 15 nt, Human
guguuuugaaagaau

SEQ ID NO: 3741144 - RNA, 16 nt, Human
guguuuugcaagugcu

SEQ ID NO: 3741145 - RNA, 22 nt, Human
guguuuuguuuugauuuaauaa

SEQ ID NO: 3741146 - RNA, 15 nt, Human
guguuuuucuauuaa

SEQ ID NO: 3741147 - RNA, 17 nt, Human
guguuuuucuauuaaaa

SEQ ID NO: 3741148 - RNA, 12 nt, Human
guguuuuucuca

SEQ ID NO: 3741149 - RNA, 19 nt, Human
guguuuuucucauauuuga

SEQ ID NO: 3741150 - RNA, 15 nt, Human
guguuuuucuccagu

SEQ ID NO: 3741151 - RNA, 18 nt, Human
guguuuuucuccagugcu

SEQ ID NO: 3741152 - RNA, 21 nt, Human
guguuuuucuuguaaaugugu

SEQ ID NO: 3741153 - RNA, 19 nt, Human
guguuuuugggaugucuua

SEQ ID NO: 3741154 - RNA, 13 nt, Human
guguuuuuuaaga

SEQ ID NO: 3741155 - RNA, 19 nt, Human
guguuuuuuuauuucuacu

SEQ ID NO: 3741156 - RNA, 19 nt, Human
guuaaaaaaaauaauaaau

SEQ ID NO: 3741157 - RNA, 20 nt, Human
guuaaaagagguuuuucuua

SEQ ID NO: 3741158 - RNA, 21 nt, Human
guuaaaagagguuuuucuuaa

SEQ ID NO: 3741159 - RNA, 20 nt, Human
guuaaaagaugaaaauauuu

SEQ ID NO: 3741160 - RNA, 21 nt, Human
guuaaaauaacuaguguugcu

SEQ ID NO: 3741161 - RNA, 15 nt, Human
guuaaaauuccaucc

SEQ ID NO: 3741162 - RNA, 23 nt, Human
guuaaacuagcauaucugccuuu

SEQ ID NO: 3741163 - RNA, 13 nt, Human
guuaaacuguuag

SEQ ID NO: 3741164 - RNA, 22 nt, Human
guuaaacuguuagcacuguuga

SEQ ID NO: 3741165 - RNA, 19 nt, Human
guuaaacuuacuuaguguu

SEQ ID NO: 3741166 - RNA, 15 nt, Human
guuaaagaaaggaaa

SEQ ID NO: 3741167 - RNA, 13 nt, Human
guuaaagauguag

SEQ ID NO: 3741168 - RNA, 13 nt, Human
guuaaaggaaaaa

SEQ ID NO: 3741169 - RNA, 21 nt, Human
guuaaagugaggccacugaag

SEQ ID NO: 3741170 - RNA, 22 nt, Human
guuaaagugaggccacugaaga

SEQ ID NO: 3741171 - RNA, 17 nt, Human
guuaaauaaauuguaua

SEQ ID NO: 3741172 - RNA, 18 nt, Human
guuaaauaaauuguauau

SEQ ID NO: 3741173 - RNA, 22 nt, Human
guuaaauaaauuguauauucac

SEQ ID NO: 3741174 - RNA, 20 nt, Human
guuaaauacuguguggaacu

SEQ ID NO: 3741175 - RNA, 12 nt, Human
guuaaauauuua

SEQ ID NO: 3741176 - RNA, 13 nt, Human
guuaaauauuuac

SEQ ID NO: 3741177 - RNA, 15 nt, Human
guuaaauauuuacau

SEQ ID NO: 3741178 - RNA, 18 nt, Human
guuaaaugaaauuguaaa

SEQ ID NO: 3741179 - RNA, 11 nt, Human
guuaaauguuu

SEQ ID NO: 3741180 - RNA, 17 nt, Human
guuaaauguuuuguaaa

SEQ ID NO: 3741181 - RNA, 19 nt, Human
guuaaauguuuuguaaacu

SEQ ID NO: 3741182 - RNA, 23 nt, Human
guuaaauguuuuguaaacuuuga

SEQ ID NO: 3741183 - RNA, 13 nt, Human
guuaaauuuguaa

SEQ ID NO: 3741184 - RNA, 14 nt, Human
guuaaauuuguaag

SEQ ID NO: 3741185 - RNA, 15 nt, Human
guuaaauuuguaagu

SEQ ID NO: 3741186 - RNA, 17 nt, Human
guuaaauuuguaaguuu

SEQ ID NO: 3741187 - RNA, 19 nt, Human
guuaaauuuguaaguuuca

SEQ ID NO: 3741188 - RNA, 23 nt, Human
guuaaauuuguaaguuucaggug

SEQ ID NO: 3741189 - RNA, 23 nt, Human
guuaacaaugccuauuguaauau

SEQ ID NO: 3741190 - RNA, 21 nt, Human
guuaacacacuaccgaaugug

SEQ ID NO: 3741191 - RNA, 15 nt, Human
guuaacacauuuugu

SEQ ID NO: 3741192 - RNA, 19 nt, Human
guuaacacauuuuguauaa

SEQ ID NO: 3741193 - RNA, 21 nt, Human
guuaacagaagggagggcaga

SEQ ID NO: 3741194 - RNA, 23 nt, Human
guuaacagagacagauaacucuc

SEQ ID NO: 3741195 - RNA, 17 nt, Human
guuaacaggcaaacauu

SEQ ID NO: 3741196 - RNA, 23 nt, Human
guuaacauuccaagacucuagag

SEQ ID NO: 3741197 - RNA, 24 nt, Human
guuaacauuccaagacucuagagu

SEQ ID NO: 3741198 - RNA, 22 nt, Human
guuaacccuucaucuuccugug

SEQ ID NO: 3741199 - RNA, 17 nt, Human
guuaaccucagugucau

SEQ ID NO: 3741200 - RNA, 18 nt, Human
guuaacuauguacaauau

SEQ ID NO: 3741201 - RNA, 19 nt, Human
guuaacuauguacaauauu

SEQ ID NO: 3741202 - RNA, 16 nt, Human
guuaacugaauaccac

SEQ ID NO: 3741203 - RNA, 22 nt, Human
guuaacugaauaccacucugua

SEQ ID NO: 3741204 - RNA, 21 nt, Human
guuaacuuauucaaagagaaa

SEQ ID NO: 3741205 - RNA, 13 nt, Human
guuaacuuugggu

SEQ ID NO: 3741206 - RNA, 18 nt, Human
guuaagaaaaaaauaauu

SEQ ID NO: 3741207 - RNA, 14 nt, Human
guuaagaaaauaaa

SEQ ID NO: 3741208 - RNA, 21 nt, Human
guuaagaagcuguuguacauu

SEQ ID NO: 3741209 - RNA, 19 nt, Human
guuaagacaugauuuccuu

SEQ ID NO: 3741210 - RNA, 14 nt, Human
guuaagaccuggca

SEQ ID NO: 3741211 - RNA, 11 nt, Human
guuaagagaaa

SEQ ID NO: 3741212 - RNA, 12 nt, Human
guuaagagaaac

SEQ ID NO: 3741213 - RNA, 12 nt, Human
guuaagagaaau

SEQ ID NO: 3741214 - RNA, 12 nt, Human
guuaagcaucua

SEQ ID NO: 3741215 - RNA, 18 nt, Human
guuaagcauuaccacuca

SEQ ID NO: 3741216 - RNA, 15 nt, Human
guuaagcucugcuau

SEQ ID NO: 3741217 - RNA, 12 nt, Human
guuaaggaaacu

SEQ ID NO: 3741218 - RNA, 14 nt, Human
guuaaggaauauaa

SEQ ID NO: 3741219 - RNA, 11 nt, Human
guuaaggccug

SEQ ID NO: 3741220 - RNA, 17 nt, Human
guuaagguucaagacag

SEQ ID NO: 3741221 - RNA, 14 nt, Human
guuaaguaugugua

SEQ ID NO: 3741222 - RNA, 23 nt, Human
guuaaguccucccugacuuuucu

SEQ ID NO: 3741223 - RNA, 22 nt, Human
guuaagucuaaauauuuccuua

SEQ ID NO: 3741224 - RNA, 22 nt, Human
guuaagucuguuuuaugacuuc

SEQ ID NO: 3741225 - RNA, 22 nt, Human
guuaaguuacuucacuuuaauu

SEQ ID NO: 3741226 - RNA, 23 nt, Human
guuaaguuggcuucuguuucuag

SEQ ID NO: 3741227 - RNA, 12 nt, Human
guuaauaaaagu

SEQ ID NO: 3741228 - RNA, 14 nt, Human
guuaauaguuccug

SEQ ID NO: 3741229 - RNA, 21 nt, Human
guuaauauaucccagaaauua

SEQ ID NO: 3741230 - RNA, 21 nt, Human
guuaaucaauuuaaacccauu

SEQ ID NO: 3741231 - RNA, 23 nt, Human
guuaaucucuguuauguacugua

SEQ ID NO: 3741232 - RNA, 17 nt, Human
guuaaucuuaauguaua

SEQ ID NO: 3741233 - RNA, 19 nt, Human
guuaaucuuaauguauauc

SEQ ID NO: 3741234 - RNA, 14 nt, Human
guuaaucuucaugg

SEQ ID NO: 3741235 - RNA, 13 nt, Human
guuaaucuugcuu

SEQ ID NO: 3741236 - RNA, 16 nt, Human
guuaaugaaaauguca

SEQ ID NO: 3741237 - RNA, 18 nt, Human
guuaaugauagcuacugu

SEQ ID NO: 3741238 - RNA, 16 nt, Human
guuaauguauauaaaa

SEQ ID NO: 3741239 - RNA, 18 nt, Human
guuaauguauauaaaaau

SEQ ID NO: 3741240 - RNA, 21 nt, Human
guuaauucagcacugauuuca

SEQ ID NO: 3741241 - RNA, 23 nt, Human
guuaauuuaaaguuguuugugcc

SEQ ID NO: 3741242 - RNA, 19 nt, Human
guuaauuuaaguuuugaca

SEQ ID NO: 3741243 - RNA, 23 nt, Human
guuaauuuaaguuuugacaagcu

SEQ ID NO: 3741244 - RNA, 17 nt, Human
guuaauuuaucuaaauu

SEQ ID NO: 3741245 - RNA, 21 nt, Human
guuaauuuaucuaaauuaaag

SEQ ID NO: 3741246 - RNA, 22 nt, Human
guuaauuuggaccauuuuccug

SEQ ID NO: 3741247 - RNA, 18 nt, Human
guuaauuuguguguuuuu

SEQ ID NO: 3741248 - RNA, 12 nt, Human
guuaauuuuuga

SEQ ID NO: 3741249 - RNA, 14 nt, Human
guuaauuuuugaua

SEQ ID NO: 3741250 - RNA, 21 nt, Human
guuaauuuuuugguacaaaaa

SEQ ID NO: 3741251 - RNA, 16 nt, Human
guuacaaaauguaacu

SEQ ID NO: 3741252 - RNA, 17 nt, Human
guuacaaaauguaacug

SEQ ID NO: 3741253 - RNA, 21 nt, Human
guuacaaaauguaacuguuac

SEQ ID NO: 3741254 - RNA, 9 nt, Human
guuacaaac

SEQ ID NO: 3741255 - RNA, 20 nt, Human
guuacaaauuauaauguauu

SEQ ID NO: 3741256 - RNA, 14 nt, Human
guuacaacagauuu

SEQ ID NO: 3741257 - RNA, 18 nt, Human
guuacaacagauuuguga

SEQ ID NO: 3741258 - RNA, 19 nt, Human
guuacaacagauuugugaa

SEQ ID NO: 3741259 - RNA, 23 nt, Human
guuacaacagauuugugaacuca

SEQ ID NO: 3741260 - RNA, 22 nt, Human
guuacaaguauacuuauauuuc

SEQ ID NO: 3741261 - RNA, 17 nt, Human
guuacacauuuuucaga

SEQ ID NO: 3741262 - RNA, 16 nt, Human
guuacacuaaaaggug

SEQ ID NO: 3741263 - RNA, 22 nt, Human
guuacacuggaggagagaagaa

SEQ ID NO: 3741264 - RNA, 23 nt, Human
guuacacuggaggagagaagaau

SEQ ID NO: 3741265 - RNA, 22 nt, Human
guuacacuguuagaacacuauu

SEQ ID NO: 3741266 - RNA, 22 nt, Human
guuacacuguuauuuucagcau

SEQ ID NO: 3741267 - RNA, 13 nt, Human
guuacacuugugc

SEQ ID NO: 3741268 - RNA, 17 nt, Human
guuacacuuuuuggaag

SEQ ID NO: 3741269 - RNA, 18 nt, Human
guuacacuuuuuggaagu

SEQ ID NO: 3741270 - RNA, 12 nt, Human
gaugauuucuau

SEQ ID NO: 3741271 - RNA, 22 nt, Human
gaugauuucuugaaaagggugu

SEQ ID NO: 3741272 - RNA, 18 nt, Human
gaugauuugcaaugggau

SEQ ID NO: 3741273 - RNA, 20 nt, Human
gaugauuugcuaucaaaaua

SEQ ID NO: 3741274 - RNA, 14 nt, Human
gaugauuuuuguca

SEQ ID NO: 3741275 - RNA, 14 nt, Human
gaugcaaagaaaau

SEQ ID NO: 3741276 - RNA, 15 nt, Human
gaugcaaagaggcaa

SEQ ID NO: 3741277 - RNA, 16 nt, Human
gaugcaaagaggcaag

SEQ ID NO: 3741278 - RNA, 17 nt, Human
gaugcaaagaggcaaga

SEQ ID NO: 3741279 - RNA, 23 nt, Human
gaugcaaaguacaauguguuuuu

SEQ ID NO: 3741280 - RNA, 19 nt, Human
gaugcaaauagcaaaacua

SEQ ID NO: 3741281 - RNA, 20 nt, Human
gaugcaacacgcauggucaa

SEQ ID NO: 3741282 - RNA, 14 nt, Human
gaugcaaggaccag

SEQ ID NO: 3741283 - RNA, 17 nt, Human
gaugcaaggaccaggac

SEQ ID NO: 3741284 - RNA, 18 nt, Human
gaugcaaggaccaggacu

SEQ ID NO: 3741285 - RNA, 21 nt, Human
gaugcaaucgguuuaaacaug

SEQ ID NO: 3741286 - RNA, 17 nt, Human
gaugcaauguagagggg

SEQ ID NO: 3741287 - RNA, 14 nt, Human
gaugcacagagaag

SEQ ID NO: 3741288 - RNA, 17 nt, Human
gaugcacagagaagcug

SEQ ID NO: 3741289 - RNA, 19 nt, Human
gaugcacagagaagcuggg

SEQ ID NO: 3741290 - RNA, 15 nt, Human
gaugcacuucaaauu

SEQ ID NO: 3741291 - RNA, 23 nt, Human
gaugcagagguaaaagugugagc

SEQ ID NO: 3741292 - RNA, 23 nt, Human
gaugcagcauuugauaaugauaa

SEQ ID NO: 3741293 - RNA, 21 nt, Human
gaugcagcauuuuguauuugu

SEQ ID NO: 3741294 - RNA, 20 nt, Human
gaugcagccgccuuccuuga

SEQ ID NO: 3741295 - RNA, 14 nt, Human
gaugcagccucaca

SEQ ID NO: 3741296 - RNA, 19 nt, Human
gaugcagccucacaguccu

SEQ ID NO: 3741297 - RNA, 16 nt, Human
gaugcagcucuuccug

SEQ ID NO: 3741298 - RNA, 14 nt, Human
gaugcagcuuauac

SEQ ID NO: 3741299 - RNA, 21 nt, Human
gaugcaggauuuguucucugu

SEQ ID NO: 3741300 - RNA, 21 nt, Human
gaugcaggcacuuauuguaaa

SEQ ID NO: 3741301 - RNA, 12 nt, Human
gaugcaggcucc

SEQ ID NO: 3741302 - RNA, 16 nt, Human
gaugcaggcuccccug

SEQ ID NO: 3741303 - RNA, 14 nt, Human
gaugcagggcaguc

SEQ ID NO: 3741304 - RNA, 19 nt, Human
gaugcagucuccucuuuaa

SEQ ID NO: 3741305 - RNA, 22 nt, Human
gaugcagugccaggaacccuua

SEQ ID NO: 3741306 - RNA, 17 nt, Human
gaugcaugucuuuuaaa

SEQ ID NO: 3741307 - RNA, 22 nt, Human
gaugcaugucuuuuaaaaugca

SEQ ID NO: 3741308 - RNA, 17 nt, Human
gaugcauuaaaagaaaa

SEQ ID NO: 3741309 - RNA, 18 nt, Human
gaugcauuaaaagaaaau

SEQ ID NO: 3741310 - RNA, 15 nt, Human
gaugccaaccucugg

SEQ ID NO: 3741311 - RNA, 15 nt, Human
gaugccacaccaagc

SEQ ID NO: 3741312 - RNA, 21 nt, Human
gaugccacaccaagcugugcc

SEQ ID NO: 3741313 - RNA, 23 nt, Human
gaugccacuucuaagaaaagccu

SEQ ID NO: 3741314 - RNA, 18 nt, Human
gaugccagccaagcucug

SEQ ID NO: 3741315 - RNA, 22 nt, Human
gaugccagccaagcucugcagu

SEQ ID NO: 3741316 - RNA, 21 nt, Human
gaugccaguaggcucaacuag

SEQ ID NO: 3741317 - RNA, 15 nt, Human
gaugccauccucuuu

SEQ ID NO: 3741318 - RNA, 18 nt, Human
gaugccaucugugggcac

SEQ ID NO: 3741319 - RNA, 17 nt, Human
gaugcccaaauccuuag

SEQ ID NO: 3741320 - RNA, 19 nt, Human
gaugcccagagggcccagg

SEQ ID NO: 3741321 - RNA, 22 nt, Human
gaugcccagggccacucugccu

SEQ ID NO: 3741322 - RNA, 15 nt, Human
gaugcccuggaggug

SEQ ID NO: 3741323 - RNA, 12 nt, Human
gaugccucagaa

SEQ ID NO: 3741324 - RNA, 23 nt, Human
gaugccucaugauaugucagggc

SEQ ID NO: 3741325 - RNA, 12 nt, Human
gaugccuccacc

SEQ ID NO: 3741326 - RNA, 13 nt, Human
gaugccuccaccg

SEQ ID NO: 3741327 - RNA, 16 nt, Human
gaugccuccaccgcug

SEQ ID NO: 3741328 - RNA, 17 nt, Human
gaugccuccaccgcugc

SEQ ID NO: 3741329 - RNA, 18 nt, Human
gaugccucccugacccug

SEQ ID NO: 3741330 - RNA, 16 nt, Human
gaugccuccuuccucu

SEQ ID NO: 3741331 - RNA, 14 nt, Human
gaugccugguggca

SEQ ID NO: 3741332 - RNA, 20 nt, Human
gaugccugugaacugaacuc

SEQ ID NO: 3741333 - RNA, 15 nt, Human
gaugcgcaguugcug

SEQ ID NO: 3741334 - RNA, 23 nt, Human
gaugcgcauucuaaccuggaggu

SEQ ID NO: 3741335 - RNA, 21 nt, Human
gaugcgguggcucacgccugu

SEQ ID NO: 3741336 - RNA, 14 nt, Human
gaugcuaaaaccug

SEQ ID NO: 3741337 - RNA, 23 nt, Human
gaugcuaagagaaaaaaaagacu

SEQ ID NO: 3741338 - RNA, 18 nt, Human
gaugcuagaacucccuuu

SEQ ID NO: 3741339 - RNA, 20 nt, Human
gaugcucccuccccugcccu

SEQ ID NO: 3741340 - RNA, 21 nt, Human
gaugcucccuccccugcccug

SEQ ID NO: 3741341 - RNA, 16 nt, Human
gaugcuccuugggccc

SEQ ID NO: 3741342 - RNA, 21 nt, Human
gaugcugaaacaggagagaaa

SEQ ID NO: 3741343 - RNA, 20 nt, Human
gaugcugacuguacuccucc

SEQ ID NO: 3741344 - RNA, 18 nt, Human
gaugcugauguucagugu

SEQ ID NO: 3741345 - RNA, 12 nt, Human
gaugcugccccu

SEQ ID NO: 3741346 - RNA, 13 nt, Human
gaugcugccccuc

SEQ ID NO: 3741347 - RNA, 12 nt, Human
gaugcugcuuuc

SEQ ID NO: 3741348 - RNA, 15 nt, Human
gaugcugcuuucccc

SEQ ID NO: 3741349 - RNA, 14 nt, Human
gaugcuggagaggu

SEQ ID NO: 3741350 - RNA, 14 nt, Human
gaugcuggaugcuc

SEQ ID NO: 3741351 - RNA, 13 nt, Human
gaugcuggcccag

SEQ ID NO: 3741352 - RNA, 14 nt, Human
gaugcuggcccagg

SEQ ID NO: 3741353 - RNA, 16 nt, Human
gaugcuggcccagggc

SEQ ID NO: 3741354 - RNA, 16 nt, Human
gaugcugggcuggcuc

SEQ ID NO: 3741355 - RNA, 17 nt, Human
gaugcugggcugggugc

SEQ ID NO: 3741356 - RNA, 23 nt, Human
gaugcuggguuggugcacaguga

SEQ ID NO: 3741357 - RNA, 17 nt, Human
gaugcugguaauggcca

SEQ ID NO: 3741358 - RNA, 19 nt, Human
gaugcugugaaauucccaa

SEQ ID NO: 3741359 - RNA, 15 nt, Human
gaugcuucugggaga

SEQ ID NO: 3741360 - RNA, 18 nt, Human
gaugcuuguaacaagaaa

SEQ ID NO: 3741361 - RNA, 14 nt, Human
gaugcuuguacaua

SEQ ID NO: 3741362 - RNA, 21 nt, Human
gaugcuuuaagugcacaacau

SEQ ID NO: 3741363 - RNA, 20 nt, Human
gaugcuuuaccaaacagcaa

SEQ ID NO: 3741364 - RNA, 17 nt, Human
gaugcuuuucugucucu

SEQ ID NO: 3741365 - RNA, 20 nt, Human
gaugcuuuucugucucugcc

SEQ ID NO: 3741366 - RNA, 15 nt, Human
gauggaaaaggaaga

SEQ ID NO: 3741367 - RNA, 16 nt, Human
gauggaaacaaagugg

SEQ ID NO: 3741368 - RNA, 23 nt, Human
gauggaaaggauuguaggugcaa

SEQ ID NO: 3741369 - RNA, 22 nt, Human
gauggaaccgcaggaagcugcu

SEQ ID NO: 3741370 - RNA, 20 nt, Human
gauggaauuuuuuuguacga

SEQ ID NO: 3741371 - RNA, 14 nt, Human
gauggacacuccag

SEQ ID NO: 3741372 - RNA, 15 nt, Human
gauggacacuccagg

SEQ ID NO: 3741373 - RNA, 23 nt, Human
gauggacaguucacacccugcaa

SEQ ID NO: 3741374 - RNA, 14 nt, Human
gauggagaaggaag

SEQ ID NO: 3741375 - RNA, 15 nt, Human
gauggagaaggaagg

SEQ ID NO: 3741376 - RNA, 17 nt, Human
gauggagcccaggcggg

SEQ ID NO: 3741377 - RNA, 12 nt, Human
gauggaggagga

SEQ ID NO: 3741378 - RNA, 15 nt, Human
gauggagugcuguuu

SEQ ID NO: 3741379 - RNA, 16 nt, Human
gauggaguucuugugc

SEQ ID NO: 3741380 - RNA, 18 nt, Human
gauggauucucagauauu

SEQ ID NO: 3741381 - RNA, 19 nt, Human
gauggauucucagauauuu

SEQ ID NO: 3741382 - RNA, 22 nt, Human
gauggauuuccagccaaagccu

SEQ ID NO: 3741383 - RNA, 19 nt, Human
gauggauuugccugugcca

SEQ ID NO: 3741384 - RNA, 12 nt, Human
gauggauuuuau

SEQ ID NO: 3741385 - RNA, 15 nt, Human
gauggcaacagaucu

SEQ ID NO: 3741386 - RNA, 21 nt, Human
gauggcaacagaucuggaacc

SEQ ID NO: 3741387 - RNA, 21 nt, Human
gauggcaggauggccuggcca

SEQ ID NO: 3741388 - RNA, 15 nt, Human
gauggcauccuguga

SEQ ID NO: 3741389 - RNA, 20 nt, Human
gauggcccauucuacuugcu

SEQ ID NO: 3741390 - RNA, 20 nt, Human
gauggcccggaugcugcuuc

SEQ ID NO: 3741391 - RNA, 14 nt, Human
gauggcccucuggu

SEQ ID NO: 3741392 - RNA, 15 nt, Human
gauggcccuucccac

SEQ ID NO: 3741393 - RNA, 23 nt, Human
gauggcccuuccuccuccaccac

SEQ ID NO: 3741394 - RNA, 22 nt, Human
gauggccgggcgcgguggcuca

SEQ ID NO: 3741395 - RNA, 18 nt, Human
gauggccguggauggccg

SEQ ID NO: 3741396 - RNA, 20 nt, Human
gauggccuggccagggccug

SEQ ID NO: 3741397 - RNA, 18 nt, Human
gauggccuuaauuuccuu

SEQ ID NO: 3741398 - RNA, 14 nt, Human
gauggcgcaggaac

SEQ ID NO: 3741399 - RNA, 15 nt, Human
gauggcggguggggg

SEQ ID NO: 3741400 - RNA, 19 nt, Human
gauggcgugggcugcguga

SEQ ID NO: 3741401 - RNA, 24 nt, Human
gauggcucagagggggacugcugc

SEQ ID NO: 3741402 - RNA, 23 nt, Human
gauggcucccaggggcucccucc

SEQ ID NO: 3741403 - RNA, 13 nt, Human
gauggcuccucuc

SEQ ID NO: 3741404 - RNA, 20 nt, Human
gauggcugugccucugccug

SEQ ID NO: 3741405 - RNA, 16 nt, Human
gauggcuuacaaaaag

SEQ ID NO: 3741406 - RNA, 16 nt, Human
gaugggaaagcauugu

SEQ ID NO: 3741407 - RNA, 21 nt, Human
gaugggaacgcagaugaucca

SEQ ID NO: 3741408 - RNA, 18 nt, Human
gaugggaaggagggaggu

SEQ ID NO: 3741409 - RNA, 13 nt, Human
gaugggaaugaag

SEQ ID NO: 3741410 - RNA, 22 nt, Human
gaugggaaugaagcuuguguau

SEQ ID NO: 3741411 - RNA, 22 nt, Human
gaugggacaauuagauaaaugu

SEQ ID NO: 3741412 - RNA, 20 nt, Human
gaugggagcuccucuccugg

SEQ ID NO: 3741413 - RNA, 20 nt, Human
gaugggaggaaagagagcag

SEQ ID NO: 3741414 - RNA, 20 nt, Human
gaugggaugguggagggcca

SEQ ID NO: 3741415 - RNA, 17 nt, Human
gaugggauucuggacag

SEQ ID NO: 3741416 - RNA, 20 nt, Human
gaugggcaacccccagccug

SEQ ID NO: 3741417 - RNA, 21 nt, Human
gaugggcaacccccagccugc

SEQ ID NO: 3741418 - RNA, 18 nt, Human
gaugggccugagugagag

SEQ ID NO: 3741419 - RNA, 17 nt, Human
guuuuccccucccuggg

SEQ ID NO: 3741420 - RNA, 24 nt, Human
guuuuccuaaauguauaccuguaa

SEQ ID NO: 3741421 - RNA, 22 nt, Human
guuuuccuauaauauaauaaau

SEQ ID NO: 3741422 - RNA, 22 nt, Human
guuuuccucccuucugcuacug

SEQ ID NO: 3741423 - RNA, 22 nt, Human
guuuuccucuauacaucucucc

SEQ ID NO: 3741424 - RNA, 24 nt, Human
guuuuccucuauacaucucucccc

SEQ ID NO: 3741425 - RNA, 14 nt, Human
guuuucgaaaauca

SEQ ID NO: 3741426 - RNA, 20 nt, Human
guuuucgaagcucagcccac

SEQ ID NO: 3741427 - RNA, 23 nt, Human
guuuucgcaccuaccaucaggga

SEQ ID NO: 3741428 - RNA, 11 nt, Human
guuuucuaauu

SEQ ID NO: 3741429 - RNA, 12 nt, Human
guuuucuaauug

SEQ ID NO: 3741430 - RNA, 14 nt, Human
guuuucuaguguau

SEQ ID NO: 3741431 - RNA, 18 nt, Human
guuuucuauuuaugccuu

SEQ ID NO: 3741432 - RNA, 13 nt, Human
guuuucuccuccc

SEQ ID NO: 3741433 - RNA, 18 nt, Human
guuuucuccucccaggaa

SEQ ID NO: 3741434 - RNA, 19 nt, Human
guuuucuccugccugugcu

SEQ ID NO: 3741435 - RNA, 17 nt, Human
guuuucugagcccgggc

SEQ ID NO: 3741436 - RNA, 19 nt, Human
guuuucugagcccgggcug

SEQ ID NO: 3741437 - RNA, 23 nt, Human
guuuucuguagucauuuacuaaa

SEQ ID NO: 3741438 - RNA, 18 nt, Human
guuuucuguguaaccauu

SEQ ID NO: 3741439 - RNA, 14 nt, Human
guuuucuguucuuu

SEQ ID NO: 3741440 - RNA, 19 nt, Human
guuuucuguucuuucuggc

SEQ ID NO: 3741441 - RNA, 16 nt, Human
guuuucuuaaccaucu

SEQ ID NO: 3741442 - RNA, 17 nt, Human
guuuucuuaaccaucuu

SEQ ID NO: 3741443 - RNA, 15 nt, Human
guuuucuuguugcuu

SEQ ID NO: 3741444 - RNA, 20 nt, Human
guuuucuuuccuccuuuccu

SEQ ID NO: 3741445 - RNA, 20 nt, Human
guuuucuuucuuuaaauguu

SEQ ID NO: 3741446 - RNA, 21 nt, Human
guuuugaaaagcuauuagcca

SEQ ID NO: 3741447 - RNA, 20 nt, Human
guuuugaaauaaaaagagua

SEQ ID NO: 3741448 - RNA, 16 nt, Human
guuuugaagauucuau

SEQ ID NO: 3741449 - RNA, 18 nt, Human
guuuugaaugguguugua

SEQ ID NO: 3741450 - RNA, 19 nt, Human
guuuugauaaaguaguaaa

SEQ ID NO: 3741451 - RNA, 14 nt, Human
guuuugauaugagu

SEQ ID NO: 3741452 - RNA, 19 nt, Human
guuuugaugacuggcauuu

SEQ ID NO: 3741453 - RNA, 19 nt, Human
guuuugauuuguacugaaa

SEQ ID NO: 3741454 - RNA, 20 nt, Human
guuuugccauguuggccagg

SEQ ID NO: 3741455 - RNA, 17 nt, Human
guuuugcuacauaauua

SEQ ID NO: 3741456 - RNA, 15 nt, Human
guuuugcuuccccuc

SEQ ID NO: 3741457 - RNA, 16 nt, Human
guuuuggaagcucuga

SEQ ID NO: 3741458 - RNA, 22 nt, Human
guuuuggcugaaauucuccugg

SEQ ID NO: 3741459 - RNA, 23 nt, Human
guuuuggcugaaauucuccugga

SEQ ID NO: 3741460 - RNA, 16 nt, Human
guuuuggggacucauu

SEQ ID NO: 3741461 - RNA, 15 nt, Human
guuuugggggucagg

SEQ ID NO: 3741462 - RNA, 21 nt, Human
guuuugggggugugaguguuu

SEQ ID NO: 3741463 - RNA, 18 nt, Human
guuuuggguagcugccac

SEQ ID NO: 3741464 - RNA, 21 nt, Human
guuuugguccacuuuuccagu

SEQ ID NO: 3741465 - RNA, 14 nt, Human
guuuugguuaaguu

SEQ ID NO: 3741466 - RNA, 15 nt, Human
guuuuguaaaagaaa

SEQ ID NO: 3741467 - RNA, 13 nt, Human
guuuuguaaacau

SEQ ID NO: 3741468 - RNA, 18 nt, Human
guuuuguaaacuuugaaa

SEQ ID NO: 3741469 - RNA, 21 nt, Human
guuuuguaaacuuugaaauau

SEQ ID NO: 3741470 - RNA, 12 nt, Human
guuuuguaaauu

SEQ ID NO: 3741471 - RNA, 18 nt, Human
guuuuguaagaugcuggg

SEQ ID NO: 3741472 - RNA, 17 nt, Human
guuuuguacauagauuu

SEQ ID NO: 3741473 - RNA, 18 nt, Human
guuuuguacauagauuua

SEQ ID NO: 3741474 - RNA, 14 nt, Human
guuuuguaccagug

SEQ ID NO: 3741475 - RNA, 15 nt, Human
guuuuguaccaguga

SEQ ID NO: 3741476 - RNA, 17 nt, Human
guuuuguaccagugaau

SEQ ID NO: 3741477 - RNA, 17 nt, Human
guuuuguaggagacuug

SEQ ID NO: 3741478 - RNA, 12 nt, Human
guuuuguauucu

SEQ ID NO: 3741479 - RNA, 24 nt, Human
guuuugucaaacuguagaaaugau

SEQ ID NO: 3741480 - RNA, 14 nt, Human
guuuugucuugaau

SEQ ID NO: 3741481 - RNA, 18 nt, Human
guuuugugauguuugucc

SEQ ID NO: 3741482 - RNA, 19 nt, Human
guuuuguggaggagcucag

SEQ ID NO: 3741483 - RNA, 17 nt, Human
guuuugugguuuggaau

SEQ ID NO: 3741484 - RNA, 15 nt, Human
guuuuguguacuuuu

SEQ ID NO: 3741485 - RNA, 17 nt, Human
guuuuguguuuguugua

SEQ ID NO: 3741486 - RNA, 14 nt, Human
guuuuguucaccau

SEQ ID NO: 3741487 - RNA, 17 nt, Human
guuuuguuccccuccuc

SEQ ID NO: 3741488 - RNA, 20 nt, Human
guuuuguuccccuccuccac

SEQ ID NO: 3741489 - RNA, 16 nt, Human
guuuuguuuauuaaau

SEQ ID NO: 3741490 - RNA, 15 nt, Human
guuuuguuucugaaa

SEQ ID NO: 3741491 - RNA, 15 nt, Human
guuuuguuugcuauc

SEQ ID NO: 3741492 - RNA, 11 nt, Human
guuuuguuugu

SEQ ID NO: 3741493 - RNA, 12 nt, Human
guuuuguuuguc

SEQ ID NO: 3741494 - RNA, 14 nt, Human
guuuuguuuuuuag

SEQ ID NO: 3741495 - RNA, 13 nt, Human
guuuuguuuuuug

SEQ ID NO: 3741496 - RNA, 16 nt, Human
guuuuguuuuuugagu

SEQ ID NO: 3741497 - RNA, 14 nt, Human
guuuuuaaacugua

SEQ ID NO: 3741498 - RNA, 23 nt, Human
guuuuuaaauagaguuugcuauu

SEQ ID NO: 3741499 - RNA, 18 nt, Human
guuuuuaaaugaggauua

SEQ ID NO: 3741500 - RNA, 13 nt, Human
guuuuuaagcugu

SEQ ID NO: 3741501 - RNA, 14 nt, Human
guuuuuaagcuguu

SEQ ID NO: 3741502 - RNA, 15 nt, Human
guuuuuaagcuguuu

SEQ ID NO: 3741503 - RNA, 17 nt, Human
guuuuuaaguuugcacu

SEQ ID NO: 3741504 - RNA, 17 nt, Human
guuuuuaauaaagacag

SEQ ID NO: 3741505 - RNA, 13 nt, Human
guuuuuaauagaa

SEQ ID NO: 3741506 - RNA, 21 nt, Human
guuuuuacaaauguuaaaaug

SEQ ID NO: 3741507 - RNA, 17 nt, Human
guuuuuacaagauguau

SEQ ID NO: 3741508 - RNA, 13 nt, Human
guuuuuacccaua

SEQ ID NO: 3741509 - RNA, 16 nt, Human
guuuuuacugcucuga

SEQ ID NO: 3741510 - RNA, 17 nt, Human
guuuuuacuuucuguug

SEQ ID NO: 3741511 - RNA, 16 nt, Human
guuuuuagagacaggg

SEQ ID NO: 3741512 - RNA, 20 nt, Human
guuuuuaguaaucuguacau

SEQ ID NO: 3741513 - RNA, 23 nt, Human
guuuuuauaaaaaauggugccug

SEQ ID NO: 3741514 - RNA, 21 nt, Human
guuuuuaugaagaaaaaauac

SEQ ID NO: 3741515 - RNA, 17 nt, Human
guuuuuaugagaaacuu

SEQ ID NO: 3741516 - RNA, 19 nt, Human
guuuuuaugauaucccuga

SEQ ID NO: 3741517 - RNA, 19 nt, Human
guuuuuauggcuuuugugc

SEQ ID NO: 3741518 - RNA, 16 nt, Human
guuuuuauggggcuga

SEQ ID NO: 3741519 - RNA, 18 nt, Human
guuuuuauggggcugaac

SEQ ID NO: 3741520 - RNA, 17 nt, Human
guuuuuauuaauuuaua

SEQ ID NO: 3741521 - RNA, 16 nt, Human
guuuuuauuuccuaug

SEQ ID NO: 3741522 - RNA, 20 nt, Human
guuuuuauuuccuaugaugu

SEQ ID NO: 3741523 - RNA, 21 nt, Human
guuuuuauuuccuaugaugua

SEQ ID NO: 3741524 - RNA, 12 nt, Human
guuuuucacauu

SEQ ID NO: 3741525 - RNA, 14 nt, Human
guuuuucacauuuu

SEQ ID NO: 3741526 - RNA, 23 nt, Human
guuuuucagguauauaccuccau

SEQ ID NO: 3741527 - RNA, 12 nt, Human
guuuuucaguuc

SEQ ID NO: 3741528 - RNA, 21 nt, Human
guuuuucaguucaaagucaug

SEQ ID NO: 3741529 - RNA, 18 nt, Human
guuuuucauuaaauaaau

SEQ ID NO: 3741530 - RNA, 16 nt, Human
guuuuuccacuacugc

SEQ ID NO: 3741531 - RNA, 18 nt, Human
guuuuuccacuacugcua

SEQ ID NO: 3741532 - RNA, 20 nt, Human
guuuuucuaaaggaguuuau

SEQ ID NO: 3741533 - RNA, 12 nt, Human
guuuuucuacua

SEQ ID NO: 3741534 - RNA, 18 nt, Human
guuuuucuaggccugggg

SEQ ID NO: 3741535 - RNA, 17 nt, Human
guuuuucuauuaaaaga

SEQ ID NO: 3741536 - RNA, 18 nt, Human
guuuuucuauuaaaagac

SEQ ID NO: 3741537 - RNA, 23 nt, Human
ggcuguccaguucccagaaggca

SEQ ID NO: 3741538 - RNA, 17 nt, Human
ggcugucccggaggcgg

SEQ ID NO: 3741539 - RNA, 13 nt, Human
ggcuguccuguac

SEQ ID NO: 3741540 - RNA, 19 nt, Human
ggcuguccuuuccaguggc

SEQ ID NO: 3741541 - RNA, 16 nt, Human
ggcugucggugggacc

SEQ ID NO: 3741542 - RNA, 18 nt, Human
ggcugugcagccuguccu

SEQ ID NO: 3741543 - RNA, 16 nt, Human
ggcugugccucugccu

SEQ ID NO: 3741544 - RNA, 19 nt, Human
ggcugugcgcugacaacca

SEQ ID NO: 3741545 - RNA, 14 nt, Human
ggcugugcugcccu

SEQ ID NO: 3741546 - RNA, 15 nt, Human
ggcugugcugcccug

SEQ ID NO: 3741547 - RNA, 21 nt, Human
ggcuguggagacaaugucugc

SEQ ID NO: 3741548 - RNA, 21 nt, Human
ggcuguggccucccugcucua

SEQ ID NO: 3741549 - RNA, 14 nt, Human
ggcugugggcaagc

SEQ ID NO: 3741550 - RNA, 15 nt, Human
ggcuguggucacagc

SEQ ID NO: 3741551 - RNA, 20 nt, Human
ggcuguguaagauuuguuuu

SEQ ID NO: 3741552 - RNA, 13 nt, Human
gguaccacugaau

SEQ ID NO: 3741553 - RNA, 20 nt, Human
gguaccacugaaucuguaca

SEQ ID NO: 3741554 - RNA, 14 nt, Human
gguaccacugauuu

SEQ ID NO: 3741555 - RNA, 22 nt, Human
gguaccagaugcagcucaagag

SEQ ID NO: 3741556 - RNA, 21 nt, Human
gguaccagcagaaagguuagu

SEQ ID NO: 3741557 - RNA, 18 nt, Human
gguaccagcccuggggcu

SEQ ID NO: 3741558 - RNA, 15 nt, Human
gguaccagcugcgcu

SEQ ID NO: 3741559 - RNA, 20 nt, Human
gguaccaguugaaauuuuug

SEQ ID NO: 3741560 - RNA, 16 nt, Human
gguacccccuucuggg

SEQ ID NO: 3741561 - RNA, 14 nt, Human
gguaccuauuuuca

SEQ ID NO: 3741562 - RNA, 12 nt, Human
gguaccuugaac

SEQ ID NO: 3741563 - RNA, 18 nt, Human
gguaccuugaacacuggg

SEQ ID NO: 3741564 - RNA, 24 nt, Human
gguaccuugcacacaucaucugua

SEQ ID NO: 3741565 - RNA, 16 nt, Human
gguacgcacagacagg

SEQ ID NO: 3741566 - RNA, 13 nt, Human
gguacgugacccu

SEQ ID NO: 3741567 - RNA, 14 nt, Human
gguacuauauuugc

SEQ ID NO: 3741568 - RNA, 12 nt, Human
gguacucuccua

SEQ ID NO: 3741569 - RNA, 14 nt, Human
gguacucuccuaga

SEQ ID NO: 3741570 - RNA, 17 nt, Human
gguacuguaauguuaau

SEQ ID NO: 3741571 - RNA, 18 nt, Human
gguacuguacagcuggcu

SEQ ID NO: 3741572 - RNA, 21 nt, Human
gguacuguacagcuggcucua

SEQ ID NO: 3741573 - RNA, 18 nt, Human
gguacuguaugaucaaau

SEQ ID NO: 3741574 - RNA, 20 nt, Human
gguacuguaugaucaaaugu

SEQ ID NO: 3741575 - RNA, 13 nt, Human
gguacuuagaguu

SEQ ID NO: 3741576 - RNA, 22 nt, Human
gguacuucaaauccuugaagau

SEQ ID NO: 3741577 - RNA, 19 nt, Human
gguacuucuugaaggugcu

SEQ ID NO: 3741578 - RNA, 16 nt, Human
gguagaaaaaggguca

SEQ ID NO: 3741579 - RNA, 20 nt, Human
gguagaaagagauacagagg

SEQ ID NO: 3741580 - RNA, 14 nt, Human
gguagaacgccagg

SEQ ID NO: 3741581 - RNA, 22 nt, Human
gguagaagcccuucuaccuucc

SEQ ID NO: 3741582 - RNA, 20 nt, Human
gguagaaugaccuuguaaug

SEQ ID NO: 3741583 - RNA, 23 nt, Human
gguagaauguuuucaaauguucu

SEQ ID NO: 3741584 - RNA, 22 nt, Human
gguagaccugucuccuggcggu

SEQ ID NO: 3741585 - RNA, 18 nt, Human
gguagaucacgagaucaa

SEQ ID NO: 3741586 - RNA, 12 nt, Human
gguagauguuca

SEQ ID NO: 3741587 - RNA, 16 nt, Human
gguagccagcacacag

SEQ ID NO: 3741588 - RNA, 12 nt, Human
gguagccauccc

SEQ ID NO: 3741589 - RNA, 15 nt, Human
gguagcccuggccag

SEQ ID NO: 3741590 - RNA, 20 nt, Human
gguagcccuggccagaggcu

SEQ ID NO: 3741591 - RNA, 15 nt, Human
gguagcuagaggaac

SEQ ID NO: 3741592 - RNA, 12 nt, Human
gguagcuguaag

SEQ ID NO: 3741593 - RNA, 21 nt, Human
gguagcuguaaggcaugaagg

SEQ ID NO: 3741594 - RNA, 19 nt, Human
gguagcuucugaccucagc

SEQ ID NO: 3741595 - RNA, 20 nt, Human
gguagcuucugaccucagca

SEQ ID NO: 3741596 - RNA, 16 nt, Human
gguaggaacugcuggg

SEQ ID NO: 3741597 - RNA, 21 nt, Human
gguaggaauauuauauuugga

SEQ ID NO: 3741598 - RNA, 14 nt, Human
gguaggcagagccu

SEQ ID NO: 3741599 - RNA, 21 nt, Human
gguaggccaagguguccuaca

SEQ ID NO: 3741600 - RNA, 14 nt, Human
gguagggaggcagc

SEQ ID NO: 3741601 - RNA, 19 nt, Human
gguaggggccccucucagc

SEQ ID NO: 3741602 - RNA, 11 nt, Human
gguaggggcug

SEQ ID NO: 3741603 - RNA, 14 nt, Human
gguaggggcuggga

SEQ ID NO: 3741604 - RNA, 17 nt, Human
gguagggggcuggagga

SEQ ID NO: 3741605 - RNA, 14 nt, Human
gguaggguaaauca

SEQ ID NO: 3741606 - RNA, 11 nt, Human
gguaggguggg

SEQ ID NO: 3741607 - RNA, 23 nt, Human
gguagggugggccuucagggagu

SEQ ID NO: 3741608 - RNA, 19 nt, Human
gguagguggcacacugggu

SEQ ID NO: 3741609 - RNA, 17 nt, Human
gguagguucagccaagg

SEQ ID NO: 3741610 - RNA, 18 nt, Human
gguagguucagccaaggu

SEQ ID NO: 3741611 - RNA, 19 nt, Human
gguagguucagccaagguu

SEQ ID NO: 3741612 - RNA, 18 nt, Human
gguagguugggacaccag

SEQ ID NO: 3741613 - RNA, 13 nt, Human
gguagguugggag

SEQ ID NO: 3741614 - RNA, 22 nt, Human
gguaguacuccugcaaaauuuu

SEQ ID NO: 3741615 - RNA, 23 nt, Human
gguaguacuccugcaaaauuuua

SEQ ID NO: 3741616 - RNA, 13 nt, Human
gguaguucaagaa

SEQ ID NO: 3741617 - RNA, 13 nt, Human
gguaguuucugug

SEQ ID NO: 3741618 - RNA, 22 nt, Human
gguauaaaacuuuccucgccug

SEQ ID NO: 3741619 - RNA, 19 nt, Human
gguauaauugugugauauu

SEQ ID NO: 3741620 - RNA, 13 nt, Human
gguauagaaaugc

SEQ ID NO: 3741621 - RNA, 16 nt, Human
gguauagauguugcua

SEQ ID NO: 3741622 - RNA, 13 nt, Human
gguauauacuuug

SEQ ID NO: 3741623 - RNA, 13 nt, Human
gguauauauacau

SEQ ID NO: 3741624 - RNA, 12 nt, Human
gguauauuuucc

SEQ ID NO: 3741625 - RNA, 18 nt, Human
gguauccugcccaguguu

SEQ ID NO: 3741626 - RNA, 12 nt, Human
gguaucuccagg

SEQ ID NO: 3741627 - RNA, 13 nt, Human
gguaucuccagga

SEQ ID NO: 3741628 - RNA, 20 nt, Human
gguaugaacuugaggacaca

SEQ ID NO: 3741629 - RNA, 17 nt, Human
gguaugaagaguguuau

SEQ ID NO: 3741630 - RNA, 21 nt, Human
gguaugaccuucuaggaagcu

SEQ ID NO: 3741631 - RNA, 21 nt, Human
gguauggcguaaguacagaga

SEQ ID NO: 3741632 - RNA, 23 nt, Human
gguauggcguaaguacagagaag

SEQ ID NO: 3741633 - RNA, 18 nt, Human
gguauuaagauuauaauu

SEQ ID NO: 3741634 - RNA, 20 nt, Human
gguauuacacuguauuugua

SEQ ID NO: 3741635 - RNA, 14 nt, Human
gguauuagaaagug

SEQ ID NO: 3741636 - RNA, 18 nt, Human
gguauucgcuugagaaaa

SEQ ID NO: 3741637 - RNA, 17 nt, Human
gguauucguuaucuaau

SEQ ID NO: 3741638 - RNA, 23 nt, Human
gguauuggcuagagguucaaaga

SEQ ID NO: 3741639 - RNA, 18 nt, Human
gguauugguggcuuuccu

SEQ ID NO: 3741640 - RNA, 17 nt, Human
gguauuguauuuauuca

SEQ ID NO: 3741641 - RNA, 22 nt, Human
gguauuguauuuauucaauaaa

SEQ ID NO: 3741642 - RNA, 14 nt, Human
gguauuuauaauau

SEQ ID NO: 3741643 - RNA, 19 nt, Human
gguauuuggauaucuguua

SEQ ID NO: 3741644 - RNA, 16 nt, Human
gguauuuugaauacca

SEQ ID NO: 3741645 - RNA, 15 nt, Human
gguauuuuguuucuu

SEQ ID NO: 3741646 - RNA, 18 nt, Human
gguauuuuguuucuuuua

SEQ ID NO: 3741647 - RNA, 16 nt, Human
gguauuuuuuccuuuu

SEQ ID NO: 3741648 - RNA, 22 nt, Human
ggucaaaccgcacucacccaug

SEQ ID NO: 3741649 - RNA, 16 nt, Human
ggucaaaugcuagaaa

SEQ ID NO: 3741650 - RNA, 18 nt, Human
ggucaacagcuaugcugg

SEQ ID NO: 3741651 - RNA, 16 nt, Human
ggucaacaguuuuccu

SEQ ID NO: 3741652 - RNA, 23 nt, Human
ggucaacaucuuuuacauucugc

SEQ ID NO: 3741653 - RNA, 13 nt, Human
ggucaagcccagg

SEQ ID NO: 3741654 - RNA, 11 nt, Human
ggucaaggccu

SEQ ID NO: 3741655 - RNA, 21 nt, Human
ggucaagggcuuacuauuucu

SEQ ID NO: 3741656 - RNA, 13 nt, Human
ggucacaacuuga

SEQ ID NO: 3741657 - RNA, 19 nt, Human
ggucacacgaccggggcca

SEQ ID NO: 3741658 - RNA, 13 nt, Human
ggucacagccagg

SEQ ID NO: 3741659 - RNA, 15 nt, Human
ggucacagccuccuc

SEQ ID NO: 3741660 - RNA, 15 nt, Human
ggucacagcggaggu

SEQ ID NO: 3741661 - RNA, 19 nt, Human
ggucaccagacggggcugg

SEQ ID NO: 3741662 - RNA, 14 nt, Human
ggucaccaugaaac

SEQ ID NO: 3741663 - RNA, 20 nt, Human
ggucacguuuggugcuucuc

SEQ ID NO: 3741664 - RNA, 22 nt, Human
ggucacucuggcagcucagaga

SEQ ID NO: 3741665 - RNA, 22 nt, Human
ggucacucuuccugcaaggacu

SEQ ID NO: 3741666 - RNA, 13 nt, Human
ggucacugcuguc

SEQ ID NO: 3741667 - RNA, 13 nt, Human
ggucacuggaacu

SEQ ID NO: 3741668 - RNA, 18 nt, Human
ggucacuggcucuccaag

SEQ ID NO: 3741669 - RNA, 16 nt, Human
ggucagaaacaggacc

SEQ ID NO: 3741670 - RNA, 12 nt, Human
ggucagagccug

SEQ ID NO: 3741671 - RNA, 23 nt, Human
ggucagaggagagauagccugug

SEQ ID NO: 3741672 - RNA, 14 nt, Human
ggucagagggccca

SEQ ID NO: 3741673 - RNA, 18 nt, Human
ggucagcacaucucaaca

SEQ ID NO: 3741674 - RNA, 12 nt, Human
ggucagccaggg

SEQ ID NO: 3741675 - RNA, 19 nt, Human
ggucagccagggccugcga

SEQ ID NO: 3741676 - RNA, 18 nt, Human
ggucagcucccuucucug

SEQ ID NO: 3741677 - RNA, 22 nt, Human
ggucaggaaggaugagcauuua

SEQ ID NO: 3741678 - RNA, 21 nt, Human
ggucaggaguuagaggccagc

SEQ ID NO: 3741679 - RNA, 21 nt, Human
ggucaggaguuccuaaccagc

SEQ ID NO: 3741680 - RNA, 14 nt, Human
ggucaggcagccag

SEQ ID NO: 3741681 - RNA, 13 nt, Human
ggucaggcccugg

SEQ ID NO: 3741682 - RNA, 12 nt, Human
ggucaggccuuu

SEQ ID NO: 3741683 - RNA, 13 nt, Human
ggucaggcuccau

SEQ ID NO: 3741684 - RNA, 16 nt, Human
ggucagggagugcugg

SEQ ID NO: 3741685 - RNA, 19 nt, Human
ggucagguugacaggaggu

SEQ ID NO: 3741686 - RNA, 17 nt, Human
ggucagguuuaacauuu

SEQ ID NO: 3741687 - RNA, 12 nt, Human
ggucaguaccca

SEQ ID NO: 3741688 - RNA, 14 nt, Human
ggucagugcugccu

SEQ ID NO: 3741689 - RNA, 22 nt, Human
ggucauauguuugcuuguauuu

SEQ ID NO: 3741690 - RNA, 18 nt, Human
ggucauauuaauauauuu

SEQ ID NO: 3741691 - RNA, 17 nt, Human
ggucaugcccuccucuc

SEQ ID NO: 3741692 - RNA, 11 nt, Human
gguccaaauaa

SEQ ID NO: 3741693 - RNA, 16 nt, Human
gguccaacugcaacuc

SEQ ID NO: 3741694 - RNA, 18 nt, Human
gguccaauuaguuuccuu

SEQ ID NO: 3741695 - RNA, 20 nt, Human
gguccaauucucgagcuugg

SEQ ID NO: 3741696 - RNA, 16 nt, Human
gguccacaacacacag

SEQ ID NO: 3741697 - RNA, 20 nt, Human
gguccacaggaagugaagaa

SEQ ID NO: 3741698 - RNA, 14 nt, Human
gguccacagggcac

SEQ ID NO: 3741699 - RNA, 16 nt, Human
gguccacccagcaaag

SEQ ID NO: 3741700 - RNA, 12 nt, Human
gguccacccagg

SEQ ID NO: 3741701 - RNA, 13 nt, Human
gguccacccagga

SEQ ID NO: 3741702 - RNA, 15 nt, Human
gguccacccaggagc

SEQ ID NO: 3741703 - RNA, 21 nt, Human
ggcuguguguacuaauacaga

SEQ ID NO: 3741704 - RNA, 11 nt, Human
ggcugugugug

SEQ ID NO: 3741705 - RNA, 13 nt, Human
ggcuguucugcac

SEQ ID NO: 3741706 - RNA, 14 nt, Human
ggcuguucuggaag

SEQ ID NO: 3741707 - RNA, 20 nt, Human
ggcuguuggcugggggccuc

SEQ ID NO: 3741708 - RNA, 22 nt, Human
ggcuguuuuugggugcaagagg

SEQ ID NO: 3741709 - RNA, 23 nt, Human
ggcuuaaacccauauuguaaaac

SEQ ID NO: 3741710 - RNA, 23 nt, Human
ggcuuaccugaccucuugcuguc

SEQ ID NO: 3741711 - RNA, 16 nt, Human
ggcuuagacccucaug

SEQ ID NO: 3741712 - RNA, 14 nt, Human
ggcuuagucacuga

SEQ ID NO: 3741713 - RNA, 18 nt, Human
ggcuuauaucuggccucu

SEQ ID NO: 3741714 - RNA, 22 nt, Human
ggcuuauauucaaccauggacu

SEQ ID NO: 3741715 - RNA, 16 nt, Human
ggcuuauccagcuggu

SEQ ID NO: 3741716 - RNA, 18 nt, Human
ggcuuauuuuaaugugau

SEQ ID NO: 3741717 - RNA, 21 nt, Human
ggcuuauuuuaaugugaugau

SEQ ID NO: 3741718 - RNA, 20 nt, Human
ggcuucagcauauuuauagc

SEQ ID NO: 3741719 - RNA, 21 nt, Human
ggcuucagccuaguggcuugu

SEQ ID NO: 3741720 - RNA, 16 nt, Human
ggcuucagcugccagu

SEQ ID NO: 3741721 - RNA, 12 nt, Human
ggcuucauacac

SEQ ID NO: 3741722 - RNA, 22 nt, Human
ggcuucauccuccucagaucuu

SEQ ID NO: 3741723 - RNA, 14 nt, Human
ggcuucauucaagu

SEQ ID NO: 3741724 - RNA, 19 nt, Human
ggcuuccaagguggucugc

SEQ ID NO: 3741725 - RNA, 13 nt, Human
ggcuuccagagag

SEQ ID NO: 3741726 - RNA, 14 nt, Human
ggcuuccagagagu

SEQ ID NO: 3741727 - RNA, 21 nt, Human
ggcuuccagguaucuccagga

SEQ ID NO: 3741728 - RNA, 22 nt, Human
ggcuuccauuugugugugugca

SEQ ID NO: 3741729 - RNA, 20 nt, Human
ggcuucccaagggcugccgg

SEQ ID NO: 3741730 - RNA, 20 nt, Human
ggcuucccaguggcugcugc

SEQ ID NO: 3741731 - RNA, 18 nt, Human
ggcuucccgcucagcccu

SEQ ID NO: 3741732 - RNA, 19 nt, Human
ggcuucccgcucagcccuc

SEQ ID NO: 3741733 - RNA, 22 nt, Human
ggcuucccgcucagcccucccu

SEQ ID NO: 3741734 - RNA, 16 nt, Human
ggcuuccucauaguau

SEQ ID NO: 3741735 - RNA, 13 nt, Human
ggcuuccuccuga

SEQ ID NO: 3741736 - RNA, 21 nt, Human
ggcuuccuccugguguggaag

SEQ ID NO: 3741737 - RNA, 19 nt, Human
ggcuuccugcguccuccuc

SEQ ID NO: 3741738 - RNA, 20 nt, Human
ggcuuccugcguccuccuca

SEQ ID NO: 3741739 - RNA, 15 nt, Human
ggcuuccuggagcag

SEQ ID NO: 3741740 - RNA, 16 nt, Human
ggcuuccuggagcaga

SEQ ID NO: 3741741 - RNA, 11 nt, Human
ggcuuccuggu

SEQ ID NO: 3741742 - RNA, 17 nt, Human
ggcuuccuggugcugga

SEQ ID NO: 3741743 - RNA, 20 nt, Human
ggcuucucauacguccacca

SEQ ID NO: 3741744 - RNA, 12 nt, Human
ggcuucuccuga

SEQ ID NO: 3741745 - RNA, 13 nt, Human
ggcuucucucuca

SEQ ID NO: 3741746 - RNA, 16 nt, Human
ggcuucucugaggaag

SEQ ID NO: 3741747 - RNA, 14 nt, Human
ggcuucugagcagc

SEQ ID NO: 3741748 - RNA, 18 nt, Human
ggcuucugaugaaucuug

SEQ ID NO: 3741749 - RNA, 13 nt, Human
ggcuucugcaccc

SEQ ID NO: 3741750 - RNA, 15 nt, Human
ggcuucugcacccuc

SEQ ID NO: 3741751 - RNA, 13 nt, Human
ggcuucuggagcc

SEQ ID NO: 3741752 - RNA, 20 nt, Human
ggcuucuggagcccuugggu

SEQ ID NO: 3741753 - RNA, 19 nt, Human
ggcuucugugcaccugggc

SEQ ID NO: 3741754 - RNA, 15 nt, Human
ggcuucuguuucuag

SEQ ID NO: 3741755 - RNA, 20 nt, Human
ggcuucuucagaucagugcu

SEQ ID NO: 3741756 - RNA, 15 nt, Human
ggcuugaagccaaag

SEQ ID NO: 3741757 - RNA, 14 nt, Human
ggcuugccacaccc

SEQ ID NO: 3741758 - RNA, 13 nt, Human
ggcuuggccugcu

SEQ ID NO: 3741759 - RNA, 18 nt, Human
ggcuuggcguggagcagg

SEQ ID NO: 3741760 - RNA, 17 nt, Human
ggcuugggauuugcugu

SEQ ID NO: 3741761 - RNA, 19 nt, Human
ggcuuggggaccagagcug

SEQ ID NO: 3741762 - RNA, 16 nt, Human
ggcuuguagaauuguu

SEQ ID NO: 3741763 - RNA, 13 nt, Human
ggcuuguaguucu

SEQ ID NO: 3741764 - RNA, 16 nt, Human
ggcuuguaguucuuua

SEQ ID NO: 3741765 - RNA, 16 nt, Human
ggcuuguguguuucac

SEQ ID NO: 3741766 - RNA, 17 nt, Human
ggcuuguuuaccuuucu

SEQ ID NO: 3741767 - RNA, 12 nt, Human
ggcuuguuuauu

SEQ ID NO: 3741768 - RNA, 20 nt, Human
ggcuuuacauacuuuaucaa

SEQ ID NO: 3741769 - RNA, 18 nt, Human
ggcuuuauccucuuuaga

SEQ ID NO: 3741770 - RNA, 22 nt, Human
ggcuuuaugauaauagauucuc

SEQ ID NO: 3741771 - RNA, 23 nt, Human
ggcuuucaggagcuccauacaca

SEQ ID NO: 3741772 - RNA, 20 nt, Human
ggcuuucaugaggaggcaga

SEQ ID NO: 3741773 - RNA, 11 nt, Human
ggcuuucaugu

SEQ ID NO: 3741774 - RNA, 20 nt, Human
ggcuuucguccacagcuucc

SEQ ID NO: 3741775 - RNA, 23 nt, Human
ggcuuucguccacagcuuccugu

SEQ ID NO: 3741776 - RNA, 15 nt, Human
ggcuuucucuuuucu

SEQ ID NO: 3741777 - RNA, 21 nt, Human
ggcuuugcaaccauuuucauu

SEQ ID NO: 3741778 - RNA, 21 nt, Human
ggcuuuggagacuuucuuuaa

SEQ ID NO: 3741779 - RNA, 15 nt, Human
ggcuuugucccacag

SEQ ID NO: 3741780 - RNA, 16 nt, Human
ggcuuugucccacagc

SEQ ID NO: 3741781 - RNA, 13 nt, Human
ggcuuuguguugu

SEQ ID NO: 3741782 - RNA, 20 nt, Human
ggcuuuuacugaagccuuuc

SEQ ID NO: 3741783 - RNA, 20 nt, Human
ggcuuuuauuaaugcacuuu

SEQ ID NO: 3741784 - RNA, 22 nt, Human
ggcuuuucacugcuggcugccu

SEQ ID NO: 3741785 - RNA, 14 nt, Human
ggcuuuucucagcu

SEQ ID NO: 3741786 - RNA, 16 nt, Human
ggcuuuucugauccag

SEQ ID NO: 3741787 - RNA, 17 nt, Human
ggcuuuuguuuugcuuu

SEQ ID NO: 3741788 - RNA, 20 nt, Human
gggaaaaacuuuggaaccag

SEQ ID NO: 3741789 - RNA, 23 nt, Human
gggaaaagggaacaggaaaagaa

SEQ ID NO: 3741790 - RNA, 22 nt, Human
gggaaaauaaaaaaagaaaaaa

SEQ ID NO: 3741791 - RNA, 13 nt, Human
gggaaaaucagcc

SEQ ID NO: 3741792 - RNA, 16 nt, Human
gggaaaauguuuugua

SEQ ID NO: 3741793 - RNA, 17 nt, Human
gggaaaauuauuugcau

SEQ ID NO: 3741794 - RNA, 15 nt, Human
gggaaacacuccuug

SEQ ID NO: 3741795 - RNA, 19 nt, Human
gggaaacagguugggaugg

SEQ ID NO: 3741796 - RNA, 21 nt, Human
gggaaacaucacaccugcccu

SEQ ID NO: 3741797 - RNA, 21 nt, Human
gggaaacuggccauggccugc

SEQ ID NO: 3741798 - RNA, 17 nt, Human
gggaaacuugucacuug

SEQ ID NO: 3741799 - RNA, 21 nt, Human
gggaaagacauccauaaagaa

SEQ ID NO: 3741800 - RNA, 19 nt, Human
gggaaagccagugacucca

SEQ ID NO: 3741801 - RNA, 22 nt, Human
gggaaagccagugacuccagga

SEQ ID NO: 3741802 - RNA, 16 nt, Human
gggaaagccccugccc

SEQ ID NO: 3741803 - RNA, 23 nt, Human
gggaaaggaggcaugccucugau

SEQ ID NO: 3741804 - RNA, 15 nt, Human
gggaaaggauauuuu

SEQ ID NO: 3741805 - RNA, 20 nt, Human
gggaaagggguuggggugac

SEQ ID NO: 3741806 - RNA, 14 nt, Human
gggaaauaagagag

SEQ ID NO: 3741807 - RNA, 23 nt, Human
gggaaauauauacaaaaagaaaa

SEQ ID NO: 3741808 - RNA, 21 nt, Human
gggaaaugguacuguacagcu

SEQ ID NO: 3741809 - RNA, 19 nt, Human
gggaacaaggguggcaucc

SEQ ID NO: 3741810 - RNA, 13 nt, Human
gggaacacugccc

SEQ ID NO: 3741811 - RNA, 14 nt, Human
gggaacagacagga

SEQ ID NO: 3741812 - RNA, 22 nt, Human
gggaacagccacuccccuccac

SEQ ID NO: 3741813 - RNA, 12 nt, Human
gggaacagggcg

SEQ ID NO: 3741814 - RNA, 12 nt, Human
gggaacaguguu

SEQ ID NO: 3741815 - RNA, 15 nt, Human
gggaacaugcccccu

SEQ ID NO: 3741816 - RNA, 12 nt, Human
gggaacccugcu

SEQ ID NO: 3741817 - RNA, 16 nt, Human
gggaaccucccagagg

SEQ ID NO: 3741818 - RNA, 18 nt, Human
gggaaccuccccagccug

SEQ ID NO: 3741819 - RNA, 19 nt, Human
gggaaccuccccagccugc

SEQ ID NO: 3741820 - RNA, 13 nt, Human
gggaaccugaccc

SEQ ID NO: 3741821 - RNA, 13 nt, Human
gggaaccuguguc

SEQ ID NO: 3741822 - RNA, 12 nt, Human
gggaacgcccac

SEQ ID NO: 3741823 - RNA, 19 nt, Human
gggaacgcccacuucccug

SEQ ID NO: 3741824 - RNA, 20 nt, Human
gggaacgcccacuucccugg

SEQ ID NO: 3741825 - RNA, 15 nt, Human
gggaacguucucuuu

SEQ ID NO: 3741826 - RNA, 13 nt, Human
gggaacuccugga

SEQ ID NO: 3741827 - RNA, 15 nt, Human
gggaacugcagaccu

SEQ ID NO: 3741828 - RNA, 20 nt, Human
gggaacugcagaccuguccu

SEQ ID NO: 3741829 - RNA, 18 nt, Human
gggaacuggccaagcuga

SEQ ID NO: 3741830 - RNA, 21 nt, Human
gggaacuggccaagcugaggu

SEQ ID NO: 3741831 - RNA, 20 nt, Human
gggaagaaacacuuucucuu

SEQ ID NO: 3741832 - RNA, 17 nt, Human
gggaagaagcagagaga

SEQ ID NO: 3741833 - RNA, 18 nt, Human
gggaagaagcucucuccu

SEQ ID NO: 3741834 - RNA, 11 nt, Human
gggaagacagu

SEQ ID NO: 3741835 - RNA, 12 nt, Human
gggaagacagug

SEQ ID NO: 3741836 - RNA, 11 nt, Human
gggaagagagg

SEQ ID NO: 3741837 - RNA, 18 nt, Human
gggaagagaggaguucaa

SEQ ID NO: 3741838 - RNA, 16 nt, Human
gggaagagauccaaag

SEQ ID NO: 3741839 - RNA, 15 nt, Human
gggaagagcacagcc

SEQ ID NO: 3741840 - RNA, 14 nt, Human
gggaagagggggcg

SEQ ID NO: 3741841 - RNA, 18 nt, Human
gggaagaguggaggugga

SEQ ID NO: 3741842 - RNA, 16 nt, Human
gggaagaguguacugg

SEQ ID NO: 3741843 - RNA, 19 nt, Human
gggaagcccagcuccaggg

SEQ ID NO: 3741844 - RNA, 18 nt, Human
gggaagcgcucagaacag

SEQ ID NO: 3741845 - RNA, 19 nt, Human
gggaagcugcagcuuggga

SEQ ID NO: 3741846 - RNA, 15 nt, Human
gggaagcuggccuga

SEQ ID NO: 3741847 - RNA, 17 nt, Human
gggaaggaacucuggcu

SEQ ID NO: 3741848 - RNA, 17 nt, Human
gggaaggaggcuggcuu

SEQ ID NO: 3741849 - RNA, 15 nt, Human
gggaaggaucccaug

SEQ ID NO: 3741850 - RNA, 18 nt, Human
gggaaggcacagggagaa

SEQ ID NO: 3741851 - RNA, 14 nt, Human
gggaaggcaggcag

SEQ ID NO: 3741852 - RNA, 15 nt, Human
gggaaggcaggcagg

SEQ ID NO: 3741853 - RNA, 23 nt, Human
gaagcuacugugugugugaauga

SEQ ID NO: 3741854 - RNA, 18 nt, Human
gaagcuagacacaugaag

SEQ ID NO: 3741855 - RNA, 12 nt, Human
gaagcuagcucc

SEQ ID NO: 3741856 - RNA, 16 nt, Human
gaagcuagcuccccuc

SEQ ID NO: 3741857 - RNA, 19 nt, Human
gaagcuagcuccccuccuc

SEQ ID NO: 3741858 - RNA, 16 nt, Human
gaagcuagucuuuugc

SEQ ID NO: 3741859 - RNA, 19 nt, Human
gaagcuauaaauuccucuu

SEQ ID NO: 3741860 - RNA, 20 nt, Human
gaagcuauuuuuuucaguuu

SEQ ID NO: 3741861 - RNA, 12 nt, Human
gaagcucagccc

SEQ ID NO: 3741862 - RNA, 19 nt, Human
gaagcucagcccacccccc

SEQ ID NO: 3741863 - RNA, 21 nt, Human
gaagcucagcccaccccccuc

SEQ ID NO: 3741864 - RNA, 12 nt, Human
gaagcucagcug

SEQ ID NO: 3741865 - RNA, 17 nt, Human
gaagcucagggccuggc

SEQ ID NO: 3741866 - RNA, 19 nt, Human
gaagcucagggccuggcuc

SEQ ID NO: 3741867 - RNA, 21 nt, Human
gaagcucagggccuggcucag

SEQ ID NO: 3741868 - RNA, 15 nt, Human
gaagcuccacuguca

SEQ ID NO: 3741869 - RNA, 20 nt, Human
gaagcuccaguccugcucuc

SEQ ID NO: 3741870 - RNA, 14 nt, Human
gaagcucccaggaa

SEQ ID NO: 3741871 - RNA, 17 nt, Human
gaagcuccucuccccag

SEQ ID NO: 3741872 - RNA, 12 nt, Human
gaagcuccuggu

SEQ ID NO: 3741873 - RNA, 12 nt, Human
gaagcucuggcu

SEQ ID NO: 3741874 - RNA, 20 nt, Human
gaagcucuggcugaacccug

SEQ ID NO: 3741875 - RNA, 23 nt, Human
gaagcucuggcugaacccugugc

SEQ ID NO: 3741876 - RNA, 20 nt, Human
gaagcucuuggagcugugag

SEQ ID NO: 3741877 - RNA, 23 nt, Human
gaagcugaagugcauccaaaggu

SEQ ID NO: 3741878 - RNA, 17 nt, Human
gaagcugagcaccaggg

SEQ ID NO: 3741879 - RNA, 17 nt, Human
gaagcugagggcaaauc

SEQ ID NO: 3741880 - RNA, 17 nt, Human
gaagcugaugcuuugcu

SEQ ID NO: 3741881 - RNA, 13 nt, Human
gaagcugccugcu

SEQ ID NO: 3741882 - RNA, 20 nt, Human
gaagcugcuccaggccugca

SEQ ID NO: 3741883 - RNA, 13 nt, Human
gaagcugcuccgu

SEQ ID NO: 3741884 - RNA, 17 nt, Human
gaagcugcucuggaauu

SEQ ID NO: 3741885 - RNA, 18 nt, Human
gaagcugcucuggaauuu

SEQ ID NO: 3741886 - RNA, 10 nt, Human
gaagcugcug

SEQ ID NO: 3741887 - RNA, 22 nt, Human
gaagcugcugaccaauugugcu

SEQ ID NO: 3741888 - RNA, 21 nt, Human
gaagcugucauaaaaagacaa

SEQ ID NO: 3741889 - RNA, 19 nt, Human
gaagcugugcgugugugug

SEQ ID NO: 3741890 - RNA, 17 nt, Human
gaagcuguguccuugca

SEQ ID NO: 3741891 - RNA, 20 nt, Human
gaagcuguguccuugcaccu

SEQ ID NO: 3741892 - RNA, 24 nt, Human
gaagcuguguccuugcaccugcau

SEQ ID NO: 3741893 - RNA, 13 nt, Human
gaagcuguuguac

SEQ ID NO: 3741894 - RNA, 18 nt, Human
gaagcuguuguacauuua

SEQ ID NO: 3741895 - RNA, 19 nt, Human
gaagcuguuguacauuuau

SEQ ID NO: 3741896 - RNA, 16 nt, Human
gaagcuguugugugag

SEQ ID NO: 3741897 - RNA, 15 nt, Human
gaagcuuauuaaugc

SEQ ID NO: 3741898 - RNA, 16 nt, Human
gaagcuuauuaaugcu

SEQ ID NO: 3741899 - RNA, 19 nt, Human
gaagcuuauuaaugcuaag

SEQ ID NO: 3741900 - RNA, 20 nt, Human
gaagcuuauuaaugcuaagg

SEQ ID NO: 3741901 - RNA, 16 nt, Human
gaagcuucaugcacuu

SEQ ID NO: 3741902 - RNA, 15 nt, Human
gaagcuucuaauaaa

SEQ ID NO: 3741903 - RNA, 22 nt, Human
gaagcuucuggugaccuuccaa

SEQ ID NO: 3741904 - RNA, 23 nt, Human
gaagcuuguguauccauuaucau

SEQ ID NO: 3741905 - RNA, 15 nt, Human
gaagcuuucucugcu

SEQ ID NO: 3741906 - RNA, 20 nt, Human
gaagcuuucucugcuucagc

SEQ ID NO: 3741907 - RNA, 14 nt, Human
gaagcuuucugucu

SEQ ID NO: 3741908 - RNA, 19 nt, Human
gaagcuuuguccccugcuu

SEQ ID NO: 3741909 - RNA, 13 nt, Human
gaaggaaaaauuc

SEQ ID NO: 3741910 - RNA, 20 nt, Human
gaaggaaacccagcucuggu

SEQ ID NO: 3741911 - RNA, 19 nt, Human
gaaggaaagaaagaaggaa

SEQ ID NO: 3741912 - RNA, 20 nt, Human
gaaggaaaugaauuucucua

SEQ ID NO: 3741913 - RNA, 15 nt, Human
gaaggaacguccccu

SEQ ID NO: 3741914 - RNA, 23 nt, Human
gaaggaaggagacucaccucugc

SEQ ID NO: 3741915 - RNA, 18 nt, Human
gaaggaaggcagggagga

SEQ ID NO: 3741916 - RNA, 20 nt, Human
gaaggaaggcagggaggagg

SEQ ID NO: 3741917 - RNA, 20 nt, Human
gaaggaauauauggcagagu

SEQ ID NO: 3741918 - RNA, 16 nt, Human
gaaggaaugucuuugg

SEQ ID NO: 3741919 - RNA, 16 nt, Human
gaaggacaaggcuaga

SEQ ID NO: 3741920 - RNA, 20 nt, Human
gaaggacauugcggacagcc

SEQ ID NO: 3741921 - RNA, 21 nt, Human
gaaggacccuucagagguggc

SEQ ID NO: 3741922 - RNA, 19 nt, Human
gaaggacuaauagaaaagu

SEQ ID NO: 3741923 - RNA, 18 nt, Human
gaaggacugugacaggca

SEQ ID NO: 3741924 - RNA, 22 nt, Human
gaaggacugugacaggcagcag

SEQ ID NO: 3741925 - RNA, 23 nt, Human
gaaggacugugacaggcagcaga

SEQ ID NO: 3741926 - RNA, 16 nt, Human
gaaggagacaggcaga

SEQ ID NO: 3741927 - RNA, 17 nt, Human
gaaggagacucaccucu

SEQ ID NO: 3741928 - RNA, 23 nt, Human
gaaggagacucaccucugccuca

SEQ ID NO: 3741929 - RNA, 16 nt, Human
gaaggagagaaagugg

SEQ ID NO: 3741930 - RNA, 20 nt, Human
gaaggagagaaaguggguga

SEQ ID NO: 3741931 - RNA, 16 nt, Human
gaaggagagaagggga

SEQ ID NO: 3741932 - RNA, 18 nt, Human
gaaggagagaaggggagg

SEQ ID NO: 3741933 - RNA, 13 nt, Human
gaaggagagccug

SEQ ID NO: 3741934 - RNA, 12 nt, Human
gaaggagcugcc

SEQ ID NO: 3741935 - RNA, 15 nt, Human
gaaggagcugccugg

SEQ ID NO: 3741936 - RNA, 22 nt, Human
gaaggaggaaugcuggacugga

SEQ ID NO: 3741937 - RNA, 14 nt, Human
gaaggaggacccag

SEQ ID NO: 3741938 - RNA, 17 nt, Human
gaaggaggggaagcugc

SEQ ID NO: 3741939 - RNA, 19 nt, Human
gaaggaggggaagcugcag

SEQ ID NO: 3741940 - RNA, 15 nt, Human
gaaggaggugaggga

SEQ ID NO: 3741941 - RNA, 21 nt, Human
gaaggauacaaaagcauguga

SEQ ID NO: 3741942 - RNA, 21 nt, Human
gaaggaucccaugagcuccuu

SEQ ID NO: 3741943 - RNA, 10 nt, Human
gaaggauccg

SEQ ID NO: 3741944 - RNA, 10 nt, Human
gaaggauccu

SEQ ID NO: 3741945 - RNA, 15 nt, Human
gaaggauguacauuu

SEQ ID NO: 3741946 - RNA, 17 nt, Human
gaaggauguacauuucc

SEQ ID NO: 3741947 - RNA, 20 nt, Human
gaaggauguacauuuccaaa

SEQ ID NO: 3741948 - RNA, 16 nt, Human
gaaggauucugcuggc

SEQ ID NO: 3741949 - RNA, 13 nt, Human
gaaggauuguaaa

SEQ ID NO: 3741950 - RNA, 14 nt, Human
gaaggauuguaaaa

SEQ ID NO: 3741951 - RNA, 13 nt, Human
gaaggauuugugu

SEQ ID NO: 3741952 - RNA, 12 nt, Human
gaaggcaaaaaa

SEQ ID NO: 3741953 - RNA, 22 nt, Human
gaaggcaagaggggguggaggg

SEQ ID NO: 3741954 - RNA, 24 nt, Human
gaaggcacuaaaaagagcuguccu

SEQ ID NO: 3741955 - RNA, 15 nt, Human
gaaggcagaaagcaa

SEQ ID NO: 3741956 - RNA, 13 nt, Human
gaaggcagacagc

SEQ ID NO: 3741957 - RNA, 22 nt, Human
gaaggcagagaaagggacaaug

SEQ ID NO: 3741958 - RNA, 13 nt, Human
gaaggcaggaaga

SEQ ID NO: 3741959 - RNA, 18 nt, Human
gaaggcaggcagggcucu

SEQ ID NO: 3741960 - RNA, 21 nt, Human
gaaggcaggcagggcucuccu

SEQ ID NO: 3741961 - RNA, 14 nt, Human
gaaggcagggagga

SEQ ID NO: 3741962 - RNA, 16 nt, Human
gaaggcagggaggagg

SEQ ID NO: 3741963 - RNA, 20 nt, Human
gaaggcagggaggaggcaga

SEQ ID NO: 3741964 - RNA, 22 nt, Human
gaaggcagggagggccugggcc

SEQ ID NO: 3741965 - RNA, 17 nt, Human
gaaggcauuugcagggu

SEQ ID NO: 3741966 - RNA, 19 nt, Human
gaaggcauuugcagggucc

SEQ ID NO: 3741967 - RNA, 23 nt, Human
gaaggcauuugcaggguccucuu

SEQ ID NO: 3741968 - RNA, 13 nt, Human
gaaggccacaugu

SEQ ID NO: 3741969 - RNA, 18 nt, Human
gaaggccucuuggagacc

SEQ ID NO: 3741970 - RNA, 17 nt, Human
gaaggcuaaaaagcaac

SEQ ID NO: 3741971 - RNA, 21 nt, Human
gaaggcuacuucggggcuggg

SEQ ID NO: 3741972 - RNA, 17 nt, Human
gaaggcucgagcaugcc

SEQ ID NO: 3741973 - RNA, 21 nt, Human
gaaggcucgagcaugccugga

SEQ ID NO: 3741974 - RNA, 18 nt, Human
gaaggcucuucuccccag

SEQ ID NO: 3741975 - RNA, 15 nt, Human
gaaggcuggguucug

SEQ ID NO: 3741976 - RNA, 20 nt, Human
gaaggcuggguucugauccu

SEQ ID NO: 3741977 - RNA, 12 nt, Human
gaaggcuguccu

SEQ ID NO: 3741978 - RNA, 17 nt, Human
gaaggcuugggauuugc

SEQ ID NO: 3741979 - RNA, 20 nt, Human
gaaggcuuguugugcuuuua

SEQ ID NO: 3741980 - RNA, 24 nt, Human
gaaggcuuucagggccuccagccc

SEQ ID NO: 3741981 - RNA, 12 nt, Human
gaaggcuuugug

SEQ ID NO: 3741982 - RNA, 17 nt, Human
gaaggcuuuuggucucc

SEQ ID NO: 3741983 - RNA, 17 nt, Human
gaagggaauaagguaca

SEQ ID NO: 3741984 - RNA, 19 nt, Human
gaagggaauccuccuccag

SEQ ID NO: 3741985 - RNA, 15 nt, Human
gaagggaccaaggca

SEQ ID NO: 3741986 - RNA, 14 nt, Human
gaagggacugagag

SEQ ID NO: 3741987 - RNA, 16 nt, Human
gaagggagaagaaagg

SEQ ID NO: 3741988 - RNA, 22 nt, Human
gaagggagccaagggauggaca

SEQ ID NO: 3741989 - RNA, 23 nt, Human
gaagggagccaagggauggacau

SEQ ID NO: 3741990 - RNA, 17 nt, Human
gaagggagcuagccaga

SEQ ID NO: 3741991 - RNA, 15 nt, Human
gaagggagggcagag

SEQ ID NO: 3741992 - RNA, 16 nt, Human
gaagggagggcagagc

SEQ ID NO: 3741993 - RNA, 17 nt, Human
gaagggagggcagagcu

SEQ ID NO: 3741994 - RNA, 21 nt, Human
gaagggagggcagagcuggug

SEQ ID NO: 3741995 - RNA, 17 nt, Human
gaagggauggauuccaa

SEQ ID NO: 3741996 - RNA, 22 nt, Human
gaagggcaggaaggagagccug

SEQ ID NO: 3741997 - RNA, 23 nt, Human
gaagggcaggaaggagagccugc

SEQ ID NO: 3741998 - RNA, 10 nt, Human
gaagggccag

SEQ ID NO: 3741999 - RNA, 15 nt, Human
gaagggccagagcca

SEQ ID NO: 3742000 - RNA, 16 nt, Human
gaagggccagagccag

SEQ ID NO: 3742001 - RNA, 18 nt, Human
gaagggccagagccaggg

SEQ ID NO: 3742002 - RNA, 20 nt, Human
gguccacccaggagccccga

SEQ ID NO: 3742003 - RNA, 20 nt, Human
gguccacuuuuccaguauuu

SEQ ID NO: 3742004 - RNA, 23 nt, Human
gguccagcccuggcugaaggacu

SEQ ID NO: 3742005 - RNA, 14 nt, Human
gguccagcucugga

SEQ ID NO: 3742006 - RNA, 16 nt, Human
gguccagcucuggagg

SEQ ID NO: 3742007 - RNA, 13 nt, Human
gguccagcuggcc

SEQ ID NO: 3742008 - RNA, 20 nt, Human
gguccagcuggccuggacag

SEQ ID NO: 3742009 - RNA, 17 nt, Human
gguccagcuugcucuuc

SEQ ID NO: 3742010 - RNA, 18 nt, Human
gguccagcuugcucuuca

SEQ ID NO: 3742011 - RNA, 11 nt, Human
gguccaggaga

SEQ ID NO: 3742012 - RNA, 19 nt, Human
gguccaggauuccucuuuu

SEQ ID NO: 3742013 - RNA, 11 nt, Human
gguccagggaa

SEQ ID NO: 3742014 - RNA, 20 nt, Human
gguccaggggccccuccagc

SEQ ID NO: 3742015 - RNA, 21 nt, Human
gguccaggguugaucacacuc

SEQ ID NO: 3742016 - RNA, 15 nt, Human
gguccauagcugugg

SEQ ID NO: 3742017 - RNA, 17 nt, Human
gguccauggaaugcuug

SEQ ID NO: 3742018 - RNA, 13 nt, Human
gguccaugggcag

SEQ ID NO: 3742019 - RNA, 12 nt, Human
ggucccaacagg

SEQ ID NO: 3742020 - RNA, 15 nt, Human
ggucccaagcugggc

SEQ ID NO: 3742021 - RNA, 14 nt, Human
ggucccacagccac

SEQ ID NO: 3742022 - RNA, 21 nt, Human
ggucccacaucccugggccug

SEQ ID NO: 3742023 - RNA, 22 nt, Human
ggucccacgaauuugcugggga

SEQ ID NO: 3742024 - RNA, 14 nt, Human
ggucccacucaguc

SEQ ID NO: 3742025 - RNA, 11 nt, Human
ggucccagugg

SEQ ID NO: 3742026 - RNA, 21 nt, Human
ggucccagugggaggggcagg

SEQ ID NO: 3742027 - RNA, 23 nt, Human
ggucccaguuuuguugccccaga

SEQ ID NO: 3742028 - RNA, 11 nt, Human
ggucccaucca

SEQ ID NO: 3742029 - RNA, 17 nt, Human
ggucccauccaggcagu

SEQ ID NO: 3742030 - RNA, 23 nt, Human
gguccccagcccuuccucugcuc

SEQ ID NO: 3742031 - RNA, 18 nt, Human
gguccccaucaucccagc

SEQ ID NO: 3742032 - RNA, 20 nt, Human
ggucccccucagcaagcccu

SEQ ID NO: 3742033 - RNA, 16 nt, Human
ggucccccugcagcua

SEQ ID NO: 3742034 - RNA, 16 nt, Human
gguccccuccaggagu

SEQ ID NO: 3742035 - RNA, 13 nt, Human
gguccccuccuuc

SEQ ID NO: 3742036 - RNA, 20 nt, Human
ggucccggagaggccucgac

SEQ ID NO: 3742037 - RNA, 16 nt, Human
ggucccggcucugugg

SEQ ID NO: 3742038 - RNA, 13 nt, Human
ggucccuaauaaa

SEQ ID NO: 3742039 - RNA, 17 nt, Human
ggucccuccccuucucu

SEQ ID NO: 3742040 - RNA, 18 nt, Human
ggucccugcuguguuccc

SEQ ID NO: 3742041 - RNA, 13 nt, Human
ggucccugggagg

SEQ ID NO: 3742042 - RNA, 20 nt, Human
ggucccuggguagcggggga

SEQ ID NO: 3742043 - RNA, 20 nt, Human
ggucccuugagaccucagcc

SEQ ID NO: 3742044 - RNA, 21 nt, Human
ggucccuugagaccucagcca

SEQ ID NO: 3742045 - RNA, 21 nt, Human
gguccgaguguguuucauccu

SEQ ID NO: 3742046 - RNA, 18 nt, Human
gguccggacacuccuaga

SEQ ID NO: 3742047 - RNA, 18 nt, Human
gguccgugcuaaggacuu

SEQ ID NO: 3742048 - RNA, 13 nt, Human
gguccgugggacg

SEQ ID NO: 3742049 - RNA, 20 nt, Human
gguccuacccauccccgcag

SEQ ID NO: 3742050 - RNA, 16 nt, Human
gguccuauggccucau

SEQ ID NO: 3742051 - RNA, 14 nt, Human
gguccucagagaau

SEQ ID NO: 3742052 - RNA, 21 nt, Human
gguccucagagaauuucuacc

SEQ ID NO: 3742053 - RNA, 17 nt, Human
gguccugaaaguaacuc

SEQ ID NO: 3742054 - RNA, 21 nt, Human
gguccugagcacugccaggag

SEQ ID NO: 3742055 - RNA, 22 nt, Human
gguccugagcacugccaggagg

SEQ ID NO: 3742056 - RNA, 23 nt, Human
gguccugagcacugccaggaggg

SEQ ID NO: 3742057 - RNA, 13 nt, Human
gguccugcucagc

SEQ ID NO: 3742058 - RNA, 21 nt, Human
gguccugcugcaguugccagu

SEQ ID NO: 3742059 - RNA, 23 nt, Human
gguccugcugcaguugccaguca

SEQ ID NO: 3742060 - RNA, 17 nt, Human
gguccuggagcagacca

SEQ ID NO: 3742061 - RNA, 18 nt, Human
gguccuggaggcucaaau

SEQ ID NO: 3742062 - RNA, 22 nt, Human
gguccuggccagauggcccgga

SEQ ID NO: 3742063 - RNA, 13 nt, Human
gguccuggccauc

SEQ ID NO: 3742064 - RNA, 16 nt, Human
gguccuggccauccca

SEQ ID NO: 3742065 - RNA, 14 nt, Human
gguccuggggccuc

SEQ ID NO: 3742066 - RNA, 13 nt, Human
gguccuggugccc

SEQ ID NO: 3742067 - RNA, 14 nt, Human
gguccuggugcccu

SEQ ID NO: 3742068 - RNA, 19 nt, Human
gguccugguggggcagcuc

SEQ ID NO: 3742069 - RNA, 13 nt, Human
gguccugucuccc

SEQ ID NO: 3742070 - RNA, 23 nt, Human
gguccugucuccccucugcuggc

SEQ ID NO: 3742071 - RNA, 13 nt, Human
gguccuguggcag

SEQ ID NO: 3742072 - RNA, 14 nt, Human
gguccuguggcagg

SEQ ID NO: 3742073 - RNA, 16 nt, Human
gguccuguggcaggca

SEQ ID NO: 3742074 - RNA, 21 nt, Human
gguccuucaaguuagcucagg

SEQ ID NO: 3742075 - RNA, 16 nt, Human
gguccuuccaggcccc

SEQ ID NO: 3742076 - RNA, 19 nt, Human
gguccuucccucuccccaa

SEQ ID NO: 3742077 - RNA, 13 nt, Human
gguccuuggcccc

SEQ ID NO: 3742078 - RNA, 22 nt, Human
gguccuuuacacucaggcuuuc

SEQ ID NO: 3742079 - RNA, 18 nt, Human
gguccuuuugacacugcu

SEQ ID NO: 3742080 - RNA, 20 nt, Human
ggucgaccccaaagccccuu

SEQ ID NO: 3742081 - RNA, 17 nt, Human
ggucgacuucgggcugg

SEQ ID NO: 3742082 - RNA, 14 nt, Human
ggucgcccaggaga

SEQ ID NO: 3742083 - RNA, 14 nt, Human
ggucgcccuggacu

SEQ ID NO: 3742084 - RNA, 22 nt, Human
ggucgccuguccugccuguggg

SEQ ID NO: 3742085 - RNA, 13 nt, Human
ggucgcuccugcc

SEQ ID NO: 3742086 - RNA, 14 nt, Human
ggucgcuccugccc

SEQ ID NO: 3742087 - RNA, 13 nt, Human
ggucggaaaacau

SEQ ID NO: 3742088 - RNA, 14 nt, Human
ggucggaaaacaug

SEQ ID NO: 3742089 - RNA, 15 nt, Human
ggucggaacccaagc

SEQ ID NO: 3742090 - RNA, 20 nt, Human
ggucguggagagcuaggagc

SEQ ID NO: 3742091 - RNA, 14 nt, Human
ggucuaggacacag

SEQ ID NO: 3742092 - RNA, 14 nt, Human
ggucuagggagaga

SEQ ID NO: 3742093 - RNA, 14 nt, Human
ggucuauggggaga

SEQ ID NO: 3742094 - RNA, 13 nt, Human
ggucuauuccagc

SEQ ID NO: 3742095 - RNA, 15 nt, Human
ggucuauuccagcuc

SEQ ID NO: 3742096 - RNA, 16 nt, Human
ggucuauuccagcuca

SEQ ID NO: 3742097 - RNA, 17 nt, Human
ggucuauugucuguauu

SEQ ID NO: 3742098 - RNA, 17 nt, Human
ggucucaaacuccugac

SEQ ID NO: 3742099 - RNA, 19 nt, Human
ggucucacaguguugccca

SEQ ID NO: 3742100 - RNA, 16 nt, Human
ggucucacccuggagg

SEQ ID NO: 3742101 - RNA, 12 nt, Human
ggucucacucug

SEQ ID NO: 3742102 - RNA, 23 nt, Human
ggucucacucugucgcccagucu

SEQ ID NO: 3742103 - RNA, 18 nt, Human
ggucucagggugucccag

SEQ ID NO: 3742104 - RNA, 22 nt, Human
ggucuccagaaagccccaccca

SEQ ID NO: 3742105 - RNA, 18 nt, Human
ggucucccucuccugccu

SEQ ID NO: 3742106 - RNA, 14 nt, Human
ggucucccuggcuc

SEQ ID NO: 3742107 - RNA, 16 nt, Human
ggucucccuggcuccc

SEQ ID NO: 3742108 - RNA, 17 nt, Human
ggucuccgaaaugcugu

SEQ ID NO: 3742109 - RNA, 22 nt, Human
ggucuccgaaaugcugucuuuc

SEQ ID NO: 3742110 - RNA, 19 nt, Human
ggucuccucacucccuucu

SEQ ID NO: 3742111 - RNA, 19 nt, Human
ggucuccucuuuguuuugu

SEQ ID NO: 3742112 - RNA, 17 nt, Human
ggucucgaacuccugac

SEQ ID NO: 3742113 - RNA, 21 nt, Human
ggucucgcugaugcugggcug

SEQ ID NO: 3742114 - RNA, 22 nt, Human
ggucucgcugaugcugggcugg

SEQ ID NO: 3742115 - RNA, 20 nt, Human
ggucucgcuuuguugcccag

SEQ ID NO: 3742116 - RNA, 16 nt, Human
ggucucucccucaggu

SEQ ID NO: 3742117 - RNA, 21 nt, Human
ggucucucuugccccaccugg

SEQ ID NO: 3742118 - RNA, 13 nt, Human
ggucucucuuugg

SEQ ID NO: 3742119 - RNA, 20 nt, Human
ggucucugcauuuuucugca

SEQ ID NO: 3742120 - RNA, 22 nt, Human
ggucucugcauuuuucugcaga

SEQ ID NO: 3742121 - RNA, 13 nt, Human
ggucucugcugcc

SEQ ID NO: 3742122 - RNA, 14 nt, Human
ggucucugcugccg

SEQ ID NO: 3742123 - RNA, 16 nt, Human
ggucucuucucccaga

SEQ ID NO: 3742124 - RNA, 21 nt, Human
ggucucuugagggagcuuagc

SEQ ID NO: 3742125 - RNA, 13 nt, Human
ggucugaaaugga

SEQ ID NO: 3742126 - RNA, 11 nt, Human
ggucugaaugu

SEQ ID NO: 3742127 - RNA, 14 nt, Human
ggucugaauguucu

SEQ ID NO: 3742128 - RNA, 15 nt, Human
ggucugagcuccagc

SEQ ID NO: 3742129 - RNA, 16 nt, Human
ggucugagcuccagcu

SEQ ID NO: 3742130 - RNA, 20 nt, Human
ggucugagucauggccgggu

SEQ ID NO: 3742131 - RNA, 16 nt, Human
ggucugcaagucagag

SEQ ID NO: 3742132 - RNA, 17 nt, Human
ggucugcaagucagagg

SEQ ID NO: 3742133 - RNA, 14 nt, Human
ggucugcaggcagg

SEQ ID NO: 3742134 - RNA, 23 nt, Human
ggucugcaggcagggcugacucu

SEQ ID NO: 3742135 - RNA, 14 nt, Human
ggucugccaggccc

SEQ ID NO: 3742136 - RNA, 12 nt, Human
ggucugcuccca

SEQ ID NO: 3742137 - RNA, 22 nt, Human
ggucugcucccaaggggccuga

SEQ ID NO: 3742138 - RNA, 18 nt, Human
ggucugcucuuucucugc

SEQ ID NO: 3742139 - RNA, 19 nt, Human
ggucugcugccucaggaau

SEQ ID NO: 3742140 - RNA, 16 nt, Human
ggucuggacugacagc

SEQ ID NO: 3742141 - RNA, 19 nt, Human
ggucuggaggaccugcccg

SEQ ID NO: 3742142 - RNA, 22 nt, Human
ggucuggcagccucccauccag

SEQ ID NO: 3742143 - RNA, 13 nt, Human
ggucuggcugcuu

SEQ ID NO: 3742144 - RNA, 13 nt, Human
ggucuggcuggug

SEQ ID NO: 3742145 - RNA, 23 nt, Human
ggucuggcugguguuaacagaag

SEQ ID NO: 3742146 - RNA, 19 nt, Human
ggucugggagucacacagu

SEQ ID NO: 3742147 - RNA, 22 nt, Human
ggucugggcggcgggcggcugg

SEQ ID NO: 3742148 - RNA, 15 nt, Human
ggucugguugggcag

SEQ ID NO: 3742149 - RNA, 18 nt, Human
ggucuguagguugcacac

SEQ ID NO: 3742150 - RNA, 14 nt, Human
ggucugucccacca

SEQ ID NO: 3742151 - RNA, 15 nt, Human
ggucugucccaccag

SEQ ID NO: 3742152 - RNA, 19 nt, Human
gggaaggccccacagacaa

SEQ ID NO: 3742153 - RNA, 16 nt, Human
gggaagggagagcggg

SEQ ID NO: 3742154 - RNA, 14 nt, Human
gggaagggagccaa

SEQ ID NO: 3742155 - RNA, 21 nt, Human
gggaagggagccaagggaugg

SEQ ID NO: 3742156 - RNA, 22 nt, Human
gggaagggccagucugggcugc

SEQ ID NO: 3742157 - RNA, 21 nt, Human
gggaagggggggcuacauuau

SEQ ID NO: 3742158 - RNA, 18 nt, Human
gggaaggggggucagaag

SEQ ID NO: 3742159 - RNA, 17 nt, Human
gggaagggucauagaaa

SEQ ID NO: 3742160 - RNA, 16 nt, Human
gggaaggguuugaauu

SEQ ID NO: 3742161 - RNA, 12 nt, Human
gggaaggucacc

SEQ ID NO: 3742162 - RNA, 19 nt, Human
gggaaggucaccagcacca

SEQ ID NO: 3742163 - RNA, 14 nt, Human
gggaaguccucccu

SEQ ID NO: 3742164 - RNA, 24 nt, Human
gggaauaaaauccuaagacacaaa

SEQ ID NO: 3742165 - RNA, 19 nt, Human
gggaauaaauaugccucuc

SEQ ID NO: 3742166 - RNA, 14 nt, Human
gggaauaaccuucc

SEQ ID NO: 3742167 - RNA, 14 nt, Human
gggaauauuugaau

SEQ ID NO: 3742168 - RNA, 14 nt, Human
gggaauauuuuauu

SEQ ID NO: 3742169 - RNA, 12 nt, Human
gggaaucacauc

SEQ ID NO: 3742170 - RNA, 14 nt, Human
gggaaucagaacuc

SEQ ID NO: 3742171 - RNA, 21 nt, Human
gggaauccaagccuccacagc

SEQ ID NO: 3742172 - RNA, 22 nt, Human
gggaauccaagccuccacagcg

SEQ ID NO: 3742173 - RNA, 21 nt, Human
gggaaucuaauauccccaaau

SEQ ID NO: 3742174 - RNA, 14 nt, Human
gggaaugaaccugg

SEQ ID NO: 3742175 - RNA, 16 nt, Human
gggaaugaaccuggag

SEQ ID NO: 3742176 - RNA, 24 nt, Human
gggaaugaagcuuguguauccauu

SEQ ID NO: 3742177 - RNA, 16 nt, Human
gggaaugagcccagag

SEQ ID NO: 3742178 - RNA, 21 nt, Human
gggaaugaggcuugcugagag

SEQ ID NO: 3742179 - RNA, 11 nt, Human
gggaaugugaa

SEQ ID NO: 3742180 - RNA, 14 nt, Human
gggaauugaggaca

SEQ ID NO: 3742181 - RNA, 14 nt, Human
gggaauugugugau

SEQ ID NO: 3742182 - RNA, 18 nt, Human
gggacaaaacccaccuug

SEQ ID NO: 3742183 - RNA, 16 nt, Human
gggacaaaggagccug

SEQ ID NO: 3742184 - RNA, 18 nt, Human
gggacaaaggagccugug

SEQ ID NO: 3742185 - RNA, 22 nt, Human
gggacaaauuuaaaacaaacaa

SEQ ID NO: 3742186 - RNA, 19 nt, Human
gggacacaaaacuccgccc

SEQ ID NO: 3742187 - RNA, 20 nt, Human
gggacacaaaacuccgcccc

SEQ ID NO: 3742188 - RNA, 23 nt, Human
gggacacaaaacuccgcccccag

SEQ ID NO: 3742189 - RNA, 23 nt, Human
gggacacauucaacccuggagag

SEQ ID NO: 3742190 - RNA, 19 nt, Human
gggacaccagccaggcucu

SEQ ID NO: 3742191 - RNA, 20 nt, Human
gggacaccagccaggcucug

SEQ ID NO: 3742192 - RNA, 14 nt, Human
gggacacccagaaa

SEQ ID NO: 3742193 - RNA, 16 nt, Human
gggacaccugcccugc

SEQ ID NO: 3742194 - RNA, 20 nt, Human
gggacagagacaccugcacc

SEQ ID NO: 3742195 - RNA, 13 nt, Human
gggacagagcaga

SEQ ID NO: 3742196 - RNA, 19 nt, Human
gggacagaggccccagccu

SEQ ID NO: 3742197 - RNA, 21 nt, Human
gggacagaggccccagccucc

SEQ ID NO: 3742198 - RNA, 15 nt, Human
gggacagaggccugc

SEQ ID NO: 3742199 - RNA, 15 nt, Human
gggacagagucuggg

SEQ ID NO: 3742200 - RNA, 17 nt, Human
gggacagaucauagauu

SEQ ID NO: 3742201 - RNA, 21 nt, Human
gggacagcccagagccuggcu

SEQ ID NO: 3742202 - RNA, 15 nt, Human
gggacagcuccuucu

SEQ ID NO: 3742203 - RNA, 21 nt, Human
gggacagcuccuucuguccua

SEQ ID NO: 3742204 - RNA, 23 nt, Human
gggacagggaggugugaggcagg

SEQ ID NO: 3742205 - RNA, 20 nt, Human
gggacagggcuggcccagcc

SEQ ID NO: 3742206 - RNA, 22 nt, Human
gggacagggcuggcccagcccu

SEQ ID NO: 3742207 - RNA, 17 nt, Human
gggacagugcugcagcu

SEQ ID NO: 3742208 - RNA, 21 nt, Human
gggacaguuuaucaugaagcc

SEQ ID NO: 3742209 - RNA, 22 nt, Human
gggacaguuuaucaugaagccu

SEQ ID NO: 3742210 - RNA, 18 nt, Human
gggacaucacaggguggg

SEQ ID NO: 3742211 - RNA, 22 nt, Human
gggacaucacagggugggccuc

SEQ ID NO: 3742212 - RNA, 15 nt, Human
gggacaucucuuuga

SEQ ID NO: 3742213 - RNA, 22 nt, Human
gggacaugaaauaaaugcccca

SEQ ID NO: 3742214 - RNA, 22 nt, Human
gggacaugggucgcccaugaga

SEQ ID NO: 3742215 - RNA, 15 nt, Human
gggacauugggaagg

SEQ ID NO: 3742216 - RNA, 16 nt, Human
gggaccaacugggccc

SEQ ID NO: 3742217 - RNA, 13 nt, Human
gggaccaaggacc

SEQ ID NO: 3742218 - RNA, 23 nt, Human
gggaccaaggcaaggcaggugcc

SEQ ID NO: 3742219 - RNA, 23 nt, Human
gggaccacagcaaggcaccugca

SEQ ID NO: 3742220 - RNA, 12 nt, Human
gggaccagcuug

SEQ ID NO: 3742221 - RNA, 18 nt, Human
gggaccaggagugggugg

SEQ ID NO: 3742222 - RNA, 13 nt, Human
gggaccauguguc

SEQ ID NO: 3742223 - RNA, 13 nt, Human
gggacccaggcuc

SEQ ID NO: 3742224 - RNA, 17 nt, Human
gggacccaggcuccgcc

SEQ ID NO: 3742225 - RNA, 17 nt, Human
gggacccaguggcaggg

SEQ ID NO: 3742226 - RNA, 20 nt, Human
gggacccauagaucuucuga

SEQ ID NO: 3742227 - RNA, 11 nt, Human
gggacccccag

SEQ ID NO: 3742228 - RNA, 13 nt, Human
gggacccccagga

SEQ ID NO: 3742229 - RNA, 13 nt, Human
gggacccccgccc

SEQ ID NO: 3742230 - RNA, 21 nt, Human
gggacccccgcccccugcccu

SEQ ID NO: 3742231 - RNA, 23 nt, Human
gggacccccguggggcagggagc

SEQ ID NO: 3742232 - RNA, 18 nt, Human
gggaccccgagccuggcu

SEQ ID NO: 3742233 - RNA, 23 nt, Human
gggaccccgagccuggcuccaaa

SEQ ID NO: 3742234 - RNA, 13 nt, Human
gggaccccuccuc

SEQ ID NO: 3742235 - RNA, 13 nt, Human
gggacccugcuuu

SEQ ID NO: 3742236 - RNA, 23 nt, Human
gggaccgccagauggggccucug

SEQ ID NO: 3742237 - RNA, 18 nt, Human
gggaccgguacagaaagg

SEQ ID NO: 3742238 - RNA, 19 nt, Human
gggaccuagggaggcaugg

SEQ ID NO: 3742239 - RNA, 17 nt, Human
gggaccuauaacugccc

SEQ ID NO: 3742240 - RNA, 15 nt, Human
gggaccucaggccug

SEQ ID NO: 3742241 - RNA, 18 nt, Human
gggaccugccaggcaggg

SEQ ID NO: 3742242 - RNA, 13 nt, Human
gggaccuggaagg

SEQ ID NO: 3742243 - RNA, 15 nt, Human
gggaccuuuaguggu

SEQ ID NO: 3742244 - RNA, 13 nt, Human
gggaccuuuuggg

SEQ ID NO: 3742245 - RNA, 20 nt, Human
gggacgcuccgcugccgugc

SEQ ID NO: 3742246 - RNA, 22 nt, Human
gggacguucgugguccugcgcu

SEQ ID NO: 3742247 - RNA, 14 nt, Human
gggacguuucucau

SEQ ID NO: 3742248 - RNA, 17 nt, Human
gggacuaaaugcccugc

SEQ ID NO: 3742249 - RNA, 15 nt, Human
gggacuagccccugu

SEQ ID NO: 3742250 - RNA, 16 nt, Human
gggacucacuggcagc

SEQ ID NO: 3742251 - RNA, 21 nt, Human
gggacucacuggcagccccag

SEQ ID NO: 3742252 - RNA, 23 nt, Human
gggacucacuggcagccccagca

SEQ ID NO: 3742253 - RNA, 12 nt, Human
gggacucagccc

SEQ ID NO: 3742254 - RNA, 17 nt, Human
gggacucagcccugagg

SEQ ID NO: 3742255 - RNA, 20 nt, Human
gggacuccggcugugcuggg

SEQ ID NO: 3742256 - RNA, 15 nt, Human
gggacugagaaauuu

SEQ ID NO: 3742257 - RNA, 18 nt, Human
gggacugccaccuccccu

SEQ ID NO: 3742258 - RNA, 22 nt, Human
gggacugccaccuccccuugcc

SEQ ID NO: 3742259 - RNA, 15 nt, Human
gggacugccucugcc

SEQ ID NO: 3742260 - RNA, 16 nt, Human
gggacugccucugcca

SEQ ID NO: 3742261 - RNA, 17 nt, Human
gggacugcggaggaagg

SEQ ID NO: 3742262 - RNA, 17 nt, Human
gggacugcugcugccug

SEQ ID NO: 3742263 - RNA, 13 nt, Human
gggacugggaggg

SEQ ID NO: 3742264 - RNA, 17 nt, Human
gggacugggagggccca

SEQ ID NO: 3742265 - RNA, 20 nt, Human
gggacuggguuuggacccca

SEQ ID NO: 3742266 - RNA, 13 nt, Human
gggacuguacaca

SEQ ID NO: 3742267 - RNA, 20 nt, Human
gggacuuccuugcucucccu

SEQ ID NO: 3742268 - RNA, 17 nt, Human
gggacuuggaagcuccg

SEQ ID NO: 3742269 - RNA, 15 nt, Human
gggacuugugucugc

SEQ ID NO: 3742270 - RNA, 15 nt, Human
gggagaaaagacaug

SEQ ID NO: 3742271 - RNA, 22 nt, Human
gggagaaaaggaaaagaaaaaa

SEQ ID NO: 3742272 - RNA, 14 nt, Human
gggagaaaaucauc

SEQ ID NO: 3742273 - RNA, 20 nt, Human
gggagaaaaucaucaagaag

SEQ ID NO: 3742274 - RNA, 15 nt, Human
gggagaaaauucaau

SEQ ID NO: 3742275 - RNA, 19 nt, Human
gggagaaauacuugaacuu

SEQ ID NO: 3742276 - RNA, 23 nt, Human
gggagaaauagucggugaagaaa

SEQ ID NO: 3742277 - RNA, 12 nt, Human
gggagaagcucc

SEQ ID NO: 3742278 - RNA, 16 nt, Human
gggagaagggggucaa

SEQ ID NO: 3742279 - RNA, 19 nt, Human
gggagaaugucaguaugug

SEQ ID NO: 3742280 - RNA, 14 nt, Human
gggagacacuggcc

SEQ ID NO: 3742281 - RNA, 21 nt, Human
gggagaccggccugccaggag

SEQ ID NO: 3742282 - RNA, 13 nt, Human
gggagaccuggac

SEQ ID NO: 3742283 - RNA, 20 nt, Human
gggagacgguuuccagggag

SEQ ID NO: 3742284 - RNA, 14 nt, Human
gggagacugggcug

SEQ ID NO: 3742285 - RNA, 16 nt, Human
gggagacugggcugag

SEQ ID NO: 3742286 - RNA, 20 nt, Human
gggagacugggcugagggag

SEQ ID NO: 3742287 - RNA, 22 nt, Human
gggagagaccucaucaggauga

SEQ ID NO: 3742288 - RNA, 23 nt, Human
gggagagagagagagagaggaca

SEQ ID NO: 3742289 - RNA, 13 nt, Human
gggagagcaggcu

SEQ ID NO: 3742290 - RNA, 15 nt, Human
gggagagcaggcugg

SEQ ID NO: 3742291 - RNA, 12 nt, Human
gggagagcccag

SEQ ID NO: 3742292 - RNA, 17 nt, Human
gggagagcccaggagcu

SEQ ID NO: 3742293 - RNA, 15 nt, Human
gggagagccccuggg

SEQ ID NO: 3742294 - RNA, 22 nt, Human
gggagaggccaugauucgccca

SEQ ID NO: 3742295 - RNA, 16 nt, Human
gggagaggugccagca

SEQ ID NO: 3742296 - RNA, 15 nt, Human
gggagcacccugagg

SEQ ID NO: 3742297 - RNA, 11 nt, Human
gggagcacugg

SEQ ID NO: 3742298 - RNA, 14 nt, Human
gggagcacuggagu

SEQ ID NO: 3742299 - RNA, 16 nt, Human
gggagcacuggagugc

SEQ ID NO: 3742300 - RNA, 15 nt, Human
gggagcagggaaggc

SEQ ID NO: 3742301 - RNA, 20 nt, Human
gggagcagugucuuccauaa

SEQ ID NO: 3742302 - RNA, 13 nt, Human
ggucugucuuuua

SEQ ID NO: 3742303 - RNA, 14 nt, Human
ggucugucuuuuaa

SEQ ID NO: 3742304 - RNA, 13 nt, Human
ggucugugucucu

SEQ ID NO: 3742305 - RNA, 17 nt, Human
ggucugugugaaugugg

SEQ ID NO: 3742306 - RNA, 11 nt, Human
ggucugugugu

SEQ ID NO: 3742307 - RNA, 22 nt, Human
ggucugugugugugugugugcg

SEQ ID NO: 3742308 - RNA, 18 nt, Human
ggucuguucuugaagcag

SEQ ID NO: 3742309 - RNA, 19 nt, Human
ggucuguucuuuccaaagu

SEQ ID NO: 3742310 - RNA, 23 nt, Human
ggucuuaagaaauguauaaacuu

SEQ ID NO: 3742311 - RNA, 13 nt, Human
ggucuuauauuua

SEQ ID NO: 3742312 - RNA, 14 nt, Human
ggucuucagccauc

SEQ ID NO: 3742313 - RNA, 19 nt, Human
ggucuucagggggccaggu

SEQ ID NO: 3742314 - RNA, 17 nt, Human
ggucuucccaggcuggg

SEQ ID NO: 3742315 - RNA, 20 nt, Human
ggucuucccuaccucaggca

SEQ ID NO: 3742316 - RNA, 22 nt, Human
ggucuucccuaccucaggcagg

SEQ ID NO: 3742317 - RNA, 22 nt, Human
ggucuugaacuccuggccucaa

SEQ ID NO: 3742318 - RNA, 13 nt, Human
ggucuugaagucc

SEQ ID NO: 3742319 - RNA, 13 nt, Human
ggucuugaucucc

SEQ ID NO: 3742320 - RNA, 19 nt, Human
ggucuugcaaaauuccuga

SEQ ID NO: 3742321 - RNA, 21 nt, Human
ggucuuucauggggugaugcu

SEQ ID NO: 3742322 - RNA, 12 nt, Human
ggucuuuguaag

SEQ ID NO: 3742323 - RNA, 14 nt, Human
ggucuuuguaagaa

SEQ ID NO: 3742324 - RNA, 15 nt, Human
ggucuuuguaagaac

SEQ ID NO: 3742325 - RNA, 14 nt, Human
ggucuuuguaucuu

SEQ ID NO: 3742326 - RNA, 21 nt, Human
ggucuuuugacauguggaaag

SEQ ID NO: 3742327 - RNA, 19 nt, Human
ggugaaacauuuucucccu

SEQ ID NO: 3742328 - RNA, 17 nt, Human
ggugaaagaaaucaugu

SEQ ID NO: 3742329 - RNA, 19 nt, Human
ggugaacaaagcagccacg

SEQ ID NO: 3742330 - RNA, 22 nt, Human
ggugaacauugcaauagaaauc

SEQ ID NO: 3742331 - RNA, 18 nt, Human
ggugaaccacuucauucu

SEQ ID NO: 3742332 - RNA, 16 nt, Human
ggugaacuugguuccc

SEQ ID NO: 3742333 - RNA, 22 nt, Human
ggugaagaggaggggaagaggc

SEQ ID NO: 3742334 - RNA, 17 nt, Human
ggugaagcuauuuaucu

SEQ ID NO: 3742335 - RNA, 18 nt, Human
ggugaaggaggcuccagg

SEQ ID NO: 3742336 - RNA, 22 nt, Human
ggugaaggaggcuccaggcagc

SEQ ID NO: 3742337 - RNA, 16 nt, Human
ggugaagggagagcca

SEQ ID NO: 3742338 - RNA, 14 nt, Human
ggugaauggcuuug

SEQ ID NO: 3742339 - RNA, 21 nt, Human
ggugacaaagauggcucagag

SEQ ID NO: 3742340 - RNA, 17 nt, Human
ggugacaagauagagag

SEQ ID NO: 3742341 - RNA, 18 nt, Human
ggugacaagauagagagc

SEQ ID NO: 3742342 - RNA, 12 nt, Human
ggugacacagac

SEQ ID NO: 3742343 - RNA, 16 nt, Human
ggugacaccagccuuu

SEQ ID NO: 3742344 - RNA, 18 nt, Human
ggugacagucaucaucag

SEQ ID NO: 3742345 - RNA, 14 nt, Human
ggugacaugugaaa

SEQ ID NO: 3742346 - RNA, 15 nt, Human
ggugacaugugaaac

SEQ ID NO: 3742347 - RNA, 15 nt, Human
ggugaccccagggca

SEQ ID NO: 3742348 - RNA, 21 nt, Human
ggugaccccuuuucagcuucu

SEQ ID NO: 3742349 - RNA, 23 nt, Human
ggugacccggcacccccugcagc

SEQ ID NO: 3742350 - RNA, 12 nt, Human
ggugacggcccu

SEQ ID NO: 3742351 - RNA, 21 nt, Human
ggugacgggacucaggcggga

SEQ ID NO: 3742352 - RNA, 22 nt, Human
ggugacugguuaucacaccauc

SEQ ID NO: 3742353 - RNA, 14 nt, Human
ggugacuuuggaua

SEQ ID NO: 3742354 - RNA, 18 nt, Human
ggugacuuuggauaauaa

SEQ ID NO: 3742355 - RNA, 20 nt, Human
ggugacuuuggauaauaagg

SEQ ID NO: 3742356 - RNA, 12 nt, Human
ggugagaaaaaa

SEQ ID NO: 3742357 - RNA, 13 nt, Human
ggugagaaauuua

SEQ ID NO: 3742358 - RNA, 21 nt, Human
ggugagaaccuggguugcaga

SEQ ID NO: 3742359 - RNA, 12 nt, Human
ggugagaacucu

SEQ ID NO: 3742360 - RNA, 17 nt, Human
ggugaggaagcuccagu

SEQ ID NO: 3742361 - RNA, 13 nt, Human
ggugagggaugug

SEQ ID NO: 3742362 - RNA, 17 nt, Human
ggugaggggcuggcacu

SEQ ID NO: 3742363 - RNA, 16 nt, Human
ggugaggguuggcgcu

SEQ ID NO: 3742364 - RNA, 17 nt, Human
ggugaguccuccagaac

SEQ ID NO: 3742365 - RNA, 23 nt, Human
ggugaguggggagacaccucaga

SEQ ID NO: 3742366 - RNA, 14 nt, Human
ggugauaagggaaa

SEQ ID NO: 3742367 - RNA, 15 nt, Human
ggugauaagggaaaa

SEQ ID NO: 3742368 - RNA, 22 nt, Human
ggugauagguauaaguggugug

SEQ ID NO: 3742369 - RNA, 19 nt, Human
ggugaucaauuaaauguag

SEQ ID NO: 3742370 - RNA, 23 nt, Human
ggugauccacccaccucagccuc

SEQ ID NO: 3742371 - RNA, 20 nt, Human
ggugauccauguaacugccu

SEQ ID NO: 3742372 - RNA, 13 nt, Human
ggugaugagggca

SEQ ID NO: 3742373 - RNA, 18 nt, Human
ggugauuuaagggcccag

SEQ ID NO: 3742374 - RNA, 20 nt, Human
ggugauuuagcaggaagcug

SEQ ID NO: 3742375 - RNA, 17 nt, Human
ggugcaaaguauuguaa

SEQ ID NO: 3742376 - RNA, 18 nt, Human
ggugcaaaguucccuacu

SEQ ID NO: 3742377 - RNA, 22 nt, Human
ggugcacaagcuccaagcuccc

SEQ ID NO: 3742378 - RNA, 20 nt, Human
ggugcacagacgucccucca

SEQ ID NO: 3742379 - RNA, 14 nt, Human
ggugcacaggaggg

SEQ ID NO: 3742380 - RNA, 23 nt, Human
ggugcacuuggggcacagggaga

SEQ ID NO: 3742381 - RNA, 19 nt, Human
ggugcagagguacccuggg

SEQ ID NO: 3742382 - RNA, 22 nt, Human
ggugcagagguacccugggugu

SEQ ID NO: 3742383 - RNA, 16 nt, Human
ggugcagagugcccag

SEQ ID NO: 3742384 - RNA, 13 nt, Human
ggugcagccagag

SEQ ID NO: 3742385 - RNA, 12 nt, Human
ggugcaggcagg

SEQ ID NO: 3742386 - RNA, 16 nt, Human
ggugcagggauguggg

SEQ ID NO: 3742387 - RNA, 16 nt, Human
ggugcagugugaaaag

SEQ ID NO: 3742388 - RNA, 18 nt, Human
ggugcaguugacagcagg

SEQ ID NO: 3742389 - RNA, 22 nt, Human
ggugcauacacccccaccuccu

SEQ ID NO: 3742390 - RNA, 15 nt, Human
ggugcauagaacugg

SEQ ID NO: 3742391 - RNA, 18 nt, Human
ggugcauagaacugggua

SEQ ID NO: 3742392 - RNA, 21 nt, Human
ggugcauauuuauaaaaauaa

SEQ ID NO: 3742393 - RNA, 17 nt, Human
ggugcaugaucuugagc

SEQ ID NO: 3742394 - RNA, 19 nt, Human
ggugcauuacagagaggag

SEQ ID NO: 3742395 - RNA, 23 nt, Human
ggugccaauuucaaguuccaagu

SEQ ID NO: 3742396 - RNA, 12 nt, Human
ggugccagaagc

SEQ ID NO: 3742397 - RNA, 13 nt, Human
ggugccagcaaag

SEQ ID NO: 3742398 - RNA, 14 nt, Human
ggugccagccuucc

SEQ ID NO: 3742399 - RNA, 16 nt, Human
ggugccaucagugccc

SEQ ID NO: 3742400 - RNA, 18 nt, Human
ggugccaugucugcagug

SEQ ID NO: 3742401 - RNA, 23 nt, Human
ggugcccacagugucaggcacug

SEQ ID NO: 3742402 - RNA, 12 nt, Human
ggugcccaggag

SEQ ID NO: 3742403 - RNA, 13 nt, Human
ggugccccaggac

SEQ ID NO: 3742404 - RNA, 14 nt, Human
ggugccccaggacc

SEQ ID NO: 3742405 - RNA, 16 nt, Human
ggugccccaggaccag

SEQ ID NO: 3742406 - RNA, 20 nt, Human
ggugccccaggaccagcuca

SEQ ID NO: 3742407 - RNA, 23 nt, Human
ggugccccaggaccagcucagga

SEQ ID NO: 3742408 - RNA, 12 nt, Human
ggugcccccucc

SEQ ID NO: 3742409 - RNA, 17 nt, Human
ggugcccccuccucucc

SEQ ID NO: 3742410 - RNA, 22 nt, Human
ggugcccccuccucucccaucc

SEQ ID NO: 3742411 - RNA, 16 nt, Human
ggugcccuccacugcc

SEQ ID NO: 3742412 - RNA, 18 nt, Human
ggugcccuggaugcccag

SEQ ID NO: 3742413 - RNA, 19 nt, Human
ggugcccuggaugcccagg

SEQ ID NO: 3742414 - RNA, 18 nt, Human
ggugcccuuggaggccag

SEQ ID NO: 3742415 - RNA, 16 nt, Human
ggugccuaggccuggg

SEQ ID NO: 3742416 - RNA, 14 nt, Human
ggugccugaggucu

SEQ ID NO: 3742417 - RNA, 18 nt, Human
ggugccugauucggcugu

SEQ ID NO: 3742418 - RNA, 23 nt, Human
ggugccuggguggggcugcuccu

SEQ ID NO: 3742419 - RNA, 17 nt, Human
ggugccugucccacccc

SEQ ID NO: 3742420 - RNA, 21 nt, Human
ggugccugugaggcaggggcg

SEQ ID NO: 3742421 - RNA, 23 nt, Human
ggugccuucuuauucucacucca

SEQ ID NO: 3742422 - RNA, 20 nt, Human
ggugccuucuucagggccug

SEQ ID NO: 3742423 - RNA, 18 nt, Human
ggugccuuucaaauuuag

SEQ ID NO: 3742424 - RNA, 19 nt, Human
ggugccuuucaaauuuaga

SEQ ID NO: 3742425 - RNA, 22 nt, Human
ggugcggcugugcagccugucc

SEQ ID NO: 3742426 - RNA, 19 nt, Human
ggugcgucugggagguugg

SEQ ID NO: 3742427 - RNA, 21 nt, Human
ggugcuacuggggaaacuggc

SEQ ID NO: 3742428 - RNA, 17 nt, Human
ggugcuauaggcuggag

SEQ ID NO: 3742429 - RNA, 22 nt, Human
ggugcuaucucccccagcccca

SEQ ID NO: 3742430 - RNA, 19 nt, Human
ggugcucacaccccauugg

SEQ ID NO: 3742431 - RNA, 14 nt, Human
ggugcucagggggc

SEQ ID NO: 3742432 - RNA, 16 nt, Human
ggugcucucugccacu

SEQ ID NO: 3742433 - RNA, 17 nt, Human
ggugcugacggccaggg

SEQ ID NO: 3742434 - RNA, 13 nt, Human
ggugcugagaagc

SEQ ID NO: 3742435 - RNA, 18 nt, Human
ggugcugaguguacagag

SEQ ID NO: 3742436 - RNA, 21 nt, Human
ggugcugcagcaccgaggggc

SEQ ID NO: 3742437 - RNA, 16 nt, Human
ggugcugcuacccucc

SEQ ID NO: 3742438 - RNA, 19 nt, Human
ggugcugcuacccucccug

SEQ ID NO: 3742439 - RNA, 20 nt, Human
ggugcugcuacccucccugc

SEQ ID NO: 3742440 - RNA, 21 nt, Human
ggugcugcuucccucugccug

SEQ ID NO: 3742441 - RNA, 12 nt, Human
ggugcugggacu

SEQ ID NO: 3742442 - RNA, 18 nt, Human
ggugcugggagaggcagc

SEQ ID NO: 3742443 - RNA, 16 nt, Human
ggugcugggccccugc

SEQ ID NO: 3742444 - RNA, 15 nt, Human
ggugcuguccucagg

SEQ ID NO: 3742445 - RNA, 23 nt, Human
ggugcuguccucagguggccaug

SEQ ID NO: 3742446 - RNA, 22 nt, Human
ggugcuguugucauugcuuuac

SEQ ID NO: 3742447 - RNA, 21 nt, Human
ggugcuucuaguucugccagg

SEQ ID NO: 3742448 - RNA, 19 nt, Human
ggugcuuuuauagaggcua

SEQ ID NO: 3742449 - RNA, 19 nt, Human
gguggaaggcccgaggggc

SEQ ID NO: 3742450 - RNA, 13 nt, Human
gguggacacacaa

SEQ ID NO: 3742451 - RNA, 16 nt, Human
gaagggccaguccugc

SEQ ID NO: 3742452 - RNA, 19 nt, Human
gaagggccagucugggcug

SEQ ID NO: 3742453 - RNA, 20 nt, Human
gaagggcuagaaccuggaga

SEQ ID NO: 3742454 - RNA, 14 nt, Human
gaagggcugcauga

SEQ ID NO: 3742455 - RNA, 18 nt, Human
gaagggcugcaugauguu

SEQ ID NO: 3742456 - RNA, 22 nt, Human
gaagggcugcuucccugaagcu

SEQ ID NO: 3742457 - RNA, 16 nt, Human
gaaggggacccccgcc

SEQ ID NO: 3742458 - RNA, 21 nt, Human
gaaggggacccccgcccccug

SEQ ID NO: 3742459 - RNA, 18 nt, Human
gaaggggacugccaccuc

SEQ ID NO: 3742460 - RNA, 17 nt, Human
gaaggggaggagggcgg

SEQ ID NO: 3742461 - RNA, 23 nt, Human
gaaggggaggcagccggcaccca

SEQ ID NO: 3742462 - RNA, 14 nt, Human
gaaggggccagagg

SEQ ID NO: 3742463 - RNA, 16 nt, Human
gaaggggccagaggcu

SEQ ID NO: 3742464 - RNA, 22 nt, Human
gaaggggccucaccgagugggg

SEQ ID NO: 3742465 - RNA, 21 nt, Human
gaaggggcgucuguucccccu

SEQ ID NO: 3742466 - RNA, 19 nt, Human
gaaggggcuggacuggcug

SEQ ID NO: 3742467 - RNA, 14 nt, Human
gaagggggccauga

SEQ ID NO: 3742468 - RNA, 19 nt, Human
gaagggggggcuacauuau

SEQ ID NO: 3742469 - RNA, 20 nt, Human
gaagggggggcuacauuaua

SEQ ID NO: 3742470 - RNA, 17 nt, Human
gaaggggguccacccag

SEQ ID NO: 3742471 - RNA, 12 nt, Human
gaaggggguggu

SEQ ID NO: 3742472 - RNA, 22 nt, Human
gaagggguaggauuacuaggug

SEQ ID NO: 3742473 - RNA, 14 nt, Human
gaagggguuccuca

SEQ ID NO: 3742474 - RNA, 14 nt, Human
gaagggguuuucuu

SEQ ID NO: 3742475 - RNA, 17 nt, Human
gaagggugguggagcca

SEQ ID NO: 3742476 - RNA, 14 nt, Human
gaaggguuucucua

SEQ ID NO: 3742477 - RNA, 20 nt, Human
gaaggguuuuccacccugga

SEQ ID NO: 3742478 - RNA, 13 nt, Human
gaagguaaaauug

SEQ ID NO: 3742479 - RNA, 13 nt, Human
gaagguaaauaaa

SEQ ID NO: 3742480 - RNA, 20 nt, Human
gaagguauaucuagguuuau

SEQ ID NO: 3742481 - RNA, 14 nt, Human
gaaggucggaggcu

SEQ ID NO: 3742482 - RNA, 19 nt, Human
gaaggucuguuuuguguac

SEQ ID NO: 3742483 - RNA, 13 nt, Human
gaaggucuugauu

SEQ ID NO: 3742484 - RNA, 17 nt, Human
gaaggucuugauuuguu

SEQ ID NO: 3742485 - RNA, 19 nt, Human
gaaggugauaagggaaaag

SEQ ID NO: 3742486 - RNA, 22 nt, Human
gaaggugccccaaaaugcaaga

SEQ ID NO: 3742487 - RNA, 18 nt, Human
gaaggugcugacggccag

SEQ ID NO: 3742488 - RNA, 12 nt, Human
gaaggugcugga

SEQ ID NO: 3742489 - RNA, 20 nt, Human
gaaggugcuggaggugggag

SEQ ID NO: 3742490 - RNA, 22 nt, Human
gaagguggauggccccagcaca

SEQ ID NO: 3742491 - RNA, 14 nt, Human
gaaggugggaggau

SEQ ID NO: 3742492 - RNA, 20 nt, Human
gaagguuaggauuuaacagu

SEQ ID NO: 3742493 - RNA, 16 nt, Human
gaagguucugguguga

SEQ ID NO: 3742494 - RNA, 20 nt, Human
gaagguucuggugugaacua

SEQ ID NO: 3742495 - RNA, 20 nt, Human
gaagguuuacucuguggcca

SEQ ID NO: 3742496 - RNA, 13 nt, Human
gaagguuuauugu

SEQ ID NO: 3742497 - RNA, 22 nt, Human
gaagguuuguguuuucucugga

SEQ ID NO: 3742498 - RNA, 20 nt, Human
gaagguuuguguuuuucugc

SEQ ID NO: 3742499 - RNA, 17 nt, Human
gaaguaaaauguggcag

SEQ ID NO: 3742500 - RNA, 18 nt, Human
gaaguaaaauguggcagg

SEQ ID NO: 3742501 - RNA, 14 nt, Human
gaaguaacaguaac

SEQ ID NO: 3742502 - RNA, 19 nt, Human
gaaguaacuggugauauau

SEQ ID NO: 3742503 - RNA, 17 nt, Human
gaaguaacuugucuuaa

SEQ ID NO: 3742504 - RNA, 16 nt, Human
gaaguaagccucauca

SEQ ID NO: 3742505 - RNA, 20 nt, Human
gaaguaauaugcacacauuu

SEQ ID NO: 3742506 - RNA, 16 nt, Human
gaaguaccuuaucaaa

SEQ ID NO: 3742507 - RNA, 18 nt, Human
gaaguacuauaauuuacc

SEQ ID NO: 3742508 - RNA, 15 nt, Human
gaaguacuggagaaa

SEQ ID NO: 3742509 - RNA, 12 nt, Human
gaaguagcacag

SEQ ID NO: 3742510 - RNA, 21 nt, Human
gaaguaggggaagaauaauuu

SEQ ID NO: 3742511 - RNA, 13 nt, Human
gaaguaguuauca

SEQ ID NO: 3742512 - RNA, 19 nt, Human
gaaguaguuaucauguuag

SEQ ID NO: 3742513 - RNA, 23 nt, Human
gaaguauuauaaauuauguuuau

SEQ ID NO: 3742514 - RNA, 17 nt, Human
gaaguauuuuuagaaua

SEQ ID NO: 3742515 - RNA, 15 nt, Human
gaagucaaacauuuc

SEQ ID NO: 3742516 - RNA, 18 nt, Human
gaagucaaggcuuagacc

SEQ ID NO: 3742517 - RNA, 15 nt, Human
gaagucacagggcag

SEQ ID NO: 3742518 - RNA, 21 nt, Human
gaagucacauuccugaacagg

SEQ ID NO: 3742519 - RNA, 15 nt, Human
gaagucacugcacag

SEQ ID NO: 3742520 - RNA, 18 nt, Human
gaagucaucuugcuacca

SEQ ID NO: 3742521 - RNA, 19 nt, Human
gaagucaugaagcccaagu

SEQ ID NO: 3742522 - RNA, 23 nt, Human
gaaguccaagcauuuagauguau

SEQ ID NO: 3742523 - RNA, 17 nt, Human
gaaguccaauguggcaa

SEQ ID NO: 3742524 - RNA, 18 nt, Human
gaaguccuguaugucugu

SEQ ID NO: 3742525 - RNA, 19 nt, Human
gaagucucaucuggggagc

SEQ ID NO: 3742526 - RNA, 24 nt, Human
gaagucucaucuggggagcaggca

SEQ ID NO: 3742527 - RNA, 16 nt, Human
gaagucucugaaguga

SEQ ID NO: 3742528 - RNA, 17 nt, Human
gaagucuuaaggacaaa

SEQ ID NO: 3742529 - RNA, 17 nt, Human
gaagucuucaugaaaug

SEQ ID NO: 3742530 - RNA, 19 nt, Human
gaagucuuuguacagacaa

SEQ ID NO: 3742531 - RNA, 14 nt, Human
gaagucuuuuguuc

SEQ ID NO: 3742532 - RNA, 14 nt, Human
gaagugaacauuuc

SEQ ID NO: 3742533 - RNA, 17 nt, Human
gaagugaauaacugcaa

SEQ ID NO: 3742534 - RNA, 23 nt, Human
gaagugacaaggccccagagacu

SEQ ID NO: 3742535 - RNA, 14 nt, Human
gaagugacagggaa

SEQ ID NO: 3742536 - RNA, 15 nt, Human
gaagugacagggaag

SEQ ID NO: 3742537 - RNA, 20 nt, Human
gaagugacagggaagcuaca

SEQ ID NO: 3742538 - RNA, 12 nt, Human
gaagugagaccu

SEQ ID NO: 3742539 - RNA, 18 nt, Human
gaagugcagaacugcagu

SEQ ID NO: 3742540 - RNA, 14 nt, Human
gaagugcauccaaa

SEQ ID NO: 3742541 - RNA, 16 nt, Human
gaagugcaucuacuug

SEQ ID NO: 3742542 - RNA, 13 nt, Human
gaagugccccugc

SEQ ID NO: 3742543 - RNA, 14 nt, Human
gaagugccccugcu

SEQ ID NO: 3742544 - RNA, 22 nt, Human
gaagugccccugcugccucccc

SEQ ID NO: 3742545 - RNA, 21 nt, Human
gaagugcugccgcgcagugug

SEQ ID NO: 3742546 - RNA, 20 nt, Human
gaagugcuguuuauuaaucu

SEQ ID NO: 3742547 - RNA, 18 nt, Human
gaaguggaccaggacagg

SEQ ID NO: 3742548 - RNA, 16 nt, Human
gaagugggccaggaca

SEQ ID NO: 3742549 - RNA, 15 nt, Human
gaaguggggacagag

SEQ ID NO: 3742550 - RNA, 14 nt, Human
gaaguggggagagg

SEQ ID NO: 3742551 - RNA, 15 nt, Human
gaaguguauuuauuu

SEQ ID NO: 3742552 - RNA, 15 nt, Human
gaagugugacuggcu

SEQ ID NO: 3742553 - RNA, 11 nt, Human
gaagugugauu

SEQ ID NO: 3742554 - RNA, 17 nt, Human
gaaguguuaauacuagu

SEQ ID NO: 3742555 - RNA, 18 nt, Human
gaaguguugaagggaggu

SEQ ID NO: 3742556 - RNA, 21 nt, Human
gaaguguugcauggauguuuu

SEQ ID NO: 3742557 - RNA, 22 nt, Human
gaaguguuucacgagagcccgg

SEQ ID NO: 3742558 - RNA, 12 nt, Human
gaaguuaaaggg

SEQ ID NO: 3742559 - RNA, 14 nt, Human
gaaguuacugaaug

SEQ ID NO: 3742560 - RNA, 16 nt, Human
gaaguuacugaaugca

SEQ ID NO: 3742561 - RNA, 16 nt, Human
gaaguuacuuuauguu

SEQ ID NO: 3742562 - RNA, 15 nt, Human
gaaguuacuuucuua

SEQ ID NO: 3742563 - RNA, 21 nt, Human
gaaguuagaauuccuucaggg

SEQ ID NO: 3742564 - RNA, 19 nt, Human
gaaguuagcuuuaacuuaa

SEQ ID NO: 3742565 - RNA, 15 nt, Human
gaaguuaguggaaau

SEQ ID NO: 3742566 - RNA, 21 nt, Human
gaaguuauauuuccuauacca

SEQ ID NO: 3742567 - RNA, 13 nt, Human
gaaguuaugggaa

SEQ ID NO: 3742568 - RNA, 15 nt, Human
gaaguuauuuuccag

SEQ ID NO: 3742569 - RNA, 21 nt, Human
gaaguuauuuucuacaguggu

SEQ ID NO: 3742570 - RNA, 15 nt, Human
gaaguucaccauuaa

SEQ ID NO: 3742571 - RNA, 19 nt, Human
gaaguucaccauuaaaagg

SEQ ID NO: 3742572 - RNA, 20 nt, Human
gaaguucaccauuaaaaggg

SEQ ID NO: 3742573 - RNA, 22 nt, Human
gaaguucaccauuaaaagggau

SEQ ID NO: 3742574 - RNA, 20 nt, Human
gaaguucauaccuaaguacu

SEQ ID NO: 3742575 - RNA, 15 nt, Human
gaaguucuaguguuu

SEQ ID NO: 3742576 - RNA, 18 nt, Human
gaaguucugccucugaug

SEQ ID NO: 3742577 - RNA, 21 nt, Human
gaaguugacucugcucuugca

SEQ ID NO: 3742578 - RNA, 16 nt, Human
gaaguugaucucccca

SEQ ID NO: 3742579 - RNA, 16 nt, Human
gaaguuggacagcaaa

SEQ ID NO: 3742580 - RNA, 22 nt, Human
gaaguugggcaauauaaccaau

SEQ ID NO: 3742581 - RNA, 17 nt, Human
gaaguugugugacccua

SEQ ID NO: 3742582 - RNA, 14 nt, Human
gaaguuuaaaacag

SEQ ID NO: 3742583 - RNA, 19 nt, Human
gaaguuuaaaacaguauuu

SEQ ID NO: 3742584 - RNA, 14 nt, Human
gaaguuuaaauauu

SEQ ID NO: 3742585 - RNA, 13 nt, Human
gaaguuuacauuu

SEQ ID NO: 3742586 - RNA, 14 nt, Human
gaaguuuacauuuu

SEQ ID NO: 3742587 - RNA, 17 nt, Human
gaaguuuauucucauuu

SEQ ID NO: 3742588 - RNA, 15 nt, Human
gaaguuucaaguuuu

SEQ ID NO: 3742589 - RNA, 22 nt, Human
gaaguuucaaguuuuaaaguuc

SEQ ID NO: 3742590 - RNA, 11 nt, Human
gaaguuucauc

SEQ ID NO: 3742591 - RNA, 13 nt, Human
gaaguuucauuua

SEQ ID NO: 3742592 - RNA, 21 nt, Human
gaaguuuccuuggcuggugca

SEQ ID NO: 3742593 - RNA, 12 nt, Human
gaaguuucugcc

SEQ ID NO: 3742594 - RNA, 12 nt, Human
gaaguuugaaug

SEQ ID NO: 3742595 - RNA, 16 nt, Human
gaaguuugaauguuaa

SEQ ID NO: 3742596 - RNA, 20 nt, Human
gaaguuugagaucagccugg

SEQ ID NO: 3742597 - RNA, 20 nt, Human
gaaguuuguccauuuguaaa

SEQ ID NO: 3742598 - RNA, 11 nt, Human
gaaguuuucaa

SEQ ID NO: 3742599 - RNA, 23 nt, Human
gaaguuuucaggacuuggucuga

SEQ ID NO: 3742600 - RNA, 15 nt, Human
gaauaaaauguugaa

SEQ ID NO: 3742601 - RNA, 14 nt, Human
gggagccaagggau

SEQ ID NO: 3742602 - RNA, 15 nt, Human
gggagccaagggaug

SEQ ID NO: 3742603 - RNA, 19 nt, Human
gggagccaugcgcccccuc

SEQ ID NO: 3742604 - RNA, 10 nt, Human
gggagcccac

SEQ ID NO: 3742605 - RNA, 19 nt, Human
gggagcccacuguccuggg

SEQ ID NO: 3742606 - RNA, 13 nt, Human
gggagcccccagc

SEQ ID NO: 3742607 - RNA, 15 nt, Human
gggagcccccagccu

SEQ ID NO: 3742608 - RNA, 12 nt, Human
gggagcccccgc

SEQ ID NO: 3742609 - RNA, 16 nt, Human
gggagcccccgccccg

SEQ ID NO: 3742610 - RNA, 22 nt, Human
gggagcccccgccccgccccac

SEQ ID NO: 3742611 - RNA, 16 nt, Human
gggagccgggccgcag

SEQ ID NO: 3742612 - RNA, 13 nt, Human
gggagccuccugc

SEQ ID NO: 3742613 - RNA, 17 nt, Human
gggagcgugggaggcgg

SEQ ID NO: 3742614 - RNA, 18 nt, Human
gggagcuagccagaggac

SEQ ID NO: 3742615 - RNA, 12 nt, Human
gggagcucagga

SEQ ID NO: 3742616 - RNA, 22 nt, Human
gggagcucaggaaccgaggcag

SEQ ID NO: 3742617 - RNA, 16 nt, Human
gggagcugcaggggca

SEQ ID NO: 3742618 - RNA, 11 nt, Human
gggagcuggag

SEQ ID NO: 3742619 - RNA, 15 nt, Human
gggagcugggccugg

SEQ ID NO: 3742620 - RNA, 17 nt, Human
gggagcugggccugguc

SEQ ID NO: 3742621 - RNA, 18 nt, Human
gggagcugggccuggucu

SEQ ID NO: 3742622 - RNA, 16 nt, Human
gggaggaaagagagca

SEQ ID NO: 3742623 - RNA, 15 nt, Human
gggaggaagcagaau

SEQ ID NO: 3742624 - RNA, 19 nt, Human
gggaggaaucgaggaacca

SEQ ID NO: 3742625 - RNA, 20 nt, Human
gggaggaccacaggugugag

SEQ ID NO: 3742626 - RNA, 15 nt, Human
gggaggaccucuggg

SEQ ID NO: 3742627 - RNA, 14 nt, Human
gggaggagaaugag

SEQ ID NO: 3742628 - RNA, 17 nt, Human
gggaggaggccaccucu

SEQ ID NO: 3742629 - RNA, 17 nt, Human
gggaggagggagaggga

SEQ ID NO: 3742630 - RNA, 16 nt, Human
gggaggagggcaggca

SEQ ID NO: 3742631 - RNA, 20 nt, Human
gggaggagguggcagcccug

SEQ ID NO: 3742632 - RNA, 22 nt, Human
gggaggaucacuggagcccagg

SEQ ID NO: 3742633 - RNA, 18 nt, Human
gggaggcaagaggggugg

SEQ ID NO: 3742634 - RNA, 18 nt, Human
gggaggcaaguguggggg

SEQ ID NO: 3742635 - RNA, 20 nt, Human
gggaggcagagguugcagug

SEQ ID NO: 3742636 - RNA, 12 nt, Human
gggaggcagccu

SEQ ID NO: 3742637 - RNA, 23 nt, Human
gggaggccaagaguggccccacc

SEQ ID NO: 3742638 - RNA, 16 nt, Human
gggaggccccacuggg

SEQ ID NO: 3742639 - RNA, 15 nt, Human
gggaggccccuucuc

SEQ ID NO: 3742640 - RNA, 17 nt, Human
gggaggccuaggcgggc

SEQ ID NO: 3742641 - RNA, 14 nt, Human
gggaggcgcgagcc

SEQ ID NO: 3742642 - RNA, 15 nt, Human
gggaggcucaggucc

SEQ ID NO: 3742643 - RNA, 22 nt, Human
gggaggcucuggagcccacugu

SEQ ID NO: 3742644 - RNA, 10 nt, Human
gggaggcuga

SEQ ID NO: 3742645 - RNA, 13 nt, Human
gggaggcugacuc

SEQ ID NO: 3742646 - RNA, 20 nt, Human
gggaggcugacuccuggucc

SEQ ID NO: 3742647 - RNA, 13 nt, Human
gggaggcuucccc

SEQ ID NO: 3742648 - RNA, 20 nt, Human
gggagggaaaagggaaguag

SEQ ID NO: 3742649 - RNA, 15 nt, Human
gggagggaagggagc

SEQ ID NO: 3742650 - RNA, 13 nt, Human
gggagggauggcc

SEQ ID NO: 3742651 - RNA, 11 nt, Human
gggagggauua

SEQ ID NO: 3742652 - RNA, 18 nt, Human
gggagggcagagcuggug

SEQ ID NO: 3742653 - RNA, 11 nt, Human
gggagggcagc

SEQ ID NO: 3742654 - RNA, 13 nt, Human
gggagggccuggg

SEQ ID NO: 3742655 - RNA, 14 nt, Human
gggagggcuccaga

SEQ ID NO: 3742656 - RNA, 15 nt, Human
gggagggcucugagg

SEQ ID NO: 3742657 - RNA, 16 nt, Human
gggagggcucugaggc

SEQ ID NO: 3742658 - RNA, 10 nt, Human
gggaggggcg

SEQ ID NO: 3742659 - RNA, 21 nt, Human
gggaggggcgcuggcccagcc

SEQ ID NO: 3742660 - RNA, 16 nt, Human
gggagggggagaaaag

SEQ ID NO: 3742661 - RNA, 15 nt, Human
gggagggggauccga

SEQ ID NO: 3742662 - RNA, 15 nt, Human
gggaggguaccagca

SEQ ID NO: 3742663 - RNA, 17 nt, Human
gggaggucaggcccugg

SEQ ID NO: 3742664 - RNA, 16 nt, Human
gggaggugaccccagg

SEQ ID NO: 3742665 - RNA, 18 nt, Human
gggaggugagaccaccuc

SEQ ID NO: 3742666 - RNA, 20 nt, Human
gggagguggagguugcauug

SEQ ID NO: 3742667 - RNA, 17 nt, Human
gggaggugggauccucc

SEQ ID NO: 3742668 - RNA, 20 nt, Human
gggagguguuuaaagagagg

SEQ ID NO: 3742669 - RNA, 22 nt, Human
gggagguguuuaaagagagguu

SEQ ID NO: 3742670 - RNA, 19 nt, Human
gggagguuuucucccccag

SEQ ID NO: 3742671 - RNA, 16 nt, Human
gggaguaugcaaaagu

SEQ ID NO: 3742672 - RNA, 16 nt, Human
gggagucaccuucccu

SEQ ID NO: 3742673 - RNA, 16 nt, Human
gggaguccaggcacag

SEQ ID NO: 3742674 - RNA, 18 nt, Human
gggagugacagaggcagc

SEQ ID NO: 3742675 - RNA, 11 nt, Human
gggagugagcu

SEQ ID NO: 3742676 - RNA, 23 nt, Human
gggagugcuggcucacaguacag

SEQ ID NO: 3742677 - RNA, 17 nt, Human
gggaguggaguggaaga

SEQ ID NO: 3742678 - RNA, 17 nt, Human
gggaguggccacagaaa

SEQ ID NO: 3742679 - RNA, 18 nt, Human
gggagugggacagagucu

SEQ ID NO: 3742680 - RNA, 19 nt, Human
gggaguggggaagugaucu

SEQ ID NO: 3742681 - RNA, 11 nt, Human
gggagugggug

SEQ ID NO: 3742682 - RNA, 21 nt, Human
gggagugugguuucuuuuuga

SEQ ID NO: 3742683 - RNA, 13 nt, Human
gggagugugugcc

SEQ ID NO: 3742684 - RNA, 12 nt, Human
gggaguguuccc

SEQ ID NO: 3742685 - RNA, 16 nt, Human
gggaguuaagaccugg

SEQ ID NO: 3742686 - RNA, 20 nt, Human
gggaguuaagaccuggcagc

SEQ ID NO: 3742687 - RNA, 22 nt, Human
gggaguugucaagucucugcug

SEQ ID NO: 3742688 - RNA, 20 nt, Human
gggauaacccuacacccaga

SEQ ID NO: 3742689 - RNA, 13 nt, Human
gggauacaugcuc

SEQ ID NO: 3742690 - RNA, 13 nt, Human
gggauacugcagg

SEQ ID NO: 3742691 - RNA, 13 nt, Human
gggauagagagag

SEQ ID NO: 3742692 - RNA, 15 nt, Human
gggauaggggcagag

SEQ ID NO: 3742693 - RNA, 19 nt, Human
gggauagucaccuuuuaaa

SEQ ID NO: 3742694 - RNA, 23 nt, Human
gggaucaaaguucugcuuucucc

SEQ ID NO: 3742695 - RNA, 13 nt, Human
gggaucacagaga

SEQ ID NO: 3742696 - RNA, 14 nt, Human
gggaucacagggcc

SEQ ID NO: 3742697 - RNA, 15 nt, Human
gggcugcccgcuccc

SEQ ID NO: 3742698 - RNA, 13 nt, Human
gggcugcccugcc

SEQ ID NO: 3742699 - RNA, 13 nt, Human
gggcugcccuggu

SEQ ID NO: 3742700 - RNA, 15 nt, Human
gggcugcccuggugc

SEQ ID NO: 3742701 - RNA, 14 nt, Human
gggcugccugggcu

SEQ ID NO: 3742702 - RNA, 15 nt, Human
gggcugccugggcug

SEQ ID NO: 3742703 - RNA, 19 nt, Human
gggcugccugggcuguugg

SEQ ID NO: 3742704 - RNA, 21 nt, Human
gggcugccugggcuguuggca

SEQ ID NO: 3742705 - RNA, 20 nt, Human
gggcugcggcguacaggcug

SEQ ID NO: 3742706 - RNA, 22 nt, Human
gggcugcggcguacaggcuggc

SEQ ID NO: 3742707 - RNA, 23 nt, Human
gggcugcucccaccuggcucugu

SEQ ID NO: 3742708 - RNA, 14 nt, Human
gggcugcuccucau

SEQ ID NO: 3742709 - RNA, 19 nt, Human
gggcugcuccuccagggcc

SEQ ID NO: 3742710 - RNA, 11 nt, Human
gggcuggaaca

SEQ ID NO: 3742711 - RNA, 21 nt, Human
gggcuggaaucuggagagcua

SEQ ID NO: 3742712 - RNA, 14 nt, Human
gggcuggacugagg

SEQ ID NO: 3742713 - RNA, 16 nt, Human
gggcuggacuggcugu

SEQ ID NO: 3742714 - RNA, 18 nt, Human
gggcuggacuucuaccug

SEQ ID NO: 3742715 - RNA, 11 nt, Human
gggcuggagaa

SEQ ID NO: 3742716 - RNA, 13 nt, Human
gggcuggaggagc

SEQ ID NO: 3742717 - RNA, 19 nt, Human
gggcuggaggcccaggcug

SEQ ID NO: 3742718 - RNA, 15 nt, Human
gggcuggaugagcuc

SEQ ID NO: 3742719 - RNA, 18 nt, Human
gggcuggaugagcuccca

SEQ ID NO: 3742720 - RNA, 17 nt, Human
gggcuggcccagcccug

SEQ ID NO: 3742721 - RNA, 22 nt, Human
gggcuggccccagggcacccug

SEQ ID NO: 3742722 - RNA, 15 nt, Human
gggcuggccuaggag

SEQ ID NO: 3742723 - RNA, 11 nt, Human
gggcuggcugg

SEQ ID NO: 3742724 - RNA, 17 nt, Human
gggcuggcuucaggagg

SEQ ID NO: 3742725 - RNA, 17 nt, Human
gggcugggcacugcucu

SEQ ID NO: 3742726 - RNA, 12 nt, Human
gggcugggcaga

SEQ ID NO: 3742727 - RNA, 15 nt, Human
gggcugggcagagga

SEQ ID NO: 3742728 - RNA, 12 nt, Human
gggcuggggagg

SEQ ID NO: 3742729 - RNA, 22 nt, Human
gggcuggggcaggaggggagug

SEQ ID NO: 3742730 - RNA, 21 nt, Human
gggcugggggaugggccugag

SEQ ID NO: 3742731 - RNA, 19 nt, Human
gggcuggguuggcgcaccc

SEQ ID NO: 3742732 - RNA, 17 nt, Human
gggcugguagcucaggu

SEQ ID NO: 3742733 - RNA, 15 nt, Human
gggcuggugccagcc

SEQ ID NO: 3742734 - RNA, 16 nt, Human
gggcuggugccagccu

SEQ ID NO: 3742735 - RNA, 17 nt, Human
gggcuggugccagccuu

SEQ ID NO: 3742736 - RNA, 19 nt, Human
gggcuggugggugccuagg

SEQ ID NO: 3742737 - RNA, 23 nt, Human
gggcugguucuguaauugugugu

SEQ ID NO: 3742738 - RNA, 17 nt, Human
gggcuguaacugccagg

SEQ ID NO: 3742739 - RNA, 19 nt, Human
gggcuguaacugccaggcu

SEQ ID NO: 3742740 - RNA, 11 nt, Human
gggcugugcua

SEQ ID NO: 3742741 - RNA, 20 nt, Human
gggcuuaauggaguucuugu

SEQ ID NO: 3742742 - RNA, 14 nt, Human
gggcuuagagcagu

SEQ ID NO: 3742743 - RNA, 24 nt, Human
gggcuuagagcaguuucuguccug

SEQ ID NO: 3742744 - RNA, 20 nt, Human
gggcuuauaauaaaggacug

SEQ ID NO: 3742745 - RNA, 14 nt, Human
gggcuuauaucugg

SEQ ID NO: 3742746 - RNA, 17 nt, Human
gggcuucagcugccagu

SEQ ID NO: 3742747 - RNA, 16 nt, Human
gggcuucaguggcagc

SEQ ID NO: 3742748 - RNA, 19 nt, Human
gggcuucaguggcagcugc

SEQ ID NO: 3742749 - RNA, 13 nt, Human
gggcuucauacac

SEQ ID NO: 3742750 - RNA, 22 nt, Human
gggcuucccaguggcugcugcc

SEQ ID NO: 3742751 - RNA, 19 nt, Human
gggcuuccucuagaagcca

SEQ ID NO: 3742752 - RNA, 12 nt, Human
gggcuuccugga

SEQ ID NO: 3742753 - RNA, 14 nt, Human
gggcuuccuggagc

SEQ ID NO: 3742754 - RNA, 21 nt, Human
gggcuuccuggagcagaagca

SEQ ID NO: 3742755 - RNA, 16 nt, Human
gggcuucuccugaccc

SEQ ID NO: 3742756 - RNA, 23 nt, Human
gggcuucugcacccuccacccug

SEQ ID NO: 3742757 - RNA, 19 nt, Human
gggcuucugugcaccuggg

SEQ ID NO: 3742758 - RNA, 13 nt, Human
gggcuugacuuuu

SEQ ID NO: 3742759 - RNA, 16 nt, Human
gggcuugacuuuugua

SEQ ID NO: 3742760 - RNA, 16 nt, Human
gggcuuggccugcugu

SEQ ID NO: 3742761 - RNA, 11 nt, Human
gggcuugggcc

SEQ ID NO: 3742762 - RNA, 15 nt, Human
gggcuugggccuagg

SEQ ID NO: 3742763 - RNA, 17 nt, Human
gggcuuguaguucuuua

SEQ ID NO: 3742764 - RNA, 13 nt, Human
gggcuugugaaca

SEQ ID NO: 3742765 - RNA, 22 nt, Human
gggcuuugauguuccuuccagu

SEQ ID NO: 3742766 - RNA, 20 nt, Human
gggcuuugauuccaucuccu

SEQ ID NO: 3742767 - RNA, 14 nt, Human
ggggaaaaaaaugu

SEQ ID NO: 3742768 - RNA, 24 nt, Human
ggggaaaaucagccugcuccagcu

SEQ ID NO: 3742769 - RNA, 17 nt, Human
ggggaaacagguuggga

SEQ ID NO: 3742770 - RNA, 18 nt, Human
ggggaacucagauccagg

SEQ ID NO: 3742771 - RNA, 21 nt, Human
ggggaacucagauccagggac

SEQ ID NO: 3742772 - RNA, 13 nt, Human
ggggaacuccugg

SEQ ID NO: 3742773 - RNA, 13 nt, Human
ggggaacuggcca

SEQ ID NO: 3742774 - RNA, 21 nt, Human
ggggaacuggccaagcugagg

SEQ ID NO: 3742775 - RNA, 16 nt, Human
ggggaagacaguggcc

SEQ ID NO: 3742776 - RNA, 17 nt, Human
ggggaagacaguggccc

SEQ ID NO: 3742777 - RNA, 21 nt, Human
ggggaagacccauuccuuccc

SEQ ID NO: 3742778 - RNA, 22 nt, Human
ggggaagacccauuccuuccca

SEQ ID NO: 3742779 - RNA, 18 nt, Human
ggggaagagcacagcccu

SEQ ID NO: 3742780 - RNA, 19 nt, Human
ggggaagcugcagcuuggg

SEQ ID NO: 3742781 - RNA, 21 nt, Human
ggggaauauuuuauucaaggu

SEQ ID NO: 3742782 - RNA, 21 nt, Human
ggggaaugagcccagagaaca

SEQ ID NO: 3742783 - RNA, 20 nt, Human
ggggaaugagggggcucagu

SEQ ID NO: 3742784 - RNA, 18 nt, Human
ggggaauguuugccucug

SEQ ID NO: 3742785 - RNA, 20 nt, Human
ggggaauucucagugccaac

SEQ ID NO: 3742786 - RNA, 22 nt, Human
ggggacagaggccugcccgggc

SEQ ID NO: 3742787 - RNA, 13 nt, Human
ggggacagcugug

SEQ ID NO: 3742788 - RNA, 12 nt, Human
ggggacaggccu

SEQ ID NO: 3742789 - RNA, 19 nt, Human
ggggacagggcuggcccag

SEQ ID NO: 3742790 - RNA, 12 nt, Human
ggggaccagagc

SEQ ID NO: 3742791 - RNA, 13 nt, Human
ggggaccagagcu

SEQ ID NO: 3742792 - RNA, 14 nt, Human
ggggaccagcagcc

SEQ ID NO: 3742793 - RNA, 12 nt, Human
ggggaccaggag

SEQ ID NO: 3742794 - RNA, 13 nt, Human
ggggaccaggagu

SEQ ID NO: 3742795 - RNA, 13 nt, Human
guaaauguaaacu

SEQ ID NO: 3742796 - RNA, 15 nt, Human
guaaauguaguucau

SEQ ID NO: 3742797 - RNA, 14 nt, Human
guaaaugucuuugu

SEQ ID NO: 3742798 - RNA, 15 nt, Human
guaaaugucuuugua

SEQ ID NO: 3742799 - RNA, 16 nt, Human
guaaauguuaguuucu

SEQ ID NO: 3742800 - RNA, 15 nt, Human
guaaauguuauuucu

SEQ ID NO: 3742801 - RNA, 17 nt, Human
guaaauguuuagguuuu

SEQ ID NO: 3742802 - RNA, 14 nt, Human
guaaauguuucuuu

SEQ ID NO: 3742803 - RNA, 21 nt, Human
guaaauguuuguuaaaaauaa

SEQ ID NO: 3742804 - RNA, 15 nt, Human
guaaauuaacuuuua

SEQ ID NO: 3742805 - RNA, 16 nt, Human
guaaauuaacuuuuau

SEQ ID NO: 3742806 - RNA, 17 nt, Human
guaaauuaacuuuuaua

SEQ ID NO: 3742807 - RNA, 21 nt, Human
guaaauuaacuuuuauaaacu

SEQ ID NO: 3742808 - RNA, 23 nt, Human
guaaauuaacuuuuauaaacuuu

SEQ ID NO: 3742809 - RNA, 19 nt, Human
guaaauuauauuugugcua

SEQ ID NO: 3742810 - RNA, 22 nt, Human
guaaauuauuaauuuaugcaga

SEQ ID NO: 3742811 - RNA, 15 nt, Human
guaaauuauucaguu

SEQ ID NO: 3742812 - RNA, 14 nt, Human
guaaauuauuuuaa

SEQ ID NO: 3742813 - RNA, 22 nt, Human
guaaauuauuuuaaauuauaag

SEQ ID NO: 3742814 - RNA, 12 nt, Human
guaaauucugau

SEQ ID NO: 3742815 - RNA, 14 nt, Human
guaaauucugauuu

SEQ ID NO: 3742816 - RNA, 15 nt, Human
guaaauucugauuuc

SEQ ID NO: 3742817 - RNA, 22 nt, Human
guaaauuggcauggaaauuuaa

SEQ ID NO: 3742818 - RNA, 19 nt, Human
guaaauuuccccaacagug

SEQ ID NO: 3742819 - RNA, 13 nt, Human
guaaauuuguacu

SEQ ID NO: 3742820 - RNA, 15 nt, Human
guaaauuuguacuau

SEQ ID NO: 3742821 - RNA, 12 nt, Human
guaacaagaaaa

SEQ ID NO: 3742822 - RNA, 14 nt, Human
guaacaagaaaaca

SEQ ID NO: 3742823 - RNA, 14 nt, Human
guaacaagaaagga

SEQ ID NO: 3742824 - RNA, 14 nt, Human
guaacaagccagau

SEQ ID NO: 3742825 - RNA, 15 nt, Human
guaacaagccagauu

SEQ ID NO: 3742826 - RNA, 19 nt, Human
guaacaauacaaauggauu

SEQ ID NO: 3742827 - RNA, 19 nt, Human
guaacaauuuuaaugcuau

SEQ ID NO: 3742828 - RNA, 22 nt, Human
guaacacagcugagagacuuuu

SEQ ID NO: 3742829 - RNA, 14 nt, Human
guaacacaggccac

SEQ ID NO: 3742830 - RNA, 17 nt, Human
guaacacuuuacaaugu

SEQ ID NO: 3742831 - RNA, 12 nt, Human
guaacagaaagg

SEQ ID NO: 3742832 - RNA, 16 nt, Human
guaacagaaagggcaa

SEQ ID NO: 3742833 - RNA, 21 nt, Human
guaacagaaagggcaacaaua

SEQ ID NO: 3742834 - RNA, 15 nt, Human
guaacagaacagcuu

SEQ ID NO: 3742835 - RNA, 21 nt, Human
guaacagaacagcuucagguu

SEQ ID NO: 3742836 - RNA, 16 nt, Human
guaacagacauuguuu

SEQ ID NO: 3742837 - RNA, 12 nt, Human
guaacagcuccu

SEQ ID NO: 3742838 - RNA, 17 nt, Human
guaacagcuccuuggga

SEQ ID NO: 3742839 - RNA, 19 nt, Human
guaacaggaaaauuuuaaa

SEQ ID NO: 3742840 - RNA, 17 nt, Human
guaacaguucauguuug

SEQ ID NO: 3742841 - RNA, 18 nt, Human
guaacaguucauguuugc

SEQ ID NO: 3742842 - RNA, 20 nt, Human
guaacaguucauguuugcuu

SEQ ID NO: 3742843 - RNA, 22 nt, Human
guaacaguucauguuugcuuca

SEQ ID NO: 3742844 - RNA, 14 nt, Human
guaacauaauaaau

SEQ ID NO: 3742845 - RNA, 14 nt, Human
guaacauaugcaaa

SEQ ID NO: 3742846 - RNA, 15 nt, Human
guaacauaugcaaac

SEQ ID NO: 3742847 - RNA, 19 nt, Human
guaacauaugcaaacauaa

SEQ ID NO: 3742848 - RNA, 20 nt, Human
guaacaucacuauccaugca

SEQ ID NO: 3742849 - RNA, 22 nt, Human
guaacauguuuacuuuucaggg

SEQ ID NO: 3742850 - RNA, 22 nt, Human
guaacauuugcuguuuuaaaca

SEQ ID NO: 3742851 - RNA, 12 nt, Human
guaaccagccag

SEQ ID NO: 3742852 - RNA, 21 nt, Human
guaacccuggugguugcuguu

SEQ ID NO: 3742853 - RNA, 17 nt, Human
guaaccucagcucuggg

SEQ ID NO: 3742854 - RNA, 20 nt, Human
guaaccucuucagaggcccu

SEQ ID NO: 3742855 - RNA, 20 nt, Human
guaaccugagauggcccucu

SEQ ID NO: 3742856 - RNA, 21 nt, Human
guaaccugagauggcccucug

SEQ ID NO: 3742857 - RNA, 16 nt, Human
guaacgcgucuuccug

SEQ ID NO: 3742858 - RNA, 17 nt, Human
guaacgcgucuuccuga

SEQ ID NO: 3742859 - RNA, 15 nt, Human
guaacuaaaauaauu

SEQ ID NO: 3742860 - RNA, 20 nt, Human
guaacuaaaauaauuuugua

SEQ ID NO: 3742861 - RNA, 22 nt, Human
guaacuaaaauaauuuuguaau

SEQ ID NO: 3742862 - RNA, 16 nt, Human
guaacuaacuaaaaca

SEQ ID NO: 3742863 - RNA, 15 nt, Human
guaacucaucuguca

SEQ ID NO: 3742864 - RNA, 22 nt, Human
guaacugcauugagaacugcau

SEQ ID NO: 3742865 - RNA, 15 nt, Human
guaacugcugaaaac

SEQ ID NO: 3742866 - RNA, 15 nt, Human
guaacugcuuucugu

SEQ ID NO: 3742867 - RNA, 17 nt, Human
guaacugcuuucuguuc

SEQ ID NO: 3742868 - RNA, 20 nt, Human
guaacugcuuucuguuccaa

SEQ ID NO: 3742869 - RNA, 14 nt, Human
guaacuggcugugu

SEQ ID NO: 3742870 - RNA, 17 nt, Human
guaacuguccuguccug

SEQ ID NO: 3742871 - RNA, 21 nt, Human
guaacuguccuguccugcuca

SEQ ID NO: 3742872 - RNA, 22 nt, Human
guaacuguuaaauugcugugua

SEQ ID NO: 3742873 - RNA, 17 nt, Human
guaacuguuaccauugg

SEQ ID NO: 3742874 - RNA, 21 nt, Human
guaacuguuaccauuggaaau

SEQ ID NO: 3742875 - RNA, 22 nt, Human
guaacuguuuagaugaauguca

SEQ ID NO: 3742876 - RNA, 14 nt, Human
guaacuuaaaauag

SEQ ID NO: 3742877 - RNA, 23 nt, Human
guaacuuauauugaagacaauuu

SEQ ID NO: 3742878 - RNA, 21 nt, Human
guaacuucuuauggaauugau

SEQ ID NO: 3742879 - RNA, 16 nt, Human
guaacuuuauguguaa

SEQ ID NO: 3742880 - RNA, 19 nt, Human
guaacuuuuguaaauacac

SEQ ID NO: 3742881 - RNA, 13 nt, Human
guaagaaaauauu

SEQ ID NO: 3742882 - RNA, 23 nt, Human
guaagaaaauauuuugucuaaaa

SEQ ID NO: 3742883 - RNA, 18 nt, Human
guaagaacaacuaccuga

SEQ ID NO: 3742884 - RNA, 16 nt, Human
guaagaacuaaagaag

SEQ ID NO: 3742885 - RNA, 13 nt, Human
guaagaagagacu

SEQ ID NO: 3742886 - RNA, 15 nt, Human
guaagaagagacugg

SEQ ID NO: 3742887 - RNA, 11 nt, Human
guaagaagccg

SEQ ID NO: 3742888 - RNA, 13 nt, Human
guaagaaggcaau

SEQ ID NO: 3742889 - RNA, 13 nt, Human
guaagaaucauug

SEQ ID NO: 3742890 - RNA, 13 nt, Human
guaagaauucuga

SEQ ID NO: 3742891 - RNA, 21 nt, Human
guaagaccggaagcuccuggu

SEQ ID NO: 3742892 - RNA, 19 nt, Human
guaagagaaaagagagaaa

SEQ ID NO: 3742893 - RNA, 17 nt, Human
guaagagcaccuuccuc

SEQ ID NO: 3742894 - RNA, 14 nt, Human
guaagagcuggugu

SEQ ID NO: 3742895 - RNA, 16 nt, Human
guaagagcuggugucu

SEQ ID NO: 3742896 - RNA, 17 nt, Human
guaagagcuuuacaaaa

SEQ ID NO: 3742897 - RNA, 20 nt, Human
guaagaucacuguuuagauu

SEQ ID NO: 3742898 - RNA, 17 nt, Human
guaagaucucuuucuaa

SEQ ID NO: 3742899 - RNA, 14 nt, Human
guaagaugucuguu

SEQ ID NO: 3742900 - RNA, 18 nt, Human
guaagauuauagauucua

SEQ ID NO: 3742901 - RNA, 20 nt, Human
guaagauuauagauucuaaa

SEQ ID NO: 3742902 - RNA, 21 nt, Human
guaagauuauagauucuaaag

SEQ ID NO: 3742903 - RNA, 22 nt, Human
guaagauuauagauucuaaaga

SEQ ID NO: 3742904 - RNA, 23 nt, Human
guaagauuauagauucuaaagau

SEQ ID NO: 3742905 - RNA, 21 nt, Human
guaagauuguuauuaaaugua

SEQ ID NO: 3742906 - RNA, 18 nt, Human
guaagauuuccuucuuuu

SEQ ID NO: 3742907 - RNA, 17 nt, Human
guaagauuuguuuuuaa

SEQ ID NO: 3742908 - RNA, 21 nt, Human
guaagauuuguuuuuaaacug

SEQ ID NO: 3742909 - RNA, 13 nt, Human
guaagauuuugaa

SEQ ID NO: 3742910 - RNA, 20 nt, Human
guaagcacugacugggacca

SEQ ID NO: 3742911 - RNA, 17 nt, Human
guaagcacuguuuuucc

SEQ ID NO: 3742912 - RNA, 20 nt, Human
guaagcaggagagaaauuuc

SEQ ID NO: 3742913 - RNA, 23 nt, Human
guaagcauaagcuuaugcuuaaa

SEQ ID NO: 3742914 - RNA, 17 nt, Human
guaagccaaagaaauga

SEQ ID NO: 3742915 - RNA, 13 nt, Human
guaagccucauca

SEQ ID NO: 3742916 - RNA, 16 nt, Human
guaagcggcucaagcc

SEQ ID NO: 3742917 - RNA, 14 nt, Human
guaagcguauggcu

SEQ ID NO: 3742918 - RNA, 17 nt, Human
guaagcucuggcuuucu

SEQ ID NO: 3742919 - RNA, 11 nt, Human
guaagcucuuu

SEQ ID NO: 3742920 - RNA, 20 nt, Human
guaagcucuuugaaacaacu

SEQ ID NO: 3742921 - RNA, 20 nt, Human
guaaggaauaccuguccccc

SEQ ID NO: 3742922 - RNA, 13 nt, Human
guaaggaaugauu

SEQ ID NO: 3742923 - RNA, 20 nt, Human
guaaggcuguguacacugac

SEQ ID NO: 3742924 - RNA, 16 nt, Human
guaaggugcaguuccc

SEQ ID NO: 3742925 - RNA, 12 nt, Human
guaaggugccuu

SEQ ID NO: 3742926 - RNA, 17 nt, Human
guaaguaaaugucugug

SEQ ID NO: 3742927 - RNA, 23 nt, Human
guaaguaauuaucgggaacagug

SEQ ID NO: 3742928 - RNA, 15 nt, Human
guaaguaauuaugca

SEQ ID NO: 3742929 - RNA, 19 nt, Human
guaaguacagagaagccau

SEQ ID NO: 3742930 - RNA, 19 nt, Human
guaagucaguguugagaug

SEQ ID NO: 3742931 - RNA, 12 nt, Human
guaagucuuuuu

SEQ ID NO: 3742932 - RNA, 16 nt, Human
guaagugcuacauaaa

SEQ ID NO: 3742933 - RNA, 18 nt, Human
guaaguuaauaagcaaaa

SEQ ID NO: 3742934 - RNA, 21 nt, Human
guaaguuccuacuaggcaaaa

SEQ ID NO: 3742935 - RNA, 23 nt, Human
guaaguugaauggccugccuuga

SEQ ID NO: 3742936 - RNA, 17 nt, Human
guaaguugggcuugcua

SEQ ID NO: 3742937 - RNA, 18 nt, Human
guaaguugggcuugcuau

SEQ ID NO: 3742938 - RNA, 19 nt, Human
guaaguuuaugucuaaaga

SEQ ID NO: 3742939 - RNA, 22 nt, Human
guaaguuucaggugacauguga

SEQ ID NO: 3742940 - RNA, 12 nt, Human
guaauaaacuau

SEQ ID NO: 3742941 - RNA, 14 nt, Human
guaauaaacuauuu

SEQ ID NO: 3742942 - RNA, 15 nt, Human
guaauaaagacucua

SEQ ID NO: 3742943 - RNA, 15 nt, Human
guaauaaaguauaua

SEQ ID NO: 3742944 - RNA, 17 nt, Human
guaauaaaguguuuuca

SEQ ID NO: 3742945 - RNA, 13 nt, Human
gaauguaaucaau

SEQ ID NO: 3742946 - RNA, 16 nt, Human
gaauguaaucaauguu

SEQ ID NO: 3742947 - RNA, 13 nt, Human
gaauguaauuugu

SEQ ID NO: 3742948 - RNA, 21 nt, Human
gaauguagcagccccgggagg

SEQ ID NO: 3742949 - RNA, 23 nt, Human
gaauguagcagccccgggagggc

SEQ ID NO: 3742950 - RNA, 22 nt, Human
gaauguauaguauuugaaaaca

SEQ ID NO: 3742951 - RNA, 21 nt, Human
gaauguauauguuuuguggga

SEQ ID NO: 3742952 - RNA, 21 nt, Human
gaauguaugcuucauacaggg

SEQ ID NO: 3742953 - RNA, 23 nt, Human
gaauguauuguaccuuuuaacac

SEQ ID NO: 3742954 - RNA, 14 nt, Human
gaaugucaguguga

SEQ ID NO: 3742955 - RNA, 17 nt, Human
gaaugugauuuuaaaga

SEQ ID NO: 3742956 - RNA, 21 nt, Human
gaaugugcagguuuguuacau

SEQ ID NO: 3742957 - RNA, 13 nt, Human
gaauguggucuca

SEQ ID NO: 3742958 - RNA, 19 nt, Human
gaauguguuucaaacugua

SEQ ID NO: 3742959 - RNA, 19 nt, Human
gaauguuaagaauugacca

SEQ ID NO: 3742960 - RNA, 20 nt, Human
gaauguuaagacuugacagu

SEQ ID NO: 3742961 - RNA, 14 nt, Human
gaauguuaagcaga

SEQ ID NO: 3742962 - RNA, 15 nt, Human
gaauguuaagcagau

SEQ ID NO: 3742963 - RNA, 21 nt, Human
gaauguuccugccuccuugau

SEQ ID NO: 3742964 - RNA, 15 nt, Human
gaauguucugacauu

SEQ ID NO: 3742965 - RNA, 17 nt, Human
gaauguucugacauuaa

SEQ ID NO: 3742966 - RNA, 14 nt, Human
gaauguuggauaag

SEQ ID NO: 3742967 - RNA, 20 nt, Human
gaauguugguuuacuuucaa

SEQ ID NO: 3742968 - RNA, 16 nt, Human
gaauguuuauagcaaa

SEQ ID NO: 3742969 - RNA, 22 nt, Human
gaauguuucauuugcacaagua

SEQ ID NO: 3742970 - RNA, 13 nt, Human
gaauguuuccggg

SEQ ID NO: 3742971 - RNA, 14 nt, Human
gaauguuugucuca

SEQ ID NO: 3742972 - RNA, 20 nt, Human
gaauguuuuagcacagcguu

SEQ ID NO: 3742973 - RNA, 17 nt, Human
gaauguuuucaaauguu

SEQ ID NO: 3742974 - RNA, 15 nt, Human
gaauguuuuccuucu

SEQ ID NO: 3742975 - RNA, 14 nt, Human
gaauuaaaacuucu

SEQ ID NO: 3742976 - RNA, 17 nt, Human
gaauuaaaacuucuuaa

SEQ ID NO: 3742977 - RNA, 19 nt, Human
gaauuaaaaggauaguauu

SEQ ID NO: 3742978 - RNA, 18 nt, Human
gaauuaaaagucauuuaa

SEQ ID NO: 3742979 - RNA, 20 nt, Human
gaauuaaauuaggaauaaau

SEQ ID NO: 3742980 - RNA, 13 nt, Human
gaauuaaauuuaa

SEQ ID NO: 3742981 - RNA, 14 nt, Human
gaauuaacacauga

SEQ ID NO: 3742982 - RNA, 19 nt, Human
gaauuaaccuggugcugga

SEQ ID NO: 3742983 - RNA, 22 nt, Human
gaauuaaccuggugcuggauau

SEQ ID NO: 3742984 - RNA, 13 nt, Human
gaauuaagaauau

SEQ ID NO: 3742985 - RNA, 16 nt, Human
gaauuaagaggauaca

SEQ ID NO: 3742986 - RNA, 18 nt, Human
gaauuaaguuagggaaug

SEQ ID NO: 3742987 - RNA, 21 nt, Human
gaauuaaguuagggaauggca

SEQ ID NO: 3742988 - RNA, 22 nt, Human
gaauuaauaucccuacauguau

SEQ ID NO: 3742989 - RNA, 17 nt, Human
gaauuaauuaauuugga

SEQ ID NO: 3742990 - RNA, 23 nt, Human
gaauuacaauuacuccuuuuauu

SEQ ID NO: 3742991 - RNA, 15 nt, Human
gaauuacauuuguau

SEQ ID NO: 3742992 - RNA, 18 nt, Human
gaauuacauuuguauaaa

SEQ ID NO: 3742993 - RNA, 14 nt, Human
gaauuaccauuugu

SEQ ID NO: 3742994 - RNA, 16 nt, Human
gaauuacuaacuucua

SEQ ID NO: 3742995 - RNA, 18 nt, Human
gaauuacuaacuucuaaa

SEQ ID NO: 3742996 - RNA, 16 nt, Human
gaauuacuuuuuucca

SEQ ID NO: 3742997 - RNA, 15 nt, Human
gaauuaggcuguaac

SEQ ID NO: 3742998 - RNA, 19 nt, Human
gaauuaggcuguaacuacu

SEQ ID NO: 3742999 - RNA, 23 nt, Human
gaauuaggcuguaacuacuuuau

SEQ ID NO: 3743000 - RNA, 16 nt, Human
gaauuauaaaagccag

SEQ ID NO: 3743001 - RNA, 14 nt, Human
gaauuaucuaauuu

SEQ ID NO: 3743002 - RNA, 12 nt, Human
gaauuaugaaac

SEQ ID NO: 3743003 - RNA, 15 nt, Human
gaauuauugacacug

SEQ ID NO: 3743004 - RNA, 14 nt, Human
gaauuauuucuguc

SEQ ID NO: 3743005 - RNA, 13 nt, Human
gaauuauuuuaaa

SEQ ID NO: 3743006 - RNA, 21 nt, Human
gaauucaaacuggggccucca

SEQ ID NO: 3743007 - RNA, 22 nt, Human
gaauucacaaaguaauuuggaa

SEQ ID NO: 3743008 - RNA, 23 nt, Human
gaauucagaagaccccugacuca

SEQ ID NO: 3743009 - RNA, 13 nt, Human
gaauucagacauc

SEQ ID NO: 3743010 - RNA, 16 nt, Human
gaauucauucuggucu

SEQ ID NO: 3743011 - RNA, 14 nt, Human
gaauucccucacuc

SEQ ID NO: 3743012 - RNA, 17 nt, Human
gaauuccuucaggguga

SEQ ID NO: 3743013 - RNA, 17 nt, Human
gaauucggugugcacca

SEQ ID NO: 3743014 - RNA, 23 nt, Human
gaauucuaggcaucccaggggac

SEQ ID NO: 3743015 - RNA, 16 nt, Human
gaauucuagugcugcu

SEQ ID NO: 3743016 - RNA, 17 nt, Human
gaauucuagugcugcug

SEQ ID NO: 3743017 - RNA, 19 nt, Human
gaauucucuaguuugauua

SEQ ID NO: 3743018 - RNA, 14 nt, Human
gaauucuguauaga

SEQ ID NO: 3743019 - RNA, 19 nt, Human
gaauucuguucauuuguua

SEQ ID NO: 3743020 - RNA, 19 nt, Human
gaauucuguuuaauuuuca

SEQ ID NO: 3743021 - RNA, 19 nt, Human
gaauucuuacauguuuucu

SEQ ID NO: 3743022 - RNA, 18 nt, Human
gaauucuugaaggaaaau

SEQ ID NO: 3743023 - RNA, 19 nt, Human
gaauucuugguugaggaaa

SEQ ID NO: 3743024 - RNA, 14 nt, Human
gaauugaaaaguuu

SEQ ID NO: 3743025 - RNA, 17 nt, Human
gaauugaaaaguuuuug

SEQ ID NO: 3743026 - RNA, 14 nt, Human
gaauugaaacacuu

SEQ ID NO: 3743027 - RNA, 20 nt, Human
gaauugaaacacuuuuuugg

SEQ ID NO: 3743028 - RNA, 14 nt, Human
gaauugaagcagga

SEQ ID NO: 3743029 - RNA, 11 nt, Human
gaauugaaggu

SEQ ID NO: 3743030 - RNA, 18 nt, Human
gaauugaagguuuuugau

SEQ ID NO: 3743031 - RNA, 21 nt, Human
gaauugaccgacagcuuucca

SEQ ID NO: 3743032 - RNA, 17 nt, Human
gaauugagaugauuaaa

SEQ ID NO: 3743033 - RNA, 18 nt, Human
gaauugaggggauuaaua

SEQ ID NO: 3743034 - RNA, 15 nt, Human
gaauugaggucugcu

SEQ ID NO: 3743035 - RNA, 20 nt, Human
gaauugaucauuuucccccc

SEQ ID NO: 3743036 - RNA, 21 nt, Human
gaauugaucauuuucccccca

SEQ ID NO: 3743037 - RNA, 13 nt, Human
gaauugauuugca

SEQ ID NO: 3743038 - RNA, 15 nt, Human
gaauugauuugcauu

SEQ ID NO: 3743039 - RNA, 22 nt, Human
gaauugauuugcauugaacaca

SEQ ID NO: 3743040 - RNA, 20 nt, Human
gaauugccugcagagagaag

SEQ ID NO: 3743041 - RNA, 19 nt, Human
gaauuggaaugcacucaga

SEQ ID NO: 3743042 - RNA, 22 nt, Human
gaauuggaccauccuauuuaac

SEQ ID NO: 3743043 - RNA, 17 nt, Human
gaauugggagcuuggga

SEQ ID NO: 3743044 - RNA, 16 nt, Human
gaauugggcggcucug

SEQ ID NO: 3743045 - RNA, 17 nt, Human
gaauugggcggcucuga

SEQ ID NO: 3743046 - RNA, 14 nt, Human
gaauuguaucauuu

SEQ ID NO: 3743047 - RNA, 20 nt, Human
gaauuguggcuauccugauu

SEQ ID NO: 3743048 - RNA, 16 nt, Human
gaauugugguuuauau

SEQ ID NO: 3743049 - RNA, 22 nt, Human
gaauugugguuuauauauuuaa

SEQ ID NO: 3743050 - RNA, 16 nt, Human
gaauugugucugcagg

SEQ ID NO: 3743051 - RNA, 15 nt, Human
gaauuguuaguuucu

SEQ ID NO: 3743052 - RNA, 20 nt, Human
gaauuguuuagauuuugugu

SEQ ID NO: 3743053 - RNA, 22 nt, Human
gaauuguuuagauuuuguguuu

SEQ ID NO: 3743054 - RNA, 18 nt, Human
gaauuuaaaaauaagaaa

SEQ ID NO: 3743055 - RNA, 22 nt, Human
gaauuuaaagaaaaaaauguca

SEQ ID NO: 3743056 - RNA, 15 nt, Human
gaauuuaaauauaau

SEQ ID NO: 3743057 - RNA, 17 nt, Human
gaauuuaaauauaauuc

SEQ ID NO: 3743058 - RNA, 16 nt, Human
gaauuuaacaaugcga

SEQ ID NO: 3743059 - RNA, 17 nt, Human
gaauuuaacaaugcgaa

SEQ ID NO: 3743060 - RNA, 19 nt, Human
gaauuuagggagaaauguu

SEQ ID NO: 3743061 - RNA, 22 nt, Human
gaauuuauauacaaccugcuug

SEQ ID NO: 3743062 - RNA, 15 nt, Human
gaauuuaucuuugau

SEQ ID NO: 3743063 - RNA, 16 nt, Human
gaauuuaucuuugaua

SEQ ID NO: 3743064 - RNA, 17 nt, Human
gaauuuauuauuguucu

SEQ ID NO: 3743065 - RNA, 16 nt, Human
gaauuuauuggcuuuu

SEQ ID NO: 3743066 - RNA, 22 nt, Human
gaauuuauuggcuuuucugauc

SEQ ID NO: 3743067 - RNA, 18 nt, Human
gaauuucauaucuacaga

SEQ ID NO: 3743068 - RNA, 15 nt, Human
gaauuucccaaagca

SEQ ID NO: 3743069 - RNA, 18 nt, Human
gaauuucccaaagcagug

SEQ ID NO: 3743070 - RNA, 14 nt, Human
gaauuucccaggac

SEQ ID NO: 3743071 - RNA, 13 nt, Human
gaauuuccucuau

SEQ ID NO: 3743072 - RNA, 18 nt, Human
gaauuuccuuacucuuga

SEQ ID NO: 3743073 - RNA, 18 nt, Human
gaauuucuaaaaagauua

SEQ ID NO: 3743074 - RNA, 13 nt, Human
gaauuucuuaacu

SEQ ID NO: 3743075 - RNA, 19 nt, Human
gaauuucuuaacuucuugc

SEQ ID NO: 3743076 - RNA, 21 nt, Human
gaauuucuuaacuucuugcuu

SEQ ID NO: 3743077 - RNA, 20 nt, Human
gaauuucuucacuguugaaa

SEQ ID NO: 3743078 - RNA, 15 nt, Human
gaauuugaagacuuc

SEQ ID NO: 3743079 - RNA, 21 nt, Human
gaauuugaagacuucaaaaua

SEQ ID NO: 3743080 - RNA, 19 nt, Human
gaauuugaagcugcaguga

SEQ ID NO: 3743081 - RNA, 14 nt, Human
gaauuugaaucuca

SEQ ID NO: 3743082 - RNA, 14 nt, Human
gaauuugaaugaaa

SEQ ID NO: 3743083 - RNA, 16 nt, Human
gaauuugaaugaaaaa

SEQ ID NO: 3743084 - RNA, 15 nt, Human
gaauuugcaaaguac

SEQ ID NO: 3743085 - RNA, 23 nt, Human
gaauuugggacccugcuuuagag

SEQ ID NO: 3743086 - RNA, 16 nt, Human
gaauuuguaaccucag

SEQ ID NO: 3743087 - RNA, 21 nt, Human
gaauuuguaaccucagcucug

SEQ ID NO: 3743088 - RNA, 17 nt, Human
gaauuugugaacagcag

SEQ ID NO: 3743089 - RNA, 21 nt, Human
gaauuuguguugaaggaacuu

SEQ ID NO: 3743090 - RNA, 13 nt, Human
gaauuuguuauca

SEQ ID NO: 3743091 - RNA, 12 nt, Human
gaauuuuaaaag

SEQ ID NO: 3743092 - RNA, 23 nt, Human
gaauuuuaaaaucugagggaaau

SEQ ID NO: 3743093 - RNA, 20 nt, Human
gaauuuuaagccuuuguuga

SEQ ID NO: 3743094 - RNA, 11 nt, Human
ggggacccacg

SEQ ID NO: 3743095 - RNA, 13 nt, Human
ggggacccaggcu

SEQ ID NO: 3743096 - RNA, 19 nt, Human
ggggacccaggcuccgccc

SEQ ID NO: 3743097 - RNA, 13 nt, Human
ggggacccagugc

SEQ ID NO: 3743098 - RNA, 13 nt, Human
ggggaccucaggc

SEQ ID NO: 3743099 - RNA, 17 nt, Human
ggggaccucaggccugg

SEQ ID NO: 3743100 - RNA, 16 nt, Human
ggggaccuggaaggga

SEQ ID NO: 3743101 - RNA, 20 nt, Human
ggggaccuuuugggggaggg

SEQ ID NO: 3743102 - RNA, 23 nt, Human
ggggacggggggccccagucagc

SEQ ID NO: 3743103 - RNA, 15 nt, Human
ggggacucagcccug

SEQ ID NO: 3743104 - RNA, 16 nt, Human
ggggacucagcccuga

SEQ ID NO: 3743105 - RNA, 12 nt, Human
ggggacugcugc

SEQ ID NO: 3743106 - RNA, 21 nt, Human
ggggacuguaaguugggcuug

SEQ ID NO: 3743107 - RNA, 19 nt, Human
ggggacuuacaugauucau

SEQ ID NO: 3743108 - RNA, 15 nt, Human
ggggacuuggccucu

SEQ ID NO: 3743109 - RNA, 16 nt, Human
ggggagacaccucaga

SEQ ID NO: 3743110 - RNA, 17 nt, Human
ggggagacaccucagag

SEQ ID NO: 3743111 - RNA, 18 nt, Human
ggggagacugggcugagg

SEQ ID NO: 3743112 - RNA, 18 nt, Human
ggggagacuuugauguca

SEQ ID NO: 3743113 - RNA, 18 nt, Human
ggggagagccugcuggca

SEQ ID NO: 3743114 - RNA, 11 nt, Human
ggggagcccuc

SEQ ID NO: 3743115 - RNA, 16 nt, Human
ggggaggaccucuggg

SEQ ID NO: 3743116 - RNA, 13 nt, Human
ggggaggaggagg

SEQ ID NO: 3743117 - RNA, 12 nt, Human
ggggaggagggc

SEQ ID NO: 3743118 - RNA, 13 nt, Human
ggggaggccaagu

SEQ ID NO: 3743119 - RNA, 21 nt, Human
ggggaggccaagugcaggcug

SEQ ID NO: 3743120 - RNA, 15 nt, Human
ggggaggccaucugg

SEQ ID NO: 3743121 - RNA, 18 nt, Human
ggggaggcggcacuccaa

SEQ ID NO: 3743122 - RNA, 17 nt, Human
ggggaggguaggcagga

SEQ ID NO: 3743123 - RNA, 14 nt, Human
ggggagggugacag

SEQ ID NO: 3743124 - RNA, 20 nt, Human
ggggagggugacaguggccg

SEQ ID NO: 3743125 - RNA, 13 nt, Human
ggggaguggaaua

SEQ ID NO: 3743126 - RNA, 17 nt, Human
ggggaguuaagaccugg

SEQ ID NO: 3743127 - RNA, 21 nt, Human
ggggaguuaagaccuggcagc

SEQ ID NO: 3743128 - RNA, 13 nt, Human
ggggauagaugug

SEQ ID NO: 3743129 - RNA, 19 nt, Human
ggggaucauaaaguuagaa

SEQ ID NO: 3743130 - RNA, 13 nt, Human
ggggauccccgcc

SEQ ID NO: 3743131 - RNA, 13 nt, Human
ggggaucucaggg

SEQ ID NO: 3743132 - RNA, 20 nt, Human
ggggaugagagggugcuauc

SEQ ID NO: 3743133 - RNA, 21 nt, Human
ggggauuuccagccagggcug

SEQ ID NO: 3743134 - RNA, 15 nt, Human
ggggauuucucccag

SEQ ID NO: 3743135 - RNA, 15 nt, Human
ggggcaaacaccugc

SEQ ID NO: 3743136 - RNA, 16 nt, Human
ggggcaacccugguga

SEQ ID NO: 3743137 - RNA, 13 nt, Human
ggggcacaggagg

SEQ ID NO: 3743138 - RNA, 21 nt, Human
ggggcagacaauaaacccuca

SEQ ID NO: 3743139 - RNA, 13 nt, Human
ggggcagagccag

SEQ ID NO: 3743140 - RNA, 14 nt, Human
ggggcagagccagg

SEQ ID NO: 3743141 - RNA, 15 nt, Human
ggggcagagccuccc

SEQ ID NO: 3743142 - RNA, 17 nt, Human
ggggcagaggcaguacc

SEQ ID NO: 3743143 - RNA, 18 nt, Human
ggggcagagggcagaggc

SEQ ID NO: 3743144 - RNA, 22 nt, Human
ggggcagagggcagaggcugga

SEQ ID NO: 3743145 - RNA, 16 nt, Human
ggggcagcagcagugg

SEQ ID NO: 3743146 - RNA, 12 nt, Human
ggggcagccucu

SEQ ID NO: 3743147 - RNA, 20 nt, Human
ggggcagcugauacaaauug

SEQ ID NO: 3743148 - RNA, 14 nt, Human
ggggcagcugccag

SEQ ID NO: 3743149 - RNA, 19 nt, Human
ggggcaggaguagcugagc

SEQ ID NO: 3743150 - RNA, 21 nt, Human
ggggcaggaguagcugagcuc

SEQ ID NO: 3743151 - RNA, 10 nt, Human
ggggcaggca

SEQ ID NO: 3743152 - RNA, 13 nt, Human
ggggcaggcacag

SEQ ID NO: 3743153 - RNA, 15 nt, Human
ggggcaggcacagca

SEQ ID NO: 3743154 - RNA, 12 nt, Human
ggggcaggcagu

SEQ ID NO: 3743155 - RNA, 13 nt, Human
ggggcaggcuggg

SEQ ID NO: 3743156 - RNA, 17 nt, Human
ggggcagggagcugggc

SEQ ID NO: 3743157 - RNA, 20 nt, Human
ggggcagugcucacccacac

SEQ ID NO: 3743158 - RNA, 23 nt, Human
ggggcagugcuuggcccaggagu

SEQ ID NO: 3743159 - RNA, 16 nt, Human
ggggcaucuggccugg

SEQ ID NO: 3743160 - RNA, 17 nt, Human
ggggcaugaccagaugc

SEQ ID NO: 3743161 - RNA, 23 nt, Human
ggggcauguauuggccuggaggu

SEQ ID NO: 3743162 - RNA, 19 nt, Human
ggggcauugaguauuguuu

SEQ ID NO: 3743163 - RNA, 21 nt, Human
ggggcauugcugacuguguau

SEQ ID NO: 3743164 - RNA, 14 nt, Human
ggggccaccaaagc

SEQ ID NO: 3743165 - RNA, 18 nt, Human
ggggccaccaaagcugcc

SEQ ID NO: 3743166 - RNA, 15 nt, Human
ggggccaccugccug

SEQ ID NO: 3743167 - RNA, 12 nt, Human
ggggccagagga

SEQ ID NO: 3743168 - RNA, 13 nt, Human
ggggccagaucca

SEQ ID NO: 3743169 - RNA, 14 nt, Human
ggggccagauccag

SEQ ID NO: 3743170 - RNA, 13 nt, Human
ggggccaggcugg

SEQ ID NO: 3743171 - RNA, 14 nt, Human
ggggccaggcuggg

SEQ ID NO: 3743172 - RNA, 19 nt, Human
ggggccaugccuccucagg

SEQ ID NO: 3743173 - RNA, 23 nt, Human
ggggccaugccuccucaggagcc

SEQ ID NO: 3743174 - RNA, 21 nt, Human
ggggccauuugcaauaacagc

SEQ ID NO: 3743175 - RNA, 20 nt, Human
ggggcccaaaugcuggcugg

SEQ ID NO: 3743176 - RNA, 22 nt, Human
ggggcccaaggcggccccuccc

SEQ ID NO: 3743177 - RNA, 12 nt, Human
ggggcccagugc

SEQ ID NO: 3743178 - RNA, 17 nt, Human
ggggcccaugaaagagg

SEQ ID NO: 3743179 - RNA, 14 nt, Human
ggggccccagggcu

SEQ ID NO: 3743180 - RNA, 15 nt, Human
ggggccccccugccc

SEQ ID NO: 3743181 - RNA, 17 nt, Human
ggggccccucucagccc

SEQ ID NO: 3743182 - RNA, 10 nt, Human
ggggccccuu

SEQ ID NO: 3743183 - RNA, 16 nt, Human
ggggcccgccuggcag

SEQ ID NO: 3743184 - RNA, 21 nt, Human
ggggcccgcuugccucggcuc

SEQ ID NO: 3743185 - RNA, 23 nt, Human
ggggcccgcuugccucggcuccu

SEQ ID NO: 3743186 - RNA, 23 nt, Human
ggggcccggacgcccaggacccc

SEQ ID NO: 3743187 - RNA, 22 nt, Human
ggggcccguugucucccuggcc

SEQ ID NO: 3743188 - RNA, 15 nt, Human
ggggcccugccuccu

SEQ ID NO: 3743189 - RNA, 19 nt, Human
ggggcccugccuccuuugu

SEQ ID NO: 3743190 - RNA, 18 nt, Human
ggggcccuggagcagcca

SEQ ID NO: 3743191 - RNA, 21 nt, Human
ggggcccugguccuuccaggc

SEQ ID NO: 3743192 - RNA, 14 nt, Human
ggggcccuuggagc

SEQ ID NO: 3743193 - RNA, 20 nt, Human
ggggccggcccugugugcag

SEQ ID NO: 3743194 - RNA, 20 nt, Human
ggggccuaauaaaacugaug

SEQ ID NO: 3743195 - RNA, 23 nt, Human
ggggccuaggccucagccagaga

SEQ ID NO: 3743196 - RNA, 14 nt, Human
ggggccucagacga

SEQ ID NO: 3743197 - RNA, 12 nt, Human
ggggccugagca

SEQ ID NO: 3743198 - RNA, 17 nt, Human
ggggccugagcaguccu

SEQ ID NO: 3743199 - RNA, 20 nt, Human
ggggccugccaccuggaccc

SEQ ID NO: 3743200 - RNA, 22 nt, Human
ggggccugccaccuggaccccu

SEQ ID NO: 3743201 - RNA, 23 nt, Human
ggggccugcccagugcacuugcu

SEQ ID NO: 3743202 - RNA, 15 nt, Human
ggggccuggaccugc

SEQ ID NO: 3743203 - RNA, 12 nt, Human
ggggccuggcag

SEQ ID NO: 3743204 - RNA, 22 nt, Human
ggggccuguacaaaagggacau

SEQ ID NO: 3743205 - RNA, 14 nt, Human
ggggccuguacugc

SEQ ID NO: 3743206 - RNA, 15 nt, Human
ggggccuguacugcc

SEQ ID NO: 3743207 - RNA, 12 nt, Human
ggggccugugga

SEQ ID NO: 3743208 - RNA, 21 nt, Human
ggggccuugcgguauccgccc

SEQ ID NO: 3743209 - RNA, 15 nt, Human
ggggcgcggcuggga

SEQ ID NO: 3743210 - RNA, 15 nt, Human
ggggcgcuggcccag

SEQ ID NO: 3743211 - RNA, 18 nt, Human
ggggcgucuguucccccu

SEQ ID NO: 3743212 - RNA, 14 nt, Human
ggggcuaccaggaa

SEQ ID NO: 3743213 - RNA, 13 nt, Human
ggggcucccgccc

SEQ ID NO: 3743214 - RNA, 13 nt, Human
ggggcucuggaga

SEQ ID NO: 3743215 - RNA, 16 nt, Human
ggggcucuggagagaa

SEQ ID NO: 3743216 - RNA, 15 nt, Human
ggggcugacagacag

SEQ ID NO: 3743217 - RNA, 23 nt, Human
ggggcugaccuuccucgcagaga

SEQ ID NO: 3743218 - RNA, 12 nt, Human
ggggcugcaccg

SEQ ID NO: 3743219 - RNA, 23 nt, Human
ggggcugcccgcucccagugucu

SEQ ID NO: 3743220 - RNA, 14 nt, Human
ggggcugcucccac

SEQ ID NO: 3743221 - RNA, 14 nt, Human
ggggcugcuccucc

SEQ ID NO: 3743222 - RNA, 20 nt, Human
ggggcugcuccuccagggcc

SEQ ID NO: 3743223 - RNA, 21 nt, Human
ggggcugcugaccuccacagc

SEQ ID NO: 3743224 - RNA, 16 nt, Human
ggggcugcuuccuccu

SEQ ID NO: 3743225 - RNA, 23 nt, Human
ggggcuggaggagcccaggccag

SEQ ID NO: 3743226 - RNA, 17 nt, Human
ggggcuggcacugacug

SEQ ID NO: 3743227 - RNA, 12 nt, Human
ggggcuggccua

SEQ ID NO: 3743228 - RNA, 19 nt, Human
ggggcuggcggcuacucag

SEQ ID NO: 3743229 - RNA, 11 nt, Human
ggggcugggcc

SEQ ID NO: 3743230 - RNA, 18 nt, Human
ggggcuggggaaggaagc

SEQ ID NO: 3743231 - RNA, 15 nt, Human
ggggcuggggcagga

SEQ ID NO: 3743232 - RNA, 18 nt, Human
ggggcuggggcaggaggg

SEQ ID NO: 3743233 - RNA, 21 nt, Human
ggggcuucugugcaccugggc

SEQ ID NO: 3743234 - RNA, 11 nt, Human
ggggcuuggcg

SEQ ID NO: 3743235 - RNA, 22 nt, Human
ggggcuuucguccacagcuucc

SEQ ID NO: 3743236 - RNA, 18 nt, Human
gggggaaggccaagggga

SEQ ID NO: 3743237 - RNA, 21 nt, Human
gggggacucugagcgggaggc

SEQ ID NO: 3743238 - RNA, 21 nt, Human
gggggacuuacaugauucauu

SEQ ID NO: 3743239 - RNA, 19 nt, Human
gggggagcacccugagggc

SEQ ID NO: 3743240 - RNA, 22 nt, Human
gggggaggugggauccuccagg

SEQ ID NO: 3743241 - RNA, 22 nt, Human
gggggagucugaagcagaugca

SEQ ID NO: 3743242 - RNA, 20 nt, Human
gggggcaagaaguagcagug

SEQ ID NO: 3743243 - RNA, 12 nt, Human
gggggcagaagu

SEQ ID NO: 3743244 - RNA, 21 nt, Human
gggggcagcacaggagggcgg

SEQ ID NO: 3743245 - RNA, 15 nt, Human
gaauuuuacauggua

SEQ ID NO: 3743246 - RNA, 23 nt, Human
gaauuuuacuguguuucuuuugg

SEQ ID NO: 3743247 - RNA, 15 nt, Human
gaauuuuagcuuuug

SEQ ID NO: 3743248 - RNA, 23 nt, Human
gaauuuuauacuuucccuacccu

SEQ ID NO: 3743249 - RNA, 20 nt, Human
gaauuuucaagcaucuccug

SEQ ID NO: 3743250 - RNA, 22 nt, Human
gaauuuucacaugaacauacug

SEQ ID NO: 3743251 - RNA, 22 nt, Human
gaauuuucauuuuacaguuacu

SEQ ID NO: 3743252 - RNA, 17 nt, Human
gaauuuucuguguuuug

SEQ ID NO: 3743253 - RNA, 21 nt, Human
gaauuuucuuuguguagcuuu

SEQ ID NO: 3743254 - RNA, 22 nt, Human
gaauuuugcaaagauuuaaucu

SEQ ID NO: 3743255 - RNA, 16 nt, Human
gaauuuuguguuagag

SEQ ID NO: 3743256 - RNA, 16 nt, Human
gaauuuuguucucugg

SEQ ID NO: 3743257 - RNA, 20 nt, Human
gaauuuuguucucugggaga

SEQ ID NO: 3743258 - RNA, 23 nt, Human
gaauuuuguucucugggagaaaa

SEQ ID NO: 3743259 - RNA, 22 nt, Human
gaauuuuguuuggacuucuuuu

SEQ ID NO: 3743260 - RNA, 18 nt, Human
gaauuuuuaaacaaguau

SEQ ID NO: 3743261 - RNA, 16 nt, Human
gaauuuuuauuaugca

SEQ ID NO: 3743262 - RNA, 19 nt, Human
gaauuuuuauuaugcauaa

SEQ ID NO: 3743263 - RNA, 13 nt, Human
gaauuuuuauugu

SEQ ID NO: 3743264 - RNA, 15 nt, Human
gaauuuuugcaauaa

SEQ ID NO: 3743265 - RNA, 20 nt, Human
gaauuuuuuucaucuucucu

SEQ ID NO: 3743266 - RNA, 16 nt, Human
gaauuuuuuuuaacau

SEQ ID NO: 3743267 - RNA, 17 nt, Human
gaauuuuuuuuaacauu

SEQ ID NO: 3743268 - RNA, 19 nt, Human
gaauuuuuuuuaacauucc

SEQ ID NO: 3743269 - RNA, 21 nt, Human
gaauuuuuuuuguuguuucag

SEQ ID NO: 3743270 - RNA, 18 nt, Human
gacaaaaaauuaaagcau

SEQ ID NO: 3743271 - RNA, 14 nt, Human
gacaaaaagcuacu

SEQ ID NO: 3743272 - RNA, 17 nt, Human
gacaaaaauuaucuauu

SEQ ID NO: 3743273 - RNA, 20 nt, Human
gacaaaaccccccagauauc

SEQ ID NO: 3743274 - RNA, 18 nt, Human
gacaaaaccuaacuugcg

SEQ ID NO: 3743275 - RNA, 12 nt, Human
gacaaaacuucu

SEQ ID NO: 3743276 - RNA, 14 nt, Human
gacaaaagucuguc

SEQ ID NO: 3743277 - RNA, 18 nt, Human
gacaaaaucaucuuugug

SEQ ID NO: 3743278 - RNA, 12 nt, Human
gacaaaauguua

SEQ ID NO: 3743279 - RNA, 16 nt, Human
gacaaaauguuauuuc

SEQ ID NO: 3743280 - RNA, 19 nt, Human
gacaaacaccucccaggag

SEQ ID NO: 3743281 - RNA, 15 nt, Human
gacaaaccagaagca

SEQ ID NO: 3743282 - RNA, 20 nt, Human
gacaaacugccaguuuuguu

SEQ ID NO: 3743283 - RNA, 18 nt, Human
gacaaacuggagucugga

SEQ ID NO: 3743284 - RNA, 19 nt, Human
gacaaacuguaaaaaaugu

SEQ ID NO: 3743285 - RNA, 19 nt, Human
gacaaagaauuccaaagca

SEQ ID NO: 3743286 - RNA, 14 nt, Human
gacaaagacaaauu

SEQ ID NO: 3743287 - RNA, 21 nt, Human
gacaaagacaaauucuguuuc

SEQ ID NO: 3743288 - RNA, 20 nt, Human
gacaaagaggccuuuaacca

SEQ ID NO: 3743289 - RNA, 22 nt, Human
gacaaagaugauuuaaaaggga

SEQ ID NO: 3743290 - RNA, 20 nt, Human
gacaaagcugcuaaaucucc

SEQ ID NO: 3743291 - RNA, 18 nt, Human
gacaaaggagccugugaa

SEQ ID NO: 3743292 - RNA, 13 nt, Human
gacaaaggcaagc

SEQ ID NO: 3743293 - RNA, 16 nt, Human
gacaaagucuccagcc

SEQ ID NO: 3743294 - RNA, 19 nt, Human
gacaaagucuccagcccac

SEQ ID NO: 3743295 - RNA, 12 nt, Human
gacaaagugcca

SEQ ID NO: 3743296 - RNA, 23 nt, Human
gacaaaguuacugauucacugca

SEQ ID NO: 3743297 - RNA, 19 nt, Human
gacaaauacucauguguau

SEQ ID NO: 3743298 - RNA, 18 nt, Human
gacaaauagaaaaugguc

SEQ ID NO: 3743299 - RNA, 14 nt, Human
gacaaauaguaggc

SEQ ID NO: 3743300 - RNA, 15 nt, Human
gacaaauaguaggca

SEQ ID NO: 3743301 - RNA, 22 nt, Human
gacaaauauuccuuugcauauu

SEQ ID NO: 3743302 - RNA, 12 nt, Human
gacaaaucaagu

SEQ ID NO: 3743303 - RNA, 20 nt, Human
gacaaaucacauauuuuaaa

SEQ ID NO: 3743304 - RNA, 12 nt, Human
gacaaaucugug

SEQ ID NO: 3743305 - RNA, 21 nt, Human
gacaaaugcugcgcccuuccc

SEQ ID NO: 3743306 - RNA, 13 nt, Human
gacaaaugugaag

SEQ ID NO: 3743307 - RNA, 16 nt, Human
gacaaaugugaagaug

SEQ ID NO: 3743308 - RNA, 14 nt, Human
gacaaauguuucua

SEQ ID NO: 3743309 - RNA, 19 nt, Human
gacaaauucauauucuuuu

SEQ ID NO: 3743310 - RNA, 17 nt, Human
gacaaauucuguuucuu

SEQ ID NO: 3743311 - RNA, 15 nt, Human
gacaaauuuaaaaca

SEQ ID NO: 3743312 - RNA, 17 nt, Human
gacaaauuuaaaacaaa

SEQ ID NO: 3743313 - RNA, 21 nt, Human
gacaacaaauuagguuuugua

SEQ ID NO: 3743314 - RNA, 16 nt, Human
gacaacacagccuaua

SEQ ID NO: 3743315 - RNA, 17 nt, Human
gacaacagaagucauga

SEQ ID NO: 3743316 - RNA, 19 nt, Human
gacaacagauuggauuuua

SEQ ID NO: 3743317 - RNA, 20 nt, Human
gacaacagguaaaacagggc

SEQ ID NO: 3743318 - RNA, 12 nt, Human
gacaacauuaaa

SEQ ID NO: 3743319 - RNA, 22 nt, Human
gacaacauuucuauagccaaaa

SEQ ID NO: 3743320 - RNA, 18 nt, Human
gacaaccaccgcucccca

SEQ ID NO: 3743321 - RNA, 22 nt, Human
gacaaccaccgcuccccagccc

SEQ ID NO: 3743322 - RNA, 15 nt, Human
gacaaccacuggucu

SEQ ID NO: 3743323 - RNA, 12 nt, Human
gacaaccaugac

SEQ ID NO: 3743324 - RNA, 17 nt, Human
gacaacugcucccaccu

SEQ ID NO: 3743325 - RNA, 17 nt, Human
gacaacuggcaggcagg

SEQ ID NO: 3743326 - RNA, 22 nt, Human
gacaagaaaggcugcuguacug

SEQ ID NO: 3743327 - RNA, 19 nt, Human
gacaagacuucaguauguu

SEQ ID NO: 3743328 - RNA, 20 nt, Human
gacaagacuucaguauguug

SEQ ID NO: 3743329 - RNA, 24 nt, Human
gacaagacuucaguauguugucaa

SEQ ID NO: 3743330 - RNA, 22 nt, Human
gacaagaguuggggacagaacu

SEQ ID NO: 3743331 - RNA, 14 nt, Human
gacaagauauugua

SEQ ID NO: 3743332 - RNA, 20 nt, Human
gacaagauuuuuuaauuguu

SEQ ID NO: 3743333 - RNA, 19 nt, Human
gacaagccaacuuguaaau

SEQ ID NO: 3743334 - RNA, 22 nt, Human
gacaagccaacuuguaaauaca

SEQ ID NO: 3743335 - RNA, 23 nt, Human
gacaagccaacuuguaaauacac

SEQ ID NO: 3743336 - RNA, 16 nt, Human
gacaagccagaacuug

SEQ ID NO: 3743337 - RNA, 12 nt, Human
gacaagccccag

SEQ ID NO: 3743338 - RNA, 17 nt, Human
gacaagccccaggcagg

SEQ ID NO: 3743339 - RNA, 14 nt, Human
gacaagcuggcuua

SEQ ID NO: 3743340 - RNA, 20 nt, Human
gacaagcuggcuuacacugg

SEQ ID NO: 3743341 - RNA, 20 nt, Human
gacaagcuguugaccaggca

SEQ ID NO: 3743342 - RNA, 22 nt, Human
gacaagcuguugaccaggcacc

SEQ ID NO: 3743343 - RNA, 13 nt, Human
gacaagcuucuga

SEQ ID NO: 3743344 - RNA, 17 nt, Human
gacaaggaaaggcaaau

SEQ ID NO: 3743345 - RNA, 19 nt, Human
gacaaggaaaggcaaaugc

SEQ ID NO: 3743346 - RNA, 19 nt, Human
gacaaggagaagagcaagg

SEQ ID NO: 3743347 - RNA, 19 nt, Human
gacaagggcugaccugccu

SEQ ID NO: 3743348 - RNA, 21 nt, Human
gacaagguagcccuggccaga

SEQ ID NO: 3743349 - RNA, 18 nt, Human
gacaaggugcaggcaggc

SEQ ID NO: 3743350 - RNA, 22 nt, Human
gacaagguucuucccuuuuaca

SEQ ID NO: 3743351 - RNA, 19 nt, Human
gacaagugacuguaucugu

SEQ ID NO: 3743352 - RNA, 15 nt, Human
gacaaguggacucag

SEQ ID NO: 3743353 - RNA, 13 nt, Human
gacaauaaagcuu

SEQ ID NO: 3743354 - RNA, 14 nt, Human
gacaauaaagcuug

SEQ ID NO: 3743355 - RNA, 19 nt, Human
gacaauaauuucagguuuu

SEQ ID NO: 3743356 - RNA, 16 nt, Human
gacaauacguuugaua

SEQ ID NO: 3743357 - RNA, 15 nt, Human
gacaauacugggguu

SEQ ID NO: 3743358 - RNA, 17 nt, Human
gacaauagcauuagaaa

SEQ ID NO: 3743359 - RNA, 14 nt, Human
gacaaucagucccc

SEQ ID NO: 3743360 - RNA, 16 nt, Human
gacaaucaguccccuc

SEQ ID NO: 3743361 - RNA, 17 nt, Human
gacaaucaguccccucc

SEQ ID NO: 3743362 - RNA, 14 nt, Human
gacaaucauuguuu

SEQ ID NO: 3743363 - RNA, 21 nt, Human
gacaaugacuuacuguacaug

SEQ ID NO: 3743364 - RNA, 20 nt, Human
gacaaugaugaugauaauga

SEQ ID NO: 3743365 - RNA, 22 nt, Human
gacaaugcaaaccaucauugaa

SEQ ID NO: 3743366 - RNA, 16 nt, Human
gacaauggaccggaga

SEQ ID NO: 3743367 - RNA, 16 nt, Human
gacaauggcagaugua

SEQ ID NO: 3743368 - RNA, 18 nt, Human
gacaaugugaaaagaaaa

SEQ ID NO: 3743369 - RNA, 12 nt, Human
gacaauguuuac

SEQ ID NO: 3743370 - RNA, 13 nt, Human
gacaauucuuuau

SEQ ID NO: 3743371 - RNA, 15 nt, Human
gacaauucuuuauac

SEQ ID NO: 3743372 - RNA, 13 nt, Human
gacaauuuauaau

SEQ ID NO: 3743373 - RNA, 19 nt, Human
gacaauuugauacauaaua

SEQ ID NO: 3743374 - RNA, 17 nt, Human
gacacaaaacuccgccc

SEQ ID NO: 3743375 - RNA, 22 nt, Human
gacacaaaacuccgcccccagc

SEQ ID NO: 3743376 - RNA, 14 nt, Human
gacacaaaugcaug

SEQ ID NO: 3743377 - RNA, 13 nt, Human
gacacaacuauuu

SEQ ID NO: 3743378 - RNA, 22 nt, Human
gacacaacugugugauuaaaag

SEQ ID NO: 3743379 - RNA, 22 nt, Human
gacacaaguggaccuuaggccu

SEQ ID NO: 3743380 - RNA, 12 nt, Human
gacacacacaca

SEQ ID NO: 3743381 - RNA, 18 nt, Human
gacacacacacgcacgca

SEQ ID NO: 3743382 - RNA, 14 nt, Human
gacacacacagcuu

SEQ ID NO: 3743383 - RNA, 14 nt, Human
gacacacagccuag

SEQ ID NO: 3743384 - RNA, 18 nt, Human
gacacacagcucuguccu

SEQ ID NO: 3743385 - RNA, 19 nt, Human
gacacacagcucuguccug

SEQ ID NO: 3743386 - RNA, 15 nt, Human
gacacaccaggcgcu

SEQ ID NO: 3743387 - RNA, 18 nt, Human
gacacaccaggcgcuaau

SEQ ID NO: 3743388 - RNA, 15 nt, Human
gacacacgcacacac

SEQ ID NO: 3743389 - RNA, 15 nt, Human
gacacacuaaccaag

SEQ ID NO: 3743390 - RNA, 14 nt, Human
gacacacugaagaa

SEQ ID NO: 3743391 - RNA, 15 nt, Human
gacacacugaagaag

SEQ ID NO: 3743392 - RNA, 20 nt, Human
gacacagacucauccugaac

SEQ ID NO: 3743393 - RNA, 15 nt, Human
gacacagcagcuuca

SEQ ID NO: 3743394 - RNA, 19 nt, Human
guaauaaaguguuuucaga

SEQ ID NO: 3743395 - RNA, 15 nt, Human
guaauaacugugaag

SEQ ID NO: 3743396 - RNA, 13 nt, Human
guaauaagacaua

SEQ ID NO: 3743397 - RNA, 19 nt, Human
guaauaagggaaaaaucaa

SEQ ID NO: 3743398 - RNA, 21 nt, Human
guaauaagguuuuaauuuagu

SEQ ID NO: 3743399 - RNA, 13 nt, Human
guaauaauagacu

SEQ ID NO: 3743400 - RNA, 18 nt, Human
guaauacuucuugugugu

SEQ ID NO: 3743401 - RNA, 15 nt, Human
guaauagagcaaaau

SEQ ID NO: 3743402 - RNA, 14 nt, Human
guaauauaauacac

SEQ ID NO: 3743403 - RNA, 21 nt, Human
guaauauaauacacaaaauca

SEQ ID NO: 3743404 - RNA, 22 nt, Human
guaauauaauacacaaaaucaa

SEQ ID NO: 3743405 - RNA, 22 nt, Human
guaauauaauggaagagaaauc

SEQ ID NO: 3743406 - RNA, 12 nt, Human
guaauauauugc

SEQ ID NO: 3743407 - RNA, 16 nt, Human
guaauauauugcugcu

SEQ ID NO: 3743408 - RNA, 20 nt, Human
guaauauauugcugcuggua

SEQ ID NO: 3743409 - RNA, 14 nt, Human
guaauaugcacaca

SEQ ID NO: 3743410 - RNA, 17 nt, Human
guaauauuuacaaugua

SEQ ID NO: 3743411 - RNA, 21 nt, Human
guaauauuuacaauguauuaa

SEQ ID NO: 3743412 - RNA, 13 nt, Human
guaauauuuugua

SEQ ID NO: 3743413 - RNA, 13 nt, Human
guaauauuuuuau

SEQ ID NO: 3743414 - RNA, 20 nt, Human
guaaucaauaaacgauuuaa

SEQ ID NO: 3743415 - RNA, 22 nt, Human
guaaucaaucuacucaaagcau

SEQ ID NO: 3743416 - RNA, 19 nt, Human
guaaucaaugaauauugaa

SEQ ID NO: 3743417 - RNA, 21 nt, Human
guaaucaaugaauauugaagu

SEQ ID NO: 3743418 - RNA, 15 nt, Human
guaaucauauuagac

SEQ ID NO: 3743419 - RNA, 15 nt, Human
guaaucaucuaaguc

SEQ ID NO: 3743420 - RNA, 20 nt, Human
guaaucauuucuugggcccu

SEQ ID NO: 3743421 - RNA, 22 nt, Human
guaaucauuucuugggcccucc

SEQ ID NO: 3743422 - RNA, 23 nt, Human
guaaucauuucuugggcccuccu

SEQ ID NO: 3743423 - RNA, 15 nt, Human
guaauccaccugccu

SEQ ID NO: 3743424 - RNA, 20 nt, Human
guaaucccagcacuuuggga

SEQ ID NO: 3743425 - RNA, 13 nt, Human
guaaucccagcag

SEQ ID NO: 3743426 - RNA, 17 nt, Human
guaaucccagcuacuca

SEQ ID NO: 3743427 - RNA, 18 nt, Human
guaaucccagcuacucag

SEQ ID NO: 3743428 - RNA, 22 nt, Human
guaauccucaagaaauaaaagg

SEQ ID NO: 3743429 - RNA, 17 nt, Human
guaaucgaccugccucg

SEQ ID NO: 3743430 - RNA, 16 nt, Human
guaaucguuaugugug

SEQ ID NO: 3743431 - RNA, 18 nt, Human
guaaucguuaugugugua

SEQ ID NO: 3743432 - RNA, 22 nt, Human
guaaucuaugaauucuaaguga

SEQ ID NO: 3743433 - RNA, 16 nt, Human
guaaucucguuucaaa

SEQ ID NO: 3743434 - RNA, 14 nt, Human
guaaucucucugca

SEQ ID NO: 3743435 - RNA, 17 nt, Human
guaaucucucugcagcu

SEQ ID NO: 3743436 - RNA, 19 nt, Human
guaaucugagaaacaauga

SEQ ID NO: 3743437 - RNA, 21 nt, Human
guaaucugaucguucuuucua

SEQ ID NO: 3743438 - RNA, 16 nt, Human
guaaucugauggcuuc

SEQ ID NO: 3743439 - RNA, 23 nt, Human
guaaucuguacauuuuguuguaa

SEQ ID NO: 3743440 - RNA, 20 nt, Human
guaaucuguguacaaagaaa

SEQ ID NO: 3743441 - RNA, 11 nt, Human
guaaugaaaac

SEQ ID NO: 3743442 - RNA, 17 nt, Human
guaaugaaaaugaauau

SEQ ID NO: 3743443 - RNA, 10 nt, Human
guaaugaaac

SEQ ID NO: 3743444 - RNA, 15 nt, Human
guaaugaaacuugga

SEQ ID NO: 3743445 - RNA, 16 nt, Human
guaaugaaacuuggau

SEQ ID NO: 3743446 - RNA, 22 nt, Human
guaaugacagaacaugcuguua

SEQ ID NO: 3743447 - RNA, 17 nt, Human
guaaugaccaugaaaga

SEQ ID NO: 3743448 - RNA, 14 nt, Human
guaaugagggacug

SEQ ID NO: 3743449 - RNA, 20 nt, Human
guaaugauauagccagaaaa

SEQ ID NO: 3743450 - RNA, 18 nt, Human
guaaugaugucguuugaa

SEQ ID NO: 3743451 - RNA, 16 nt, Human
guaaugccucugucua

SEQ ID NO: 3743452 - RNA, 17 nt, Human
guaaugcgccaauaaac

SEQ ID NO: 3743453 - RNA, 20 nt, Human
guaaugcuuagagaauguuc

SEQ ID NO: 3743454 - RNA, 16 nt, Human
guaaugcuucaaucag

SEQ ID NO: 3743455 - RNA, 23 nt, Human
guaauggcaguuauauuuugcag

SEQ ID NO: 3743456 - RNA, 19 nt, Human
guaaugguacugacuuugc

SEQ ID NO: 3743457 - RNA, 16 nt, Human
guaaugguguagaaca

SEQ ID NO: 3743458 - RNA, 17 nt, Human
guaauguaaaauccauc

SEQ ID NO: 3743459 - RNA, 14 nt, Human
guaauguaacugcu

SEQ ID NO: 3743460 - RNA, 12 nt, Human
guaaugucacca

SEQ ID NO: 3743461 - RNA, 19 nt, Human
guaaugucaccaccuuccc

SEQ ID NO: 3743462 - RNA, 19 nt, Human
guaaugucuugagcucuau

SEQ ID NO: 3743463 - RNA, 17 nt, Human
guaauguggaagaaaau

SEQ ID NO: 3743464 - RNA, 20 nt, Human
guaaugugugguggccucag

SEQ ID NO: 3743465 - RNA, 13 nt, Human
guaauguuacuga

SEQ ID NO: 3743466 - RNA, 18 nt, Human
guaauuaaaagcaaauca

SEQ ID NO: 3743467 - RNA, 20 nt, Human
guaauuaaaagcaaaucauu

SEQ ID NO: 3743468 - RNA, 14 nt, Human
guaauuaaguacua

SEQ ID NO: 3743469 - RNA, 22 nt, Human
guaauuaucgggaacaguguuu

SEQ ID NO: 3743470 - RNA, 13 nt, Human
guaauuaugauuu

SEQ ID NO: 3743471 - RNA, 17 nt, Human
guaauucuuauucuuuc

SEQ ID NO: 3743472 - RNA, 15 nt, Human
guaauucuucaguug

SEQ ID NO: 3743473 - RNA, 13 nt, Human
guaauugaacuua

SEQ ID NO: 3743474 - RNA, 15 nt, Human
guaauugaacuuauc

SEQ ID NO: 3743475 - RNA, 15 nt, Human
guaauugacaugugc

SEQ ID NO: 3743476 - RNA, 18 nt, Human
guaauugacgguuuuuua

SEQ ID NO: 3743477 - RNA, 15 nt, Human
guaauugcuuacauu

SEQ ID NO: 3743478 - RNA, 15 nt, Human
guaauuggaaaggca

SEQ ID NO: 3743479 - RNA, 12 nt, Human
guaauuguucca

SEQ ID NO: 3743480 - RNA, 21 nt, Human
guaauuguuccagagacaaau

SEQ ID NO: 3743481 - RNA, 14 nt, Human
guaauuguuccuuu

SEQ ID NO: 3743482 - RNA, 21 nt, Human
guaauuguugcuaaucuucuu

SEQ ID NO: 3743483 - RNA, 21 nt, Human
guaauuguuguuuguauguau

SEQ ID NO: 3743484 - RNA, 10 nt, Human
guaauuuaaa

SEQ ID NO: 3743485 - RNA, 20 nt, Human
guaauuuaaaauugugaugu

SEQ ID NO: 3743486 - RNA, 23 nt, Human
guaauuuaaaauugugauguguc

SEQ ID NO: 3743487 - RNA, 14 nt, Human
guaauuuaaacagg

SEQ ID NO: 3743488 - RNA, 20 nt, Human
guaauuuaaacaggcccagc

SEQ ID NO: 3743489 - RNA, 21 nt, Human
guaauuuaaaugaaagaaaau

SEQ ID NO: 3743490 - RNA, 17 nt, Human
guaauuuagauuguaaa

SEQ ID NO: 3743491 - RNA, 19 nt, Human
guaauuuaggguacuaaau

SEQ ID NO: 3743492 - RNA, 17 nt, Human
guaauuuaguuauugau

SEQ ID NO: 3743493 - RNA, 14 nt, Human
guaauuuguaaagu

SEQ ID NO: 3743494 - RNA, 15 nt, Human
guaauuugugauaca

SEQ ID NO: 3743495 - RNA, 22 nt, Human
guaauuugugauacaaugcugu

SEQ ID NO: 3743496 - RNA, 18 nt, Human
guaauuuuauaugaagau

SEQ ID NO: 3743497 - RNA, 16 nt, Human
guaauuuuauuuuaaa

SEQ ID NO: 3743498 - RNA, 19 nt, Human
guaauuuuauuuuaaaauu

SEQ ID NO: 3743499 - RNA, 20 nt, Human
guaauuuuauuuuaaaauuu

SEQ ID NO: 3743500 - RNA, 23 nt, Human
guaauuuucggaugggagaguuu

SEQ ID NO: 3743501 - RNA, 13 nt, Human
guaauuuucuuga

SEQ ID NO: 3743502 - RNA, 14 nt, Human
guaauuuugccaaa

SEQ ID NO: 3743503 - RNA, 14 nt, Human
guaauuuuguguaa

SEQ ID NO: 3743504 - RNA, 16 nt, Human
guaauuuuucuguaua

SEQ ID NO: 3743505 - RNA, 16 nt, Human
guaauuuuuuucuuau

SEQ ID NO: 3743506 - RNA, 19 nt, Human
guacaaaaaaaaaguuuua

SEQ ID NO: 3743507 - RNA, 20 nt, Human
guacaaaaaaaaaguuuuau

SEQ ID NO: 3743508 - RNA, 21 nt, Human
guacaaaaaaaucuuccaauu

SEQ ID NO: 3743509 - RNA, 14 nt, Human
guacaaaagggaca

SEQ ID NO: 3743510 - RNA, 20 nt, Human
guacaaauauaagaauaaaa

SEQ ID NO: 3743511 - RNA, 23 nt, Human
guacaaauauaagaauaaaaugu

SEQ ID NO: 3743512 - RNA, 22 nt, Human
guacaaccuguucugcuuuccu

SEQ ID NO: 3743513 - RNA, 14 nt, Human
guacaacggaggcc

SEQ ID NO: 3743514 - RNA, 16 nt, Human
guacaauaaaaguaaa

SEQ ID NO: 3743515 - RNA, 22 nt, Human
guacaauaaguguuuuuguauu

SEQ ID NO: 3743516 - RNA, 16 nt, Human
guacaauaauucauau

SEQ ID NO: 3743517 - RNA, 13 nt, Human
guacaauauuuaa

SEQ ID NO: 3743518 - RNA, 16 nt, Human
guacaauauuuuaagc

SEQ ID NO: 3743519 - RNA, 20 nt, Human
guacaauauuuuaagcauua

SEQ ID NO: 3743520 - RNA, 22 nt, Human
guacaauauuuuaagcauuacu

SEQ ID NO: 3743521 - RNA, 14 nt, Human
guacaaucucaaau

SEQ ID NO: 3743522 - RNA, 22 nt, Human
guacaaugugacuuugaaaaua

SEQ ID NO: 3743523 - RNA, 13 nt, Human
guacaauguguuu

SEQ ID NO: 3743524 - RNA, 16 nt, Human
guacacacacauacac

SEQ ID NO: 3743525 - RNA, 15 nt, Human
guacacacuuuauuu

SEQ ID NO: 3743526 - RNA, 18 nt, Human
guacacccaugaaagaaa

SEQ ID NO: 3743527 - RNA, 14 nt, Human
guacacucugcugu

SEQ ID NO: 3743528 - RNA, 14 nt, Human
guacacugaauauu

SEQ ID NO: 3743529 - RNA, 17 nt, Human
guacacugaauuuuuau

SEQ ID NO: 3743530 - RNA, 16 nt, Human
guacacugacuugaga

SEQ ID NO: 3743531 - RNA, 21 nt, Human
guacacuguuucaaacuuuac

SEQ ID NO: 3743532 - RNA, 14 nt, Human
guacagaaagcugc

SEQ ID NO: 3743533 - RNA, 17 nt, Human
guacagaaucauugcuu

SEQ ID NO: 3743534 - RNA, 20 nt, Human
guacagaauucugcuaccuc

SEQ ID NO: 3743535 - RNA, 17 nt, Human
guacagaauuugaauua

SEQ ID NO: 3743536 - RNA, 17 nt, Human
guacagacauauuuaac

SEQ ID NO: 3743537 - RNA, 12 nt, Human
guacagagaagc

SEQ ID NO: 3743538 - RNA, 13 nt, Human
guacagagaagga

SEQ ID NO: 3743539 - RNA, 12 nt, Human
guacagagccca

SEQ ID NO: 3743540 - RNA, 20 nt, Human
guacagagccguaaaaacug

SEQ ID NO: 3743541 - RNA, 21 nt, Human
guacagaguguggacucuggu

SEQ ID NO: 3743542 - RNA, 13 nt, Human
guacagcugggcu

SEQ ID NO: 3743543 - RNA, 15 nt, Human
guacaggacauauau

SEQ ID NO: 3743544 - RNA, 14 nt, Human
gggggccaccugcc

SEQ ID NO: 3743545 - RNA, 14 nt, Human
gggggccaugagcu

SEQ ID NO: 3743546 - RNA, 15 nt, Human
gggggccaugagcuc

SEQ ID NO: 3743547 - RNA, 21 nt, Human
gggggccaugaggccucagug

SEQ ID NO: 3743548 - RNA, 19 nt, Human
gggggccccagucagccuc

SEQ ID NO: 3743549 - RNA, 15 nt, Human
gggggcggccuauga

SEQ ID NO: 3743550 - RNA, 16 nt, Human
gggggcucagcaaggc

SEQ ID NO: 3743551 - RNA, 20 nt, Human
gggggcucagcaaggccacc

SEQ ID NO: 3743552 - RNA, 14 nt, Human
gggggcugcuccca

SEQ ID NO: 3743553 - RNA, 15 nt, Human
gggggcugggcagag

SEQ ID NO: 3743554 - RNA, 19 nt, Human
gggggcuggugccagccuu

SEQ ID NO: 3743555 - RNA, 22 nt, Human
gggggcuucauacacaugagau

SEQ ID NO: 3743556 - RNA, 12 nt, Human
gggggcuuucug

SEQ ID NO: 3743557 - RNA, 16 nt, Human
ggggggauguggauca

SEQ ID NO: 3743558 - RNA, 11 nt, Human
ggggggcagag

SEQ ID NO: 3743559 - RNA, 20 nt, Human
ggggguagagcugauccaga

SEQ ID NO: 3743560 - RNA, 16 nt, Human
ggggguccacccagca

SEQ ID NO: 3743561 - RNA, 22 nt, Human
gggggucccagugggaggggca

SEQ ID NO: 3743562 - RNA, 18 nt, Human
gggggucucacccaugca

SEQ ID NO: 3743563 - RNA, 12 nt, Human
gggggucuggcu

SEQ ID NO: 3743564 - RNA, 16 nt, Human
gggggucuggcuggug

SEQ ID NO: 3743565 - RNA, 20 nt, Human
ggggguggccaggccgggaa

SEQ ID NO: 3743566 - RNA, 23 nt, Human
ggggguggccgcugaguggcagg

SEQ ID NO: 3743567 - RNA, 18 nt, Human
ggggguuuuuacuccagu

SEQ ID NO: 3743568 - RNA, 24 nt, Human
ggggguuuuuacuccaguggugaa

SEQ ID NO: 3743569 - RNA, 16 nt, Human
gggguaaggugcaucu

SEQ ID NO: 3743570 - RNA, 18 nt, Human
gggguagcuagaggaacc

SEQ ID NO: 3743571 - RNA, 19 nt, Human
gggguagcuagaggaacca

SEQ ID NO: 3743572 - RNA, 22 nt, Human
gggguauuuaccacagcagcug

SEQ ID NO: 3743573 - RNA, 18 nt, Human
ggggucaugcccuccucu

SEQ ID NO: 3743574 - RNA, 14 nt, Human
ggggucccagcagc

SEQ ID NO: 3743575 - RNA, 23 nt, Human
gggguccccaucaucccagcugc

SEQ ID NO: 3743576 - RNA, 16 nt, Human
ggggucccuagcagcc

SEQ ID NO: 3743577 - RNA, 15 nt, Human
gggguccuguggcag

SEQ ID NO: 3743578 - RNA, 13 nt, Human
ggggucucccugg

SEQ ID NO: 3743579 - RNA, 21 nt, Human
ggggucucccuggcucccucc

SEQ ID NO: 3743580 - RNA, 16 nt, Human
ggggucuggcuggugu

SEQ ID NO: 3743581 - RNA, 23 nt, Human
ggggucugggaggaauggacaga

SEQ ID NO: 3743582 - RNA, 15 nt, Human
ggggucuguaaaauc

SEQ ID NO: 3743583 - RNA, 22 nt, Human
ggggucuuugugagagugagcu

SEQ ID NO: 3743584 - RNA, 18 nt, Human
ggggugaccuccggccag

SEQ ID NO: 3743585 - RNA, 18 nt, Human
ggggugacggcccucauc

SEQ ID NO: 3743586 - RNA, 17 nt, Human
ggggugauuucagagag

SEQ ID NO: 3743587 - RNA, 18 nt, Human
ggggugcagggauguggg

SEQ ID NO: 3743588 - RNA, 23 nt, Human
ggggugcccccuccucucccauc

SEQ ID NO: 3743589 - RNA, 13 nt, Human
ggggugccgccug

SEQ ID NO: 3743590 - RNA, 14 nt, Human
ggggugccgccugc

SEQ ID NO: 3743591 - RNA, 22 nt, Human
ggggugcggcggucccagcucc

SEQ ID NO: 3743592 - RNA, 20 nt, Human
ggggugcuuuuauagaggcu

SEQ ID NO: 3743593 - RNA, 18 nt, Human
gggguggcugcagccuca

SEQ ID NO: 3743594 - RNA, 15 nt, Human
ggggugggagagguc

SEQ ID NO: 3743595 - RNA, 13 nt, Human
ggggugggccagg

SEQ ID NO: 3743596 - RNA, 14 nt, Human
ggggugggccucug

SEQ ID NO: 3743597 - RNA, 20 nt, Human
gggguggggggggugcuggg

SEQ ID NO: 3743598 - RNA, 19 nt, Human
gggguguggcuccuuccca

SEQ ID NO: 3743599 - RNA, 13 nt, Human
gggguuacaaacu

SEQ ID NO: 3743600 - RNA, 15 nt, Human
gggguuaucucugug

SEQ ID NO: 3743601 - RNA, 21 nt, Human
gggguuccguguccaccccca

SEQ ID NO: 3743602 - RNA, 15 nt, Human
gggguuguguuguca

SEQ ID NO: 3743603 - RNA, 21 nt, Human
ggguaagggauuucuuagggg

SEQ ID NO: 3743604 - RNA, 13 nt, Human
ggguaaggugccu

SEQ ID NO: 3743605 - RNA, 17 nt, Human
ggguaaucccugcuuuu

SEQ ID NO: 3743606 - RNA, 13 nt, Human
ggguacagcuggg

SEQ ID NO: 3743607 - RNA, 15 nt, Human
ggguacauuuauaau

SEQ ID NO: 3743608 - RNA, 19 nt, Human
ggguacauuucccugugcu

SEQ ID NO: 3743609 - RNA, 23 nt, Human
ggguagagcggagaaaggaaggg

SEQ ID NO: 3743610 - RNA, 14 nt, Human
ggguagagcugauc

SEQ ID NO: 3743611 - RNA, 15 nt, Human
ggguagcagcuggac

SEQ ID NO: 3743612 - RNA, 22 nt, Human
ggguagcagcuggacuacccac

SEQ ID NO: 3743613 - RNA, 12 nt, Human
ggguagcccgcc

SEQ ID NO: 3743614 - RNA, 16 nt, Human
ggguagcgggggaggg

SEQ ID NO: 3743615 - RNA, 20 nt, Human
ggguaggcaggauuggggaa

SEQ ID NO: 3743616 - RNA, 24 nt, Human
ggguaggggaagaagagcuaucag

SEQ ID NO: 3743617 - RNA, 22 nt, Human
ggguaggguaaaucaguaagag

SEQ ID NO: 3743618 - RNA, 23 nt, Human
ggguauaaaacuuuccucgccug

SEQ ID NO: 3743619 - RNA, 20 nt, Human
ggguaucaggugcugccauc

SEQ ID NO: 3743620 - RNA, 20 nt, Human
ggguauccaaguuggacugg

SEQ ID NO: 3743621 - RNA, 21 nt, Human
ggguauccaaguuggacuggg

SEQ ID NO: 3743622 - RNA, 13 nt, Human
ggguauggcguaa

SEQ ID NO: 3743623 - RNA, 23 nt, Human
gggucaaguuauuaauuucuuca

SEQ ID NO: 3743624 - RNA, 17 nt, Human
gggucacccucuccagc

SEQ ID NO: 3743625 - RNA, 19 nt, Human
gggucagacgccugaggaa

SEQ ID NO: 3743626 - RNA, 13 nt, Human
gggucagccaggg

SEQ ID NO: 3743627 - RNA, 19 nt, Human
gggucagccagggccaggg

SEQ ID NO: 3743628 - RNA, 14 nt, Human
gggucaggagaggg

SEQ ID NO: 3743629 - RNA, 15 nt, Human
gggucaggccacggc

SEQ ID NO: 3743630 - RNA, 17 nt, Human
gggucaggccacggcag

SEQ ID NO: 3743631 - RNA, 21 nt, Human
gggucaggccacggcagccua

SEQ ID NO: 3743632 - RNA, 18 nt, Human
gggucaggccgggcagag

SEQ ID NO: 3743633 - RNA, 21 nt, Human
gggucaggccgggcagagcac

SEQ ID NO: 3743634 - RNA, 18 nt, Human
gggucagggaccaaggac

SEQ ID NO: 3743635 - RNA, 18 nt, Human
gggucagguugacaggag

SEQ ID NO: 3743636 - RNA, 14 nt, Human
gggucauagaaauu

SEQ ID NO: 3743637 - RNA, 16 nt, Human
gggucaugcccuccuc

SEQ ID NO: 3743638 - RNA, 20 nt, Human
ggguccacccagcaaagagu

SEQ ID NO: 3743639 - RNA, 17 nt, Human
ggguccagaaggagaca

SEQ ID NO: 3743640 - RNA, 12 nt, Human
ggguccaggagg

SEQ ID NO: 3743641 - RNA, 12 nt, Human
ggguccaugggc

SEQ ID NO: 3743642 - RNA, 13 nt, Human
gggucccaagcug

SEQ ID NO: 3743643 - RNA, 17 nt, Human
gggucccaagcugggcc

SEQ ID NO: 3743644 - RNA, 14 nt, Human
gggucccaguggga

SEQ ID NO: 3743645 - RNA, 16 nt, Human
ggguccccagcccuuc

SEQ ID NO: 3743646 - RNA, 17 nt, Human
gggucccuagcagccca

SEQ ID NO: 3743647 - RNA, 20 nt, Human
ggguccuccuccagggacag

SEQ ID NO: 3743648 - RNA, 15 nt, Human
ggguccucugagacu

SEQ ID NO: 3743649 - RNA, 13 nt, Human
ggguccucuucug

SEQ ID NO: 3743650 - RNA, 21 nt, Human
ggguccugaggccugcagcac

SEQ ID NO: 3743651 - RNA, 19 nt, Human
ggguccugcagccugcagg

SEQ ID NO: 3743652 - RNA, 13 nt, Human
ggguccuggccau

SEQ ID NO: 3743653 - RNA, 16 nt, Human
ggguccuggccauccc

SEQ ID NO: 3743654 - RNA, 18 nt, Human
ggguccuguggcaggcag

SEQ ID NO: 3743655 - RNA, 19 nt, Human
ggguccuguggcaggcagc

SEQ ID NO: 3743656 - RNA, 19 nt, Human
ggguccuuuugacacugcu

SEQ ID NO: 3743657 - RNA, 16 nt, Human
gggucgaaagcucuag

SEQ ID NO: 3743658 - RNA, 20 nt, Human
gggucggcugaccaugcuca

SEQ ID NO: 3743659 - RNA, 20 nt, Human
gggucgucaccaccucuccu

SEQ ID NO: 3743660 - RNA, 14 nt, Human
gggucuagggagag

SEQ ID NO: 3743661 - RNA, 14 nt, Human
gggucucacucugu

SEQ ID NO: 3743662 - RNA, 15 nt, Human
gggucucccucuccu

SEQ ID NO: 3743663 - RNA, 20 nt, Human
gggucucccucuccugccua

SEQ ID NO: 3743664 - RNA, 16 nt, Human
gggucucccuggcucc

SEQ ID NO: 3743665 - RNA, 22 nt, Human
gggucucccuggcucccuccuc

SEQ ID NO: 3743666 - RNA, 17 nt, Human
gggucuccucaggacca

SEQ ID NO: 3743667 - RNA, 24 nt, Human
gggucucucacagacaggaccccu

SEQ ID NO: 3743668 - RNA, 18 nt, Human
gggucucugcugccgccc

SEQ ID NO: 3743669 - RNA, 17 nt, Human
gggucugagcuccagcu

SEQ ID NO: 3743670 - RNA, 21 nt, Human
gggucugcucccaaggggccu

SEQ ID NO: 3743671 - RNA, 20 nt, Human
gggucugcucuuucucugcc

SEQ ID NO: 3743672 - RNA, 21 nt, Human
gggucugcucuuucucugcca

SEQ ID NO: 3743673 - RNA, 22 nt, Human
gggucugcucuuucucugccag

SEQ ID NO: 3743674 - RNA, 20 nt, Human
gggucuggaguugaucugga

SEQ ID NO: 3743675 - RNA, 21 nt, Human
gggucuggucuccucagccuc

SEQ ID NO: 3743676 - RNA, 17 nt, Human
gggucuguaaaaucuuu

SEQ ID NO: 3743677 - RNA, 20 nt, Human
gggucuguaaaaucuuucuu

SEQ ID NO: 3743678 - RNA, 15 nt, Human
gggucugugucucuu

SEQ ID NO: 3743679 - RNA, 15 nt, Human
gggucugugugaaug

SEQ ID NO: 3743680 - RNA, 24 nt, Human
gggucugugugaaugugggcacug

SEQ ID NO: 3743681 - RNA, 21 nt, Human
gggucuucagcauucccuccc

SEQ ID NO: 3743682 - RNA, 11 nt, Human
gggucuuccua

SEQ ID NO: 3743683 - RNA, 21 nt, Human
gggucuuuucaucugggaaag

SEQ ID NO: 3743684 - RNA, 19 nt, Human
gggugaagagaaccgagca

SEQ ID NO: 3743685 - RNA, 13 nt, Human
gggugaagggaga

SEQ ID NO: 3743686 - RNA, 13 nt, Human
gggugacaagaua

SEQ ID NO: 3743687 - RNA, 23 nt, Human
gggugacauguguuggcagccuc

SEQ ID NO: 3743688 - RNA, 18 nt, Human
gggugacggcccucaucu

SEQ ID NO: 3743689 - RNA, 17 nt, Human
gggugagaacaaccaaa

SEQ ID NO: 3743690 - RNA, 15 nt, Human
gggugagaugcugga

SEQ ID NO: 3743691 - RNA, 18 nt, Human
gggugaggaccacuccug

SEQ ID NO: 3743692 - RNA, 14 nt, Human
gggugaggauaaca

SEQ ID NO: 3743693 - RNA, 17 nt, Human
gggugagggucccaugu

SEQ ID NO: 3743694 - RNA, 13 nt, Human
gggugcacaggag

SEQ ID NO: 3743695 - RNA, 14 nt, Human
gggugcagaggcug

SEQ ID NO: 3743696 - RNA, 17 nt, Human
gggugcagcaucuggaa

SEQ ID NO: 3743697 - RNA, 21 nt, Human
gggugcgaccccaucugccca

SEQ ID NO: 3743698 - RNA, 22 nt, Human
gggugcgaccccaucugcccag

SEQ ID NO: 3743699 - RNA, 13 nt, Human
gggugcucagaau

SEQ ID NO: 3743700 - RNA, 18 nt, Human
gggugcucagaauaaggc

SEQ ID NO: 3743701 - RNA, 20 nt, Human
gggugcugcuaauucuuugc

SEQ ID NO: 3743702 - RNA, 21 nt, Human
gggugcugcuucccucugccu

SEQ ID NO: 3743703 - RNA, 20 nt, Human
gggugcuuuuauagaggcua

SEQ ID NO: 3743704 - RNA, 22 nt, Human
gggugcuuuuauagaggcuagc

SEQ ID NO: 3743705 - RNA, 12 nt, Human
ggguggagaagc

SEQ ID NO: 3743706 - RNA, 13 nt, Human
ggguggagaagcc

SEQ ID NO: 3743707 - RNA, 14 nt, Human
ggguggagaagcca

SEQ ID NO: 3743708 - RNA, 16 nt, Human
ggguggagaagccauu

SEQ ID NO: 3743709 - RNA, 16 nt, Human
ggguggaggcuuccug

SEQ ID NO: 3743710 - RNA, 21 nt, Human
ggguggauauaaauauauaua

SEQ ID NO: 3743711 - RNA, 14 nt, Human
ggguggcacugcca

SEQ ID NO: 3743712 - RNA, 12 nt, Human
ggguggccaggc

SEQ ID NO: 3743713 - RNA, 14 nt, Human
ggguggccaggccg

SEQ ID NO: 3743714 - RNA, 18 nt, Human
ggguggcccauccccccu

SEQ ID NO: 3743715 - RNA, 19 nt, Human
ggguggcccauccccccuc

SEQ ID NO: 3743716 - RNA, 17 nt, Human
ggguggccgcugagugg

SEQ ID NO: 3743717 - RNA, 23 nt, Human
ggguggccuaagaguugagcucu

SEQ ID NO: 3743718 - RNA, 18 nt, Human
ggguggcgcuagaggcca

SEQ ID NO: 3743719 - RNA, 16 nt, Human
ggguggcuagucagag

SEQ ID NO: 3743720 - RNA, 17 nt, Human
ggguggcugcagccuca

SEQ ID NO: 3743721 - RNA, 19 nt, Human
gggugggagagcccagcca

SEQ ID NO: 3743722 - RNA, 15 nt, Human
gggugggcaggaaaa

SEQ ID NO: 3743723 - RNA, 15 nt, Human
gggugggcaguuuuu

SEQ ID NO: 3743724 - RNA, 14 nt, Human
gggugggccaggcu

SEQ ID NO: 3743725 - RNA, 11 nt, Human
gggugggccuc

SEQ ID NO: 3743726 - RNA, 13 nt, Human
gggugggccucgg

SEQ ID NO: 3743727 - RNA, 23 nt, Human
ggguggggacguccugccaccug

SEQ ID NO: 3743728 - RNA, 12 nt, Human
ggguggggcugc

SEQ ID NO: 3743729 - RNA, 14 nt, Human
ggguggggcugcuc

SEQ ID NO: 3743730 - RNA, 14 nt, Human
gggugggggcagca

SEQ ID NO: 3743731 - RNA, 21 nt, Human
gggugggggccaccugccugc

SEQ ID NO: 3743732 - RNA, 19 nt, Human
ggguggggggcuucauaca

SEQ ID NO: 3743733 - RNA, 15 nt, Human
ggguggggggggugc

SEQ ID NO: 3743734 - RNA, 16 nt, Human
gggugggguagggcug

SEQ ID NO: 3743735 - RNA, 16 nt, Human
gggugggguggcugca

SEQ ID NO: 3743736 - RNA, 22 nt, Human
ggguggucucuucuuggggccc

SEQ ID NO: 3743737 - RNA, 16 nt, Human
ggguggucugcaggca

SEQ ID NO: 3743738 - RNA, 12 nt, Human
ggguggugcugg

SEQ ID NO: 3743739 - RNA, 13 nt, Human
ggguggugucaga

SEQ ID NO: 3743740 - RNA, 18 nt, Human
gggugucauuucauucca

SEQ ID NO: 3743741 - RNA, 13 nt, Human
gggugucccagac

SEQ ID NO: 3743742 - RNA, 18 nt, Human
gggugucugucuuccuuu

SEQ ID NO: 3743743 - RNA, 15 nt, Human
gggugucuugggcag

SEQ ID NO: 3743744 - RNA, 20 nt, Human
gggugucuuuuuuuggugau

SEQ ID NO: 3743745 - RNA, 21 nt, Human
gggugugcaaugucugaguga

SEQ ID NO: 3743746 - RNA, 13 nt, Human
gggugugcuggga

SEQ ID NO: 3743747 - RNA, 17 nt, Human
ggguguggcgcagcaua

SEQ ID NO: 3743748 - RNA, 11 nt, Human
ggguguggguu

SEQ ID NO: 3743749 - RNA, 17 nt, Human
ggguuaaaucaaagaua

SEQ ID NO: 3743750 - RNA, 16 nt, Human
ggguuaagaagacuuu

SEQ ID NO: 3743751 - RNA, 17 nt, Human
ggguuagacugccagcu

SEQ ID NO: 3743752 - RNA, 13 nt, Human
ggguuaucucugu

SEQ ID NO: 3743753 - RNA, 14 nt, Human
ggguuaugaauauu

SEQ ID NO: 3743754 - RNA, 19 nt, Human
ggguuauguaucagaagag

SEQ ID NO: 3743755 - RNA, 23 nt, Human
ggguucaagcgauucuucugcuu

SEQ ID NO: 3743756 - RNA, 19 nt, Human
ggguucagaaaugcugccu

SEQ ID NO: 3743757 - RNA, 20 nt, Human
ggguucagaaaugcugccug

SEQ ID NO: 3743758 - RNA, 19 nt, Human
ggguucagagacucagggc

SEQ ID NO: 3743759 - RNA, 13 nt, Human
ggguucagccccu

SEQ ID NO: 3743760 - RNA, 17 nt, Human
ggguucagccccuccuc

SEQ ID NO: 3743761 - RNA, 22 nt, Human
ggguuccagcaauucuccugcc

SEQ ID NO: 3743762 - RNA, 21 nt, Human
ggguucccuuuccuuccaucc

SEQ ID NO: 3743763 - RNA, 18 nt, Human
ggguuccuccccuccagc

SEQ ID NO: 3743764 - RNA, 19 nt, Human
ggguuccuuccucugagcc

SEQ ID NO: 3743765 - RNA, 13 nt, Human
ggguuccuucugg

SEQ ID NO: 3743766 - RNA, 18 nt, Human
ggguucguggaaagggug

SEQ ID NO: 3743767 - RNA, 20 nt, Human
ggguucugccugccagcugc

SEQ ID NO: 3743768 - RNA, 15 nt, Human
ggguucugcugggac

SEQ ID NO: 3743769 - RNA, 14 nt, Human
ggguucuuucuucc

SEQ ID NO: 3743770 - RNA, 16 nt, Human
ggguucuuucuuccuc

SEQ ID NO: 3743771 - RNA, 17 nt, Human
ggguucuuucuuccucu

SEQ ID NO: 3743772 - RNA, 12 nt, Human
ggguugagggga

SEQ ID NO: 3743773 - RNA, 17 nt, Human
ggguugauuaaggcagu

SEQ ID NO: 3743774 - RNA, 19 nt, Human
ggguugcaguggagaggga

SEQ ID NO: 3743775 - RNA, 20 nt, Human
ggguugcguccugacggcgc

SEQ ID NO: 3743776 - RNA, 14 nt, Human
ggguugcuggagcc

SEQ ID NO: 3743777 - RNA, 15 nt, Human
ggguugcuggagccu

SEQ ID NO: 3743778 - RNA, 15 nt, Human
ggguugugugucugu

SEQ ID NO: 3743779 - RNA, 15 nt, Human
ggguuuauucacuga

SEQ ID NO: 3743780 - RNA, 19 nt, Human
ggguuuggaccccagcugg

SEQ ID NO: 3743781 - RNA, 21 nt, Human
ggguuuggaccccagcuggga

SEQ ID NO: 3743782 - RNA, 17 nt, Human
ggguuuuccacccugga

SEQ ID NO: 3743783 - RNA, 20 nt, Human
ggguuuugccauguuggcca

SEQ ID NO: 3743784 - RNA, 23 nt, Human
ggguuuugccauguuggccaggc

SEQ ID NO: 3743785 - RNA, 22 nt, Human
ggguuuuuuaguugaauuuuuu

SEQ ID NO: 3743786 - RNA, 22 nt, Human
gguaaaaaaaaauuacuguuua

SEQ ID NO: 3743787 - RNA, 16 nt, Human
gguaaaaaauuuauaa

SEQ ID NO: 3743788 - RNA, 13 nt, Human
gguaaaacacuug

SEQ ID NO: 3743789 - RNA, 18 nt, Human
gguaaaacagggccacau

SEQ ID NO: 3743790 - RNA, 13 nt, Human
gguaaaaugccau

SEQ ID NO: 3743791 - RNA, 17 nt, Human
gguaaaauguauuuuuc

SEQ ID NO: 3743792 - RNA, 13 nt, Human
gguaaaauuuugu

SEQ ID NO: 3743793 - RNA, 15 nt, Human
gguaaauaaaaagaa

SEQ ID NO: 3743794 - RNA, 20 nt, Human
gguaaauaccaaguauuuau

SEQ ID NO: 3743795 - RNA, 22 nt, Human
gguaaaucagacuaugaaguuu

SEQ ID NO: 3743796 - RNA, 13 nt, Human
gguaaaugaugug

SEQ ID NO: 3743797 - RNA, 13 nt, Human
gguaaaugccaca

SEQ ID NO: 3743798 - RNA, 20 nt, Human
gguaaaugccacacaccuuu

SEQ ID NO: 3743799 - RNA, 13 nt, Human
gguaaauguuucu

SEQ ID NO: 3743800 - RNA, 22 nt, Human
gguaaauuuccccaacagugug

SEQ ID NO: 3743801 - RNA, 18 nt, Human
gguaacagaacagcuuca

SEQ ID NO: 3743802 - RNA, 14 nt, Human
gguaacaggcagau

SEQ ID NO: 3743803 - RNA, 16 nt, Human
gguaacucuucuugau

SEQ ID NO: 3743804 - RNA, 23 nt, Human
gguaagaaguuuuaaaaagccag

SEQ ID NO: 3743805 - RNA, 17 nt, Human
gguaagagaauguuaua

SEQ ID NO: 3743806 - RNA, 23 nt, Human
gguaagagacagaauguaucugu

SEQ ID NO: 3743807 - RNA, 17 nt, Human
gguaagcaacauggcuu

SEQ ID NO: 3743808 - RNA, 19 nt, Human
gguaagcaacauggcuuug

SEQ ID NO: 3743809 - RNA, 18 nt, Human
gguaagcuuccaggaaaa

SEQ ID NO: 3743810 - RNA, 22 nt, Human
gguaaucaaugaauauugaagu

SEQ ID NO: 3743811 - RNA, 15 nt, Human
gguaaucauauuaga

SEQ ID NO: 3743812 - RNA, 20 nt, Human
gguaauccaggcacagcuga

SEQ ID NO: 3743813 - RNA, 14 nt, Human
gguaaucgaccugc

SEQ ID NO: 3743814 - RNA, 20 nt, Human
gguaaucuugcucugcuuga

SEQ ID NO: 3743815 - RNA, 20 nt, Human
gguaauuuuuacccuaaugu

SEQ ID NO: 3743816 - RNA, 19 nt, Human
gguacacaacuaguuuugu

SEQ ID NO: 3743817 - RNA, 15 nt, Human
gguacacuugugaau

SEQ ID NO: 3743818 - RNA, 10 nt, Human
gguacagaga

SEQ ID NO: 3743819 - RNA, 13 nt, Human
gguacagagaagc

SEQ ID NO: 3743820 - RNA, 15 nt, Human
gguacagagaaggaa

SEQ ID NO: 3743821 - RNA, 18 nt, Human
gguacaugguguuugugg

SEQ ID NO: 3743822 - RNA, 18 nt, Human
gguacauuucccugugcu

SEQ ID NO: 3743823 - RNA, 16 nt, Human
gguacauuuuucaacu

SEQ ID NO: 3743824 - RNA, 17 nt, Human
gguacauuuuucaacuu

SEQ ID NO: 3743825 - RNA, 14 nt, Human
gguaccagcugcgc

SEQ ID NO: 3743826 - RNA, 11 nt, Human
gguacccacug

SEQ ID NO: 3743827 - RNA, 13 nt, Human
gguacccacugcu

SEQ ID NO: 3743828 - RNA, 20 nt, Human
gguacccagccaucugccca

SEQ ID NO: 3743829 - RNA, 17 nt, Human
gguacccggggcccagg

SEQ ID NO: 3743830 - RNA, 13 nt, Human
gguacccugggug

SEQ ID NO: 3743831 - RNA, 11 nt, Human
gguaccuugca

SEQ ID NO: 3743832 - RNA, 12 nt, Human
gguaccuugcac

SEQ ID NO: 3743833 - RNA, 15 nt, Human
gguacgcacagacag

SEQ ID NO: 3743834 - RNA, 21 nt, Human
gguacuguaugaucaaauguu

SEQ ID NO: 3743835 - RNA, 21 nt, Human
gguacuuagaguuucuguuug

SEQ ID NO: 3743836 - RNA, 16 nt, Human
gguacuuguggacaca

SEQ ID NO: 3743837 - RNA, 21 nt, Human
gguacuuguggacacagcucu

SEQ ID NO: 3743838 - RNA, 22 nt, Human
gguacuuguggacacagcucuu

SEQ ID NO: 3743839 - RNA, 22 nt, Human
gguacuuuuaugauguauauuu

SEQ ID NO: 3743840 - RNA, 13 nt, Human
gguagaaaaacau

SEQ ID NO: 3743841 - RNA, 23 nt, Human
gguagaaauaucugaaaauguau

SEQ ID NO: 3743842 - RNA, 11 nt, Human
gguagaacaca

SEQ ID NO: 3743843 - RNA, 23 nt, Human
gguagaacgccagggaccccaga

SEQ ID NO: 3743844 - RNA, 17 nt, Human
guacaggacauauauuu

SEQ ID NO: 3743845 - RNA, 23 nt, Human
guacaggacauauauuuuuuaaa

SEQ ID NO: 3743846 - RNA, 13 nt, Human
guacaggcuggcg

SEQ ID NO: 3743847 - RNA, 15 nt, Human
guacagguacuuugu

SEQ ID NO: 3743848 - RNA, 16 nt, Human
guacagguacuuuguc

SEQ ID NO: 3743849 - RNA, 21 nt, Human
guacaguauggggguuguaaa

SEQ ID NO: 3743850 - RNA, 22 nt, Human
guacaguauggggguuguaaau

SEQ ID NO: 3743851 - RNA, 21 nt, Human
guacagucugucuucuguaua

SEQ ID NO: 3743852 - RNA, 13 nt, Human
guacagucuugua

SEQ ID NO: 3743853 - RNA, 15 nt, Human
guacagugucuuuuu

SEQ ID NO: 3743854 - RNA, 20 nt, Human
guacagugucuuuuuuugua

SEQ ID NO: 3743855 - RNA, 21 nt, Human
guacagugucuuuuuuuguau

SEQ ID NO: 3743856 - RNA, 17 nt, Human
gaccacaccucccugaa

SEQ ID NO: 3743857 - RNA, 20 nt, Human
gaccacaccucccugaacca

SEQ ID NO: 3743858 - RNA, 16 nt, Human
gaccacaccugccucu

SEQ ID NO: 3743859 - RNA, 16 nt, Human
gaccacacuccagcug

SEQ ID NO: 3743860 - RNA, 17 nt, Human
gaccacacuuccugucc

SEQ ID NO: 3743861 - RNA, 21 nt, Human
gaccacagcaaggcaccugca

SEQ ID NO: 3743862 - RNA, 21 nt, Human
gaccacaggguucaaaauguc

SEQ ID NO: 3743863 - RNA, 18 nt, Human
gaccacauuuuauauuua

SEQ ID NO: 3743864 - RNA, 12 nt, Human
gaccaccaagcc

SEQ ID NO: 3743865 - RNA, 15 nt, Human
gaccaccaagccuug

SEQ ID NO: 3743866 - RNA, 13 nt, Human
gaccaccagggca

SEQ ID NO: 3743867 - RNA, 22 nt, Human
gaccaccagggcaucucugggc

SEQ ID NO: 3743868 - RNA, 18 nt, Human
gaccaccccgccugcccu

SEQ ID NO: 3743869 - RNA, 20 nt, Human
gaccaccccgccugcccuca

SEQ ID NO: 3743870 - RNA, 20 nt, Human
gaccaccccugccuccaccc

SEQ ID NO: 3743871 - RNA, 22 nt, Human
gaccaccccugccuccacccuc

SEQ ID NO: 3743872 - RNA, 19 nt, Human
gaccacccucacuggcucu

SEQ ID NO: 3743873 - RNA, 14 nt, Human
gaccacccuccccu

SEQ ID NO: 3743874 - RNA, 15 nt, Human
gaccacccuccccuc

SEQ ID NO: 3743875 - RNA, 16 nt, Human
gaccacccuccccucu

SEQ ID NO: 3743876 - RNA, 19 nt, Human
gaccacccuccccucucuu

SEQ ID NO: 3743877 - RNA, 14 nt, Human
gaccacccugagcc

SEQ ID NO: 3743878 - RNA, 14 nt, Human
gaccaccugcccaa

SEQ ID NO: 3743879 - RNA, 21 nt, Human
gaccacgcccguccugccugu

SEQ ID NO: 3743880 - RNA, 21 nt, Human
gaccacgcuuucuagcuguug

SEQ ID NO: 3743881 - RNA, 21 nt, Human
gaccacggacguuuccaucag

SEQ ID NO: 3743882 - RNA, 14 nt, Human
gaccacguuucuaa

SEQ ID NO: 3743883 - RNA, 13 nt, Human
gaccacucagaga

SEQ ID NO: 3743884 - RNA, 19 nt, Human
gaccacucagagacaugca

SEQ ID NO: 3743885 - RNA, 19 nt, Human
guagcccccuggccucugu

SEQ ID NO: 3743886 - RNA, 17 nt, Human
guagcccucccacuuug

SEQ ID NO: 3743887 - RNA, 14 nt, Human
guagcccuuucugu

SEQ ID NO: 3743888 - RNA, 19 nt, Human
guagccgagagccugcucc

SEQ ID NO: 3743889 - RNA, 14 nt, Human
guagccuuccucca

SEQ ID NO: 3743890 - RNA, 11 nt, Human
guagccuuuuu

SEQ ID NO: 3743891 - RNA, 23 nt, Human
guagcgggggaggguaggcagga

SEQ ID NO: 3743892 - RNA, 18 nt, Human
guagcguuuuuuaaaugu

SEQ ID NO: 3743893 - RNA, 16 nt, Human
guagcuaacuuuuauu

SEQ ID NO: 3743894 - RNA, 15 nt, Human
guagcuacagagaaa

SEQ ID NO: 3743895 - RNA, 17 nt, Human
guagcuagaggaaccaa

SEQ ID NO: 3743896 - RNA, 11 nt, Human
guagcucaggu

SEQ ID NO: 3743897 - RNA, 10 nt, Human
guagcuccuc

SEQ ID NO: 3743898 - RNA, 13 nt, Human
guagcuccucccc

SEQ ID NO: 3743899 - RNA, 19 nt, Human
guagcuccuccccuggagg

SEQ ID NO: 3743900 - RNA, 14 nt, Human
guagcugaaaugca

SEQ ID NO: 3743901 - RNA, 17 nt, Human
guagcugcaaaggacag

SEQ ID NO: 3743902 - RNA, 23 nt, Human
guagcugccacuugaacaaaauc

SEQ ID NO: 3743903 - RNA, 15 nt, Human
guagcugccccuggc

SEQ ID NO: 3743904 - RNA, 17 nt, Human
guagcuggauuacaggc

SEQ ID NO: 3743905 - RNA, 22 nt, Human
guagcugggaaagcauaaagcu

SEQ ID NO: 3743906 - RNA, 19 nt, Human
guagcugggacuacaggca

SEQ ID NO: 3743907 - RNA, 21 nt, Human
guagcugggauuacaggugug

SEQ ID NO: 3743908 - RNA, 22 nt, Human
guagcugggauuuuaaacuaga

SEQ ID NO: 3743909 - RNA, 24 nt, Human
guagcugggauuuuaaacuagaug

SEQ ID NO: 3743910 - RNA, 14 nt, Human
guagcugugaccug

SEQ ID NO: 3743911 - RNA, 17 nt, Human
guagcugugaccugcug

SEQ ID NO: 3743912 - RNA, 18 nt, Human
guagcugugaccugcuga

SEQ ID NO: 3743913 - RNA, 19 nt, Human
guagcugugaccugcugag

SEQ ID NO: 3743914 - RNA, 21 nt, Human
guagcugugaccugcugagcu

SEQ ID NO: 3743915 - RNA, 18 nt, Human
guagcuguggugaggugg

SEQ ID NO: 3743916 - RNA, 18 nt, Human
guagcuuaccugacacaa

SEQ ID NO: 3743917 - RNA, 16 nt, Human
guagcuucagucauua

SEQ ID NO: 3743918 - RNA, 11 nt, Human
guagcuuugca

SEQ ID NO: 3743919 - RNA, 14 nt, Human
guaggaaagggcaa

SEQ ID NO: 3743920 - RNA, 13 nt, Human
guaggaaaugugg

SEQ ID NO: 3743921 - RNA, 22 nt, Human
guaggaaccgugguaugucugc

SEQ ID NO: 3743922 - RNA, 16 nt, Human
guaggaacugcugggc

SEQ ID NO: 3743923 - RNA, 15 nt, Human
guaggaaguaggaag

SEQ ID NO: 3743924 - RNA, 17 nt, Human
guaggaauauuauauuu

SEQ ID NO: 3743925 - RNA, 20 nt, Human
guaggacaaggugcaggcag

SEQ ID NO: 3743926 - RNA, 19 nt, Human
guaggaccaagcaucuugg

SEQ ID NO: 3743927 - RNA, 19 nt, Human
guaggacuuuccuaaaugu

SEQ ID NO: 3743928 - RNA, 18 nt, Human
guaggagcccagcucuga

SEQ ID NO: 3743929 - RNA, 17 nt, Human
guaggagggugggaagg

SEQ ID NO: 3743930 - RNA, 15 nt, Human
guaggaugaaaagau

SEQ ID NO: 3743931 - RNA, 18 nt, Human
guaggcaagauggcacag

SEQ ID NO: 3743932 - RNA, 11 nt, Human
guaggcagaca

SEQ ID NO: 3743933 - RNA, 23 nt, Human
guaggcagacacagggacuugaa

SEQ ID NO: 3743934 - RNA, 22 nt, Human
guaggcagccugagagucuaga

SEQ ID NO: 3743935 - RNA, 17 nt, Human
guaggcaugagggauca

SEQ ID NO: 3743936 - RNA, 23 nt, Human
guaggcaugagggaucacagggc

SEQ ID NO: 3743937 - RNA, 14 nt, Human
guaggcauuuccua

SEQ ID NO: 3743938 - RNA, 15 nt, Human
guagggaggcagccu

SEQ ID NO: 3743939 - RNA, 13 nt, Human
guagggagggcgg

SEQ ID NO: 3743940 - RNA, 16 nt, Human
guagggcgggaggaug

SEQ ID NO: 3743941 - RNA, 12 nt, Human
guagggcugacu

SEQ ID NO: 3743942 - RNA, 20 nt, Human
guaggggccccucucagccc

SEQ ID NO: 3743943 - RNA, 13 nt, Human
guaggggcuggga

SEQ ID NO: 3743944 - RNA, 17 nt, Human
guaggggcugggaacag

SEQ ID NO: 3743945 - RNA, 18 nt, Human
guagggguaccacugaau

SEQ ID NO: 3743946 - RNA, 15 nt, Human
guagggguggcccga

SEQ ID NO: 3743947 - RNA, 21 nt, Human
guagggucaggccacggcagc

SEQ ID NO: 3743948 - RNA, 22 nt, Human
guagggucaggccacggcagcc

SEQ ID NO: 3743949 - RNA, 15 nt, Human
guagggugggagugg

SEQ ID NO: 3743950 - RNA, 17 nt, Human
guagggugggccuucag

SEQ ID NO: 3743951 - RNA, 16 nt, Human
guaggguuauaauaau

SEQ ID NO: 3743952 - RNA, 22 nt, Human
guagguaaaauguauuuuucua

SEQ ID NO: 3743953 - RNA, 20 nt, Human
guagguacuuuuugugaaga

SEQ ID NO: 3743954 - RNA, 19 nt, Human
guagguugcacacuuuggu

SEQ ID NO: 3743955 - RNA, 15 nt, Human
guaguaaauaaugcu

SEQ ID NO: 3743956 - RNA, 15 nt, Human
guaguaacacuaaua

SEQ ID NO: 3743957 - RNA, 19 nt, Human
guaguacuccuuaagaaca

SEQ ID NO: 3743958 - RNA, 20 nt, Human
guaguacuccuuaagaacac

SEQ ID NO: 3743959 - RNA, 17 nt, Human
guaguacuucuucugua

SEQ ID NO: 3743960 - RNA, 22 nt, Human
guaguacuucuucuguaauauu

SEQ ID NO: 3743961 - RNA, 21 nt, Human
guaguagcccuuucugugugc

SEQ ID NO: 3743962 - RNA, 17 nt, Human
guaguauggccuguguc

SEQ ID NO: 3743963 - RNA, 19 nt, Human
guaguauuuuuuguauaau

SEQ ID NO: 3743964 - RNA, 23 nt, Human
guaguauuuuuuguauaauugga

SEQ ID NO: 3743965 - RNA, 17 nt, Human
guagucaagauuguguu

SEQ ID NO: 3743966 - RNA, 14 nt, Human
guagucaggugccu

SEQ ID NO: 3743967 - RNA, 18 nt, Human
guagucuaaccaaaugca

SEQ ID NO: 3743968 - RNA, 20 nt, Human
guagucucacugcuugaacu

SEQ ID NO: 3743969 - RNA, 18 nt, Human
guagucucauuacuuuug

SEQ ID NO: 3743970 - RNA, 16 nt, Human
guagucuugaugacca

SEQ ID NO: 3743971 - RNA, 22 nt, Human
guagugaaauaauagaaugagc

SEQ ID NO: 3743972 - RNA, 20 nt, Human
guaguguccauuuugugaag

SEQ ID NO: 3743973 - RNA, 14 nt, Human
guaguguuggagaa

SEQ ID NO: 3743974 - RNA, 17 nt, Human
guaguguuggagaagaa

SEQ ID NO: 3743975 - RNA, 20 nt, Human
guaguguuggagaagaacug

SEQ ID NO: 3743976 - RNA, 23 nt, Human
guaguuaaaaaaaaaaaaaggaa

SEQ ID NO: 3743977 - RNA, 20 nt, Human
guaguuaggaaauaaaaccu

SEQ ID NO: 3743978 - RNA, 13 nt, Human
guaguuaguagca

SEQ ID NO: 3743979 - RNA, 15 nt, Human
guaguuaucauguua

SEQ ID NO: 3743980 - RNA, 19 nt, Human
guaguucaagaaaugaaga

SEQ ID NO: 3743981 - RNA, 15 nt, Human
guaguucauguaaau

SEQ ID NO: 3743982 - RNA, 17 nt, Human
guaguucccugaaaacc

SEQ ID NO: 3743983 - RNA, 23 nt, Human
guaguucccugaaaacccagaga

SEQ ID NO: 3743984 - RNA, 13 nt, Human
guaguucuaagac

SEQ ID NO: 3743985 - RNA, 16 nt, Human
guaguucugcuccaga

SEQ ID NO: 3743986 - RNA, 14 nt, Human
guaguucuguauuu

SEQ ID NO: 3743987 - RNA, 15 nt, Human
guaguucuguauuug

SEQ ID NO: 3743988 - RNA, 16 nt, Human
guaguucuguauuuga

SEQ ID NO: 3743989 - RNA, 20 nt, Human
guaguugaggaaagcacaga

SEQ ID NO: 3743990 - RNA, 20 nt, Human
guaguuuuauuuuauguuua

SEQ ID NO: 3743991 - RNA, 14 nt, Human
guaguuuuuucauc

SEQ ID NO: 3743992 - RNA, 17 nt, Human
guaguuuuuucaucuuc

SEQ ID NO: 3743993 - RNA, 15 nt, Human
guauaaaacuuuccu

SEQ ID NO: 3743994 - RNA, 16 nt, Human
guauaaaacuuuccuc

SEQ ID NO: 3743995 - RNA, 23 nt, Human
guauaaaagauggggucuguaaa

SEQ ID NO: 3743996 - RNA, 18 nt, Human
guauaaaagccuguuuaa

SEQ ID NO: 3743997 - RNA, 21 nt, Human
guauaaaagccuguuuaagag

SEQ ID NO: 3743998 - RNA, 19 nt, Human
guauaaaagggacugagaa

SEQ ID NO: 3743999 - RNA, 21 nt, Human
guauaaaauaauuuuuauauu

SEQ ID NO: 3744000 - RNA, 17 nt, Human
guauaaacaagaaaaau

SEQ ID NO: 3744001 - RNA, 22 nt, Human
guauaaacaagaaaaauaaaga

SEQ ID NO: 3744002 - RNA, 11 nt, Human
guauaaacauu

SEQ ID NO: 3744003 - RNA, 19 nt, Human
guauaaacauuaaaugucu

SEQ ID NO: 3744004 - RNA, 16 nt, Human
guauaaagcucagaag

SEQ ID NO: 3744005 - RNA, 18 nt, Human
guauaaaggcauugauau

SEQ ID NO: 3744006 - RNA, 11 nt, Human
guauaaaugua

SEQ ID NO: 3744007 - RNA, 17 nt, Human
guauaaauguauauaca

SEQ ID NO: 3744008 - RNA, 22 nt, Human
guauaaauugucuuuaaaaacu

SEQ ID NO: 3744009 - RNA, 23 nt, Human
guauaaauuuauuuacugcuagu

SEQ ID NO: 3744010 - RNA, 13 nt, Human
guauaacagguua

SEQ ID NO: 3744011 - RNA, 23 nt, Human
guauaacuuuaacuucuguuuua

SEQ ID NO: 3744012 - RNA, 14 nt, Human
guauaagaaaugca

SEQ ID NO: 3744013 - RNA, 18 nt, Human
guauaagauccuagaucc

SEQ ID NO: 3744014 - RNA, 22 nt, Human
guauaagauccuagauccuaag

SEQ ID NO: 3744015 - RNA, 22 nt, Human
guauaagcacugaaaaacaaca

SEQ ID NO: 3744016 - RNA, 23 nt, Human
guauaaguccuugcaagaaucag

SEQ ID NO: 3744017 - RNA, 12 nt, Human
guauaaguuauu

SEQ ID NO: 3744018 - RNA, 21 nt, Human
guauaaguuauuuuuguacau

SEQ ID NO: 3744019 - RNA, 22 nt, Human
guauaaguuauuuuuguacaug

SEQ ID NO: 3744020 - RNA, 23 nt, Human
guauaaguuauuuuuguacaugu

SEQ ID NO: 3744021 - RNA, 22 nt, Human
guauaauacuuuguauacaagu

SEQ ID NO: 3744022 - RNA, 13 nt, Human
guauaauauaaaa

SEQ ID NO: 3744023 - RNA, 15 nt, Human
guauaauauugaaaa

SEQ ID NO: 3744024 - RNA, 18 nt, Human
guauaauguuuauuaaau

SEQ ID NO: 3744025 - RNA, 20 nt, Human
guauaauguuuauuaaaugc

SEQ ID NO: 3744026 - RNA, 17 nt, Human
guauaauuaacauguua

SEQ ID NO: 3744027 - RNA, 19 nt, Human
guauaauuaacauguuaaa

SEQ ID NO: 3744028 - RNA, 22 nt, Human
guauaauucacccaccagacuu

SEQ ID NO: 3744029 - RNA, 23 nt, Human
guauaauugugugauauuucaga

SEQ ID NO: 3744030 - RNA, 17 nt, Human
guauaauuucgagauuu

SEQ ID NO: 3744031 - RNA, 18 nt, Human
guauaauuucgagauuug

SEQ ID NO: 3744032 - RNA, 19 nt, Human
guauacaacccuggcauua

SEQ ID NO: 3744033 - RNA, 21 nt, Human
guauacaguggauuaauuaaa

SEQ ID NO: 3744034 - RNA, 15 nt, Human
ggugcugggccccug

SEQ ID NO: 3744035 - RNA, 13 nt, Human
ggugcuggucccg

SEQ ID NO: 3744036 - RNA, 11 nt, Human
ggugcugucca

SEQ ID NO: 3744037 - RNA, 20 nt, Human
ggugcuguccucagguggcc

SEQ ID NO: 3744038 - RNA, 14 nt, Human
ggugcugugaggga

SEQ ID NO: 3744039 - RNA, 17 nt, Human
ggugcugugagggaggg

SEQ ID NO: 3744040 - RNA, 16 nt, Human
ggugcuguggccaggg

SEQ ID NO: 3744041 - RNA, 21 nt, Human
ggugcuuguucccucucccug

SEQ ID NO: 3744042 - RNA, 10 nt, Human
ggugcuuucc

SEQ ID NO: 3744043 - RNA, 21 nt, Human
ggugcuuuuauagaggcuagc

SEQ ID NO: 3744044 - RNA, 21 nt, Human
gguggaaaggugugagacugg

SEQ ID NO: 3744045 - RNA, 19 nt, Human
gguggaacauauggucucc

SEQ ID NO: 3744046 - RNA, 13 nt, Human
gguggaagcccuc

SEQ ID NO: 3744047 - RNA, 18 nt, Human
gguggaagcccuccuucc

SEQ ID NO: 3744048 - RNA, 16 nt, Human
gguggaaggcccgagg

SEQ ID NO: 3744049 - RNA, 15 nt, Human
gguggaauuauuuua

SEQ ID NO: 3744050 - RNA, 14 nt, Human
gguggacaguccug

SEQ ID NO: 3744051 - RNA, 15 nt, Human
gguggacaguccugg

SEQ ID NO: 3744052 - RNA, 18 nt, Human
gguggacaguccugggag

SEQ ID NO: 3744053 - RNA, 15 nt, Human
gguggacauggcccc

SEQ ID NO: 3744054 - RNA, 18 nt, Human
gguggacccagggaacag

SEQ ID NO: 3744055 - RNA, 22 nt, Human
gguggaccuuuuaaaguguuuc

SEQ ID NO: 3744056 - RNA, 18 nt, Human
gguggacuuagaaagcag

SEQ ID NO: 3744057 - RNA, 14 nt, Human
gguggagaagccau

SEQ ID NO: 3744058 - RNA, 23 nt, Human
gguggagggccacaugggaggcu

SEQ ID NO: 3744059 - RNA, 19 nt, Human
gguggagugcaguggugcg

SEQ ID NO: 3744060 - RNA, 15 nt, Human
gguggaguuaaucuu

SEQ ID NO: 3744061 - RNA, 15 nt, Human
gguggauauaaauau

SEQ ID NO: 3744062 - RNA, 15 nt, Human
gguggaucacagagg

SEQ ID NO: 3744063 - RNA, 20 nt, Human
gguggaugauccccacgcca

SEQ ID NO: 3744064 - RNA, 13 nt, Human
gguggaugccugg

SEQ ID NO: 3744065 - RNA, 22 nt, Human
gguggauggccccagcacagcu

SEQ ID NO: 3744066 - RNA, 16 nt, Human
gguggcacuuuuucau

SEQ ID NO: 3744067 - RNA, 17 nt, Human
gguggcaucccaguggc

SEQ ID NO: 3744068 - RNA, 20 nt, Human
gguggccacuccagaccccu

SEQ ID NO: 3744069 - RNA, 22 nt, Human
gguggccacuccagaccccugg

SEQ ID NO: 3744070 - RNA, 20 nt, Human
gguggccaugccucagcccu

SEQ ID NO: 3744071 - RNA, 15 nt, Human
gguggccaugcuccu

SEQ ID NO: 3744072 - RNA, 20 nt, Human
gguggcccucuccccugccc

SEQ ID NO: 3744073 - RNA, 21 nt, Human
gguggcccucuccccugcccc

SEQ ID NO: 3744074 - RNA, 23 nt, Human
gguggcccuuaugacugccaaga

SEQ ID NO: 3744075 - RNA, 19 nt, Human
gguggccuaagaguugagc

SEQ ID NO: 3744076 - RNA, 22 nt, Human
gguggccucccaacucacccca

SEQ ID NO: 3744077 - RNA, 22 nt, Human
gguggcgcuagaggccauggag

SEQ ID NO: 3744078 - RNA, 21 nt, Human
gguggcgggcgccuguaaucc

SEQ ID NO: 3744079 - RNA, 19 nt, Human
gguggcgggugccuguaau

SEQ ID NO: 3744080 - RNA, 19 nt, Human
gguggcuacucugugccag

SEQ ID NO: 3744081 - RNA, 17 nt, Human
gguggcuagucagagag

SEQ ID NO: 3744082 - RNA, 14 nt, Human
gguggcucacgccu

SEQ ID NO: 3744083 - RNA, 17 nt, Human
gguggcucaugccugua

SEQ ID NO: 3744084 - RNA, 13 nt, Human
gguggcugaccca

SEQ ID NO: 3744085 - RNA, 23 nt, Human
gguggcugacccagucccugggg

SEQ ID NO: 3744086 - RNA, 15 nt, Human
gguggcugcagccuc

SEQ ID NO: 3744087 - RNA, 16 nt, Human
gguggcugcagccuca

SEQ ID NO: 3744088 - RNA, 11 nt, Human
gguggcugggc

SEQ ID NO: 3744089 - RNA, 23 nt, Human
gguggcuuuccuuguggcagagg

SEQ ID NO: 3744090 - RNA, 15 nt, Human
ggugggaaggggagc

SEQ ID NO: 3744091 - RNA, 23 nt, Human
ggugggaaggggagcacaauuuc

SEQ ID NO: 3744092 - RNA, 15 nt, Human
ggugggagagcccag

SEQ ID NO: 3744093 - RNA, 20 nt, Human
ggugggaggauugcuugagc

SEQ ID NO: 3744094 - RNA, 15 nt, Human
ggugggauccuccag

SEQ ID NO: 3744095 - RNA, 14 nt, Human
ggugggcagguggu

SEQ ID NO: 3744096 - RNA, 16 nt, Human
ggugggccagccccuc

SEQ ID NO: 3744097 - RNA, 12 nt, Human
ggugggccaggc

SEQ ID NO: 3744098 - RNA, 14 nt, Human
ggugggccaggcug

SEQ ID NO: 3744099 - RNA, 20 nt, Human
ggugggcccaggaccagcug

SEQ ID NO: 3744100 - RNA, 21 nt, Human
ggugggcccaggaccagcugg

SEQ ID NO: 3744101 - RNA, 22 nt, Human
ggugggcccaggaccagcuggg

SEQ ID NO: 3744102 - RNA, 20 nt, Human
ggugggcggcacagccuucu

SEQ ID NO: 3744103 - RNA, 20 nt, Human
ggugggcuucccaguggcug

SEQ ID NO: 3744104 - RNA, 11 nt, Human
gguggggaggg

SEQ ID NO: 3744105 - RNA, 14 nt, Human
gguggggaggggcg

SEQ ID NO: 3744106 - RNA, 13 nt, Human
gguggggcagcuc

SEQ ID NO: 3744107 - RNA, 13 nt, Human
gguggggcagcuu

SEQ ID NO: 3744108 - RNA, 16 nt, Human
gguggggcgaggcagg

SEQ ID NO: 3744109 - RNA, 13 nt, Human
gguggggcugcuc

SEQ ID NO: 3744110 - RNA, 17 nt, Human
gguggggcugcuccucc

SEQ ID NO: 3744111 - RNA, 22 nt, Human
gguggggcugcuccuccagggc

SEQ ID NO: 3744112 - RNA, 12 nt, Human
ggugggggagga

SEQ ID NO: 3744113 - RNA, 13 nt, Human
ggugggggccucg

SEQ ID NO: 3744114 - RNA, 19 nt, Human
ggugggggggcagagcccu

SEQ ID NO: 3744115 - RNA, 10 nt, Human
ggugggggua

SEQ ID NO: 3744116 - RNA, 20 nt, Human
gguggggguagggggcugga

SEQ ID NO: 3744117 - RNA, 23 nt, Human
gguggggguaggguuucccuacu

SEQ ID NO: 3744118 - RNA, 17 nt, Human
ggugggggugggucaga

SEQ ID NO: 3744119 - RNA, 14 nt, Human
ggugggguccugga

SEQ ID NO: 3744120 - RNA, 11 nt, Human
gguggggugga

SEQ ID NO: 3744121 - RNA, 14 nt, Human
gguggguauaaaag

SEQ ID NO: 3744122 - RNA, 14 nt, Human
gguggguccauggg

SEQ ID NO: 3744123 - RNA, 20 nt, Human
gguggguccaugggcagagc

SEQ ID NO: 3744124 - RNA, 19 nt, Human
ggugggucccggcucugug

SEQ ID NO: 3744125 - RNA, 12 nt, Human
ggugggugaaag

SEQ ID NO: 3744126 - RNA, 15 nt, Human
ggugggugaaaggaa

SEQ ID NO: 3744127 - RNA, 12 nt, Human
ggugggugcuca

SEQ ID NO: 3744128 - RNA, 20 nt, Human
ggugguauuuucaauagcca

SEQ ID NO: 3744129 - RNA, 14 nt, Human
gguggucaggcgua

SEQ ID NO: 3744130 - RNA, 14 nt, Human
gguggucccugggu

SEQ ID NO: 3744131 - RNA, 18 nt, Human
gguggucugaauguucug

SEQ ID NO: 3744132 - RNA, 19 nt, Human
gguggucugaauguucuga

SEQ ID NO: 3744133 - RNA, 17 nt, Human
gguggucugcaggcagg

SEQ ID NO: 3744134 - RNA, 19 nt, Human
gguggucugcucgggccca

SEQ ID NO: 3744135 - RNA, 22 nt, Human
gguggucuguuggcaggcuggc

SEQ ID NO: 3744136 - RNA, 16 nt, Human
gguggugaccucugcc

SEQ ID NO: 3744137 - RNA, 21 nt, Human
ggugguggaucuguccaagga

SEQ ID NO: 3744138 - RNA, 15 nt, Human
ggugguggcucggga

SEQ ID NO: 3744139 - RNA, 19 nt, Human
gguggugucgggcccuucu

SEQ ID NO: 3744140 - RNA, 21 nt, Human
gguggugucuccaacccccca

SEQ ID NO: 3744141 - RNA, 21 nt, Human
ggugguuauggagaggguguc

SEQ ID NO: 3744142 - RNA, 23 nt, Human
ggugguucacucuuggagccugc

SEQ ID NO: 3744143 - RNA, 21 nt, Human
ggugguugcuguuuuccuccc

SEQ ID NO: 3744144 - RNA, 18 nt, Human
ggugguuucagaaaugug

SEQ ID NO: 3744145 - RNA, 15 nt, Human
ggugguuuucuguuc

SEQ ID NO: 3744146 - RNA, 16 nt, Human
gguguaaccugagaug

SEQ ID NO: 3744147 - RNA, 14 nt, Human
gguguaauaagaca

SEQ ID NO: 3744148 - RNA, 15 nt, Human
gguguaauaagacau

SEQ ID NO: 3744149 - RNA, 16 nt, Human
gguguaauaagacaua

SEQ ID NO: 3744150 - RNA, 18 nt, Human
gguguaauaagacauaac

SEQ ID NO: 3744151 - RNA, 14 nt, Human
gguguaauggagca

SEQ ID NO: 3744152 - RNA, 12 nt, Human
gguguagccagg

SEQ ID NO: 3744153 - RNA, 16 nt, Human
gguguagcuacagaga

SEQ ID NO: 3744154 - RNA, 16 nt, Human
gguguauuuaaacuau

SEQ ID NO: 3744155 - RNA, 17 nt, Human
gguguauuuauuuuccu

SEQ ID NO: 3744156 - RNA, 19 nt, Human
ggugucacauggugccccu

SEQ ID NO: 3744157 - RNA, 13 nt, Human
ggugucaccccag

SEQ ID NO: 3744158 - RNA, 16 nt, Human
ggugucaccccagagc

SEQ ID NO: 3744159 - RNA, 22 nt, Human
ggugucaccccagagccacaca

SEQ ID NO: 3744160 - RNA, 19 nt, Human
ggugucaccugaagacuca

SEQ ID NO: 3744161 - RNA, 14 nt, Human
ggugucacuguccc

SEQ ID NO: 3744162 - RNA, 17 nt, Human
ggugucacuuacuguuu

SEQ ID NO: 3744163 - RNA, 19 nt, Human
ggugucacuuacuguuucu

SEQ ID NO: 3744164 - RNA, 20 nt, Human
ggugucagccauugcaccca

SEQ ID NO: 3744165 - RNA, 21 nt, Human
gguguccccaccaucugcugu

SEQ ID NO: 3744166 - RNA, 20 nt, Human
gguguccccgcugcugugca

SEQ ID NO: 3744167 - RNA, 12 nt, Human
gguguccuacag

SEQ ID NO: 3744168 - RNA, 15 nt, Human
gguguccuacagaaa

SEQ ID NO: 3744169 - RNA, 12 nt, Human
gguguccugacc

SEQ ID NO: 3744170 - RNA, 18 nt, Human
gguguccugaccacccuc

SEQ ID NO: 3744171 - RNA, 20 nt, Human
gguguccugccugucugccc

SEQ ID NO: 3744172 - RNA, 21 nt, Human
gguguccugccugucugcccc

SEQ ID NO: 3744173 - RNA, 19 nt, Human
ggugucuccaaccccccag

SEQ ID NO: 3744174 - RNA, 21 nt, Human
ggugucucuucuuuagaacag

SEQ ID NO: 3744175 - RNA, 23 nt, Human
ggugucuguguuccaaccacuga

SEQ ID NO: 3744176 - RNA, 20 nt, Human
ggugucuugggcagagcugg

SEQ ID NO: 3744177 - RNA, 20 nt, Human
ggugugaaagucagaugccc

SEQ ID NO: 3744178 - RNA, 16 nt, Human
ggugugaccacugcag

SEQ ID NO: 3744179 - RNA, 18 nt, Human
ggugugcacaucucugcu

SEQ ID NO: 3744180 - RNA, 24 nt, Human
ggugugcacguggcauguggccug

SEQ ID NO: 3744181 - RNA, 13 nt, Human
ggugugccugcag

SEQ ID NO: 3744182 - RNA, 15 nt, Human
ggugugccugcagcc

SEQ ID NO: 3744183 - RNA, 16 nt, Human
gguguggagccgaggc

SEQ ID NO: 3744184 - RNA, 12 nt, Human
gguguggcuccu

SEQ ID NO: 3744185 - RNA, 11 nt, Human
gguguggggga

SEQ ID NO: 3744186 - RNA, 13 nt, Human
ggugugggggaag

SEQ ID NO: 3744187 - RNA, 19 nt, Human
gguguggguguccugccug

SEQ ID NO: 3744188 - RNA, 15 nt, Human
ggugugguacagaga

SEQ ID NO: 3744189 - RNA, 19 nt, Human
ggugugguacagagaagcc

SEQ ID NO: 3744190 - RNA, 23 nt, Human
ggugugguacagagaagccagcu

SEQ ID NO: 3744191 - RNA, 19 nt, Human
gguguguuccaacugcccc

SEQ ID NO: 3744192 - RNA, 22 nt, Human
gguguuauuuggaaccuuguuu

SEQ ID NO: 3744193 - RNA, 22 nt, Human
gguguugccaaauauguccugg

SEQ ID NO: 3744194 - RNA, 15 nt, Human
gguguuuaguugcag

SEQ ID NO: 3744195 - RNA, 22 nt, Human
gguguuucucccucucacuguc

SEQ ID NO: 3744196 - RNA, 23 nt, Human
gguguuucucccucucacugucu

SEQ ID NO: 3744197 - RNA, 14 nt, Human
gguguuugaaaaua

SEQ ID NO: 3744198 - RNA, 22 nt, Human
gguguuuuuuaugaagugcgug

SEQ ID NO: 3744199 - RNA, 16 nt, Human
gguuaaaaaaaaaagu

SEQ ID NO: 3744200 - RNA, 21 nt, Human
gguuaaaacuguacauuuaaa

SEQ ID NO: 3744201 - RNA, 22 nt, Human
gguuaaaacuguacauuuaaaa

SEQ ID NO: 3744202 - RNA, 14 nt, Human
gguuaaauacugug

SEQ ID NO: 3744203 - RNA, 13 nt, Human
gguuaacaaauaa

SEQ ID NO: 3744204 - RNA, 13 nt, Human
gguuaaggccuga

SEQ ID NO: 3744205 - RNA, 14 nt, Human
gguuaaggccugaa

SEQ ID NO: 3744206 - RNA, 16 nt, Human
gguuaagucuguuuua

SEQ ID NO: 3744207 - RNA, 15 nt, Human
gguuaauaccagcuu

SEQ ID NO: 3744208 - RNA, 14 nt, Human
gguuacaacagauu

SEQ ID NO: 3744209 - RNA, 21 nt, Human
gguuacacuguuagaacacua

SEQ ID NO: 3744210 - RNA, 16 nt, Human
gguuaccaagaagccu

SEQ ID NO: 3744211 - RNA, 18 nt, Human
gguuaccgauuucaaagu

SEQ ID NO: 3744212 - RNA, 17 nt, Human
gguuacuucuucucuua

SEQ ID NO: 3744213 - RNA, 13 nt, Human
gguuagaccuaca

SEQ ID NO: 3744214 - RNA, 17 nt, Human
gguuagcagagcuggac

SEQ ID NO: 3744215 - RNA, 22 nt, Human
gguuaggaggguuucauugucu

SEQ ID NO: 3744216 - RNA, 12 nt, Human
gguuauacauga

SEQ ID NO: 3744217 - RNA, 14 nt, Human
gguuauacaugaca

SEQ ID NO: 3744218 - RNA, 23 nt, Human
gguuauagacagucguucccagu

SEQ ID NO: 3744219 - RNA, 14 nt, Human
gguuaucucugugu

SEQ ID NO: 3744220 - RNA, 20 nt, Human
gguuaucugaagucagaucu

SEQ ID NO: 3744221 - RNA, 16 nt, Human
gguuauuuaaaaugua

SEQ ID NO: 3744222 - RNA, 23 nt, Human
gguuauuuuaguuucuguucugu

SEQ ID NO: 3744223 - RNA, 12 nt, Human
gguuauuuuuau

SEQ ID NO: 3744224 - RNA, 13 nt, Human
gguucaaaugugu

SEQ ID NO: 3744225 - RNA, 14 nt, Human
gguucaacuuauua

SEQ ID NO: 3744226 - RNA, 21 nt, Human
gguucaagcgauucuucugcu

SEQ ID NO: 3744227 - RNA, 16 nt, Human
gguucaaggucacugu

SEQ ID NO: 3744228 - RNA, 15 nt, Human
gguucaccagccucu

SEQ ID NO: 3744229 - RNA, 22 nt, Human
gguucacgccuguaaucccagc

SEQ ID NO: 3744230 - RNA, 15 nt, Human
gguucacuaaagcag

SEQ ID NO: 3744231 - RNA, 18 nt, Human
gguucagaaaugcugccu

SEQ ID NO: 3744232 - RNA, 19 nt, Human
gguucagaaaugcugccug

SEQ ID NO: 3744233 - RNA, 22 nt, Human
gguucagaaaugcugccugccu

SEQ ID NO: 3744234 - RNA, 18 nt, Human
gguucagaauuaaacuuu

SEQ ID NO: 3744235 - RNA, 19 nt, Human
gguucagaauuaaacuuuu

SEQ ID NO: 3744236 - RNA, 14 nt, Human
gguucagccccucc

SEQ ID NO: 3744237 - RNA, 16 nt, Human
gguucagccccuccuc

SEQ ID NO: 3744238 - RNA, 18 nt, Human
gguucagccccuccucug

SEQ ID NO: 3744239 - RNA, 19 nt, Human
gguucagccccuccucugc

SEQ ID NO: 3744240 - RNA, 21 nt, Human
gguucagccccuccucugcca

SEQ ID NO: 3744241 - RNA, 22 nt, Human
gguucagccccuccucugccac

SEQ ID NO: 3744242 - RNA, 12 nt, Human
gguucaggcccg

SEQ ID NO: 3744243 - RNA, 18 nt, Human
gguucaggguuggccccu

SEQ ID NO: 3744244 - RNA, 21 nt, Human
gguucauaggucacuggcucu

SEQ ID NO: 3744245 - RNA, 14 nt, Human
gguucaucaguguu

SEQ ID NO: 3744246 - RNA, 15 nt, Human
gguucaucaguguua

SEQ ID NO: 3744247 - RNA, 19 nt, Human
gguucaucaguguuaaaaa

SEQ ID NO: 3744248 - RNA, 22 nt, Human
gguucaucaguguuaaaaaauu

SEQ ID NO: 3744249 - RNA, 13 nt, Human
gguucaugaugca

SEQ ID NO: 3744250 - RNA, 14 nt, Human
gguucaugaugcag

SEQ ID NO: 3744251 - RNA, 17 nt, Human
gguucauuauuggaauu

SEQ ID NO: 3744252 - RNA, 23 nt, Human
gguucauuuucagauucaggcau

SEQ ID NO: 3744253 - RNA, 16 nt, Human
gguuccaauccuggcu

SEQ ID NO: 3744254 - RNA, 24 nt, Human
gguuccagcaauucuccugccuca

SEQ ID NO: 3744255 - RNA, 13 nt, Human
gguucccccagcc

SEQ ID NO: 3744256 - RNA, 15 nt, Human
gguucccccagcccu

SEQ ID NO: 3744257 - RNA, 13 nt, Human
gguucccuguucu

SEQ ID NO: 3744258 - RNA, 16 nt, Human
gguucccuguucuucc

SEQ ID NO: 3744259 - RNA, 16 nt, Human
gguucccuuccuauuc

SEQ ID NO: 3744260 - RNA, 21 nt, Human
gguucccuuugacgccauccc

SEQ ID NO: 3744261 - RNA, 22 nt, Human
gguucccuuugacgccauccca

SEQ ID NO: 3744262 - RNA, 22 nt, Human
gguucccuuuuuuggcugcuga

SEQ ID NO: 3744263 - RNA, 16 nt, Human
gguuccggcauggaca

SEQ ID NO: 3744264 - RNA, 17 nt, Human
gguuccguguccacccc

SEQ ID NO: 3744265 - RNA, 19 nt, Human
gguuccguguccaccccca

SEQ ID NO: 3744266 - RNA, 12 nt, Human
gguuccucugcc

SEQ ID NO: 3744267 - RNA, 14 nt, Human
gguuccucugccug

SEQ ID NO: 3744268 - RNA, 23 nt, Human
gguucguggaaagggugcugcuu

SEQ ID NO: 3744269 - RNA, 14 nt, Human
gguucuaaaaggug

SEQ ID NO: 3744270 - RNA, 11 nt, Human
gguucuaaagu

SEQ ID NO: 3744271 - RNA, 12 nt, Human
gguucuaaaguu

SEQ ID NO: 3744272 - RNA, 15 nt, Human
gguucuaaaguucua

SEQ ID NO: 3744273 - RNA, 17 nt, Human
gguucuaaaguucuaag

SEQ ID NO: 3744274 - RNA, 12 nt, Human
gguucuaaggcc

SEQ ID NO: 3744275 - RNA, 23 nt, Human
gguucuacagccuugucccccuc

SEQ ID NO: 3744276 - RNA, 21 nt, Human
gguucuaggcaucucuguacu

SEQ ID NO: 3744277 - RNA, 15 nt, Human
gguucuagguuucaa

SEQ ID NO: 3744278 - RNA, 16 nt, Human
gguucuauuuggaauu

SEQ ID NO: 3744279 - RNA, 14 nt, Human
gguucucaaugaaa

SEQ ID NO: 3744280 - RNA, 20 nt, Human
gguucuccguuagcuccugu

SEQ ID NO: 3744281 - RNA, 17 nt, Human
gguucuccucuccccuc

SEQ ID NO: 3744282 - RNA, 21 nt, Human
gguucugaugaugugccuggg

SEQ ID NO: 3744283 - RNA, 20 nt, Human
gguucugccugccagcugca

SEQ ID NO: 3744284 - RNA, 13 nt, Human
gguucuggcuguu

SEQ ID NO: 3744285 - RNA, 12 nt, Human
gguucuggggcc

SEQ ID NO: 3744286 - RNA, 18 nt, Human
gguucuggugugaacuaa

SEQ ID NO: 3744287 - RNA, 13 nt, Human
gguucuucccuuu

SEQ ID NO: 3744288 - RNA, 19 nt, Human
gguucuugaggggaccagg

SEQ ID NO: 3744289 - RNA, 22 nt, Human
gguucuugaggggaccaggagu

SEQ ID NO: 3744290 - RNA, 17 nt, Human
gguucuugguagagauu

SEQ ID NO: 3744291 - RNA, 14 nt, Human
gguucuuucuuccu

SEQ ID NO: 3744292 - RNA, 17 nt, Human
gguucuuucuuccucug

SEQ ID NO: 3744293 - RNA, 19 nt, Human
gguugaagaggugagcacg

SEQ ID NO: 3744294 - RNA, 17 nt, Human
gguugaagccaugucua

SEQ ID NO: 3744295 - RNA, 11 nt, Human
gguugaauaaa

SEQ ID NO: 3744296 - RNA, 14 nt, Human
gguugacaggaggu

SEQ ID NO: 3744297 - RNA, 15 nt, Human
gguugaccccagagg

SEQ ID NO: 3744298 - RNA, 13 nt, Human
gguugagaaauga

SEQ ID NO: 3744299 - RNA, 21 nt, Human
gguugauaaaucauuuuaugu

SEQ ID NO: 3744300 - RNA, 20 nt, Human
gguugauuaaggcaguacaa

SEQ ID NO: 3744301 - RNA, 16 nt, Human
gguugcaaggccgcug

SEQ ID NO: 3744302 - RNA, 14 nt, Human
gguugcagacagga

SEQ ID NO: 3744303 - RNA, 15 nt, Human
gguugcuaacugaac

SEQ ID NO: 3744304 - RNA, 20 nt, Human
gguugcuguuuuccucccuu

SEQ ID NO: 3744305 - RNA, 21 nt, Human
gguugcuguuuuccucccuuc

SEQ ID NO: 3744306 - RNA, 11 nt, Human
gguuggagccc

SEQ ID NO: 3744307 - RNA, 14 nt, Human
gguuggagcccagg

SEQ ID NO: 3744308 - RNA, 18 nt, Human
gguuggcaaaaaggcagg

SEQ ID NO: 3744309 - RNA, 17 nt, Human
gguuggcgcacccuccc

SEQ ID NO: 3744310 - RNA, 20 nt, Human
gguuggcucugccaguccug

SEQ ID NO: 3744311 - RNA, 15 nt, Human
gguuggcugggccca

SEQ ID NO: 3744312 - RNA, 19 nt, Human
gguugggagaaugucagua

SEQ ID NO: 3744313 - RNA, 17 nt, Human
gguugggcccagaucug

SEQ ID NO: 3744314 - RNA, 13 nt, Human
gguugguagggug

SEQ ID NO: 3744315 - RNA, 14 nt, Human
gguuggugcacagu

SEQ ID NO: 3744316 - RNA, 13 nt, Human
gguuggugggggc

SEQ ID NO: 3744317 - RNA, 14 nt, Human
gguuguauucuuug

SEQ ID NO: 3744318 - RNA, 20 nt, Human
gguuguauucuuugauguua

SEQ ID NO: 3744319 - RNA, 22 nt, Human
gguuguauucuuugauguuaac

SEQ ID NO: 3744320 - RNA, 15 nt, Human
gguugucacucaaca

SEQ ID NO: 3744321 - RNA, 13 nt, Human
gguugugaggccu

SEQ ID NO: 3744322 - RNA, 22 nt, Human
gguugugaggccuggccaggca

SEQ ID NO: 3744323 - RNA, 14 nt, Human
gguugugcacuguu

SEQ ID NO: 3744324 - RNA, 12 nt, Human
gguuguuucugu

SEQ ID NO: 3744325 - RNA, 21 nt, Human
gguuuaaaacuaguuagauuc

SEQ ID NO: 3744326 - RNA, 19 nt, Human
gguuuaaacuucucugaag

SEQ ID NO: 3744327 - RNA, 20 nt, Human
gguuuaaagagucuagauuc

SEQ ID NO: 3744328 - RNA, 13 nt, Human
gguuuaacucaga

SEQ ID NO: 3744329 - RNA, 17 nt, Human
gguuuaacucagaucac

SEQ ID NO: 3744330 - RNA, 18 nt, Human
gguuuaacucagaucacu

SEQ ID NO: 3744331 - RNA, 20 nt, Human
gguuuaacucagaucacuac

SEQ ID NO: 3744332 - RNA, 13 nt, Human
gguuuaauauuac

SEQ ID NO: 3744333 - RNA, 13 nt, Human
gguuuaauguuuu

SEQ ID NO: 3744334 - RNA, 21 nt, Human
gguuuacaauuuacaaagugu

SEQ ID NO: 3744335 - RNA, 19 nt, Human
guauacaguucaauaaacu

SEQ ID NO: 3744336 - RNA, 20 nt, Human
guauacauccuggguaauga

SEQ ID NO: 3744337 - RNA, 13 nt, Human
guauaccucacuu

SEQ ID NO: 3744338 - RNA, 13 nt, Human
guauacuuccuua

SEQ ID NO: 3744339 - RNA, 19 nt, Human
guauacuuccuuaugcuuc

SEQ ID NO: 3744340 - RNA, 13 nt, Human
guauacuuuaaau

SEQ ID NO: 3744341 - RNA, 20 nt, Human
guauacuuuaaauaauuuaa

SEQ ID NO: 3744342 - RNA, 14 nt, Human
guauagaaaaucuu

SEQ ID NO: 3744343 - RNA, 15 nt, Human
guauagaaaugcugg

SEQ ID NO: 3744344 - RNA, 19 nt, Human
guauagaaccucuuugucu

SEQ ID NO: 3744345 - RNA, 17 nt, Human
guauagaagucuucaug

SEQ ID NO: 3744346 - RNA, 21 nt, Human
guauagaagucuucaugaaau

SEQ ID NO: 3744347 - RNA, 23 nt, Human
guauagaagucuucaugaaaugc

SEQ ID NO: 3744348 - RNA, 21 nt, Human
guauagaauaggcacuuuaaa

SEQ ID NO: 3744349 - RNA, 21 nt, Human
guauagacaggagaagaaaga

SEQ ID NO: 3744350 - RNA, 20 nt, Human
guauagauauaaugaacaaa

SEQ ID NO: 3744351 - RNA, 18 nt, Human
guauagaugcaagauauu

SEQ ID NO: 3744352 - RNA, 15 nt, Human
guauagauguugcua

SEQ ID NO: 3744353 - RNA, 20 nt, Human
guauagcaugaaauaaaaua

SEQ ID NO: 3744354 - RNA, 18 nt, Human
guauagcaugcaucuguu

SEQ ID NO: 3744355 - RNA, 21 nt, Human
guauagccuauggcagaaaaa

SEQ ID NO: 3744356 - RNA, 14 nt, Human
guauagcuguauug

SEQ ID NO: 3744357 - RNA, 23 nt, Human
guauagcuguauugaaucaugua

SEQ ID NO: 3744358 - RNA, 14 nt, Human
guauaguuauguaa

SEQ ID NO: 3744359 - RNA, 15 nt, Human
guauaguuauguaaa

SEQ ID NO: 3744360 - RNA, 16 nt, Human
guauaguugcuugccu

SEQ ID NO: 3744361 - RNA, 17 nt, Human
guauaguugcuugccug

SEQ ID NO: 3744362 - RNA, 18 nt, Human
guauaguugcuugccuga

SEQ ID NO: 3744363 - RNA, 13 nt, Human
guauaguugcuuu

SEQ ID NO: 3744364 - RNA, 14 nt, Human
guauauaaaaaugg

SEQ ID NO: 3744365 - RNA, 13 nt, Human
guauauaaauggg

SEQ ID NO: 3744366 - RNA, 14 nt, Human
guauauacacauau

SEQ ID NO: 3744367 - RNA, 18 nt, Human
guauauacacauauaccu

SEQ ID NO: 3744368 - RNA, 23 nt, Human
guauauacuuugaaaggagaugu

SEQ ID NO: 3744369 - RNA, 12 nt, Human
guauauacuuuu

SEQ ID NO: 3744370 - RNA, 13 nt, Human
guauauacuuuuu

SEQ ID NO: 3744371 - RNA, 15 nt, Human
guauauagcccagcc

SEQ ID NO: 3744372 - RNA, 15 nt, Human
guauauauaagaaag

SEQ ID NO: 3744373 - RNA, 15 nt, Human
guauauauacauaca

SEQ ID NO: 3744374 - RNA, 17 nt, Human
guauauauacauacacu

SEQ ID NO: 3744375 - RNA, 18 nt, Human
guauauauacauauauau

SEQ ID NO: 3744376 - RNA, 14 nt, Human
guauauauagaauc

SEQ ID NO: 3744377 - RNA, 10 nt, Human
guauauauau

SEQ ID NO: 3744378 - RNA, 12 nt, Human
guauauaugugu

SEQ ID NO: 3744379 - RNA, 20 nt, Human
guauauauguguauauauac

SEQ ID NO: 3744380 - RNA, 16 nt, Human
guauauauguguguuu

SEQ ID NO: 3744381 - RNA, 21 nt, Human
guauauauuuuuuaaaaaucu

SEQ ID NO: 3744382 - RNA, 17 nt, Human
guauauauuuuuuuuua

SEQ ID NO: 3744383 - RNA, 13 nt, Human
guauaucauucua

SEQ ID NO: 3744384 - RNA, 20 nt, Human
guauauccuuuucuguguuu

SEQ ID NO: 3744385 - RNA, 20 nt, Human
guauaucuagguuuaugaca

SEQ ID NO: 3744386 - RNA, 16 nt, Human
guauauguaugugugu

SEQ ID NO: 3744387 - RNA, 13 nt, Human
guauaugucucag

SEQ ID NO: 3744388 - RNA, 14 nt, Human
guauauuaaaaaug

SEQ ID NO: 3744389 - RNA, 18 nt, Human
guauauuaaaaaugguaa

SEQ ID NO: 3744390 - RNA, 22 nt, Human
guauauuaaaaaugguaaaauu

SEQ ID NO: 3744391 - RNA, 12 nt, Human
guauauucagga

SEQ ID NO: 3744392 - RNA, 23 nt, Human
guauauucaggacuugaaagaaa

SEQ ID NO: 3744393 - RNA, 16 nt, Human
guauauucauuucaaa

SEQ ID NO: 3744394 - RNA, 22 nt, Human
guauauugauccagaaagaaaa

SEQ ID NO: 3744395 - RNA, 19 nt, Human
guauauugcacaauuauaa

SEQ ID NO: 3744396 - RNA, 22 nt, Human
guauauuguauaggggcaacug

SEQ ID NO: 3744397 - RNA, 15 nt, Human
guauauuuauauaau

SEQ ID NO: 3744398 - RNA, 17 nt, Human
guauauuuauauaauua

SEQ ID NO: 3744399 - RNA, 20 nt, Human
guauauuugauuuauuaacu

SEQ ID NO: 3744400 - RNA, 23 nt, Human
guauauuugauuuauuaacuuaa

SEQ ID NO: 3744401 - RNA, 15 nt, Human
guauauuuguaugau

SEQ ID NO: 3744402 - RNA, 20 nt, Human
guauauuuguauuuaaauga

SEQ ID NO: 3744403 - RNA, 20 nt, Human
guauauuugugauagcacuu

SEQ ID NO: 3744404 - RNA, 23 nt, Human
guauauuugugauagcacuuucu

SEQ ID NO: 3744405 - RNA, 16 nt, Human
guauauuuuauaucaa

SEQ ID NO: 3744406 - RNA, 15 nt, Human
guauauuuuauuuca

SEQ ID NO: 3744407 - RNA, 20 nt, Human
guauauuuuauuucaaugua

SEQ ID NO: 3744408 - RNA, 22 nt, Human
guauauuuuauuucaauguaau

SEQ ID NO: 3744409 - RNA, 17 nt, Human
guauauuuuuguuuguu

SEQ ID NO: 3744410 - RNA, 21 nt, Human
guauauuuuuuucuaagagaa

SEQ ID NO: 3744411 - RNA, 14 nt, Human
guaucaaaaugcuc

SEQ ID NO: 3744412 - RNA, 19 nt, Human
guaucaaacagcucaggcu

SEQ ID NO: 3744413 - RNA, 15 nt, Human
guaucaaacccacga

SEQ ID NO: 3744414 - RNA, 17 nt, Human
guaucaacccagaaaca

SEQ ID NO: 3744415 - RNA, 18 nt, Human
guaucaaguauagaaaau

SEQ ID NO: 3744416 - RNA, 22 nt, Human
guaucacauuuuaguccagaga

SEQ ID NO: 3744417 - RNA, 21 nt, Human
guaucacucugugucugagug

SEQ ID NO: 3744418 - RNA, 18 nt, Human
guaucagaagagagggga

SEQ ID NO: 3744419 - RNA, 22 nt, Human
guaucagagauguccauuuuua

SEQ ID NO: 3744420 - RNA, 19 nt, Human
guaucaguguuuaugugcu

SEQ ID NO: 3744421 - RNA, 23 nt, Human
guaucaguguuuuaaauucugag

SEQ ID NO: 3744422 - RNA, 17 nt, Human
guaucaguugcaauaau

SEQ ID NO: 3744423 - RNA, 14 nt, Human
guaucaugaagccu

SEQ ID NO: 3744424 - RNA, 14 nt, Human
guauccacuuugca

SEQ ID NO: 3744425 - RNA, 20 nt, Human
guauccauauuuuauuacug

SEQ ID NO: 3744426 - RNA, 14 nt, Human
guauccaugcucuu

SEQ ID NO: 3744427 - RNA, 16 nt, Human
guauccaugggggcag

SEQ ID NO: 3744428 - RNA, 18 nt, Human
guauccaugggggcaggg

SEQ ID NO: 3744429 - RNA, 16 nt, Human
guauccauuaucaugu

SEQ ID NO: 3744430 - RNA, 19 nt, Human
guaucccaugagccucagc

SEQ ID NO: 3744431 - RNA, 15 nt, Human
guaucccuacuguaa

SEQ ID NO: 3744432 - RNA, 17 nt, Human
guaucccuucucacagc

SEQ ID NO: 3744433 - RNA, 19 nt, Human
guaucccuucucacagcac

SEQ ID NO: 3744434 - RNA, 14 nt, Human
guauccuccagguu

SEQ ID NO: 3744435 - RNA, 15 nt, Human
guauccuccagguuu

SEQ ID NO: 3744436 - RNA, 23 nt, Human
guauccuccagguuuuucaauua

SEQ ID NO: 3744437 - RNA, 16 nt, Human
guauccugcccagugu

SEQ ID NO: 3744438 - RNA, 23 nt, Human
guauccuggaacaauauuuuaug

SEQ ID NO: 3744439 - RNA, 13 nt, Human
guauccuggggcu

SEQ ID NO: 3744440 - RNA, 17 nt, Human
guauccuggggcucccu

SEQ ID NO: 3744441 - RNA, 14 nt, Human
guaucgauguuuua

SEQ ID NO: 3744442 - RNA, 16 nt, Human
guaucguaaccagcca

SEQ ID NO: 3744443 - RNA, 17 nt, Human
guaucguauucaccuuc

SEQ ID NO: 3744444 - RNA, 16 nt, Human
guaucuaaaaguguca

SEQ ID NO: 3744445 - RNA, 14 nt, Human
guaucuagcaauca

SEQ ID NO: 3744446 - RNA, 24 nt, Human
guaucuagcaaucacaacacuggc

SEQ ID NO: 3744447 - RNA, 16 nt, Human
guaucuagugcagcug

SEQ ID NO: 3744448 - RNA, 20 nt, Human
guaucuauauauguguaugu

SEQ ID NO: 3744449 - RNA, 14 nt, Human
guaucucagaaagu

SEQ ID NO: 3744450 - RNA, 20 nt, Human
guaucucagaaagugccuga

SEQ ID NO: 3744451 - RNA, 22 nt, Human
guaucucagaaagugccugaca

SEQ ID NO: 3744452 - RNA, 15 nt, Human
guaucuccucgcaag

SEQ ID NO: 3744453 - RNA, 20 nt, Human
guaucucggaccuuucagcu

SEQ ID NO: 3744454 - RNA, 19 nt, Human
guaucucugaagcauguuu

SEQ ID NO: 3744455 - RNA, 20 nt, Human
guaucucugaagcauguuuc

SEQ ID NO: 3744456 - RNA, 22 nt, Human
guaucucuuucacauuguuugc

SEQ ID NO: 3744457 - RNA, 15 nt, Human
guaucugaguugcca

SEQ ID NO: 3744458 - RNA, 19 nt, Human
guaucuggugacuuuccuc

SEQ ID NO: 3744459 - RNA, 16 nt, Human
guaucuguaucucucu

SEQ ID NO: 3744460 - RNA, 13 nt, Human
guaucugucuuuc

SEQ ID NO: 3744461 - RNA, 19 nt, Human
guaucugucuuuccacucu

SEQ ID NO: 3744462 - RNA, 20 nt, Human
guaucugucuuuccacucug

SEQ ID NO: 3744463 - RNA, 22 nt, Human
guaucugucuuuccacucugga

SEQ ID NO: 3744464 - RNA, 12 nt, Human
guaucugugaac

SEQ ID NO: 3744465 - RNA, 23 nt, Human
guaucuuguuuuuccacuacugc

SEQ ID NO: 3744466 - RNA, 18 nt, Human
guaucuuugcacuccaau

SEQ ID NO: 3744467 - RNA, 22 nt, Human
guaucuuugggucuuugauaaa

SEQ ID NO: 3744468 - RNA, 13 nt, Human
guaucuuuugaua

SEQ ID NO: 3744469 - RNA, 20 nt, Human
guaugaaaacauggaacagu

SEQ ID NO: 3744470 - RNA, 19 nt, Human
guaugaaacuaaagccuuu

SEQ ID NO: 3744471 - RNA, 22 nt, Human
guaugaaagauggcugugccuc

SEQ ID NO: 3744472 - RNA, 23 nt, Human
guaugaaagauggcugugccucu

SEQ ID NO: 3744473 - RNA, 11 nt, Human
guaugaaauau

SEQ ID NO: 3744474 - RNA, 17 nt, Human
guaugaaauauauguga

SEQ ID NO: 3744475 - RNA, 17 nt, Human
guaugaaccaccgcgcc

SEQ ID NO: 3744476 - RNA, 16 nt, Human
guaugaacuugaggac

SEQ ID NO: 3744477 - RNA, 19 nt, Human
guaugaacuugaggacaca

SEQ ID NO: 3744478 - RNA, 20 nt, Human
guaugaacuugaggacacau

SEQ ID NO: 3744479 - RNA, 22 nt, Human
guaugaacuugaggacacaugu

SEQ ID NO: 3744480 - RNA, 19 nt, Human
guaugaagagcuugcuuug

SEQ ID NO: 3744481 - RNA, 18 nt, Human
guaugaauaaagacaccu

SEQ ID NO: 3744482 - RNA, 15 nt, Human
guaugaaucuaugcc

SEQ ID NO: 3744483 - RNA, 16 nt, Human
guaugaaucuaugcca

SEQ ID NO: 3744484 - RNA, 15 nt, Human
gaccacucagccccu

SEQ ID NO: 3744485 - RNA, 21 nt, Human
gaccacugcaugagcuuuuau

SEQ ID NO: 3744486 - RNA, 18 nt, Human
gaccacuguuucuugcuu

SEQ ID NO: 3744487 - RNA, 14 nt, Human
gaccagagcucugg

SEQ ID NO: 3744488 - RNA, 15 nt, Human
gaccagagcucugga

SEQ ID NO: 3744489 - RNA, 17 nt, Human
gaccagagcucuggagc

SEQ ID NO: 3744490 - RNA, 11 nt, Human
gaccagagcug

SEQ ID NO: 3744491 - RNA, 19 nt, Human
gaccagagcugccaccugc

SEQ ID NO: 3744492 - RNA, 18 nt, Human
gaccagaggagccuuuuu

SEQ ID NO: 3744493 - RNA, 17 nt, Human
gaccagcacugucucag

SEQ ID NO: 3744494 - RNA, 15 nt, Human
gaccagcagacagag

SEQ ID NO: 3744495 - RNA, 18 nt, Human
gaccagcagacagagcca

SEQ ID NO: 3744496 - RNA, 20 nt, Human
gaccagcagacagagccagg

SEQ ID NO: 3744497 - RNA, 16 nt, Human
gaccagcagaucccag

SEQ ID NO: 3744498 - RNA, 16 nt, Human
gaccagcagccccaca

SEQ ID NO: 3744499 - RNA, 13 nt, Human
gaccagcagcgcc

SEQ ID NO: 3744500 - RNA, 23 nt, Human
gaccagcagcgccuuucccaacu

SEQ ID NO: 3744501 - RNA, 12 nt, Human
gaccagccagca

SEQ ID NO: 3744502 - RNA, 11 nt, Human
gaccagccagg

SEQ ID NO: 3744503 - RNA, 14 nt, Human
gaccagcccacgcu

SEQ ID NO: 3744504 - RNA, 23 nt, Human
gaccagcccacgcugacuacagg

SEQ ID NO: 3744505 - RNA, 11 nt, Human
gaccagccugg

SEQ ID NO: 3744506 - RNA, 12 nt, Human
gaccagccuggc

SEQ ID NO: 3744507 - RNA, 18 nt, Human
gaccagccuggccaacau

SEQ ID NO: 3744508 - RNA, 20 nt, Human
gaccagccuggccaacaugg

SEQ ID NO: 3744509 - RNA, 22 nt, Human
gaccagccuggccaacauggua

SEQ ID NO: 3744510 - RNA, 23 nt, Human
gaccagccuguuggacccgcucu

SEQ ID NO: 3744511 - RNA, 13 nt, Human
gaccagcuccccc

SEQ ID NO: 3744512 - RNA, 13 nt, Human
gaccagcugcucc

SEQ ID NO: 3744513 - RNA, 12 nt, Human
gaccagcugggg

SEQ ID NO: 3744514 - RNA, 22 nt, Human
gaccagcuuggcucaggcugag

SEQ ID NO: 3744515 - RNA, 14 nt, Human
gaccaggacucccu

SEQ ID NO: 3744516 - RNA, 16 nt, Human
gaccaggacucccucc

SEQ ID NO: 3744517 - RNA, 17 nt, Human
gaccaggacucccuccu

SEQ ID NO: 3744518 - RNA, 16 nt, Human
gaccaggagggcacug

SEQ ID NO: 3744519 - RNA, 12 nt, Human
gaccaggauccc

SEQ ID NO: 3744520 - RNA, 20 nt, Human
gaccaggaucccaagccucc

SEQ ID NO: 3744521 - RNA, 22 nt, Human
gaccaggaucccaagccuccug

SEQ ID NO: 3744522 - RNA, 16 nt, Human
gaccaggcaccaggca

SEQ ID NO: 3744523 - RNA, 15 nt, Human
gaccaggcugccucc

SEQ ID NO: 3744524 - RNA, 13 nt, Human
gaccaggcuguag

SEQ ID NO: 3744525 - RNA, 23 nt, Human
gaccagggacagauccagcaggc

SEQ ID NO: 3744526 - RNA, 14 nt, Human
gaccagggagccuu

SEQ ID NO: 3744527 - RNA, 18 nt, Human
gaccagggauuuccauga

SEQ ID NO: 3744528 - RNA, 15 nt, Human
gaccagggcagggcc

SEQ ID NO: 3744529 - RNA, 16 nt, Human
gaccagggcagggcca

SEQ ID NO: 3744530 - RNA, 13 nt, Human
gaccagggccgag

SEQ ID NO: 3744531 - RNA, 19 nt, Human
gaccagggccuuuucuggc

SEQ ID NO: 3744532 - RNA, 18 nt, Human
gaccagucaaccugggca

SEQ ID NO: 3744533 - RNA, 16 nt, Human
gaccagucccagagca

SEQ ID NO: 3744534 - RNA, 15 nt, Human
gaccagucugacccu

SEQ ID NO: 3744535 - RNA, 14 nt, Human
gaccaguggucuca

SEQ ID NO: 3744536 - RNA, 22 nt, Human
gaccaguggugccuuggaggga

SEQ ID NO: 3744537 - RNA, 22 nt, Human
gaccagugguuuccagucauga

SEQ ID NO: 3744538 - RNA, 15 nt, Human
gaccaguugcacuug

SEQ ID NO: 3744539 - RNA, 14 nt, Human
gaccaguugcaguc

SEQ ID NO: 3744540 - RNA, 17 nt, Human
gaccaguugggagcacu

SEQ ID NO: 3744541 - RNA, 20 nt, Human
gaccaguugggagcacugga

SEQ ID NO: 3744542 - RNA, 13 nt, Human
gaccauacuaauu

SEQ ID NO: 3744543 - RNA, 19 nt, Human
gaccauccacucuacccuc

SEQ ID NO: 3744544 - RNA, 16 nt, Human
gaccaucccugaaggc

SEQ ID NO: 3744545 - RNA, 20 nt, Human
gaccauccuggccaacauga

SEQ ID NO: 3744546 - RNA, 21 nt, Human
gaccaugcucaucugcugguc

SEQ ID NO: 3744547 - RNA, 22 nt, Human
gaccaugcucaucugcuggucc

SEQ ID NO: 3744548 - RNA, 19 nt, Human
gaccaugcugucuggcaca

SEQ ID NO: 3744549 - RNA, 16 nt, Human
gaccauggacacuaca

SEQ ID NO: 3744550 - RNA, 15 nt, Human
gaccaugugucacuu

SEQ ID NO: 3744551 - RNA, 21 nt, Human
gaccauucuccaccugccagg

SEQ ID NO: 3744552 - RNA, 22 nt, Human
gaccauucuccaccugccaggg

SEQ ID NO: 3744553 - RNA, 19 nt, Human
gaccauuggggcucccagc

SEQ ID NO: 3744554 - RNA, 21 nt, Human
gaccauuggggcucccagcca

SEQ ID NO: 3744555 - RNA, 13 nt, Human
gaccauuuauaau

SEQ ID NO: 3744556 - RNA, 21 nt, Human
gaccauuuauaauguuaguag

SEQ ID NO: 3744557 - RNA, 11 nt, Human
gaccauuuucc

SEQ ID NO: 3744558 - RNA, 13 nt, Human
gaccauuuuccug

SEQ ID NO: 3744559 - RNA, 20 nt, Human
gaccauuuuuuaauuuacuu

SEQ ID NO: 3744560 - RNA, 19 nt, Human
gacccaaaaggcagaagca

SEQ ID NO: 3744561 - RNA, 18 nt, Human
gacccaaggaaaacugca

SEQ ID NO: 3744562 - RNA, 18 nt, Human
gacccaccccugugcucc

SEQ ID NO: 3744563 - RNA, 12 nt, Human
gacccacugcuu

SEQ ID NO: 3744564 - RNA, 18 nt, Human
gacccacugguuccuucu

SEQ ID NO: 3744565 - RNA, 18 nt, Human
gacccacuucucaucaca

SEQ ID NO: 3744566 - RNA, 19 nt, Human
gacccacuucucaucacac

SEQ ID NO: 3744567 - RNA, 16 nt, Human
gacccagacccagugg

SEQ ID NO: 3744568 - RNA, 15 nt, Human
gacccagauccucac

SEQ ID NO: 3744569 - RNA, 15 nt, Human
gacccagccaggccc

SEQ ID NO: 3744570 - RNA, 17 nt, Human
gacccagccaggcccag

SEQ ID NO: 3744571 - RNA, 12 nt, Human
gacccaggacag

SEQ ID NO: 3744572 - RNA, 22 nt, Human
gacccaggacaggauccaggcc

SEQ ID NO: 3744573 - RNA, 11 nt, Human
gacccaggccg

SEQ ID NO: 3744574 - RNA, 22 nt, Human
gacccaggccgcagcucuugcc

SEQ ID NO: 3744575 - RNA, 17 nt, Human
gacccaggcuccgcccu

SEQ ID NO: 3744576 - RNA, 17 nt, Human
gacccagggaacagcca

SEQ ID NO: 3744577 - RNA, 19 nt, Human
gacccagggaacagccacu

SEQ ID NO: 3744578 - RNA, 22 nt, Human
gacccagugagauuacagagga

SEQ ID NO: 3744579 - RNA, 10 nt, Human
gacccagugc

SEQ ID NO: 3744580 - RNA, 12 nt, Human
gacccagugcag

SEQ ID NO: 3744581 - RNA, 14 nt, Human
gacccagugcagaa

SEQ ID NO: 3744582 - RNA, 17 nt, Human
gacccagugcccccacu

SEQ ID NO: 3744583 - RNA, 18 nt, Human
gacccaguggcagggcac

SEQ ID NO: 3744584 - RNA, 20 nt, Human
gacccaguggcagggcacag

SEQ ID NO: 3744585 - RNA, 16 nt, Human
gacccaugcugcccug

SEQ ID NO: 3744586 - RNA, 18 nt, Human
gacccaugcugcccugug

SEQ ID NO: 3744587 - RNA, 19 nt, Human
gacccaugcugcccuguga

SEQ ID NO: 3744588 - RNA, 14 nt, Human
gacccaugggcagg

SEQ ID NO: 3744589 - RNA, 18 nt, Human
gacccaugggcaggagac

SEQ ID NO: 3744590 - RNA, 14 nt, Human
gacccauuccuucc

SEQ ID NO: 3744591 - RNA, 22 nt, Human
gacccauuugauauuuuuuaaa

SEQ ID NO: 3744592 - RNA, 16 nt, Human
gaccccaaagagccug

SEQ ID NO: 3744593 - RNA, 18 nt, Human
gaccccaaagagccugga

SEQ ID NO: 3744594 - RNA, 20 nt, Human
gaccccaaagagccuggaga

SEQ ID NO: 3744595 - RNA, 22 nt, Human
gaccccacuccggcccuccaga

SEQ ID NO: 3744596 - RNA, 11 nt, Human
gaccccagaau

SEQ ID NO: 3744597 - RNA, 14 nt, Human
gaccccagcuggga

SEQ ID NO: 3744598 - RNA, 16 nt, Human
gaccccagcugggagg

SEQ ID NO: 3744599 - RNA, 11 nt, Human
gaccccagggc

SEQ ID NO: 3744600 - RNA, 15 nt, Human
gaccccagggcacag

SEQ ID NO: 3744601 - RNA, 19 nt, Human
gaccccaucaccuacucac

SEQ ID NO: 3744602 - RNA, 19 nt, Human
gaccccaucugugaauaag

SEQ ID NO: 3744603 - RNA, 14 nt, Human
gacccccaccccuu

SEQ ID NO: 3744604 - RNA, 16 nt, Human
gacccccaccccuucc

SEQ ID NO: 3744605 - RNA, 21 nt, Human
gacccccaccccuuccccacu

SEQ ID NO: 3744606 - RNA, 22 nt, Human
gacccccaccccuuccccacug

SEQ ID NO: 3744607 - RNA, 19 nt, Human
gacccccacucucauuccc

SEQ ID NO: 3744608 - RNA, 17 nt, Human
gacccccagcuccggcc

SEQ ID NO: 3744609 - RNA, 23 nt, Human
gacccccagcuccggccuguccu

SEQ ID NO: 3744610 - RNA, 12 nt, Human
gacccccaggac

SEQ ID NO: 3744611 - RNA, 17 nt, Human
gaccccccgugggcucc

SEQ ID NO: 3744612 - RNA, 18 nt, Human
gaccccccucaggacccu

SEQ ID NO: 3744613 - RNA, 15 nt, Human
gacccccgcccccug

SEQ ID NO: 3744614 - RNA, 17 nt, Human
gacccccucucccugca

SEQ ID NO: 3744615 - RNA, 17 nt, Human
gaccccgacgccacagc

SEQ ID NO: 3744616 - RNA, 22 nt, Human
gaccccgacgccacagcccagc

SEQ ID NO: 3744617 - RNA, 21 nt, Human
gaccccuaguucccucugcuc

SEQ ID NO: 3744618 - RNA, 13 nt, Human
gaccccucaccuu

SEQ ID NO: 3744619 - RNA, 22 nt, Human
gaccccucaccuugcaacacac

SEQ ID NO: 3744620 - RNA, 11 nt, Human
gaccccuccuc

SEQ ID NO: 3744621 - RNA, 12 nt, Human
gaccccuccuca

SEQ ID NO: 3744622 - RNA, 15 nt, Human
gaccccuccucacug

SEQ ID NO: 3744623 - RNA, 13 nt, Human
gaccccuccuccc

SEQ ID NO: 3744624 - RNA, 14 nt, Human
gaccccuccucccu

SEQ ID NO: 3744625 - RNA, 14 nt, Human
gaccccuccugggg

SEQ ID NO: 3744626 - RNA, 17 nt, Human
gaccccuccuggggcca

SEQ ID NO: 3744627 - RNA, 13 nt, Human
gaccccucuggcc

SEQ ID NO: 3744628 - RNA, 14 nt, Human
gaccccugaccccu

SEQ ID NO: 3744629 - RNA, 15 nt, Human
gaccccuggccuccg

SEQ ID NO: 3744630 - RNA, 21 nt, Human
gaccccuggcuuuucacugcu

SEQ ID NO: 3744631 - RNA, 22 nt, Human
gaccccuggcuuuucacugcug

SEQ ID NO: 3744632 - RNA, 13 nt, Human
gaccccugucucc

SEQ ID NO: 3744633 - RNA, 16 nt, Human
gaccccuguucaugcc

SEQ ID NO: 3744634 - RNA, 18 nt, Human
gaccccuuuucagcuucu

SEQ ID NO: 3744635 - RNA, 14 nt, Human
gguuuacuuucaaa

SEQ ID NO: 3744636 - RNA, 20 nt, Human
gguuuaggcugguggcccag

SEQ ID NO: 3744637 - RNA, 18 nt, Human
gguuuauaauuuucugaa

SEQ ID NO: 3744638 - RNA, 21 nt, Human
gguuuaugacaguaauugugu

SEQ ID NO: 3744639 - RNA, 20 nt, Human
gguuucacccuuaacccaag

SEQ ID NO: 3744640 - RNA, 13 nt, Human
gguuucagaaaug

SEQ ID NO: 3744641 - RNA, 19 nt, Human
gguuucccuacugaagccc

SEQ ID NO: 3744642 - RNA, 15 nt, Human
gguuuccugcccugg

SEQ ID NO: 3744643 - RNA, 16 nt, Human
gguuucgcagccugag

SEQ ID NO: 3744644 - RNA, 16 nt, Human
gguuucuaaagcugcc

SEQ ID NO: 3744645 - RNA, 21 nt, Human
gguuucucgcauaggaccuuu

SEQ ID NO: 3744646 - RNA, 18 nt, Human
gguuucucucuacagugc

SEQ ID NO: 3744647 - RNA, 13 nt, Human
gguuucucuucuc

SEQ ID NO: 3744648 - RNA, 15 nt, Human
gguuucucuucuccc

SEQ ID NO: 3744649 - RNA, 13 nt, Human
gguuucugaaaau

SEQ ID NO: 3744650 - RNA, 17 nt, Human
gguuucugcccugccca

SEQ ID NO: 3744651 - RNA, 13 nt, Human
gguuucuguuggc

SEQ ID NO: 3744652 - RNA, 22 nt, Human
gguuucuuucagauuuuuugaa

SEQ ID NO: 3744653 - RNA, 22 nt, Human
gguuucuuuuugaaucuuuaau

SEQ ID NO: 3744654 - RNA, 21 nt, Human
gguuugaaagugaauaaacuu

SEQ ID NO: 3744655 - RNA, 15 nt, Human
gguuugaagccugga

SEQ ID NO: 3744656 - RNA, 22 nt, Human
gguuugagauugccccaggucu

SEQ ID NO: 3744657 - RNA, 14 nt, Human
gguuugcaaggaag

SEQ ID NO: 3744658 - RNA, 17 nt, Human
gguuugccgguggugca

SEQ ID NO: 3744659 - RNA, 19 nt, Human
gguuuggaccccagcuggg

SEQ ID NO: 3744660 - RNA, 20 nt, Human
gguuuggaccccagcuggga

SEQ ID NO: 3744661 - RNA, 15 nt, Human
gguuuggagcugauc

SEQ ID NO: 3744662 - RNA, 19 nt, Human
gguuuggcgggccaaggac

SEQ ID NO: 3744663 - RNA, 14 nt, Human
gguuugggaccccu

SEQ ID NO: 3744664 - RNA, 19 nt, Human
gguuuggggagcagagaca

SEQ ID NO: 3744665 - RNA, 15 nt, Human
gguuuggucugggac

SEQ ID NO: 3744666 - RNA, 17 nt, Human
gguuugguuccucucug

SEQ ID NO: 3744667 - RNA, 15 nt, Human
gguuugguuugcuuu

SEQ ID NO: 3744668 - RNA, 22 nt, Human
gguuuguuuagaagaagugugu

SEQ ID NO: 3744669 - RNA, 15 nt, Human
gguuuuaaaaaaauc

SEQ ID NO: 3744670 - RNA, 13 nt, Human
gguuuuaaacuuu

SEQ ID NO: 3744671 - RNA, 14 nt, Human
gguuuuaaacuuuc

SEQ ID NO: 3744672 - RNA, 17 nt, Human
gguuuuaaguuguuugc

SEQ ID NO: 3744673 - RNA, 17 nt, Human
gguuuuaauuuaguaaa

SEQ ID NO: 3744674 - RNA, 21 nt, Human
gguuuuaauuuaguaaaccaa

SEQ ID NO: 3744675 - RNA, 17 nt, Human
gguuuuagguagaaaaa

SEQ ID NO: 3744676 - RNA, 16 nt, Human
gguuuuagguucuaaa

SEQ ID NO: 3744677 - RNA, 17 nt, Human
gguuuuauaaggcugau

SEQ ID NO: 3744678 - RNA, 16 nt, Human
gguuuuauacugaagg

SEQ ID NO: 3744679 - RNA, 17 nt, Human
gguuuucacauuggaaa

SEQ ID NO: 3744680 - RNA, 13 nt, Human
gguuuuccacgcu

SEQ ID NO: 3744681 - RNA, 18 nt, Human
gguuuuccccucccuggg

SEQ ID NO: 3744682 - RNA, 22 nt, Human
gguuuuccgcauucuuuguaca

SEQ ID NO: 3744683 - RNA, 13 nt, Human
gguuuuccugaaa

SEQ ID NO: 3744684 - RNA, 13 nt, Human
gguuuucgagauu

SEQ ID NO: 3744685 - RNA, 13 nt, Human
gguuuucuguucu

SEQ ID NO: 3744686 - RNA, 15 nt, Human
gguuuucuguucuuu

SEQ ID NO: 3744687 - RNA, 18 nt, Human
gguuuucuuaaccaucuu

SEQ ID NO: 3744688 - RNA, 13 nt, Human
gguuuugacugga

SEQ ID NO: 3744689 - RNA, 21 nt, Human
gguuuuggcaaacgcuaaaga

SEQ ID NO: 3744690 - RNA, 17 nt, Human
gguuuuguaagaugcug

SEQ ID NO: 3744691 - RNA, 13 nt, Human
gguuuuguacaau

SEQ ID NO: 3744692 - RNA, 17 nt, Human
gguuuugugccaucugu

SEQ ID NO: 3744693 - RNA, 19 nt, Human
gguuuuguuccccuccucc

SEQ ID NO: 3744694 - RNA, 22 nt, Human
gguuuuguuccccuccuccacu

SEQ ID NO: 3744695 - RNA, 13 nt, Human
gguuuuuaccugu

SEQ ID NO: 3744696 - RNA, 22 nt, Human
gguuuuuaccugucacauugca

SEQ ID NO: 3744697 - RNA, 19 nt, Human
gguuuuuacugcucugaga

SEQ ID NO: 3744698 - RNA, 20 nt, Human
gguuuuuacugcucugagaa

SEQ ID NO: 3744699 - RNA, 14 nt, Human
gguuuuuacuguua

SEQ ID NO: 3744700 - RNA, 17 nt, Human
gguuuuuauuucuccuu

SEQ ID NO: 3744701 - RNA, 20 nt, Human
gguuuuuuguguacuuuuug

SEQ ID NO: 3744702 - RNA, 9 nt, Human
gguuuuuuu

SEQ ID NO: 3744703 - RNA, 21 nt, Human
gguuuuuuuguacuuuguaca

SEQ ID NO: 3744704 - RNA, 23 nt, Human
guaaaaaaaaaaaaaauguucuu

SEQ ID NO: 3744705 - RNA, 16 nt, Human
guaaaaaaaaaaaagu

SEQ ID NO: 3744706 - RNA, 23 nt, Human
guaaaaaaaccaccaaaaacaaa

SEQ ID NO: 3744707 - RNA, 23 nt, Human
guaaaaaauuuaaaaagcccaac

SEQ ID NO: 3744708 - RNA, 13 nt, Human
guaaaaaauuuau

SEQ ID NO: 3744709 - RNA, 18 nt, Human
guaaaaacaaagaaauua

SEQ ID NO: 3744710 - RNA, 18 nt, Human
guaaaaacagcauugcuu

SEQ ID NO: 3744711 - RNA, 19 nt, Human
guaaaaacagcauugcuuu

SEQ ID NO: 3744712 - RNA, 14 nt, Human
guaaaaacugaagu

SEQ ID NO: 3744713 - RNA, 22 nt, Human
guaaaaacugaaguucugccuc

SEQ ID NO: 3744714 - RNA, 19 nt, Human
guaaaaaguauuuuuucaa

SEQ ID NO: 3744715 - RNA, 13 nt, Human
guaaaaauaaaau

SEQ ID NO: 3744716 - RNA, 18 nt, Human
guaaaaauaaaauacuuu

SEQ ID NO: 3744717 - RNA, 17 nt, Human
guaaaaauggaaacuau

SEQ ID NO: 3744718 - RNA, 14 nt, Human
guaaaaauuaaaaa

SEQ ID NO: 3744719 - RNA, 12 nt, Human
guaaaacaaaaa

SEQ ID NO: 3744720 - RNA, 20 nt, Human
guaaaacaaaaauguaauga

SEQ ID NO: 3744721 - RNA, 17 nt, Human
guaaaacagggccacau

SEQ ID NO: 3744722 - RNA, 20 nt, Human
guaaaacagggccacauaga

SEQ ID NO: 3744723 - RNA, 14 nt, Human
guaaaaccacagca

SEQ ID NO: 3744724 - RNA, 19 nt, Human
guaaaacgcugucaaaagu

SEQ ID NO: 3744725 - RNA, 13 nt, Human
guaaaacugaggc

SEQ ID NO: 3744726 - RNA, 19 nt, Human
guaaaagaaagaaagaaaa

SEQ ID NO: 3744727 - RNA, 18 nt, Human
guaaaagcaacaucagcu

SEQ ID NO: 3744728 - RNA, 19 nt, Human
guaaaagcaacaucagcuu

SEQ ID NO: 3744729 - RNA, 11 nt, Human
guaaaagcauc

SEQ ID NO: 3744730 - RNA, 20 nt, Human
guaaaaggccaaaccucugu

SEQ ID NO: 3744731 - RNA, 20 nt, Human
guaaaauaaauauugucuuu

SEQ ID NO: 3744732 - RNA, 22 nt, Human
guaaaauacuuuuacucugccu

SEQ ID NO: 3744733 - RNA, 16 nt, Human
guaaaauauagcugua

SEQ ID NO: 3744734 - RNA, 16 nt, Human
guaaaaucuugucaug

SEQ ID NO: 3744735 - RNA, 18 nt, Human
guaaaaucuugucaugug

SEQ ID NO: 3744736 - RNA, 19 nt, Human
guaaaaucuugucaugugu

SEQ ID NO: 3744737 - RNA, 20 nt, Human
guaaaaucuugucaugugua

SEQ ID NO: 3744738 - RNA, 21 nt, Human
guaaaaucuugucauguguau

SEQ ID NO: 3744739 - RNA, 23 nt, Human
guaaaaucuugucauguguauaa

SEQ ID NO: 3744740 - RNA, 14 nt, Human
guaaaaucuuucuu

SEQ ID NO: 3744741 - RNA, 16 nt, Human
guaaaaugaagaauuu

SEQ ID NO: 3744742 - RNA, 17 nt, Human
guaaaaugaagaauuua

SEQ ID NO: 3744743 - RNA, 21 nt, Human
guaaaaugacaaucaugugug

SEQ ID NO: 3744744 - RNA, 13 nt, Human
guaaaauggaaaa

SEQ ID NO: 3744745 - RNA, 20 nt, Human
guaaaauggaaaacuuaguu

SEQ ID NO: 3744746 - RNA, 19 nt, Human
guaaaauguauuauguccu

SEQ ID NO: 3744747 - RNA, 17 nt, Human
guaaaaugucuuuccaa

SEQ ID NO: 3744748 - RNA, 12 nt, Human
guaaaaugugaa

SEQ ID NO: 3744749 - RNA, 19 nt, Human
guaaaaugugaagugaaug

SEQ ID NO: 3744750 - RNA, 15 nt, Human
guaaaauguugaaua

SEQ ID NO: 3744751 - RNA, 12 nt, Human
guaaaauucuaa

SEQ ID NO: 3744752 - RNA, 13 nt, Human
guaaaauucuaaa

SEQ ID NO: 3744753 - RNA, 22 nt, Human
guaaaauucuaaauaaaauaua

SEQ ID NO: 3744754 - RNA, 16 nt, Human
guaaaauugaaaggca

SEQ ID NO: 3744755 - RNA, 13 nt, Human
guaaaauugcaug

SEQ ID NO: 3744756 - RNA, 14 nt, Human
guaaaauugccaua

SEQ ID NO: 3744757 - RNA, 19 nt, Human
guaaaauugcugugcuuua

SEQ ID NO: 3744758 - RNA, 14 nt, Human
guaaacaaacucuu

SEQ ID NO: 3744759 - RNA, 18 nt, Human
guaaacagugccugcuga

SEQ ID NO: 3744760 - RNA, 20 nt, Human
guaaacaguuuuuauuaaaa

SEQ ID NO: 3744761 - RNA, 22 nt, Human
guaaacauguguuuuaauucca

SEQ ID NO: 3744762 - RNA, 20 nt, Human
guaaaccacugaaaaaauau

SEQ ID NO: 3744763 - RNA, 14 nt, Human
guaaacgacacucu

SEQ ID NO: 3744764 - RNA, 16 nt, Human
guaaacguuucaguaa

SEQ ID NO: 3744765 - RNA, 22 nt, Human
guaaacuaucuuggugaauuuu

SEQ ID NO: 3744766 - RNA, 16 nt, Human
guaaacuauuuaucug

SEQ ID NO: 3744767 - RNA, 15 nt, Human
guaaacucaaaacuu

SEQ ID NO: 3744768 - RNA, 19 nt, Human
guaaacuguacuagucugu

SEQ ID NO: 3744769 - RNA, 16 nt, Human
guaaacuguggaugau

SEQ ID NO: 3744770 - RNA, 19 nt, Human
guaaacuuuaucacuuaaa

SEQ ID NO: 3744771 - RNA, 16 nt, Human
guaaacuuugaaauau

SEQ ID NO: 3744772 - RNA, 16 nt, Human
guaaacuuuuugugcu

SEQ ID NO: 3744773 - RNA, 14 nt, Human
guaaagaaagagag

SEQ ID NO: 3744774 - RNA, 15 nt, Human
guaaagaaagagaga

SEQ ID NO: 3744775 - RNA, 22 nt, Human
guaaagaaauuuaaaagacacu

SEQ ID NO: 3744776 - RNA, 14 nt, Human
guaaagaaauuuac

SEQ ID NO: 3744777 - RNA, 15 nt, Human
guaaagacuggcuuu

SEQ ID NO: 3744778 - RNA, 14 nt, Human
guaaagagaaacuu

SEQ ID NO: 3744779 - RNA, 15 nt, Human
guaaagagaaacuuu

SEQ ID NO: 3744780 - RNA, 23 nt, Human
guaaagagaccuaccucagguug

SEQ ID NO: 3744781 - RNA, 22 nt, Human
guaaagauauuuuuaucuuuau

SEQ ID NO: 3744782 - RNA, 16 nt, Human
guaaagaucaauaaaa

SEQ ID NO: 3744783 - RNA, 20 nt, Human
guaaagcuaaaauaaagaaa

SEQ ID NO: 3744784 - RNA, 12 nt, Human
guaaagcuccua

SEQ ID NO: 3744785 - RNA, 21 nt, Human
guaugaaucuaugccaaagau

SEQ ID NO: 3744786 - RNA, 15 nt, Human
guaugaaucuauuug

SEQ ID NO: 3744787 - RNA, 15 nt, Human
guaugaaugcagugg

SEQ ID NO: 3744788 - RNA, 14 nt, Human
guaugaauuauuca

SEQ ID NO: 3744789 - RNA, 12 nt, Human
guaugaauuuga

SEQ ID NO: 3744790 - RNA, 17 nt, Human
guaugacgcugauacau

SEQ ID NO: 3744791 - RNA, 20 nt, Human
guaugaggcauuuguuugaa

SEQ ID NO: 3744792 - RNA, 16 nt, Human
guaugauacuucgaca

SEQ ID NO: 3744793 - RNA, 14 nt, Human
guaugaucaaaugu

SEQ ID NO: 3744794 - RNA, 19 nt, Human
guaugaucggcaggacacc

SEQ ID NO: 3744795 - RNA, 14 nt, Human
guaugcacacacau

SEQ ID NO: 3744796 - RNA, 15 nt, Human
guaugcaugugaaga

SEQ ID NO: 3744797 - RNA, 17 nt, Human
guaugcaugugaagaaa

SEQ ID NO: 3744798 - RNA, 18 nt, Human
guaugcauuauuaaauug

SEQ ID NO: 3744799 - RNA, 20 nt, Human
guaugccaccaacuuacaaa

SEQ ID NO: 3744800 - RNA, 13 nt, Human
guaugcugcuuuu

SEQ ID NO: 3744801 - RNA, 16 nt, Human
guaugcuuauuuuaaa

SEQ ID NO: 3744802 - RNA, 13 nt, Human
guaugcuucauac

SEQ ID NO: 3744803 - RNA, 13 nt, Human
guauggaaauaaa

SEQ ID NO: 3744804 - RNA, 20 nt, Human
guauggaagguggagcguuc

SEQ ID NO: 3744805 - RNA, 18 nt, Human
guauggaauacaguguua

SEQ ID NO: 3744806 - RNA, 14 nt, Human
guauggcucugcac

SEQ ID NO: 3744807 - RNA, 22 nt, Human
guauggcuuuauuuuuuugaac

SEQ ID NO: 3744808 - RNA, 15 nt, Human
guaugggagagaaga

SEQ ID NO: 3744809 - RNA, 19 nt, Human
guauggguuaaaucaaaga

SEQ ID NO: 3744810 - RNA, 13 nt, Human
guaugguggcugg

SEQ ID NO: 3744811 - RNA, 16 nt, Human
guaugguggcuggguu

SEQ ID NO: 3744812 - RNA, 14 nt, Human
guauguaaacagga

SEQ ID NO: 3744813 - RNA, 18 nt, Human
guaugucaacuuuaugca

SEQ ID NO: 3744814 - RNA, 19 nt, Human
guaugucugccauguugcc

SEQ ID NO: 3744815 - RNA, 23 nt, Human
guaugugacaccaaagccaccuc

SEQ ID NO: 3744816 - RNA, 16 nt, Human
guaugugcacugucac

SEQ ID NO: 3744817 - RNA, 11 nt, Human
guaugugccau

SEQ ID NO: 3744818 - RNA, 14 nt, Human
guaugugccauuua

SEQ ID NO: 3744819 - RNA, 16 nt, Human
guaugugcuguaauuu

SEQ ID NO: 3744820 - RNA, 17 nt, Human
guauguggaaguguggg

SEQ ID NO: 3744821 - RNA, 21 nt, Human
guauguggaagugugggucug

SEQ ID NO: 3744822 - RNA, 20 nt, Human
guaugugggggucugugugu

SEQ ID NO: 3744823 - RNA, 15 nt, Human
guauguguaauaaau

SEQ ID NO: 3744824 - RNA, 13 nt, Human
guaugugugugug

SEQ ID NO: 3744825 - RNA, 16 nt, Human
guauguguuugugugu

SEQ ID NO: 3744826 - RNA, 18 nt, Human
guauguuaagcucuuuau

SEQ ID NO: 3744827 - RNA, 17 nt, Human
guauguugucaaagaga

SEQ ID NO: 3744828 - RNA, 19 nt, Human
guauguuuaaucuguuaug

SEQ ID NO: 3744829 - RNA, 14 nt, Human
guauguuuacacug

SEQ ID NO: 3744830 - RNA, 21 nt, Human
guauguuugcacacuugugug

SEQ ID NO: 3744831 - RNA, 15 nt, Human
guauguuuuacacug

SEQ ID NO: 3744832 - RNA, 13 nt, Human
guauguuuuucag

SEQ ID NO: 3744833 - RNA, 20 nt, Human
guauguuuuucaguucaaag

SEQ ID NO: 3744834 - RNA, 21 nt, Human
guauguuuuucaguucaaagu

SEQ ID NO: 3744835 - RNA, 14 nt, Human
guauuaaaacauug

SEQ ID NO: 3744836 - RNA, 17 nt, Human
guauuaaaacauuggau

SEQ ID NO: 3744837 - RNA, 19 nt, Human
guauuaaaggggggagggg

SEQ ID NO: 3744838 - RNA, 13 nt, Human
guauuaaaugcca

SEQ ID NO: 3744839 - RNA, 22 nt, Human
guauuaaauuacauuuguaauu

SEQ ID NO: 3744840 - RNA, 15 nt, Human
guauuaagaaaggaa

SEQ ID NO: 3744841 - RNA, 21 nt, Human
guauuaagcccacaguauauu

SEQ ID NO: 3744842 - RNA, 18 nt, Human
guauuaagucaagaauau

SEQ ID NO: 3744843 - RNA, 19 nt, Human
guauuaauaaauagagcaa

SEQ ID NO: 3744844 - RNA, 21 nt, Human
guauuaauacuaaaauauguc

SEQ ID NO: 3744845 - RNA, 22 nt, Human
guauuaauacuaaaauaugucu

SEQ ID NO: 3744846 - RNA, 18 nt, Human
guauuacacucuguaauu

SEQ ID NO: 3744847 - RNA, 13 nt, Human
guauuacacugua

SEQ ID NO: 3744848 - RNA, 23 nt, Human
guauuacccaagaaguaaagaug

SEQ ID NO: 3744849 - RNA, 19 nt, Human
guauuagggguaauauauu

SEQ ID NO: 3744850 - RNA, 21 nt, Human
guauuagugauauuucucuag

SEQ ID NO: 3744851 - RNA, 22 nt, Human
guauuauacaugugauacauuu

SEQ ID NO: 3744852 - RNA, 22 nt, Human
guauuaucaaagggauaaagaa

SEQ ID NO: 3744853 - RNA, 17 nt, Human
guauuaugcuucuugga

SEQ ID NO: 3744854 - RNA, 16 nt, Human
guauuaugucucuucu

SEQ ID NO: 3744855 - RNA, 16 nt, Human
guauuauucugcagca

SEQ ID NO: 3744856 - RNA, 17 nt, Human
guauuauugcuguugcu

SEQ ID NO: 3744857 - RNA, 16 nt, Human
guauuauuuacauuua

SEQ ID NO: 3744858 - RNA, 19 nt, Human
guauucauauuuguacuuu

SEQ ID NO: 3744859 - RNA, 23 nt, Human
guauucauauuuguacuuucugu

SEQ ID NO: 3744860 - RNA, 15 nt, Human
guauuccaccuuaaa

SEQ ID NO: 3744861 - RNA, 20 nt, Human
guauuccaccuuaaauuaaa

SEQ ID NO: 3744862 - RNA, 21 nt, Human
guauucccaaaaauuacuuug

SEQ ID NO: 3744863 - RNA, 19 nt, Human
guauucccauuagaccaag

SEQ ID NO: 3744864 - RNA, 16 nt, Human
guauuccccuucccac

SEQ ID NO: 3744865 - RNA, 14 nt, Human
guauuccugccucc

SEQ ID NO: 3744866 - RNA, 19 nt, Human
guauucuaauaagcuaguu

SEQ ID NO: 3744867 - RNA, 22 nt, Human
guauucuaauaagcuaguugaa

SEQ ID NO: 3744868 - RNA, 19 nt, Human
guauucucugagcugugca

SEQ ID NO: 3744869 - RNA, 23 nt, Human
guauucugccuuugcagaaacag

SEQ ID NO: 3744870 - RNA, 15 nt, Human
guauucuuaaaaugc

SEQ ID NO: 3744871 - RNA, 19 nt, Human
guauucuuaaaaugcaaua

SEQ ID NO: 3744872 - RNA, 14 nt, Human
guauucuugucaaa

SEQ ID NO: 3744873 - RNA, 23 nt, Human
guauucuuugauguuaacacauu

SEQ ID NO: 3744874 - RNA, 18 nt, Human
guauugaagcauuuuaua

SEQ ID NO: 3744875 - RNA, 12 nt, Human
guauugaaucau

SEQ ID NO: 3744876 - RNA, 11 nt, Human
guauugacaaa

SEQ ID NO: 3744877 - RNA, 15 nt, Human
guauugacaaaaugu

SEQ ID NO: 3744878 - RNA, 16 nt, Human
guauugacaaaauguu

SEQ ID NO: 3744879 - RNA, 17 nt, Human
guauugacaaaauguua

SEQ ID NO: 3744880 - RNA, 14 nt, Human
guauugagauacuu

SEQ ID NO: 3744881 - RNA, 17 nt, Human
guauugagauauuacac

SEQ ID NO: 3744882 - RNA, 16 nt, Human
guauugagauuucuua

SEQ ID NO: 3744883 - RNA, 14 nt, Human
guauugcacauugu

SEQ ID NO: 3744884 - RNA, 18 nt, Human
guauugcacauuguaaaa

SEQ ID NO: 3744885 - RNA, 20 nt, Human
guauugcuguccuugaaugc

SEQ ID NO: 3744886 - RNA, 10 nt, Human
guauuggaaa

SEQ ID NO: 3744887 - RNA, 13 nt, Human
guauuggcaaaga

SEQ ID NO: 3744888 - RNA, 14 nt, Human
guauuggccuggag

SEQ ID NO: 3744889 - RNA, 17 nt, Human
guauuguaaacaugugu

SEQ ID NO: 3744890 - RNA, 13 nt, Human
guauuguaaauua

SEQ ID NO: 3744891 - RNA, 20 nt, Human
guauuguaccuuuuaacacc

SEQ ID NO: 3744892 - RNA, 22 nt, Human
guauuguauuuauucaauaaag

SEQ ID NO: 3744893 - RNA, 17 nt, Human
guauugucugaacuugc

SEQ ID NO: 3744894 - RNA, 14 nt, Human
guauugugcaaugu

SEQ ID NO: 3744895 - RNA, 19 nt, Human
guauugugcaauguguaua

SEQ ID NO: 3744896 - RNA, 22 nt, Human
guauugugcaauguguauaaac

SEQ ID NO: 3744897 - RNA, 23 nt, Human
guauugugcaauguguauaaaca

SEQ ID NO: 3744898 - RNA, 18 nt, Human
guauugugucuuuugcau

SEQ ID NO: 3744899 - RNA, 16 nt, Human
guauuguuagauguuu

SEQ ID NO: 3744900 - RNA, 14 nt, Human
guauuguucccagu

SEQ ID NO: 3744901 - RNA, 20 nt, Human
guauuguuguccuuuucaua

SEQ ID NO: 3744902 - RNA, 18 nt, Human
guauuguuuaaaauguaa

SEQ ID NO: 3744903 - RNA, 17 nt, Human
guauuuaaaaauagaaa

SEQ ID NO: 3744904 - RNA, 18 nt, Human
guauuuaaacuaucuugu

SEQ ID NO: 3744905 - RNA, 9 nt, Human
guauuuaac

SEQ ID NO: 3744906 - RNA, 17 nt, Human
guauuuaacagaaauug

SEQ ID NO: 3744907 - RNA, 19 nt, Human
guauuuaacagaaauugua

SEQ ID NO: 3744908 - RNA, 15 nt, Human
guauuuaagcaaaua

SEQ ID NO: 3744909 - RNA, 19 nt, Human
guauuuaauuagugcuaag

SEQ ID NO: 3744910 - RNA, 18 nt, Human
guauuuaauuguaaacug

SEQ ID NO: 3744911 - RNA, 19 nt, Human
guauuuaauuguaaacugu

SEQ ID NO: 3744912 - RNA, 22 nt, Human
guauuuaauuguaaacuguacu

SEQ ID NO: 3744913 - RNA, 16 nt, Human
guauuuaauuuugaca

SEQ ID NO: 3744914 - RNA, 20 nt, Human
guauuuaccaaaaauuuugu

SEQ ID NO: 3744915 - RNA, 19 nt, Human
guauuuacgcuuugauuca

SEQ ID NO: 3744916 - RNA, 12 nt, Human
guauuuauauau

SEQ ID NO: 3744917 - RNA, 19 nt, Human
guauuuauucaauaaagua

SEQ ID NO: 3744918 - RNA, 22 nt, Human
guauuuauucaauaaaguauuu

SEQ ID NO: 3744919 - RNA, 13 nt, Human
guauuuauuccau

SEQ ID NO: 3744920 - RNA, 21 nt, Human
guauuuauuccauauucaugu

SEQ ID NO: 3744921 - RNA, 23 nt, Human
guauuuauuccauauucauguaa

SEQ ID NO: 3744922 - RNA, 13 nt, Human
guauuuauuuaaa

SEQ ID NO: 3744923 - RNA, 14 nt, Human
guauuuauuuaaaa

SEQ ID NO: 3744924 - RNA, 18 nt, Human
guauuuauuuaaaagauu

SEQ ID NO: 3744925 - RNA, 21 nt, Human
guauuuauuuaaaagauucau

SEQ ID NO: 3744926 - RNA, 14 nt, Human
guauuuauuuaugu

SEQ ID NO: 3744927 - RNA, 17 nt, Human
guauuuauuuuccuccc

SEQ ID NO: 3744928 - RNA, 20 nt, Human
guauuuauuuuccuccccag

SEQ ID NO: 3744929 - RNA, 22 nt, Human
guauuuauuuuccuccccagca

SEQ ID NO: 3744930 - RNA, 16 nt, Human
guauuuauuuuguaau

SEQ ID NO: 3744931 - RNA, 23 nt, Human
guauuuauuuuguaauuaugauu

SEQ ID NO: 3744932 - RNA, 19 nt, Human
guauuuauuuuuucuuuuc

SEQ ID NO: 3744933 - RNA, 13 nt, Human
guauuucaaauug

SEQ ID NO: 3744934 - RNA, 21 nt, Human
guauuucaguguaguuaauuu

SEQ ID NO: 3744935 - RNA, 13 nt, Human
gacccgcucugga

SEQ ID NO: 3744936 - RNA, 14 nt, Human
gacccgcucuggac

SEQ ID NO: 3744937 - RNA, 15 nt, Human
gacccggaggccaca

SEQ ID NO: 3744938 - RNA, 18 nt, Human
gacccggaggggccuggc

SEQ ID NO: 3744939 - RNA, 13 nt, Human
gacccggcugcgu

SEQ ID NO: 3744940 - RNA, 14 nt, Human
gacccuacaggaga

SEQ ID NO: 3744941 - RNA, 20 nt, Human
gacccuaugggucuaggaca

SEQ ID NO: 3744942 - RNA, 15 nt, Human
gacccucaucuuucu

SEQ ID NO: 3744943 - RNA, 14 nt, Human
gacccucaugcugc

SEQ ID NO: 3744944 - RNA, 22 nt, Human
gacccucaugcugccaauaucc

SEQ ID NO: 3744945 - RNA, 13 nt, Human
gacccuccaaggc

SEQ ID NO: 3744946 - RNA, 21 nt, Human
gacccuccaccgcagaaggaa

SEQ ID NO: 3744947 - RNA, 22 nt, Human
gacccuccaccgcagaaggaag

SEQ ID NO: 3744948 - RNA, 23 nt, Human
gacccuccuguugcacccagccc

SEQ ID NO: 3744949 - RNA, 20 nt, Human
gacccucgcuggcccccacu

SEQ ID NO: 3744950 - RNA, 18 nt, Human
gacccucuaaccucgccc

SEQ ID NO: 3744951 - RNA, 16 nt, Human
gacccucuccacccca

SEQ ID NO: 3744952 - RNA, 23 nt, Human
gacccucugaaugguccaggguu

SEQ ID NO: 3744953 - RNA, 15 nt, Human
gacccucugccacca

SEQ ID NO: 3744954 - RNA, 11 nt, Human
gacccucugcu

SEQ ID NO: 3744955 - RNA, 13 nt, Human
gacccucugggaa

SEQ ID NO: 3744956 - RNA, 23 nt, Human
gacccucugggaaccucccagag

SEQ ID NO: 3744957 - RNA, 19 nt, Human
gacccucuugcccauccug

SEQ ID NO: 3744958 - RNA, 22 nt, Human
gacccucuugcccauccugacu

SEQ ID NO: 3744959 - RNA, 14 nt, Human
gacccugaaaugug

SEQ ID NO: 3744960 - RNA, 17 nt, Human
gacccugaccagcuccc

SEQ ID NO: 3744961 - RNA, 18 nt, Human
gacccugaccagcucccc

SEQ ID NO: 3744962 - RNA, 23 nt, Human
gacccugaccagcucccccuccc

SEQ ID NO: 3744963 - RNA, 18 nt, Human
gacccugaggcccagagg

SEQ ID NO: 3744964 - RNA, 21 nt, Human
gacccugaggcccagagggcc

SEQ ID NO: 3744965 - RNA, 23 nt, Human
gacccugaggcccagagggccug

SEQ ID NO: 3744966 - RNA, 13 nt, Human
gacccugcacccu

SEQ ID NO: 3744967 - RNA, 12 nt, Human
gacccugccagg

SEQ ID NO: 3744968 - RNA, 14 nt, Human
gacccugccaggca

SEQ ID NO: 3744969 - RNA, 12 nt, Human
gacccugcccug

SEQ ID NO: 3744970 - RNA, 13 nt, Human
gacccugcccugu

SEQ ID NO: 3744971 - RNA, 17 nt, Human
gacccugcccugugggc

SEQ ID NO: 3744972 - RNA, 13 nt, Human
gacccugcccuug

SEQ ID NO: 3744973 - RNA, 12 nt, Human
gacccugccucu

SEQ ID NO: 3744974 - RNA, 16 nt, Human
gacccugccucuccca

SEQ ID NO: 3744975 - RNA, 16 nt, Human
gacccuggaggcccca

SEQ ID NO: 3744976 - RNA, 17 nt, Human
gacccugggggcacagg

SEQ ID NO: 3744977 - RNA, 18 nt, Human
gacccugggggcacagga

SEQ ID NO: 3744978 - RNA, 23 nt, Human
gacccuggguaggggaagagaag

SEQ ID NO: 3744979 - RNA, 18 nt, Human
gacccugggugggcucug

SEQ ID NO: 3744980 - RNA, 15 nt, Human
gacccuguugcuaag

SEQ ID NO: 3744981 - RNA, 17 nt, Human
gacccuuacagccucug

SEQ ID NO: 3744982 - RNA, 20 nt, Human
gacccuuacagccucugacu

SEQ ID NO: 3744983 - RNA, 17 nt, Human
gacccuuauaaaauccu

SEQ ID NO: 3744984 - RNA, 20 nt, Human
gacccuuccagacauacgaa

SEQ ID NO: 3744985 - RNA, 23 nt, Human
gacccuucccaaucagcacugaa

SEQ ID NO: 3744986 - RNA, 17 nt, Human
gacccuugacaccugcu

SEQ ID NO: 3744987 - RNA, 21 nt, Human
gacccuuguggucccacccca

SEQ ID NO: 3744988 - RNA, 20 nt, Human
gacccuuuccuuccuucccu

SEQ ID NO: 3744989 - RNA, 22 nt, Human
gacccuuuccuuccuucccugg

SEQ ID NO: 3744990 - RNA, 18 nt, Human
gacccuuuuggguuucug

SEQ ID NO: 3744991 - RNA, 22 nt, Human
gaccgccagauggggccucugu

SEQ ID NO: 3744992 - RNA, 15 nt, Human
gaccgcccccuccuc

SEQ ID NO: 3744993 - RNA, 22 nt, Human
gaccgcccuccgcgaaaauagu

SEQ ID NO: 3744994 - RNA, 20 nt, Human
gaccgcuacaccacucuggc

SEQ ID NO: 3744995 - RNA, 21 nt, Human
gaccgcuacaccacucuggca

SEQ ID NO: 3744996 - RNA, 22 nt, Human
gaccgcuacaccacucuggcag

SEQ ID NO: 3744997 - RNA, 22 nt, Human
gaccgcuuguggggacccaggc

SEQ ID NO: 3744998 - RNA, 14 nt, Human
gaccggaagcuccu

SEQ ID NO: 3744999 - RNA, 17 nt, Human
gaccggacuuuucugca

SEQ ID NO: 3745000 - RNA, 16 nt, Human
gaccggccugccagga

SEQ ID NO: 3745001 - RNA, 19 nt, Human
gaccggccugccaggagga

SEQ ID NO: 3745002 - RNA, 20 nt, Human
gaccggcggaccccagccau

SEQ ID NO: 3745003 - RNA, 13 nt, Human
gaccguccucacc

SEQ ID NO: 3745004 - RNA, 20 nt, Human
gaccgugggcggggccuugc

SEQ ID NO: 3745005 - RNA, 19 nt, Human
gaccuaaaauuugcccucc

SEQ ID NO: 3745006 - RNA, 19 nt, Human
gaccuaaccagggccagaa

SEQ ID NO: 3745007 - RNA, 21 nt, Human
gaccuaaccuaagcaaaacca

SEQ ID NO: 3745008 - RNA, 13 nt, Human
gaccuacaaauca

SEQ ID NO: 3745009 - RNA, 13 nt, Human
gaccuacaggcug

SEQ ID NO: 3745010 - RNA, 21 nt, Human
gaccuacagggggucuggcug

SEQ ID NO: 3745011 - RNA, 23 nt, Human
gaccuacagggggucuggcuggu

SEQ ID NO: 3745012 - RNA, 17 nt, Human
gaccuacuacgcagagg

SEQ ID NO: 3745013 - RNA, 17 nt, Human
gaccuacuguucuaaag

SEQ ID NO: 3745014 - RNA, 19 nt, Human
gucaugaugaaucaguccu

SEQ ID NO: 3745015 - RNA, 16 nt, Human
gucaugaugcucuuuc

SEQ ID NO: 3745016 - RNA, 22 nt, Human
gucaugcagaguauuucuaaag

SEQ ID NO: 3745017 - RNA, 18 nt, Human
gucaugcauaaauaugca

SEQ ID NO: 3745018 - RNA, 19 nt, Human
gucaugcauaaauaugcag

SEQ ID NO: 3745019 - RNA, 16 nt, Human
gucaugccccccucaa

SEQ ID NO: 3745020 - RNA, 16 nt, Human
gucaugcccuccucuc

SEQ ID NO: 3745021 - RNA, 20 nt, Human
gucaugcuccccugugccag

SEQ ID NO: 3745022 - RNA, 14 nt, Human
gucaugcugccuua

SEQ ID NO: 3745023 - RNA, 12 nt, Human
gucauggccaca

SEQ ID NO: 3745024 - RNA, 15 nt, Human
gucauggccacacug

SEQ ID NO: 3745025 - RNA, 18 nt, Human
gucauggccacacuguga

SEQ ID NO: 3745026 - RNA, 20 nt, Human
gucauggccacacugugaca

SEQ ID NO: 3745027 - RNA, 20 nt, Human
gucauggcuuaauguuuauu

SEQ ID NO: 3745028 - RNA, 23 nt, Human
gucaugggccacugcuuuucccu

SEQ ID NO: 3745029 - RNA, 20 nt, Human
gucauguaagcugaaaauau

SEQ ID NO: 3745030 - RNA, 13 nt, Human
gucauguauguuu

SEQ ID NO: 3745031 - RNA, 14 nt, Human
gucauguauguuuc

SEQ ID NO: 3745032 - RNA, 16 nt, Human
gucauguguucccuuu

SEQ ID NO: 3745033 - RNA, 18 nt, Human
gucauguguucccuuugu

SEQ ID NO: 3745034 - RNA, 13 nt, Human
gucauguuuaucu

SEQ ID NO: 3745035 - RNA, 21 nt, Human
gucauguuuuaaauguacagu

SEQ ID NO: 3745036 - RNA, 22 nt, Human
gucauuaaaauaaauaaaugca

SEQ ID NO: 3745037 - RNA, 13 nt, Human
gucauuaaacugg

SEQ ID NO: 3745038 - RNA, 14 nt, Human
gucauuaauguguu

SEQ ID NO: 3745039 - RNA, 16 nt, Human
gucauuagacuccucc

SEQ ID NO: 3745040 - RNA, 21 nt, Human
gucauuaugagaggcaaugau

SEQ ID NO: 3745041 - RNA, 19 nt, Human
gucauuauguuaauauuuc

SEQ ID NO: 3745042 - RNA, 20 nt, Human
gucauucagagucagccagg

SEQ ID NO: 3745043 - RNA, 19 nt, Human
gucauugcacauaagcuuc

SEQ ID NO: 3745044 - RNA, 15 nt, Human
gucauugcuguagga

SEQ ID NO: 3745045 - RNA, 14 nt, Human
gucauugcuucuuc

SEQ ID NO: 3745046 - RNA, 17 nt, Human
gucauuggcuuuauccu

SEQ ID NO: 3745047 - RNA, 16 nt, Human
gucauuuacuaaacau

SEQ ID NO: 3745048 - RNA, 21 nt, Human
gucauuuaugugucaguucau

SEQ ID NO: 3745049 - RNA, 12 nt, Human
gucauuucauuc

SEQ ID NO: 3745050 - RNA, 14 nt, Human
gucauuucauucca

SEQ ID NO: 3745051 - RNA, 21 nt, Human
gucauuuccauguaugcauaa

SEQ ID NO: 3745052 - RNA, 12 nt, Human
gucauuucugau

SEQ ID NO: 3745053 - RNA, 21 nt, Human
gucauuugcgcacaacuuaaa

SEQ ID NO: 3745054 - RNA, 21 nt, Human
gucauuugcugagcauguacu

SEQ ID NO: 3745055 - RNA, 11 nt, Human
gucauuuucau

SEQ ID NO: 3745056 - RNA, 13 nt, Human
gucauuuucauua

SEQ ID NO: 3745057 - RNA, 12 nt, Human
gucauuuugaag

SEQ ID NO: 3745058 - RNA, 14 nt, Human
gucauuuugaagcu

SEQ ID NO: 3745059 - RNA, 18 nt, Human
gucauuuugcuucauagc

SEQ ID NO: 3745060 - RNA, 20 nt, Human
gucauuuugguacuuuggug

SEQ ID NO: 3745061 - RNA, 17 nt, Human
gucauuuuuacaaugua

SEQ ID NO: 3745062 - RNA, 20 nt, Human
gucauuuuucagaccuuuua

SEQ ID NO: 3745063 - RNA, 21 nt, Human
gucauuuuuuuuaagaaaaag

SEQ ID NO: 3745064 - RNA, 23 nt, Human
gucauuuuuuuucuuugaauaaa

SEQ ID NO: 3745065 - RNA, 15 nt, Human
guccaaaaccgccag

SEQ ID NO: 3745066 - RNA, 18 nt, Human
guccaaaaccgccagcuc

SEQ ID NO: 3745067 - RNA, 23 nt, Human
guccaaaaccgccagcucuguuc

SEQ ID NO: 3745068 - RNA, 17 nt, Human
guccaaacguccucuuu

SEQ ID NO: 3745069 - RNA, 19 nt, Human
guccaaagaggcugccccu

SEQ ID NO: 3745070 - RNA, 14 nt, Human
guccaaaggaggcu

SEQ ID NO: 3745071 - RNA, 11 nt, Human
guccaaauaaa

SEQ ID NO: 3745072 - RNA, 15 nt, Human
guccaaauaaaaacu

SEQ ID NO: 3745073 - RNA, 18 nt, Human
guccaaauaaaaacuaaa

SEQ ID NO: 3745074 - RNA, 16 nt, Human
guccaaccagaccugg

SEQ ID NO: 3745075 - RNA, 14 nt, Human
guccaaccuaaccc

SEQ ID NO: 3745076 - RNA, 20 nt, Human
guccaacguggggcagcaca

SEQ ID NO: 3745077 - RNA, 21 nt, Human
guccaacguggggcagcacag

SEQ ID NO: 3745078 - RNA, 14 nt, Human
guccaacuaaaaac

SEQ ID NO: 3745079 - RNA, 13 nt, Human
guccaacuccagu

SEQ ID NO: 3745080 - RNA, 15 nt, Human
guccaacugcaacuc

SEQ ID NO: 3745081 - RNA, 13 nt, Human
guccaagaagccc

SEQ ID NO: 3745082 - RNA, 15 nt, Human
guccaagaagcccag

SEQ ID NO: 3745083 - RNA, 16 nt, Human
guccaagaagcccagg

SEQ ID NO: 3745084 - RNA, 22 nt, Human
guccaagauuccggauccuaag

SEQ ID NO: 3745085 - RNA, 20 nt, Human
guccaagggguccccuccag

SEQ ID NO: 3745086 - RNA, 21 nt, Human
guccaaugagcuuucugaaca

SEQ ID NO: 3745087 - RNA, 12 nt, Human
guccaauguggc

SEQ ID NO: 3745088 - RNA, 13 nt, Human
guccacagagagg

SEQ ID NO: 3745089 - RNA, 14 nt, Human
guccacaguggaac

SEQ ID NO: 3745090 - RNA, 16 nt, Human
guccacaguggaacca

SEQ ID NO: 3745091 - RNA, 20 nt, Human
guccacccaccuaugugcca

SEQ ID NO: 3745092 - RNA, 11 nt, Human
guccacccagc

SEQ ID NO: 3745093 - RNA, 12 nt, Human
guccacccagga

SEQ ID NO: 3745094 - RNA, 14 nt, Human
guccacccaggagc

SEQ ID NO: 3745095 - RNA, 18 nt, Human
guccacccgccccugccc

SEQ ID NO: 3745096 - RNA, 21 nt, Human
guccaccuggccccaugucuc

SEQ ID NO: 3745097 - RNA, 15 nt, Human
guccacgacugucuc

SEQ ID NO: 3745098 - RNA, 16 nt, Human
guccacgacugucucc

SEQ ID NO: 3745099 - RNA, 19 nt, Human
guccacgcgugccguggca

SEQ ID NO: 3745100 - RNA, 22 nt, Human
guccacgcgugccguggcacca

SEQ ID NO: 3745101 - RNA, 12 nt, Human
guccacuuuucc

SEQ ID NO: 3745102 - RNA, 15 nt, Human
guccacuuuuccagu

SEQ ID NO: 3745103 - RNA, 22 nt, Human
guccagaagaauauucaggacu

SEQ ID NO: 3745104 - RNA, 14 nt, Human
guccagacagccug

SEQ ID NO: 3745105 - RNA, 16 nt, Human
guccagacagccugua

SEQ ID NO: 3745106 - RNA, 17 nt, Human
guccagagcugcuuccc

SEQ ID NO: 3745107 - RNA, 15 nt, Human
guccagauuuacacu

SEQ ID NO: 3745108 - RNA, 23 nt, Human
guccagcaccuugugccuggggu

SEQ ID NO: 3745109 - RNA, 14 nt, Human
guccagcagucacu

SEQ ID NO: 3745110 - RNA, 21 nt, Human
guccagcauugcuggacucug

SEQ ID NO: 3745111 - RNA, 15 nt, Human
guccagcccaucucg

SEQ ID NO: 3745112 - RNA, 19 nt, Human
guccagcccaucucggagc

SEQ ID NO: 3745113 - RNA, 22 nt, Human
guccagccugccccggagcugg

SEQ ID NO: 3745114 - RNA, 12 nt, Human
guccagcucugg

SEQ ID NO: 3745115 - RNA, 21 nt, Human
guccagcugcccuuccgcagu

SEQ ID NO: 3745116 - RNA, 22 nt, Human
guccagcugcccuuccgcagug

SEQ ID NO: 3745117 - RNA, 13 nt, Human
guccagcuggccu

SEQ ID NO: 3745118 - RNA, 17 nt, Human
guccagcuggccuggac

SEQ ID NO: 3745119 - RNA, 18 nt, Human
guccagcuggccuggaca

SEQ ID NO: 3745120 - RNA, 19 nt, Human
guccagcuggccuggacag

SEQ ID NO: 3745121 - RNA, 16 nt, Human
guccagcuugcucuuc

SEQ ID NO: 3745122 - RNA, 17 nt, Human
guccagcuugcucuuca

SEQ ID NO: 3745123 - RNA, 15 nt, Human
guccaggaacaagcu

SEQ ID NO: 3745124 - RNA, 14 nt, Human
guccaggcacagga

SEQ ID NO: 3745125 - RNA, 17 nt, Human
guccaggccccaaaacc

SEQ ID NO: 3745126 - RNA, 19 nt, Human
guccaggccuacuccuguc

SEQ ID NO: 3745127 - RNA, 13 nt, Human
guccaggcugccg

SEQ ID NO: 3745128 - RNA, 15 nt, Human
guccagggaagcugg

SEQ ID NO: 3745129 - RNA, 14 nt, Human
guccagggcccuga

SEQ ID NO: 3745130 - RNA, 17 nt, Human
guccagggcccugagcu

SEQ ID NO: 3745131 - RNA, 18 nt, Human
guccaggggaggccuucc

SEQ ID NO: 3745132 - RNA, 18 nt, Human
guccaggggccccuccag

SEQ ID NO: 3745133 - RNA, 20 nt, Human
guccaggggccccuccagcu

SEQ ID NO: 3745134 - RNA, 23 nt, Human
guccaggggccccuccagcuugu

SEQ ID NO: 3745135 - RNA, 15 nt, Human
guccagguccuggug

SEQ ID NO: 3745136 - RNA, 16 nt, Human
guccagguccuggugg

SEQ ID NO: 3745137 - RNA, 23 nt, Human
guccagguccugguggggcagcu

SEQ ID NO: 3745138 - RNA, 19 nt, Human
guccaggucgggcucagcu

SEQ ID NO: 3745139 - RNA, 22 nt, Human
guccagguggagguggcauccc

SEQ ID NO: 3745140 - RNA, 20 nt, Human
guccagugcaaccacacacc

SEQ ID NO: 3745141 - RNA, 12 nt, Human
guccagugccca

SEQ ID NO: 3745142 - RNA, 13 nt, Human
guccagugcccau

SEQ ID NO: 3745143 - RNA, 14 nt, Human
guccagugcccauu

SEQ ID NO: 3745144 - RNA, 15 nt, Human
guccaguguuucuuu

SEQ ID NO: 3745145 - RNA, 14 nt, Human
guccaguucccaga

SEQ ID NO: 3745146 - RNA, 14 nt, Human
guccauagagagca

SEQ ID NO: 3745147 - RNA, 17 nt, Human
guccaucagccaggaca

SEQ ID NO: 3745148 - RNA, 15 nt, Human
guccaucagccccuc

SEQ ID NO: 3745149 - RNA, 12 nt, Human
guccaucccagc

SEQ ID NO: 3745150 - RNA, 14 nt, Human
guccaucugcccgc

SEQ ID NO: 3745151 - RNA, 21 nt, Human
guccaucugcccgccugccca

SEQ ID NO: 3745152 - RNA, 23 nt, Human
guccaugaagauguagaggagaa

SEQ ID NO: 3745153 - RNA, 22 nt, Human
guccaugcaugacagccucuau

SEQ ID NO: 3745154 - RNA, 20 nt, Human
guccauggaaugcuugaaaa

SEQ ID NO: 3745155 - RNA, 23 nt, Human
guccaugggcagagcccaaggga

SEQ ID NO: 3745156 - RNA, 19 nt, Human
guccaugugguucuucaaa

SEQ ID NO: 3745157 - RNA, 15 nt, Human
guccauucucccagg

SEQ ID NO: 3745158 - RNA, 23 nt, Human
guccauuuauauaugaaaacuau

SEQ ID NO: 3745159 - RNA, 21 nt, Human
guccauuuauccacaggaaag

SEQ ID NO: 3745160 - RNA, 13 nt, Human
guccauuuguaaa

SEQ ID NO: 3745161 - RNA, 16 nt, Human
guccauuuugugaagc

SEQ ID NO: 3745162 - RNA, 20 nt, Human
guccauuuugugaagcccug

SEQ ID NO: 3745163 - RNA, 18 nt, Human
gucccaagguucugggug

SEQ ID NO: 3745164 - RNA, 13 nt, Human
gucccaagugcca

SEQ ID NO: 3745165 - RNA, 17 nt, Human
gucccacaaaugggcgc

SEQ ID NO: 3745166 - RNA, 18 nt, Human
gucccacaaaugggcgcc

SEQ ID NO: 3745167 - RNA, 12 nt, Human
gucccacagcuu

SEQ ID NO: 3745168 - RNA, 15 nt, Human
gucccacagcuuggg

SEQ ID NO: 3745169 - RNA, 18 nt, Human
gucccacaucccugggcc

SEQ ID NO: 3745170 - RNA, 15 nt, Human
gucccaccccacaca

SEQ ID NO: 3745171 - RNA, 19 nt, Human
gucccacccccuuccccca

SEQ ID NO: 3745172 - RNA, 21 nt, Human
gucccaccgguugcuucuggg

SEQ ID NO: 3745173 - RNA, 22 nt, Human
gucccaccgguugcuucuggga

SEQ ID NO: 3745174 - RNA, 15 nt, Human
gucccaccuccagcc

SEQ ID NO: 3745175 - RNA, 14 nt, Human
gucccaccucuucu

SEQ ID NO: 3745176 - RNA, 21 nt, Human
gucccaccucuucucuuccug

SEQ ID NO: 3745177 - RNA, 22 nt, Human
gucccaccuuggcugcagggag

SEQ ID NO: 3745178 - RNA, 14 nt, Human
gucccacgugucuu

SEQ ID NO: 3745179 - RNA, 18 nt, Human
gucccacgugucuuccac

SEQ ID NO: 3745180 - RNA, 17 nt, Human
gucccacuaucugggug

SEQ ID NO: 3745181 - RNA, 12 nt, Human
gucccacucaag

SEQ ID NO: 3745182 - RNA, 21 nt, Human
gucccacuuccccuccuaccc

SEQ ID NO: 3745183 - RNA, 22 nt, Human
gucccagagcaggaggccccug

SEQ ID NO: 3745184 - RNA, 21 nt, Human
gucccagauuggcucacacug

SEQ ID NO: 3745185 - RNA, 17 nt, Human
gucccagcagccagcca

SEQ ID NO: 3745186 - RNA, 15 nt, Human
gucccagccaccccg

SEQ ID NO: 3745187 - RNA, 16 nt, Human
gucccagccaccccgg

SEQ ID NO: 3745188 - RNA, 23 nt, Human
gucccagccaccccgggcucucu

SEQ ID NO: 3745189 - RNA, 14 nt, Human
gucccagcuacucg

SEQ ID NO: 3745190 - RNA, 11 nt, Human
gucccagcucc

SEQ ID NO: 3745191 - RNA, 12 nt, Human
gucccaggcaga

SEQ ID NO: 3745192 - RNA, 15 nt, Human
gucccaggcugagcc

SEQ ID NO: 3745193 - RNA, 16 nt, Human
gucccaggcugagccu

SEQ ID NO: 3745194 - RNA, 18 nt, Human
gucccaggcugagccuca

SEQ ID NO: 3745195 - RNA, 19 nt, Human
gucccagguuggcucugcc

SEQ ID NO: 3745196 - RNA, 10 nt, Human
gucccagugg

SEQ ID NO: 3745197 - RNA, 14 nt, Human
gucccagugggagg

SEQ ID NO: 3745198 - RNA, 15 nt, Human
gucccagugggaggc

SEQ ID NO: 3745199 - RNA, 17 nt, Human
gucccagugggaggcgc

SEQ ID NO: 3745200 - RNA, 13 nt, Human
gucccauccaggc

SEQ ID NO: 3745201 - RNA, 16 nt, Human
gucccauccaggcagu

SEQ ID NO: 3745202 - RNA, 17 nt, Human
gucccaugacccacccc

SEQ ID NO: 3745203 - RNA, 18 nt, Human
gucccaugacccaccccu

SEQ ID NO: 3745204 - RNA, 20 nt, Human
gucccaugacccaccccugu

SEQ ID NO: 3745205 - RNA, 22 nt, Human
gucccaugacccaccccugugc

SEQ ID NO: 3745206 - RNA, 23 nt, Human
gucccaugacccaccccugugcu

SEQ ID NO: 3745207 - RNA, 23 nt, Human
gucccauggacacuccagugcca

SEQ ID NO: 3745208 - RNA, 20 nt, Human
gucccaugugagcugcugcc

SEQ ID NO: 3745209 - RNA, 21 nt, Human
gucccaugugagcugcugcca

SEQ ID NO: 3745210 - RNA, 14 nt, Human
gucccauucccugg

SEQ ID NO: 3745211 - RNA, 22 nt, Human
gucccauugguguugucauugu

SEQ ID NO: 3745212 - RNA, 16 nt, Human
gucccauuucucacug

SEQ ID NO: 3745213 - RNA, 18 nt, Human
guccccaaaccugcaagg

SEQ ID NO: 3745214 - RNA, 19 nt, Human
guccccaacagcgcccaaa

SEQ ID NO: 3745215 - RNA, 21 nt, Human
guccccaagauucacaccuga

SEQ ID NO: 3745216 - RNA, 16 nt, Human
guccccaaugaauaua

SEQ ID NO: 3745217 - RNA, 15 nt, Human
guccccaccaucugc

SEQ ID NO: 3745218 - RNA, 17 nt, Human
guccccaccaucugcug

SEQ ID NO: 3745219 - RNA, 18 nt, Human
guccccaccaucugcugu

SEQ ID NO: 3745220 - RNA, 14 nt, Human
guccccaccccugc

SEQ ID NO: 3745221 - RNA, 15 nt, Human
guccccaccccugcc

SEQ ID NO: 3745222 - RNA, 18 nt, Human
guccccacccuccacuca

SEQ ID NO: 3745223 - RNA, 17 nt, Human
guccccaccgcagacag

SEQ ID NO: 3745224 - RNA, 22 nt, Human
guccccagacuccaccaagccu

SEQ ID NO: 3745225 - RNA, 23 nt, Human
guccccagagaaagcgcagaugc

SEQ ID NO: 3745226 - RNA, 18 nt, Human
guccccagagaccaggcu

SEQ ID NO: 3745227 - RNA, 14 nt, Human
guccccagcagaga

SEQ ID NO: 3745228 - RNA, 19 nt, Human
guccccaguuugcagaaaa

SEQ ID NO: 3745229 - RNA, 17 nt, Human
guccccauacuccuaug

SEQ ID NO: 3745230 - RNA, 17 nt, Human
gucccccaaccccagcc

SEQ ID NO: 3745231 - RNA, 16 nt, Human
gucccccaacuugaga

SEQ ID NO: 3745232 - RNA, 12 nt, Human
guccccccaccc

SEQ ID NO: 3745233 - RNA, 21 nt, Human
guccccccccaaccuuucccu

SEQ ID NO: 3745234 - RNA, 17 nt, Human
gucccccuauccuuggc

SEQ ID NO: 3745235 - RNA, 18 nt, Human
gucccccuauccuuggca

SEQ ID NO: 3745236 - RNA, 15 nt, Human
gucccccugcagcua

SEQ ID NO: 3745237 - RNA, 18 nt, Human
gucccccuuccauggacu

SEQ ID NO: 3745238 - RNA, 13 nt, Human
guccccgcagccc

SEQ ID NO: 3745239 - RNA, 15 nt, Human
guccccggggcccag

SEQ ID NO: 3745240 - RNA, 22 nt, Human
guccccgugccccgccuccccg

SEQ ID NO: 3745241 - RNA, 13 nt, Human
guccccucagcuc

SEQ ID NO: 3745242 - RNA, 22 nt, Human
guccccucccagagcuggugga

SEQ ID NO: 3745243 - RNA, 12 nt, Human
guccccucccau

SEQ ID NO: 3745244 - RNA, 15 nt, Human
guccccucccaucug

SEQ ID NO: 3745245 - RNA, 22 nt, Human
guccccuguuuguuucugaaag

SEQ ID NO: 3745246 - RNA, 23 nt, Human
guccccuguuuguuucugaaagg

SEQ ID NO: 3745247 - RNA, 13 nt, Human
guccccuuccauc

SEQ ID NO: 3745248 - RNA, 22 nt, Human
guccccuuuucuuuucuacccu

SEQ ID NO: 3745249 - RNA, 16 nt, Human
gucccgauuguaacuc

SEQ ID NO: 3745250 - RNA, 17 nt, Human
gucccggcucugugggu

SEQ ID NO: 3745251 - RNA, 22 nt, Human
gucccggggccagcacuuccau

SEQ ID NO: 3745252 - RNA, 16 nt, Human
gucccgggguccugug

SEQ ID NO: 3745253 - RNA, 19 nt, Human
gucccgggguccuguggca

SEQ ID NO: 3745254 - RNA, 20 nt, Human
gucccgggguccuguggcag

SEQ ID NO: 3745255 - RNA, 15 nt, Human
gucccuaauaaagcu

SEQ ID NO: 3745256 - RNA, 16 nt, Human
gucccuaauaaagcug

SEQ ID NO: 3745257 - RNA, 22 nt, Human
gucccuaccgagucucuucucc

SEQ ID NO: 3745258 - RNA, 15 nt, Human
gucccuagcagccca

SEQ ID NO: 3745259 - RNA, 21 nt, Human
gucccuagcagcccacccugc

SEQ ID NO: 3745260 - RNA, 22 nt, Human
gucccuauguauuugcaguuca

SEQ ID NO: 3745261 - RNA, 12 nt, Human
gucccucccacc

SEQ ID NO: 3745262 - RNA, 14 nt, Human
gucccucccaccuc

SEQ ID NO: 3745263 - RNA, 16 nt, Human
gucccucccaccucug

SEQ ID NO: 3745264 - RNA, 21 nt, Human
gucccucccaccucugugacc

SEQ ID NO: 3745265 - RNA, 12 nt, Human
gucccuccuggu

SEQ ID NO: 3745266 - RNA, 22 nt, Human
gucccuccuggugucaccccag

SEQ ID NO: 3745267 - RNA, 23 nt, Human
gucccuccuggugucaccccaga

SEQ ID NO: 3745268 - RNA, 16 nt, Human
gucccucucaggcaug

SEQ ID NO: 3745269 - RNA, 18 nt, Human
gucccugccccagcaaga

SEQ ID NO: 3745270 - RNA, 17 nt, Human
gucccugcccccucccc

SEQ ID NO: 3745271 - RNA, 12 nt, Human
gucccugccuca

SEQ ID NO: 3745272 - RNA, 20 nt, Human
gucccugccuggaccagccu

SEQ ID NO: 3745273 - RNA, 23 nt, Human
gucccugccuggaccagccucuc

SEQ ID NO: 3745274 - RNA, 14 nt, Human
guaccuugaacacu

SEQ ID NO: 3745275 - RNA, 18 nt, Human
guaccuugaacacugggg

SEQ ID NO: 3745276 - RNA, 17 nt, Human
guaccuugcacacauca

SEQ ID NO: 3745277 - RNA, 23 nt, Human
guaccuuugcucuugcagagaag

SEQ ID NO: 3745278 - RNA, 13 nt, Human
guaccuuuuaaca

SEQ ID NO: 3745279 - RNA, 19 nt, Human
guacgacgucagauguuua

SEQ ID NO: 3745280 - RNA, 12 nt, Human
guacgcacagac

SEQ ID NO: 3745281 - RNA, 14 nt, Human
guacgcacagacag

SEQ ID NO: 3745282 - RNA, 21 nt, Human
guacguuauuguugacuuauu

SEQ ID NO: 3745283 - RNA, 18 nt, Human
guacuaacauuuauuuga

SEQ ID NO: 3745284 - RNA, 20 nt, Human
guacuaaggauacaggcugg

SEQ ID NO: 3745285 - RNA, 17 nt, Human
guacuacaguccuccca

SEQ ID NO: 3745286 - RNA, 18 nt, Human
guacuacaguccucccau

SEQ ID NO: 3745287 - RNA, 19 nt, Human
guacuacaguccucccauc

SEQ ID NO: 3745288 - RNA, 19 nt, Human
guacuaguacuguguacug

SEQ ID NO: 3745289 - RNA, 13 nt, Human
guacuauucugau

SEQ ID NO: 3745290 - RNA, 14 nt, Human
guacuauuuaacug

SEQ ID NO: 3745291 - RNA, 15 nt, Human
guacuauuuaacuga

SEQ ID NO: 3745292 - RNA, 21 nt, Human
guacuauuuagauauaacacu

SEQ ID NO: 3745293 - RNA, 15 nt, Human
guacucacugaagcc

SEQ ID NO: 3745294 - RNA, 16 nt, Human
guacucacugaagccu

SEQ ID NO: 3745295 - RNA, 23 nt, Human
guacucaggaggcugaggggagg

SEQ ID NO: 3745296 - RNA, 20 nt, Human
guacucaucaucaacccuaa

SEQ ID NO: 3745297 - RNA, 20 nt, Human
guacucccucucaggaucca

SEQ ID NO: 3745298 - RNA, 14 nt, Human
guacuccucccagg

SEQ ID NO: 3745299 - RNA, 16 nt, Human
guacucugcacauacg

SEQ ID NO: 3745300 - RNA, 23 nt, Human
guacucuuccgaaaaauccucuu

SEQ ID NO: 3745301 - RNA, 22 nt, Human
guacugaaagccuuagggaagc

SEQ ID NO: 3745302 - RNA, 22 nt, Human
guacugaauuuuuuuguaauaa

SEQ ID NO: 3745303 - RNA, 14 nt, Human
guacugacuuugcu

SEQ ID NO: 3745304 - RNA, 20 nt, Human
guacugacuuugcuugcuuu

SEQ ID NO: 3745305 - RNA, 12 nt, Human
guacugagauuu

SEQ ID NO: 3745306 - RNA, 16 nt, Human
guacugagccuuguaa

SEQ ID NO: 3745307 - RNA, 14 nt, Human
guacugauuucagu

SEQ ID NO: 3745308 - RNA, 13 nt, Human
guacugcauuauu

SEQ ID NO: 3745309 - RNA, 15 nt, Human
guacugcauuauuug

SEQ ID NO: 3745310 - RNA, 21 nt, Human
guacugccccccaugaggaag

SEQ ID NO: 3745311 - RNA, 22 nt, Human
guacugccccccaugaggaagg

SEQ ID NO: 3745312 - RNA, 22 nt, Human
guacugcucaggcugcagcugg

SEQ ID NO: 3745313 - RNA, 16 nt, Human
guacuguaaagagacc

SEQ ID NO: 3745314 - RNA, 13 nt, Human
guacuguaauaau

SEQ ID NO: 3745315 - RNA, 17 nt, Human
guacuguaauaauaccu

SEQ ID NO: 3745316 - RNA, 20 nt, Human
guacuguacagcuggcucua

SEQ ID NO: 3745317 - RNA, 14 nt, Human
guacuguaguuuuu

SEQ ID NO: 3745318 - RNA, 17 nt, Human
guacuguauagacaguu

SEQ ID NO: 3745319 - RNA, 18 nt, Human
guacuguauagacaguuu

SEQ ID NO: 3745320 - RNA, 20 nt, Human
guacuguauagacaguuugu

SEQ ID NO: 3745321 - RNA, 21 nt, Human
guacuguaugaucaaauguuu

SEQ ID NO: 3745322 - RNA, 21 nt, Human
guacugugggcaauuuagaaa

SEQ ID NO: 3745323 - RNA, 23 nt, Human
guacuguucucuucuugaacacu

SEQ ID NO: 3745324 - RNA, 15 nt, Human
guacuguucuguguc

SEQ ID NO: 3745325 - RNA, 19 nt, Human
guacuguuuaauguucugu

SEQ ID NO: 3745326 - RNA, 19 nt, Human
guacuuaaaugaaagcaug

SEQ ID NO: 3745327 - RNA, 15 nt, Human
guacuuaauaaauuc

SEQ ID NO: 3745328 - RNA, 17 nt, Human
guacuuagaguuucugu

SEQ ID NO: 3745329 - RNA, 16 nt, Human
guacuuagcagcuauc

SEQ ID NO: 3745330 - RNA, 19 nt, Human
guacuuagcagcuaucucu

SEQ ID NO: 3745331 - RNA, 16 nt, Human
guacuuauaaagaagg

SEQ ID NO: 3745332 - RNA, 13 nt, Human
guacuuauuacug

SEQ ID NO: 3745333 - RNA, 21 nt, Human
guacuucaaauccuugaagau

SEQ ID NO: 3745334 - RNA, 16 nt, Human
guacuucagcaagaga

SEQ ID NO: 3745335 - RNA, 18 nt, Human
guacuucagcaagagaga

SEQ ID NO: 3745336 - RNA, 14 nt, Human
guacuuccacugau

SEQ ID NO: 3745337 - RNA, 13 nt, Human
guacuucccgggc

SEQ ID NO: 3745338 - RNA, 20 nt, Human
guacuucccgggccagggcu

SEQ ID NO: 3745339 - RNA, 15 nt, Human
guacuucuccacccu

SEQ ID NO: 3745340 - RNA, 17 nt, Human
guacuucuccacccugc

SEQ ID NO: 3745341 - RNA, 21 nt, Human
guacuucuccacccugcucuc

SEQ ID NO: 3745342 - RNA, 16 nt, Human
guacuucuucuguaau

SEQ ID NO: 3745343 - RNA, 23 nt, Human
guacuugcccugaccaugcauuu

SEQ ID NO: 3745344 - RNA, 14 nt, Human
guacuugcucuuga

SEQ ID NO: 3745345 - RNA, 18 nt, Human
guacuugcucuugaugcc

SEQ ID NO: 3745346 - RNA, 21 nt, Human
guacuuggaguauuggggucu

SEQ ID NO: 3745347 - RNA, 22 nt, Human
guacuugguccaacugcaacuc

SEQ ID NO: 3745348 - RNA, 16 nt, Human
guacuugucaaagaag

SEQ ID NO: 3745349 - RNA, 17 nt, Human
guacuugucauauguag

SEQ ID NO: 3745350 - RNA, 19 nt, Human
guacuugucauauguagcc

SEQ ID NO: 3745351 - RNA, 22 nt, Human
guacuugugaaacacagcuguu

SEQ ID NO: 3745352 - RNA, 14 nt, Human
guacuuuaaaaauu

SEQ ID NO: 3745353 - RNA, 22 nt, Human
guacuuuauagaagaaugcaug

SEQ ID NO: 3745354 - RNA, 16 nt, Human
guacuuucuguuaaaa

SEQ ID NO: 3745355 - RNA, 21 nt, Human
guacuuucuguuaaaaugcau

SEQ ID NO: 3745356 - RNA, 13 nt, Human
guacuuugauuca

SEQ ID NO: 3745357 - RNA, 15 nt, Human
guacuuugauucaca

SEQ ID NO: 3745358 - RNA, 16 nt, Human
guacuuuuaaaaacau

SEQ ID NO: 3745359 - RNA, 18 nt, Human
guacuuuucauucucuuu

SEQ ID NO: 3745360 - RNA, 21 nt, Human
guacuuuucauucucuuuuaa

SEQ ID NO: 3745361 - RNA, 22 nt, Human
guacuuuucauucucuuuuaau

SEQ ID NO: 3745362 - RNA, 19 nt, Human
guacuuuugagugugugug

SEQ ID NO: 3745363 - RNA, 22 nt, Human
guacuuuugagugugugugugc

SEQ ID NO: 3745364 - RNA, 24 nt, Human
guacuuuugagugugugugugcau

SEQ ID NO: 3745365 - RNA, 21 nt, Human
guacuuuuuggcauaacauaa

SEQ ID NO: 3745366 - RNA, 20 nt, Human
guagaaaaaaaaauucacau

SEQ ID NO: 3745367 - RNA, 17 nt, Human
guagaaaauauguccca

SEQ ID NO: 3745368 - RNA, 18 nt, Human
guagaaaaugugacccuc

SEQ ID NO: 3745369 - RNA, 14 nt, Human
guagaaaggccuuu

SEQ ID NO: 3745370 - RNA, 16 nt, Human
guagaaaggccuuuaa

SEQ ID NO: 3745371 - RNA, 14 nt, Human
guagaaaugaugau

SEQ ID NO: 3745372 - RNA, 22 nt, Human
guagaaaugguuguauuagaug

SEQ ID NO: 3745373 - RNA, 17 nt, Human
guagaacacuaauucau

SEQ ID NO: 3745374 - RNA, 16 nt, Human
guagaacucacucugg

SEQ ID NO: 3745375 - RNA, 19 nt, Human
guagaacucacucugggcu

SEQ ID NO: 3745376 - RNA, 17 nt, Human
guagaacuccaggcccu

SEQ ID NO: 3745377 - RNA, 13 nt, Human
guagaacuuugua

SEQ ID NO: 3745378 - RNA, 15 nt, Human
guagaacuuuguaua

SEQ ID NO: 3745379 - RNA, 12 nt, Human
guagaagauggc

SEQ ID NO: 3745380 - RNA, 21 nt, Human
guagaagcauuccuucuuuga

SEQ ID NO: 3745381 - RNA, 13 nt, Human
guagaaggagaca

SEQ ID NO: 3745382 - RNA, 15 nt, Human
guagaaggagacaga

SEQ ID NO: 3745383 - RNA, 19 nt, Human
guagaagguugacacaguu

SEQ ID NO: 3745384 - RNA, 19 nt, Human
guagaaguucuaguguuuu

SEQ ID NO: 3745385 - RNA, 17 nt, Human
guagaauguauuguacc

SEQ ID NO: 3745386 - RNA, 14 nt, Human
guagaauguuuuca

SEQ ID NO: 3745387 - RNA, 17 nt, Human
guagaauuaucuaauuu

SEQ ID NO: 3745388 - RNA, 22 nt, Human
guagaauuaucuaauuuauaaa

SEQ ID NO: 3745389 - RNA, 14 nt, Human
guagaauugcauug

SEQ ID NO: 3745390 - RNA, 19 nt, Human
guagacacaggauagauaa

SEQ ID NO: 3745391 - RNA, 14 nt, Human
guagacauuuuaac

SEQ ID NO: 3745392 - RNA, 14 nt, Human
guagaccaaaauaa

SEQ ID NO: 3745393 - RNA, 15 nt, Human
guagaccaaaauaaa

SEQ ID NO: 3745394 - RNA, 16 nt, Human
guagaccaaaauaaaa

SEQ ID NO: 3745395 - RNA, 15 nt, Human
guagaccacugccau

SEQ ID NO: 3745396 - RNA, 20 nt, Human
guagaccuuguuacuucuga

SEQ ID NO: 3745397 - RNA, 15 nt, Human
guagacuauauacau

SEQ ID NO: 3745398 - RNA, 12 nt, Human
guagagacaggg

SEQ ID NO: 3745399 - RNA, 15 nt, Human
guagagccagagguc

SEQ ID NO: 3745400 - RNA, 11 nt, Human
guagagccagg

SEQ ID NO: 3745401 - RNA, 15 nt, Human
guagagccagggucu

SEQ ID NO: 3745402 - RNA, 18 nt, Human
guagagccagggucucac

SEQ ID NO: 3745403 - RNA, 21 nt, Human
guagagcuagaacauggagag

SEQ ID NO: 3745404 - RNA, 16 nt, Human
guagagggugcugccc

SEQ ID NO: 3745405 - RNA, 20 nt, Human
guagagguacacuugugaau

SEQ ID NO: 3745406 - RNA, 15 nt, Human
guagagguauaauug

SEQ ID NO: 3745407 - RNA, 21 nt, Human
guagagucugagggcuuguag

SEQ ID NO: 3745408 - RNA, 13 nt, Human
guagagugggagc

SEQ ID NO: 3745409 - RNA, 15 nt, Human
guagagugugccuga

SEQ ID NO: 3745410 - RNA, 15 nt, Human
guagaguuaagaagc

SEQ ID NO: 3745411 - RNA, 16 nt, Human
guagaguuaagaagcu

SEQ ID NO: 3745412 - RNA, 15 nt, Human
guagaguugcugaga

SEQ ID NO: 3745413 - RNA, 15 nt, Human
guagauaaauauuug

SEQ ID NO: 3745414 - RNA, 17 nt, Human
guagauaauuucagggu

SEQ ID NO: 3745415 - RNA, 18 nt, Human
guagauaauuucagggug

SEQ ID NO: 3745416 - RNA, 12 nt, Human
guagauagaaau

SEQ ID NO: 3745417 - RNA, 13 nt, Human
guagauagaaaua

SEQ ID NO: 3745418 - RNA, 16 nt, Human
guagauaguaugcacu

SEQ ID NO: 3745419 - RNA, 15 nt, Human
guagauauuacuuua

SEQ ID NO: 3745420 - RNA, 22 nt, Human
guagauauuggacaaagaaccu

SEQ ID NO: 3745421 - RNA, 22 nt, Human
guagauccauuuccauugcuua

SEQ ID NO: 3745422 - RNA, 21 nt, Human
guagaucuauauuagaucaaa

SEQ ID NO: 3745423 - RNA, 15 nt, Human
guagaugcauuuggg

SEQ ID NO: 3745424 - RNA, 19 nt, Human
gacucugcacaugucuugu

SEQ ID NO: 3745425 - RNA, 16 nt, Human
gacucugcagccucag

SEQ ID NO: 3745426 - RNA, 19 nt, Human
gacucugcaucccagcacc

SEQ ID NO: 3745427 - RNA, 21 nt, Human
gacucugcaucccagcaccug

SEQ ID NO: 3745428 - RNA, 13 nt, Human
gacucugcccccu

SEQ ID NO: 3745429 - RNA, 12 nt, Human
gacucugccucc

SEQ ID NO: 3745430 - RNA, 17 nt, Human
gacucuggacuuucucu

SEQ ID NO: 3745431 - RNA, 18 nt, Human
gacucuggcccuggcccu

SEQ ID NO: 3745432 - RNA, 16 nt, Human
gacucuggggacuccg

SEQ ID NO: 3745433 - RNA, 20 nt, Human
gacucuggguccuuccugaa

SEQ ID NO: 3745434 - RNA, 19 nt, Human
gacucugguuucucauucu

SEQ ID NO: 3745435 - RNA, 13 nt, Human
gacucuguccuga

SEQ ID NO: 3745436 - RNA, 13 nt, Human
gacucugugcugg

SEQ ID NO: 3745437 - RNA, 18 nt, Human
gacucugugcuggccagc

SEQ ID NO: 3745438 - RNA, 15 nt, Human
gacucuuaagaagac

SEQ ID NO: 3745439 - RNA, 17 nt, Human
gacucuuaagaagacug

SEQ ID NO: 3745440 - RNA, 10 nt, Human
gacucuuccc

SEQ ID NO: 3745441 - RNA, 18 nt, Human
gacucuugacucuugccu

SEQ ID NO: 3745442 - RNA, 16 nt, Human
gacucuugcucuuucu

SEQ ID NO: 3745443 - RNA, 14 nt, Human
gacucuuguuuuca

SEQ ID NO: 3745444 - RNA, 22 nt, Human
gacucuuuauugucuguaaauc

SEQ ID NO: 3745445 - RNA, 19 nt, Human
gacucuuugguggcuuugc

SEQ ID NO: 3745446 - RNA, 21 nt, Human
gacucuuugguggcuuugcau

SEQ ID NO: 3745447 - RNA, 22 nt, Human
gacucuuuuccaaacacaggca

SEQ ID NO: 3745448 - RNA, 19 nt, Human
gacucuuuuuagggccagg

SEQ ID NO: 3745449 - RNA, 18 nt, Human
gacucuuuuuguaccugg

SEQ ID NO: 3745450 - RNA, 16 nt, Human
gacugaaaaccucucc

SEQ ID NO: 3745451 - RNA, 19 nt, Human
gacugaaaauauuguuuua

SEQ ID NO: 3745452 - RNA, 18 nt, Human
gacugaagaugcagcuca

SEQ ID NO: 3745453 - RNA, 16 nt, Human
gacugaauggacuuug

SEQ ID NO: 3745454 - RNA, 20 nt, Human
gacugaauuaugaaacuuuu

SEQ ID NO: 3745455 - RNA, 12 nt, Human
gacugaauucca

SEQ ID NO: 3745456 - RNA, 14 nt, Human
gacugaauuucuuu

SEQ ID NO: 3745457 - RNA, 20 nt, Human
gacugacagcaugugcccuc

SEQ ID NO: 3745458 - RNA, 13 nt, Human
gacugaccagcag

SEQ ID NO: 3745459 - RNA, 15 nt, Human
gacugaccuggucca

SEQ ID NO: 3745460 - RNA, 23 nt, Human
gacugaccugguccacagggcac

SEQ ID NO: 3745461 - RNA, 11 nt, Human
gacugagaaau

SEQ ID NO: 3745462 - RNA, 13 nt, Human
gacugagaaauuu

SEQ ID NO: 3745463 - RNA, 18 nt, Human
gacugagcacccucugga

SEQ ID NO: 3745464 - RNA, 15 nt, Human
gacugagcaccugcu

SEQ ID NO: 3745465 - RNA, 12 nt, Human
gacugagccagu

SEQ ID NO: 3745466 - RNA, 13 nt, Human
gacugagcucaag

SEQ ID NO: 3745467 - RNA, 21 nt, Human
gacugaggccugagcgcuccu

SEQ ID NO: 3745468 - RNA, 15 nt, Human
gacugagggggccug

SEQ ID NO: 3745469 - RNA, 16 nt, Human
gacugagggggccugg

SEQ ID NO: 3745470 - RNA, 19 nt, Human
gacugagggggccuggaug

SEQ ID NO: 3745471 - RNA, 23 nt, Human
gacugaguacguugugcauuugg

SEQ ID NO: 3745472 - RNA, 17 nt, Human
gacugagugggaagccc

SEQ ID NO: 3745473 - RNA, 12 nt, Human
gacugaucucag

SEQ ID NO: 3745474 - RNA, 15 nt, Human
gacugaugucuccua

SEQ ID NO: 3745475 - RNA, 16 nt, Human
gacugauguuugugca

SEQ ID NO: 3745476 - RNA, 13 nt, Human
gacugauucuuca

SEQ ID NO: 3745477 - RNA, 14 nt, Human
gacugauuucagag

SEQ ID NO: 3745478 - RNA, 13 nt, Human
gacugauuuuaau

SEQ ID NO: 3745479 - RNA, 23 nt, Human
gacugcaacaggaacuuggagug

SEQ ID NO: 3745480 - RNA, 18 nt, Human
gacugcacagcggccccu

SEQ ID NO: 3745481 - RNA, 21 nt, Human
gacugcagggacacgggcagc

SEQ ID NO: 3745482 - RNA, 17 nt, Human
gacugcaugguaauuua

SEQ ID NO: 3745483 - RNA, 18 nt, Human
gacugcaugguaauuuau

SEQ ID NO: 3745484 - RNA, 19 nt, Human
gacugcaugguaauuuaua

SEQ ID NO: 3745485 - RNA, 23 nt, Human
gacugcauguaccauuugcaugg

SEQ ID NO: 3745486 - RNA, 16 nt, Human
gacugcauuauauuua

SEQ ID NO: 3745487 - RNA, 20 nt, Human
gacugccaagacugcugugg

SEQ ID NO: 3745488 - RNA, 12 nt, Human
gacugccaagcc

SEQ ID NO: 3745489 - RNA, 14 nt, Human
gacugccaagccau

SEQ ID NO: 3745490 - RNA, 15 nt, Human
gacugccaagccaug

SEQ ID NO: 3745491 - RNA, 14 nt, Human
gacugccaccuccc

SEQ ID NO: 3745492 - RNA, 15 nt, Human
gacugccaccucccc

SEQ ID NO: 3745493 - RNA, 16 nt, Human
gacugccaccuccccu

SEQ ID NO: 3745494 - RNA, 15 nt, Human
gacugccagcucuuc

SEQ ID NO: 3745495 - RNA, 21 nt, Human
gacugccagcucuuccuagcu

SEQ ID NO: 3745496 - RNA, 20 nt, Human
gacugccagucccccugccc

SEQ ID NO: 3745497 - RNA, 15 nt, Human
gacugccccgugcag

SEQ ID NO: 3745498 - RNA, 17 nt, Human
gacugccccgugcagac

SEQ ID NO: 3745499 - RNA, 23 nt, Human
gacugccccgugcagacuggagg

SEQ ID NO: 3745500 - RNA, 15 nt, Human
gacugcccggcaggg

SEQ ID NO: 3745501 - RNA, 20 nt, Human
gacugccgaccgaggcugga

SEQ ID NO: 3745502 - RNA, 13 nt, Human
gacugccucugcc

SEQ ID NO: 3745503 - RNA, 21 nt, Human
gacugccucugccacacucug

SEQ ID NO: 3745504 - RNA, 18 nt, Human
gacugcuaguguucuguc

SEQ ID NO: 3745505 - RNA, 22 nt, Human
gacugcugcugccuggccacug

SEQ ID NO: 3745506 - RNA, 14 nt, Human
gacugcugggacug

SEQ ID NO: 3745507 - RNA, 15 nt, Human
gacugcugguuugua

SEQ ID NO: 3745508 - RNA, 16 nt, Human
gacugcuguggccagg

SEQ ID NO: 3745509 - RNA, 15 nt, Human
gacugcuucccaucc

SEQ ID NO: 3745510 - RNA, 16 nt, Human
gacugcuucccauccu

SEQ ID NO: 3745511 - RNA, 20 nt, Human
gacugcuucccauccuaccc

SEQ ID NO: 3745512 - RNA, 15 nt, Human
gacugcuugcccuaa

SEQ ID NO: 3745513 - RNA, 14 nt, Human
gacuggaagcacag

SEQ ID NO: 3745514 - RNA, 15 nt, Human
gacuggacagcuugu

SEQ ID NO: 3745515 - RNA, 21 nt, Human
gacuggacagcuuguggcaag

SEQ ID NO: 3745516 - RNA, 16 nt, Human
gacuggagacaaugca

SEQ ID NO: 3745517 - RNA, 15 nt, Human
gacuggaggccccug

SEQ ID NO: 3745518 - RNA, 16 nt, Human
gacuggaggccccugg

SEQ ID NO: 3745519 - RNA, 15 nt, Human
gacuggagucccugu

SEQ ID NO: 3745520 - RNA, 15 nt, Human
gacuggauacugccc

SEQ ID NO: 3745521 - RNA, 16 nt, Human
gacuggauaguccguc

SEQ ID NO: 3745522 - RNA, 17 nt, Human
gacuggauaguccgucu

SEQ ID NO: 3745523 - RNA, 18 nt, Human
gacuggcacaguuuucug

SEQ ID NO: 3745524 - RNA, 22 nt, Human
gacuggcacaguuuucugagaa

SEQ ID NO: 3745525 - RNA, 16 nt, Human
gacuggccccuggguc

SEQ ID NO: 3745526 - RNA, 18 nt, Human
gacuggcggggggcccau

SEQ ID NO: 3745527 - RNA, 17 nt, Human
gacuggcuagaguccuc

SEQ ID NO: 3745528 - RNA, 14 nt, Human
gacuggcuggcugc

SEQ ID NO: 3745529 - RNA, 21 nt, Human
gacuggcuuuuauuaaugcac

SEQ ID NO: 3745530 - RNA, 22 nt, Human
gacuggcuuuuauuaaugcacu

SEQ ID NO: 3745531 - RNA, 16 nt, Human
gacugggaacagaacu

SEQ ID NO: 3745532 - RNA, 22 nt, Human
gacugggaagauaggcucugca

SEQ ID NO: 3745533 - RNA, 16 nt, Human
gacugggaccaggcac

SEQ ID NO: 3745534 - RNA, 18 nt, Human
gacugggaccaggcacca

SEQ ID NO: 3745535 - RNA, 20 nt, Human
gacugggaccaggcaccagg

SEQ ID NO: 3745536 - RNA, 17 nt, Human
gacugggagcccccagc

SEQ ID NO: 3745537 - RNA, 16 nt, Human
gacugggcugagggag

SEQ ID NO: 3745538 - RNA, 21 nt, Human
gacugggcugagggagccugg

SEQ ID NO: 3745539 - RNA, 16 nt, Human
gacuggggauguggga

SEQ ID NO: 3745540 - RNA, 23 nt, Human
gacuggggaugugggagggagca

SEQ ID NO: 3745541 - RNA, 11 nt, Human
gacuggggcag

SEQ ID NO: 3745542 - RNA, 13 nt, Human
gacuggggcaggg

SEQ ID NO: 3745543 - RNA, 14 nt, Human
gacuggggggcuug

SEQ ID NO: 3745544 - RNA, 15 nt, Human
gacuggggugggagg

SEQ ID NO: 3745545 - RNA, 16 nt, Human
gacuggggugggaggu

SEQ ID NO: 3745546 - RNA, 16 nt, Human
gacuggguuuaugucc

SEQ ID NO: 3745547 - RNA, 21 nt, Human
gacuggguuuggaccccagcu

SEQ ID NO: 3745548 - RNA, 22 nt, Human
gacuggguuuggaccccagcug

SEQ ID NO: 3745549 - RNA, 18 nt, Human
gacuggugacugauucuu

SEQ ID NO: 3745550 - RNA, 17 nt, Human
gacuggugagcagacug

SEQ ID NO: 3745551 - RNA, 20 nt, Human
gacuggugcuauaggcugga

SEQ ID NO: 3745552 - RNA, 18 nt, Human
gacugguuuacaggcccu

SEQ ID NO: 3745553 - RNA, 14 nt, Human
gacugguuuucugc

SEQ ID NO: 3745554 - RNA, 15 nt, Human
gacugguuuucugcc

SEQ ID NO: 3745555 - RNA, 16 nt, Human
gacugguuuucugcca

SEQ ID NO: 3745556 - RNA, 22 nt, Human
gacuguacaaaguagaagucuu

SEQ ID NO: 3745557 - RNA, 16 nt, Human
gacuguacacacuuua

SEQ ID NO: 3745558 - RNA, 21 nt, Human
gacuguagauugcuucuguag

SEQ ID NO: 3745559 - RNA, 14 nt, Human
gacuguauauaaag

SEQ ID NO: 3745560 - RNA, 15 nt, Human
gacugucauagaaau

SEQ ID NO: 3745561 - RNA, 19 nt, Human
gacuguccucuccccucca

SEQ ID NO: 3745562 - RNA, 22 nt, Human
gacuguccucuccccuccagcc

SEQ ID NO: 3745563 - RNA, 19 nt, Human
gacugucucacuuaauccu

SEQ ID NO: 3745564 - RNA, 19 nt, Human
gacugucuggccccccugg

SEQ ID NO: 3745565 - RNA, 15 nt, Human
gacugugauucagaa

SEQ ID NO: 3745566 - RNA, 13 nt, Human
gacugugcuacug

SEQ ID NO: 3745567 - RNA, 16 nt, Human
gacuguggagacugcu

SEQ ID NO: 3745568 - RNA, 19 nt, Human
gacuguggagacugcuccu

SEQ ID NO: 3745569 - RNA, 21 nt, Human
gacuguggcacuugccugggu

SEQ ID NO: 3745570 - RNA, 12 nt, Human
gacuguggcugc

SEQ ID NO: 3745571 - RNA, 19 nt, Human
gacuguggguuuguggggg

SEQ ID NO: 3745572 - RNA, 13 nt, Human
gacugugugcuca

SEQ ID NO: 3745573 - RNA, 15 nt, Human
gacugugugugcccu

SEQ ID NO: 3745574 - RNA, 14 nt, Human
gacuguucaagagc

SEQ ID NO: 3745575 - RNA, 15 nt, Human
gucccuggggcuagg

SEQ ID NO: 3745576 - RNA, 21 nt, Human
gucccugggggaagcccugga

SEQ ID NO: 3745577 - RNA, 22 nt, Human
gucccugggggaagcccuggau

SEQ ID NO: 3745578 - RNA, 17 nt, Human
gucccugucaccucuuc

SEQ ID NO: 3745579 - RNA, 12 nt, Human
gucccuguuaga

SEQ ID NO: 3745580 - RNA, 19 nt, Human
gucccuguuuucugagccc

SEQ ID NO: 3745581 - RNA, 20 nt, Human
gucccuguuuucugagcccg

SEQ ID NO: 3745582 - RNA, 19 nt, Human
gucccuuacgugaguccug

SEQ ID NO: 3745583 - RNA, 18 nt, Human
gucccuucaccuccucgc

SEQ ID NO: 3745584 - RNA, 20 nt, Human
gucccuuccacacccccacc

SEQ ID NO: 3745585 - RNA, 13 nt, Human
gucccuuccccuc

SEQ ID NO: 3745586 - RNA, 14 nt, Human
gucccuuccccucc

SEQ ID NO: 3745587 - RNA, 17 nt, Human
gucccuuccccucccug

SEQ ID NO: 3745588 - RNA, 19 nt, Human
gucccuuccccucccuggc

SEQ ID NO: 3745589 - RNA, 16 nt, Human
gucccuugagaccuca

SEQ ID NO: 3745590 - RNA, 20 nt, Human
gucccuugagaccucagcca

SEQ ID NO: 3745591 - RNA, 19 nt, Human
gucccuugaugcacagaga

SEQ ID NO: 3745592 - RNA, 19 nt, Human
gucccuugccccccuggcc

SEQ ID NO: 3745593 - RNA, 16 nt, Human
gucccuugcuguaugc

SEQ ID NO: 3745594 - RNA, 23 nt, Human
gucccuuucgacuugcauuuuug

SEQ ID NO: 3745595 - RNA, 13 nt, Human
gucccuuuuccuu

SEQ ID NO: 3745596 - RNA, 22 nt, Human
guccgaaagggacuuggaagcu

SEQ ID NO: 3745597 - RNA, 20 nt, Human
guccgaccuggccugucugu

SEQ ID NO: 3745598 - RNA, 18 nt, Human
guccgcccugcuccuccc

SEQ ID NO: 3745599 - RNA, 21 nt, Human
guccgcccugcuccucccugg

SEQ ID NO: 3745600 - RNA, 19 nt, Human
guccggacccaccucaccc

SEQ ID NO: 3745601 - RNA, 18 nt, Human
guccggcagcuucugccc

SEQ ID NO: 3745602 - RNA, 21 nt, Human
guccggucccugucccagugc

SEQ ID NO: 3745603 - RNA, 15 nt, Human
guccgguguucuaag

SEQ ID NO: 3745604 - RNA, 17 nt, Human
guccgguguucuaagau

SEQ ID NO: 3745605 - RNA, 15 nt, Human
guccgguuuacuuua

SEQ ID NO: 3745606 - RNA, 15 nt, Human
guccgugcuaaggac

SEQ ID NO: 3745607 - RNA, 15 nt, Human
guccgugcugacagc

SEQ ID NO: 3745608 - RNA, 19 nt, Human
guccgugcugacagcugcu

SEQ ID NO: 3745609 - RNA, 21 nt, Human
guccgugcugacagcugcucc

SEQ ID NO: 3745610 - RNA, 22 nt, Human
guccgugcugacagcugcuccu

SEQ ID NO: 3745611 - RNA, 18 nt, Human
guccguggguugcuaacu

SEQ ID NO: 3745612 - RNA, 14 nt, Human
guccguuuacucca

SEQ ID NO: 3745613 - RNA, 15 nt, Human
guccuaaggaaccuu

SEQ ID NO: 3745614 - RNA, 18 nt, Human
guccuaagucccugcccc

SEQ ID NO: 3745615 - RNA, 20 nt, Human
guccuaauaauaucccacug

SEQ ID NO: 3745616 - RNA, 14 nt, Human
guccuacagaaaaa

SEQ ID NO: 3745617 - RNA, 15 nt, Human
guccuacccacccuc

SEQ ID NO: 3745618 - RNA, 14 nt, Human
guccuacccauccc

SEQ ID NO: 3745619 - RNA, 16 nt, Human
guccuacccauccccg

SEQ ID NO: 3745620 - RNA, 12 nt, Human
guccuacucugu

SEQ ID NO: 3745621 - RNA, 21 nt, Human
guccuacuuuacauaugcuuu

SEQ ID NO: 3745622 - RNA, 17 nt, Human
guccuagacuucaggga

SEQ ID NO: 3745623 - RNA, 20 nt, Human
guccuagaggcccuuugcug

SEQ ID NO: 3745624 - RNA, 21 nt, Human
guccuagcacagauggccagc

SEQ ID NO: 3745625 - RNA, 18 nt, Human
guccuagccacucaggag

SEQ ID NO: 3745626 - RNA, 19 nt, Human
guccuagccacucaggagg

SEQ ID NO: 3745627 - RNA, 12 nt, Human
guccuaggagua

SEQ ID NO: 3745628 - RNA, 14 nt, Human
guccuaggccucaa

SEQ ID NO: 3745629 - RNA, 14 nt, Human
guccuaguaagaag

SEQ ID NO: 3745630 - RNA, 18 nt, Human
guccuaucuaucuuccaa

SEQ ID NO: 3745631 - RNA, 20 nt, Human
guccuaucuccagcggcccu

SEQ ID NO: 3745632 - RNA, 18 nt, Human
guccuaucugggcuuccu

SEQ ID NO: 3745633 - RNA, 24 nt, Human
guccuaucugggcuuccuggagca

SEQ ID NO: 3745634 - RNA, 16 nt, Human
guccuaugaaugcuuu

SEQ ID NO: 3745635 - RNA, 14 nt, Human
guccuaugcaauaa

SEQ ID NO: 3745636 - RNA, 20 nt, Human
guccuauuaguguuauauga

SEQ ID NO: 3745637 - RNA, 19 nt, Human
guccuauuauauucauucu

SEQ ID NO: 3745638 - RNA, 21 nt, Human
guccuauuauauucauucuuu

SEQ ID NO: 3745639 - RNA, 20 nt, Human
guccucaaggggccauccug

SEQ ID NO: 3745640 - RNA, 18 nt, Human
guccucacaucuuucaca

SEQ ID NO: 3745641 - RNA, 17 nt, Human
guccucaccccuguccu

SEQ ID NO: 3745642 - RNA, 23 nt, Human
guccucaccccuguccucacugc

SEQ ID NO: 3745643 - RNA, 16 nt, Human
guccucacucccaguc

SEQ ID NO: 3745644 - RNA, 20 nt, Human
guccucagagaauuucuacc

SEQ ID NO: 3745645 - RNA, 13 nt, Human
guccucagccagu

SEQ ID NO: 3745646 - RNA, 14 nt, Human
guccucagccuugc

SEQ ID NO: 3745647 - RNA, 16 nt, Human
guccucagccuugcca

SEQ ID NO: 3745648 - RNA, 13 nt, Human
guccucagcuucu

SEQ ID NO: 3745649 - RNA, 22 nt, Human
guccucagggagcagggaaggc

SEQ ID NO: 3745650 - RNA, 14 nt, Human
guccucagguggcc

SEQ ID NO: 3745651 - RNA, 16 nt, Human
guccucagguggccau

SEQ ID NO: 3745652 - RNA, 17 nt, Human
guccucauucaaaggga

SEQ ID NO: 3745653 - RNA, 20 nt, Human
guccuccagaagccucuggc

SEQ ID NO: 3745654 - RNA, 22 nt, Human
guccuccaucccaacagccaug

SEQ ID NO: 3745655 - RNA, 15 nt, Human
guccucccagcuccu

SEQ ID NO: 3745656 - RNA, 20 nt, Human
guccucccauccccuggacu

SEQ ID NO: 3745657 - RNA, 12 nt, Human
guccucccaucu

SEQ ID NO: 3745658 - RNA, 23 nt, Human
guccucccaucucacacaugagc

SEQ ID NO: 3745659 - RNA, 16 nt, Human
guccucccccugccag

SEQ ID NO: 3745660 - RNA, 19 nt, Human
guccucccccugccagugc

SEQ ID NO: 3745661 - RNA, 20 nt, Human
guccucccccugccagugcc

SEQ ID NO: 3745662 - RNA, 21 nt, Human
guccuccccucacagccucug

SEQ ID NO: 3745663 - RNA, 21 nt, Human
guccucccgagcuccucuucc

SEQ ID NO: 3745664 - RNA, 12 nt, Human
guccucccgggc

SEQ ID NO: 3745665 - RNA, 15 nt, Human
guccucccgggcccu

SEQ ID NO: 3745666 - RNA, 20 nt, Human
guccucccucacccccuccu

SEQ ID NO: 3745667 - RNA, 15 nt, Human
guccucccugacuuu

SEQ ID NO: 3745668 - RNA, 18 nt, Human
guccuccgccuuaccagg

SEQ ID NO: 3745669 - RNA, 17 nt, Human
guccuccucaccucaug

SEQ ID NO: 3745670 - RNA, 13 nt, Human
guccuccuccagg

SEQ ID NO: 3745671 - RNA, 20 nt, Human
guccuccuccagggacagca

SEQ ID NO: 3745672 - RNA, 14 nt, Human
guccuccugcugcc

SEQ ID NO: 3745673 - RNA, 21 nt, Human
guccuccugguggguccaggg

SEQ ID NO: 3745674 - RNA, 13 nt, Human
guccucgauggga

SEQ ID NO: 3745675 - RNA, 20 nt, Human
guccucuccccuccagccuu

SEQ ID NO: 3745676 - RNA, 16 nt, Human
guccucucuggcuggg

SEQ ID NO: 3745677 - RNA, 17 nt, Human
guccucucuggcugggg

SEQ ID NO: 3745678 - RNA, 18 nt, Human
guccucucuggcugggga

SEQ ID NO: 3745679 - RNA, 15 nt, Human
guccucugagacucc

SEQ ID NO: 3745680 - RNA, 18 nt, Human
guccucuggagcccuaac

SEQ ID NO: 3745681 - RNA, 18 nt, Human
guccucuggauggcacca

SEQ ID NO: 3745682 - RNA, 17 nt, Human
guccucuugccuccugg

SEQ ID NO: 3745683 - RNA, 17 nt, Human
guccucuuuaguuuuug

SEQ ID NO: 3745684 - RNA, 19 nt, Human
guccucuuucagaaaacag

SEQ ID NO: 3745685 - RNA, 23 nt, Human
guccucuuucagaaaacagaaaa

SEQ ID NO: 3745686 - RNA, 14 nt, Human
guccucuuucagcu

SEQ ID NO: 3745687 - RNA, 17 nt, Human
guccucuuucagcuccu

SEQ ID NO: 3745688 - RNA, 17 nt, Human
guccugaagaggcgggc

SEQ ID NO: 3745689 - RNA, 22 nt, Human
guccugaagaggcgggccagcc

SEQ ID NO: 3745690 - RNA, 14 nt, Human
guccugaaggccug

SEQ ID NO: 3745691 - RNA, 14 nt, Human
guccugaccacccu

SEQ ID NO: 3745692 - RNA, 17 nt, Human
guccugaccacccuccc

SEQ ID NO: 3745693 - RNA, 19 nt, Human
guccugaccacccuccccu

SEQ ID NO: 3745694 - RNA, 16 nt, Human
guccugacggcgcccc

SEQ ID NO: 3745695 - RNA, 21 nt, Human
guccugacuucaggggcugcc

SEQ ID NO: 3745696 - RNA, 22 nt, Human
guccugagcacugccaggaggg

SEQ ID NO: 3745697 - RNA, 13 nt, Human
guccugagcucag

SEQ ID NO: 3745698 - RNA, 15 nt, Human
guccugagcucagcg

SEQ ID NO: 3745699 - RNA, 18 nt, Human
guccugaggguccccacc

SEQ ID NO: 3745700 - RNA, 17 nt, Human
guccugaucagagccgu

SEQ ID NO: 3745701 - RNA, 15 nt, Human
guccugaucugugau

SEQ ID NO: 3745702 - RNA, 17 nt, Human
guccugauggucagcuc

SEQ ID NO: 3745703 - RNA, 23 nt, Human
guccugauggucagcucccuucu

SEQ ID NO: 3745704 - RNA, 20 nt, Human
guccugcaccggggccuggg

SEQ ID NO: 3745705 - RNA, 20 nt, Human
guccugcagcaaacacucca

SEQ ID NO: 3745706 - RNA, 18 nt, Human
guccugcagccugcagga

SEQ ID NO: 3745707 - RNA, 18 nt, Human
guccugccaccuggggca

SEQ ID NO: 3745708 - RNA, 18 nt, Human
guccugccggagaggaag

SEQ ID NO: 3745709 - RNA, 19 nt, Human
guccugccuggccaggcag

SEQ ID NO: 3745710 - RNA, 14 nt, Human
guccugccugucug

SEQ ID NO: 3745711 - RNA, 23 nt, Human
guccugccugucugaagccaaug

SEQ ID NO: 3745712 - RNA, 15 nt, Human
guccugccugucugc

SEQ ID NO: 3745713 - RNA, 15 nt, Human
guccugccuguggcg

SEQ ID NO: 3745714 - RNA, 19 nt, Human
guccugcuccacaguguug

SEQ ID NO: 3745715 - RNA, 12 nt, Human
guccugcuccag

SEQ ID NO: 3745716 - RNA, 16 nt, Human
guccugcugcaguugc

SEQ ID NO: 3745717 - RNA, 17 nt, Human
guccuggcaugggaaug

SEQ ID NO: 3745718 - RNA, 20 nt, Human
guccuggccuggcuucuccu

SEQ ID NO: 3745719 - RNA, 19 nt, Human
guccugggagaaccucagg

SEQ ID NO: 3745720 - RNA, 15 nt, Human
guccugggaggagag

SEQ ID NO: 3745721 - RNA, 14 nt, Human
guccugggccugca

SEQ ID NO: 3745722 - RNA, 16 nt, Human
guccuggggcucugug

SEQ ID NO: 3745723 - RNA, 14 nt, Human
guccugggggccug

SEQ ID NO: 3745724 - RNA, 16 nt, Human
guccuggugcucucug

SEQ ID NO: 3745725 - RNA, 18 nt, Human
guccuggugcucucugcc

SEQ ID NO: 3745726 - RNA, 22 nt, Human
guccugguggggcagcuccucu

SEQ ID NO: 3745727 - RNA, 16 nt, Human
guccuggugucacuua

SEQ ID NO: 3745728 - RNA, 16 nt, Human
guccuguaaacacuca

SEQ ID NO: 3745729 - RNA, 21 nt, Human
guccuguaaacacucagcugu

SEQ ID NO: 3745730 - RNA, 15 nt, Human
guccuguacauugug

SEQ ID NO: 3745731 - RNA, 14 nt, Human
guccugucagugcc

SEQ ID NO: 3745732 - RNA, 16 nt, Human
guccugucagugccgc

SEQ ID NO: 3745733 - RNA, 18 nt, Human
guccuguccacacccagc

SEQ ID NO: 3745734 - RNA, 22 nt, Human
guccuguccacacccagcucag

SEQ ID NO: 3745735 - RNA, 17 nt, Human
guccuguggcaggcagc

SEQ ID NO: 3745736 - RNA, 22 nt, Human
guccugugucaguuuauguuuu

SEQ ID NO: 3745737 - RNA, 19 nt, Human
guccuuaaaaaucacacug

SEQ ID NO: 3745738 - RNA, 22 nt, Human
guccuuaaaaaucacacuguaa

SEQ ID NO: 3745739 - RNA, 20 nt, Human
guccuuaaugauccguucca

SEQ ID NO: 3745740 - RNA, 15 nt, Human
guccuuaccagcaga

SEQ ID NO: 3745741 - RNA, 16 nt, Human
guccuuaccagcagag

SEQ ID NO: 3745742 - RNA, 15 nt, Human
guccuuacuccugug

SEQ ID NO: 3745743 - RNA, 17 nt, Human
guccuuacuccuguggg

SEQ ID NO: 3745744 - RNA, 22 nt, Human
guccuuacuccugugggagccu

SEQ ID NO: 3745745 - RNA, 17 nt, Human
guccuuagaacauuuua

SEQ ID NO: 3745746 - RNA, 13 nt, Human
guccuuagccugg

SEQ ID NO: 3745747 - RNA, 19 nt, Human
guccuuagccuggaccucu

SEQ ID NO: 3745748 - RNA, 22 nt, Human
guccuucaaaauccuuccaaag

SEQ ID NO: 3745749 - RNA, 14 nt, Human
guccuuccaccucg

SEQ ID NO: 3745750 - RNA, 21 nt, Human
guccuucccucuccccaagac

SEQ ID NO: 3745751 - RNA, 19 nt, Human
guccuucucucaccuccua

SEQ ID NO: 3745752 - RNA, 14 nt, Human
guccuugaaaauau

SEQ ID NO: 3745753 - RNA, 16 nt, Human
guccuugaaugccaua

SEQ ID NO: 3745754 - RNA, 19 nt, Human
guccuugauuucaaaguuu

SEQ ID NO: 3745755 - RNA, 12 nt, Human
guccuugcacac

SEQ ID NO: 3745756 - RNA, 22 nt, Human
guccuugcacacuccccugcac

SEQ ID NO: 3745757 - RNA, 16 nt, Human
guccuugcaccccuca

SEQ ID NO: 3745758 - RNA, 16 nt, Human
guccuugcaccugcau

SEQ ID NO: 3745759 - RNA, 17 nt, Human
guccuuggaaguuucau

SEQ ID NO: 3745760 - RNA, 12 nt, Human
guccuuuagaaa

SEQ ID NO: 3745761 - RNA, 14 nt, Human
guccuuuaguaccu

SEQ ID NO: 3745762 - RNA, 22 nt, Human
guccuuuccaaggcuucuccaa

SEQ ID NO: 3745763 - RNA, 11 nt, Human
guccuuucccu

SEQ ID NO: 3745764 - RNA, 13 nt, Human
guccuuucccucc

SEQ ID NO: 3745765 - RNA, 14 nt, Human
guccuuucccucca

SEQ ID NO: 3745766 - RNA, 13 nt, Human
guccuuucuuccg

SEQ ID NO: 3745767 - RNA, 21 nt, Human
guccuuuggggcauagaucag

SEQ ID NO: 3745768 - RNA, 15 nt, Human
guccuuuugacacug

SEQ ID NO: 3745769 - RNA, 17 nt, Human
guccuuuugacacugcu

SEQ ID NO: 3745770 - RNA, 19 nt, Human
guccuuuugacacugcucu

SEQ ID NO: 3745771 - RNA, 15 nt, Human
guccuuuugucuucu

SEQ ID NO: 3745772 - RNA, 22 nt, Human
guccuuuugucuucucugucuc

SEQ ID NO: 3745773 - RNA, 16 nt, Human
gucgaaagcucuagaa

SEQ ID NO: 3745774 - RNA, 17 nt, Human
gucgaauuaauagcuuu

SEQ ID NO: 3745775 - RNA, 18 nt, Human
gucgacuucgggcuggcc

SEQ ID NO: 3745776 - RNA, 14 nt, Human
gucgaggacaggga

SEQ ID NO: 3745777 - RNA, 14 nt, Human
gucgaggggcucuc

SEQ ID NO: 3745778 - RNA, 13 nt, Human
gucgauuagacug

SEQ ID NO: 3745779 - RNA, 14 nt, Human
gucgauuagacugg

SEQ ID NO: 3745780 - RNA, 13 nt, Human
gucgccaggcuag

SEQ ID NO: 3745781 - RNA, 14 nt, Human
gucgcccuggacug

SEQ ID NO: 3745782 - RNA, 18 nt, Human
gucgcccuggacugugug

SEQ ID NO: 3745783 - RNA, 17 nt, Human
gucgcccuuugcugcau

SEQ ID NO: 3745784 - RNA, 22 nt, Human
gucgcccuuugcugcauggcag

SEQ ID NO: 3745785 - RNA, 18 nt, Human
gucgccuuagcauguuug

SEQ ID NO: 3745786 - RNA, 20 nt, Human
gucgccuuagcauguuugcu

SEQ ID NO: 3745787 - RNA, 21 nt, Human
gucgcucaugugugcaacagg

SEQ ID NO: 3745788 - RNA, 17 nt, Human
gucgcugugccacaggc

SEQ ID NO: 3745789 - RNA, 21 nt, Human
gucggaaaacaugcuacacac

SEQ ID NO: 3745790 - RNA, 16 nt, Human
gucggagcccugucuc

SEQ ID NO: 3745791 - RNA, 23 nt, Human
gucggccucuaaccccaggcccc

SEQ ID NO: 3745792 - RNA, 16 nt, Human
gucgggcagcugcagg

SEQ ID NO: 3745793 - RNA, 16 nt, Human
gucgggcaugacacga

SEQ ID NO: 3745794 - RNA, 16 nt, Human
gucgggggcuggccua

SEQ ID NO: 3745795 - RNA, 17 nt, Human
gucgguccuggugcccu

SEQ ID NO: 3745796 - RNA, 14 nt, Human
gucggucugugccc

SEQ ID NO: 3745797 - RNA, 15 nt, Human
gucguaguuacucuc

SEQ ID NO: 3745798 - RNA, 17 nt, Human
gucgugagcucuuguga

SEQ ID NO: 3745799 - RNA, 14 nt, Human
gucgugccuguguc

SEQ ID NO: 3745800 - RNA, 17 nt, Human
gucgugccuguguccau

SEQ ID NO: 3745801 - RNA, 18 nt, Human
gucguggagagcuaggag

SEQ ID NO: 3745802 - RNA, 20 nt, Human
gucguggagagcuaggagca

SEQ ID NO: 3745803 - RNA, 22 nt, Human
gucguggcagauaaucagccuc

SEQ ID NO: 3745804 - RNA, 17 nt, Human
gucguggggugugcugg

SEQ ID NO: 3745805 - RNA, 23 nt, Human
gucguuaaaaacagauuuggaaa

SEQ ID NO: 3745806 - RNA, 15 nt, Human
gucguucccagugug

SEQ ID NO: 3745807 - RNA, 13 nt, Human
gucguugugaggg

SEQ ID NO: 3745808 - RNA, 12 nt, Human
gucguuuuccaa

SEQ ID NO: 3745809 - RNA, 12 nt, Human
gucuaaaaacac

SEQ ID NO: 3745810 - RNA, 14 nt, Human
gucuaaaaauaaaa

SEQ ID NO: 3745811 - RNA, 11 nt, Human
gucuaaaacuc

SEQ ID NO: 3745812 - RNA, 14 nt, Human
gucuaaagagcuuu

SEQ ID NO: 3745813 - RNA, 20 nt, Human
gucuaaagauggaguuucua

SEQ ID NO: 3745814 - RNA, 23 nt, Human
gucuaaagauggaguuucuaagg

SEQ ID NO: 3745815 - RNA, 21 nt, Human
gucuaaagcugguuuaauguu

SEQ ID NO: 3745816 - RNA, 23 nt, Human
gucuaaauauuuccuuaaacugu

SEQ ID NO: 3745817 - RNA, 15 nt, Human
gucuaaauuuauuau

SEQ ID NO: 3745818 - RNA, 17 nt, Human
gucuaaccaaaugcauc

SEQ ID NO: 3745819 - RNA, 22 nt, Human
gucuaaccacagcuccuuuucc

SEQ ID NO: 3745820 - RNA, 21 nt, Human
gucuaagauaguaacaaugaa

SEQ ID NO: 3745821 - RNA, 23 nt, Human
gucuaagauaguaacaaugaaga

SEQ ID NO: 3745822 - RNA, 16 nt, Human
gucuaagauucuagau

SEQ ID NO: 3745823 - RNA, 22 nt, Human
gucuaauuaaaacacuuucaaa

SEQ ID NO: 3745824 - RNA, 15 nt, Human
gucuacaaauauaag

SEQ ID NO: 3745825 - RNA, 20 nt, Human
gucuacaaauauaagauuuu

SEQ ID NO: 3745826 - RNA, 17 nt, Human
gucuacacacccugcau

SEQ ID NO: 3745827 - RNA, 16 nt, Human
gucuacacugcaauca

SEQ ID NO: 3745828 - RNA, 22 nt, Human
gucuacacugcaaucauaugug

SEQ ID NO: 3745829 - RNA, 21 nt, Human
gucuacagcucccccagcucc

SEQ ID NO: 3745830 - RNA, 12 nt, Human
gucuacauuuca

SEQ ID NO: 3745831 - RNA, 17 nt, Human
gucuacccagagaagcc

SEQ ID NO: 3745832 - RNA, 21 nt, Human
gucuacccagagaagccccuu

SEQ ID NO: 3745833 - RNA, 22 nt, Human
gucuacccugggauucaggaaa

SEQ ID NO: 3745834 - RNA, 20 nt, Human
gucuacucauuccccggggc

SEQ ID NO: 3745835 - RNA, 17 nt, Human
gucuacucuuaagccau

SEQ ID NO: 3745836 - RNA, 19 nt, Human
gucuacucuuaagccaucu

SEQ ID NO: 3745837 - RNA, 15 nt, Human
gucuacuugcucagg

SEQ ID NO: 3745838 - RNA, 21 nt, Human
gucuagauggcuccucucagu

SEQ ID NO: 3745839 - RNA, 21 nt, Human
gucuagauucaaagguucuag

SEQ ID NO: 3745840 - RNA, 12 nt, Human
gucuagauucuc

SEQ ID NO: 3745841 - RNA, 14 nt, Human
gucuagcaugccaa

SEQ ID NO: 3745842 - RNA, 23 nt, Human
gucuagccuauguggauuuuuuc

SEQ ID NO: 3745843 - RNA, 22 nt, Human
gucuagucacgcaugcaguguu

SEQ ID NO: 3745844 - RNA, 19 nt, Human
gucuaguuaacauuucaag

SEQ ID NO: 3745845 - RNA, 20 nt, Human
gucuauaaucccagcacuuu

SEQ ID NO: 3745846 - RNA, 22 nt, Human
gucuaugggacucaaugcacug

SEQ ID NO: 3745847 - RNA, 15 nt, Human
gucuauguuccgaau

SEQ ID NO: 3745848 - RNA, 13 nt, Human
gucuauucagcuu

SEQ ID NO: 3745849 - RNA, 13 nt, Human
gucuauucuaguc

SEQ ID NO: 3745850 - RNA, 12 nt, Human
gucuauuuaagc

SEQ ID NO: 3745851 - RNA, 16 nt, Human
gucuauuuaagccuca

SEQ ID NO: 3745852 - RNA, 20 nt, Human
gucuauuuacggaacucaaa

SEQ ID NO: 3745853 - RNA, 20 nt, Human
gucuauuucaucagaacagc

SEQ ID NO: 3745854 - RNA, 17 nt, Human
gucuauuucugcugaau

SEQ ID NO: 3745855 - RNA, 20 nt, Human
gucuauuuggauuauucuuu

SEQ ID NO: 3745856 - RNA, 16 nt, Human
gucuauuuuugucuua

SEQ ID NO: 3745857 - RNA, 17 nt, Human
gucucaaaaaaagaaaa

SEQ ID NO: 3745858 - RNA, 13 nt, Human
gucucaaacaagg

SEQ ID NO: 3745859 - RNA, 20 nt, Human
gucucaaaccuccaaaagcc

SEQ ID NO: 3745860 - RNA, 22 nt, Human
gucucaaacuccugaccucagg

SEQ ID NO: 3745861 - RNA, 20 nt, Human
gucucaaacuccugggcuca

SEQ ID NO: 3745862 - RNA, 22 nt, Human
gucucaaacucuugaccucagg

SEQ ID NO: 3745863 - RNA, 21 nt, Human
gucucaacccuuuugucugcc

SEQ ID NO: 3745864 - RNA, 23 nt, Human
gucucaacugcucuuuuauacug

SEQ ID NO: 3745865 - RNA, 17 nt, Human
gucucaagagggcacug

SEQ ID NO: 3745866 - RNA, 20 nt, Human
gucucaagagggcacuggug

SEQ ID NO: 3745867 - RNA, 19 nt, Human
gucucaagggcuagcaucc

SEQ ID NO: 3745868 - RNA, 15 nt, Human
gucucaaugaaauag

SEQ ID NO: 3745869 - RNA, 15 nt, Human
gucucaccauuuccc

SEQ ID NO: 3745870 - RNA, 18 nt, Human
gucucaccauuuccccag

SEQ ID NO: 3745871 - RNA, 13 nt, Human
gucucacccaugc

SEQ ID NO: 3745872 - RNA, 20 nt, Human
gucucacccuggaggcaccu

SEQ ID NO: 3745873 - RNA, 21 nt, Human
guagaugugcauuuuugugaa

SEQ ID NO: 3745874 - RNA, 16 nt, Human
guagauguucuacuuu

SEQ ID NO: 3745875 - RNA, 16 nt, Human
guagauucuguggaac

SEQ ID NO: 3745876 - RNA, 13 nt, Human
guagauugcagaa

SEQ ID NO: 3745877 - RNA, 19 nt, Human
guagauuuauuucaucaua

SEQ ID NO: 3745878 - RNA, 19 nt, Human
guagcagggucgggaaagg

SEQ ID NO: 3745879 - RNA, 17 nt, Human
guagcagguaccacuga

SEQ ID NO: 3745880 - RNA, 18 nt, Human
guagcagguaccacugau

SEQ ID NO: 3745881 - RNA, 22 nt, Human
guagcagugagucauaucuuaa

SEQ ID NO: 3745882 - RNA, 13 nt, Human
guagcauacauuu

SEQ ID NO: 3745883 - RNA, 16 nt, Human
guagcauccuggaaua

SEQ ID NO: 3745884 - RNA, 16 nt, Human
guagcaucuucuggag

SEQ ID NO: 3745885 - RNA, 14 nt, Human
guagcauuuacugu

SEQ ID NO: 3745886 - RNA, 21 nt, Human
guagcauuuguguugaagagg

SEQ ID NO: 3745887 - RNA, 15 nt, Human
guagcauuuuaaaca

SEQ ID NO: 3745888 - RNA, 18 nt, Human
guagccaaggugggcuga

SEQ ID NO: 3745889 - RNA, 18 nt, Human
guagccagcacacagggc

SEQ ID NO: 3745890 - RNA, 21 nt, Human
guagccagcacacagggcagu

SEQ ID NO: 3745891 - RNA, 11 nt, Human
guagccagccg

SEQ ID NO: 3745892 - RNA, 23 nt, Human
guagccagggggacuagccccug

SEQ ID NO: 3745893 - RNA, 20 nt, Human
guagccauguuaacaugaca

SEQ ID NO: 3745894 - RNA, 21 nt, Human
guagccccaagaaggcugggg

SEQ ID NO: 3745895 - RNA, 16 nt, Human
guagccccagugacag

SEQ ID NO: 3745896 - RNA, 19 nt, Human
guagcccccucuucccugg

SEQ ID NO: 3745897 - RNA, 16 nt, Human
guagcccccuggccuc

SEQ ID NO: 3745898 - RNA, 23 nt, Human
guagcccccuggccucugugccu

SEQ ID NO: 3745899 - RNA, 16 nt, Human
guagcccgccugccag

SEQ ID NO: 3745900 - RNA, 15 nt, Human
guagcccucccacuu

SEQ ID NO: 3745901 - RNA, 16 nt, Human
guagccuauguugugg

SEQ ID NO: 3745902 - RNA, 20 nt, Human
guagccuauuuuuuuagauu

SEQ ID NO: 3745903 - RNA, 21 nt, Human
guagccucaaucgagugagac

SEQ ID NO: 3745904 - RNA, 22 nt, Human
guagccucaaucgagugagaca

SEQ ID NO: 3745905 - RNA, 21 nt, Human
guagccucuccuguauuuaac

SEQ ID NO: 3745906 - RNA, 12 nt, Human
guagccugcugg

SEQ ID NO: 3745907 - RNA, 15 nt, Human
guagccuugcccgga

SEQ ID NO: 3745908 - RNA, 16 nt, Human
guagccuuuugacuuu

SEQ ID NO: 3745909 - RNA, 18 nt, Human
guagccuuuuuguauaaa

SEQ ID NO: 3745910 - RNA, 18 nt, Human
guagcggaugauucuuca

SEQ ID NO: 3745911 - RNA, 18 nt, Human
guagcgucuuucuuuuuu

SEQ ID NO: 3745912 - RNA, 17 nt, Human
guagcguuuuuuaaaug

SEQ ID NO: 3745913 - RNA, 22 nt, Human
guagcguuuuuuaaauguauac

SEQ ID NO: 3745914 - RNA, 16 nt, Human
guagcuacagagaaac

SEQ ID NO: 3745915 - RNA, 23 nt, Human
guagcuacagagaaaccagcuuc

SEQ ID NO: 3745916 - RNA, 15 nt, Human
guagcuagaggaacc

SEQ ID NO: 3745917 - RNA, 16 nt, Human
guagcuauaucuauau

SEQ ID NO: 3745918 - RNA, 14 nt, Human
guagcucagguggg

SEQ ID NO: 3745919 - RNA, 23 nt, Human
guagcuccucaacucaccuaaug

SEQ ID NO: 3745920 - RNA, 20 nt, Human
guagcucuuugucagggagu

SEQ ID NO: 3745921 - RNA, 21 nt, Human
guagcucuuugucagggagug

SEQ ID NO: 3745922 - RNA, 12 nt, Human
guagcugagcuc

SEQ ID NO: 3745923 - RNA, 21 nt, Human
guagcugagcucacaaggcag

SEQ ID NO: 3745924 - RNA, 22 nt, Human
guagcugagcucacaaggcagc

SEQ ID NO: 3745925 - RNA, 12 nt, Human
guagcugccccu

SEQ ID NO: 3745926 - RNA, 17 nt, Human
guagcugggacuacagg

SEQ ID NO: 3745927 - RNA, 18 nt, Human
guagcugggacuacaggc

SEQ ID NO: 3745928 - RNA, 17 nt, Human
guagcugggauuuuaaa

SEQ ID NO: 3745929 - RNA, 16 nt, Human
guagcuguaaaacgcu

SEQ ID NO: 3745930 - RNA, 20 nt, Human
guagcuguaaggcaugaagg

SEQ ID NO: 3745931 - RNA, 16 nt, Human
guagcugugaccugcu

SEQ ID NO: 3745932 - RNA, 15 nt, Human
guagcuuaagaaaaa

SEQ ID NO: 3745933 - RNA, 17 nt, Human
guagcuuaccagaagcu

SEQ ID NO: 3745934 - RNA, 17 nt, Human
guagcuuaccugacaca

SEQ ID NO: 3745935 - RNA, 19 nt, Human
guagcuuaccugacacaag

SEQ ID NO: 3745936 - RNA, 11 nt, Human
guagcuucuga

SEQ ID NO: 3745937 - RNA, 19 nt, Human
guagcuucugaccucagca

SEQ ID NO: 3745938 - RNA, 17 nt, Human
guagcuuucccaaauaa

SEQ ID NO: 3745939 - RNA, 13 nt, Human
guagcuuugcacu

SEQ ID NO: 3745940 - RNA, 15 nt, Human
guaggaaaaaaauag

SEQ ID NO: 3745941 - RNA, 16 nt, Human
guaggaaagaggaagc

SEQ ID NO: 3745942 - RNA, 15 nt, Human
guaggaagacuuugg

SEQ ID NO: 3745943 - RNA, 19 nt, Human
guaggaagguacuguauga

SEQ ID NO: 3745944 - RNA, 16 nt, Human
guaggaauauuauauu

SEQ ID NO: 3745945 - RNA, 18 nt, Human
guaggaauauuauauuug

SEQ ID NO: 3745946 - RNA, 20 nt, Human
guaggaauauuauauuugga

SEQ ID NO: 3745947 - RNA, 18 nt, Human
guaggacccaagcagaga

SEQ ID NO: 3745948 - RNA, 15 nt, Human
guaggacuccuuauu

SEQ ID NO: 3745949 - RNA, 14 nt, Human
guaggagcugccuu

SEQ ID NO: 3745950 - RNA, 16 nt, Human
guaggagggugggaag

SEQ ID NO: 3745951 - RNA, 20 nt, Human
guaggauauuuugucaccag

SEQ ID NO: 3745952 - RNA, 13 nt, Human
guaggcagacaca

SEQ ID NO: 3745953 - RNA, 14 nt, Human
guaggcagagccuu

SEQ ID NO: 3745954 - RNA, 13 nt, Human
guaggcaggauug

SEQ ID NO: 3745955 - RNA, 20 nt, Human
guaggcaugagggaucacag

SEQ ID NO: 3745956 - RNA, 22 nt, Human
guaggcaugagggaucacaggg

SEQ ID NO: 3745957 - RNA, 18 nt, Human
guaggccaagguguccua

SEQ ID NO: 3745958 - RNA, 15 nt, Human
guaggccucagguga

SEQ ID NO: 3745959 - RNA, 18 nt, Human
guaggccuuuuaacauuu

SEQ ID NO: 3745960 - RNA, 17 nt, Human
guaggcuacagagaagc

SEQ ID NO: 3745961 - RNA, 17 nt, Human
guaggcucaacuaggga

SEQ ID NO: 3745962 - RNA, 17 nt, Human
guaggcuuuacuuagcu

SEQ ID NO: 3745963 - RNA, 15 nt, Human
guagggaacucuggg

SEQ ID NO: 3745964 - RNA, 13 nt, Human
guagggaauaaaa

SEQ ID NO: 3745965 - RNA, 14 nt, Human
guagggaggcagcc

SEQ ID NO: 3745966 - RNA, 23 nt, Human
guagggcgggaggauguucuggg

SEQ ID NO: 3745967 - RNA, 22 nt, Human
guaggggcuuauaauaaaggac

SEQ ID NO: 3745968 - RNA, 17 nt, Human
guagggggcuggaggag

SEQ ID NO: 3745969 - RNA, 22 nt, Human
guaggguaauuaguaacaugug

SEQ ID NO: 3745970 - RNA, 14 nt, Human
guagggugggccuu

SEQ ID NO: 3745971 - RNA, 12 nt, Human
guaggguuucua

SEQ ID NO: 3745972 - RNA, 18 nt, Human
guagguaaaauguauuuu

SEQ ID NO: 3745973 - RNA, 15 nt, Human
guaggugauuugaag

SEQ ID NO: 3745974 - RNA, 23 nt, Human
guagguggaagcuagacacauga

SEQ ID NO: 3745975 - RNA, 17 nt, Human
guagguucagccaaggu

SEQ ID NO: 3745976 - RNA, 18 nt, Human
guagguugcacacuuugg

SEQ ID NO: 3745977 - RNA, 17 nt, Human
guaguaaauaaugcuuu

SEQ ID NO: 3745978 - RNA, 21 nt, Human
guaguaaauaaugcuuugaaa

SEQ ID NO: 3745979 - RNA, 14 nt, Human
guaguaacacuaau

SEQ ID NO: 3745980 - RNA, 16 nt, Human
guaguaccaaaugcuu

SEQ ID NO: 3745981 - RNA, 19 nt, Human
guaguaccaaaugcuuuaa

SEQ ID NO: 3745982 - RNA, 20 nt, Human
guaguagcccuuucugugug

SEQ ID NO: 3745983 - RNA, 16 nt, Human
guaguaggcauuuuua

SEQ ID NO: 3745984 - RNA, 17 nt, Human
guagucauuuacuaaac

SEQ ID NO: 3745985 - RNA, 12 nt, Human
guagucccagcc

SEQ ID NO: 3745986 - RNA, 12 nt, Human
guagucccagcu

SEQ ID NO: 3745987 - RNA, 22 nt, Human
guaguccgugcugacagcugcu

SEQ ID NO: 3745988 - RNA, 21 nt, Human
guaguccuuggcauagacaug

SEQ ID NO: 3745989 - RNA, 14 nt, Human
guagucuaaccaaa

SEQ ID NO: 3745990 - RNA, 12 nt, Human
guagucuugaug

SEQ ID NO: 3745991 - RNA, 13 nt, Human
guagugagcagug

SEQ ID NO: 3745992 - RNA, 19 nt, Human
guagugauuuuuaugccac

SEQ ID NO: 3745993 - RNA, 20 nt, Human
guagugccgcucuuggggac

SEQ ID NO: 3745994 - RNA, 23 nt, Human
guagugcuacaggguccaacaua

SEQ ID NO: 3745995 - RNA, 13 nt, Human
guagugcuuugag

SEQ ID NO: 3745996 - RNA, 18 nt, Human
guaguggggaagaggguu

SEQ ID NO: 3745997 - RNA, 19 nt, Human
guaguguaagcuagaagaa

SEQ ID NO: 3745998 - RNA, 19 nt, Human
guaguguccauuuugugaa

SEQ ID NO: 3745999 - RNA, 23 nt, Human
guaguguccauuuugugaagccc

SEQ ID NO: 3746000 - RNA, 19 nt, Human
guagugucuggaucaguaa

SEQ ID NO: 3746001 - RNA, 15 nt, Human
guaguguuggagaag

SEQ ID NO: 3746002 - RNA, 13 nt, Human
guaguuaauuuau

SEQ ID NO: 3746003 - RNA, 14 nt, Human
guaguuaggaaaua

SEQ ID NO: 3746004 - RNA, 17 nt, Human
guaguuauauaauuguu

SEQ ID NO: 3746005 - RNA, 12 nt, Human
guaguuaucaug

SEQ ID NO: 3746006 - RNA, 13 nt, Human
guaguuaucaugu

SEQ ID NO: 3746007 - RNA, 14 nt, Human
guaguuaucauguu

SEQ ID NO: 3746008 - RNA, 15 nt, Human
guaguucaagaaaug

SEQ ID NO: 3746009 - RNA, 20 nt, Human
guaguucaagaaaugaagag

SEQ ID NO: 3746010 - RNA, 22 nt, Human
guaguuccacuuauagccucug

SEQ ID NO: 3746011 - RNA, 16 nt, Human
guaguucuaccggcuu

SEQ ID NO: 3746012 - RNA, 20 nt, Human
guaguucuguauuugaaagu

SEQ ID NO: 3746013 - RNA, 14 nt, Human
guaguugaauauug

SEQ ID NO: 3746014 - RNA, 12 nt, Human
guaguugaaugg

SEQ ID NO: 3746015 - RNA, 20 nt, Human
guaguuuuuauauguuguaa

SEQ ID NO: 3746016 - RNA, 17 nt, Human
guaguuuuucuucaaca

SEQ ID NO: 3746017 - RNA, 15 nt, Human
guaguuuuuucaucu

SEQ ID NO: 3746018 - RNA, 12 nt, Human
guauaaaaacaa

SEQ ID NO: 3746019 - RNA, 16 nt, Human
guauaaaaauaaaaaa

SEQ ID NO: 3746020 - RNA, 11 nt, Human
guauaaaagau

SEQ ID NO: 3746021 - RNA, 14 nt, Human
guauaaaauacaua

SEQ ID NO: 3746022 - RNA, 18 nt, Human
guauaaaauacauaguga

SEQ ID NO: 3746023 - RNA, 20 nt, Human
guauaaaauacauagugaaa

SEQ ID NO: 3746024 - RNA, 23 nt, Human
gacuguucaagagcacacuuggc

SEQ ID NO: 3746025 - RNA, 11 nt, Human
gacuguugaug

SEQ ID NO: 3746026 - RNA, 14 nt, Human
gacuguuguuaucu

SEQ ID NO: 3746027 - RNA, 21 nt, Human
gacuguuguuaucuguuugag

SEQ ID NO: 3746028 - RNA, 21 nt, Human
gacuguuuucucucggcuccc

SEQ ID NO: 3746029 - RNA, 13 nt, Human
gacuguuuuuacc

SEQ ID NO: 3746030 - RNA, 21 nt, Human
gacuguuuuuuccugagcuug

SEQ ID NO: 3746031 - RNA, 16 nt, Human
gacuuaaaaaaaccau

SEQ ID NO: 3746032 - RNA, 13 nt, Human
gacuuaaagcaga

SEQ ID NO: 3746033 - RNA, 22 nt, Human
gacuuaagcaucuggcucuaau

SEQ ID NO: 3746034 - RNA, 14 nt, Human
gacuuaaugugauu

SEQ ID NO: 3746035 - RNA, 15 nt, Human
gacuuaaugugauua

SEQ ID NO: 3746036 - RNA, 18 nt, Human
gacuuacaugauucauuu

SEQ ID NO: 3746037 - RNA, 14 nt, Human
gacuuacucuaaga

SEQ ID NO: 3746038 - RNA, 16 nt, Human
gacuuacuguacauga

SEQ ID NO: 3746039 - RNA, 21 nt, Human
gacuuagaaaaccagcucagc

SEQ ID NO: 3746040 - RNA, 23 nt, Human
gacuuagaaaaccagcucagcac

SEQ ID NO: 3746041 - RNA, 18 nt, Human
gacuuagaaagcaggggc

SEQ ID NO: 3746042 - RNA, 19 nt, Human
gacuuagaaagcaggggcu

SEQ ID NO: 3746043 - RNA, 15 nt, Human
gacuuagcugggaga

SEQ ID NO: 3746044 - RNA, 15 nt, Human
gacuuauaguacaug

SEQ ID NO: 3746045 - RNA, 18 nt, Human
gacuuauaguacaugaua

SEQ ID NO: 3746046 - RNA, 23 nt, Human
gacuuauuguggauaacaaagau

SEQ ID NO: 3746047 - RNA, 17 nt, Human
gacuuauuucuucaaau

SEQ ID NO: 3746048 - RNA, 17 nt, Human
gacuucaaaauauugag

SEQ ID NO: 3746049 - RNA, 19 nt, Human
gacuucaaaauauugagca

SEQ ID NO: 3746050 - RNA, 13 nt, Human
gacuucacacugc

SEQ ID NO: 3746051 - RNA, 22 nt, Human
gacuucacgaaguguugcaugg

SEQ ID NO: 3746052 - RNA, 18 nt, Human
gacuucaggggcugcccg

SEQ ID NO: 3746053 - RNA, 19 nt, Human
gacuucaguauguugucaa

SEQ ID NO: 3746054 - RNA, 21 nt, Human
gacuucaguauguugucaaag

SEQ ID NO: 3746055 - RNA, 12 nt, Human
gacuucaucccu

SEQ ID NO: 3746056 - RNA, 23 nt, Human
gacuucauugucccucuucacuc

SEQ ID NO: 3746057 - RNA, 16 nt, Human
gacuucauuuuuccua

SEQ ID NO: 3746058 - RNA, 15 nt, Human
gacuuccaaagaaug

SEQ ID NO: 3746059 - RNA, 12 nt, Human
gacuucccagcu

SEQ ID NO: 3746060 - RNA, 13 nt, Human
gacuucccagcua

SEQ ID NO: 3746061 - RNA, 18 nt, Human
gacuuccccaauaucuug

SEQ ID NO: 3746062 - RNA, 20 nt, Human
gacuuccccgcauuccaggc

SEQ ID NO: 3746063 - RNA, 19 nt, Human
gacuuccccggagggcugc

SEQ ID NO: 3746064 - RNA, 20 nt, Human
gacuuccccggagggcugcg

SEQ ID NO: 3746065 - RNA, 21 nt, Human
gacuuccugauugguuucucu

SEQ ID NO: 3746066 - RNA, 19 nt, Human
gacuuccuguccagcucca

SEQ ID NO: 3746067 - RNA, 14 nt, Human
gacuuccuugagac

SEQ ID NO: 3746068 - RNA, 17 nt, Human
gacuuccuugcucuccc

SEQ ID NO: 3746069 - RNA, 17 nt, Human
gacuucggaccgcuugu

SEQ ID NO: 3746070 - RNA, 19 nt, Human
gacuucuaauaucauucac

SEQ ID NO: 3746071 - RNA, 12 nt, Human
gacuucugagau

SEQ ID NO: 3746072 - RNA, 13 nt, Human
gacuucugccugg

SEQ ID NO: 3746073 - RNA, 14 nt, Human
gacuucugccugga

SEQ ID NO: 3746074 - RNA, 16 nt, Human
gacuucugccuggaga

SEQ ID NO: 3746075 - RNA, 18 nt, Human
gacuucuguuuucaaucu

SEQ ID NO: 3746076 - RNA, 20 nt, Human
gacuucuuuaauuuuggaau

SEQ ID NO: 3746077 - RNA, 16 nt, Human
gacuucuuuucacauu

SEQ ID NO: 3746078 - RNA, 17 nt, Human
gacuugaaagcauccau

SEQ ID NO: 3746079 - RNA, 17 nt, Human
gacuugaacuuuccugg

SEQ ID NO: 3746080 - RNA, 12 nt, Human
gacuugaaguug

SEQ ID NO: 3746081 - RNA, 13 nt, Human
gacuugaaguugu

SEQ ID NO: 3746082 - RNA, 21 nt, Human
gacuugaauuuucccacugca

SEQ ID NO: 3746083 - RNA, 16 nt, Human
gacuugacagaacacu

SEQ ID NO: 3746084 - RNA, 18 nt, Human
gacuugacagaacacugu

SEQ ID NO: 3746085 - RNA, 19 nt, Human
gacuugacuuuagucugca

SEQ ID NO: 3746086 - RNA, 17 nt, Human
gacuugcacagggauuc

SEQ ID NO: 3746087 - RNA, 13 nt, Human
gacuugcauuuuu

SEQ ID NO: 3746088 - RNA, 22 nt, Human
gacuugccuuccuaagccugug

SEQ ID NO: 3746089 - RNA, 19 nt, Human
gacuugcuguuuuguucug

SEQ ID NO: 3746090 - RNA, 20 nt, Human
gacuugcuguuuuguucugu

SEQ ID NO: 3746091 - RNA, 21 nt, Human
gacuuggaggguugguccucu

SEQ ID NO: 3746092 - RNA, 13 nt, Human
gacuuggccucuc

SEQ ID NO: 3746093 - RNA, 14 nt, Human
gacuuggccucucu

SEQ ID NO: 3746094 - RNA, 14 nt, Human
gacuugggcacccc

SEQ ID NO: 3746095 - RNA, 18 nt, Human
gacuugggcacccccagc

SEQ ID NO: 3746096 - RNA, 20 nt, Human
gacuugggcacccccagccu

SEQ ID NO: 3746097 - RNA, 23 nt, Human
gacuugggcacccccagccuggg

SEQ ID NO: 3746098 - RNA, 20 nt, Human
gacuuggggagauggaguuc

SEQ ID NO: 3746099 - RNA, 20 nt, Human
gacuugggucucauuuagaa

SEQ ID NO: 3746100 - RNA, 20 nt, Human
gacuugguugguaggguggg

SEQ ID NO: 3746101 - RNA, 18 nt, Human
gacuuguagcauauucuu

SEQ ID NO: 3746102 - RNA, 21 nt, Human
gacuuguauauucuauuuuac

SEQ ID NO: 3746103 - RNA, 18 nt, Human
gacuugucccgggacacc

SEQ ID NO: 3746104 - RNA, 17 nt, Human
gacuugugcacaggcag

SEQ ID NO: 3746105 - RNA, 19 nt, Human
gacuugugcacaggcagag

SEQ ID NO: 3746106 - RNA, 18 nt, Human
gacuugugucccaugauc

SEQ ID NO: 3746107 - RNA, 16 nt, Human
gacuugugucucugug

SEQ ID NO: 3746108 - RNA, 12 nt, Human
gacuugugucug

SEQ ID NO: 3746109 - RNA, 18 nt, Human
gacuuguuugucuuccau

SEQ ID NO: 3746110 - RNA, 22 nt, Human
gacuuguuugucuuccauucca

SEQ ID NO: 3746111 - RNA, 16 nt, Human
gacuuguuuuugcaca

SEQ ID NO: 3746112 - RNA, 18 nt, Human
gacuuguuuuugcacaug

SEQ ID NO: 3746113 - RNA, 14 nt, Human
gacuuuaacauaag

SEQ ID NO: 3746114 - RNA, 19 nt, Human
gacuuuagaaagcugacau

SEQ ID NO: 3746115 - RNA, 17 nt, Human
gacuuuagaaauaaaug

SEQ ID NO: 3746116 - RNA, 15 nt, Human
gacuuuagcuuucug

SEQ ID NO: 3746117 - RNA, 17 nt, Human
gacuuuagucugcaaaa

SEQ ID NO: 3746118 - RNA, 13 nt, Human
gacuuuauaagcc

SEQ ID NO: 3746119 - RNA, 21 nt, Human
gacuuucaaaauuaaaucugu

SEQ ID NO: 3746120 - RNA, 21 nt, Human
gacuuucaaaguggaugcaau

SEQ ID NO: 3746121 - RNA, 19 nt, Human
gacuuuccacccccucccu

SEQ ID NO: 3746122 - RNA, 12 nt, Human
gacuuuccccac

SEQ ID NO: 3746123 - RNA, 20 nt, Human
gacuuuccccaccagaugcu

SEQ ID NO: 3746124 - RNA, 23 nt, Human
gacuuucucagccucugaauaug

SEQ ID NO: 3746125 - RNA, 18 nt, Human
gacuuucucuaauaauaa

SEQ ID NO: 3746126 - RNA, 18 nt, Human
gacuuucuuuuuugauau

SEQ ID NO: 3746127 - RNA, 21 nt, Human
gacuuugcagccggcacaggg

SEQ ID NO: 3746128 - RNA, 19 nt, Human
gacuuuggcugcaugcgag

SEQ ID NO: 3746129 - RNA, 13 nt, Human
gacuuugugaucc

SEQ ID NO: 3746130 - RNA, 21 nt, Human
gacuuuuaaugucauuuguua

SEQ ID NO: 3746131 - RNA, 14 nt, Human
gacuuuucaaguau

SEQ ID NO: 3746132 - RNA, 14 nt, Human
gacuuuuccaaccc

SEQ ID NO: 3746133 - RNA, 19 nt, Human
gacuuuuccaacccucauc

SEQ ID NO: 3746134 - RNA, 17 nt, Human
gacuuuuccauguaucu

SEQ ID NO: 3746135 - RNA, 18 nt, Human
gacuuuucuguaauucag

SEQ ID NO: 3746136 - RNA, 21 nt, Human
gacuuuucuguccgagcuuug

SEQ ID NO: 3746137 - RNA, 21 nt, Human
gacuuuucuuuguggcuuccu

SEQ ID NO: 3746138 - RNA, 15 nt, Human
gacuuuuguacaucu

SEQ ID NO: 3746139 - RNA, 19 nt, Human
gacuuuuguacaucuggcu

SEQ ID NO: 3746140 - RNA, 23 nt, Human
gacuuuuguauagguagauguuc

SEQ ID NO: 3746141 - RNA, 12 nt, Human
gacuuuugugaa

SEQ ID NO: 3746142 - RNA, 22 nt, Human
gacuuuuuauggcacuaguauu

SEQ ID NO: 3746143 - RNA, 16 nt, Human
gacuuuuugcauuuaa

SEQ ID NO: 3746144 - RNA, 23 nt, Human
gacuuuuugguggauguaaauaa

SEQ ID NO: 3746145 - RNA, 10 nt, Human
gagaaaaaaa

SEQ ID NO: 3746146 - RNA, 11 nt, Human
gagaaaaacaa

SEQ ID NO: 3746147 - RNA, 14 nt, Human
gagaaaaagaaaug

SEQ ID NO: 3746148 - RNA, 21 nt, Human
gagaaaacgucuugcuuggga

SEQ ID NO: 3746149 - RNA, 16 nt, Human
gagaaaacuaaagaaa

SEQ ID NO: 3746150 - RNA, 16 nt, Human
gagaaaacuuauuuga

SEQ ID NO: 3746151 - RNA, 18 nt, Human
gagaaaacuuauuugagu

SEQ ID NO: 3746152 - RNA, 9 nt, Human
gagaaaaga

SEQ ID NO: 3746153 - RNA, 10 nt, Human
gagaaaagaa

SEQ ID NO: 3746154 - RNA, 11 nt, Human
gagaaaagaaa

SEQ ID NO: 3746155 - RNA, 13 nt, Human
gagaaaagaaaaa

SEQ ID NO: 3746156 - RNA, 20 nt, Human
gagaaaagaaaaaaaaagaa

SEQ ID NO: 3746157 - RNA, 13 nt, Human
gagaaaagacaug

SEQ ID NO: 3746158 - RNA, 13 nt, Human
gagaaaaggaaaa

SEQ ID NO: 3746159 - RNA, 12 nt, Human
gagaaaauaaaa

SEQ ID NO: 3746160 - RNA, 14 nt, Human
gagaaaauaaaaag

SEQ ID NO: 3746161 - RNA, 16 nt, Human
gagaaaauaaaaaguu

SEQ ID NO: 3746162 - RNA, 19 nt, Human
gagaaaauaaaaaguuaaa

SEQ ID NO: 3746163 - RNA, 16 nt, Human
gagaaaauauauguau

SEQ ID NO: 3746164 - RNA, 17 nt, Human
gagaaaauauauguauu

SEQ ID NO: 3746165 - RNA, 11 nt, Human
gagaaaaucau

SEQ ID NO: 3746166 - RNA, 16 nt, Human
gagaaaaucaucaaga

SEQ ID NO: 3746167 - RNA, 23 nt, Human
gagaaaaucaucaagaagggcug

SEQ ID NO: 3746168 - RNA, 13 nt, Human
gagaaaauugaau

SEQ ID NO: 3746169 - RNA, 15 nt, Human
gagaaaauugaauuu

SEQ ID NO: 3746170 - RNA, 19 nt, Human
gagaaacacugaaaagaag

SEQ ID NO: 3746171 - RNA, 23 nt, Human
ggagcugguuagaaaugcagaau

SEQ ID NO: 3746172 - RNA, 20 nt, Human
ggagcugugaguucucccug

SEQ ID NO: 3746173 - RNA, 21 nt, Human
ggagcuuagccaaugugggag

SEQ ID NO: 3746174 - RNA, 20 nt, Human
ggagcuucauggcagaaggc

SEQ ID NO: 3746175 - RNA, 19 nt, Human
ggagcuuccuguccuccca

SEQ ID NO: 3746176 - RNA, 20 nt, Human
ggagcuuucaaagaaggaau

SEQ ID NO: 3746177 - RNA, 20 nt, Human
ggagcuuugacucaggagcc

SEQ ID NO: 3746178 - RNA, 19 nt, Human
ggagcuuuguuuugggggu

SEQ ID NO: 3746179 - RNA, 23 nt, Human
ggagcuuuguuuugggggucagg

SEQ ID NO: 3746180 - RNA, 21 nt, Human
ggaggaaaaccaagccguggc

SEQ ID NO: 3746181 - RNA, 15 nt, Human
ggaggaaagggagga

SEQ ID NO: 3746182 - RNA, 19 nt, Human
ggaggaaccagagugcuga

SEQ ID NO: 3746183 - RNA, 12 nt, Human
ggaggaagagaa

SEQ ID NO: 3746184 - RNA, 17 nt, Human
ggaggaagcagaauaaa

SEQ ID NO: 3746185 - RNA, 19 nt, Human
ggaggaagcagaauaaagc

SEQ ID NO: 3746186 - RNA, 22 nt, Human
ggaggaagcagaauaaagcaau

SEQ ID NO: 3746187 - RNA, 11 nt, Human
ggaggaagccc

SEQ ID NO: 3746188 - RNA, 20 nt, Human
ggaggaaggaaacccagcuc

SEQ ID NO: 3746189 - RNA, 23 nt, Human
ggaggaaggaaacccagcucugg

SEQ ID NO: 3746190 - RNA, 13 nt, Human
ggaggaaggagag

SEQ ID NO: 3746191 - RNA, 11 nt, Human
ggaggaaggau

SEQ ID NO: 3746192 - RNA, 14 nt, Human
ggaggaaggcaaga

SEQ ID NO: 3746193 - RNA, 12 nt, Human
ggaggaauacug

SEQ ID NO: 3746194 - RNA, 19 nt, Human
ggaggaaucgaggaaccag

SEQ ID NO: 3746195 - RNA, 21 nt, Human
ggaggaaucgaggaaccagag

SEQ ID NO: 3746196 - RNA, 16 nt, Human
ggaggaaugcuggacu

SEQ ID NO: 3746197 - RNA, 21 nt, Human
ggaggaauuucugaguggcca

SEQ ID NO: 3746198 - RNA, 14 nt, Human
ggaggacaauucau

SEQ ID NO: 3746199 - RNA, 22 nt, Human
ggaggacaggcgggaggaggug

SEQ ID NO: 3746200 - RNA, 16 nt, Human
ggaggaccaaaaaaau

SEQ ID NO: 3746201 - RNA, 20 nt, Human
ggaggaccagggcagggcca

SEQ ID NO: 3746202 - RNA, 22 nt, Human
ggaggaccagggcuggggcagc

SEQ ID NO: 3746203 - RNA, 12 nt, Human
ggaggacccagg

SEQ ID NO: 3746204 - RNA, 16 nt, Human
ggaggacccaggacag

SEQ ID NO: 3746205 - RNA, 16 nt, Human
ggaggacccagggcuc

SEQ ID NO: 3746206 - RNA, 18 nt, Human
ggaggacccagggcucug

SEQ ID NO: 3746207 - RNA, 19 nt, Human
ggaggacccagggcucugu

SEQ ID NO: 3746208 - RNA, 17 nt, Human
ggaggaccugagccugc

SEQ ID NO: 3746209 - RNA, 19 nt, Human
ggaggaccugagccugccg

SEQ ID NO: 3746210 - RNA, 18 nt, Human
ggaggaccuggggcacag

SEQ ID NO: 3746211 - RNA, 19 nt, Human
ggaggaccuggggcacagu

SEQ ID NO: 3746212 - RNA, 20 nt, Human
ggaggacgcucucuggccuu

SEQ ID NO: 3746213 - RNA, 21 nt, Human
ggaggacgcucucuggccuuc

SEQ ID NO: 3746214 - RNA, 16 nt, Human
ggaggacuagaaccug

SEQ ID NO: 3746215 - RNA, 21 nt, Human
ggaggacuagaaccuggaggg

SEQ ID NO: 3746216 - RNA, 19 nt, Human
ggaggacuccaggcagcag

SEQ ID NO: 3746217 - RNA, 13 nt, Human
ggaggagagaaga

SEQ ID NO: 3746218 - RNA, 15 nt, Human
ggaggagcacaguuu

SEQ ID NO: 3746219 - RNA, 12 nt, Human
ggaggagcaggg

SEQ ID NO: 3746220 - RNA, 12 nt, Human
ggaggagcccag

SEQ ID NO: 3746221 - RNA, 15 nt, Human
ggaggagccuguccu

SEQ ID NO: 3746222 - RNA, 21 nt, Human
ggaggagccuguccugccugu

SEQ ID NO: 3746223 - RNA, 17 nt, Human
ggaggaggcagagaaga

SEQ ID NO: 3746224 - RNA, 12 nt, Human
ggaggagggaga

SEQ ID NO: 3746225 - RNA, 14 nt, Human
ggaggagggcaggc

SEQ ID NO: 3746226 - RNA, 20 nt, Human
ggaggagggcaggcaucggg

SEQ ID NO: 3746227 - RNA, 19 nt, Human
ggaggagggcggggggcac

SEQ ID NO: 3746228 - RNA, 19 nt, Human
ggaggagggucggugccuu

SEQ ID NO: 3746229 - RNA, 17 nt, Human
ggaggaggugccaacag

SEQ ID NO: 3746230 - RNA, 20 nt, Human
ggaggagguggcagcccugu

SEQ ID NO: 3746231 - RNA, 23 nt, Human
ggaggagguuuaggucaagaaga

SEQ ID NO: 3746232 - RNA, 15 nt, Human
ggaggagugagacag

SEQ ID NO: 3746233 - RNA, 16 nt, Human
ggaggaucacuggagc

SEQ ID NO: 3746234 - RNA, 17 nt, Human
ggaggaucacuggagcc

SEQ ID NO: 3746235 - RNA, 19 nt, Human
ggaggaucacuggagccca

SEQ ID NO: 3746236 - RNA, 21 nt, Human
ggaggaucacuggagcccagg

SEQ ID NO: 3746237 - RNA, 22 nt, Human
ggaggaucacuggagcccagga

SEQ ID NO: 3746238 - RNA, 17 nt, Human
ggaggaucucuugagcc

SEQ ID NO: 3746239 - RNA, 14 nt, Human
ggaggauggagaga

SEQ ID NO: 3746240 - RNA, 21 nt, Human
ggaggauggagagaggggaau

SEQ ID NO: 3746241 - RNA, 13 nt, Human
ggaggaugugaau

SEQ ID NO: 3746242 - RNA, 20 nt, Human
ggaggcaaagcuggcucacc

SEQ ID NO: 3746243 - RNA, 23 nt, Human
ggaggcaagagggguggagacug

SEQ ID NO: 3746244 - RNA, 20 nt, Human
ggaggcagagguuguaguga

SEQ ID NO: 3746245 - RNA, 12 nt, Human
ggaggcagaguu

SEQ ID NO: 3746246 - RNA, 14 nt, Human
ggaggcagcaggac

SEQ ID NO: 3746247 - RNA, 17 nt, Human
ggaggcagggaggcagc

SEQ ID NO: 3746248 - RNA, 18 nt, Human
ggaggcagggaggcagcc

SEQ ID NO: 3746249 - RNA, 18 nt, Human
ggaggcagggccuugccc

SEQ ID NO: 3746250 - RNA, 19 nt, Human
ggaggcagggccuugccca

SEQ ID NO: 3746251 - RNA, 17 nt, Human
ggaggcaggggcuuccu

SEQ ID NO: 3746252 - RNA, 21 nt, Human
ggaggcaggggcuuccuggug

SEQ ID NO: 3746253 - RNA, 14 nt, Human
ggaggcaucugcac

SEQ ID NO: 3746254 - RNA, 15 nt, Human
ggaggcauggcccug

SEQ ID NO: 3746255 - RNA, 23 nt, Human
ggaggccaagaguggccccaccu

SEQ ID NO: 3746256 - RNA, 12 nt, Human
ggaggccaccuc

SEQ ID NO: 3746257 - RNA, 18 nt, Human
ggaggccaccuccuaaaa

SEQ ID NO: 3746258 - RNA, 19 nt, Human
ggaggccaccucuccaagg

SEQ ID NO: 3746259 - RNA, 21 nt, Human
ggaggccaccucuccaagggc

SEQ ID NO: 3746260 - RNA, 13 nt, Human
ggaggccagccag

SEQ ID NO: 3746261 - RNA, 13 nt, Human
ggaggccagccuu

SEQ ID NO: 3746262 - RNA, 16 nt, Human
ggaggccagugagcca

SEQ ID NO: 3746263 - RNA, 17 nt, Human
ggaggccagugagccac

SEQ ID NO: 3746264 - RNA, 12 nt, Human
ggaggccaucug

SEQ ID NO: 3746265 - RNA, 13 nt, Human
ggaggccaucugg

SEQ ID NO: 3746266 - RNA, 21 nt, Human
ggaggcccagcgcggacaucc

SEQ ID NO: 3746267 - RNA, 14 nt, Human
ggaggcccaggcug

SEQ ID NO: 3746268 - RNA, 14 nt, Human
ggaggccccagggg

SEQ ID NO: 3746269 - RNA, 17 nt, Human
ggaggccccuggcccag

SEQ ID NO: 3746270 - RNA, 23 nt, Human
ggaggcccuccugugcuggggga

SEQ ID NO: 3746271 - RNA, 15 nt, Human
ggaggcccugugccc

SEQ ID NO: 3746272 - RNA, 13 nt, Human
ggaggccgaggcc

SEQ ID NO: 3746273 - RNA, 18 nt, Human
ggaggccgaggccaugug

SEQ ID NO: 3746274 - RNA, 13 nt, Human
ggaggccucuggg

SEQ ID NO: 3746275 - RNA, 20 nt, Human
ggaggccugcgacccugggg

SEQ ID NO: 3746276 - RNA, 18 nt, Human
ggaggccugggggcaggg

SEQ ID NO: 3746277 - RNA, 13 nt, Human
ggaggcgcccuug

SEQ ID NO: 3746278 - RNA, 22 nt, Human
ggaggcggacguuccagccggc

SEQ ID NO: 3746279 - RNA, 12 nt, Human
ggaggcggagag

SEQ ID NO: 3746280 - RNA, 20 nt, Human
ggaggcggagcuugcaguga

SEQ ID NO: 3746281 - RNA, 18 nt, Human
ggaggcgucucgggagag

SEQ ID NO: 3746282 - RNA, 16 nt, Human
ggaggcuccagagggc

SEQ ID NO: 3746283 - RNA, 22 nt, Human
ggaggcuccugccugagcuucc

SEQ ID NO: 3746284 - RNA, 21 nt, Human
ggaggcuccuguuagcuccuc

SEQ ID NO: 3746285 - RNA, 14 nt, Human
ggaggcugacuccu

SEQ ID NO: 3746286 - RNA, 18 nt, Human
ggaggcugagacaggaga

SEQ ID NO: 3746287 - RNA, 19 nt, Human
ggaggcugagacaggagaa

SEQ ID NO: 3746288 - RNA, 12 nt, Human
ggaggcugaggc

SEQ ID NO: 3746289 - RNA, 14 nt, Human
ggaggcugaggcag

SEQ ID NO: 3746290 - RNA, 15 nt, Human
ggaggcugaggcaga

SEQ ID NO: 3746291 - RNA, 12 nt, Human
ggaggcugcccc

SEQ ID NO: 3746292 - RNA, 21 nt, Human
ggaggcugcccccggcccccu

SEQ ID NO: 3746293 - RNA, 12 nt, Human
ggaggcuggagg

SEQ ID NO: 3746294 - RNA, 21 nt, Human
ggagggaagggagccaaggga

SEQ ID NO: 3746295 - RNA, 21 nt, Human
ggagggaaugaaccuggaggg

SEQ ID NO: 3746296 - RNA, 19 nt, Human
ggagggaauugaggucugc

SEQ ID NO: 3746297 - RNA, 21 nt, Human
ggagggacaaaggagccugug

SEQ ID NO: 3746298 - RNA, 13 nt, Human
ggagggacauggc

SEQ ID NO: 3746299 - RNA, 16 nt, Human
ggagggagcagacagg

SEQ ID NO: 3746300 - RNA, 13 nt, Human
ggagggagggcuc

SEQ ID NO: 3746301 - RNA, 22 nt, Human
ggagggauucugguuccagggu

SEQ ID NO: 3746302 - RNA, 20 nt, Human
ggagggauuggccgcuuggc

SEQ ID NO: 3746303 - RNA, 23 nt, Human
ggagggcaagggccaugcugaag

SEQ ID NO: 3746304 - RNA, 21 nt, Human
ggagggcacauuccuugccug

SEQ ID NO: 3746305 - RNA, 22 nt, Human
ggagggccugggccuggcuccc

SEQ ID NO: 3746306 - RNA, 17 nt, Human
ggagggcggcacagguc

SEQ ID NO: 3746307 - RNA, 20 nt, Human
ggagggcggcaggggccugg

SEQ ID NO: 3746308 - RNA, 16 nt, Human
ggagggcuagaaccug

SEQ ID NO: 3746309 - RNA, 22 nt, Human
ggagggcuagaaccuggagagc

SEQ ID NO: 3746310 - RNA, 19 nt, Human
ggagggcuagaacuggaga

SEQ ID NO: 3746311 - RNA, 22 nt, Human
ggagggcuagaaucuggagagc

SEQ ID NO: 3746312 - RNA, 15 nt, Human
gcuuuccaugggacc

SEQ ID NO: 3746313 - RNA, 16 nt, Human
gcuuuccauguugcug

SEQ ID NO: 3746314 - RNA, 19 nt, Human
gcuuuccauguugcugcca

SEQ ID NO: 3746315 - RNA, 21 nt, Human
gcuuuccauguugcugccaac

SEQ ID NO: 3746316 - RNA, 15 nt, Human
gcuuucccacuuccc

SEQ ID NO: 3746317 - RNA, 22 nt, Human
gcuuucccacuucccacccugc

SEQ ID NO: 3746318 - RNA, 22 nt, Human
gcuuuccccaugucucgacuca

SEQ ID NO: 3746319 - RNA, 16 nt, Human
gcuuuccccugugggg

SEQ ID NO: 3746320 - RNA, 15 nt, Human
gcuuucccugccucu

SEQ ID NO: 3746321 - RNA, 16 nt, Human
gcuuucccuuaucaaa

SEQ ID NO: 3746322 - RNA, 15 nt, Human
gcuuuccuaaaucag

SEQ ID NO: 3746323 - RNA, 17 nt, Human
gcuuuccuacuugcacu

SEQ ID NO: 3746324 - RNA, 11 nt, Human
gcuuuccugaa

SEQ ID NO: 3746325 - RNA, 11 nt, Human
gcuuuccugcc

SEQ ID NO: 3746326 - RNA, 14 nt, Human
gcuuuccugcccca

SEQ ID NO: 3746327 - RNA, 18 nt, Human
gcuuuccugugccaggug

SEQ ID NO: 3746328 - RNA, 17 nt, Human
gcuuuccuuuuuuaaaa

SEQ ID NO: 3746329 - RNA, 19 nt, Human
gcuuucguccacagcuucc

SEQ ID NO: 3746330 - RNA, 22 nt, Human
gcuuucuacccagcgagcccug

SEQ ID NO: 3746331 - RNA, 23 nt, Human
gcuuucuacccagcgagcccugg

SEQ ID NO: 3746332 - RNA, 18 nt, Human
gcuuucuaugcuguuugu

SEQ ID NO: 3746333 - RNA, 15 nt, Human
gcuuucucuucauau

SEQ ID NO: 3746334 - RNA, 16 nt, Human
gcuuucugaacagcug

SEQ ID NO: 3746335 - RNA, 20 nt, Human
gcuuucugaacagcuggugu

SEQ ID NO: 3746336 - RNA, 15 nt, Human
gcuuucugccaucua

SEQ ID NO: 3746337 - RNA, 13 nt, Human
gcuuucugcucag

SEQ ID NO: 3746338 - RNA, 19 nt, Human
gcuuucugcucagcuucuc

SEQ ID NO: 3746339 - RNA, 22 nt, Human
gcuuucuggaaaagaggaguuu

SEQ ID NO: 3746340 - RNA, 11 nt, Human
gcuuucugucu

SEQ ID NO: 3746341 - RNA, 12 nt, Human
gcuuucuguucc

SEQ ID NO: 3746342 - RNA, 20 nt, Human
gcuuucuugcucccuucagc

SEQ ID NO: 3746343 - RNA, 21 nt, Human
gcuuucuuucacaaaaaagaa

SEQ ID NO: 3746344 - RNA, 20 nt, Human
gcuuucuuucguuuguuugu

SEQ ID NO: 3746345 - RNA, 21 nt, Human
gcuuucuuucguuuguuuguu

SEQ ID NO: 3746346 - RNA, 22 nt, Human
gcuuucuuuuuaaagcuuuuga

SEQ ID NO: 3746347 - RNA, 21 nt, Human
gcuuugaaagccccagaaauc

SEQ ID NO: 3746348 - RNA, 17 nt, Human
gcuuugaaauugaaccu

SEQ ID NO: 3746349 - RNA, 19 nt, Human
gcuuugaaauugaaccuuu

SEQ ID NO: 3746350 - RNA, 17 nt, Human
gcuuugaauaaaugugu

SEQ ID NO: 3746351 - RNA, 24 nt, Human
gcuuugacucaggagccugugaca

SEQ ID NO: 3746352 - RNA, 21 nt, Human
gcuuugacuggaggguccauu

SEQ ID NO: 3746353 - RNA, 14 nt, Human
gcuuugagaagccu

SEQ ID NO: 3746354 - RNA, 19 nt, Human
gcuuugagguggaagaggg

SEQ ID NO: 3746355 - RNA, 17 nt, Human
gcuuugaucccuucuua

SEQ ID NO: 3746356 - RNA, 20 nt, Human
gcuuugauguuccuuccagu

SEQ ID NO: 3746357 - RNA, 21 nt, Human
gcuuugauuaguuuucuuguu

SEQ ID NO: 3746358 - RNA, 12 nt, Human
gcuuugcaguga

SEQ ID NO: 3746359 - RNA, 18 nt, Human
gcuuugcauguuccacua

SEQ ID NO: 3746360 - RNA, 20 nt, Human
gcuuugcauguuccacuaac

SEQ ID NO: 3746361 - RNA, 21 nt, Human
gcuuugcauuuuaaaaaugaa

SEQ ID NO: 3746362 - RNA, 14 nt, Human
gcuuugccagcugc

SEQ ID NO: 3746363 - RNA, 15 nt, Human
gcuuugccagcugcu

SEQ ID NO: 3746364 - RNA, 18 nt, Human
gcuuugccagcugcugcu

SEQ ID NO: 3746365 - RNA, 16 nt, Human
gcuuugccaugugcuu

SEQ ID NO: 3746366 - RNA, 20 nt, Human
gcuuugcccaacaccagccc

SEQ ID NO: 3746367 - RNA, 22 nt, Human
gcuuugcccaacaccagccccu

SEQ ID NO: 3746368 - RNA, 23 nt, Human
gcuuugcccugcugcccuccccc

SEQ ID NO: 3746369 - RNA, 13 nt, Human
gcuuugccuucca

SEQ ID NO: 3746370 - RNA, 21 nt, Human
gcuuugcucuugucccacgug

SEQ ID NO: 3746371 - RNA, 12 nt, Human
gcuuugcugcua

SEQ ID NO: 3746372 - RNA, 19 nt, Human
gcuuugcugcugaaggcuc

SEQ ID NO: 3746373 - RNA, 15 nt, Human
gcuuugcuguuucau

SEQ ID NO: 3746374 - RNA, 18 nt, Human
gcuuugcuuucugcucag

SEQ ID NO: 3746375 - RNA, 14 nt, Human
gcuuugcuuugucu

SEQ ID NO: 3746376 - RNA, 16 nt, Human
gcuuugcuuugucugg

SEQ ID NO: 3746377 - RNA, 21 nt, Human
gcuuuggaaguuuagcucuga

SEQ ID NO: 3746378 - RNA, 23 nt, Human
gcuuuggaaguuuagcucugaga

SEQ ID NO: 3746379 - RNA, 19 nt, Human
gcuuuggacccaaggaaaa

SEQ ID NO: 3746380 - RNA, 22 nt, Human
gcuuugggaauguuuuuagcug

SEQ ID NO: 3746381 - RNA, 15 nt, Human
gcuuugggcugcccu

SEQ ID NO: 3746382 - RNA, 16 nt, Human
gcuuugggcugcccug

SEQ ID NO: 3746383 - RNA, 19 nt, Human
gcuuugggcugcccuggug

SEQ ID NO: 3746384 - RNA, 15 nt, Human
gcuuugggcuugggc

SEQ ID NO: 3746385 - RNA, 17 nt, Human
gcuuuggugagaaccug

SEQ ID NO: 3746386 - RNA, 15 nt, Human
gcuuugguuuauauu

SEQ ID NO: 3746387 - RNA, 16 nt, Human
gcuuuguaggugucuc

SEQ ID NO: 3746388 - RNA, 14 nt, Human
gcuuuguauagaac

SEQ ID NO: 3746389 - RNA, 12 nt, Human
gcuuugucccac

SEQ ID NO: 3746390 - RNA, 16 nt, Human
gcuuuguccccugcuu

SEQ ID NO: 3746391 - RNA, 21 nt, Human
gcuuuguccccugcuucagau

SEQ ID NO: 3746392 - RNA, 19 nt, Human
gcuuugucguauuuggcac

SEQ ID NO: 3746393 - RNA, 18 nt, Human
gcuuugucuacuucaaaa

SEQ ID NO: 3746394 - RNA, 13 nt, Human
gcuuugucuccuc

SEQ ID NO: 3746395 - RNA, 18 nt, Human
gcuuugucuggaagaaag

SEQ ID NO: 3746396 - RNA, 15 nt, Human
gcuuugugugauuga

SEQ ID NO: 3746397 - RNA, 21 nt, Human
gcuuuguguuugguuuacauu

SEQ ID NO: 3746398 - RNA, 22 nt, Human
gcuuuguguuugguuuacauuu

SEQ ID NO: 3746399 - RNA, 15 nt, Human
gcuuuguuaaaaaaa

SEQ ID NO: 3746400 - RNA, 16 nt, Human
gcuuuguugcacugaa

SEQ ID NO: 3746401 - RNA, 19 nt, Human
gcuuuguugugugccucua

SEQ ID NO: 3746402 - RNA, 15 nt, Human
gcuuuguuuguucuu

SEQ ID NO: 3746403 - RNA, 14 nt, Human
gcuuuuaaaagauu

SEQ ID NO: 3746404 - RNA, 14 nt, Human
gcuuuuaaaauuuu

SEQ ID NO: 3746405 - RNA, 20 nt, Human
gcuuuuaccaugccccugag

SEQ ID NO: 3746406 - RNA, 19 nt, Human
gcuuuuaguuuuucugucc

SEQ ID NO: 3746407 - RNA, 16 nt, Human
gcuuuuauagaggcua

SEQ ID NO: 3746408 - RNA, 19 nt, Human
gcuuuuauagaggcuagcu

SEQ ID NO: 3746409 - RNA, 22 nt, Human
gcuuuuaucucagauguuaaaa

SEQ ID NO: 3746410 - RNA, 21 nt, Human
gcuuuuaugugaaacauguuu

SEQ ID NO: 3746411 - RNA, 15 nt, Human
gcuuuuauuaaugca

SEQ ID NO: 3746412 - RNA, 18 nt, Human
gcuuuuauuaaugcacuu

SEQ ID NO: 3746413 - RNA, 16 nt, Human
gcuuuuauuuugaaaa

SEQ ID NO: 3746414 - RNA, 13 nt, Human
gcuuuucaaacaa

SEQ ID NO: 3746415 - RNA, 18 nt, Human
gcuuuucaaacaagaaug

SEQ ID NO: 3746416 - RNA, 17 nt, Human
gcuuuucacugcugcaa

SEQ ID NO: 3746417 - RNA, 23 nt, Human
gcuuuucacugcuggcugccuua

SEQ ID NO: 3746418 - RNA, 18 nt, Human
gcuuuucaugcaaacucu

SEQ ID NO: 3746419 - RNA, 22 nt, Human
gcuuuuccccggucccuugaga

SEQ ID NO: 3746420 - RNA, 19 nt, Human
gcuuuucccuaagccaagg

SEQ ID NO: 3746421 - RNA, 14 nt, Human
gcuuuucccucuuu

SEQ ID NO: 3746422 - RNA, 15 nt, Human
gcuuuuccugggaca

SEQ ID NO: 3746423 - RNA, 15 nt, Human
gcuuuuccuuggcau

SEQ ID NO: 3746424 - RNA, 21 nt, Human
gcuuuuccuuggcauuccgca

SEQ ID NO: 3746425 - RNA, 12 nt, Human
gcuuuucugauc

SEQ ID NO: 3746426 - RNA, 16 nt, Human
gcuuuucugcccuggc

SEQ ID NO: 3746427 - RNA, 12 nt, Human
gcuuuucuguuu

SEQ ID NO: 3746428 - RNA, 13 nt, Human
gcuuuugcauauu

SEQ ID NO: 3746429 - RNA, 20 nt, Human
gcuuuugcccauuuugaauc

SEQ ID NO: 3746430 - RNA, 14 nt, Human
gcuuuuggucauca

SEQ ID NO: 3746431 - RNA, 18 nt, Human
gcuuuuguuccaauguca

SEQ ID NO: 3746432 - RNA, 21 nt, Human
gcuuuuguuuccuuuuucaga

SEQ ID NO: 3746433 - RNA, 21 nt, Human
gcuuuuuauuucugcauaugu

SEQ ID NO: 3746434 - RNA, 13 nt, Human
gcuuuuucacagu

SEQ ID NO: 3746435 - RNA, 16 nt, Human
gcuuuuuccuccugga

SEQ ID NO: 3746436 - RNA, 18 nt, Human
gcuuuuucugacuccagu

SEQ ID NO: 3746437 - RNA, 16 nt, Human
gcuuuuugaaaugaaa

SEQ ID NO: 3746438 - RNA, 20 nt, Human
gcuuuuugagguggcacuuu

SEQ ID NO: 3746439 - RNA, 12 nt, Human
gcuuuuuggaau

SEQ ID NO: 3746440 - RNA, 18 nt, Human
gcuuuuugguguauagaa

SEQ ID NO: 3746441 - RNA, 16 nt, Human
gcuuuuuguguuuuuu

SEQ ID NO: 3746442 - RNA, 18 nt, Human
gcuuuuuuaucaugugaa

SEQ ID NO: 3746443 - RNA, 21 nt, Human
gcuuuuuuugaaacuuugaga

SEQ ID NO: 3746444 - RNA, 17 nt, Human
gcuuuuuuuguguguau

SEQ ID NO: 3746445 - RNA, 15 nt, Human
gcuuuuuuuuccuuc

SEQ ID NO: 3746446 - RNA, 16 nt, Human
gcuuuuuuuuuuccag

SEQ ID NO: 3746447 - RNA, 19 nt, Human
ggaaaaaaaucaucuauuu

SEQ ID NO: 3746448 - RNA, 21 nt, Human
ggaaaaaaaucaucuauuuug

SEQ ID NO: 3746449 - RNA, 19 nt, Human
ggaaaaaaaucguccaggg

SEQ ID NO: 3746450 - RNA, 16 nt, Human
ggaaaaaauaacaaug

SEQ ID NO: 3746451 - RNA, 23 nt, Human
ggaaaaaauugcuuuugagagaa

SEQ ID NO: 3746452 - RNA, 19 nt, Human
ggaaaaacuuuggaaccag

SEQ ID NO: 3746453 - RNA, 13 nt, Human
ggaaaaagaaaau

SEQ ID NO: 3746454 - RNA, 16 nt, Human
ggaaaaagcacaagaa

SEQ ID NO: 3746455 - RNA, 23 nt, Human
ggaaaaagcuccaugugccucuu

SEQ ID NO: 3746456 - RNA, 12 nt, Human
ggaaaaaggaca

SEQ ID NO: 3746457 - RNA, 13 nt, Human
ggaaaaauagccu

SEQ ID NO: 3746458 - RNA, 12 nt, Human
ggaaaaauaugu

SEQ ID NO: 3746459 - RNA, 16 nt, Human
ggaaaaauaugugaag

SEQ ID NO: 3746460 - RNA, 17 nt, Human
ggaaaaaugagagaagg

SEQ ID NO: 3746461 - RNA, 19 nt, Human
ggaaaaaugccaucaaaug

SEQ ID NO: 3746462 - RNA, 18 nt, Human
cuuucaauacagauauau

SEQ ID NO: 3746463 - RNA, 19 nt, Human
cuuucaauacagauauauu

SEQ ID NO: 3746464 - RNA, 20 nt, Human
cuuucaauacagauauauuu

SEQ ID NO: 3746465 - RNA, 14 nt, Human
cuuucaauaggaaa

SEQ ID NO: 3746466 - RNA, 20 nt, Human
cuuucaauaggaaaaacuga

SEQ ID NO: 3746467 - RNA, 13 nt, Human
cuuucaauucugu

SEQ ID NO: 3746468 - RNA, 14 nt, Human
cuuucacaaaaaag

SEQ ID NO: 3746469 - RNA, 16 nt, Human
cuuucacaaaaaagaa

SEQ ID NO: 3746470 - RNA, 20 nt, Human
cuuucacaacauuugcagau

SEQ ID NO: 3746471 - RNA, 19 nt, Human
cuuucacaguaccaucuga

SEQ ID NO: 3746472 - RNA, 20 nt, Human
cuuucacccacagaaagaga

SEQ ID NO: 3746473 - RNA, 16 nt, Human
cuuucaccccagggcc

SEQ ID NO: 3746474 - RNA, 14 nt, Human
cuuucacccuuuuc

SEQ ID NO: 3746475 - RNA, 16 nt, Human
cuuucacuucuuuccc

SEQ ID NO: 3746476 - RNA, 20 nt, Human
cuuucacuucuuucccuucc

SEQ ID NO: 3746477 - RNA, 14 nt, Human
cuuucagaaaacag

SEQ ID NO: 3746478 - RNA, 20 nt, Human
cuuucagaaaacgggaagcg

SEQ ID NO: 3746479 - RNA, 14 nt, Human
cuuucagaauaugu

SEQ ID NO: 3746480 - RNA, 16 nt, Human
cuuucagacuugccau

SEQ ID NO: 3746481 - RNA, 18 nt, Human
cuuucagacuugccaugu

SEQ ID NO: 3746482 - RNA, 19 nt, Human
cuuucagacuugccaugug

SEQ ID NO: 3746483 - RNA, 13 nt, Human
cuuucagagccuc

SEQ ID NO: 3746484 - RNA, 14 nt, Human
cuuucagauacugg

SEQ ID NO: 3746485 - RNA, 12 nt, Human
cuuucagauguc

SEQ ID NO: 3746486 - RNA, 22 nt, Human
cuuucagaugucuucugccugu

SEQ ID NO: 3746487 - RNA, 23 nt, Human
cuuucagaugucuucugccuguu

SEQ ID NO: 3746488 - RNA, 20 nt, Human
cuuucagcaagacuucucuu

SEQ ID NO: 3746489 - RNA, 17 nt, Human
cuuucagcagacugauc

SEQ ID NO: 3746490 - RNA, 13 nt, Human
cuuucagcuccug

SEQ ID NO: 3746491 - RNA, 15 nt, Human
cuuucagcuccugac

SEQ ID NO: 3746492 - RNA, 22 nt, Human
cuuucagcugucuuuuggagga

SEQ ID NO: 3746493 - RNA, 21 nt, Human
cuuucaggaucuauuuuugga

SEQ ID NO: 3746494 - RNA, 20 nt, Human
cuuucagggaauuucaggaa

SEQ ID NO: 3746495 - RNA, 16 nt, Human
cuuucagggccauggu

SEQ ID NO: 3746496 - RNA, 17 nt, Human
cuuucagggccaugguu

SEQ ID NO: 3746497 - RNA, 21 nt, Human
cuuucagggggguugugaggc

SEQ ID NO: 3746498 - RNA, 14 nt, Human
cuuucaguacuuuu

SEQ ID NO: 3746499 - RNA, 15 nt, Human
cuuucagugaaagca

SEQ ID NO: 3746500 - RNA, 14 nt, Human
cuuucaguuagccu

SEQ ID NO: 3746501 - RNA, 13 nt, Human
cuuucauauaguu

SEQ ID NO: 3746502 - RNA, 16 nt, Human
cuuucauauuuuaaac

SEQ ID NO: 3746503 - RNA, 21 nt, Human
cuuucaucaaucauuguacag

SEQ ID NO: 3746504 - RNA, 19 nt, Human
cuuucaucacacugggugg

SEQ ID NO: 3746505 - RNA, 17 nt, Human
cuuucauccacuagugc

SEQ ID NO: 3746506 - RNA, 18 nt, Human
cuuucauccugacucugc

SEQ ID NO: 3746507 - RNA, 16 nt, Human
cuuucauccuugacua

SEQ ID NO: 3746508 - RNA, 22 nt, Human
cuuucaugaguuuuucccagcu

SEQ ID NO: 3746509 - RNA, 21 nt, Human
cuuucauguaaacugugcacc

SEQ ID NO: 3746510 - RNA, 22 nt, Human
cuuucaugugugccaaggcuga

SEQ ID NO: 3746511 - RNA, 18 nt, Human
cuuucauugccagugucu

SEQ ID NO: 3746512 - RNA, 18 nt, Human
cuuucauuucuugaggua

SEQ ID NO: 3746513 - RNA, 19 nt, Human
cuuucauuuucucucaggu

SEQ ID NO: 3746514 - RNA, 14 nt, Human
cuuucauuuugcuu

SEQ ID NO: 3746515 - RNA, 16 nt, Human
cuuucauuuugcuuua

SEQ ID NO: 3746516 - RNA, 17 nt, Human
cuuucauuuugcuuuaa

SEQ ID NO: 3746517 - RNA, 19 nt, Human
cuuucauuuugcuuuaauu

SEQ ID NO: 3746518 - RNA, 15 nt, Human
cuuucauuuuugaua

SEQ ID NO: 3746519 - RNA, 15 nt, Human
cuuucauuuuuuucc

SEQ ID NO: 3746520 - RNA, 22 nt, Human
cuuuccaaaccuuaucuccaca

SEQ ID NO: 3746521 - RNA, 20 nt, Human
cuuuccaaagccaaugugaa

SEQ ID NO: 3746522 - RNA, 21 nt, Human
cuuuccaaaggccauggagag

SEQ ID NO: 3746523 - RNA, 16 nt, Human
cuuuccaaaugcccag

SEQ ID NO: 3746524 - RNA, 15 nt, Human
cuuuccaaggcuucu

SEQ ID NO: 3746525 - RNA, 17 nt, Human
cuuuccaauucuccuuu

SEQ ID NO: 3746526 - RNA, 22 nt, Human
cuuuccaccacagccagcaccu

SEQ ID NO: 3746527 - RNA, 17 nt, Human
cuuuccacccccucccu

SEQ ID NO: 3746528 - RNA, 22 nt, Human
cuuuccacccccucccuggccu

SEQ ID NO: 3746529 - RNA, 21 nt, Human
cuuuccacuccuccuagccac

SEQ ID NO: 3746530 - RNA, 13 nt, Human
cuuuccagcucac

SEQ ID NO: 3746531 - RNA, 23 nt, Human
cuuuccauauccauagugacuuu

SEQ ID NO: 3746532 - RNA, 15 nt, Human
cuuuccauccauggc

SEQ ID NO: 3746533 - RNA, 20 nt, Human
cuuuccauccauggccagca

SEQ ID NO: 3746534 - RNA, 21 nt, Human
cuuuccauccauggccagcag

SEQ ID NO: 3746535 - RNA, 14 nt, Human
cuuuccauguugcu

SEQ ID NO: 3746536 - RNA, 17 nt, Human
cuuuccauguugcugcc

SEQ ID NO: 3746537 - RNA, 14 nt, Human
cuuuccauuucucu

SEQ ID NO: 3746538 - RNA, 17 nt, Human
cuuucccaacaccucuu

SEQ ID NO: 3746539 - RNA, 11 nt, Human
cuuucccaagc

SEQ ID NO: 3746540 - RNA, 18 nt, Human
cuuucccacccagccugg

SEQ ID NO: 3746541 - RNA, 19 nt, Human
cuuucccacccagccuggg

SEQ ID NO: 3746542 - RNA, 21 nt, Human
cuuucccaccccaaccugcuc

SEQ ID NO: 3746543 - RNA, 22 nt, Human
cuuucccaccccaaccugcucu

SEQ ID NO: 3746544 - RNA, 22 nt, Human
cuuucccaccccacgccuuauc

SEQ ID NO: 3746545 - RNA, 16 nt, Human
cuuucccacccuguuc

SEQ ID NO: 3746546 - RNA, 16 nt, Human
cuuucccaucuuccaa

SEQ ID NO: 3746547 - RNA, 19 nt, Human
cuuuccccaccagaugcug

SEQ ID NO: 3746548 - RNA, 20 nt, Human
cuuuccccagcaucacuccc

SEQ ID NO: 3746549 - RNA, 13 nt, Human
cuuuccccagccc

SEQ ID NO: 3746550 - RNA, 17 nt, Human
cuuuccccagcccaggg

SEQ ID NO: 3746551 - RNA, 19 nt, Human
cuuuccccauuccuaccca

SEQ ID NO: 3746552 - RNA, 17 nt, Human
cuuuccccuguggggau

SEQ ID NO: 3746553 - RNA, 13 nt, Human
cuuucccuacccu

SEQ ID NO: 3746554 - RNA, 16 nt, Human
cuuucccuacccucua

SEQ ID NO: 3746555 - RNA, 11 nt, Human
cuuucccuccc

SEQ ID NO: 3746556 - RNA, 14 nt, Human
cuuucccuccuugg

SEQ ID NO: 3746557 - RNA, 20 nt, Human
cuuucccugaacugggaccu

SEQ ID NO: 3746558 - RNA, 13 nt, Human
cuuucccugccuc

SEQ ID NO: 3746559 - RNA, 13 nt, Human
cuuucccuggucc

SEQ ID NO: 3746560 - RNA, 13 nt, Human
cuuucccuuccag

SEQ ID NO: 3746561 - RNA, 12 nt, Human
cuuucccuuccu

SEQ ID NO: 3746562 - RNA, 17 nt, Human
cuuucccuuccucuucg

SEQ ID NO: 3746563 - RNA, 13 nt, Human
cuuucccuugcuu

SEQ ID NO: 3746564 - RNA, 22 nt, Human
cuuucccuugcuuuucccucuu

SEQ ID NO: 3746565 - RNA, 17 nt, Human
cuuucccuuggugcccu

SEQ ID NO: 3746566 - RNA, 20 nt, Human
cuuucccuuuuccauuugaa

SEQ ID NO: 3746567 - RNA, 22 nt, Human
cuuuccgucaacguuguacugu

SEQ ID NO: 3746568 - RNA, 17 nt, Human
cuuuccguggcacugca

SEQ ID NO: 3746569 - RNA, 20 nt, Human
cuuuccuaagaccugggguu

SEQ ID NO: 3746570 - RNA, 21 nt, Human
cuuuccuagauggcagucacu

SEQ ID NO: 3746571 - RNA, 19 nt, Human
cuuuccucaaauguugaca

SEQ ID NO: 3746572 - RNA, 18 nt, Human
cuuuccucauuaaauuac

SEQ ID NO: 3746573 - RNA, 22 nt, Human
cuuuccuccucaggcacacagc

SEQ ID NO: 3746574 - RNA, 17 nt, Human
cuuuccuccuuuaucac

SEQ ID NO: 3746575 - RNA, 13 nt, Human
cuuuccuccuuuc

SEQ ID NO: 3746576 - RNA, 14 nt, Human
cuuuccuccuuucc

SEQ ID NO: 3746577 - RNA, 16 nt, Human
cuuuccucucuauauu

SEQ ID NO: 3746578 - RNA, 18 nt, Human
cuuuccucucuauauuuc

SEQ ID NO: 3746579 - RNA, 21 nt, Human
cuuuccugaggcugggcuccc

SEQ ID NO: 3746580 - RNA, 20 nt, Human
cuuuccugagucccaucccu

SEQ ID NO: 3746581 - RNA, 21 nt, Human
cuuuccugcaacucaaggacu

SEQ ID NO: 3746582 - RNA, 21 nt, Human
cuuuccuggagagucucacuc

SEQ ID NO: 3746583 - RNA, 9 nt, Human
cuuuccugu

SEQ ID NO: 3746584 - RNA, 23 nt, Human
cuuuccuguauuuguucccaaga

SEQ ID NO: 3746585 - RNA, 13 nt, Human
cuuuccugugcca

SEQ ID NO: 3746586 - RNA, 14 nt, Human
cuuuccugugccag

SEQ ID NO: 3746587 - RNA, 13 nt, Human
cuuuccuguucag

SEQ ID NO: 3746588 - RNA, 14 nt, Human
cuuuccuguucagc

SEQ ID NO: 3746589 - RNA, 17 nt, Human
cuuuccuguucagcauu

SEQ ID NO: 3746590 - RNA, 19 nt, Human
cuuuccuguucagcauucu

SEQ ID NO: 3746591 - RNA, 17 nt, Human
cuuuccuguuucucagu

SEQ ID NO: 3746592 - RNA, 14 nt, Human
cuuuccuucuugcc

SEQ ID NO: 3746593 - RNA, 17 nt, Human
cuuuccuuggcucccau

SEQ ID NO: 3746594 - RNA, 15 nt, Human
cuuuccuuggcuuua

SEQ ID NO: 3746595 - RNA, 21 nt, Human
cuuuccuuuucgccuuuccuc

SEQ ID NO: 3746596 - RNA, 20 nt, Human
cuuucgacuugcauuuuugc

SEQ ID NO: 3746597 - RNA, 21 nt, Human
cuuucgacuugcauuuuugca

SEQ ID NO: 3746598 - RNA, 19 nt, Human
cuuucgauacccaggacca

SEQ ID NO: 3746599 - RNA, 18 nt, Human
cuuucguccacagcuucc

SEQ ID NO: 3746600 - RNA, 22 nt, Human
cuuucguguaaauuauguaaug

SEQ ID NO: 3746601 - RNA, 14 nt, Human
cuuucuaagaaauc

SEQ ID NO: 3746602 - RNA, 14 nt, Human
cuuucuaaugcuga

SEQ ID NO: 3746603 - RNA, 17 nt, Human
cuuucuaaugugugaau

SEQ ID NO: 3746604 - RNA, 20 nt, Human
cuuucuacaaugugaacuuu

SEQ ID NO: 3746605 - RNA, 16 nt, Human
cuuucuacucauuuua

SEQ ID NO: 3746606 - RNA, 18 nt, Human
cuuucuagaaagaauaaa

SEQ ID NO: 3746607 - RNA, 23 nt, Human
cuuucuagaaguuucccuuccuc

SEQ ID NO: 3746608 - RNA, 16 nt, Human
cuuucuagccuggcua

SEQ ID NO: 3746609 - RNA, 23 nt, Human
cuuucuagcuguugagcuguuuu

SEQ ID NO: 3746610 - RNA, 20 nt, Human
cuuucuaguccuauucuauu

SEQ ID NO: 3746611 - RNA, 23 nt, Human
ggaaaaauggauccccagugaaa

SEQ ID NO: 3746612 - RNA, 12 nt, Human
ggaaaaauguuu

SEQ ID NO: 3746613 - RNA, 14 nt, Human
ggaaaaauguuugu

SEQ ID NO: 3746614 - RNA, 17 nt, Human
ggaaaacacccagggaa

SEQ ID NO: 3746615 - RNA, 15 nt, Human
ggaaaacagaacacu

SEQ ID NO: 3746616 - RNA, 15 nt, Human
ggaaaacauuccauc

SEQ ID NO: 3746617 - RNA, 21 nt, Human
ggaaaaccaagccguggcuuc

SEQ ID NO: 3746618 - RNA, 15 nt, Human
ggaaaacgauuuaau

SEQ ID NO: 3746619 - RNA, 14 nt, Human
ggaaaacgcucucu

SEQ ID NO: 3746620 - RNA, 22 nt, Human
ggaaaacuaccuguauuuaaaa

SEQ ID NO: 3746621 - RNA, 23 nt, Human
ggaaaacuuauuuuauauuuucc

SEQ ID NO: 3746622 - RNA, 22 nt, Human
ggaaaacuugcagcuaaggagg

SEQ ID NO: 3746623 - RNA, 22 nt, Human
ggaaaagaaaaaaaaaagaaga

SEQ ID NO: 3746624 - RNA, 10 nt, Human
ggaaaagaau

SEQ ID NO: 3746625 - RNA, 18 nt, Human
ggaaaagaauacagaaag

SEQ ID NO: 3746626 - RNA, 13 nt, Human
ggaaaagacacau

SEQ ID NO: 3746627 - RNA, 17 nt, Human
ggaaaagacacauuuuu

SEQ ID NO: 3746628 - RNA, 15 nt, Human
ggaaaagacuaagau

SEQ ID NO: 3746629 - RNA, 22 nt, Human
ggaaaagagcgcaucaggccug

SEQ ID NO: 3746630 - RNA, 22 nt, Human
ggaaaagauaaagaccagaaau

SEQ ID NO: 3746631 - RNA, 18 nt, Human
ggaaaagcagcucucccc

SEQ ID NO: 3746632 - RNA, 20 nt, Human
ggaaaagccaagaggcugca

SEQ ID NO: 3746633 - RNA, 19 nt, Human
ggaaaagcggacaucagcu

SEQ ID NO: 3746634 - RNA, 14 nt, Human
ggaaaagcugcuga

SEQ ID NO: 3746635 - RNA, 20 nt, Human
ggaaaagcugcugacagugu

SEQ ID NO: 3746636 - RNA, 11 nt, Human
ggaaaaggaag

SEQ ID NO: 3746637 - RNA, 12 nt, Human
ggaaaaggccug

SEQ ID NO: 3746638 - RNA, 17 nt, Human
ggaaaaggccuggggug

SEQ ID NO: 3746639 - RNA, 12 nt, Human
ggaaaagggaag

SEQ ID NO: 3746640 - RNA, 21 nt, Human
ggaaaagggucuugggaaaua

SEQ ID NO: 3746641 - RNA, 18 nt, Human
ggaaaagguuuuauuuug

SEQ ID NO: 3746642 - RNA, 15 nt, Human
ggaaaaguacauuua

SEQ ID NO: 3746643 - RNA, 14 nt, Human
ggaaaaguuuaaua

SEQ ID NO: 3746644 - RNA, 13 nt, Human
ggaaaauacccca

SEQ ID NO: 3746645 - RNA, 14 nt, Human
ggaaaaugaauaau

SEQ ID NO: 3746646 - RNA, 20 nt, Human
ggaaaaugcagcagggaugc

SEQ ID NO: 3746647 - RNA, 15 nt, Human
ggaaaaugccaaucu

SEQ ID NO: 3746648 - RNA, 19 nt, Human
ggaaaaugccaugaauuac

SEQ ID NO: 3746649 - RNA, 22 nt, Human
ggaaacaaagcuuagcaggaga

SEQ ID NO: 3746650 - RNA, 19 nt, Human
ggaaacacuaaauguuaaa

SEQ ID NO: 3746651 - RNA, 23 nt, Human
ggaaacacuaaauguuaaagaug

SEQ ID NO: 3746652 - RNA, 17 nt, Human
ggaaacacuccuugcau

SEQ ID NO: 3746653 - RNA, 16 nt, Human
ggaaacagaggaccag

SEQ ID NO: 3746654 - RNA, 17 nt, Human
ggaaacagaggaccagc

SEQ ID NO: 3746655 - RNA, 17 nt, Human
ggaaacagaugaaaagc

SEQ ID NO: 3746656 - RNA, 17 nt, Human
ggaaacaguugcaugua

SEQ ID NO: 3746657 - RNA, 15 nt, Human
ggaaaccacagcugc

SEQ ID NO: 3746658 - RNA, 21 nt, Human
ggaaaccacagcugcuggaga

SEQ ID NO: 3746659 - RNA, 15 nt, Human
ggaaacccagcucug

SEQ ID NO: 3746660 - RNA, 14 nt, Human
ggaaacccgagggu

SEQ ID NO: 3746661 - RNA, 15 nt, Human
ggaaaccuuggugua

SEQ ID NO: 3746662 - RNA, 23 nt, Human
ggaaacgcuaccucucugucccu

SEQ ID NO: 3746663 - RNA, 15 nt, Human
ggaaacgugcccucu

SEQ ID NO: 3746664 - RNA, 16 nt, Human
ggaaacuaagauucuu

SEQ ID NO: 3746665 - RNA, 17 nt, Human
ggaaacuaauaaaauau

SEQ ID NO: 3746666 - RNA, 18 nt, Human
ggaaacucacacuccccu

SEQ ID NO: 3746667 - RNA, 16 nt, Human
ggaaacuccugugacc

SEQ ID NO: 3746668 - RNA, 20 nt, Human
ggaaacucuugcuauugaau

SEQ ID NO: 3746669 - RNA, 17 nt, Human
ggaaacuggccauggcc

SEQ ID NO: 3746670 - RNA, 18 nt, Human
ggaaacuguugccagaga

SEQ ID NO: 3746671 - RNA, 17 nt, Human
ggaaacuugucacuugc

SEQ ID NO: 3746672 - RNA, 15 nt, Human
ggaaagaaaguugca

SEQ ID NO: 3746673 - RNA, 21 nt, Human
ggaaagaagaaggugggagga

SEQ ID NO: 3746674 - RNA, 22 nt, Human
ggaaagacuggacucuaaaguc

SEQ ID NO: 3746675 - RNA, 17 nt, Human
ggaaagaguaggaagac

SEQ ID NO: 3746676 - RNA, 23 nt, Human
ggaaagaugguguggguguccug

SEQ ID NO: 3746677 - RNA, 16 nt, Human
ggaaagcaagaaucag

SEQ ID NO: 3746678 - RNA, 21 nt, Human
ggaaagcaagaaucagagaag

SEQ ID NO: 3746679 - RNA, 14 nt, Human
ggaaagcacagagg

SEQ ID NO: 3746680 - RNA, 19 nt, Human
ggaaagcagccuggccaac

SEQ ID NO: 3746681 - RNA, 15 nt, Human
ggaaagcagcucaaa

SEQ ID NO: 3746682 - RNA, 19 nt, Human
ggaaagcagcucaaaggca

SEQ ID NO: 3746683 - RNA, 22 nt, Human
ggaaagcagcucaaaggcacag

SEQ ID NO: 3746684 - RNA, 21 nt, Human
ggaaagcagguggcaucucua

SEQ ID NO: 3746685 - RNA, 16 nt, Human
ggaaagcccugugcuc

SEQ ID NO: 3746686 - RNA, 13 nt, Human
ggaaagccucugc

SEQ ID NO: 3746687 - RNA, 16 nt, Human
ggaaagccucugcugc

SEQ ID NO: 3746688 - RNA, 21 nt, Human
ggaaagcuuuucuauuuuaau

SEQ ID NO: 3746689 - RNA, 24 nt, Human
ggaaaggaagugggacuggcacua

SEQ ID NO: 3746690 - RNA, 17 nt, Human
ggaaaggaaugcaaaga

SEQ ID NO: 3746691 - RNA, 15 nt, Human
ggaaaggagaggaaa

SEQ ID NO: 3746692 - RNA, 21 nt, Human
ggaaaggaguagaaaaagcag

SEQ ID NO: 3746693 - RNA, 20 nt, Human
ggaaaggcaaaugcccaagg

SEQ ID NO: 3746694 - RNA, 20 nt, Human
ggaaaggccagcuggcagca

SEQ ID NO: 3746695 - RNA, 15 nt, Human
ggaaaggcucugaaa

SEQ ID NO: 3746696 - RNA, 23 nt, Human
ggaaagggauuuucagcccucag

SEQ ID NO: 3746697 - RNA, 21 nt, Human
ggaaagggcccuccuuccuaa

SEQ ID NO: 3746698 - RNA, 13 nt, Human
ggaaaggggagag

SEQ ID NO: 3746699 - RNA, 20 nt, Human
ggaaaggggucggcugacca

SEQ ID NO: 3746700 - RNA, 16 nt, Human
ggaaagucauuggcuu

SEQ ID NO: 3746701 - RNA, 19 nt, Human
ggaaagugaauuugaauga

SEQ ID NO: 3746702 - RNA, 18 nt, Human
ggaaagugcuuuccagaa

SEQ ID NO: 3746703 - RNA, 23 nt, Human
ggaaaguggccaagaagcagugg

SEQ ID NO: 3746704 - RNA, 15 nt, Human
ggaaauaaaaaaguc

SEQ ID NO: 3746705 - RNA, 16 nt, Human
ggaaauaaaaccuuuc

SEQ ID NO: 3746706 - RNA, 23 nt, Human
ggaaauacccuucuuuuaugagc

SEQ ID NO: 3746707 - RNA, 12 nt, Human
ggaaauauuaaa

SEQ ID NO: 3746708 - RNA, 14 nt, Human
ggaaauauuaaaag

SEQ ID NO: 3746709 - RNA, 15 nt, Human
ggaaauauuuauuuu

SEQ ID NO: 3746710 - RNA, 18 nt, Human
ggaaauauuuauuuuaau

SEQ ID NO: 3746711 - RNA, 12 nt, Human
ggaaauauuuua

SEQ ID NO: 3746712 - RNA, 20 nt, Human
ggaaaucaaagugcuauuac

SEQ ID NO: 3746713 - RNA, 17 nt, Human
ggaaaucaaauguaaag

SEQ ID NO: 3746714 - RNA, 18 nt, Human
ggaaaucagccaaguuuu

SEQ ID NO: 3746715 - RNA, 18 nt, Human
ggaaaugaucaguuuuuu

SEQ ID NO: 3746716 - RNA, 17 nt, Human
ggaaaugccuaagaaga

SEQ ID NO: 3746717 - RNA, 22 nt, Human
ggaaauggaaccccaccacugu

SEQ ID NO: 3746718 - RNA, 13 nt, Human
ggaaauggugccu

SEQ ID NO: 3746719 - RNA, 12 nt, Human
ggaaauuaaagu

SEQ ID NO: 3746720 - RNA, 19 nt, Human
ggaaauuaagaagaaacua

SEQ ID NO: 3746721 - RNA, 16 nt, Human
ggaaauugauuuugaa

SEQ ID NO: 3746722 - RNA, 17 nt, Human
ggaaauuggaagagcac

SEQ ID NO: 3746723 - RNA, 12 nt, Human
ggaaauuucacg

SEQ ID NO: 3746724 - RNA, 16 nt, Human
ggaacaaaaaaaccac

SEQ ID NO: 3746725 - RNA, 14 nt, Human
ggaacaaacagggc

SEQ ID NO: 3746726 - RNA, 15 nt, Human
ggaacaaaucuuccu

SEQ ID NO: 3746727 - RNA, 23 nt, Human
ggaacaaggcaaggcugucaauu

SEQ ID NO: 3746728 - RNA, 13 nt, Human
ggaacaaguugag

SEQ ID NO: 3746729 - RNA, 14 nt, Human
ggaacacggccaca

SEQ ID NO: 3746730 - RNA, 15 nt, Human
ggaacacucugagac

SEQ ID NO: 3746731 - RNA, 16 nt, Human
ggaacacucugagacu

SEQ ID NO: 3746732 - RNA, 16 nt, Human
ggaacacugcccucgc

SEQ ID NO: 3746733 - RNA, 11 nt, Human
ggaacagaagg

SEQ ID NO: 3746734 - RNA, 13 nt, Human
ggaacagaaggau

SEQ ID NO: 3746735 - RNA, 12 nt, Human
ggaacagaaugu

SEQ ID NO: 3746736 - RNA, 16 nt, Human
ggaacagaauguuuua

SEQ ID NO: 3746737 - RNA, 21 nt, Human
ggaacagacaacagaagucau

SEQ ID NO: 3746738 - RNA, 16 nt, Human
ggaacagacaggagaa

SEQ ID NO: 3746739 - RNA, 17 nt, Human
ggaacagacaggagaaa

SEQ ID NO: 3746740 - RNA, 23 nt, Human
ggaacagcuaugggagccccagg

SEQ ID NO: 3746741 - RNA, 23 nt, Human
ggaacaggcucagaucucauggg

SEQ ID NO: 3746742 - RNA, 18 nt, Human
ggaacaguguuucccaua

SEQ ID NO: 3746743 - RNA, 23 nt, Human
ggaacaucaucaaggcacugccu

SEQ ID NO: 3746744 - RNA, 20 nt, Human
ggaacauccuuugcagggca

SEQ ID NO: 3746745 - RNA, 22 nt, Human
ggaacauccuuugcagggcagc

SEQ ID NO: 3746746 - RNA, 15 nt, Human
ggaacaugcccccug

SEQ ID NO: 3746747 - RNA, 17 nt, Human
ggaacauuuauuuuaug

SEQ ID NO: 3746748 - RNA, 18 nt, Human
ggaacauuucuguaaaua

SEQ ID NO: 3746749 - RNA, 19 nt, Human
ggaacauuucuguaaauac

SEQ ID NO: 3746750 - RNA, 22 nt, Human
ggaaccaaagcgaauuuuaaaa

SEQ ID NO: 3746751 - RNA, 13 nt, Human
ggaaccagagcca

SEQ ID NO: 3746752 - RNA, 14 nt, Human
ggaaccaggcuugg

SEQ ID NO: 3746753 - RNA, 17 nt, Human
ggaaccagggagaccga

SEQ ID NO: 3746754 - RNA, 18 nt, Human
ggaaccaugaagacagga

SEQ ID NO: 3746755 - RNA, 14 nt, Human
ggaacccagacuca

SEQ ID NO: 3746756 - RNA, 15 nt, Human
ggaaccccccuccca

SEQ ID NO: 3746757 - RNA, 21 nt, Human
ggaaccccccucccacccacc

SEQ ID NO: 3746758 - RNA, 13 nt, Human
ggaaccccuuucc

SEQ ID NO: 3746759 - RNA, 14 nt, Human
ggaaccccuuuccc

SEQ ID NO: 3746760 - RNA, 16 nt, Human
ggaaccccuuucccac

SEQ ID NO: 3746761 - RNA, 12 nt, Human
ggagggcuccag

SEQ ID NO: 3746762 - RNA, 14 nt, Human
ggagggcuccagac

SEQ ID NO: 3746763 - RNA, 17 nt, Human
ggagggcuccagacaca

SEQ ID NO: 3746764 - RNA, 16 nt, Human
ggagggcucugaggcg

SEQ ID NO: 3746765 - RNA, 21 nt, Human
ggagggcucugaggcgcccca

SEQ ID NO: 3746766 - RNA, 14 nt, Human
ggaggggagacuuu

SEQ ID NO: 3746767 - RNA, 15 nt, Human
ggaggggcagagcca

SEQ ID NO: 3746768 - RNA, 14 nt, Human
ggaggggcaggcug

SEQ ID NO: 3746769 - RNA, 22 nt, Human
ggaggggcccgcuugccucggc

SEQ ID NO: 3746770 - RNA, 17 nt, Human
ggaggggcgcccaccuc

SEQ ID NO: 3746771 - RNA, 15 nt, Human
ggaggggcugugggc

SEQ ID NO: 3746772 - RNA, 15 nt, Human
ggagggggagaaaag

SEQ ID NO: 3746773 - RNA, 21 nt, Human
ggagggggcuugaagccaaag

SEQ ID NO: 3746774 - RNA, 18 nt, Human
ggagggguaggggcuggg

SEQ ID NO: 3746775 - RNA, 17 nt, Human
ggagggguguggcagug

SEQ ID NO: 3746776 - RNA, 16 nt, Human
ggagggguugccacag

SEQ ID NO: 3746777 - RNA, 18 nt, Human
ggagggguugccacaggc

SEQ ID NO: 3746778 - RNA, 22 nt, Human
ggagggguugccacaggccucc

SEQ ID NO: 3746779 - RNA, 18 nt, Human
ggaggguacagcugggcu

SEQ ID NO: 3746780 - RNA, 13 nt, Human
ggaggguaggcag

SEQ ID NO: 3746781 - RNA, 19 nt, Human
ggagggucuagaggccuga

SEQ ID NO: 3746782 - RNA, 19 nt, Human
ggaggguuggggaggggcg

SEQ ID NO: 3746783 - RNA, 21 nt, Human
ggaggguuucauugucuguga

SEQ ID NO: 3746784 - RNA, 21 nt, Human
ggagguagcuuugagguggaa

SEQ ID NO: 3746785 - RNA, 22 nt, Human
ggagguauucguaaggauggga

SEQ ID NO: 3746786 - RNA, 20 nt, Human
ggaggucaaggcugcaguga

SEQ ID NO: 3746787 - RNA, 14 nt, Human
ggaggucgaggcag

SEQ ID NO: 3746788 - RNA, 15 nt, Human
ggaggucgaggcagg

SEQ ID NO: 3746789 - RNA, 13 nt, Human
ggaggugagggau

SEQ ID NO: 3746790 - RNA, 16 nt, Human
ggaggugccacuggag

SEQ ID NO: 3746791 - RNA, 13 nt, Human
ggaggugccagca

SEQ ID NO: 3746792 - RNA, 16 nt, Human
ggaggugggagcagga

SEQ ID NO: 3746793 - RNA, 13 nt, Human
ggaggugucucag

SEQ ID NO: 3746794 - RNA, 12 nt, Human
ggaggugugagg

SEQ ID NO: 3746795 - RNA, 13 nt, Human
ggagguguucacu

SEQ ID NO: 3746796 - RNA, 14 nt, Human
ggagguguucacug

SEQ ID NO: 3746797 - RNA, 21 nt, Human
ggagguguuuaaagagagguu

SEQ ID NO: 3746798 - RNA, 19 nt, Human
ggagguuaaggcugaggaa

SEQ ID NO: 3746799 - RNA, 21 nt, Human
ggagguuaaggcugaggaaag

SEQ ID NO: 3746800 - RNA, 12 nt, Human
ggagguugauaa

SEQ ID NO: 3746801 - RNA, 14 nt, Human
ggagguugcaggga

SEQ ID NO: 3746802 - RNA, 21 nt, Human
ggagguugcagugagcugaga

SEQ ID NO: 3746803 - RNA, 17 nt, Human
ggagguuggagggaaag

SEQ ID NO: 3746804 - RNA, 22 nt, Human
ggaguaacaauacaaauggauu

SEQ ID NO: 3746805 - RNA, 17 nt, Human
ggaguaccauguggcaa

SEQ ID NO: 3746806 - RNA, 22 nt, Human
ggaguagagauggggaaagaau

SEQ ID NO: 3746807 - RNA, 14 nt, Human
ggaguagcugagcu

SEQ ID NO: 3746808 - RNA, 15 nt, Human
ggaguaugcaaaagu

SEQ ID NO: 3746809 - RNA, 16 nt, Human
ggaguauugaauggug

SEQ ID NO: 3746810 - RNA, 21 nt, Human
ggaguauugaaugguggugga

SEQ ID NO: 3746811 - RNA, 16 nt, Human
ggagucaaaaauuaaa

SEQ ID NO: 3746812 - RNA, 15 nt, Human
ggagucaagugugga

SEQ ID NO: 3746813 - RNA, 14 nt, Human
ggagucagagagaa

SEQ ID NO: 3746814 - RNA, 14 nt, Human
ggagucagugccag

SEQ ID NO: 3746815 - RNA, 18 nt, Human
ggagucagugccaggucc

SEQ ID NO: 3746816 - RNA, 21 nt, Human
ggagucauuuuguguugaaga

SEQ ID NO: 3746817 - RNA, 16 nt, Human
ggaguccacuuuguuu

SEQ ID NO: 3746818 - RNA, 20 nt, Human
ggaguccaggacaggagaug

SEQ ID NO: 3746819 - RNA, 20 nt, Human
ggagucccacuccaagccag

SEQ ID NO: 3746820 - RNA, 13 nt, Human
ggaguccccuccc

SEQ ID NO: 3746821 - RNA, 24 nt, Human
ggagucguggggugugcugggagc

SEQ ID NO: 3746822 - RNA, 13 nt, Human
ggagucugagguc

SEQ ID NO: 3746823 - RNA, 17 nt, Human
ggagucugccacccagg

SEQ ID NO: 3746824 - RNA, 21 nt, Human
ggagucugccacccaggaucc

SEQ ID NO: 3746825 - RNA, 13 nt, Human
ggagucugccagg

SEQ ID NO: 3746826 - RNA, 16 nt, Human
ggagucugccagggcc

SEQ ID NO: 3746827 - RNA, 20 nt, Human
ggagucugccagggccccuc

SEQ ID NO: 3746828 - RNA, 23 nt, Human
ggagugaaaccuuuagggcagcu

SEQ ID NO: 3746829 - RNA, 12 nt, Human
ggagugaagagg

SEQ ID NO: 3746830 - RNA, 16 nt, Human
ggagugaagaggggca

SEQ ID NO: 3746831 - RNA, 18 nt, Human
ggagugacagaggcagcc

SEQ ID NO: 3746832 - RNA, 19 nt, Human
ggagugacagaggcagccc

SEQ ID NO: 3746833 - RNA, 12 nt, Human
ggagugagcugg

SEQ ID NO: 3746834 - RNA, 12 nt, Human
ggagugcaguga

SEQ ID NO: 3746835 - RNA, 14 nt, Human
ggagugcagugagc

SEQ ID NO: 3746836 - RNA, 19 nt, Human
ggagugcccacccugggag

SEQ ID NO: 3746837 - RNA, 18 nt, Human
ggagugcggaccacccuc

SEQ ID NO: 3746838 - RNA, 18 nt, Human
ggagugcuggcucacagu

SEQ ID NO: 3746839 - RNA, 19 nt, Human
ggaguggaagaagagggag

SEQ ID NO: 3746840 - RNA, 23 nt, Human
ggaguggaauaguauccuccagg

SEQ ID NO: 3746841 - RNA, 16 nt, Human
ggaguggcagcccagc

SEQ ID NO: 3746842 - RNA, 22 nt, Human
ggagugggcccaaugcacuuug

SEQ ID NO: 3746843 - RNA, 23 nt, Human
ggagugggguggugucagacccu

SEQ ID NO: 3746844 - RNA, 17 nt, Human
ggagugggucuggagga

SEQ ID NO: 3746845 - RNA, 13 nt, Human
ggaguguccucuu

SEQ ID NO: 3746846 - RNA, 20 nt, Human
ggaguguccucuucccucuc

SEQ ID NO: 3746847 - RNA, 19 nt, Human
ggaguguguauuguuccca

SEQ ID NO: 3746848 - RNA, 17 nt, Human
ggagugugugugagugu

SEQ ID NO: 3746849 - RNA, 12 nt, Human
ggaguguucccc

SEQ ID NO: 3746850 - RNA, 20 nt, Human
ggaguguuccccuuccacug

SEQ ID NO: 3746851 - RNA, 16 nt, Human
ggaguuaagaccuggc

SEQ ID NO: 3746852 - RNA, 12 nt, Human
ggaguucaauga

SEQ ID NO: 3746853 - RNA, 13 nt, Human
ggaguucaaugau

SEQ ID NO: 3746854 - RNA, 14 nt, Human
ggaguucaaugauc

SEQ ID NO: 3746855 - RNA, 15 nt, Human
ggaguuccaugaaga

SEQ ID NO: 3746856 - RNA, 20 nt, Human
ggaguucgagaccagccugg

SEQ ID NO: 3746857 - RNA, 20 nt, Human
ggaguucgaggcugcaguca

SEQ ID NO: 3746858 - RNA, 22 nt, Human
ggaguucuaacaaaacaaguug

SEQ ID NO: 3746859 - RNA, 19 nt, Human
ggaguuggcauugcauuua

SEQ ID NO: 3746860 - RNA, 21 nt, Human
ggaguuuauguuccauuaaac

SEQ ID NO: 3746861 - RNA, 20 nt, Human
ggaguuugaggcugcagcga

SEQ ID NO: 3746862 - RNA, 15 nt, Human
ggaguuuugcaaagu

SEQ ID NO: 3746863 - RNA, 21 nt, Human
ggaguuuugcucuuguagccc

SEQ ID NO: 3746864 - RNA, 17 nt, Human
ggaguuuuguuuccucu

SEQ ID NO: 3746865 - RNA, 20 nt, Human
ggaguuuuuguuuggagagc

SEQ ID NO: 3746866 - RNA, 18 nt, Human
ggauaaaaagccagggcu

SEQ ID NO: 3746867 - RNA, 21 nt, Human
ggauaaaaagccagggcugga

SEQ ID NO: 3746868 - RNA, 17 nt, Human
ggauaaaauaaugcugc

SEQ ID NO: 3746869 - RNA, 18 nt, Human
ggauaacaaagauaucuu

SEQ ID NO: 3746870 - RNA, 14 nt, Human
ggauaaccuauaug

SEQ ID NO: 3746871 - RNA, 20 nt, Human
ggauaacuuuacagaaaugg

SEQ ID NO: 3746872 - RNA, 22 nt, Human
ggauaauaaggaaaaguuuaau

SEQ ID NO: 3746873 - RNA, 16 nt, Human
ggauacugcagggcca

SEQ ID NO: 3746874 - RNA, 17 nt, Human
ggauacuggcacagagg

SEQ ID NO: 3746875 - RNA, 14 nt, Human
ggauagaugcuggc

SEQ ID NO: 3746876 - RNA, 18 nt, Human
ggauagaugcuggcccag

SEQ ID NO: 3746877 - RNA, 20 nt, Human
ggauagaugcuggcccaggg

SEQ ID NO: 3746878 - RNA, 15 nt, Human
ggauagaugugugga

SEQ ID NO: 3746879 - RNA, 13 nt, Human
ggauagcauuuuu

SEQ ID NO: 3746880 - RNA, 14 nt, Human
ggauaggagccugc

SEQ ID NO: 3746881 - RNA, 15 nt, Human
ggauaggagccugcu

SEQ ID NO: 3746882 - RNA, 21 nt, Human
ggauaggaguucacuucaucu

SEQ ID NO: 3746883 - RNA, 14 nt, Human
ggauaggccagccg

SEQ ID NO: 3746884 - RNA, 21 nt, Human
ggauaggccuucauuaacaaa

SEQ ID NO: 3746885 - RNA, 13 nt, Human
ggauauaaauaua

SEQ ID NO: 3746886 - RNA, 14 nt, Human
ggauauaaauauau

SEQ ID NO: 3746887 - RNA, 13 nt, Human
ggauauguggaga

SEQ ID NO: 3746888 - RNA, 21 nt, Human
ggauauuagucauagaagaac

SEQ ID NO: 3746889 - RNA, 16 nt, Human
ggauauuuaagaaaau

SEQ ID NO: 3746890 - RNA, 22 nt, Human
ggauauuuaagaaaauacaaua

SEQ ID NO: 3746891 - RNA, 12 nt, Human
ggauauuuaagg

SEQ ID NO: 3746892 - RNA, 13 nt, Human
ggauauuuucaaa

SEQ ID NO: 3746893 - RNA, 14 nt, Human
ggaucacaagaugg

SEQ ID NO: 3746894 - RNA, 16 nt, Human
ggaucacagccucuga

SEQ ID NO: 3746895 - RNA, 22 nt, Human
ggaucacaggugucagccauug

SEQ ID NO: 3746896 - RNA, 19 nt, Human
ggaucacuggagcccagga

SEQ ID NO: 3746897 - RNA, 16 nt, Human
ggaucagagcaggacc

SEQ ID NO: 3746898 - RNA, 21 nt, Human
ggaucagaugaacucuuagaa

SEQ ID NO: 3746899 - RNA, 16 nt, Human
ggaucagauugcaugu

SEQ ID NO: 3746900 - RNA, 16 nt, Human
ggaucaggcucccagg

SEQ ID NO: 3746901 - RNA, 19 nt, Human
ggaucaugaaaguagacag

SEQ ID NO: 3746902 - RNA, 19 nt, Human
ggaucaugguguaauaaga

SEQ ID NO: 3746903 - RNA, 14 nt, Human
ggauccacaccugg

SEQ ID NO: 3746904 - RNA, 12 nt, Human
ggauccaggccc

SEQ ID NO: 3746905 - RNA, 17 nt, Human
ggauccaggccccuccc

SEQ ID NO: 3746906 - RNA, 21 nt, Human
ggaucccaagccuccugcugc

SEQ ID NO: 3746907 - RNA, 18 nt, Human
ggaucccucugggcacug

SEQ ID NO: 3746908 - RNA, 18 nt, Human
ggauccuagccuuauccu

SEQ ID NO: 3746909 - RNA, 20 nt, Human
ggauccuagccuuauccucu

SEQ ID NO: 3746910 - RNA, 13 nt, Human
ggauccugagcca

SEQ ID NO: 3746911 - RNA, 16 nt, Human
ggauccugagccagau

SEQ ID NO: 3746912 - RNA, 18 nt, Human
ggauccugagccagauuu

SEQ ID NO: 3746913 - RNA, 20 nt, Human
ggauccugagccagauuuca

SEQ ID NO: 3746914 - RNA, 16 nt, Human
ggauccuguguggaga

SEQ ID NO: 3746915 - RNA, 13 nt, Human
ggaucuaccagca

SEQ ID NO: 3746916 - RNA, 17 nt, Human
ggaucuaccuggaggga

SEQ ID NO: 3746917 - RNA, 17 nt, Human
ggaucucaccaggcagc

SEQ ID NO: 3746918 - RNA, 22 nt, Human
ggaucucaccaggcagccucug

SEQ ID NO: 3746919 - RNA, 15 nt, Human
ggaucucagcuuuga

SEQ ID NO: 3746920 - RNA, 16 nt, Human
ggaucucagcuuugag

SEQ ID NO: 3746921 - RNA, 10 nt, Human
ggaucucagg

SEQ ID NO: 3746922 - RNA, 17 nt, Human
ggaucucauuggacccu

SEQ ID NO: 3746923 - RNA, 24 nt, Human
ggaucucauuggacccuuccaugg

SEQ ID NO: 3746924 - RNA, 21 nt, Human
ggaucucccugagaugggcuu

SEQ ID NO: 3746925 - RNA, 13 nt, Human
ggaucucucagga

SEQ ID NO: 3746926 - RNA, 23 nt, Human
ggaucucucuagugauggucaga

SEQ ID NO: 3746927 - RNA, 17 nt, Human
ggaucugccccucccug

SEQ ID NO: 3746928 - RNA, 20 nt, Human
ggaucugccccucccugcuu

SEQ ID NO: 3746929 - RNA, 17 nt, Human
ggaucuggagaaccuca

SEQ ID NO: 3746930 - RNA, 19 nt, Human
ggaucugggacccuuuccu

SEQ ID NO: 3746931 - RNA, 15 nt, Human
ggaucugugcccaga

SEQ ID NO: 3746932 - RNA, 15 nt, Human
ggaucuucaauggcu

SEQ ID NO: 3746933 - RNA, 22 nt, Human
ggaucuugcauucccagugguc

SEQ ID NO: 3746934 - RNA, 15 nt, Human
ggaucuuuguggcca

SEQ ID NO: 3746935 - RNA, 18 nt, Human
ggaugaaugaggucccag

SEQ ID NO: 3746936 - RNA, 17 nt, Human
ggaugaauuguaaaagc

SEQ ID NO: 3746937 - RNA, 20 nt, Human
ggaugaauuguaaaagcaac

SEQ ID NO: 3746938 - RNA, 20 nt, Human
ggaugacaugucccuacacc

SEQ ID NO: 3746939 - RNA, 23 nt, Human
ggaugagaauuugagugcucuga

SEQ ID NO: 3746940 - RNA, 14 nt, Human
ggaugagagcccag

SEQ ID NO: 3746941 - RNA, 20 nt, Human
ggaugagagcccagagguaa

SEQ ID NO: 3746942 - RNA, 14 nt, Human
ggaugagcucccac

SEQ ID NO: 3746943 - RNA, 22 nt, Human
ggaugagcucccacaagccuga

SEQ ID NO: 3746944 - RNA, 17 nt, Human
ggaugaggugcugggag

SEQ ID NO: 3746945 - RNA, 16 nt, Human
ggaugauccccacgcc

SEQ ID NO: 3746946 - RNA, 21 nt, Human
ggaugauccccacgccacagc

SEQ ID NO: 3746947 - RNA, 22 nt, Human
ggaugauccccacgccacagcc

SEQ ID NO: 3746948 - RNA, 22 nt, Human
ggaugaucuaggaagacuuugg

SEQ ID NO: 3746949 - RNA, 20 nt, Human
ggaugauucagaaauuggaa

SEQ ID NO: 3746950 - RNA, 15 nt, Human
ggaugauuguacaga

SEQ ID NO: 3746951 - RNA, 13 nt, Human
ggaugauuuaagu

SEQ ID NO: 3746952 - RNA, 23 nt, Human
ggaugcacagaguuguuacauuu

SEQ ID NO: 3746953 - RNA, 16 nt, Human
ggaugcagagucagca

SEQ ID NO: 3746954 - RNA, 18 nt, Human
ggaugcagagucagcaga

SEQ ID NO: 3746955 - RNA, 16 nt, Human
ggaugcagccucacag

SEQ ID NO: 3746956 - RNA, 19 nt, Human
ggaugcagccucacagucc

SEQ ID NO: 3746957 - RNA, 15 nt, Human
ggaugcauuucucug

SEQ ID NO: 3746958 - RNA, 22 nt, Human
ggaugccaauauuaaaucugcu

SEQ ID NO: 3746959 - RNA, 19 nt, Human
ggaugccacuccucccucc

SEQ ID NO: 3746960 - RNA, 15 nt, Human
ggaugcccaaagaug

SEQ ID NO: 3746961 - RNA, 18 nt, Human
ggaugcccaaagaugcag

SEQ ID NO: 3746962 - RNA, 19 nt, Human
ggaugccugguggcagcug

SEQ ID NO: 3746963 - RNA, 20 nt, Human
ggaugccugguggcagcugc

SEQ ID NO: 3746964 - RNA, 21 nt, Human
ggaugcuccucccuucucuac

SEQ ID NO: 3746965 - RNA, 15 nt, Human
ggaugcuuguacaua

SEQ ID NO: 3746966 - RNA, 21 nt, Human
ggauggaggggugguccugac

SEQ ID NO: 3746967 - RNA, 22 nt, Human
ggauggcaggacgugggcuggg

SEQ ID NO: 3746968 - RNA, 13 nt, Human
ggauggccagugu

SEQ ID NO: 3746969 - RNA, 14 nt, Human
ggauggccaguguc

SEQ ID NO: 3746970 - RNA, 22 nt, Human
ggauggcccuucccacuggagg

SEQ ID NO: 3746971 - RNA, 23 nt, Human
ggauggcccuuccuccuccacca

SEQ ID NO: 3746972 - RNA, 18 nt, Human
ggauggccguggauggcc

SEQ ID NO: 3746973 - RNA, 16 nt, Human
ggauggccuggccagg

SEQ ID NO: 3746974 - RNA, 14 nt, Human
ggauggcuugucua

SEQ ID NO: 3746975 - RNA, 15 nt, Human
ggaugggaaggaggg

SEQ ID NO: 3746976 - RNA, 14 nt, Human
ggaugggccaccgc

SEQ ID NO: 3746977 - RNA, 20 nt, Human
ggaugggggaaauggugccu

SEQ ID NO: 3746978 - RNA, 22 nt, Human
ggaugggggaacucagauccag

SEQ ID NO: 3746979 - RNA, 16 nt, Human
ggaugggucagagcua

SEQ ID NO: 3746980 - RNA, 16 nt, Human
ggauggguggauggcc

SEQ ID NO: 3746981 - RNA, 20 nt, Human
ggaugguaguuuuuucaucu

SEQ ID NO: 3746982 - RNA, 19 nt, Human
ggauggucuuacagcaggc

SEQ ID NO: 3746983 - RNA, 18 nt, Human
ggauggugugccuuccag

SEQ ID NO: 3746984 - RNA, 17 nt, Human
ggauguaaacagugccu

SEQ ID NO: 3746985 - RNA, 18 nt, Human
ggauguaaacagugccug

SEQ ID NO: 3746986 - RNA, 20 nt, Human
ggauguaaacagugccugcu

SEQ ID NO: 3746987 - RNA, 21 nt, Human
ggauguacaaggacagccccu

SEQ ID NO: 3746988 - RNA, 18 nt, Human
ggauguauaugucaucuc

SEQ ID NO: 3746989 - RNA, 20 nt, Human
ggauguaugaauacagcagc

SEQ ID NO: 3746990 - RNA, 21 nt, Human
ggauguaugaauacagcagca

SEQ ID NO: 3746991 - RNA, 15 nt, Human
ggaugucacagggcc

SEQ ID NO: 3746992 - RNA, 13 nt, Human
ggaugucaccaau

SEQ ID NO: 3746993 - RNA, 18 nt, Human
ggaugucacucagaugga

SEQ ID NO: 3746994 - RNA, 15 nt, Human
ggauguccccagcag

SEQ ID NO: 3746995 - RNA, 20 nt, Human
ggaugucugccaauuuuugc

SEQ ID NO: 3746996 - RNA, 13 nt, Human
ggaugucugggcc

SEQ ID NO: 3746997 - RNA, 17 nt, Human
ggaugucuuccuuggag

SEQ ID NO: 3746998 - RNA, 22 nt, Human
ggaugugaauugccugcagaga

SEQ ID NO: 3746999 - RNA, 17 nt, Human
ggauguggcugcagcag

SEQ ID NO: 3747000 - RNA, 15 nt, Human
ggaugugggagggag

SEQ ID NO: 3747001 - RNA, 13 nt, Human
ggaugugggcagc

SEQ ID NO: 3747002 - RNA, 22 nt, Human
ggaugugggguccccaucaucc

SEQ ID NO: 3747003 - RNA, 18 nt, Human
ggauguuacucucuugca

SEQ ID NO: 3747004 - RNA, 23 nt, Human
ggauguuauuauccuugggggcu

SEQ ID NO: 3747005 - RNA, 20 nt, Human
ggauguucagcacugucccu

SEQ ID NO: 3747006 - RNA, 15 nt, Human
ggauguucugggaca

SEQ ID NO: 3747007 - RNA, 16 nt, Human
ggauguucugggacac

SEQ ID NO: 3747008 - RNA, 14 nt, Human
ggauguugcucaga

SEQ ID NO: 3747009 - RNA, 23 nt, Human
ggauguuuuaauuccaugaaucg

SEQ ID NO: 3747010 - RNA, 18 nt, Human
ggauguuuuucaugaaaa

SEQ ID NO: 3747011 - RNA, 23 nt, Human
ggauuaaacuuaaucuaaaugga

SEQ ID NO: 3747012 - RNA, 15 nt, Human
ggauuaauaugaaaa

SEQ ID NO: 3747013 - RNA, 15 nt, Human
ggauuacccaagcaa

SEQ ID NO: 3747014 - RNA, 21 nt, Human
ggauuagguuucagcagagcu

SEQ ID NO: 3747015 - RNA, 17 nt, Human
ggauuaguuuagaacag

SEQ ID NO: 3747016 - RNA, 15 nt, Human
ggauuauaaucagaa

SEQ ID NO: 3747017 - RNA, 19 nt, Human
ggauuauucauuuaaaaug

SEQ ID NO: 3747018 - RNA, 19 nt, Human
ggauuauuuaauaacauua

SEQ ID NO: 3747019 - RNA, 19 nt, Human
ggauuauuuuuucagaccg

SEQ ID NO: 3747020 - RNA, 20 nt, Human
ggauucacaccccaccugcg

SEQ ID NO: 3747021 - RNA, 23 nt, Human
ggauucagccuucuuuuucugga

SEQ ID NO: 3747022 - RNA, 21 nt, Human
ggauucaggaauguguggccu

SEQ ID NO: 3747023 - RNA, 22 nt, Human
ggauucauugucucucacagau

SEQ ID NO: 3747024 - RNA, 18 nt, Human
ggauucuccuuuuuaccc

SEQ ID NO: 3747025 - RNA, 16 nt, Human
ggauucucuaaccuuu

SEQ ID NO: 3747026 - RNA, 21 nt, Human
ggauucugaggcccugcccaa

SEQ ID NO: 3747027 - RNA, 13 nt, Human
ggauucugggagg

SEQ ID NO: 3747028 - RNA, 16 nt, Human
ggauucuuauggacaa

SEQ ID NO: 3747029 - RNA, 19 nt, Human
ggauucuuguuuugcuucc

SEQ ID NO: 3747030 - RNA, 12 nt, Human
ggauucuuuaaa

SEQ ID NO: 3747031 - RNA, 14 nt, Human
ggauugaagcccuc

SEQ ID NO: 3747032 - RNA, 13 nt, Human
ggauugacaguaa

SEQ ID NO: 3747033 - RNA, 16 nt, Human
ggauugacaguaacuu

SEQ ID NO: 3747034 - RNA, 13 nt, Human
ggauugagucugu

SEQ ID NO: 3747035 - RNA, 18 nt, Human
ggauugauuaugcagaau

SEQ ID NO: 3747036 - RNA, 17 nt, Human
ggauugcgagagaugug

SEQ ID NO: 3747037 - RNA, 14 nt, Human
ggauugcugccacu

SEQ ID NO: 3747038 - RNA, 15 nt, Human
ggauugcugccacuu

SEQ ID NO: 3747039 - RNA, 17 nt, Human
ggauugcuugagcccag

SEQ ID NO: 3747040 - RNA, 22 nt, Human
ggauuggauuauuuaauaacau

SEQ ID NO: 3747041 - RNA, 19 nt, Human
ggauuggggaagacugugg

SEQ ID NO: 3747042 - RNA, 14 nt, Human
ggauugggggcugg

SEQ ID NO: 3747043 - RNA, 18 nt, Human
ggauugggggcuggugcc

SEQ ID NO: 3747044 - RNA, 23 nt, Human
ggauuguaaaaaaaaaugccuuu

SEQ ID NO: 3747045 - RNA, 16 nt, Human
ggauuguccccgaccc

SEQ ID NO: 3747046 - RNA, 23 nt, Human
ggauugugccuaauguguuugag

SEQ ID NO: 3747047 - RNA, 19 nt, Human
ggauuguuaauuucagucc

SEQ ID NO: 3747048 - RNA, 18 nt, Human
ggauuuaaaaacuggaac

SEQ ID NO: 3747049 - RNA, 14 nt, Human
ggauuuaauuucca

SEQ ID NO: 3747050 - RNA, 23 nt, Human
ggauuuagaagugucauguuuau

SEQ ID NO: 3747051 - RNA, 19 nt, Human
ggauuuauuuaaaauagca

SEQ ID NO: 3747052 - RNA, 13 nt, Human
ggauuucucccag

SEQ ID NO: 3747053 - RNA, 21 nt, Human
ggauuugaggagcagcuucag

SEQ ID NO: 3747054 - RNA, 14 nt, Human
ggauuuguucucug

SEQ ID NO: 3747055 - RNA, 15 nt, Human
ggauuuguugccaug

SEQ ID NO: 3747056 - RNA, 12 nt, Human
ggauuuucagcc

SEQ ID NO: 3747057 - RNA, 23 nt, Human
ggauuuuuguuuuguuuuuacaa

SEQ ID NO: 3747058 - RNA, 12 nt, Human
ggauuuuuucca

SEQ ID NO: 3747059 - RNA, 21 nt, Human
cuuucuaguggucuuuguaag

SEQ ID NO: 3747060 - RNA, 21 nt, Human
cuuucuaguugaaaauaaagu

SEQ ID NO: 3747061 - RNA, 17 nt, Human
cuuucuauaauuuuaca

SEQ ID NO: 3747062 - RNA, 19 nt, Human
cuuucuaugcugcuuuuau

SEQ ID NO: 3747063 - RNA, 18 nt, Human
cuuucucaauaagccuca

SEQ ID NO: 3747064 - RNA, 22 nt, Human
cuuucucacuaaaucuuuuaua

SEQ ID NO: 3747065 - RNA, 22 nt, Human
cuuucucagccgcuucugacug

SEQ ID NO: 3747066 - RNA, 17 nt, Human
cuuucucaguuuucaua

SEQ ID NO: 3747067 - RNA, 20 nt, Human
cuuucucaguuuucauaagu

SEQ ID NO: 3747068 - RNA, 23 nt, Human
cuuucuccaaaguuauccagagg

SEQ ID NO: 3747069 - RNA, 14 nt, Human
cuuucuccagccag

SEQ ID NO: 3747070 - RNA, 19 nt, Human
cuuucuccagccagcaaug

SEQ ID NO: 3747071 - RNA, 20 nt, Human
cuuucuccagccagcaauga

SEQ ID NO: 3747072 - RNA, 19 nt, Human
cuuucucccaggccaggcu

SEQ ID NO: 3747073 - RNA, 14 nt, Human
cuuucuccccugcc

SEQ ID NO: 3747074 - RNA, 18 nt, Human
cuuucuccccugccccca

SEQ ID NO: 3747075 - RNA, 22 nt, Human
cuuucuccccugcccccaggac

SEQ ID NO: 3747076 - RNA, 24 nt, Human
cuuucuccccugcccccaggacug

SEQ ID NO: 3747077 - RNA, 12 nt, Human
cuuucuccuguu

SEQ ID NO: 3747078 - RNA, 20 nt, Human
cuuucuccuuagucuucuca

SEQ ID NO: 3747079 - RNA, 15 nt, Human
cuuucuccuugaaua

SEQ ID NO: 3747080 - RNA, 23 nt, Human
cuuucuccuuuguacuuugugcu

SEQ ID NO: 3747081 - RNA, 18 nt, Human
cuuucucgauuuuaucuu

SEQ ID NO: 3747082 - RNA, 17 nt, Human
cuuucucuaauaauaaa

SEQ ID NO: 3747083 - RNA, 13 nt, Human
cuuucucuacuuu

SEQ ID NO: 3747084 - RNA, 16 nt, Human
cuuucucuccuuucuu

SEQ ID NO: 3747085 - RNA, 17 nt, Human
cuuucucuccuuucuuu

SEQ ID NO: 3747086 - RNA, 22 nt, Human
cuuucucucuuuauacagcugu

SEQ ID NO: 3747087 - RNA, 18 nt, Human
cuuucucugccagugaca

SEQ ID NO: 3747088 - RNA, 12 nt, Human
cuuucucugcuu

SEQ ID NO: 3747089 - RNA, 14 nt, Human
cuuucucugcuuca

SEQ ID NO: 3747090 - RNA, 19 nt, Human
cuuucucuuuucucuuuuu

SEQ ID NO: 3747091 - RNA, 13 nt, Human
cuuucugaaauaa

SEQ ID NO: 3747092 - RNA, 14 nt, Human
cuuucugaacagcu

SEQ ID NO: 3747093 - RNA, 20 nt, Human
cuuucugagugccuucugug

SEQ ID NO: 3747094 - RNA, 17 nt, Human
cuuucugaucuucacua

SEQ ID NO: 3747095 - RNA, 15 nt, Human
cuuucugcagaaaca

SEQ ID NO: 3747096 - RNA, 19 nt, Human
cuuucugcaguuuuucagg

SEQ ID NO: 3747097 - RNA, 20 nt, Human
cuuucugcaguuuuucagga

SEQ ID NO: 3747098 - RNA, 21 nt, Human
cuuucugccaucuagccagcc

SEQ ID NO: 3747099 - RNA, 22 nt, Human
cuuucugccaucuagccagccc

SEQ ID NO: 3747100 - RNA, 15 nt, Human
cuuucugccucucaa

SEQ ID NO: 3747101 - RNA, 11 nt, Human
cuuucugccug

SEQ ID NO: 3747102 - RNA, 13 nt, Human
cuuucugcucagc

SEQ ID NO: 3747103 - RNA, 19 nt, Human
cuuucugcucagcuucucc

SEQ ID NO: 3747104 - RNA, 18 nt, Human
cuuucuggcagguccucc

SEQ ID NO: 3747105 - RNA, 18 nt, Human
cuuucuggcuaugcauuu

SEQ ID NO: 3747106 - RNA, 18 nt, Human
cuuucugggguuuuucug

SEQ ID NO: 3747107 - RNA, 13 nt, Human
cuuucuguaaacu

SEQ ID NO: 3747108 - RNA, 13 nt, Human
cuuucuguauaua

SEQ ID NO: 3747109 - RNA, 16 nt, Human
cuuucuguauugagua

SEQ ID NO: 3747110 - RNA, 14 nt, Human
cuuucugugcccua

SEQ ID NO: 3747111 - RNA, 15 nt, Human
cuuucuguuaaaaug

SEQ ID NO: 3747112 - RNA, 19 nt, Human
cuuucuguuaaaaugcaug

SEQ ID NO: 3747113 - RNA, 12 nt, Human
cuuucuguucca

SEQ ID NO: 3747114 - RNA, 13 nt, Human
cuuucuguuccaa

SEQ ID NO: 3747115 - RNA, 20 nt, Human
cuuucuguuccaaauucagu

SEQ ID NO: 3747116 - RNA, 23 nt, Human
cuuucuguuccaaauucaguuuc

SEQ ID NO: 3747117 - RNA, 13 nt, Human
cuuucuguugcca

SEQ ID NO: 3747118 - RNA, 21 nt, Human
cuuucuguugucauugcuguu

SEQ ID NO: 3747119 - RNA, 21 nt, Human
cuuucuuauaauacucuguug

SEQ ID NO: 3747120 - RNA, 11 nt, Human
cuuucuuccuc

SEQ ID NO: 3747121 - RNA, 13 nt, Human
cuuucuuccucug

SEQ ID NO: 3747122 - RNA, 14 nt, Human
cuuucuuccucugc

SEQ ID NO: 3747123 - RNA, 12 nt, Human
cuuucuucuccc

SEQ ID NO: 3747124 - RNA, 14 nt, Human
cuuucuucucugcu

SEQ ID NO: 3747125 - RNA, 22 nt, Human
cuuucuugaucaacaucuuuuc

SEQ ID NO: 3747126 - RNA, 14 nt, Human
cuuucuugcucccu

SEQ ID NO: 3747127 - RNA, 19 nt, Human
cuuucuugcucccugacug

SEQ ID NO: 3747128 - RNA, 20 nt, Human
cuuucuugguucauaaauga

SEQ ID NO: 3747129 - RNA, 17 nt, Human
cuuucuuuaaaguucuu

SEQ ID NO: 3747130 - RNA, 15 nt, Human
cuuucuuuaaauguu

SEQ ID NO: 3747131 - RNA, 13 nt, Human
cuuucuuuaaauu

SEQ ID NO: 3747132 - RNA, 15 nt, Human
cuuucuuuaccugag

SEQ ID NO: 3747133 - RNA, 15 nt, Human
cuuucuuuauuuuga

SEQ ID NO: 3747134 - RNA, 17 nt, Human
cuuucuuugauucuccu

SEQ ID NO: 3747135 - RNA, 18 nt, Human
cuuucuuugggaauauuu

SEQ ID NO: 3747136 - RNA, 21 nt, Human
cuuucuuugggaauauuugaa

SEQ ID NO: 3747137 - RNA, 13 nt, Human
cuuucuuuggugc

SEQ ID NO: 3747138 - RNA, 23 nt, Human
cuuucuuuggugccuuuccuguu

SEQ ID NO: 3747139 - RNA, 21 nt, Human
cuuucuuuucgccguggcugc

SEQ ID NO: 3747140 - RNA, 11 nt, Human
cuuucuuuucu

SEQ ID NO: 3747141 - RNA, 10 nt, Human
cuuucuuuuu

SEQ ID NO: 3747142 - RNA, 20 nt, Human
cuuucuuuuucuucuucccu

SEQ ID NO: 3747143 - RNA, 16 nt, Human
cuuucuuuuuguagcu

SEQ ID NO: 3747144 - RNA, 18 nt, Human
cuuucuuuuuuggccauc

SEQ ID NO: 3747145 - RNA, 19 nt, Human
cuuucuuuuuuggccaucu

SEQ ID NO: 3747146 - RNA, 16 nt, Human
cuuucuuuuuuucccc

SEQ ID NO: 3747147 - RNA, 17 nt, Human
cuuugaaaaaaaauaaa

SEQ ID NO: 3747148 - RNA, 23 nt, Human
cuuugaaaaaucacuugauucau

SEQ ID NO: 3747149 - RNA, 13 nt, Human
cuuugaaacagaa

SEQ ID NO: 3747150 - RNA, 21 nt, Human
cuuugaaagacuuccaaagaa

SEQ ID NO: 3747151 - RNA, 20 nt, Human
cuuugaaagccccagaaauc

SEQ ID NO: 3747152 - RNA, 16 nt, Human
cuuugaaauaccucau

SEQ ID NO: 3747153 - RNA, 20 nt, Human
cuuugaaauaccucauguuu

SEQ ID NO: 3747154 - RNA, 19 nt, Human
cuuugaaauagucugugug

SEQ ID NO: 3747155 - RNA, 21 nt, Human
cuuugaaauagucugugugaa

SEQ ID NO: 3747156 - RNA, 23 nt, Human
cuuugaaauauauggucuaaugu

SEQ ID NO: 3747157 - RNA, 16 nt, Human
cuuugaaaugaauaua

SEQ ID NO: 3747158 - RNA, 14 nt, Human
cuuugaaauguguu

SEQ ID NO: 3747159 - RNA, 20 nt, Human
cuuugaaauuauguaaauua

SEQ ID NO: 3747160 - RNA, 18 nt, Human
cuuugaaauugaaccuuu

SEQ ID NO: 3747161 - RNA, 13 nt, Human
cuuugaagccuca

SEQ ID NO: 3747162 - RNA, 21 nt, Human
cuuugaaguuagcuuuaacuu

SEQ ID NO: 3747163 - RNA, 17 nt, Human
cuuugaauaaaaaugca

SEQ ID NO: 3747164 - RNA, 18 nt, Human
cuuugaauccucucucug

SEQ ID NO: 3747165 - RNA, 13 nt, Human
cuuugaaugcuuu

SEQ ID NO: 3747166 - RNA, 16 nt, Human
cuuugaaugcuuuuug

SEQ ID NO: 3747167 - RNA, 14 nt, Human
cuuugaauguuaau

SEQ ID NO: 3747168 - RNA, 11 nt, Human
cuuugaauuuu

SEQ ID NO: 3747169 - RNA, 18 nt, Human
cuuugaauuuucauuuua

SEQ ID NO: 3747170 - RNA, 19 nt, Human
cuuugaauuuucauuuuac

SEQ ID NO: 3747171 - RNA, 21 nt, Human
cuuugaauuuucauuuuacag

SEQ ID NO: 3747172 - RNA, 17 nt, Human
cuuugacaaagguaaau

SEQ ID NO: 3747173 - RNA, 19 nt, Human
cuuugacaaagguaaauca

SEQ ID NO: 3747174 - RNA, 20 nt, Human
cuuugacagcgcacagcugc

SEQ ID NO: 3747175 - RNA, 22 nt, Human
cuuugacagcgcacagcugcuc

SEQ ID NO: 3747176 - RNA, 14 nt, Human
cuuugacauuuaau

SEQ ID NO: 3747177 - RNA, 14 nt, Human
cuuugaccucugca

SEQ ID NO: 3747178 - RNA, 15 nt, Human
cuuugaccucugcag

SEQ ID NO: 3747179 - RNA, 18 nt, Human
cuuugaccucugcagcaa

SEQ ID NO: 3747180 - RNA, 20 nt, Human
cuuugaccugccucccuuca

SEQ ID NO: 3747181 - RNA, 23 nt, Human
cuuugaccugccucccuucaugc

SEQ ID NO: 3747182 - RNA, 17 nt, Human
cuuugacgccaucccag

SEQ ID NO: 3747183 - RNA, 21 nt, Human
cuuugacgccaucccagcccc

SEQ ID NO: 3747184 - RNA, 16 nt, Human
cuuugacucaccuguu

SEQ ID NO: 3747185 - RNA, 17 nt, Human
cuuugacuuuuugcauu

SEQ ID NO: 3747186 - RNA, 17 nt, Human
cuuugagaagccuucag

SEQ ID NO: 3747187 - RNA, 16 nt, Human
cuuugagacaguuucu

SEQ ID NO: 3747188 - RNA, 18 nt, Human
cuuugagagagaaaggac

SEQ ID NO: 3747189 - RNA, 18 nt, Human
cuuugagauagaagaacu

SEQ ID NO: 3747190 - RNA, 16 nt, Human
cuuugagaucuaaaaa

SEQ ID NO: 3747191 - RNA, 22 nt, Human
cuuugagaucuaaaaauaacug

SEQ ID NO: 3747192 - RNA, 17 nt, Human
cuuugagccugggaaau

SEQ ID NO: 3747193 - RNA, 22 nt, Human
cuuugagcuacugccgucagug

SEQ ID NO: 3747194 - RNA, 16 nt, Human
cuuugagcuuaagaau

SEQ ID NO: 3747195 - RNA, 14 nt, Human
cuuugagggacugc

SEQ ID NO: 3747196 - RNA, 16 nt, Human
cuuugagggacugccu

SEQ ID NO: 3747197 - RNA, 20 nt, Human
cuuugagggacugccucugc

SEQ ID NO: 3747198 - RNA, 21 nt, Human
cuuugagggacugccucugcc

SEQ ID NO: 3747199 - RNA, 23 nt, Human
cuuugaguagauccauuuccauu

SEQ ID NO: 3747200 - RNA, 19 nt, Human
cuuugagucccccagagau

SEQ ID NO: 3747201 - RNA, 19 nt, Human
cuuugaguuaagucuaucu

SEQ ID NO: 3747202 - RNA, 16 nt, Human
cuuugaguuuccucag

SEQ ID NO: 3747203 - RNA, 22 nt, Human
cuuugaguuuccucaggcugcu

SEQ ID NO: 3747204 - RNA, 14 nt, Human
cuuugauaaaauaa

SEQ ID NO: 3747205 - RNA, 18 nt, Human
cuuugauaaaauaaauga

SEQ ID NO: 3747206 - RNA, 14 nt, Human
cuuugauaauguua

SEQ ID NO: 3747207 - RNA, 15 nt, Human
cuuugauaauguuaa

SEQ ID NO: 3747208 - RNA, 16 nt, Human
cuuugauaauguuaaa

SEQ ID NO: 3747209 - RNA, 17 nt, Human
ggaaccccuuucccacc

SEQ ID NO: 3747210 - RNA, 23 nt, Human
ggaaccgagggggcugcucccac

SEQ ID NO: 3747211 - RNA, 16 nt, Human
ggaaccguaggaccca

SEQ ID NO: 3747212 - RNA, 12 nt, Human
ggaaccucacuc

SEQ ID NO: 3747213 - RNA, 21 nt, Human
ggaaccucaggguauugcuug

SEQ ID NO: 3747214 - RNA, 13 nt, Human
ggaaccucccaga

SEQ ID NO: 3747215 - RNA, 16 nt, Human
ggaaccuccccagccu

SEQ ID NO: 3747216 - RNA, 17 nt, Human
ggaaccuccccagccug

SEQ ID NO: 3747217 - RNA, 16 nt, Human
ggaaccucgaguacug

SEQ ID NO: 3747218 - RNA, 17 nt, Human
ggaaccucgaguacugu

SEQ ID NO: 3747219 - RNA, 22 nt, Human
ggaaccucgaguacugugggca

SEQ ID NO: 3747220 - RNA, 19 nt, Human
ggaaccuuccuuccugcuu

SEQ ID NO: 3747221 - RNA, 15 nt, Human
ggaaccuugcugucc

SEQ ID NO: 3747222 - RNA, 17 nt, Human
ggaaccuugcuguccug

SEQ ID NO: 3747223 - RNA, 14 nt, Human
ggaacgacugggca

SEQ ID NO: 3747224 - RNA, 15 nt, Human
ggaacgaugugucug

SEQ ID NO: 3747225 - RNA, 13 nt, Human
ggaacgcagauga

SEQ ID NO: 3747226 - RNA, 13 nt, Human
ggaacgcccacuu

SEQ ID NO: 3747227 - RNA, 19 nt, Human
ggaacgcccacuucccugg

SEQ ID NO: 3747228 - RNA, 23 nt, Human
ggaacguagucggcacagccugg

SEQ ID NO: 3747229 - RNA, 14 nt, Human
ggaacuaauaaaua

SEQ ID NO: 3747230 - RNA, 18 nt, Human
ggaacuagacugccuggg

SEQ ID NO: 3747231 - RNA, 21 nt, Human
ggaacuagagggauacacuga

SEQ ID NO: 3747232 - RNA, 15 nt, Human
ggaacucagauccag

SEQ ID NO: 3747233 - RNA, 16 nt, Human
ggaacucagauccagg

SEQ ID NO: 3747234 - RNA, 22 nt, Human
ggaacuccuaaaccuuugcccc

SEQ ID NO: 3747235 - RNA, 17 nt, Human
ggaacuccuuggccuag

SEQ ID NO: 3747236 - RNA, 13 nt, Human
ggaacucugacaa

SEQ ID NO: 3747237 - RNA, 14 nt, Human
ggaacucugacaag

SEQ ID NO: 3747238 - RNA, 21 nt, Human
ggaacucugacaagggcugac

SEQ ID NO: 3747239 - RNA, 21 nt, Human
ggaacugaagggggcggccua

SEQ ID NO: 3747240 - RNA, 14 nt, Human
ggaacugcagaccu

SEQ ID NO: 3747241 - RNA, 15 nt, Human
ggaacugcagaccug

SEQ ID NO: 3747242 - RNA, 15 nt, Human
ggaacugcugccacu

SEQ ID NO: 3747243 - RNA, 16 nt, Human
ggaacugcugccacug

SEQ ID NO: 3747244 - RNA, 21 nt, Human
ggaacugcugccacugagggg

SEQ ID NO: 3747245 - RNA, 14 nt, Human
ggaacuggccaagc

SEQ ID NO: 3747246 - RNA, 19 nt, Human
ggaacuggccaagcugagg

SEQ ID NO: 3747247 - RNA, 14 nt, Human
ggaacuguccagag

SEQ ID NO: 3747248 - RNA, 14 nt, Human
ggaacuucagagau

SEQ ID NO: 3747249 - RNA, 18 nt, Human
ggaacuugaacugauuca

SEQ ID NO: 3747250 - RNA, 22 nt, Human
ggaacuuggggaguuaagaccu

SEQ ID NO: 3747251 - RNA, 11 nt, Human
ggaacuugucu

SEQ ID NO: 3747252 - RNA, 18 nt, Human
ggaacuugucucuucauc

SEQ ID NO: 3747253 - RNA, 23 nt, Human
ggaagaaaaaaaucuucuccaga

SEQ ID NO: 3747254 - RNA, 12 nt, Human
ggaagaaacaaa

SEQ ID NO: 3747255 - RNA, 21 nt, Human
ggaagaacggggcucuucuca

SEQ ID NO: 3747256 - RNA, 19 nt, Human
ggaagaagcuuaggcaggg

SEQ ID NO: 3747257 - RNA, 13 nt, Human
ggaagaagggaga

SEQ ID NO: 3747258 - RNA, 16 nt, Human
ggaagaagggagaaga

SEQ ID NO: 3747259 - RNA, 17 nt, Human
ggaagacaaaauguuuu

SEQ ID NO: 3747260 - RNA, 14 nt, Human
ggaagacaauguga

SEQ ID NO: 3747261 - RNA, 12 nt, Human
ggaagacagaga

SEQ ID NO: 3747262 - RNA, 23 nt, Human
ggaagacagagaccuccugccuc

SEQ ID NO: 3747263 - RNA, 14 nt, Human
ggaagacagcucuu

SEQ ID NO: 3747264 - RNA, 14 nt, Human
ggaagacaguggcc

SEQ ID NO: 3747265 - RNA, 23 nt, Human
ggaagacaguucuacagaaaaac

SEQ ID NO: 3747266 - RNA, 15 nt, Human
ggaagacauuucuuu

SEQ ID NO: 3747267 - RNA, 15 nt, Human
ggaagaccccaccca

SEQ ID NO: 3747268 - RNA, 19 nt, Human
ggaagaccccacccaagcu

SEQ ID NO: 3747269 - RNA, 15 nt, Human
ggaagacgccugagc

SEQ ID NO: 3747270 - RNA, 13 nt, Human
ggaagagaaacag

SEQ ID NO: 3747271 - RNA, 17 nt, Human
ggaagagaaggagcaga

SEQ ID NO: 3747272 - RNA, 17 nt, Human
ggaagagaggaguucaa

SEQ ID NO: 3747273 - RNA, 18 nt, Human
ggaagagaggaguucaau

SEQ ID NO: 3747274 - RNA, 20 nt, Human
ggaagagaggaguucaauga

SEQ ID NO: 3747275 - RNA, 22 nt, Human
ggaagagaggaguucaaugauc

SEQ ID NO: 3747276 - RNA, 14 nt, Human
ggaagagcacagcc

SEQ ID NO: 3747277 - RNA, 17 nt, Human
ggaagagcagcaccucc

SEQ ID NO: 3747278 - RNA, 22 nt, Human
ggaagagcagcaccuccucagc

SEQ ID NO: 3747279 - RNA, 20 nt, Human
ggaagagcccagucuguuga

SEQ ID NO: 3747280 - RNA, 13 nt, Human
ggaagaggccugu

SEQ ID NO: 3747281 - RNA, 23 nt, Human
ggaagaggccuguuuggccucuc

SEQ ID NO: 3747282 - RNA, 19 nt, Human
ggaagagugacucuccagg

SEQ ID NO: 3747283 - RNA, 16 nt, Human
ggaagaguguacuggg

SEQ ID NO: 3747284 - RNA, 16 nt, Human
ggaagauaaguuggaa

SEQ ID NO: 3747285 - RNA, 17 nt, Human
ggaagauaggcucugca

SEQ ID NO: 3747286 - RNA, 18 nt, Human
ggaagauggggaccagca

SEQ ID NO: 3747287 - RNA, 18 nt, Human
ggaagaugggggcaagaa

SEQ ID NO: 3747288 - RNA, 19 nt, Human
ggaagaugggggcaagaag

SEQ ID NO: 3747289 - RNA, 14 nt, Human
ggaagauuucuaaa

SEQ ID NO: 3747290 - RNA, 20 nt, Human
ggaagauuugcccauuuaca

SEQ ID NO: 3747291 - RNA, 18 nt, Human
ggaagauuuuaaauucac

SEQ ID NO: 3747292 - RNA, 22 nt, Human
ggaagcaaaaacgaaagcuggg

SEQ ID NO: 3747293 - RNA, 15 nt, Human
ggaagcacaugccuc

SEQ ID NO: 3747294 - RNA, 21 nt, Human
ggaagcacaugccucucucag

SEQ ID NO: 3747295 - RNA, 13 nt, Human
ggaagcaccccau

SEQ ID NO: 3747296 - RNA, 22 nt, Human
ggaagcaccccaugccaaagcu

SEQ ID NO: 3747297 - RNA, 13 nt, Human
ggaagcagaauaa

SEQ ID NO: 3747298 - RNA, 15 nt, Human
ggaagcagaauaaag

SEQ ID NO: 3747299 - RNA, 21 nt, Human
ggaagcagaauaaagcaauuu

SEQ ID NO: 3747300 - RNA, 22 nt, Human
ggaagcagaauaaagcaauuuu

SEQ ID NO: 3747301 - RNA, 12 nt, Human
ggaagcagcagc

SEQ ID NO: 3747302 - RNA, 22 nt, Human
ggaagcagguuaaauguuuugu

SEQ ID NO: 3747303 - RNA, 11 nt, Human
ggaagcagugc

SEQ ID NO: 3747304 - RNA, 12 nt, Human
ggaagcagugcc

SEQ ID NO: 3747305 - RNA, 21 nt, Human
ggaagcagugccuuccauaau

SEQ ID NO: 3747306 - RNA, 16 nt, Human
ggaagcauucagagag

SEQ ID NO: 3747307 - RNA, 14 nt, Human
ggaagccaaagagu

SEQ ID NO: 3747308 - RNA, 15 nt, Human
ggaagccaaauuuau

SEQ ID NO: 3747309 - RNA, 21 nt, Human
ggaagccacccucccagcucu

SEQ ID NO: 3747310 - RNA, 23 nt, Human
ggaagccacccucccagcucuga

SEQ ID NO: 3747311 - RNA, 14 nt, Human
ggaagccagcaggc

SEQ ID NO: 3747312 - RNA, 17 nt, Human
ggaagccagcaggcucu

SEQ ID NO: 3747313 - RNA, 20 nt, Human
ggaagccagcaggcucucag

SEQ ID NO: 3747314 - RNA, 22 nt, Human
ggaagccagcaggcucucaggc

SEQ ID NO: 3747315 - RNA, 16 nt, Human
ggaagccagcuuuccc

SEQ ID NO: 3747316 - RNA, 21 nt, Human
ggaagcccccaccgugggcag

SEQ ID NO: 3747317 - RNA, 18 nt, Human
ggaagccccugggcccag

SEQ ID NO: 3747318 - RNA, 19 nt, Human
ggaagccccugggcccagu

SEQ ID NO: 3747319 - RNA, 11 nt, Human
ggaagcccucc

SEQ ID NO: 3747320 - RNA, 12 nt, Human
ggaagcccuccu

SEQ ID NO: 3747321 - RNA, 15 nt, Human
ggaagcccuccuucc

SEQ ID NO: 3747322 - RNA, 16 nt, Human
ggaagcccuccuucca

SEQ ID NO: 3747323 - RNA, 12 nt, Human
ggaagcccugga

SEQ ID NO: 3747324 - RNA, 15 nt, Human
ggaagccgcuggggc

SEQ ID NO: 3747325 - RNA, 20 nt, Human
ggaagccggaggguguuuau

SEQ ID NO: 3747326 - RNA, 16 nt, Human
ggaagccggcggccca

SEQ ID NO: 3747327 - RNA, 20 nt, Human
ggaagccggcggcccaagcc

SEQ ID NO: 3747328 - RNA, 22 nt, Human
ggaagccucagauuccuuccca

SEQ ID NO: 3747329 - RNA, 21 nt, Human
ggacuaagccuaccugcucuc

SEQ ID NO: 3747330 - RNA, 14 nt, Human
ggacuacaggugug

SEQ ID NO: 3747331 - RNA, 14 nt, Human
ggacuagccccugu

SEQ ID NO: 3747332 - RNA, 22 nt, Human
ggacuagccccuguggagacug

SEQ ID NO: 3747333 - RNA, 16 nt, Human
ggacucaaugcacuga

SEQ ID NO: 3747334 - RNA, 21 nt, Human
ggacucacagguuggaagaga

SEQ ID NO: 3747335 - RNA, 16 nt, Human
ggacucacuggcagcc

SEQ ID NO: 3747336 - RNA, 23 nt, Human
ggacucacuggcagccccagcac

SEQ ID NO: 3747337 - RNA, 15 nt, Human
ggacucacuugccca

SEQ ID NO: 3747338 - RNA, 17 nt, Human
ggacucagcuccccaga

SEQ ID NO: 3747339 - RNA, 15 nt, Human
ggacucagggcagcg

SEQ ID NO: 3747340 - RNA, 16 nt, Human
ggacucaucuuucccu

SEQ ID NO: 3747341 - RNA, 19 nt, Human
ggacucaucuuucccuccu

SEQ ID NO: 3747342 - RNA, 23 nt, Human
ggacucaucuuucccuccuuggu

SEQ ID NO: 3747343 - RNA, 24 nt, Human
ggacucauuucauuccuaacacag

SEQ ID NO: 3747344 - RNA, 14 nt, Human
ggacuccaggccca

SEQ ID NO: 3747345 - RNA, 15 nt, Human
ggacuccaggcccaa

SEQ ID NO: 3747346 - RNA, 22 nt, Human
ggacuccaggcccaaggcuccc

SEQ ID NO: 3747347 - RNA, 16 nt, Human
ggacuccggcugugcu

SEQ ID NO: 3747348 - RNA, 21 nt, Human
ggacuccuccccacccuccug

SEQ ID NO: 3747349 - RNA, 23 nt, Human
ggacuccuccccacccuccuggc

SEQ ID NO: 3747350 - RNA, 15 nt, Human
ggacuccucugucca

SEQ ID NO: 3747351 - RNA, 16 nt, Human
ggacuccugaaaaaaa

SEQ ID NO: 3747352 - RNA, 14 nt, Human
ggacucgcuuguaa

SEQ ID NO: 3747353 - RNA, 11 nt, Human
ggacucugagg

SEQ ID NO: 3747354 - RNA, 21 nt, Human
ggacucugaggcucuuucugg

SEQ ID NO: 3747355 - RNA, 11 nt, Human
ggacucugccu

SEQ ID NO: 3747356 - RNA, 17 nt, Human
ggacucugggguuuuua

SEQ ID NO: 3747357 - RNA, 18 nt, Human
ggacucuggugccuccag

SEQ ID NO: 3747358 - RNA, 14 nt, Human
ggacucuguccuga

SEQ ID NO: 3747359 - RNA, 21 nt, Human
ggacucuguccugaaggccug

SEQ ID NO: 3747360 - RNA, 16 nt, Human
ggacucuugcucuuuc

SEQ ID NO: 3747361 - RNA, 18 nt, Human
ggacugaaaaccucuccu

SEQ ID NO: 3747362 - RNA, 17 nt, Human
ggacugaagccugcagg

SEQ ID NO: 3747363 - RNA, 19 nt, Human
ggacugaagccugcaggag

SEQ ID NO: 3747364 - RNA, 19 nt, Human
ggacugaauuguccccagu

SEQ ID NO: 3747365 - RNA, 13 nt, Human
ggacugacagcau

SEQ ID NO: 3747366 - RNA, 17 nt, Human
ggacugacugaggcagu

SEQ ID NO: 3747367 - RNA, 12 nt, Human
ggacugagccag

SEQ ID NO: 3747368 - RNA, 17 nt, Human
ggacugagccaguccca

SEQ ID NO: 3747369 - RNA, 12 nt, Human
ggacugagcccc

SEQ ID NO: 3747370 - RNA, 15 nt, Human
ggacugagccccgca

SEQ ID NO: 3747371 - RNA, 13 nt, Human
ggacugagccugg

SEQ ID NO: 3747372 - RNA, 13 nt, Human
ggacugaggccug

SEQ ID NO: 3747373 - RNA, 17 nt, Human
ggacugagugggaagcc

SEQ ID NO: 3747374 - RNA, 18 nt, Human
ggacugagugggaagccc

SEQ ID NO: 3747375 - RNA, 22 nt, Human
ggacugcaagcagggcucugcc

SEQ ID NO: 3747376 - RNA, 22 nt, Human
ggacugcacagcguccugucca

SEQ ID NO: 3747377 - RNA, 10 nt, Human
ggacugccac

SEQ ID NO: 3747378 - RNA, 11 nt, Human
ggacugccacc

SEQ ID NO: 3747379 - RNA, 14 nt, Human
ggacugccaccucc

SEQ ID NO: 3747380 - RNA, 17 nt, Human
ggacugccaccuccccu

SEQ ID NO: 3747381 - RNA, 12 nt, Human
ggacugccucug

SEQ ID NO: 3747382 - RNA, 14 nt, Human
ggacugccucugcc

SEQ ID NO: 3747383 - RNA, 15 nt, Human
ggacugcggaggaag

SEQ ID NO: 3747384 - RNA, 16 nt, Human
ggacugcggaggaagg

SEQ ID NO: 3747385 - RNA, 23 nt, Human
ggacugcuaccuuucaaagcuug

SEQ ID NO: 3747386 - RNA, 20 nt, Human
ggacugcugcugccuggcca

SEQ ID NO: 3747387 - RNA, 14 nt, Human
ggacuggaaccagg

SEQ ID NO: 3747388 - RNA, 15 nt, Human
ggacuggaaccaggg

SEQ ID NO: 3747389 - RNA, 18 nt, Human
ggacuggaaccagggaga

SEQ ID NO: 3747390 - RNA, 22 nt, Human
ggacuggaaccagggagaccga

SEQ ID NO: 3747391 - RNA, 17 nt, Human
ggacuggaggccccugg

SEQ ID NO: 3747392 - RNA, 19 nt, Human
ggacuggcuagaguccuca

SEQ ID NO: 3747393 - RNA, 20 nt, Human
ggacuggcuagaguccucac

SEQ ID NO: 3747394 - RNA, 17 nt, Human
ggacugggaacagaacu

SEQ ID NO: 3747395 - RNA, 19 nt, Human
ggacugggagcccccagcc

SEQ ID NO: 3747396 - RNA, 20 nt, Human
ggacugggagcccccagccu

SEQ ID NO: 3747397 - RNA, 13 nt, Human
ggacuggguuugg

SEQ ID NO: 3747398 - RNA, 18 nt, Human
ggacuggguuuggacccc

SEQ ID NO: 3747399 - RNA, 19 nt, Human
ggcauuguaucugucuuuc

SEQ ID NO: 3747400 - RNA, 16 nt, Human
ggcauuucccacccug

SEQ ID NO: 3747401 - RNA, 11 nt, Human
ggcauuuccua

SEQ ID NO: 3747402 - RNA, 19 nt, Human
ggcauuuguaaauauuaaa

SEQ ID NO: 3747403 - RNA, 18 nt, Human
ggcauuuuacuguacaga

SEQ ID NO: 3747404 - RNA, 15 nt, Human
ggcauuuuuauuuua

SEQ ID NO: 3747405 - RNA, 15 nt, Human
ggccaaaagcuuccc

SEQ ID NO: 3747406 - RNA, 14 nt, Human
ggccaaaaggaaaa

SEQ ID NO: 3747407 - RNA, 15 nt, Human
ggccaaacaggcccu

SEQ ID NO: 3747408 - RNA, 16 nt, Human
ggccaaaccucuguuc

SEQ ID NO: 3747409 - RNA, 20 nt, Human
ggccaaacucaccugccccu

SEQ ID NO: 3747410 - RNA, 11 nt, Human
ggccaaacugc

SEQ ID NO: 3747411 - RNA, 11 nt, Human
ggccaaagaac

SEQ ID NO: 3747412 - RNA, 13 nt, Human
ggccaaagacaaa

SEQ ID NO: 3747413 - RNA, 16 nt, Human
ggccaaagagucucca

SEQ ID NO: 3747414 - RNA, 12 nt, Human
ggccaaaggaag

SEQ ID NO: 3747415 - RNA, 13 nt, Human
ggccaaaggaagc

SEQ ID NO: 3747416 - RNA, 21 nt, Human
ggccaaaggagggucaggaag

SEQ ID NO: 3747417 - RNA, 21 nt, Human
ggccaaaggggaccuggaagg

SEQ ID NO: 3747418 - RNA, 22 nt, Human
ggccaaauauauucucuuuggu

SEQ ID NO: 3747419 - RNA, 22 nt, Human
ggccaaauccgcucucuuccug

SEQ ID NO: 3747420 - RNA, 12 nt, Human
ggccaacaaagc

SEQ ID NO: 3747421 - RNA, 15 nt, Human
ggccaacaaagcugu

SEQ ID NO: 3747422 - RNA, 16 nt, Human
ggccaacaaagcuguu

SEQ ID NO: 3747423 - RNA, 17 nt, Human
ggccaacauggcgaaac

SEQ ID NO: 3747424 - RNA, 17 nt, Human
ggccaaccccaaagaag

SEQ ID NO: 3747425 - RNA, 16 nt, Human
ggccaacccuucuccu

SEQ ID NO: 3747426 - RNA, 23 nt, Human
ggccaacccuucuccucuuguaa

SEQ ID NO: 3747427 - RNA, 21 nt, Human
ggccaacuugagggcccagag

SEQ ID NO: 3747428 - RNA, 22 nt, Human
ggccaacuugagggcccagagc

SEQ ID NO: 3747429 - RNA, 23 nt, Human
ggccaacuugagggcccagagca

SEQ ID NO: 3747430 - RNA, 17 nt, Human
ggccaagaauauugcaa

SEQ ID NO: 3747431 - RNA, 23 nt, Human
ggccaagacuuggcaacagaagc

SEQ ID NO: 3747432 - RNA, 23 nt, Human
ggccaagagaaaggccugcacac

SEQ ID NO: 3747433 - RNA, 20 nt, Human
ggccaagaguggccccaccu

SEQ ID NO: 3747434 - RNA, 21 nt, Human
ggccaagaguggccccaccug

SEQ ID NO: 3747435 - RNA, 20 nt, Human
ggccaagcugaggugcccag

SEQ ID NO: 3747436 - RNA, 13 nt, Human
ggccaaggagcug

SEQ ID NO: 3747437 - RNA, 15 nt, Human
ggccaaggagcugcu

SEQ ID NO: 3747438 - RNA, 19 nt, Human
ggccaaggccuucuccucc

SEQ ID NO: 3747439 - RNA, 13 nt, Human
ggccaauccccag

SEQ ID NO: 3747440 - RNA, 17 nt, Human
ggccacacaagugcagu

SEQ ID NO: 3747441 - RNA, 12 nt, Human
ggccacacagcu

SEQ ID NO: 3747442 - RNA, 20 nt, Human
ggccacagggcgagacuccg

SEQ ID NO: 3747443 - RNA, 19 nt, Human
ggccacaugggaggcucac

SEQ ID NO: 3747444 - RNA, 16 nt, Human
ggccacauggggcugg

SEQ ID NO: 3747445 - RNA, 17 nt, Human
ggccacauggggcuggg

SEQ ID NO: 3747446 - RNA, 13 nt, Human
ggccaccaaagcu

SEQ ID NO: 3747447 - RNA, 18 nt, Human
ggccaccaaagcugccca

SEQ ID NO: 3747448 - RNA, 20 nt, Human
ggccaccacgccuagccuca

SEQ ID NO: 3747449 - RNA, 14 nt, Human
ggccaccaggaugg

SEQ ID NO: 3747450 - RNA, 15 nt, Human
ggccaccaggcuggc

SEQ ID NO: 3747451 - RNA, 13 nt, Human
ggccaccucucca

SEQ ID NO: 3747452 - RNA, 14 nt, Human
ggccaccucuccaa

SEQ ID NO: 3747453 - RNA, 16 nt, Human
ggccaccucuuccugg

SEQ ID NO: 3747454 - RNA, 16 nt, Human
ggccaccugagguggg

SEQ ID NO: 3747455 - RNA, 19 nt, Human
ggccaccugaggugggccc

SEQ ID NO: 3747456 - RNA, 20 nt, Human
ggccaccugaggugggccca

SEQ ID NO: 3747457 - RNA, 14 nt, Human
ggccaccugcaggu

SEQ ID NO: 3747458 - RNA, 23 nt, Human
ggccaccugcccccuucucccac

SEQ ID NO: 3747459 - RNA, 22 nt, Human
ggccaccugcggugcuaucucc

SEQ ID NO: 3747460 - RNA, 18 nt, Human
ggccacgcagccaggaca

SEQ ID NO: 3747461 - RNA, 23 nt, Human
ggccacgugggcaaacaggcagu

SEQ ID NO: 3747462 - RNA, 16 nt, Human
ggccacguucuuacua

SEQ ID NO: 3747463 - RNA, 17 nt, Human
ggccacuccagaccccu

SEQ ID NO: 3747464 - RNA, 12 nt, Human
ggccacuccucc

SEQ ID NO: 3747465 - RNA, 14 nt, Human
ggccacuccuuccu

SEQ ID NO: 3747466 - RNA, 17 nt, Human
ggccacuccuuccugcc

SEQ ID NO: 3747467 - RNA, 20 nt, Human
ggccacuccuuccugcccca

SEQ ID NO: 3747468 - RNA, 22 nt, Human
ggccacucugccucugccugca

SEQ ID NO: 3747469 - RNA, 17 nt, Human
ggccacugaagaggagg

SEQ ID NO: 3747470 - RNA, 19 nt, Human
ggccacugaagaggaggag

SEQ ID NO: 3747471 - RNA, 15 nt, Human
ggccacugcacagag

SEQ ID NO: 3747472 - RNA, 20 nt, Human
ggccacugcucccuaagcca

SEQ ID NO: 3747473 - RNA, 15 nt, Human
ggccacuucugucca

SEQ ID NO: 3747474 - RNA, 21 nt, Human
ggccacuuuaagagagaaauc

SEQ ID NO: 3747475 - RNA, 21 nt, Human
ggccagaaaccuuccugcuga

SEQ ID NO: 3747476 - RNA, 15 nt, Human
ggccagaaguagcuu

SEQ ID NO: 3747477 - RNA, 18 nt, Human
ggccagacaugccacaag

SEQ ID NO: 3747478 - RNA, 11 nt, Human
ggccagagcca

SEQ ID NO: 3747479 - RNA, 14 nt, Human
ggccagagccaagg

SEQ ID NO: 3747480 - RNA, 13 nt, Human
ggccagagccagg

SEQ ID NO: 3747481 - RNA, 22 nt, Human
ggccagagcuacccgcagaguu

SEQ ID NO: 3747482 - RNA, 17 nt, Human
ggccagagcugggaggc

SEQ ID NO: 3747483 - RNA, 16 nt, Human
ggccagaggcccccag

SEQ ID NO: 3747484 - RNA, 19 nt, Human
ggccagaggcccccagccc

SEQ ID NO: 3747485 - RNA, 17 nt, Human
ggccagagggagugaca

SEQ ID NO: 3747486 - RNA, 18 nt, Human
ggccagauccagccuggg

SEQ ID NO: 3747487 - RNA, 21 nt, Human
ggccagaucuguuaagugguu

SEQ ID NO: 3747488 - RNA, 16 nt, Human
ggccagaugcaccagc

SEQ ID NO: 3747489 - RNA, 22 nt, Human
ggccagcaagguggaguggaug

SEQ ID NO: 3747490 - RNA, 15 nt, Human
ggccagccagccacu

SEQ ID NO: 3747491 - RNA, 12 nt, Human
ggccagccaggc

SEQ ID NO: 3747492 - RNA, 13 nt, Human
ggccagccaggcg

SEQ ID NO: 3747493 - RNA, 18 nt, Human
ggccagccccacagccca

SEQ ID NO: 3747494 - RNA, 13 nt, Human
ggccagccccacc

SEQ ID NO: 3747495 - RNA, 14 nt, Human
ggccagccccaccc

SEQ ID NO: 3747496 - RNA, 14 nt, Human
ggccagccccucca

SEQ ID NO: 3747497 - RNA, 16 nt, Human
ggccagccccucccac

SEQ ID NO: 3747498 - RNA, 15 nt, Human
ggccagccccuuaga

SEQ ID NO: 3747499 - RNA, 15 nt, Human
ggccagcccuggagg

SEQ ID NO: 3747500 - RNA, 21 nt, Human
ggccagccgcgcaucagacug

SEQ ID NO: 3747501 - RNA, 13 nt, Human
ggccagccgcucu

SEQ ID NO: 3747502 - RNA, 21 nt, Human
ggccagccgcucuccugccac

SEQ ID NO: 3747503 - RNA, 22 nt, Human
ggccagccuccgagagggagag

SEQ ID NO: 3747504 - RNA, 15 nt, Human
ggccagccuggccuc

SEQ ID NO: 3747505 - RNA, 16 nt, Human
ggccagccuggccucc

SEQ ID NO: 3747506 - RNA, 19 nt, Human
ggccagccuggccuccugc

SEQ ID NO: 3747507 - RNA, 22 nt, Human
ggccagccuggccuccugccuc

SEQ ID NO: 3747508 - RNA, 15 nt, Human
ggccagccuggggcc

SEQ ID NO: 3747509 - RNA, 12 nt, Human
ggccagcuccgc

SEQ ID NO: 3747510 - RNA, 17 nt, Human
ggccagcugcuugggcu

SEQ ID NO: 3747511 - RNA, 14 nt, Human
ggccagcuggcagc

SEQ ID NO: 3747512 - RNA, 20 nt, Human
ggccagcugggaucugacug

SEQ ID NO: 3747513 - RNA, 19 nt, Human
ggccaggaaguagcacagg

SEQ ID NO: 3747514 - RNA, 21 nt, Human
ggccaggaaguagcacaggcu

SEQ ID NO: 3747515 - RNA, 15 nt, Human
ggccaggacaggccc

SEQ ID NO: 3747516 - RNA, 15 nt, Human
ggccaggacucugca

SEQ ID NO: 3747517 - RNA, 21 nt, Human
ggccaggacucugcagccuca

SEQ ID NO: 3747518 - RNA, 13 nt, Human
ggccaggagcagg

SEQ ID NO: 3747519 - RNA, 13 nt, Human
ggccaggaggugc

SEQ ID NO: 3747520 - RNA, 23 nt, Human
ggccaggaguuuaagaccagccu

SEQ ID NO: 3747521 - RNA, 20 nt, Human
ggccaggcaggagcccuucu

SEQ ID NO: 3747522 - RNA, 19 nt, Human
ggccaggcauguggcaggg

SEQ ID NO: 3747523 - RNA, 15 nt, Human
ggccaggccaccagg

SEQ ID NO: 3747524 - RNA, 16 nt, Human
ggccaggccaccagga

SEQ ID NO: 3747525 - RNA, 17 nt, Human
ggccaggccaccaggau

SEQ ID NO: 3747526 - RNA, 21 nt, Human
ggccaggccaccuccagaaac

SEQ ID NO: 3747527 - RNA, 15 nt, Human
ggccaggccagcugc

SEQ ID NO: 3747528 - RNA, 17 nt, Human
ggccaggcccucugccc

SEQ ID NO: 3747529 - RNA, 18 nt, Human
ggccaggcuggucucaaa

SEQ ID NO: 3747530 - RNA, 18 nt, Human
ggccaggcuugucucgaa

SEQ ID NO: 3747531 - RNA, 23 nt, Human
ggccagggccccucacccugccu

SEQ ID NO: 3747532 - RNA, 13 nt, Human
ggccagggcccug

SEQ ID NO: 3747533 - RNA, 20 nt, Human
ggccagggcugcccugagaa

SEQ ID NO: 3747534 - RNA, 23 nt, Human
ggccagggucacugaaggccugg

SEQ ID NO: 3747535 - RNA, 11 nt, Human
ggccaggucac

SEQ ID NO: 3747536 - RNA, 14 nt, Human
ggccaggugcagug

SEQ ID NO: 3747537 - RNA, 16 nt, Human
ggccaggugccuccug

SEQ ID NO: 3747538 - RNA, 17 nt, Human
ggccagguuucugccca

SEQ ID NO: 3747539 - RNA, 21 nt, Human
ggccaguaucuauauaugugu

SEQ ID NO: 3747540 - RNA, 15 nt, Human
ggccaguccaggcug

SEQ ID NO: 3747541 - RNA, 23 nt, Human
ggccagucccugaggcagguccc

SEQ ID NO: 3747542 - RNA, 19 nt, Human
ggccaguccugccuggcca

SEQ ID NO: 3747543 - RNA, 23 nt, Human
ggccagucuguggaucagagaug

SEQ ID NO: 3747544 - RNA, 22 nt, Human
ggccagugcaguuugguguguc

SEQ ID NO: 3747545 - RNA, 20 nt, Human
ggccagugcccugaucccag

SEQ ID NO: 3747546 - RNA, 21 nt, Human
ggccagugcccugaucccaga

SEQ ID NO: 3747547 - RNA, 13 nt, Human
ggccagugcucca

SEQ ID NO: 3747548 - RNA, 14 nt, Human
ggccaguggcggaa

SEQ ID NO: 3747549 - RNA, 24 nt, Human
ggacuggguuuggaccccagcugg

SEQ ID NO: 3747550 - RNA, 11 nt, Human
ggacuggugcc

SEQ ID NO: 3747551 - RNA, 14 nt, Human
ggacugguuugaga

SEQ ID NO: 3747552 - RNA, 18 nt, Human
ggacuguagggagggcgg

SEQ ID NO: 3747553 - RNA, 20 nt, Human
ggacugugauuugaauccag

SEQ ID NO: 3747554 - RNA, 19 nt, Human
ggacuguggcacuugccug

SEQ ID NO: 3747555 - RNA, 22 nt, Human
ggacuguggguuugugggggga

SEQ ID NO: 3747556 - RNA, 14 nt, Human
ggacuguucuuuug

SEQ ID NO: 3747557 - RNA, 13 nt, Human
ggacuguuucaaa

SEQ ID NO: 3747558 - RNA, 19 nt, Human
ggacuuagaaaaccagcuc

SEQ ID NO: 3747559 - RNA, 23 nt, Human
ggacuuagaaaaccagcucagca

SEQ ID NO: 3747560 - RNA, 18 nt, Human
ggacuuagaaagcagggg

SEQ ID NO: 3747561 - RNA, 17 nt, Human
ggacuuagcugggagaa

SEQ ID NO: 3747562 - RNA, 19 nt, Human
ggacuuauuacaauuuguu

SEQ ID NO: 3747563 - RNA, 11 nt, Human
ggacuuccuga

SEQ ID NO: 3747564 - RNA, 23 nt, Human
ggacuuccuguccagcuccaacc

SEQ ID NO: 3747565 - RNA, 18 nt, Human
ggacuuccuugcucuccc

SEQ ID NO: 3747566 - RNA, 16 nt, Human
ggacuucggaccgcuu

SEQ ID NO: 3747567 - RNA, 23 nt, Human
ggacuucggaccgcuugugggga

SEQ ID NO: 3747568 - RNA, 14 nt, Human
ggacuucuggggua

SEQ ID NO: 3747569 - RNA, 18 nt, Human
ggacuucuuuaauuuugg

SEQ ID NO: 3747570 - RNA, 21 nt, Human
ggacuucuuuaauuuuggaau

SEQ ID NO: 3747571 - RNA, 15 nt, Human
ggacuugaacccagg

SEQ ID NO: 3747572 - RNA, 19 nt, Human
ggacuugcaaaaaggguca

SEQ ID NO: 3747573 - RNA, 14 nt, Human
ggacuuggaagcuc

SEQ ID NO: 3747574 - RNA, 13 nt, Human
ggacuuggccucu

SEQ ID NO: 3747575 - RNA, 14 nt, Human
ggacuuguauauuu

SEQ ID NO: 3747576 - RNA, 15 nt, Human
ggacuuguauauuug

SEQ ID NO: 3747577 - RNA, 15 nt, Human
ggacuuguuagaucu

SEQ ID NO: 3747578 - RNA, 20 nt, Human
ggacuuuauagaucagccag

SEQ ID NO: 3747579 - RNA, 22 nt, Human
ggacuuucaaaauuaaaucugu

SEQ ID NO: 3747580 - RNA, 17 nt, Human
ggacuuuccacccccuc

SEQ ID NO: 3747581 - RNA, 20 nt, Human
ggacuuuccacccccucccu

SEQ ID NO: 3747582 - RNA, 21 nt, Human
ggacuuuccacccccucccug

SEQ ID NO: 3747583 - RNA, 22 nt, Human
ggacuuugcagccggcacaggg

SEQ ID NO: 3747584 - RNA, 19 nt, Human
ggacuuuguauacuuuaaa

SEQ ID NO: 3747585 - RNA, 12 nt, Human
ggacuuuguuac

SEQ ID NO: 3747586 - RNA, 19 nt, Human
ggagaaaauggacguguua

SEQ ID NO: 3747587 - RNA, 13 nt, Human
ggagaaacagaga

SEQ ID NO: 3747588 - RNA, 15 nt, Human
ggagaaacagagaca

SEQ ID NO: 3747589 - RNA, 19 nt, Human
ggagaaacccuugaaaaga

SEQ ID NO: 3747590 - RNA, 15 nt, Human
ggagaaagcugacuu

SEQ ID NO: 3747591 - RNA, 14 nt, Human
ggagaaauugacag

SEQ ID NO: 3747592 - RNA, 11 nt, Human
ggagaacaaau

SEQ ID NO: 3747593 - RNA, 22 nt, Human
ggagaaccaaaaagaggcuaug

SEQ ID NO: 3747594 - RNA, 20 nt, Human
ggagaaccaaaucuggaagc

SEQ ID NO: 3747595 - RNA, 13 nt, Human
ggagaaccaccua

SEQ ID NO: 3747596 - RNA, 13 nt, Human
ggagaacuagaga

SEQ ID NO: 3747597 - RNA, 21 nt, Human
ggagaacuccuaggguggcug

SEQ ID NO: 3747598 - RNA, 12 nt, Human
ggagaagaaaau

SEQ ID NO: 3747599 - RNA, 20 nt, Human
ggagaagaaagaggugaccc

SEQ ID NO: 3747600 - RNA, 14 nt, Human
ggagaagagaggag

SEQ ID NO: 3747601 - RNA, 18 nt, Human
ggagaagcaugaaaaagc

SEQ ID NO: 3747602 - RNA, 20 nt, Human
ggagaagccacaggccugag

SEQ ID NO: 3747603 - RNA, 11 nt, Human
ggagaagccau

SEQ ID NO: 3747604 - RNA, 12 nt, Human
ggagaagccauu

SEQ ID NO: 3747605 - RNA, 16 nt, Human
ggagaagccauugucu

SEQ ID NO: 3747606 - RNA, 18 nt, Human
ggagaagcccgugugaga

SEQ ID NO: 3747607 - RNA, 17 nt, Human
ggagaagcggcuggcag

SEQ ID NO: 3747608 - RNA, 19 nt, Human
ggagaagcuccucucccca

SEQ ID NO: 3747609 - RNA, 13 nt, Human
ggagaagcugaug

SEQ ID NO: 3747610 - RNA, 12 nt, Human
ggagaagcugca

SEQ ID NO: 3747611 - RNA, 12 nt, Human
ggagaaggaucu

SEQ ID NO: 3747612 - RNA, 14 nt, Human
ggagaagggaugga

SEQ ID NO: 3747613 - RNA, 13 nt, Human
ggagaagucucag

SEQ ID NO: 3747614 - RNA, 15 nt, Human
ggagaaucaucagga

SEQ ID NO: 3747615 - RNA, 17 nt, Human
ggagaaucaucaggacc

SEQ ID NO: 3747616 - RNA, 14 nt, Human
ggagaaucauguga

SEQ ID NO: 3747617 - RNA, 22 nt, Human
ggagaaugucaguauguggaag

SEQ ID NO: 3747618 - RNA, 22 nt, Human
ggagaauuuagguuuuuauuag

SEQ ID NO: 3747619 - RNA, 15 nt, Human
ggagacaaaagagca

SEQ ID NO: 3747620 - RNA, 18 nt, Human
ggagacaagaaaucccug

SEQ ID NO: 3747621 - RNA, 21 nt, Human
ggagacaaugucugcagcccu

SEQ ID NO: 3747622 - RNA, 21 nt, Human
ggagacacaacaacuccuagg

SEQ ID NO: 3747623 - RNA, 12 nt, Human
ggagacacagau

SEQ ID NO: 3747624 - RNA, 14 nt, Human
ggagacaccucaga

SEQ ID NO: 3747625 - RNA, 15 nt, Human
ggagacagccccaga

SEQ ID NO: 3747626 - RNA, 19 nt, Human
ggagacagccccagagcag

SEQ ID NO: 3747627 - RNA, 23 nt, Human
ggagacagccccagagcagggug

SEQ ID NO: 3747628 - RNA, 11 nt, Human
ggagacagggu

SEQ ID NO: 3747629 - RNA, 14 nt, Human
ggagacaugugaca

SEQ ID NO: 3747630 - RNA, 19 nt, Human
ggagacaugugacauuuau

SEQ ID NO: 3747631 - RNA, 17 nt, Human
ggagaccaaggcgggag

SEQ ID NO: 3747632 - RNA, 22 nt, Human
ggagacccugcaaacagaacag

SEQ ID NO: 3747633 - RNA, 23 nt, Human
ggagacccugcaaacagaacagg

SEQ ID NO: 3747634 - RNA, 17 nt, Human
ggagaccggccugccag

SEQ ID NO: 3747635 - RNA, 22 nt, Human
ggagaccggccugccaggagga

SEQ ID NO: 3747636 - RNA, 21 nt, Human
ggagaccuggacacaggccug

SEQ ID NO: 3747637 - RNA, 19 nt, Human
ggagacguggaaccucugu

SEQ ID NO: 3747638 - RNA, 23 nt, Human
ggagacguggaaccucugucuca

SEQ ID NO: 3747639 - RNA, 22 nt, Human
ggagacguuuauaaacagaaau

SEQ ID NO: 3747640 - RNA, 10 nt, Human
ggagacuaga

SEQ ID NO: 3747641 - RNA, 16 nt, Human
ggagacucaccucugc

SEQ ID NO: 3747642 - RNA, 19 nt, Human
ggagacucaccucugccuc

SEQ ID NO: 3747643 - RNA, 18 nt, Human
ggagacuccaugagaagc

SEQ ID NO: 3747644 - RNA, 16 nt, Human
ggagacuccuaggcag

SEQ ID NO: 3747645 - RNA, 18 nt, Human
ggagacuccuaggcagga

SEQ ID NO: 3747646 - RNA, 12 nt, Human
ggagacuccugc

SEQ ID NO: 3747647 - RNA, 17 nt, Human
ggagacuccugcccugu

SEQ ID NO: 3747648 - RNA, 20 nt, Human
ggagacucuguggggccuug

SEQ ID NO: 3747649 - RNA, 15 nt, Human
ggagacugcccagcu

SEQ ID NO: 3747650 - RNA, 19 nt, Human
ggagacugcuccugagccc

SEQ ID NO: 3747651 - RNA, 15 nt, Human
ggagacuggggggcu

SEQ ID NO: 3747652 - RNA, 18 nt, Human
ggagacuggggggcuuga

SEQ ID NO: 3747653 - RNA, 16 nt, Human
ggagacugucucaaga

SEQ ID NO: 3747654 - RNA, 19 nt, Human
ggagacugucuggcccccc

SEQ ID NO: 3747655 - RNA, 18 nt, Human
ggagacugugugugcccu

SEQ ID NO: 3747656 - RNA, 22 nt, Human
ggagacuuagggcaccaggggu

SEQ ID NO: 3747657 - RNA, 12 nt, Human
ggagagaaaaca

SEQ ID NO: 3747658 - RNA, 18 nt, Human
ggagagaaacaauaaaga

SEQ ID NO: 3747659 - RNA, 12 nt, Human
ggagagaagaau

SEQ ID NO: 3747660 - RNA, 17 nt, Human
ggagagacacugguggg

SEQ ID NO: 3747661 - RNA, 15 nt, Human
ggagagaccucauca

SEQ ID NO: 3747662 - RNA, 19 nt, Human
ggagagacucccaugaagc

SEQ ID NO: 3747663 - RNA, 12 nt, Human
ggagagagaaag

SEQ ID NO: 3747664 - RNA, 20 nt, Human
ggagagagaaagccaggcag

SEQ ID NO: 3747665 - RNA, 19 nt, Human
ggagagagagagagagagg

SEQ ID NO: 3747666 - RNA, 10 nt, Human
ggagagaggc

SEQ ID NO: 3747667 - RNA, 12 nt, Human
ggagagagggga

SEQ ID NO: 3747668 - RNA, 21 nt, Human
ggagagaggggaauaauagaa

SEQ ID NO: 3747669 - RNA, 17 nt, Human
ggagagaguugaaccua

SEQ ID NO: 3747670 - RNA, 11 nt, Human
ggagagcagcg

SEQ ID NO: 3747671 - RNA, 20 nt, Human
ggagagcaucggccuagggc

SEQ ID NO: 3747672 - RNA, 16 nt, Human
ggagagccagaaccug

SEQ ID NO: 3747673 - RNA, 14 nt, Human
ggagagccagagaa

SEQ ID NO: 3747674 - RNA, 11 nt, Human
ggagagccagc

SEQ ID NO: 3747675 - RNA, 15 nt, Human
ggagagccagcccuc

SEQ ID NO: 3747676 - RNA, 21 nt, Human
ggagagcccaggagcuccccu

SEQ ID NO: 3747677 - RNA, 11 nt, Human
ggagagcccug

SEQ ID NO: 3747678 - RNA, 13 nt, Human
ggagagcccuggg

SEQ ID NO: 3747679 - RNA, 14 nt, Human
ggagagcccuggga

SEQ ID NO: 3747680 - RNA, 13 nt, Human
ggagagccugcug

SEQ ID NO: 3747681 - RNA, 16 nt, Human
ggagagccuuccaggg

SEQ ID NO: 3747682 - RNA, 20 nt, Human
ggagagcgccugccccuccc

SEQ ID NO: 3747683 - RNA, 16 nt, Human
ggagagcuagaaccug

SEQ ID NO: 3747684 - RNA, 17 nt, Human
ggagagcuagcagcagg

SEQ ID NO: 3747685 - RNA, 21 nt, Human
ggagagcuagcagcagggagg

SEQ ID NO: 3747686 - RNA, 13 nt, Human
ggagagcuaggag

SEQ ID NO: 3747687 - RNA, 14 nt, Human
ggagagcuaggagc

SEQ ID NO: 3747688 - RNA, 13 nt, Human
ggagagcuggagc

SEQ ID NO: 3747689 - RNA, 22 nt, Human
ggagagcuggagccuggugccc

SEQ ID NO: 3747690 - RNA, 19 nt, Human
ggagagcuuagggucucag

SEQ ID NO: 3747691 - RNA, 12 nt, Human
ggagaggagaga

SEQ ID NO: 3747692 - RNA, 18 nt, Human
ggagaggagagaggcaga

SEQ ID NO: 3747693 - RNA, 20 nt, Human
ggagaggagugacugagcuu

SEQ ID NO: 3747694 - RNA, 14 nt, Human
ggagaggaguguga

SEQ ID NO: 3747695 - RNA, 22 nt, Human
ggagaggaugagagcccagagg

SEQ ID NO: 3747696 - RNA, 17 nt, Human
ggagaggccccagccgc

SEQ ID NO: 3747697 - RNA, 21 nt, Human
ggagaggcuagaaccaagaag

SEQ ID NO: 3747698 - RNA, 24 nt, Human
ggagagggaugaggugcugggagg

SEQ ID NO: 3747699 - RNA, 13 nt, Human
ggagagggcgcag

SEQ ID NO: 3747700 - RNA, 19 nt, Human
cuuuuaucacgauauuauu

SEQ ID NO: 3747701 - RNA, 13 nt, Human
cuuuuaucucaga

SEQ ID NO: 3747702 - RNA, 14 nt, Human
cuuuuaugagcuca

SEQ ID NO: 3747703 - RNA, 18 nt, Human
cuuuuaugauguauauuu

SEQ ID NO: 3747704 - RNA, 22 nt, Human
cuuuuaugauugccuuuuuaua

SEQ ID NO: 3747705 - RNA, 21 nt, Human
cuuuuaugcagauagaaucaa

SEQ ID NO: 3747706 - RNA, 15 nt, Human
cuuuuauguaguaau

SEQ ID NO: 3747707 - RNA, 22 nt, Human
cuuuuauguaguaauugacaug

SEQ ID NO: 3747708 - RNA, 14 nt, Human
cuuuuaugugaaac

SEQ ID NO: 3747709 - RNA, 20 nt, Human
cuuuuauguuauuuauauau

SEQ ID NO: 3747710 - RNA, 13 nt, Human
cuuuuauguuuga

SEQ ID NO: 3747711 - RNA, 15 nt, Human
cuuuuauguuugaau

SEQ ID NO: 3747712 - RNA, 19 nt, Human
cuuuuauuaaugcacuuuc

SEQ ID NO: 3747713 - RNA, 19 nt, Human
cuuuuauuguauaaacuau

SEQ ID NO: 3747714 - RNA, 13 nt, Human
cuuuuauugucag

SEQ ID NO: 3747715 - RNA, 19 nt, Human
cuuuuauuugcaacauuua

SEQ ID NO: 3747716 - RNA, 20 nt, Human
cuuuuauuuuacacagaaac

SEQ ID NO: 3747717 - RNA, 19 nt, Human
cuuuuauuuugaaaagcuu

SEQ ID NO: 3747718 - RNA, 18 nt, Human
cuuuucaaacaagaaugu

SEQ ID NO: 3747719 - RNA, 16 nt, Human
cuuuucaaggcuuaua

SEQ ID NO: 3747720 - RNA, 14 nt, Human
cuuuucaaguauuu

SEQ ID NO: 3747721 - RNA, 18 nt, Human
cuuuucaauauauuugua

SEQ ID NO: 3747722 - RNA, 15 nt, Human
cuuuucaaugacauu

SEQ ID NO: 3747723 - RNA, 13 nt, Human
cuuuucacaaaua

SEQ ID NO: 3747724 - RNA, 21 nt, Human
cuuuucacauccauuuccccu

SEQ ID NO: 3747725 - RNA, 17 nt, Human
cuuuucacauucuuaua

SEQ ID NO: 3747726 - RNA, 19 nt, Human
cuuuucaccuccuucaauu

SEQ ID NO: 3747727 - RNA, 12 nt, Human
cuuuucaccuuu

SEQ ID NO: 3747728 - RNA, 23 nt, Human
cuuuucagcgauguaugcagcua

SEQ ID NO: 3747729 - RNA, 19 nt, Human
cuuuucagcuucugcuggg

SEQ ID NO: 3747730 - RNA, 16 nt, Human
cuuuucagggcuggcu

SEQ ID NO: 3747731 - RNA, 18 nt, Human
cuuuucauauuugcacua

SEQ ID NO: 3747732 - RNA, 13 nt, Human
cuuuucaucuggg

SEQ ID NO: 3747733 - RNA, 17 nt, Human
cuuuucaucugggaaag

SEQ ID NO: 3747734 - RNA, 19 nt, Human
cuuuucaugcaaacucuuu

SEQ ID NO: 3747735 - RNA, 15 nt, Human
cuuuucauucucauu

SEQ ID NO: 3747736 - RNA, 13 nt, Human
cuuuuccaacccu

SEQ ID NO: 3747737 - RNA, 13 nt, Human
cuuuucccacucc

SEQ ID NO: 3747738 - RNA, 19 nt, Human
cuuuucccccauuaaucag

SEQ ID NO: 3747739 - RNA, 23 nt, Human
cuuuucccccauuaaucaguuca

SEQ ID NO: 3747740 - RNA, 20 nt, Human
cuuuuccccuuuccuguccc

SEQ ID NO: 3747741 - RNA, 21 nt, Human
cuuuuccccuuuccuguccca

SEQ ID NO: 3747742 - RNA, 22 nt, Human
cuuuuccccuuuccugucccac

SEQ ID NO: 3747743 - RNA, 22 nt, Human
cuuuucccucuuuggcuccccu

SEQ ID NO: 3747744 - RNA, 16 nt, Human
cuuuucccucuuuucu

SEQ ID NO: 3747745 - RNA, 15 nt, Human
cuuuucccugcuucc

SEQ ID NO: 3747746 - RNA, 18 nt, Human
cuuuucccugcuuccagg

SEQ ID NO: 3747747 - RNA, 19 nt, Human
cuuuucccuuugugaguca

SEQ ID NO: 3747748 - RNA, 20 nt, Human
cuuuuccuauuuucagccca

SEQ ID NO: 3747749 - RNA, 16 nt, Human
cuuuuccucgcuucuu

SEQ ID NO: 3747750 - RNA, 17 nt, Human
cuuuuccucgcuucuuu

SEQ ID NO: 3747751 - RNA, 16 nt, Human
cuuuuccucucucccg

SEQ ID NO: 3747752 - RNA, 15 nt, Human
cuuuuccuucccaaa

SEQ ID NO: 3747753 - RNA, 15 nt, Human
cuuuuccuugcauac

SEQ ID NO: 3747754 - RNA, 20 nt, Human
cuuuucgcaggauucuuccu

SEQ ID NO: 3747755 - RNA, 21 nt, Human
cuuuucgcaggauucuuccuc

SEQ ID NO: 3747756 - RNA, 15 nt, Human
cuuuucgccuuuccu

SEQ ID NO: 3747757 - RNA, 16 nt, Human
cuuuucguuaacauug

SEQ ID NO: 3747758 - RNA, 18 nt, Human
cuuuucuaaaagacuucc

SEQ ID NO: 3747759 - RNA, 23 nt, Human
cuuuucuaaacuaggcuccuuca

SEQ ID NO: 3747760 - RNA, 20 nt, Human
cuuuucuaacagaaagcaug

SEQ ID NO: 3747761 - RNA, 22 nt, Human
cuuuucuaaccaagaggcuggu

SEQ ID NO: 3747762 - RNA, 17 nt, Human
cuuuucuacagcaaauu

SEQ ID NO: 3747763 - RNA, 19 nt, Human
cuuuucuacagcaaauuua

SEQ ID NO: 3747764 - RNA, 20 nt, Human
cuuuucuacagcaaauuuau

SEQ ID NO: 3747765 - RNA, 22 nt, Human
cuuuucuacccuagccauuccu

SEQ ID NO: 3747766 - RNA, 20 nt, Human
cuuuucuauuuucccucgcu

SEQ ID NO: 3747767 - RNA, 18 nt, Human
cuuuucucauguguuugc

SEQ ID NO: 3747768 - RNA, 17 nt, Human
cuuuucuccaauaucag

SEQ ID NO: 3747769 - RNA, 17 nt, Human
cuuuucuccucacugua

SEQ ID NO: 3747770 - RNA, 12 nt, Human
cuuuucucugcc

SEQ ID NO: 3747771 - RNA, 16 nt, Human
cuuuucucuuuuuagu

SEQ ID NO: 3747772 - RNA, 11 nt, Human
cuuuucugaua

SEQ ID NO: 3747773 - RNA, 12 nt, Human
cuuuucugcaga

SEQ ID NO: 3747774 - RNA, 15 nt, Human
cuuuucugcagaggg

SEQ ID NO: 3747775 - RNA, 23 nt, Human
cuuuucugcaucaucuguagaua

SEQ ID NO: 3747776 - RNA, 13 nt, Human
cuuuucugcccug

SEQ ID NO: 3747777 - RNA, 14 nt, Human
cuuuucuggcaccg

SEQ ID NO: 3747778 - RNA, 15 nt, Human
cuuuucuggcaccgc

SEQ ID NO: 3747779 - RNA, 16 nt, Human
cuuuucuguaauucag

SEQ ID NO: 3747780 - RNA, 13 nt, Human
cuuuucuguauuu

SEQ ID NO: 3747781 - RNA, 12 nt, Human
cuuuucuguuuc

SEQ ID NO: 3747782 - RNA, 19 nt, Human
cuuuucuguuuccuguacc

SEQ ID NO: 3747783 - RNA, 15 nt, Human
cuuuucuuaaaccuu

SEQ ID NO: 3747784 - RNA, 13 nt, Human
cuuuucuuaacaa

SEQ ID NO: 3747785 - RNA, 17 nt, Human
cuuuucuuacuccuccu

SEQ ID NO: 3747786 - RNA, 23 nt, Human
cuuuucuuacuccuccucuuucu

SEQ ID NO: 3747787 - RNA, 17 nt, Human
cuuuucuuauuuuugua

SEQ ID NO: 3747788 - RNA, 14 nt, Human
cuuuucuuccuggc

SEQ ID NO: 3747789 - RNA, 14 nt, Human
cuuuucuucuaugu

SEQ ID NO: 3747790 - RNA, 18 nt, Human
cuuuucuucuauugccuc

SEQ ID NO: 3747791 - RNA, 19 nt, Human
cuuuucuucuauugccucu

SEQ ID NO: 3747792 - RNA, 21 nt, Human
cuuuucuugacuauuggagga

SEQ ID NO: 3747793 - RNA, 14 nt, Human
cuuuucuuggacac

SEQ ID NO: 3747794 - RNA, 22 nt, Human
cuuuucuuggcaaaagccuugu

SEQ ID NO: 3747795 - RNA, 16 nt, Human
cuuuucuuguaucugg

SEQ ID NO: 3747796 - RNA, 18 nt, Human
cuuuucuuuaaagaaguu

SEQ ID NO: 3747797 - RNA, 14 nt, Human
cuuuucuuuaacuu

SEQ ID NO: 3747798 - RNA, 22 nt, Human
cuuuucuuuagagcauugccau

SEQ ID NO: 3747799 - RNA, 17 nt, Human
cuuuucuuucagccaag

SEQ ID NO: 3747800 - RNA, 23 nt, Human
cuuuucuuugaaggaugacuaca

SEQ ID NO: 3747801 - RNA, 13 nt, Human
cuuuucuuuguau

SEQ ID NO: 3747802 - RNA, 15 nt, Human
cuuuucuuuucuaac

SEQ ID NO: 3747803 - RNA, 17 nt, Human
cuuuucuuuucuacccu

SEQ ID NO: 3747804 - RNA, 13 nt, Human
cuuuucuuuuguu

SEQ ID NO: 3747805 - RNA, 18 nt, Human
cuuuugaacccaggaguu

SEQ ID NO: 3747806 - RNA, 21 nt, Human
cuuuugaacgcccccccccac

SEQ ID NO: 3747807 - RNA, 20 nt, Human
cuuuugaaguaguuuguaua

SEQ ID NO: 3747808 - RNA, 21 nt, Human
cuuuugaauccaugcuugggu

SEQ ID NO: 3747809 - RNA, 12 nt, Human
cuuuugacacug

SEQ ID NO: 3747810 - RNA, 10 nt, Human
cuuuugaccu

SEQ ID NO: 3747811 - RNA, 18 nt, Human
cuuuugagaacuuuuggu

SEQ ID NO: 3747812 - RNA, 15 nt, Human
cuuuugagacuuuuu

SEQ ID NO: 3747813 - RNA, 15 nt, Human
cuuuugagugugugu

SEQ ID NO: 3747814 - RNA, 22 nt, Human
cuuuugauaaucaacugggcug

SEQ ID NO: 3747815 - RNA, 23 nt, Human
cuuuugauaugcauauuuguuua

SEQ ID NO: 3747816 - RNA, 16 nt, Human
cuuuugcaaccaggaa

SEQ ID NO: 3747817 - RNA, 14 nt, Human
cuuuugcaccccuc

SEQ ID NO: 3747818 - RNA, 16 nt, Human
cuuuugcaccccuccc

SEQ ID NO: 3747819 - RNA, 22 nt, Human
cuuuugcaccugcucucuugua

SEQ ID NO: 3747820 - RNA, 18 nt, Human
cuuuugcagaagagggug

SEQ ID NO: 3747821 - RNA, 15 nt, Human
cuuuugcaucauugu

SEQ ID NO: 3747822 - RNA, 20 nt, Human
cuuuugcccuucacaguguu

SEQ ID NO: 3747823 - RNA, 23 nt, Human
cuuuugcgguucaggaaaauuga

SEQ ID NO: 3747824 - RNA, 20 nt, Human
cuuuugcuugccaaaguaca

SEQ ID NO: 3747825 - RNA, 18 nt, Human
cuuuugcuuuaauuccau

SEQ ID NO: 3747826 - RNA, 14 nt, Human
cuuuugcuuuauuc

SEQ ID NO: 3747827 - RNA, 15 nt, Human
cuuuugcuuuuggca

SEQ ID NO: 3747828 - RNA, 20 nt, Human
cuuuuggaaucuagaagaaa

SEQ ID NO: 3747829 - RNA, 21 nt, Human
cuuuuggaaucuagaagaaau

SEQ ID NO: 3747830 - RNA, 22 nt, Human
cuuuuggaaucuagaagaaaug

SEQ ID NO: 3747831 - RNA, 23 nt, Human
cuuuuggaaucuagaagaaauga

SEQ ID NO: 3747832 - RNA, 18 nt, Human
cuuuuggauuggacaaaa

SEQ ID NO: 3747833 - RNA, 15 nt, Human
cuuuuggcacugaga

SEQ ID NO: 3747834 - RNA, 15 nt, Human
cuuuuggcauuuuac

SEQ ID NO: 3747835 - RNA, 20 nt, Human
cuuuuggcccccgagcuggg

SEQ ID NO: 3747836 - RNA, 17 nt, Human
cuuuuggcggggaggag

SEQ ID NO: 3747837 - RNA, 15 nt, Human
cuuuugggggagggc

SEQ ID NO: 3747838 - RNA, 17 nt, Human
cuuuuggguuucugccc

SEQ ID NO: 3747839 - RNA, 21 nt, Human
cuuuugguaaagacuggcuuu

SEQ ID NO: 3747840 - RNA, 18 nt, Human
cuuuugguguguuggaca

SEQ ID NO: 3747841 - RNA, 20 nt, Human
cuuuugguuaagucuguuuu

SEQ ID NO: 3747842 - RNA, 22 nt, Human
cuuuuguaaagaaauuuacuau

SEQ ID NO: 3747843 - RNA, 23 nt, Human
cuuuuguaaagaaauuuacuaua

SEQ ID NO: 3747844 - RNA, 14 nt, Human
cuuuuguaaauaca

SEQ ID NO: 3747845 - RNA, 15 nt, Human
cuuuuguaaauuaaa

SEQ ID NO: 3747846 - RNA, 14 nt, Human
cuuuuguaauaaac

SEQ ID NO: 3747847 - RNA, 17 nt, Human
cuuuuguacugaauuuu

SEQ ID NO: 3747848 - RNA, 19 nt, Human
cuuuuguagaagucacauu

SEQ ID NO: 3747849 - RNA, 15 nt, Human
ggccaguggggccug

SEQ ID NO: 3747850 - RNA, 18 nt, Human
ggccaguggggccugugg

SEQ ID NO: 3747851 - RNA, 23 nt, Human
ggccagugucugucccggggucc

SEQ ID NO: 3747852 - RNA, 14 nt, Human
ggccaguugguccc

SEQ ID NO: 3747853 - RNA, 13 nt, Human
ggccauaagcaac

SEQ ID NO: 3747854 - RNA, 23 nt, Human
ggccauaagcaacaauuuucaga

SEQ ID NO: 3747855 - RNA, 17 nt, Human
ggccauagcuccugcuc

SEQ ID NO: 3747856 - RNA, 21 nt, Human
ggccauauuuaccucagccug

SEQ ID NO: 3747857 - RNA, 14 nt, Human
ggccaucccacaag

SEQ ID NO: 3747858 - RNA, 19 nt, Human
ggccauccggcccccagag

SEQ ID NO: 3747859 - RNA, 14 nt, Human
ggccaucgguccug

SEQ ID NO: 3747860 - RNA, 22 nt, Human
ggccaucgguccugucuccccu

SEQ ID NO: 3747861 - RNA, 18 nt, Human
ggccaucuccacccccag

SEQ ID NO: 3747862 - RNA, 14 nt, Human
ggccaucugcuccu

SEQ ID NO: 3747863 - RNA, 14 nt, Human
ggccaucuggagag

SEQ ID NO: 3747864 - RNA, 22 nt, Human
ggccaucugguuaggauggcag

SEQ ID NO: 3747865 - RNA, 17 nt, Human
ggccaucuuccaggugg

SEQ ID NO: 3747866 - RNA, 18 nt, Human
ggccaucuuccagguggg

SEQ ID NO: 3747867 - RNA, 22 nt, Human
ggccaucuuccaggugggguga

SEQ ID NO: 3747868 - RNA, 23 nt, Human
ggccaugaccacuuuccccgugg

SEQ ID NO: 3747869 - RNA, 17 nt, Human
ggccaugacccugccuc

SEQ ID NO: 3747870 - RNA, 16 nt, Human
ggccaugagcuccaga

SEQ ID NO: 3747871 - RNA, 21 nt, Human
ggccaugagcuccagaccccc

SEQ ID NO: 3747872 - RNA, 21 nt, Human
ggccaugaggccucaguggac

SEQ ID NO: 3747873 - RNA, 15 nt, Human
ggccaugaguaaaau

SEQ ID NO: 3747874 - RNA, 22 nt, Human
ggccaugauggcaacagaucug

SEQ ID NO: 3747875 - RNA, 19 nt, Human
ggccaugcaauucauccca

SEQ ID NO: 3747876 - RNA, 21 nt, Human
ggccaugccuccucaggagcc

SEQ ID NO: 3747877 - RNA, 22 nt, Human
ggccaugcuccucuuccccaga

SEQ ID NO: 3747878 - RNA, 14 nt, Human
ggccaugcugaggc

SEQ ID NO: 3747879 - RNA, 15 nt, Human
ggccaugcugaggcc

SEQ ID NO: 3747880 - RNA, 18 nt, Human
ggccaugcugaggccugg

SEQ ID NO: 3747881 - RNA, 19 nt, Human
ggccaugcugaggccuggg

SEQ ID NO: 3747882 - RNA, 17 nt, Human
ggccauggacucugucc

SEQ ID NO: 3747883 - RNA, 18 nt, Human
ggccauggacucuguccu

SEQ ID NO: 3747884 - RNA, 15 nt, Human
ggccauggagaaagc

SEQ ID NO: 3747885 - RNA, 14 nt, Human
ggccauggagagcu

SEQ ID NO: 3747886 - RNA, 23 nt, Human
ggccauguccaaagaggcugccc

SEQ ID NO: 3747887 - RNA, 17 nt, Human
ggccauguuccaauaaa

SEQ ID NO: 3747888 - RNA, 14 nt, Human
ggccauuaggaaac

SEQ ID NO: 3747889 - RNA, 17 nt, Human
ggccauuaggaaacugu

SEQ ID NO: 3747890 - RNA, 20 nt, Human
ggccauucuauuguggcaag

SEQ ID NO: 3747891 - RNA, 20 nt, Human
ggccauucuccacagcaacc

SEQ ID NO: 3747892 - RNA, 14 nt, Human
ggccauucugccgc

SEQ ID NO: 3747893 - RNA, 21 nt, Human
ggccauucuuuuuuucuuggc

SEQ ID NO: 3747894 - RNA, 22 nt, Human
ggccauuugcaauaacagcugc

SEQ ID NO: 3747895 - RNA, 23 nt, Human
ggccauuugcaauaacagcugca

SEQ ID NO: 3747896 - RNA, 22 nt, Human
ggcccaagagucuggggaccag

SEQ ID NO: 3747897 - RNA, 17 nt, Human
ggcccaaggcggccccu

SEQ ID NO: 3747898 - RNA, 22 nt, Human
ggcccaagucccuguuuucuga

SEQ ID NO: 3747899 - RNA, 12 nt, Human
ggcccacacaca

SEQ ID NO: 3747900 - RNA, 13 nt, Human
ggcccacagcucc

SEQ ID NO: 3747901 - RNA, 17 nt, Human
ggcccacagcucccacc

SEQ ID NO: 3747902 - RNA, 18 nt, Human
ggcccacagcucccaccc

SEQ ID NO: 3747903 - RNA, 18 nt, Human
ggcccacaggaggcaagc

SEQ ID NO: 3747904 - RNA, 20 nt, Human
ggcccacagggaacccugcu

SEQ ID NO: 3747905 - RNA, 18 nt, Human
ggcccaccaggccccccu

SEQ ID NO: 3747906 - RNA, 19 nt, Human
ggcccaccccacccacuuc

SEQ ID NO: 3747907 - RNA, 22 nt, Human
ggcccaccccacccacuucugc

SEQ ID NO: 3747908 - RNA, 23 nt, Human
ggcccaccccacccacuucugca

SEQ ID NO: 3747909 - RNA, 18 nt, Human
ggcccacccggugggacc

SEQ ID NO: 3747910 - RNA, 20 nt, Human
ggcccacccggugggacccc

SEQ ID NO: 3747911 - RNA, 21 nt, Human
ggcccacccgguucaguguuu

SEQ ID NO: 3747912 - RNA, 22 nt, Human
ggcccaccuaccuucaaagcug

SEQ ID NO: 3747913 - RNA, 19 nt, Human
ggcccaccuggccaccuga

SEQ ID NO: 3747914 - RNA, 22 nt, Human
ggcccaccuggccaccugaggu

SEQ ID NO: 3747915 - RNA, 14 nt, Human
ggcccacugcaucg

SEQ ID NO: 3747916 - RNA, 15 nt, Human
ggcccagagaagcca

SEQ ID NO: 3747917 - RNA, 18 nt, Human
ggcccagagagaagagcc

SEQ ID NO: 3747918 - RNA, 12 nt, Human
ggcccagagagg

SEQ ID NO: 3747919 - RNA, 14 nt, Human
ggcccagagcagga

SEQ ID NO: 3747920 - RNA, 16 nt, Human
ggcccagagcaggaag

SEQ ID NO: 3747921 - RNA, 15 nt, Human
ggcccagagcccagc

SEQ ID NO: 3747922 - RNA, 19 nt, Human
ggcccagagcccagcucca

SEQ ID NO: 3747923 - RNA, 17 nt, Human
ggcccagaggcacagcc

SEQ ID NO: 3747924 - RNA, 20 nt, Human
ggcccagagggccugcaagg

SEQ ID NO: 3747925 - RNA, 22 nt, Human
ggcccagaucuggucccuugca

SEQ ID NO: 3747926 - RNA, 15 nt, Human
ggcccagcauugcug

SEQ ID NO: 3747927 - RNA, 21 nt, Human
ggcccagcccccacagugcug

SEQ ID NO: 3747928 - RNA, 12 nt, Human
ggcccagcccgg

SEQ ID NO: 3747929 - RNA, 14 nt, Human
ggcccagcccugcu

SEQ ID NO: 3747930 - RNA, 17 nt, Human
ggcccagccggccucuc

SEQ ID NO: 3747931 - RNA, 19 nt, Human
ggcccagccggccucucug

SEQ ID NO: 3747932 - RNA, 20 nt, Human
ggcccagccggccucucugg

SEQ ID NO: 3747933 - RNA, 23 nt, Human
ggcccagccuuuguuccccacug

SEQ ID NO: 3747934 - RNA, 18 nt, Human
ggcccagcggccccuccc

SEQ ID NO: 3747935 - RNA, 15 nt, Human
ggcccagcucccccg

SEQ ID NO: 3747936 - RNA, 14 nt, Human
ggcccagcugggcu

SEQ ID NO: 3747937 - RNA, 17 nt, Human
ggcccagcugggcucug

SEQ ID NO: 3747938 - RNA, 16 nt, Human
ggcccaggaccagcug

SEQ ID NO: 3747939 - RNA, 17 nt, Human
ggcccaggaccagcugg

SEQ ID NO: 3747940 - RNA, 18 nt, Human
ggcccaggaccagcuggg

SEQ ID NO: 3747941 - RNA, 11 nt, Human
ggcccaggccu

SEQ ID NO: 3747942 - RNA, 16 nt, Human
ggcccagggcaucugg

SEQ ID NO: 3747943 - RNA, 14 nt, Human
ggcccagggcccag

SEQ ID NO: 3747944 - RNA, 18 nt, Human
ggcccagggcccagagcc

SEQ ID NO: 3747945 - RNA, 19 nt, Human
ggcccagggggcuuccuga

SEQ ID NO: 3747946 - RNA, 22 nt, Human
ggcccaguaccuagcuggcucu

SEQ ID NO: 3747947 - RNA, 15 nt, Human
ggcccagugcauggu

SEQ ID NO: 3747948 - RNA, 22 nt, Human
ggcccauagaaacaugacacug

SEQ ID NO: 3747949 - RNA, 24 nt, Human
ggcccauaucugugaaaugcuggc

SEQ ID NO: 3747950 - RNA, 22 nt, Human
ggcccaucaguguacccccgcc

SEQ ID NO: 3747951 - RNA, 16 nt, Human
ggcccauccccccuca

SEQ ID NO: 3747952 - RNA, 18 nt, Human
ggcccauccccccucacc

SEQ ID NO: 3747953 - RNA, 19 nt, Human
ggcccauccccccucacca

SEQ ID NO: 3747954 - RNA, 17 nt, Human
ggcccauguauggccag

SEQ ID NO: 3747955 - RNA, 21 nt, Human
ggcccauguauggccaggaag

SEQ ID NO: 3747956 - RNA, 23 nt, Human
ggcccauucuacuugcucuggac

SEQ ID NO: 3747957 - RNA, 16 nt, Human
ggccccaaaaccacag

SEQ ID NO: 3747958 - RNA, 21 nt, Human
ggccccaaaaccacagcccug

SEQ ID NO: 3747959 - RNA, 18 nt, Human
ggccccaacucgggcucc

SEQ ID NO: 3747960 - RNA, 22 nt, Human
ggccccaauaccccauggacca

SEQ ID NO: 3747961 - RNA, 15 nt, Human
ggccccaccaccuag

SEQ ID NO: 3747962 - RNA, 15 nt, Human
ggccccaccagugcc

SEQ ID NO: 3747963 - RNA, 12 nt, Human
ggccccacccuc

SEQ ID NO: 3747964 - RNA, 17 nt, Human
ggccccacccucgggga

SEQ ID NO: 3747965 - RNA, 13 nt, Human
ggccccacccugg

SEQ ID NO: 3747966 - RNA, 16 nt, Human
ggccccaccugcagcu

SEQ ID NO: 3747967 - RNA, 19 nt, Human
ggccccagaaggcagggaa

SEQ ID NO: 3747968 - RNA, 12 nt, Human
ggccccagagac

SEQ ID NO: 3747969 - RNA, 14 nt, Human
ggccccagagacuc

SEQ ID NO: 3747970 - RNA, 13 nt, Human
ggccccagcacua

SEQ ID NO: 3747971 - RNA, 16 nt, Human
ggccccagcacuaaag

SEQ ID NO: 3747972 - RNA, 13 nt, Human
ggccccagccaga

SEQ ID NO: 3747973 - RNA, 15 nt, Human
ggccccagcccaccc

SEQ ID NO: 3747974 - RNA, 16 nt, Human
ggccccagcccacccu

SEQ ID NO: 3747975 - RNA, 19 nt, Human
ggccccagcccacccuccu

SEQ ID NO: 3747976 - RNA, 14 nt, Human
ggccccagcccugc

SEQ ID NO: 3747977 - RNA, 22 nt, Human
ggccccagcccugcuggggauc

SEQ ID NO: 3747978 - RNA, 14 nt, Human
ggccccagccuggc

SEQ ID NO: 3747979 - RNA, 20 nt, Human
ggccccagccuggcccagcu

SEQ ID NO: 3747980 - RNA, 21 nt, Human
ggccccagccuggcccagcuc

SEQ ID NO: 3747981 - RNA, 14 nt, Human
ggccccaggaagcc

SEQ ID NO: 3747982 - RNA, 15 nt, Human
ggccccagucagccu

SEQ ID NO: 3747983 - RNA, 16 nt, Human
ggccccagucagccuc

SEQ ID NO: 3747984 - RNA, 16 nt, Human
ggcccccacuggcugu

SEQ ID NO: 3747985 - RNA, 17 nt, Human
ggcccccacuggcugug

SEQ ID NO: 3747986 - RNA, 18 nt, Human
ggcccccacuugccucuu

SEQ ID NO: 3747987 - RNA, 17 nt, Human
ggcccccagagcgcccc

SEQ ID NO: 3747988 - RNA, 17 nt, Human
ggcccccagcccagggc

SEQ ID NO: 3747989 - RNA, 20 nt, Human
ggcccccagcccagggcucc

SEQ ID NO: 3747990 - RNA, 12 nt, Human
ggcccccagcug

SEQ ID NO: 3747991 - RNA, 14 nt, Human
ggcccccaucucau

SEQ ID NO: 3747992 - RNA, 21 nt, Human
ggcccccaucucaugccccug

SEQ ID NO: 3747993 - RNA, 17 nt, Human
ggccccccagcucaggg

SEQ ID NO: 3747994 - RNA, 23 nt, Human
ggccccccagcucaggggcagcu

SEQ ID NO: 3747995 - RNA, 17 nt, Human
ggcccccucccuggaug

SEQ ID NO: 3747996 - RNA, 13 nt, Human
ggcccccugcccg

SEQ ID NO: 3747997 - RNA, 12 nt, Human
ggcccccugccu

SEQ ID NO: 3747998 - RNA, 18 nt, Human
ggagaggggaagggccag

SEQ ID NO: 3747999 - RNA, 18 nt, Human
ggagaggucuuuuuuaaa

SEQ ID NO: 3748000 - RNA, 23 nt, Human
ggagagguuauaggucacuccug

SEQ ID NO: 3748001 - RNA, 16 nt, Human
ggagagguugucugug

SEQ ID NO: 3748002 - RNA, 17 nt, Human
ggagagucucccaggga

SEQ ID NO: 3748003 - RNA, 21 nt, Human
ggagaguggccauucuuuuuu

SEQ ID NO: 3748004 - RNA, 12 nt, Human
ggagagugucaa

SEQ ID NO: 3748005 - RNA, 22 nt, Human
ggagauacuuggucacagccag

SEQ ID NO: 3748006 - RNA, 14 nt, Human
ggagauagggaaag

SEQ ID NO: 3748007 - RNA, 12 nt, Human
ggagauauuuaa

SEQ ID NO: 3748008 - RNA, 22 nt, Human
ggagauauuuauggggggagaa

SEQ ID NO: 3748009 - RNA, 18 nt, Human
ggagauccuuguguuuau

SEQ ID NO: 3748010 - RNA, 19 nt, Human
ggagaucggggccagaggc

SEQ ID NO: 3748011 - RNA, 20 nt, Human
ggagauggaaguugcaguga

SEQ ID NO: 3748012 - RNA, 17 nt, Human
ggagauggggagaaacc

SEQ ID NO: 3748013 - RNA, 13 nt, Human
ggagauguaagag

SEQ ID NO: 3748014 - RNA, 14 nt, Human
ggagauguaagagc

SEQ ID NO: 3748015 - RNA, 12 nt, Human
ggagauuauaau

SEQ ID NO: 3748016 - RNA, 14 nt, Human
ggagauuauaauaa

SEQ ID NO: 3748017 - RNA, 22 nt, Human
ggagauucucauaacuugagac

SEQ ID NO: 3748018 - RNA, 23 nt, Human
ggagauucucauaacuugagacc

SEQ ID NO: 3748019 - RNA, 14 nt, Human
ggagauugagaagg

SEQ ID NO: 3748020 - RNA, 17 nt, Human
ggagauugagaaggaga

SEQ ID NO: 3748021 - RNA, 21 nt, Human
ggagauugagaaggagagaaa

SEQ ID NO: 3748022 - RNA, 17 nt, Human
ggagauuuuccuuccua

SEQ ID NO: 3748023 - RNA, 19 nt, Human
ggagcaaacugcaugccca

SEQ ID NO: 3748024 - RNA, 15 nt, Human
ggagcaaagccuguu

SEQ ID NO: 3748025 - RNA, 14 nt, Human
ggagcaaaggcuga

SEQ ID NO: 3748026 - RNA, 13 nt, Human
ggagcaagggcag

SEQ ID NO: 3748027 - RNA, 21 nt, Human
ggagcaauuacggggugaccu

SEQ ID NO: 3748028 - RNA, 15 nt, Human
ggagcacaggcagcu

SEQ ID NO: 3748029 - RNA, 15 nt, Human
ggagcacagguccca

SEQ ID NO: 3748030 - RNA, 17 nt, Human
ggagcacaggucccacc

SEQ ID NO: 3748031 - RNA, 14 nt, Human
ggagcacccugagg

SEQ ID NO: 3748032 - RNA, 16 nt, Human
ggagcacccugagggc

SEQ ID NO: 3748033 - RNA, 12 nt, Human
ggagcagaacug

SEQ ID NO: 3748034 - RNA, 14 nt, Human
ggagcagaagcagc

SEQ ID NO: 3748035 - RNA, 15 nt, Human
ggagcagaccacccc

SEQ ID NO: 3748036 - RNA, 16 nt, Human
ggagcagagaaggcca

SEQ ID NO: 3748037 - RNA, 17 nt, Human
ggagcagagcucugccg

SEQ ID NO: 3748038 - RNA, 14 nt, Human
ggagcagaguguuc

SEQ ID NO: 3748039 - RNA, 12 nt, Human
ggagcagcagga

SEQ ID NO: 3748040 - RNA, 19 nt, Human
ggagcagcaggagggggga

SEQ ID NO: 3748041 - RNA, 21 nt, Human
ggagcagcaggaggggggagg

SEQ ID NO: 3748042 - RNA, 13 nt, Human
ggagcagccacau

SEQ ID NO: 3748043 - RNA, 16 nt, Human
ggagcaggcacgggug

SEQ ID NO: 3748044 - RNA, 21 nt, Human
ggagcaggcgguggggagaga

SEQ ID NO: 3748045 - RNA, 17 nt, Human
ggagcagggaaggccug

SEQ ID NO: 3748046 - RNA, 12 nt, Human
ggagcagugucu

SEQ ID NO: 3748047 - RNA, 18 nt, Human
ggagcauagaaggcaggu

SEQ ID NO: 3748048 - RNA, 16 nt, Human
ggagcaucaagccacu

SEQ ID NO: 3748049 - RNA, 17 nt, Human
ggagcaucaagccacuc

SEQ ID NO: 3748050 - RNA, 16 nt, Human
ggagcaucagugcccu

SEQ ID NO: 3748051 - RNA, 13 nt, Human
ggagcaucccgga

SEQ ID NO: 3748052 - RNA, 14 nt, Human
ggagcaucccggag

SEQ ID NO: 3748053 - RNA, 21 nt, Human
ggagcaucucuugaggccagg

SEQ ID NO: 3748054 - RNA, 20 nt, Human
ggagccaacagaagcuucca

SEQ ID NO: 3748055 - RNA, 23 nt, Human
ggagccaaggguucagagacuca

SEQ ID NO: 3748056 - RNA, 16 nt, Human
ggagccaccuguccca

SEQ ID NO: 3748057 - RNA, 21 nt, Human
ggagccacuccucugacucag

SEQ ID NO: 3748058 - RNA, 13 nt, Human
ggagccaggaggg

SEQ ID NO: 3748059 - RNA, 18 nt, Human
ggagccaguaaacagagg

SEQ ID NO: 3748060 - RNA, 14 nt, Human
ggagccauuugaga

SEQ ID NO: 3748061 - RNA, 15 nt, Human
ggagcccacuguacu

SEQ ID NO: 3748062 - RNA, 18 nt, Human
ggagcccacuguacuugc

SEQ ID NO: 3748063 - RNA, 22 nt, Human
ggagcccaggccaggacucugc

SEQ ID NO: 3748064 - RNA, 13 nt, Human
ggagcccagggca

SEQ ID NO: 3748065 - RNA, 22 nt, Human
ggagcccauuuggagggccugg

SEQ ID NO: 3748066 - RNA, 15 nt, Human
ggagccccacugccc

SEQ ID NO: 3748067 - RNA, 13 nt, Human
ggagccccaggcc

SEQ ID NO: 3748068 - RNA, 14 nt, Human
ggagccccaggccu

SEQ ID NO: 3748069 - RNA, 13 nt, Human
ggagccccagggu

SEQ ID NO: 3748070 - RNA, 12 nt, Human
ggagccccaucu

SEQ ID NO: 3748071 - RNA, 16 nt, Human
ggagccccaucugucu

SEQ ID NO: 3748072 - RNA, 22 nt, Human
ggagcccccacccuguuccugc

SEQ ID NO: 3748073 - RNA, 14 nt, Human
ggagcccccagccu

SEQ ID NO: 3748074 - RNA, 15 nt, Human
ggagcccccagccug

SEQ ID NO: 3748075 - RNA, 18 nt, Human
ggagccccuucugcucag

SEQ ID NO: 3748076 - RNA, 20 nt, Human
ggagcccugccucuccgccc

SEQ ID NO: 3748077 - RNA, 23 nt, Human
ggagcccugucuccucucucugu

SEQ ID NO: 3748078 - RNA, 13 nt, Human
ggagccgcuggca

SEQ ID NO: 3748079 - RNA, 23 nt, Human
ggagccgguaacuguccuguccu

SEQ ID NO: 3748080 - RNA, 16 nt, Human
ggagccuagaagcugg

SEQ ID NO: 3748081 - RNA, 21 nt, Human
ggagccuagagugagggccug

SEQ ID NO: 3748082 - RNA, 22 nt, Human
ggagccuaggaccacucagccc

SEQ ID NO: 3748083 - RNA, 16 nt, Human
ggagccuaggccaggu

SEQ ID NO: 3748084 - RNA, 20 nt, Human
ggagccucauccgaggcagg

SEQ ID NO: 3748085 - RNA, 20 nt, Human
ggagccuccacugccucugg

SEQ ID NO: 3748086 - RNA, 14 nt, Human
ggagccucccugcc

SEQ ID NO: 3748087 - RNA, 14 nt, Human
ggagccuccugccc

SEQ ID NO: 3748088 - RNA, 15 nt, Human
ggagccuccugccca

SEQ ID NO: 3748089 - RNA, 18 nt, Human
ggagccucgcaacccgug

SEQ ID NO: 3748090 - RNA, 16 nt, Human
ggagccugacagccag

SEQ ID NO: 3748091 - RNA, 17 nt, Human
ggagccugacagccaga

SEQ ID NO: 3748092 - RNA, 21 nt, Human
ggagccugagucagggcccag

SEQ ID NO: 3748093 - RNA, 22 nt, Human
ggagccugagucagggcccaga

SEQ ID NO: 3748094 - RNA, 22 nt, Human
ggagccugcaggguggugcugg

SEQ ID NO: 3748095 - RNA, 23 nt, Human
ggagccugcauuuccucgcagcc

SEQ ID NO: 3748096 - RNA, 22 nt, Human
ggagccugcuggucacagccuc

SEQ ID NO: 3748097 - RNA, 16 nt, Human
ggagccuggcacagga

SEQ ID NO: 3748098 - RNA, 13 nt, Human
ggagccuguccug

SEQ ID NO: 3748099 - RNA, 21 nt, Human
ggagccugugaacccaggaca

SEQ ID NO: 3748100 - RNA, 15 nt, Human
ggagccuguguaaca

SEQ ID NO: 3748101 - RNA, 18 nt, Human
ggagccuguguaacagcu

SEQ ID NO: 3748102 - RNA, 20 nt, Human
ggagccuguguaacagcucc

SEQ ID NO: 3748103 - RNA, 22 nt, Human
ggagccuucccaaguugugcuu

SEQ ID NO: 3748104 - RNA, 23 nt, Human
ggagccuucccaaguugugcuug

SEQ ID NO: 3748105 - RNA, 16 nt, Human
ggagccuuuuaacugu

SEQ ID NO: 3748106 - RNA, 19 nt, Human
ggagccuuuuuaaaacaca

SEQ ID NO: 3748107 - RNA, 16 nt, Human
ggagcgggaccugugg

SEQ ID NO: 3748108 - RNA, 22 nt, Human
ggagcgguggcccugucccucc

SEQ ID NO: 3748109 - RNA, 15 nt, Human
ggagcguggacuggu

SEQ ID NO: 3748110 - RNA, 19 nt, Human
ggagcguggacugguuggu

SEQ ID NO: 3748111 - RNA, 14 nt, Human
ggagcgugggaggc

SEQ ID NO: 3748112 - RNA, 14 nt, Human
ggagcuaccugugu

SEQ ID NO: 3748113 - RNA, 15 nt, Human
ggagcuaucaggaac

SEQ ID NO: 3748114 - RNA, 12 nt, Human
ggagcuauuuua

SEQ ID NO: 3748115 - RNA, 12 nt, Human
ggagcuauuuuc

SEQ ID NO: 3748116 - RNA, 17 nt, Human
ggagcucaucugcaaaa

SEQ ID NO: 3748117 - RNA, 17 nt, Human
ggagcuccacucugcuu

SEQ ID NO: 3748118 - RNA, 20 nt, Human
ggagcuccacucugcuucuc

SEQ ID NO: 3748119 - RNA, 18 nt, Human
ggagcuccagccugacau

SEQ ID NO: 3748120 - RNA, 17 nt, Human
ggagcuccaguguccug

SEQ ID NO: 3748121 - RNA, 20 nt, Human
ggagcuccaguguccugagc

SEQ ID NO: 3748122 - RNA, 17 nt, Human
ggagcuccucuccugga

SEQ ID NO: 3748123 - RNA, 20 nt, Human
ggagcuccucuccuggagga

SEQ ID NO: 3748124 - RNA, 17 nt, Human
ggagcucuucaggccuc

SEQ ID NO: 3748125 - RNA, 18 nt, Human
ggagcucuucaggccucc

SEQ ID NO: 3748126 - RNA, 15 nt, Human
ggagcugaaaaauca

SEQ ID NO: 3748127 - RNA, 16 nt, Human
ggagcugaguggggga

SEQ ID NO: 3748128 - RNA, 22 nt, Human
ggagcugaucgcuucuccccca

SEQ ID NO: 3748129 - RNA, 14 nt, Human
ggagcugcaggggc

SEQ ID NO: 3748130 - RNA, 13 nt, Human
ggagcugcccaga

SEQ ID NO: 3748131 - RNA, 14 nt, Human
ggagcugccuggac

SEQ ID NO: 3748132 - RNA, 12 nt, Human
ggagcugccugu

SEQ ID NO: 3748133 - RNA, 18 nt, Human
ggagcugcuauagccugg

SEQ ID NO: 3748134 - RNA, 15 nt, Human
ggagcuggccccgcc

SEQ ID NO: 3748135 - RNA, 16 nt, Human
ggagcuggccccgccg

SEQ ID NO: 3748136 - RNA, 20 nt, Human
ggagcuggccccgccgccug

SEQ ID NO: 3748137 - RNA, 18 nt, Human
ggagcuggcuccagccug

SEQ ID NO: 3748138 - RNA, 12 nt, Human
ggagcugggccc

SEQ ID NO: 3748139 - RNA, 20 nt, Human
ggagcuggggagaggaaaga

SEQ ID NO: 3748140 - RNA, 21 nt, Human
ggagcuucugggguccccagg

SEQ ID NO: 3748141 - RNA, 15 nt, Human
ggagcuugggaaugg

SEQ ID NO: 3748142 - RNA, 22 nt, Human
ggagcuuugacucaggagccug

SEQ ID NO: 3748143 - RNA, 20 nt, Human
ggaggaaaaccaagccgugg

SEQ ID NO: 3748144 - RNA, 21 nt, Human
ggaggaagaacugaaaggcuu

SEQ ID NO: 3748145 - RNA, 14 nt, Human
ggaggaagaauagg

SEQ ID NO: 3748146 - RNA, 13 nt, Human
ggaggaagcagaa

SEQ ID NO: 3748147 - RNA, 15 nt, Human
ggaggaagcagaaua

SEQ ID NO: 3748148 - RNA, 23 nt, Human
ggaggaagcagaauaaagcaauu

SEQ ID NO: 3748149 - RNA, 23 nt, Human
cuuuuguauacauccuggguaau

SEQ ID NO: 3748150 - RNA, 13 nt, Human
cuuuuguauguaa

SEQ ID NO: 3748151 - RNA, 17 nt, Human
cuuuuguauguaaaugu

SEQ ID NO: 3748152 - RNA, 17 nt, Human
cuuuugucauguggcua

SEQ ID NO: 3748153 - RNA, 14 nt, Human
cuuuugucccagaa

SEQ ID NO: 3748154 - RNA, 21 nt, Human
cuuuuguccugcaucaucuug

SEQ ID NO: 3748155 - RNA, 16 nt, Human
cuuuugucuaauuaaa

SEQ ID NO: 3748156 - RNA, 13 nt, Human
cuuuugugaauua

SEQ ID NO: 3748157 - RNA, 22 nt, Human
cuuuugugauggagugcuguuu

SEQ ID NO: 3748158 - RNA, 13 nt, Human
cuuuugugcauua

SEQ ID NO: 3748159 - RNA, 14 nt, Human
cuuuugugcauuau

SEQ ID NO: 3748160 - RNA, 16 nt, Human
cuuuuguguaaugaaa

SEQ ID NO: 3748161 - RNA, 10 nt, Human
cuuuuguuac

SEQ ID NO: 3748162 - RNA, 20 nt, Human
cuuuuguuacucuugggaca

SEQ ID NO: 3748163 - RNA, 20 nt, Human
cuuuuguuacuguucuugcu

SEQ ID NO: 3748164 - RNA, 23 nt, Human
cuuuuguuacuguucuugcugcu

SEQ ID NO: 3748165 - RNA, 22 nt, Human
cuuuuguucagggcugugaucg

SEQ ID NO: 3748166 - RNA, 22 nt, Human
cuuuuguucauuucauccuuuc

SEQ ID NO: 3748167 - RNA, 17 nt, Human
cuuuuguucccauccuc

SEQ ID NO: 3748168 - RNA, 11 nt, Human
cuuuuguucuu

SEQ ID NO: 3748169 - RNA, 12 nt, Human
cuuuuguucuug

SEQ ID NO: 3748170 - RNA, 20 nt, Human
cuuuuguucuugguuuguaa

SEQ ID NO: 3748171 - RNA, 12 nt, Human
cuuuuguuuggu

SEQ ID NO: 3748172 - RNA, 14 nt, Human
cuuuuguuugguaa

SEQ ID NO: 3748173 - RNA, 15 nt, Human
cuuuuguuugguaaa

SEQ ID NO: 3748174 - RNA, 16 nt, Human
cuuuuguuugguaaau

SEQ ID NO: 3748175 - RNA, 15 nt, Human
cuuuuguuuugcuuu

SEQ ID NO: 3748176 - RNA, 18 nt, Human
cuuuuguuuuuugaagug

SEQ ID NO: 3748177 - RNA, 14 nt, Human
cuuuuuaaaacaca

SEQ ID NO: 3748178 - RNA, 23 nt, Human
cuuuuuaaagcuuuugauguggu

SEQ ID NO: 3748179 - RNA, 16 nt, Human
cuuuuuaaaguguuuc

SEQ ID NO: 3748180 - RNA, 16 nt, Human
cuuuuuaaccugcaaa

SEQ ID NO: 3748181 - RNA, 19 nt, Human
cuuuuuaagcuuauuuaau

SEQ ID NO: 3748182 - RNA, 18 nt, Human
cuuuuuaaguaaugugga

SEQ ID NO: 3748183 - RNA, 16 nt, Human
cuuuuuaauaugcuua

SEQ ID NO: 3748184 - RNA, 21 nt, Human
cuuuuuaaucaugaauaugau

SEQ ID NO: 3748185 - RNA, 15 nt, Human
cuuuuuaauuguugu

SEQ ID NO: 3748186 - RNA, 22 nt, Human
cuuuuuaauuguuguuucuuuc

SEQ ID NO: 3748187 - RNA, 19 nt, Human
cuuuuuacauaacugccuu

SEQ ID NO: 3748188 - RNA, 15 nt, Human
cuuuuuacuccccuu

SEQ ID NO: 3748189 - RNA, 14 nt, Human
cuuuuuauaaaaag

SEQ ID NO: 3748190 - RNA, 15 nt, Human
cuuuuuauaaaaaga

SEQ ID NO: 3748191 - RNA, 19 nt, Human
cuuuuuauaaaaagauaau

SEQ ID NO: 3748192 - RNA, 12 nt, Human
cuuuuuauaacu

SEQ ID NO: 3748193 - RNA, 16 nt, Human
cuuuuuauuaaaauau

SEQ ID NO: 3748194 - RNA, 17 nt, Human
cuuuuuauugaaucuau

SEQ ID NO: 3748195 - RNA, 13 nt, Human
cuuuuuauugccu

SEQ ID NO: 3748196 - RNA, 12 nt, Human
cuuuuuauuuau

SEQ ID NO: 3748197 - RNA, 13 nt, Human
cuuuuuauuuaua

SEQ ID NO: 3748198 - RNA, 17 nt, Human
cuuuuuauuuauaugua

SEQ ID NO: 3748199 - RNA, 19 nt, Human
cuuuuuauuuauauguaug

SEQ ID NO: 3748200 - RNA, 13 nt, Human
cuuuuuauuugca

SEQ ID NO: 3748201 - RNA, 14 nt, Human
cuuuuuauuugcau

SEQ ID NO: 3748202 - RNA, 21 nt, Human
cuuuuuauuuuuuaauuauug

SEQ ID NO: 3748203 - RNA, 17 nt, Human
cuuuuucaggagaauua

SEQ ID NO: 3748204 - RNA, 17 nt, Human
cuuuuucauccccuuac

SEQ ID NO: 3748205 - RNA, 13 nt, Human
cuuuuucauuugc

SEQ ID NO: 3748206 - RNA, 17 nt, Human
cuuuuucauuugccuau

SEQ ID NO: 3748207 - RNA, 15 nt, Human
cuuuuucauuuucca

SEQ ID NO: 3748208 - RNA, 18 nt, Human
cuuuuucauuuuccaaua

SEQ ID NO: 3748209 - RNA, 17 nt, Human
cuuuuuccaacaagaag

SEQ ID NO: 3748210 - RNA, 22 nt, Human
cuuuuuccagacacuuuuuuga

SEQ ID NO: 3748211 - RNA, 16 nt, Human
cuuuuucccaauaaau

SEQ ID NO: 3748212 - RNA, 18 nt, Human
cuuuuucuaaugugguua

SEQ ID NO: 3748213 - RNA, 20 nt, Human
cuuuuucucuuuccaugaca

SEQ ID NO: 3748214 - RNA, 11 nt, Human
cuuuuucugac

SEQ ID NO: 3748215 - RNA, 16 nt, Human
cuuuuucugauuagcu

SEQ ID NO: 3748216 - RNA, 16 nt, Human
cuuuuucugcacuaua

SEQ ID NO: 3748217 - RNA, 19 nt, Human
cuuuuucuggacucuggac

SEQ ID NO: 3748218 - RNA, 12 nt, Human
cuuuuucuuaau

SEQ ID NO: 3748219 - RNA, 14 nt, Human
cuuuuucuuccuca

SEQ ID NO: 3748220 - RNA, 19 nt, Human
cuuuuucuucuucccuccc

SEQ ID NO: 3748221 - RNA, 15 nt, Human
cuuuuugaaaugaaa

SEQ ID NO: 3748222 - RNA, 18 nt, Human
cuuuuugaaaugaaauuu

SEQ ID NO: 3748223 - RNA, 22 nt, Human
cuuuuugaaaugaaauuuaaac

SEQ ID NO: 3748224 - RNA, 21 nt, Human
cuuuuugaaguguaggcagac

SEQ ID NO: 3748225 - RNA, 23 nt, Human
cuuuuugaaguguaggcagacac

SEQ ID NO: 3748226 - RNA, 15 nt, Human
cuuuuugaaucuuua

SEQ ID NO: 3748227 - RNA, 17 nt, Human
cuuuuugaaucuuuaau

SEQ ID NO: 3748228 - RNA, 18 nt, Human
cuuuuugaaucuuuaauu

SEQ ID NO: 3748229 - RNA, 20 nt, Human
cuuuuugagguggcacuuuu

SEQ ID NO: 3748230 - RNA, 18 nt, Human
cuuuuugcucuaaaauau

SEQ ID NO: 3748231 - RNA, 16 nt, Human
cuuuuuggcauaacau

SEQ ID NO: 3748232 - RNA, 17 nt, Human
cuuuuugggagagacuu

SEQ ID NO: 3748233 - RNA, 19 nt, Human
cuuuuuguaagugagugug

SEQ ID NO: 3748234 - RNA, 16 nt, Human
cuuuuuguaccuggug

SEQ ID NO: 3748235 - RNA, 18 nt, Human
cuuuuuguauaaaauaga

SEQ ID NO: 3748236 - RNA, 13 nt, Human
cuuuuugugaaga

SEQ ID NO: 3748237 - RNA, 21 nt, Human
cuuuuuguuguaaaacaaaau

SEQ ID NO: 3748238 - RNA, 19 nt, Human
cuuuuuuaaauaaacuuuu

SEQ ID NO: 3748239 - RNA, 18 nt, Human
cuuuuuuaaauauuuucu

SEQ ID NO: 3748240 - RNA, 18 nt, Human
cuuuuuuaaaugaagaaa

SEQ ID NO: 3748241 - RNA, 14 nt, Human
cuuuuuuaaauuaa

SEQ ID NO: 3748242 - RNA, 21 nt, Human
cuuuuuuaagauuuuucucaa

SEQ ID NO: 3748243 - RNA, 16 nt, Human
cuuuuuuaauaaacua

SEQ ID NO: 3748244 - RNA, 13 nt, Human
cuuuuuuacucau

SEQ ID NO: 3748245 - RNA, 21 nt, Human
cuuuuuuacuuaguagauuaa

SEQ ID NO: 3748246 - RNA, 16 nt, Human
cuuuuuuagaguugau

SEQ ID NO: 3748247 - RNA, 17 nt, Human
cuuuuuuauacauaaac

SEQ ID NO: 3748248 - RNA, 14 nt, Human
cuuuuuuauaucuu

SEQ ID NO: 3748249 - RNA, 20 nt, Human
cuuuuuuauuaaucacugug

SEQ ID NO: 3748250 - RNA, 16 nt, Human
cuuuuuucaaaagaaa

SEQ ID NO: 3748251 - RNA, 22 nt, Human
cuuuuuucauggacacuuugaa

SEQ ID NO: 3748252 - RNA, 15 nt, Human
cuuuuuuccccagac

SEQ ID NO: 3748253 - RNA, 18 nt, Human
cuuuuuuccuuaauccag

SEQ ID NO: 3748254 - RNA, 18 nt, Human
cuuuuuuccuuuccaccu

SEQ ID NO: 3748255 - RNA, 20 nt, Human
cuuuuuucucugauacagaa

SEQ ID NO: 3748256 - RNA, 14 nt, Human
cuuuuuucugccuc

SEQ ID NO: 3748257 - RNA, 16 nt, Human
cuuuuuucuuauuuaa

SEQ ID NO: 3748258 - RNA, 16 nt, Human
cuuuuuucuuuuuccu

SEQ ID NO: 3748259 - RNA, 18 nt, Human
cuuuuuugauaaaguuuc

SEQ ID NO: 3748260 - RNA, 19 nt, Human
cuuuuuugauaaaguuucu

SEQ ID NO: 3748261 - RNA, 16 nt, Human
cuuuuuuggcugcuga

SEQ ID NO: 3748262 - RNA, 22 nt, Human
cuuuuuuggcugcugaaggcuc

SEQ ID NO: 3748263 - RNA, 23 nt, Human
cuuuuuuggcugcugaaggcucg

SEQ ID NO: 3748264 - RNA, 23 nt, Human
cuuuuuuggcuuuagacacuggc

SEQ ID NO: 3748265 - RNA, 11 nt, Human
cuuuuuugucc

SEQ ID NO: 3748266 - RNA, 22 nt, Human
cuuuuuuguuuguuucuuugug

SEQ ID NO: 3748267 - RNA, 16 nt, Human
cuuuuuuguuuuuuca

SEQ ID NO: 3748268 - RNA, 12 nt, Human
cuuuuuuucaau

SEQ ID NO: 3748269 - RNA, 13 nt, Human
cuuuuuuucaaug

SEQ ID NO: 3748270 - RNA, 15 nt, Human
cuuuuuuucaaugug

SEQ ID NO: 3748271 - RNA, 19 nt, Human
cuuuuuuuccaucuuuaca

SEQ ID NO: 3748272 - RNA, 11 nt, Human
cuuuuuuuccc

SEQ ID NO: 3748273 - RNA, 19 nt, Human
cuuuuuuucuauauuauug

SEQ ID NO: 3748274 - RNA, 15 nt, Human
cuuuuuuucuuuggu

SEQ ID NO: 3748275 - RNA, 22 nt, Human
cuuuuuuugagcgacaucucug

SEQ ID NO: 3748276 - RNA, 15 nt, Human
cuuuuuuuggcccag

SEQ ID NO: 3748277 - RNA, 16 nt, Human
cuuuuuuuggcccagg

SEQ ID NO: 3748278 - RNA, 13 nt, Human
cuuuuuuuguaua

SEQ ID NO: 3748279 - RNA, 16 nt, Human
cuuuuuuuguauaguu

SEQ ID NO: 3748280 - RNA, 17 nt, Human
cuuuuuuuuaaugugcu

SEQ ID NO: 3748281 - RNA, 18 nt, Human
cuuuuuuuucuauuucac

SEQ ID NO: 3748282 - RNA, 22 nt, Human
cuuuuuuuugacagcuuccugu

SEQ ID NO: 3748283 - RNA, 23 nt, Human
cuuuuuuuugacagcuuccuguc

SEQ ID NO: 3748284 - RNA, 21 nt, Human
cuuuuuuuuuaaguucuuaug

SEQ ID NO: 3748285 - RNA, 18 nt, Human
cuuuuuuuuuuuguuuga

SEQ ID NO: 3748286 - RNA, 16 nt, Human
cuuuuuuuuuuuucca

SEQ ID NO: 3748287 - RNA, 20 nt, Human
cuuuuuuuuuuuugagacag

SEQ ID NO: 3748288 - RNA, 22 nt, Human
cuuuuuuuuuuuuuaaagacag

SEQ ID NO: 3748289 - RNA, 17 nt, Human
gaaaaaaaaaaaagagg

SEQ ID NO: 3748290 - RNA, 21 nt, Human
gaaaaaaaaaaaagaggaaaa

SEQ ID NO: 3748291 - RNA, 16 nt, Human
gaaaaaaaaaagaaga

SEQ ID NO: 3748292 - RNA, 19 nt, Human
gaaaaaaaaaagaagaaga

SEQ ID NO: 3748293 - RNA, 18 nt, Human
gaaaaaaaaaaugcugaa

SEQ ID NO: 3748294 - RNA, 18 nt, Human
gaaaaaaaaagaaaaaag

SEQ ID NO: 3748295 - RNA, 15 nt, Human
gaaaaaaaaaugcca

SEQ ID NO: 3748296 - RNA, 20 nt, Human
gaaaaaaaaaugccauaaua

SEQ ID NO: 3748297 - RNA, 18 nt, Human
gaaaaaaaaauucacaug

SEQ ID NO: 3748298 - RNA, 21 nt, Human
gaaaaaaaaccugagauuuau

SEQ ID NO: 3748299 - RNA, 17 nt, Human
ggcccccuggucucugg

SEQ ID NO: 3748300 - RNA, 19 nt, Human
ggccccgaggacccagacc

SEQ ID NO: 3748301 - RNA, 18 nt, Human
ggccccggaucagagcag

SEQ ID NO: 3748302 - RNA, 17 nt, Human
ggccccggccccagcca

SEQ ID NO: 3748303 - RNA, 18 nt, Human
ggccccgucucaggucug

SEQ ID NO: 3748304 - RNA, 17 nt, Human
ggccccuccccuccaaa

SEQ ID NO: 3748305 - RNA, 21 nt, Human
ggccccucccuaccucaaccu

SEQ ID NO: 3748306 - RNA, 23 nt, Human
ggccccucccucuccagcaggcc

SEQ ID NO: 3748307 - RNA, 20 nt, Human
ggccccucucagcccucaca

SEQ ID NO: 3748308 - RNA, 16 nt, Human
ggccccucugcccagc

SEQ ID NO: 3748309 - RNA, 17 nt, Human
ggccccucugcccagcu

SEQ ID NO: 3748310 - RNA, 19 nt, Human
ggccccugccagacccccu

SEQ ID NO: 3748311 - RNA, 20 nt, Human
ggccccugccagacccccug

SEQ ID NO: 3748312 - RNA, 15 nt, Human
ggccccugcccggcu

SEQ ID NO: 3748313 - RNA, 17 nt, Human
ggccccugccucucugc

SEQ ID NO: 3748314 - RNA, 13 nt, Human
ggccccugcuggu

SEQ ID NO: 3748315 - RNA, 14 nt, Human
ggccccugcugguu

SEQ ID NO: 3748316 - RNA, 12 nt, Human
ggccccuggagg

SEQ ID NO: 3748317 - RNA, 15 nt, Human
ggccccuggcccagc

SEQ ID NO: 3748318 - RNA, 21 nt, Human
ggccccugggcuuggccugcu

SEQ ID NO: 3748319 - RNA, 18 nt, Human
ggccccuuugcugacccu

SEQ ID NO: 3748320 - RNA, 18 nt, Human
ggccccuuugggcccugc

SEQ ID NO: 3748321 - RNA, 19 nt, Human
ggccccuuugggcccugca

SEQ ID NO: 3748322 - RNA, 17 nt, Human
ggcccgacagccuggca

SEQ ID NO: 3748323 - RNA, 13 nt, Human
ggcccgacauggc

SEQ ID NO: 3748324 - RNA, 16 nt, Human
ggcccgcacagagcug

SEQ ID NO: 3748325 - RNA, 19 nt, Human
ggcccgccuggcagaacug

SEQ ID NO: 3748326 - RNA, 23 nt, Human
ggcccgccuggcagaacugagcu

SEQ ID NO: 3748327 - RNA, 23 nt, Human
ggcccgcgauguggaacugcugc

SEQ ID NO: 3748328 - RNA, 14 nt, Human
ggcccgcgccacag

SEQ ID NO: 3748329 - RNA, 17 nt, Human
ggcccgcgccacaggac

SEQ ID NO: 3748330 - RNA, 18 nt, Human
ggcccgcgccacaggacc

SEQ ID NO: 3748331 - RNA, 17 nt, Human
ggcccgcuugccucggc

SEQ ID NO: 3748332 - RNA, 23 nt, Human
ggcccggagcugccccucucugg

SEQ ID NO: 3748333 - RNA, 13 nt, Human
ggcccggcagggc

SEQ ID NO: 3748334 - RNA, 12 nt, Human
ggcccggccagc

SEQ ID NO: 3748335 - RNA, 13 nt, Human
ggcccggccucuc

SEQ ID NO: 3748336 - RNA, 23 nt, Human
ggcccggcgcgguggcucacgcc

SEQ ID NO: 3748337 - RNA, 13 nt, Human
ggcccggggcugg

SEQ ID NO: 3748338 - RNA, 14 nt, Human
ggcccgucugucca

SEQ ID NO: 3748339 - RNA, 20 nt, Human
ggcccgucuguccaucugcc

SEQ ID NO: 3748340 - RNA, 20 nt, Human
ggcccguugaggaugaggcc

SEQ ID NO: 3748341 - RNA, 22 nt, Human
ggcccguugaggaugaggccgc

SEQ ID NO: 3748342 - RNA, 19 nt, Human
ggcccguugucucccuggc

SEQ ID NO: 3748343 - RNA, 20 nt, Human
ggcccguugucucccuggcc

SEQ ID NO: 3748344 - RNA, 22 nt, Human
ggcccguugucucccuggcccu

SEQ ID NO: 3748345 - RNA, 24 nt, Human
ggcccguugucucccuggcccuca

SEQ ID NO: 3748346 - RNA, 16 nt, Human
ggcccuaccagcgccc

SEQ ID NO: 3748347 - RNA, 23 nt, Human
ggcccuagcccagcgcucugccu

SEQ ID NO: 3748348 - RNA, 16 nt, Human
ggcccucaaggccucc

SEQ ID NO: 3748349 - RNA, 19 nt, Human
ggcccucaaggccucccac

SEQ ID NO: 3748350 - RNA, 18 nt, Human
ggcccucaccccugcccu

SEQ ID NO: 3748351 - RNA, 22 nt, Human
ggcccucaccccugcccuggga

SEQ ID NO: 3748352 - RNA, 21 nt, Human
ggcccucaucuaugaggaaag

SEQ ID NO: 3748353 - RNA, 14 nt, Human
ggcccuccagagcc

SEQ ID NO: 3748354 - RNA, 21 nt, Human
ggcccuccagagccccacagc

SEQ ID NO: 3748355 - RNA, 20 nt, Human
ggcccucccuguuccccaga

SEQ ID NO: 3748356 - RNA, 13 nt, Human
ggcccucccuugg

SEQ ID NO: 3748357 - RNA, 16 nt, Human
ggcccuccuacccugc

SEQ ID NO: 3748358 - RNA, 19 nt, Human
ggcccuccuacccugcgcc

SEQ ID NO: 3748359 - RNA, 15 nt, Human
ggcccucgacacuca

SEQ ID NO: 3748360 - RNA, 15 nt, Human
ggcccucgcugccag

SEQ ID NO: 3748361 - RNA, 21 nt, Human
ggcccucgcugccagcucugu

SEQ ID NO: 3748362 - RNA, 15 nt, Human
ggcccucgggcccag

SEQ ID NO: 3748363 - RNA, 16 nt, Human
ggcccucgggcccagc

SEQ ID NO: 3748364 - RNA, 18 nt, Human
ggcccucgggcccagccc

SEQ ID NO: 3748365 - RNA, 12 nt, Human
ggcccucucccc

SEQ ID NO: 3748366 - RNA, 21 nt, Human
ggcccucucugaaggaggcca

SEQ ID NO: 3748367 - RNA, 14 nt, Human
ggcccucucugcuc

SEQ ID NO: 3748368 - RNA, 18 nt, Human
ggcccucucuucucaccu

SEQ ID NO: 3748369 - RNA, 19 nt, Human
ggcccucugcccacucccu

SEQ ID NO: 3748370 - RNA, 21 nt, Human
ggcccucugcccacucccugc

SEQ ID NO: 3748371 - RNA, 19 nt, Human
ggcccucuggaguggccac

SEQ ID NO: 3748372 - RNA, 13 nt, Human
ggcccugagcuga

SEQ ID NO: 3748373 - RNA, 17 nt, Human
ggcccugaggugugggg

SEQ ID NO: 3748374 - RNA, 18 nt, Human
ggcccugagucugggcag

SEQ ID NO: 3748375 - RNA, 22 nt, Human
ggcccugcaaaaggacucucag

SEQ ID NO: 3748376 - RNA, 14 nt, Human
ggcccugcacuguc

SEQ ID NO: 3748377 - RNA, 16 nt, Human
ggcccugcacuguccu

SEQ ID NO: 3748378 - RNA, 18 nt, Human
ggcccugcacuguccugc

SEQ ID NO: 3748379 - RNA, 20 nt, Human
ggcccugcacuguccugcuc

SEQ ID NO: 3748380 - RNA, 22 nt, Human
ggcccugcaguguucgcuuggc

SEQ ID NO: 3748381 - RNA, 18 nt, Human
ggcccugcccugaggaag

SEQ ID NO: 3748382 - RNA, 17 nt, Human
ggcccugcccuggcagg

SEQ ID NO: 3748383 - RNA, 22 nt, Human
ggcccugcccugguuuccugcc

SEQ ID NO: 3748384 - RNA, 10 nt, Human
ggcccugccu

SEQ ID NO: 3748385 - RNA, 15 nt, Human
ggcccugcuccugca

SEQ ID NO: 3748386 - RNA, 14 nt, Human
ggcccugcuuccug

SEQ ID NO: 3748387 - RNA, 16 nt, Human
ggcccugcuuccugcu

SEQ ID NO: 3748388 - RNA, 15 nt, Human
ggcccuggaacucua

SEQ ID NO: 3748389 - RNA, 13 nt, Human
ggcccuggcagcc

SEQ ID NO: 3748390 - RNA, 12 nt, Human
ggcccuggccug

SEQ ID NO: 3748391 - RNA, 14 nt, Human
ggcccuggccugcu

SEQ ID NO: 3748392 - RNA, 16 nt, Human
ggcccuggccugcugg

SEQ ID NO: 3748393 - RNA, 19 nt, Human
ggcccuggcugagggcagc

SEQ ID NO: 3748394 - RNA, 15 nt, Human
ggcccugggcuggaa

SEQ ID NO: 3748395 - RNA, 17 nt, Human
ggcccugguccuuccag

SEQ ID NO: 3748396 - RNA, 15 nt, Human
ggcccugucccuccc

SEQ ID NO: 3748397 - RNA, 16 nt, Human
ggcccugucccuccca

SEQ ID NO: 3748398 - RNA, 12 nt, Human
ggcccugugccu

SEQ ID NO: 3748399 - RNA, 20 nt, Human
ggcccuuacuugcuucucua

SEQ ID NO: 3748400 - RNA, 21 nt, Human
ggcccuucacugccuuugcuc

SEQ ID NO: 3748401 - RNA, 17 nt, Human
ggcccuuccucuccacu

SEQ ID NO: 3748402 - RNA, 19 nt, Human
ggcccuuccucuccacugc

SEQ ID NO: 3748403 - RNA, 15 nt, Human
ggcccuuccuggaca

SEQ ID NO: 3748404 - RNA, 20 nt, Human
ggcccuuccuggacagcugu

SEQ ID NO: 3748405 - RNA, 22 nt, Human
ggcccuuccuggacagcugugc

SEQ ID NO: 3748406 - RNA, 23 nt, Human
ggcccuucucuccagccccugga

SEQ ID NO: 3748407 - RNA, 10 nt, Human
ggcccuugga

SEQ ID NO: 3748408 - RNA, 16 nt, Human
ggcccuuuccucaggc

SEQ ID NO: 3748409 - RNA, 19 nt, Human
ggcccuuuccuuccagauc

SEQ ID NO: 3748410 - RNA, 19 nt, Human
ggcccuuugaagccucagc

SEQ ID NO: 3748411 - RNA, 18 nt, Human
ggccgaagcuaacaggga

SEQ ID NO: 3748412 - RNA, 20 nt, Human
ggccgaagcuaacagggaag

SEQ ID NO: 3748413 - RNA, 14 nt, Human
ggccgaagcucugg

SEQ ID NO: 3748414 - RNA, 16 nt, Human
ggccgaagcucuggcu

SEQ ID NO: 3748415 - RNA, 17 nt, Human
ggccgaagcucuggcug

SEQ ID NO: 3748416 - RNA, 16 nt, Human
ggccgacauugucucc

SEQ ID NO: 3748417 - RNA, 17 nt, Human
ggccgacauugucuccc

SEQ ID NO: 3748418 - RNA, 16 nt, Human
ggccgacggagccggg

SEQ ID NO: 3748419 - RNA, 14 nt, Human
ggccgagugagagc

SEQ ID NO: 3748420 - RNA, 14 nt, Human
ggccgauggagaca

SEQ ID NO: 3748421 - RNA, 20 nt, Human
ggccgcagcucuugcccuuc

SEQ ID NO: 3748422 - RNA, 21 nt, Human
ggccgcagcucuugcccuucc

SEQ ID NO: 3748423 - RNA, 22 nt, Human
ggccgcagcucuugcccuuccc

SEQ ID NO: 3748424 - RNA, 23 nt, Human
ggccgcagcucuugcccuucccu

SEQ ID NO: 3748425 - RNA, 15 nt, Human
ggccgcauucccuga

SEQ ID NO: 3748426 - RNA, 17 nt, Human
ggccgcauucccugagu

SEQ ID NO: 3748427 - RNA, 18 nt, Human
ggccgccccagccucuga

SEQ ID NO: 3748428 - RNA, 14 nt, Human
ggccgccgccucuu

SEQ ID NO: 3748429 - RNA, 15 nt, Human
ggccgccugggucca

SEQ ID NO: 3748430 - RNA, 16 nt, Human
ggccgcgggggcaggg

SEQ ID NO: 3748431 - RNA, 14 nt, Human
ggccgcuagaggcc

SEQ ID NO: 3748432 - RNA, 17 nt, Human
ggccgcuagaggccuga

SEQ ID NO: 3748433 - RNA, 21 nt, Human
ggccgcuagaggccugaggau

SEQ ID NO: 3748434 - RNA, 14 nt, Human
ggccgcuccaccag

SEQ ID NO: 3748435 - RNA, 19 nt, Human
ggccgcuccaccagcauca

SEQ ID NO: 3748436 - RNA, 16 nt, Human
ggccgcuccaggggug

SEQ ID NO: 3748437 - RNA, 19 nt, Human
ggccgcuccagggguggcu

SEQ ID NO: 3748438 - RNA, 20 nt, Human
ggccggagucagugccaggu

SEQ ID NO: 3748439 - RNA, 20 nt, Human
ggccggcagccccagccugc

SEQ ID NO: 3748440 - RNA, 12 nt, Human
ggccggccagcc

SEQ ID NO: 3748441 - RNA, 14 nt, Human
ggccggccagccag

SEQ ID NO: 3748442 - RNA, 15 nt, Human
ggccggccagccagc

SEQ ID NO: 3748443 - RNA, 17 nt, Human
ggccggccaggugggcg

SEQ ID NO: 3748444 - RNA, 18 nt, Human
ggccggcgagcccugugg

SEQ ID NO: 3748445 - RNA, 22 nt, Human
ggccggcuucaugccagcuacu

SEQ ID NO: 3748446 - RNA, 18 nt, Human
ggccggcuuucaggagcu

SEQ ID NO: 3748447 - RNA, 19 nt, Human
ggccggcuuucaggagcuc

SEQ ID NO: 3748448 - RNA, 23 nt, Human
ggccgggaccccgagccuggcuc

SEQ ID NO: 3748449 - RNA, 22 nt, Human
ggaggaaggagccuauggcauc

SEQ ID NO: 3748450 - RNA, 13 nt, Human
ggaggaaggcaag

SEQ ID NO: 3748451 - RNA, 23 nt, Human
ggaggaauaagcucccagggccu

SEQ ID NO: 3748452 - RNA, 16 nt, Human
ggaggaaugcuccccc

SEQ ID NO: 3748453 - RNA, 18 nt, Human
ggaggaaugcucccccau

SEQ ID NO: 3748454 - RNA, 15 nt, Human
ggaggaauuucugag

SEQ ID NO: 3748455 - RNA, 14 nt, Human
ggaggacaaaacuu

SEQ ID NO: 3748456 - RNA, 19 nt, Human
ggaggacaauucaugaacu

SEQ ID NO: 3748457 - RNA, 17 nt, Human
ggaggaccaaaaaaaua

SEQ ID NO: 3748458 - RNA, 15 nt, Human
ggaggacccagggcu

SEQ ID NO: 3748459 - RNA, 14 nt, Human
ggaggaccucuggg

SEQ ID NO: 3748460 - RNA, 13 nt, Human
ggaggaccugagc

SEQ ID NO: 3748461 - RNA, 16 nt, Human
ggaggaccugagccug

SEQ ID NO: 3748462 - RNA, 18 nt, Human
ggaggaccugagccugcc

SEQ ID NO: 3748463 - RNA, 16 nt, Human
ggaggagccuguccug

SEQ ID NO: 3748464 - RNA, 13 nt, Human
ggaggaggaaggc

SEQ ID NO: 3748465 - RNA, 18 nt, Human
ggaggaggcagagaagaa

SEQ ID NO: 3748466 - RNA, 15 nt, Human
ggaggagggggccgg

SEQ ID NO: 3748467 - RNA, 15 nt, Human
ggaggaggugccaac

SEQ ID NO: 3748468 - RNA, 23 nt, Human
ggaggaucacuugaguccagaag

SEQ ID NO: 3748469 - RNA, 13 nt, Human
ggaggauggagag

SEQ ID NO: 3748470 - RNA, 21 nt, Human
ggaggaugucccugggccagg

SEQ ID NO: 3748471 - RNA, 15 nt, Human
ggaggaugugggcag

SEQ ID NO: 3748472 - RNA, 12 nt, Human
ggaggcaagcaa

SEQ ID NO: 3748473 - RNA, 14 nt, Human
ggaggcaagcccug

SEQ ID NO: 3748474 - RNA, 17 nt, Human
ggaggcacacagcugca

SEQ ID NO: 3748475 - RNA, 21 nt, Human
ggaggcacagcaaacuguccc

SEQ ID NO: 3748476 - RNA, 22 nt, Human
ggaggcacuuuagggcuguaaa

SEQ ID NO: 3748477 - RNA, 15 nt, Human
ggaggcagagaagaa

SEQ ID NO: 3748478 - RNA, 16 nt, Human
ggaggcagcaggacug

SEQ ID NO: 3748479 - RNA, 11 nt, Human
ggaggcagccu

SEQ ID NO: 3748480 - RNA, 14 nt, Human
ggaggcaggcaugg

SEQ ID NO: 3748481 - RNA, 18 nt, Human
ggaggcaggggcuuccug

SEQ ID NO: 3748482 - RNA, 19 nt, Human
ggaggcaggggcuuccugg

SEQ ID NO: 3748483 - RNA, 16 nt, Human
ggaggcauggcccugg

SEQ ID NO: 3748484 - RNA, 21 nt, Human
ggaggcaugugaugagaggaa

SEQ ID NO: 3748485 - RNA, 18 nt, Human
ggaggccaagugcaggcu

SEQ ID NO: 3748486 - RNA, 13 nt, Human
ggaggccaccucc

SEQ ID NO: 3748487 - RNA, 14 nt, Human
ggaggccaccuccu

SEQ ID NO: 3748488 - RNA, 17 nt, Human
ggcucuaauucacagug

SEQ ID NO: 3748489 - RNA, 12 nt, Human
ggcucuacacau

SEQ ID NO: 3748490 - RNA, 23 nt, Human
ggcucuauuccaauaaacuauga

SEQ ID NO: 3748491 - RNA, 12 nt, Human
ggcaacagagca

SEQ ID NO: 3748492 - RNA, 16 nt, Human
ggcaacagagcaagac

SEQ ID NO: 3748493 - RNA, 20 nt, Human
ggcaacagagcaagacucca

SEQ ID NO: 3748494 - RNA, 19 nt, Human
ggcaacagagcaagauccu

SEQ ID NO: 3748495 - RNA, 20 nt, Human
ggcaacagaucaguaaagaa

SEQ ID NO: 3748496 - RNA, 14 nt, Human
ggcaacagaucugg

SEQ ID NO: 3748497 - RNA, 15 nt, Human
ggcaacagaucugga

SEQ ID NO: 3748498 - RNA, 22 nt, Human
ggcaacaugccugcuuuagaau

SEQ ID NO: 3748499 - RNA, 19 nt, Human
ggcaacauugcuggcugga

SEQ ID NO: 3748500 - RNA, 21 nt, Human
ggcaaccacaggcagcauuua

SEQ ID NO: 3748501 - RNA, 17 nt, Human
ggcaaccccaguucugc

SEQ ID NO: 3748502 - RNA, 18 nt, Human
ggcaaccccaguucugcu

SEQ ID NO: 3748503 - RNA, 21 nt, Human
ggcaaccccaguucugcuccu

SEQ ID NO: 3748504 - RNA, 16 nt, Human
ggcaacccccagccug

SEQ ID NO: 3748505 - RNA, 17 nt, Human
ggcaacccccagccugc

SEQ ID NO: 3748506 - RNA, 19 nt, Human
ggcaaccuugucucuaugc

SEQ ID NO: 3748507 - RNA, 14 nt, Human
ggcaacugaacaaa

SEQ ID NO: 3748508 - RNA, 23 nt, Human
ggcaacugaggcagacagcagcu

SEQ ID NO: 3748509 - RNA, 23 nt, Human
ggcaacuugggaacuagacuccc

SEQ ID NO: 3748510 - RNA, 18 nt, Human
ggcaagaaggaauugacu

SEQ ID NO: 3748511 - RNA, 16 nt, Human
ggcaagagggggugga

SEQ ID NO: 3748512 - RNA, 14 nt, Human
ggcaagaggggugg

SEQ ID NO: 3748513 - RNA, 18 nt, Human
ggcaagauugugucccau

SEQ ID NO: 3748514 - RNA, 18 nt, Human
ggcaagcuagaaccugga

SEQ ID NO: 3748515 - RNA, 22 nt, Human
ggcaagcugugacuucuccagg

SEQ ID NO: 3748516 - RNA, 22 nt, Human
ggcaagcuuggcuguagaagga

SEQ ID NO: 3748517 - RNA, 17 nt, Human
ggcaaggaaaaagaaaa

SEQ ID NO: 3748518 - RNA, 14 nt, Human
ggcaaggacacaga

SEQ ID NO: 3748519 - RNA, 23 nt, Human
ggcaaggacgcuucacaggacag

SEQ ID NO: 3748520 - RNA, 22 nt, Human
ggcaaggcaggugccuccaggu

SEQ ID NO: 3748521 - RNA, 15 nt, Human
ggcaaggcugucaau

SEQ ID NO: 3748522 - RNA, 16 nt, Human
ggcaaggcugucaauu

SEQ ID NO: 3748523 - RNA, 14 nt, Human
ggcaaggcugugcu

SEQ ID NO: 3748524 - RNA, 16 nt, Human
ggcaaggggaaucugg

SEQ ID NO: 3748525 - RNA, 15 nt, Human
ggcaauaaauuuuga

SEQ ID NO: 3748526 - RNA, 16 nt, Human
ggcaauaaauuuugaa

SEQ ID NO: 3748527 - RNA, 17 nt, Human
ggcaauaaauuuugaaa

SEQ ID NO: 3748528 - RNA, 20 nt, Human
ggcaauagaccgagacuccg

SEQ ID NO: 3748529 - RNA, 16 nt, Human
ggcaauauaaccaaug

SEQ ID NO: 3748530 - RNA, 21 nt, Human
ggcaauauagcaagaucccau

SEQ ID NO: 3748531 - RNA, 14 nt, Human
ggcaauauuaaccu

SEQ ID NO: 3748532 - RNA, 19 nt, Human
ggcaauauucucuguacau

SEQ ID NO: 3748533 - RNA, 15 nt, Human
ggcaaucaauguuca

SEQ ID NO: 3748534 - RNA, 18 nt, Human
ggcaaucuauuaauagcu

SEQ ID NO: 3748535 - RNA, 15 nt, Human
ggcaaugauggcaau

SEQ ID NO: 3748536 - RNA, 18 nt, Human
ggcaaugccacagcccug

SEQ ID NO: 3748537 - RNA, 14 nt, Human
ggcaaugcuggcug

SEQ ID NO: 3748538 - RNA, 15 nt, Human
ggcaaugcuggcugu

SEQ ID NO: 3748539 - RNA, 18 nt, Human
ggcaaugucaggaacaga

SEQ ID NO: 3748540 - RNA, 22 nt, Human
ggcaauguuaauuuaguggaaa

SEQ ID NO: 3748541 - RNA, 19 nt, Human
ggcaauuccaauauuucug

SEQ ID NO: 3748542 - RNA, 17 nt, Human
ggcacaaagggcccaga

SEQ ID NO: 3748543 - RNA, 22 nt, Human
ggcacaacugcaauaacuucug

SEQ ID NO: 3748544 - RNA, 13 nt, Human
ggcacaagacuga

SEQ ID NO: 3748545 - RNA, 11 nt, Human
ggcacaauaaa

SEQ ID NO: 3748546 - RNA, 22 nt, Human
ggcacaaucucggcucacugca

SEQ ID NO: 3748547 - RNA, 14 nt, Human
ggcacacaccacca

SEQ ID NO: 3748548 - RNA, 13 nt, Human
ggcacacaccugu

SEQ ID NO: 3748549 - RNA, 22 nt, Human
ggcacaccuccucccacugccc

SEQ ID NO: 3748550 - RNA, 21 nt, Human
ggcacacgcugcucugcccca

SEQ ID NO: 3748551 - RNA, 21 nt, Human
ggcacacucugccagcaaaga

SEQ ID NO: 3748552 - RNA, 19 nt, Human
ggcacagaaaauggaagac

SEQ ID NO: 3748553 - RNA, 20 nt, Human
ggcacagaaaauggaagaca

SEQ ID NO: 3748554 - RNA, 21 nt, Human
ggcacagaaaauggaagacag

SEQ ID NO: 3748555 - RNA, 11 nt, Human
ggcacagauug

SEQ ID NO: 3748556 - RNA, 23 nt, Human
ggcacagccggggccugccuagc

SEQ ID NO: 3748557 - RNA, 12 nt, Human
ggcacagccugg

SEQ ID NO: 3748558 - RNA, 13 nt, Human
ggcacagccuucu

SEQ ID NO: 3748559 - RNA, 12 nt, Human
ggcacagcugug

SEQ ID NO: 3748560 - RNA, 13 nt, Human
ggcacaggagcua

SEQ ID NO: 3748561 - RNA, 19 nt, Human
ggcacaggagcuaccugug

SEQ ID NO: 3748562 - RNA, 19 nt, Human
ggcacaggaguguccucuu

SEQ ID NO: 3748563 - RNA, 12 nt, Human
ggcacaggcagg

SEQ ID NO: 3748564 - RNA, 13 nt, Human
ggcacaggcaggg

SEQ ID NO: 3748565 - RNA, 15 nt, Human
ggcacaggcagggca

SEQ ID NO: 3748566 - RNA, 23 nt, Human
ggcacaggccauggauggaaaac

SEQ ID NO: 3748567 - RNA, 13 nt, Human
ggcacagggccug

SEQ ID NO: 3748568 - RNA, 14 nt, Human
ggcacagggccugg

SEQ ID NO: 3748569 - RNA, 15 nt, Human
ggcacagggccuggc

SEQ ID NO: 3748570 - RNA, 14 nt, Human
ggcacaggucaggg

SEQ ID NO: 3748571 - RNA, 15 nt, Human
ggcacagugucuggg

SEQ ID NO: 3748572 - RNA, 18 nt, Human
ggcacagugucugggcug

SEQ ID NO: 3748573 - RNA, 12 nt, Human
ggcacauagaga

SEQ ID NO: 3748574 - RNA, 18 nt, Human
ggcacaucagcacgauuu

SEQ ID NO: 3748575 - RNA, 19 nt, Human
ggcacaugcugagucuccc

SEQ ID NO: 3748576 - RNA, 16 nt, Human
ggcacauuuccccaga

SEQ ID NO: 3748577 - RNA, 21 nt, Human
ggcacauuuccccagaccuga

SEQ ID NO: 3748578 - RNA, 15 nt, Human
ggcaccaaagaugca

SEQ ID NO: 3748579 - RNA, 17 nt, Human
ggcaccagacacccagg

SEQ ID NO: 3748580 - RNA, 18 nt, Human
ggcaccagacacccagga

SEQ ID NO: 3748581 - RNA, 20 nt, Human
ggcaccagacacccaggacu

SEQ ID NO: 3748582 - RNA, 19 nt, Human
ggcaccagaggcugcagaa

SEQ ID NO: 3748583 - RNA, 18 nt, Human
ggcaccagcagccuggac

SEQ ID NO: 3748584 - RNA, 13 nt, Human
ggcaccagccagc

SEQ ID NO: 3748585 - RNA, 14 nt, Human
ggcaccagccagcg

SEQ ID NO: 3748586 - RNA, 17 nt, Human
ggcaccagggguuucuc

SEQ ID NO: 3748587 - RNA, 19 nt, Human
ggcaccaguagcaggcccg

SEQ ID NO: 3748588 - RNA, 14 nt, Human
ggcaccagucccug

SEQ ID NO: 3748589 - RNA, 16 nt, Human
ggcacccacaaauaaa

SEQ ID NO: 3748590 - RNA, 20 nt, Human
ggcacccaccaucaugucug

SEQ ID NO: 3748591 - RNA, 20 nt, Human
ggcacccagugagcacuccc

SEQ ID NO: 3748592 - RNA, 18 nt, Human
ggcacccccagccugggc

SEQ ID NO: 3748593 - RNA, 21 nt, Human
ggcacccccagccugggccua

SEQ ID NO: 3748594 - RNA, 14 nt, Human
ggcacccccugcag

SEQ ID NO: 3748595 - RNA, 15 nt, Human
ggcacccggccccug

SEQ ID NO: 3748596 - RNA, 19 nt, Human
ggcacccggccccugcugg

SEQ ID NO: 3748597 - RNA, 22 nt, Human
ggcacccggccccugcugguuc

SEQ ID NO: 3748598 - RNA, 12 nt, Human
ggcacccucugg

SEQ ID NO: 3748599 - RNA, 17 nt, Human
ggcacccuucuuuccuc

SEQ ID NO: 3748600 - RNA, 22 nt, Human
ggcacccuucuuuccucuuccc

SEQ ID NO: 3748601 - RNA, 16 nt, Human
ggcaccgaagcccaga

SEQ ID NO: 3748602 - RNA, 14 nt, Human
ggcaccgagaaugu

SEQ ID NO: 3748603 - RNA, 18 nt, Human
ggcaccggggccucggac

SEQ ID NO: 3748604 - RNA, 15 nt, Human
ggcaccuaauccagg

SEQ ID NO: 3748605 - RNA, 18 nt, Human
ggcaccuaauccaggcag

SEQ ID NO: 3748606 - RNA, 17 nt, Human
ggcaccuauaaaacagg

SEQ ID NO: 3748607 - RNA, 16 nt, Human
ggcaccugcagguugg

SEQ ID NO: 3748608 - RNA, 22 nt, Human
ggcaccugggcccuggggccug

SEQ ID NO: 3748609 - RNA, 16 nt, Human
ggcaccugucgcccag

SEQ ID NO: 3748610 - RNA, 13 nt, Human
ggcaccugucugc

SEQ ID NO: 3748611 - RNA, 19 nt, Human
ggcacgaacccaccugcug

SEQ ID NO: 3748612 - RNA, 20 nt, Human
ggcacgagcaaagugaagac

SEQ ID NO: 3748613 - RNA, 17 nt, Human
ggcacgcacuggguugc

SEQ ID NO: 3748614 - RNA, 13 nt, Human
ggcacgcuguggg

SEQ ID NO: 3748615 - RNA, 21 nt, Human
ggcacgcuugcguaugucugu

SEQ ID NO: 3748616 - RNA, 14 nt, Human
ggcacggguggucc

SEQ ID NO: 3748617 - RNA, 18 nt, Human
ggcacgucaucuaguuuu

SEQ ID NO: 3748618 - RNA, 19 nt, Human
ggcacgugguugagugggg

SEQ ID NO: 3748619 - RNA, 23 nt, Human
ggcacucaaugcagccagaccua

SEQ ID NO: 3748620 - RNA, 22 nt, Human
ggcacucacagaccuggagccc

SEQ ID NO: 3748621 - RNA, 18 nt, Human
ggcacucagaagacacug

SEQ ID NO: 3748622 - RNA, 19 nt, Human
ggcacucagaagacacuga

SEQ ID NO: 3748623 - RNA, 23 nt, Human
ggcacucagaagacacugauggg

SEQ ID NO: 3748624 - RNA, 19 nt, Human
ggcacuccaaccuaaccug

SEQ ID NO: 3748625 - RNA, 13 nt, Human
ggcacucuagauu

SEQ ID NO: 3748626 - RNA, 17 nt, Human
ggcacugagauauuuau

SEQ ID NO: 3748627 - RNA, 22 nt, Human
ggcacugauuguuuuagagacu

SEQ ID NO: 3748628 - RNA, 24 nt, Human
ggcacugcccugguggcccucucc

SEQ ID NO: 3748629 - RNA, 13 nt, Human
ggcacuggcccag

SEQ ID NO: 3748630 - RNA, 16 nt, Human
ggcacuggcgaggaga

SEQ ID NO: 3748631 - RNA, 15 nt, Human
ggcacugggcaugag

SEQ ID NO: 3748632 - RNA, 22 nt, Human
ggcacugggcuguuguuccauu

SEQ ID NO: 3748633 - RNA, 20 nt, Human
ggcacugguuuguucccugu

SEQ ID NO: 3748634 - RNA, 13 nt, Human
ggcacuguacaaa

SEQ ID NO: 3748635 - RNA, 17 nt, Human
ggcacuguaguucuaag

SEQ ID NO: 3748636 - RNA, 15 nt, Human
ggcacuucacagagu

SEQ ID NO: 3748637 - RNA, 21 nt, Human
ggcacuucacagagugugcug

SEQ ID NO: 3748638 - RNA, 21 nt, Human
ggcacuucauguaaaguguca

SEQ ID NO: 3748639 - RNA, 16 nt, Human
ggcacuugccuggguc

SEQ ID NO: 3748640 - RNA, 18 nt, Human
ggcacuuggcagccuugu

SEQ ID NO: 3748641 - RNA, 13 nt, Human
aacuccaguagcu

SEQ ID NO: 3748642 - RNA, 15 nt, Human
aacucccauuaccau

SEQ ID NO: 3748643 - RNA, 13 nt, Human
aacucccugcccc

SEQ ID NO: 3748644 - RNA, 12 nt, Human
aacuccggauug

SEQ ID NO: 3748645 - RNA, 19 nt, Human
aacuccucgacaucacugu

SEQ ID NO: 3748646 - RNA, 22 nt, Human
aacuccucgacaucacuguuca

SEQ ID NO: 3748647 - RNA, 17 nt, Human
aacuccugaccucaggc

SEQ ID NO: 3748648 - RNA, 14 nt, Human
aacuccuguccuuu

SEQ ID NO: 3748649 - RNA, 13 nt, Human
aacuccugugacc

SEQ ID NO: 3748650 - RNA, 19 nt, Human
aacucgaggacuguauuug

SEQ ID NO: 3748651 - RNA, 22 nt, Human
aacucgaggacuguauuuguga

SEQ ID NO: 3748652 - RNA, 18 nt, Human
aacucgcuucucugugac

SEQ ID NO: 3748653 - RNA, 17 nt, Human
aacucgguguccccacc

SEQ ID NO: 3748654 - RNA, 22 nt, Human
aacucgguguccccaccaucug

SEQ ID NO: 3748655 - RNA, 23 nt, Human
aacucgguguccccaccaucugc

SEQ ID NO: 3748656 - RNA, 19 nt, Human
aacucguauagcaugcauc

SEQ ID NO: 3748657 - RNA, 14 nt, Human
aacucuaaaagauc

SEQ ID NO: 3748658 - RNA, 17 nt, Human
aacucuaaguguuugcu

SEQ ID NO: 3748659 - RNA, 15 nt, Human
aacucuaauagugcu

SEQ ID NO: 3748660 - RNA, 13 nt, Human
aacucuaauucua

SEQ ID NO: 3748661 - RNA, 22 nt, Human
aacucuauauuguucagcaugc

SEQ ID NO: 3748662 - RNA, 23 nt, Human
aacucuauggguaucaaacagcu

SEQ ID NO: 3748663 - RNA, 22 nt, Human
aacucuccucugcugcuggcug

SEQ ID NO: 3748664 - RNA, 23 nt, Human
aacucuccucugcugcuggcugg

SEQ ID NO: 3748665 - RNA, 20 nt, Human
aacucucuggaagccccugg

SEQ ID NO: 3748666 - RNA, 10 nt, Human
aacucucuuu

SEQ ID NO: 3748667 - RNA, 19 nt, Human
aacucucuuugggaauguu

SEQ ID NO: 3748668 - RNA, 14 nt, Human
aacucugaacuuug

SEQ ID NO: 3748669 - RNA, 18 nt, Human
aacucugaacuuuggaga

SEQ ID NO: 3748670 - RNA, 15 nt, Human
aacucugaauaagca

SEQ ID NO: 3748671 - RNA, 19 nt, Human
aacucugaauuuuaaagca

SEQ ID NO: 3748672 - RNA, 15 nt, Human
aacucugacaagggc

SEQ ID NO: 3748673 - RNA, 17 nt, Human
aacucugacaagggcug

SEQ ID NO: 3748674 - RNA, 19 nt, Human
aacucugacaagggcugac

SEQ ID NO: 3748675 - RNA, 22 nt, Human
aacucugacaagggcugaccug

SEQ ID NO: 3748676 - RNA, 23 nt, Human
aacucugagagauuuggggcuaa

SEQ ID NO: 3748677 - RNA, 18 nt, Human
aacucugagugcaaacuu

SEQ ID NO: 3748678 - RNA, 20 nt, Human
aacucugagugcaaacuuca

SEQ ID NO: 3748679 - RNA, 22 nt, Human
aacucugagugcaaacuucaga

SEQ ID NO: 3748680 - RNA, 13 nt, Human
aacucugauguaa

SEQ ID NO: 3748681 - RNA, 20 nt, Human
aacucugauguaaaugaagu

SEQ ID NO: 3748682 - RNA, 15 nt, Human
aacucugcacuacuc

SEQ ID NO: 3748683 - RNA, 15 nt, Human
aacucugcauguaga

SEQ ID NO: 3748684 - RNA, 12 nt, Human
aacucugccugc

SEQ ID NO: 3748685 - RNA, 15 nt, Human
aacucugcugagggu

SEQ ID NO: 3748686 - RNA, 21 nt, Human
aacucugcugaggguccagaa

SEQ ID NO: 3748687 - RNA, 13 nt, Human
aacucugguggca

SEQ ID NO: 3748688 - RNA, 15 nt, Human
aacucuuaucucagu

SEQ ID NO: 3748689 - RNA, 21 nt, Human
aacucuucaaucucuugcacu

SEQ ID NO: 3748690 - RNA, 16 nt, Human
aacucuucucauuacu

SEQ ID NO: 3748691 - RNA, 12 nt, Human
aacucuuucaaa

SEQ ID NO: 3748692 - RNA, 15 nt, Human
aacucuuuguuauuu

SEQ ID NO: 3748693 - RNA, 12 nt, Human
aacugaaaacau

SEQ ID NO: 3748694 - RNA, 18 nt, Human
aacugaaaacauaaaaag

SEQ ID NO: 3748695 - RNA, 13 nt, Human
aacugaaaagaga

SEQ ID NO: 3748696 - RNA, 14 nt, Human
aacugaaaagagag

SEQ ID NO: 3748697 - RNA, 19 nt, Human
aacugaaaagagagcagag

SEQ ID NO: 3748698 - RNA, 20 nt, Human
aacugaaaagagagcagaga

SEQ ID NO: 3748699 - RNA, 22 nt, Human
aacugaaaagagagcagagaau

SEQ ID NO: 3748700 - RNA, 19 nt, Human
aacugaaaaucuaauauua

SEQ ID NO: 3748701 - RNA, 16 nt, Human
aacugaaacaugcuua

SEQ ID NO: 3748702 - RNA, 13 nt, Human
aacugaaaucaua

SEQ ID NO: 3748703 - RNA, 20 nt, Human
aacugaaaucauacuucuua

SEQ ID NO: 3748704 - RNA, 16 nt, Human
aacugaaaugccugcu

SEQ ID NO: 3748705 - RNA, 16 nt, Human
aacugaacaaaaaaau

SEQ ID NO: 3748706 - RNA, 22 nt, Human
aacugaacaccauugaaggcuu

SEQ ID NO: 3748707 - RNA, 15 nt, Human
aacugaacuucagag

SEQ ID NO: 3748708 - RNA, 20 nt, Human
aacugaacuuugaagacccg

SEQ ID NO: 3748709 - RNA, 13 nt, Human
aacugaagagaca

SEQ ID NO: 3748710 - RNA, 13 nt, Human
aacugaagccaga

SEQ ID NO: 3748711 - RNA, 21 nt, Human
aacugaaggcuaaaaagcaac

SEQ ID NO: 3748712 - RNA, 16 nt, Human
aacugaaguuucacau

SEQ ID NO: 3748713 - RNA, 10 nt, Human
aacugaauaa

SEQ ID NO: 3748714 - RNA, 13 nt, Human
aacugaauaccac

SEQ ID NO: 3748715 - RNA, 14 nt, Human
aacugaauaccacu

SEQ ID NO: 3748716 - RNA, 15 nt, Human
aacugaauaccacuc

SEQ ID NO: 3748717 - RNA, 17 nt, Human
aacugaauaccacucug

SEQ ID NO: 3748718 - RNA, 21 nt, Human
aacugaauaccacucuguaau

SEQ ID NO: 3748719 - RNA, 15 nt, Human
aacugacaaaucaag

SEQ ID NO: 3748720 - RNA, 18 nt, Human
aacugacaaaucaaguuu

SEQ ID NO: 3748721 - RNA, 13 nt, Human
aacugacacagga

SEQ ID NO: 3748722 - RNA, 23 nt, Human
aacugacacaugcugaacaucac

SEQ ID NO: 3748723 - RNA, 14 nt, Human
aacugaccagccuc

SEQ ID NO: 3748724 - RNA, 22 nt, Human
aacugacuaucauaaaaucaaa

SEQ ID NO: 3748725 - RNA, 20 nt, Human
aacugacuauucuugaugua

SEQ ID NO: 3748726 - RNA, 19 nt, Human
aacugacucuuaagaagac

SEQ ID NO: 3748727 - RNA, 13 nt, Human
aacugacuugcug

SEQ ID NO: 3748728 - RNA, 13 nt, Human
aacugacuuuauc

SEQ ID NO: 3748729 - RNA, 13 nt, Human
aacugagcuugga

SEQ ID NO: 3748730 - RNA, 17 nt, Human
aacugagcuuggaagcu

SEQ ID NO: 3748731 - RNA, 21 nt, Human
aacugagcuuggaagcuucug

SEQ ID NO: 3748732 - RNA, 12 nt, Human
aacugaggaauu

SEQ ID NO: 3748733 - RNA, 16 nt, Human
aacugaggaauuuucu

SEQ ID NO: 3748734 - RNA, 20 nt, Human
aacugaggaauuuucuuugu

SEQ ID NO: 3748735 - RNA, 20 nt, Human
aacugaggcagacagcagcu

SEQ ID NO: 3748736 - RNA, 16 nt, Human
aacugagugccuuuug

SEQ ID NO: 3748737 - RNA, 23 nt, Human
aacugauaguuacuguugugacc

SEQ ID NO: 3748738 - RNA, 16 nt, Human
aacugaucauguuuau

SEQ ID NO: 3748739 - RNA, 17 nt, Human
aacugcaaccuuguuua

SEQ ID NO: 3748740 - RNA, 17 nt, Human
aacugcaagucacaaag

SEQ ID NO: 3748741 - RNA, 23 nt, Human
aacugcaagucacaaaggaaugg

SEQ ID NO: 3748742 - RNA, 17 nt, Human
aacugcaauagagacug

SEQ ID NO: 3748743 - RNA, 16 nt, Human
aacugcacaugauuuc

SEQ ID NO: 3748744 - RNA, 21 nt, Human
aacugcacaugauuucacaaa

SEQ ID NO: 3748745 - RNA, 17 nt, Human
aacugcagaccuguccu

SEQ ID NO: 3748746 - RNA, 18 nt, Human
aacugcagaccuguccuc

SEQ ID NO: 3748747 - RNA, 19 nt, Human
aacugcagaccuguccucc

SEQ ID NO: 3748748 - RNA, 10 nt, Human
aacugcagca

SEQ ID NO: 3748749 - RNA, 19 nt, Human
aacugcaggcccuggccuc

SEQ ID NO: 3748750 - RNA, 20 nt, Human
aacugcaggcccuggccucc

SEQ ID NO: 3748751 - RNA, 23 nt, Human
aacugcagggaaaauuauuugca

SEQ ID NO: 3748752 - RNA, 18 nt, Human
aacugcaugcccagagac

SEQ ID NO: 3748753 - RNA, 16 nt, Human
aacugcaugcugcugg

SEQ ID NO: 3748754 - RNA, 19 nt, Human
aacugcauguauaaaugaa

SEQ ID NO: 3748755 - RNA, 22 nt, Human
aacugcauuaccgcguuguaaa

SEQ ID NO: 3748756 - RNA, 16 nt, Human
aacugcauuagaaauu

SEQ ID NO: 3748757 - RNA, 18 nt, Human
aacugccaaaaugcucua

SEQ ID NO: 3748758 - RNA, 15 nt, Human
aacugccaagaaauu

SEQ ID NO: 3748759 - RNA, 14 nt, Human
aacugccaguuuug

SEQ ID NO: 3748760 - RNA, 16 nt, Human
aacugcccaguuucca

SEQ ID NO: 3748761 - RNA, 21 nt, Human
aacugcccccucugcccugcg

SEQ ID NO: 3748762 - RNA, 16 nt, Human
aacugcguuaaaggcu

SEQ ID NO: 3748763 - RNA, 19 nt, Human
aacugcucuugggcaauau

SEQ ID NO: 3748764 - RNA, 22 nt, Human
aacugcucuugggcaauauucu

SEQ ID NO: 3748765 - RNA, 23 nt, Human
aacugcucuugggcaauauucuc

SEQ ID NO: 3748766 - RNA, 21 nt, Human
aacugcugacuguuuucucuu

SEQ ID NO: 3748767 - RNA, 23 nt, Human
aacugcugacuguuuucucuuga

SEQ ID NO: 3748768 - RNA, 18 nt, Human
aacugcugaugcucaugg

SEQ ID NO: 3748769 - RNA, 19 nt, Human
aacugcugaugcucauggu

SEQ ID NO: 3748770 - RNA, 22 nt, Human
aacugcugccccaaaggaagcu

SEQ ID NO: 3748771 - RNA, 23 nt, Human
aacugcuggacgucuuucuuuuu

SEQ ID NO: 3748772 - RNA, 15 nt, Human
aacugcuuucuuucg

SEQ ID NO: 3748773 - RNA, 17 nt, Human
aacuggaaaacagaaca

SEQ ID NO: 3748774 - RNA, 19 nt, Human
aacuggaaaacagaacacu

SEQ ID NO: 3748775 - RNA, 16 nt, Human
aacuggaaguuauuua

SEQ ID NO: 3748776 - RNA, 14 nt, Human
aacuggaauaagaa

SEQ ID NO: 3748777 - RNA, 15 nt, Human
aacuggaauaagaag

SEQ ID NO: 3748778 - RNA, 17 nt, Human
aacuggaauaguuuuuu

SEQ ID NO: 3748779 - RNA, 16 nt, Human
aacuggaaucagcuca

SEQ ID NO: 3748780 - RNA, 17 nt, Human
aacuggacccuguugcu

SEQ ID NO: 3748781 - RNA, 22 nt, Human
aacuggacucaggaugcccagg

SEQ ID NO: 3748782 - RNA, 16 nt, Human
aacuggauuaaacuua

SEQ ID NO: 3748783 - RNA, 19 nt, Human
aacuggcaauugucuauuu

SEQ ID NO: 3748784 - RNA, 17 nt, Human
aacuggcaguuuuccau

SEQ ID NO: 3748785 - RNA, 18 nt, Human
aacuggccauggccugca

SEQ ID NO: 3748786 - RNA, 14 nt, Human
aacuggcccucuuc

SEQ ID NO: 3748787 - RNA, 15 nt, Human
aacuggcccucuucu

SEQ ID NO: 3748788 - RNA, 16 nt, Human
aacuggcccucuucuu

SEQ ID NO: 3748789 - RNA, 11 nt, Human
aacuggcugca

SEQ ID NO: 3748790 - RNA, 18 nt, Human
aacugggaaccccuuucc

SEQ ID NO: 3748791 - RNA, 18 nt, Human
ggcucuccaagugccaga

SEQ ID NO: 3748792 - RNA, 19 nt, Human
ggcucuccaagugccagag

SEQ ID NO: 3748793 - RNA, 20 nt, Human
ggcucuccaagugccagagg

SEQ ID NO: 3748794 - RNA, 22 nt, Human
ggcucuccaccucagccuugga

SEQ ID NO: 3748795 - RNA, 14 nt, Human
ggcucuccuggccc

SEQ ID NO: 3748796 - RNA, 21 nt, Human
ggcucucgcggccucuucucu

SEQ ID NO: 3748797 - RNA, 12 nt, Human
ggcucucuccag

SEQ ID NO: 3748798 - RNA, 22 nt, Human
ggcucugaagcaaggcggugga

SEQ ID NO: 3748799 - RNA, 20 nt, Human
ggcucugacaaagcuucccg

SEQ ID NO: 3748800 - RNA, 13 nt, Human
ggcucugaccagu

SEQ ID NO: 3748801 - RNA, 14 nt, Human
ggcucugagcgccu

SEQ ID NO: 3748802 - RNA, 15 nt, Human
ggcucugagcgccuc

SEQ ID NO: 3748803 - RNA, 14 nt, Human
ggcucugaggcgcc

SEQ ID NO: 3748804 - RNA, 22 nt, Human
ggcucugaugaaaaauugcuga

SEQ ID NO: 3748805 - RNA, 12 nt, Human
ggcucugcacag

SEQ ID NO: 3748806 - RNA, 12 nt, Human
ggcucugcaguc

SEQ ID NO: 3748807 - RNA, 22 nt, Human
ggcucugcaguccuacucaagc

SEQ ID NO: 3748808 - RNA, 17 nt, Human
ggcucugccaguccugu

SEQ ID NO: 3748809 - RNA, 20 nt, Human
ggcucugccaguccuguccu

SEQ ID NO: 3748810 - RNA, 17 nt, Human
ggcucugccccagaggc

SEQ ID NO: 3748811 - RNA, 14 nt, Human
ggcucugccccagc

SEQ ID NO: 3748812 - RNA, 21 nt, Human
ggcucugccccagcucuggcu

SEQ ID NO: 3748813 - RNA, 15 nt, Human
ggcucugcccuuggu

SEQ ID NO: 3748814 - RNA, 16 nt, Human
ggcucugccucccauc

SEQ ID NO: 3748815 - RNA, 18 nt, Human
ggcucuggacucuaaaga

SEQ ID NO: 3748816 - RNA, 12 nt, Human
ggcucuggagac

SEQ ID NO: 3748817 - RNA, 16 nt, Human
ggcucuggagacagcc

SEQ ID NO: 3748818 - RNA, 21 nt, Human
ggcucuggagacagccccaga

SEQ ID NO: 3748819 - RNA, 16 nt, Human
ggcucuggagcccacu

SEQ ID NO: 3748820 - RNA, 23 nt, Human
ggcucuguccccagccugggaaa

SEQ ID NO: 3748821 - RNA, 15 nt, Human
ggcucugucccccug

SEQ ID NO: 3748822 - RNA, 15 nt, Human
ggcucugugcaggga

SEQ ID NO: 3748823 - RNA, 19 nt, Human
ggcucugugcugacccucc

SEQ ID NO: 3748824 - RNA, 18 nt, Human
ggcucuguggcuugcuag

SEQ ID NO: 3748825 - RNA, 12 nt, Human
ggcucugugggc

SEQ ID NO: 3748826 - RNA, 18 nt, Human
ggcucugugggcugcacu

SEQ ID NO: 3748827 - RNA, 19 nt, Human
ggcucugugggugaugggg

SEQ ID NO: 3748828 - RNA, 20 nt, Human
ggcucuuagcagcuuccaga

SEQ ID NO: 3748829 - RNA, 21 nt, Human
ggcucuuagcagcuuccagau

SEQ ID NO: 3748830 - RNA, 12 nt, Human
ggcucuucucau

SEQ ID NO: 3748831 - RNA, 17 nt, Human
ggcucuucuccccagag

SEQ ID NO: 3748832 - RNA, 13 nt, Human
ggcucuucuccuu

SEQ ID NO: 3748833 - RNA, 20 nt, Human
ggcucuugaacugagcuugg

SEQ ID NO: 3748834 - RNA, 23 nt, Human
ggcucuugugcuggauggagccc

SEQ ID NO: 3748835 - RNA, 15 nt, Human
ggcucuuuccuugcu

SEQ ID NO: 3748836 - RNA, 15 nt, Human
ggcucuuugggcugg

SEQ ID NO: 3748837 - RNA, 22 nt, Human
ggcucuuuggggucagccaggg

SEQ ID NO: 3748838 - RNA, 11 nt, Human
ggcugaaagcc

SEQ ID NO: 3748839 - RNA, 21 nt, Human
ggcugaacccugugcuggugu

SEQ ID NO: 3748840 - RNA, 15 nt, Human
ggcugaacggggaga

SEQ ID NO: 3748841 - RNA, 13 nt, Human
ggcugaaggacug

SEQ ID NO: 3748842 - RNA, 18 nt, Human
ggcugaaggacugugaca

SEQ ID NO: 3748843 - RNA, 22 nt, Human
ggcugacacuucaaggugacag

SEQ ID NO: 3748844 - RNA, 22 nt, Human
ggcugacaugaagcuguugugu

SEQ ID NO: 3748845 - RNA, 13 nt, Human
ggcugaccacagc

SEQ ID NO: 3748846 - RNA, 15 nt, Human
ggcugaccacagcac

SEQ ID NO: 3748847 - RNA, 17 nt, Human
ggcugacccagucccug

SEQ ID NO: 3748848 - RNA, 18 nt, Human
ggcugaccccaaagagcc

SEQ ID NO: 3748849 - RNA, 22 nt, Human
ggcugaccccaaagagccugga

SEQ ID NO: 3748850 - RNA, 23 nt, Human
ggcugaccuuccucgcagagagg

SEQ ID NO: 3748851 - RNA, 22 nt, Human
ggcugacggugcagucugggug

SEQ ID NO: 3748852 - RNA, 16 nt, Human
ggcugacugggccagg

SEQ ID NO: 3748853 - RNA, 14 nt, Human
ggcugagaacacug

SEQ ID NO: 3748854 - RNA, 21 nt, Human
ggcugagacugcgggaugguc

SEQ ID NO: 3748855 - RNA, 15 nt, Human
ggcugagauaugaac

SEQ ID NO: 3748856 - RNA, 11 nt, Human
ggcugagccug

SEQ ID NO: 3748857 - RNA, 15 nt, Human
ggcugagccuggcug

SEQ ID NO: 3748858 - RNA, 19 nt, Human
ggcugagcggaugcaucug

SEQ ID NO: 3748859 - RNA, 19 nt, Human
ggcugaggaggccuccauc

SEQ ID NO: 3748860 - RNA, 13 nt, Human
ggcugaggcagaa

SEQ ID NO: 3748861 - RNA, 14 nt, Human
ggcugaggcagaag

SEQ ID NO: 3748862 - RNA, 14 nt, Human
ggcugaggcaggag

SEQ ID NO: 3748863 - RNA, 16 nt, Human
ggcugaggcaggagaa

SEQ ID NO: 3748864 - RNA, 23 nt, Human
ggcugaggcaggagaauggugug

SEQ ID NO: 3748865 - RNA, 13 nt, Human
ggcugaggccacc

SEQ ID NO: 3748866 - RNA, 16 nt, Human
ggcugaggccuggacu

SEQ ID NO: 3748867 - RNA, 12 nt, Human
ggcugagggccu

SEQ ID NO: 3748868 - RNA, 14 nt, Human
ggcugagggccugc

SEQ ID NO: 3748869 - RNA, 15 nt, Human
ggcugagggccugcu

SEQ ID NO: 3748870 - RNA, 15 nt, Human
ggcugaggugggagg

SEQ ID NO: 3748871 - RNA, 16 nt, Human
ggcugagguuccucug

SEQ ID NO: 3748872 - RNA, 17 nt, Human
ggcugagguuccucugc

SEQ ID NO: 3748873 - RNA, 19 nt, Human
ggcugagguuccucugccu

SEQ ID NO: 3748874 - RNA, 17 nt, Human
ggcugagucaggacuug

SEQ ID NO: 3748875 - RNA, 22 nt, Human
ggcugagucaugaucucccugc

SEQ ID NO: 3748876 - RNA, 16 nt, Human
ggcugagugcaggccc

SEQ ID NO: 3748877 - RNA, 17 nt, Human
ggcugagugcaggccca

SEQ ID NO: 3748878 - RNA, 19 nt, Human
ggcugagugcaggcccacc

SEQ ID NO: 3748879 - RNA, 15 nt, Human
ggcugaucucaggga

SEQ ID NO: 3748880 - RNA, 19 nt, Human
ggcugaucucagggaagcc

SEQ ID NO: 3748881 - RNA, 18 nt, Human
ggcugaugucaauuucug

SEQ ID NO: 3748882 - RNA, 17 nt, Human
ggcugcaccggcuggcc

SEQ ID NO: 3748883 - RNA, 16 nt, Human
ggcugcagaggccaga

SEQ ID NO: 3748884 - RNA, 18 nt, Human
ggcugcagaggccagagg

SEQ ID NO: 3748885 - RNA, 16 nt, Human
ggcugcagccaggcca

SEQ ID NO: 3748886 - RNA, 18 nt, Human
ggcugcagccucaggacu

SEQ ID NO: 3748887 - RNA, 15 nt, Human
ggcugcagccugcgc

SEQ ID NO: 3748888 - RNA, 17 nt, Human
ggcugcaguagccaugu

SEQ ID NO: 3748889 - RNA, 22 nt, Human
ggcugcaguucgacucugugcu

SEQ ID NO: 3748890 - RNA, 16 nt, Human
ggcugcauagaaggag

SEQ ID NO: 3748891 - RNA, 21 nt, Human
ggcugccaaugggagcucaug

SEQ ID NO: 3748892 - RNA, 13 nt, Human
ggcugccaccaag

SEQ ID NO: 3748893 - RNA, 20 nt, Human
ggcugcccacacaccccaau

SEQ ID NO: 3748894 - RNA, 19 nt, Human
ggcugcccccggcccccug

SEQ ID NO: 3748895 - RNA, 13 nt, Human
ggcugccccucuc

SEQ ID NO: 3748896 - RNA, 13 nt, Human
ggcugcccgcucc

SEQ ID NO: 3748897 - RNA, 18 nt, Human
ggcugcccgcucccagug

SEQ ID NO: 3748898 - RNA, 14 nt, Human
ggcugcccuccugu

SEQ ID NO: 3748899 - RNA, 20 nt, Human
ggcugcccuccugugcucag

SEQ ID NO: 3748900 - RNA, 13 nt, Human
ggcugcccugaga

SEQ ID NO: 3748901 - RNA, 12 nt, Human
ggcugcccugcc

SEQ ID NO: 3748902 - RNA, 12 nt, Human
ggcugcccuggc

SEQ ID NO: 3748903 - RNA, 19 nt, Human
ggcugcccuggcccugagg

SEQ ID NO: 3748904 - RNA, 21 nt, Human
ggcugcccuggcccugaggug

SEQ ID NO: 3748905 - RNA, 15 nt, Human
ggcugccggggcagc

SEQ ID NO: 3748906 - RNA, 21 nt, Human
ggcugccggguucuagucucc

SEQ ID NO: 3748907 - RNA, 23 nt, Human
ggcugccguggggccgccgccuc

SEQ ID NO: 3748908 - RNA, 19 nt, Human
ggcugccuccacucccacu

SEQ ID NO: 3748909 - RNA, 12 nt, Human
ggcugccuccca

SEQ ID NO: 3748910 - RNA, 20 nt, Human
ggcugccucccuuguggcag

SEQ ID NO: 3748911 - RNA, 15 nt, Human
ggcugccuggagccc

SEQ ID NO: 3748912 - RNA, 11 nt, Human
ggcugccuggg

SEQ ID NO: 3748913 - RNA, 15 nt, Human
ggcugccugggcugu

SEQ ID NO: 3748914 - RNA, 15 nt, Human
ggcugcgcacugugu

SEQ ID NO: 3748915 - RNA, 17 nt, Human
ggcugcggcgucugucu

SEQ ID NO: 3748916 - RNA, 16 nt, Human
ggcugcuacccagaaa

SEQ ID NO: 3748917 - RNA, 12 nt, Human
ggcugcucccac

SEQ ID NO: 3748918 - RNA, 21 nt, Human
ggcugcucccaccuggcucug

SEQ ID NO: 3748919 - RNA, 22 nt, Human
ggcugcucccaccuggcucugu

SEQ ID NO: 3748920 - RNA, 12 nt, Human
ggcugcuccucc

SEQ ID NO: 3748921 - RNA, 19 nt, Human
ggcugcuccuccagggcca

SEQ ID NO: 3748922 - RNA, 22 nt, Human
ggcugcucggggugcacaggag

SEQ ID NO: 3748923 - RNA, 13 nt, Human
ggcugcugaagcu

SEQ ID NO: 3748924 - RNA, 15 nt, Human
ggcugcugaaggcuc

SEQ ID NO: 3748925 - RNA, 16 nt, Human
ggcugcugaccuccac

SEQ ID NO: 3748926 - RNA, 19 nt, Human
ggcugcugaucgccuuccc

SEQ ID NO: 3748927 - RNA, 11 nt, Human
ggcugcugccc

SEQ ID NO: 3748928 - RNA, 14 nt, Human
ggcugcugcccagg

SEQ ID NO: 3748929 - RNA, 13 nt, Human
ggcugcugccccc

SEQ ID NO: 3748930 - RNA, 12 nt, Human
ggcugcuggagg

SEQ ID NO: 3748931 - RNA, 14 nt, Human
ggcugcuggcgccu

SEQ ID NO: 3748932 - RNA, 18 nt, Human
ggcugcuggcgccucugc

SEQ ID NO: 3748933 - RNA, 22 nt, Human
ggcugcugggggcaacuggcca

SEQ ID NO: 3748934 - RNA, 14 nt, Human
ggcugcuuagaauc

SEQ ID NO: 3748935 - RNA, 11 nt, Human
ggcugcuucaa

SEQ ID NO: 3748936 - RNA, 14 nt, Human
ggcugcuucaagga

SEQ ID NO: 3748937 - RNA, 19 nt, Human
ggcugcuucaaggauccug

SEQ ID NO: 3748938 - RNA, 16 nt, Human
ggcugcuuccuccugg

SEQ ID NO: 3748939 - RNA, 19 nt, Human
ggcugcuuccuccuggaaa

SEQ ID NO: 3748940 - RNA, 18 nt, Human
ggcugcuucugccacugc

SEQ ID NO: 3748941 - RNA, 15 nt, Human
ggcugcuuuccaaag

SEQ ID NO: 3748942 - RNA, 16 nt, Human
ggcacuuuaaaacacu

SEQ ID NO: 3748943 - RNA, 22 nt, Human
ggcacuuugaaggggccucacc

SEQ ID NO: 3748944 - RNA, 16 nt, Human
ggcacuuugacagcgc

SEQ ID NO: 3748945 - RNA, 14 nt, Human
ggcacuuuuuaauu

SEQ ID NO: 3748946 - RNA, 22 nt, Human
ggcagaaagguucugcccggga

SEQ ID NO: 3748947 - RNA, 14 nt, Human
ggcagaacacuaac

SEQ ID NO: 3748948 - RNA, 15 nt, Human
ggcagaacacuaacc

SEQ ID NO: 3748949 - RNA, 14 nt, Human
ggcagaacagccgc

SEQ ID NO: 3748950 - RNA, 15 nt, Human
ggcagaagacaccag

SEQ ID NO: 3748951 - RNA, 16 nt, Human
ggcagaagacaccaga

SEQ ID NO: 3748952 - RNA, 21 nt, Human
ggcagaagacaccagagcaga

SEQ ID NO: 3748953 - RNA, 12 nt, Human
ggcagaaggaag

SEQ ID NO: 3748954 - RNA, 18 nt, Human
ggcagaaugcuagcucug

SEQ ID NO: 3748955 - RNA, 17 nt, Human
ggcagacacagggacuu

SEQ ID NO: 3748956 - RNA, 14 nt, Human
ggcagacagcagcu

SEQ ID NO: 3748957 - RNA, 20 nt, Human
ggcagacagcagcucaggca

SEQ ID NO: 3748958 - RNA, 17 nt, Human
ggcagacagcaggcagc

SEQ ID NO: 3748959 - RNA, 23 nt, Human
ggcagacagcaggcagcgccaag

SEQ ID NO: 3748960 - RNA, 16 nt, Human
ggcagacgccggggac

SEQ ID NO: 3748961 - RNA, 19 nt, Human
ggcagacucuuuaugcuug

SEQ ID NO: 3748962 - RNA, 14 nt, Human
ggcagagaaagaag

SEQ ID NO: 3748963 - RNA, 17 nt, Human
ggcagagaaagaagaga

SEQ ID NO: 3748964 - RNA, 20 nt, Human
ggcagagaagaaagaacgga

SEQ ID NO: 3748965 - RNA, 16 nt, Human
ggcagagagagagaaa

SEQ ID NO: 3748966 - RNA, 16 nt, Human
ggcagagaggcugugg

SEQ ID NO: 3748967 - RNA, 16 nt, Human
ggcagagaugccuccc

SEQ ID NO: 3748968 - RNA, 22 nt, Human
ggcagagaugccucccugagcu

SEQ ID NO: 3748969 - RNA, 10 nt, Human
ggcagagcag

SEQ ID NO: 3748970 - RNA, 20 nt, Human
ggcagagcagagaccauccc

SEQ ID NO: 3748971 - RNA, 17 nt, Human
ggcagagccaggaagau

SEQ ID NO: 3748972 - RNA, 12 nt, Human
ggcagagcccaa

SEQ ID NO: 3748973 - RNA, 20 nt, Human
ggcagagcccugcucccucc

SEQ ID NO: 3748974 - RNA, 12 nt, Human
ggcagagcuggu

SEQ ID NO: 3748975 - RNA, 14 nt, Human
ggcagagcuggugc

SEQ ID NO: 3748976 - RNA, 13 nt, Human
ggcagagcuucuu

SEQ ID NO: 3748977 - RNA, 21 nt, Human
ggcagagcuuggacuggaugc

SEQ ID NO: 3748978 - RNA, 14 nt, Human
ggcagaggcccagg

SEQ ID NO: 3748979 - RNA, 21 nt, Human
ggcagaggcccaggcugccgu

SEQ ID NO: 3748980 - RNA, 22 nt, Human
ggcagaggcccaggcugccguc

SEQ ID NO: 3748981 - RNA, 17 nt, Human
ggcagaggccugggcug

SEQ ID NO: 3748982 - RNA, 18 nt, Human
ggcagaggccugggcugg

SEQ ID NO: 3748983 - RNA, 19 nt, Human
ggcagaggcuggaggcagg

SEQ ID NO: 3748984 - RNA, 13 nt, Human
ggcagagggcugg

SEQ ID NO: 3748985 - RNA, 21 nt, Human
ggcagagggcuggaggcccag

SEQ ID NO: 3748986 - RNA, 15 nt, Human
ggcagaguccuggag

SEQ ID NO: 3748987 - RNA, 16 nt, Human
ggcagagugccccacc

SEQ ID NO: 3748988 - RNA, 21 nt, Human
ggcagagugccccaccugcca

SEQ ID NO: 3748989 - RNA, 22 nt, Human
ggcagagugccccaccugccac

SEQ ID NO: 3748990 - RNA, 19 nt, Human
ggcagaguugaagacagag

SEQ ID NO: 3748991 - RNA, 21 nt, Human
ggcagaguugaagacagagcu

SEQ ID NO: 3748992 - RNA, 14 nt, Human
ggcagaguuguaaa

SEQ ID NO: 3748993 - RNA, 15 nt, Human
ggcagaguuguaaau

SEQ ID NO: 3748994 - RNA, 18 nt, Human
ggcagaguuguaaauaua

SEQ ID NO: 3748995 - RNA, 23 nt, Human
ggcagaguuguaaauauauaaau

SEQ ID NO: 3748996 - RNA, 20 nt, Human
ggcagauaaucagccucuua

SEQ ID NO: 3748997 - RNA, 14 nt, Human
ggcagauccaggac

SEQ ID NO: 3748998 - RNA, 13 nt, Human
ggcagaucuccca

SEQ ID NO: 3748999 - RNA, 19 nt, Human
ggcagaucucccacaugcc

SEQ ID NO: 3749000 - RNA, 16 nt, Human
ggcagaucugugcccc

SEQ ID NO: 3749001 - RNA, 18 nt, Human
ggcagaucugugccccau

SEQ ID NO: 3749002 - RNA, 15 nt, Human
ggcagauggggagac

SEQ ID NO: 3749003 - RNA, 14 nt, Human
ggcagauguaggag

SEQ ID NO: 3749004 - RNA, 16 nt, Human
ggcagauguaggaggg

SEQ ID NO: 3749005 - RNA, 24 nt, Human
ggcagauuuagugaaagcuagaga

SEQ ID NO: 3749006 - RNA, 21 nt, Human
ggcagauuuuacaaaagaugu

SEQ ID NO: 3749007 - RNA, 20 nt, Human
ggcagauuuuacagagcgca

SEQ ID NO: 3749008 - RNA, 17 nt, Human
ggcagcaacaauaaaua

SEQ ID NO: 3749009 - RNA, 22 nt, Human
ggcagcaacaauaaauagacac

SEQ ID NO: 3749010 - RNA, 12 nt, Human
ggcagcaaggcc

SEQ ID NO: 3749011 - RNA, 17 nt, Human
ggcagcaaggcccgagc

SEQ ID NO: 3749012 - RNA, 19 nt, Human
ggcagcaaggcccgagcag

SEQ ID NO: 3749013 - RNA, 23 nt, Human
ggcagcaaggcccgagcagcuga

SEQ ID NO: 3749014 - RNA, 16 nt, Human
ggcagcaauuuaaaug

SEQ ID NO: 3749015 - RNA, 18 nt, Human
ggcagcagaagggggugg

SEQ ID NO: 3749016 - RNA, 14 nt, Human
ggcagcagacacau

SEQ ID NO: 3749017 - RNA, 16 nt, Human
ggcagcagacacaugc

SEQ ID NO: 3749018 - RNA, 14 nt, Human
ggcagcagcagccc

SEQ ID NO: 3749019 - RNA, 14 nt, Human
ggcagcagccagcc

SEQ ID NO: 3749020 - RNA, 18 nt, Human
ggcagcagccagcccugc

SEQ ID NO: 3749021 - RNA, 15 nt, Human
ggcagcagcccccag

SEQ ID NO: 3749022 - RNA, 21 nt, Human
ggcagcagggcuacccugagc

SEQ ID NO: 3749023 - RNA, 19 nt, Human
ggcagcagugugaggccag

SEQ ID NO: 3749024 - RNA, 14 nt, Human
ggcagccagaccag

SEQ ID NO: 3749025 - RNA, 19 nt, Human
ggcagccagcaucugggcc

SEQ ID NO: 3749026 - RNA, 20 nt, Human
ggcagccagcaucugggccu

SEQ ID NO: 3749027 - RNA, 13 nt, Human
ggcagccaggcca

SEQ ID NO: 3749028 - RNA, 15 nt, Human
ggcagccaggcugcc

SEQ ID NO: 3749029 - RNA, 19 nt, Human
ggcagccagugcccugagc

SEQ ID NO: 3749030 - RNA, 15 nt, Human
ggcagcccagagacu

SEQ ID NO: 3749031 - RNA, 14 nt, Human
ggcagcccagccag

SEQ ID NO: 3749032 - RNA, 15 nt, Human
ggcagcccagccagc

SEQ ID NO: 3749033 - RNA, 18 nt, Human
ggcagcccagccagcguc

SEQ ID NO: 3749034 - RNA, 13 nt, Human
ggcagccccagca

SEQ ID NO: 3749035 - RNA, 23 nt, Human
ggcagccccagcaccaccagguc

SEQ ID NO: 3749036 - RNA, 13 nt, Human
ggcagccccagcc

SEQ ID NO: 3749037 - RNA, 19 nt, Human
ggcagccccagccugcuag

SEQ ID NO: 3749038 - RNA, 21 nt, Human
ggcagccccauucugccugcc

SEQ ID NO: 3749039 - RNA, 13 nt, Human
ggcagccgagcuc

SEQ ID NO: 3749040 - RNA, 19 nt, Human
ggcagccgcggugcccaac

SEQ ID NO: 3749041 - RNA, 21 nt, Human
ggcagccgugccuucagcucu

SEQ ID NO: 3749042 - RNA, 22 nt, Human
ggcagccuacuagggaccuggg

SEQ ID NO: 3749043 - RNA, 21 nt, Human
ggcagccucccauccagggcc

SEQ ID NO: 3749044 - RNA, 13 nt, Human
ggcagccucuggg

SEQ ID NO: 3749045 - RNA, 16 nt, Human
ggcagccucugggggg

SEQ ID NO: 3749046 - RNA, 19 nt, Human
ggcagccucuggggggugg

SEQ ID NO: 3749047 - RNA, 23 nt, Human
ggcagccucugggggguggccag

SEQ ID NO: 3749048 - RNA, 14 nt, Human
ggcagccugagagu

SEQ ID NO: 3749049 - RNA, 19 nt, Human
ggcagccugccuugcccac

SEQ ID NO: 3749050 - RNA, 11 nt, Human
ggcagccugga

SEQ ID NO: 3749051 - RNA, 19 nt, Human
ggcagccuggcucccagga

SEQ ID NO: 3749052 - RNA, 20 nt, Human
ggcagccuggcucccaggac

SEQ ID NO: 3749053 - RNA, 21 nt, Human
ggcagccuggcucccaggaca

SEQ ID NO: 3749054 - RNA, 22 nt, Human
ggcagccuggcucccaggacac

SEQ ID NO: 3749055 - RNA, 14 nt, Human
ggcagccuugugau

SEQ ID NO: 3749056 - RNA, 20 nt, Human
ggcagcgccaagugcgugcc

SEQ ID NO: 3749057 - RNA, 12 nt, Human
ggcagcucaccu

SEQ ID NO: 3749058 - RNA, 22 nt, Human
ggcagcucaccucucccuugga

SEQ ID NO: 3749059 - RNA, 13 nt, Human
ggcagcucagaga

SEQ ID NO: 3749060 - RNA, 21 nt, Human
ggcagcucagagaggguggga

SEQ ID NO: 3749061 - RNA, 15 nt, Human
ggcagcucaucucug

SEQ ID NO: 3749062 - RNA, 21 nt, Human
ggcagcuccucugucucgagc

SEQ ID NO: 3749063 - RNA, 13 nt, Human
ggcagcucuccag

SEQ ID NO: 3749064 - RNA, 21 nt, Human
ggcagcucuccagucaggagg

SEQ ID NO: 3749065 - RNA, 20 nt, Human
ggcagcucuggacagcccca

SEQ ID NO: 3749066 - RNA, 11 nt, Human
ggcagcugcca

SEQ ID NO: 3749067 - RNA, 15 nt, Human
ggcagcugccagaga

SEQ ID NO: 3749068 - RNA, 22 nt, Human
ggcagcugcuauuuauuuuccu

SEQ ID NO: 3749069 - RNA, 19 nt, Human
ggcagcugggcccaacccu

SEQ ID NO: 3749070 - RNA, 17 nt, Human
ggcagcuuagggcccug

SEQ ID NO: 3749071 - RNA, 18 nt, Human
ggcagcuuagggcccugg

SEQ ID NO: 3749072 - RNA, 19 nt, Human
ggcagcuuagggcccugga

SEQ ID NO: 3749073 - RNA, 21 nt, Human
ggcagcuucugcccccugcag

SEQ ID NO: 3749074 - RNA, 13 nt, Human
ggcagcuugcccc

SEQ ID NO: 3749075 - RNA, 14 nt, Human
ggcagcuuucuaga

SEQ ID NO: 3749076 - RNA, 15 nt, Human
ggcaggaaggagagc

SEQ ID NO: 3749077 - RNA, 23 nt, Human
ggcaggaaggagagccugcugca

SEQ ID NO: 3749078 - RNA, 18 nt, Human
ggcaggacaacgaggaag

SEQ ID NO: 3749079 - RNA, 21 nt, Human
ggcaggacaacgaggaagccc

SEQ ID NO: 3749080 - RNA, 14 nt, Human
ggcaggacaggaaa

SEQ ID NO: 3749081 - RNA, 15 nt, Human
ggcaggaccucagag

SEQ ID NO: 3749082 - RNA, 16 nt, Human
ggcaggacucagcucc

SEQ ID NO: 3749083 - RNA, 23 nt, Human
ggcaggacucagcuccccagagu

SEQ ID NO: 3749084 - RNA, 13 nt, Human
ggcaggagcucag

SEQ ID NO: 3749085 - RNA, 14 nt, Human
ggcaggagcucaga

SEQ ID NO: 3749086 - RNA, 18 nt, Human
ggcaggaguagcugagcu

SEQ ID NO: 3749087 - RNA, 19 nt, Human
ggcaggaguagcugagcuc

SEQ ID NO: 3749088 - RNA, 15 nt, Human
ggcaggaugacccug

SEQ ID NO: 3749089 - RNA, 17 nt, Human
ggcaggauuggggaaga

SEQ ID NO: 3749090 - RNA, 17 nt, Human
ggcaggcagaggcccag

SEQ ID NO: 3749091 - RNA, 23 nt, Human
ggcaggcagaggcccaggcugcc

SEQ ID NO: 3749092 - RNA, 23 nt, Human
gaaaagcuuagcuuuagaaacag

SEQ ID NO: 3749093 - RNA, 16 nt, Human
gaaaagcuucuuaauu

SEQ ID NO: 3749094 - RNA, 23 nt, Human
gaaaagcuucuuaauuaauuuga

SEQ ID NO: 3749095 - RNA, 14 nt, Human
gaaaagcuuuguuu

SEQ ID NO: 3749096 - RNA, 16 nt, Human
gaaaagcuuuguuugu

SEQ ID NO: 3749097 - RNA, 14 nt, Human
gaaaaggaaaagaa

SEQ ID NO: 3749098 - RNA, 16 nt, Human
gaaaaggaaaagaaaa

SEQ ID NO: 3749099 - RNA, 17 nt, Human
gaaaaggaaaagaaaaa

SEQ ID NO: 3749100 - RNA, 18 nt, Human
gaaaaggaaaagaaaaaa

SEQ ID NO: 3749101 - RNA, 23 nt, Human
gaaaaggaaucacguuagaggaa

SEQ ID NO: 3749102 - RNA, 11 nt, Human
gaaaaggcagg

SEQ ID NO: 3749103 - RNA, 12 nt, Human
gaaaaggccugg

SEQ ID NO: 3749104 - RNA, 20 nt, Human
gaaaagggacugcugggagg

SEQ ID NO: 3749105 - RNA, 21 nt, Human
gaaaagggagauucagacugu

SEQ ID NO: 3749106 - RNA, 17 nt, Human
gaaaagggaguuuaaaa

SEQ ID NO: 3749107 - RNA, 19 nt, Human
gaaaagguugaauaauaua

SEQ ID NO: 3749108 - RNA, 22 nt, Human
gaaaagguuuaugaaaaagaag

SEQ ID NO: 3749109 - RNA, 14 nt, Human
gaaaagguuuuauu

SEQ ID NO: 3749110 - RNA, 17 nt, Human
gaaaagguuuuauuuug

SEQ ID NO: 3749111 - RNA, 19 nt, Human
gaaaaguaauauuuauuaa

SEQ ID NO: 3749112 - RNA, 14 nt, Human
gaaaaguacauuua

SEQ ID NO: 3749113 - RNA, 13 nt, Human
gaaaagucaaacu

SEQ ID NO: 3749114 - RNA, 14 nt, Human
gaaaagucaaacug

SEQ ID NO: 3749115 - RNA, 22 nt, Human
gaaaagucaaggguaggguggg

SEQ ID NO: 3749116 - RNA, 16 nt, Human
gaaaagucguuuucca

SEQ ID NO: 3749117 - RNA, 16 nt, Human
gaaaagugaauugaag

SEQ ID NO: 3749118 - RNA, 20 nt, Human
gaaaagugcauauuuaucca

SEQ ID NO: 3749119 - RNA, 18 nt, Human
gaaaaguggcaagaccaa

SEQ ID NO: 3749120 - RNA, 19 nt, Human
gaaaaguuuaauauuaaag

SEQ ID NO: 3749121 - RNA, 20 nt, Human
gaaaaguuuaauauuaaagc

SEQ ID NO: 3749122 - RNA, 13 nt, Human
gaaaauaaaaagu

SEQ ID NO: 3749123 - RNA, 15 nt, Human
gaaaauaaaaaguua

SEQ ID NO: 3749124 - RNA, 14 nt, Human
gaaaauaaaauuaa

SEQ ID NO: 3749125 - RNA, 19 nt, Human
gaaaauaacgauaaaagac

SEQ ID NO: 3749126 - RNA, 15 nt, Human
gaaaauaacugaauu

SEQ ID NO: 3749127 - RNA, 18 nt, Human
gaaaauaagaauagaaau

SEQ ID NO: 3749128 - RNA, 19 nt, Human
gaaaauaagagcucaggau

SEQ ID NO: 3749129 - RNA, 13 nt, Human
gaaaauaaggcac

SEQ ID NO: 3749130 - RNA, 15 nt, Human
gaaaauaauugacag

SEQ ID NO: 3749131 - RNA, 14 nt, Human
gaaaauacaauaaa

SEQ ID NO: 3749132 - RNA, 15 nt, Human
gaaaauacuuaaaug

SEQ ID NO: 3749133 - RNA, 16 nt, Human
gaaaauacuuaaaugu

SEQ ID NO: 3749134 - RNA, 19 nt, Human
gaaaauaggaacgacucua

SEQ ID NO: 3749135 - RNA, 13 nt, Human
gaaaauaguuugu

SEQ ID NO: 3749136 - RNA, 14 nt, Human
gaaaauaguuuguu

SEQ ID NO: 3749137 - RNA, 21 nt, Human
gaaaauauaaaacaaauaaaa

SEQ ID NO: 3749138 - RNA, 14 nt, Human
gaaaauauaaguaa

SEQ ID NO: 3749139 - RNA, 13 nt, Human
gaaaauauacugu

SEQ ID NO: 3749140 - RNA, 16 nt, Human
gaaaauauacuguaaa

SEQ ID NO: 3749141 - RNA, 19 nt, Human
gaaaauauacuguaaagaa

SEQ ID NO: 3749142 - RNA, 16 nt, Human
gaaaauauauguauuu

SEQ ID NO: 3749143 - RNA, 22 nt, Human
gaaaauauauguauuuuuauau

SEQ ID NO: 3749144 - RNA, 13 nt, Human
gaaaauauucucu

SEQ ID NO: 3749145 - RNA, 13 nt, Human
gaaaauauuuaaa

SEQ ID NO: 3749146 - RNA, 12 nt, Human
gaaaauauuuuc

SEQ ID NO: 3749147 - RNA, 21 nt, Human
gaaaauauuuugucuaaaaug

SEQ ID NO: 3749148 - RNA, 14 nt, Human
gaaaaucaaauaca

SEQ ID NO: 3749149 - RNA, 15 nt, Human
gaaaaucaaauggua

SEQ ID NO: 3749150 - RNA, 14 nt, Human
gaaaaucauauugc

SEQ ID NO: 3749151 - RNA, 15 nt, Human
gaaaaucaucaagaa

SEQ ID NO: 3749152 - RNA, 16 nt, Human
gaaaaucaucaagaag

SEQ ID NO: 3749153 - RNA, 20 nt, Human
gaaaaucaucaagaagggcu

SEQ ID NO: 3749154 - RNA, 14 nt, Human
gaaaauccuaccaa

SEQ ID NO: 3749155 - RNA, 14 nt, Human
gaaaauccucuggc

SEQ ID NO: 3749156 - RNA, 20 nt, Human
gaaaaucuaauauuaaaaau

SEQ ID NO: 3749157 - RNA, 21 nt, Human
gaaaaucuaauauuaaaaaua

SEQ ID NO: 3749158 - RNA, 20 nt, Human
gaaaaucugaauuggaaugc

SEQ ID NO: 3749159 - RNA, 18 nt, Human
gaaaaucuuauaauuuaa

SEQ ID NO: 3749160 - RNA, 20 nt, Human
gaaaaucuuauaauuuaaaa

SEQ ID NO: 3749161 - RNA, 19 nt, Human
gaaaaucuuuauaaaugua

SEQ ID NO: 3749162 - RNA, 13 nt, Human
gaaaaugaaagcu

SEQ ID NO: 3749163 - RNA, 22 nt, Human
gaaaaugaauaucuauuaauau

SEQ ID NO: 3749164 - RNA, 16 nt, Human
gaaaaugaaucccucu

SEQ ID NO: 3749165 - RNA, 18 nt, Human
gaaaaugaguugugaaag

SEQ ID NO: 3749166 - RNA, 15 nt, Human
gaaaaugauacagca

SEQ ID NO: 3749167 - RNA, 16 nt, Human
gaaaaugaucugaguc

SEQ ID NO: 3749168 - RNA, 22 nt, Human
gaaaaugaucugagucccagga

SEQ ID NO: 3749169 - RNA, 19 nt, Human
gaaaaugcuagaagaaaac

SEQ ID NO: 3749170 - RNA, 20 nt, Human
gaaaaugcuagaagaaaaca

SEQ ID NO: 3749171 - RNA, 15 nt, Human
gaaaauggaaccagg

SEQ ID NO: 3749172 - RNA, 18 nt, Human
gaaaauggaaccaggcuu

SEQ ID NO: 3749173 - RNA, 23 nt, Human
gaaaauggacguguuaugacucc

SEQ ID NO: 3749174 - RNA, 17 nt, Human
gaaaauguaagcuguuu

SEQ ID NO: 3749175 - RNA, 20 nt, Human
gaaaauguaaguaaaugucu

SEQ ID NO: 3749176 - RNA, 12 nt, Human
gaaaauguacug

SEQ ID NO: 3749177 - RNA, 21 nt, Human
gaaaaugucagaaaccaguua

SEQ ID NO: 3749178 - RNA, 17 nt, Human
gaaaaugucuguaauaa

SEQ ID NO: 3749179 - RNA, 14 nt, Human
gaaaaugucuugug

SEQ ID NO: 3749180 - RNA, 18 nt, Human
gaaaaugugacccuccaa

SEQ ID NO: 3749181 - RNA, 20 nt, Human
gaaaaugugacccuccaaau

SEQ ID NO: 3749182 - RNA, 22 nt, Human
gaaaaugugacccuccaaaugg

SEQ ID NO: 3749183 - RNA, 15 nt, Human
gaaaaugugugugug

SEQ ID NO: 3749184 - RNA, 15 nt, Human
gaaaauguguguuuu

SEQ ID NO: 3749185 - RNA, 14 nt, Human
gaaaauguucauca

SEQ ID NO: 3749186 - RNA, 15 nt, Human
gaaaauguucuucca

SEQ ID NO: 3749187 - RNA, 17 nt, Human
gaaaauguugagaaucc

SEQ ID NO: 3749188 - RNA, 22 nt, Human
gaaaauguuuuguaagaaacca

SEQ ID NO: 3749189 - RNA, 20 nt, Human
gaaaauguuuuucugccagg

SEQ ID NO: 3749190 - RNA, 15 nt, Human
gaaaauuaacacugc

SEQ ID NO: 3749191 - RNA, 14 nt, Human
gaaaauuagacugu

SEQ ID NO: 3749192 - RNA, 14 nt, Human
gaaaauuaguuccc

SEQ ID NO: 3749193 - RNA, 16 nt, Human
gaaaauuauuugcaua

SEQ ID NO: 3749194 - RNA, 19 nt, Human
gaaaauucaaaaaguguuu

SEQ ID NO: 3749195 - RNA, 18 nt, Human
gaaaauucacuauuggcu

SEQ ID NO: 3749196 - RNA, 22 nt, Human
gaaaauucauuucacauuaaug

SEQ ID NO: 3749197 - RNA, 14 nt, Human
gaaaauuccagaaa

SEQ ID NO: 3749198 - RNA, 18 nt, Human
gaaaauuccuauaaggaa

SEQ ID NO: 3749199 - RNA, 22 nt, Human
gaaaauucuaacccagguaucc

SEQ ID NO: 3749200 - RNA, 16 nt, Human
gaaaauucuuaaaagg

SEQ ID NO: 3749201 - RNA, 19 nt, Human
gaaaauugaaauaaagcua

SEQ ID NO: 3749202 - RNA, 13 nt, Human
gaaaauugaauuu

SEQ ID NO: 3749203 - RNA, 17 nt, Human
gaaaauugaauuuaaca

SEQ ID NO: 3749204 - RNA, 20 nt, Human
gaaaauugaauuuaacaaug

SEQ ID NO: 3749205 - RNA, 22 nt, Human
gaaaauugaauuuaacaaugcg

SEQ ID NO: 3749206 - RNA, 12 nt, Human
gaaaauugaguu

SEQ ID NO: 3749207 - RNA, 19 nt, Human
gaaaauugcauugaagccc

SEQ ID NO: 3749208 - RNA, 19 nt, Human
gaaaauugccuuucugugu

SEQ ID NO: 3749209 - RNA, 20 nt, Human
gaaaauugccuuucuguguu

SEQ ID NO: 3749210 - RNA, 21 nt, Human
gaaaauuuguuauuuugcaac

SEQ ID NO: 3749211 - RNA, 19 nt, Human
gaaaauuuuaaaaauacau

SEQ ID NO: 3749212 - RNA, 18 nt, Human
gaaaauuuugauguuuua

SEQ ID NO: 3749213 - RNA, 13 nt, Human
gaaacaaaauaca

SEQ ID NO: 3749214 - RNA, 12 nt, Human
gaaacaaacuuu

SEQ ID NO: 3749215 - RNA, 12 nt, Human
gaaacaaagaug

SEQ ID NO: 3749216 - RNA, 24 nt, Human
gaaacaaagcauuugacuuucugu

SEQ ID NO: 3749217 - RNA, 15 nt, Human
gaaacaaagcuuagc

SEQ ID NO: 3749218 - RNA, 18 nt, Human
gaaacaaaguggaaggaa

SEQ ID NO: 3749219 - RNA, 20 nt, Human
gaaacaaaguggaaggaaag

SEQ ID NO: 3749220 - RNA, 14 nt, Human
gaaacaaauaauca

SEQ ID NO: 3749221 - RNA, 18 nt, Human
gaaacaacauuuauaugu

SEQ ID NO: 3749222 - RNA, 17 nt, Human
gaaacaagugaaagcau

SEQ ID NO: 3749223 - RNA, 14 nt, Human
gaaacacaauauuu

SEQ ID NO: 3749224 - RNA, 15 nt, Human
gaaacacaauauuuu

SEQ ID NO: 3749225 - RNA, 16 nt, Human
gaaacacaccaggcug

SEQ ID NO: 3749226 - RNA, 19 nt, Human
gaaacacacugaggcaggg

SEQ ID NO: 3749227 - RNA, 23 nt, Human
gaaacacacugaggcagggaagu

SEQ ID NO: 3749228 - RNA, 15 nt, Human
gaaacacagagaagc

SEQ ID NO: 3749229 - RNA, 15 nt, Human
gaaacacagcuguuc

SEQ ID NO: 3749230 - RNA, 20 nt, Human
gaaacacauaauuaacacuu

SEQ ID NO: 3749231 - RNA, 17 nt, Human
gaaacacccacaggcau

SEQ ID NO: 3749232 - RNA, 19 nt, Human
gaaacacccucacacuggg

SEQ ID NO: 3749233 - RNA, 18 nt, Human
gaaacaccuagaucagaa

SEQ ID NO: 3749234 - RNA, 14 nt, Human
gaaacaccuucucu

SEQ ID NO: 3749235 - RNA, 23 nt, Human
gaaacacuaaauguuaaagaugu

SEQ ID NO: 3749236 - RNA, 15 nt, Human
gaaacacuccuugca

SEQ ID NO: 3749237 - RNA, 16 nt, Human
gaaacacuccuugcau

SEQ ID NO: 3749238 - RNA, 15 nt, Human
gaaacacuggggcug

SEQ ID NO: 3749239 - RNA, 13 nt, Human
gaaacacugguuu

SEQ ID NO: 3749240 - RNA, 22 nt, Human
gaaacacuuugccuccugugua

SEQ ID NO: 3749241 - RNA, 11 nt, Human
gaaacagaaaa

SEQ ID NO: 3749242 - RNA, 14 nt, Human
gaaacagaaacaaa

SEQ ID NO: 3749243 - RNA, 14 nt, Human
ggcuggaaggagga

SEQ ID NO: 3749244 - RNA, 16 nt, Human
ggcuggaaucuggaga

SEQ ID NO: 3749245 - RNA, 23 nt, Human
ggcuggacuccagaucugcaccg

SEQ ID NO: 3749246 - RNA, 17 nt, Human
ggcuggacugaggccug

SEQ ID NO: 3749247 - RNA, 18 nt, Human
ggcuggacugaggccuga

SEQ ID NO: 3749248 - RNA, 20 nt, Human
ggcuggacuucuaccugccc

SEQ ID NO: 3749249 - RNA, 16 nt, Human
ggcuggagaggacaag

SEQ ID NO: 3749250 - RNA, 18 nt, Human
ggcuggagcuagaauuug

SEQ ID NO: 3749251 - RNA, 16 nt, Human
ggcuggaggagcccag

SEQ ID NO: 3749252 - RNA, 13 nt, Human
ggcuggaggccca

SEQ ID NO: 3749253 - RNA, 20 nt, Human
ggcuggaguacaguggugcc

SEQ ID NO: 3749254 - RNA, 20 nt, Human
ggcuggagugcaguggugug

SEQ ID NO: 3749255 - RNA, 20 nt, Human
ggcuggaguucaguggugug

SEQ ID NO: 3749256 - RNA, 23 nt, Human
ggcuggaugagcucccacaagcc

SEQ ID NO: 3749257 - RNA, 19 nt, Human
ggcuggaugugguggcaua

SEQ ID NO: 3749258 - RNA, 15 nt, Human
ggcuggcacaggaca

SEQ ID NO: 3749259 - RNA, 15 nt, Human
ggcuggcagggcugg

SEQ ID NO: 3749260 - RNA, 12 nt, Human
ggcuggcaugau

SEQ ID NO: 3749261 - RNA, 21 nt, Human
ggcuggccacugcacagagcu

SEQ ID NO: 3749262 - RNA, 15 nt, Human
ggcuggccagcccca

SEQ ID NO: 3749263 - RNA, 17 nt, Human
ggcuggccagccccaca

SEQ ID NO: 3749264 - RNA, 19 nt, Human
ggcuggccagccccacagc

SEQ ID NO: 3749265 - RNA, 20 nt, Human
ggcuggccaguccaggcugc

SEQ ID NO: 3749266 - RNA, 14 nt, Human
ggcuggcccagccc

SEQ ID NO: 3749267 - RNA, 18 nt, Human
ggcuggcccagcccugcu

SEQ ID NO: 3749268 - RNA, 16 nt, Human
ggcuggccccagggca

SEQ ID NO: 3749269 - RNA, 14 nt, Human
ggcuggcccugccc

SEQ ID NO: 3749270 - RNA, 15 nt, Human
ggcuggccuggcccc

SEQ ID NO: 3749271 - RNA, 22 nt, Human
ggcuggccuggccccucagggu

SEQ ID NO: 3749272 - RNA, 13 nt, Human
ggcuggccuuccu

SEQ ID NO: 3749273 - RNA, 16 nt, Human
ggcuggcgcagccaag

SEQ ID NO: 3749274 - RNA, 14 nt, Human
ggcuggcuccccug

SEQ ID NO: 3749275 - RNA, 13 nt, Human
ggcuggcuccuga

SEQ ID NO: 3749276 - RNA, 14 nt, Human
ggcuggcugcagug

SEQ ID NO: 3749277 - RNA, 13 nt, Human
ggcuggcuggccu

SEQ ID NO: 3749278 - RNA, 15 nt, Human
ggcuggcuggccuca

SEQ ID NO: 3749279 - RNA, 13 nt, Human
ggcuggcuggggc

SEQ ID NO: 3749280 - RNA, 21 nt, Human
ggcugggaauggaggggcaga

SEQ ID NO: 3749281 - RNA, 22 nt, Human
ggcugggaauggaggggcagag

SEQ ID NO: 3749282 - RNA, 23 nt, Human
ggcugggacguggcucagccagc

SEQ ID NO: 3749283 - RNA, 13 nt, Human
ggcugggagagcc

SEQ ID NO: 3749284 - RNA, 16 nt, Human
ggcugggagagccuuc

SEQ ID NO: 3749285 - RNA, 18 nt, Human
ggcugggagagccuucca

SEQ ID NO: 3749286 - RNA, 23 nt, Human
ggcugggagagccuuccaggggu

SEQ ID NO: 3749287 - RNA, 20 nt, Human
ggcugggaggagggcaggca

SEQ ID NO: 3749288 - RNA, 21 nt, Human
ggcugggaggagggcaggcau

SEQ ID NO: 3749289 - RNA, 13 nt, Human
ggcugggaguggu

SEQ ID NO: 3749290 - RNA, 14 nt, Human
ggcugggcacugcu

SEQ ID NO: 3749291 - RNA, 20 nt, Human
ggcugggcacugcucucacc

SEQ ID NO: 3749292 - RNA, 14 nt, Human
ggcugggcagagcu

SEQ ID NO: 3749293 - RNA, 13 nt, Human
ggcugggcagcua

SEQ ID NO: 3749294 - RNA, 14 nt, Human
ggcugggcagcugu

SEQ ID NO: 3749295 - RNA, 18 nt, Human
ggcugggccaagccaggg

SEQ ID NO: 3749296 - RNA, 22 nt, Human
ggcugggccaagccagggaugg

SEQ ID NO: 3749297 - RNA, 11 nt, Human
ggcugggccau

SEQ ID NO: 3749298 - RNA, 17 nt, Human
ggcugggccauguccaa

SEQ ID NO: 3749299 - RNA, 20 nt, Human
ggcugggccauguccaaaga

SEQ ID NO: 3749300 - RNA, 21 nt, Human
ggcugggccauguccaaagag

SEQ ID NO: 3749301 - RNA, 13 nt, Human
ggcugggcccaga

SEQ ID NO: 3749302 - RNA, 14 nt, Human
ggcugggcccagag

SEQ ID NO: 3749303 - RNA, 16 nt, Human
ggcugggcccagaggc

SEQ ID NO: 3749304 - RNA, 17 nt, Human
ggcugggcccagaggca

SEQ ID NO: 3749305 - RNA, 21 nt, Human
ggcugggccccccagcucagg

SEQ ID NO: 3749306 - RNA, 22 nt, Human
ggcugggcucccuucccaccuc

SEQ ID NO: 3749307 - RNA, 18 nt, Human
ggcugggcugggcacugc

SEQ ID NO: 3749308 - RNA, 11 nt, Human
ggcugggcuuc

SEQ ID NO: 3749309 - RNA, 13 nt, Human
ggcugggcuucag

SEQ ID NO: 3749310 - RNA, 21 nt, Human
ggcugggcuucaguggcagcu

SEQ ID NO: 3749311 - RNA, 17 nt, Human
ggcuggggaaguccucu

SEQ ID NO: 3749312 - RNA, 18 nt, Human
ggcuggggaaguccucug

SEQ ID NO: 3749313 - RNA, 14 nt, Human
ggcuggggcagccu

SEQ ID NO: 3749314 - RNA, 20 nt, Human
ggcuggggcagccucugggc

SEQ ID NO: 3749315 - RNA, 20 nt, Human
ggcuggggccuaucagugug

SEQ ID NO: 3749316 - RNA, 21 nt, Human
ggcuggggccuaucagugugc

SEQ ID NO: 3749317 - RNA, 18 nt, Human
ggcugggggaugggccug

SEQ ID NO: 3749318 - RNA, 16 nt, Human
ggcugggggcaggagg

SEQ ID NO: 3749319 - RNA, 14 nt, Human
ggcugggggccuca

SEQ ID NO: 3749320 - RNA, 16 nt, Human
ggcuggggucccagca

SEQ ID NO: 3749321 - RNA, 18 nt, Human
ggcuggggucccagcagc

SEQ ID NO: 3749322 - RNA, 10 nt, Human
ggcugggugc

SEQ ID NO: 3749323 - RNA, 14 nt, Human
ggcugggugcccac

SEQ ID NO: 3749324 - RNA, 22 nt, Human
ggcugggugcccacagcccgca

SEQ ID NO: 3749325 - RNA, 19 nt, Human
ggcuggguggcaccagcag

SEQ ID NO: 3749326 - RNA, 22 nt, Human
ggcuggguucuacccaggugcu

SEQ ID NO: 3749327 - RNA, 16 nt, Human
ggcugguagcucaggu

SEQ ID NO: 3749328 - RNA, 17 nt, Human
ggcugguagcucaggug

SEQ ID NO: 3749329 - RNA, 23 nt, Human
ggcugguccagggcuagugacuu

SEQ ID NO: 3749330 - RNA, 21 nt, Human
ggcugguccuauggccucaug

SEQ ID NO: 3749331 - RNA, 23 nt, Human
ggcuggucuugaaguccuggcuu

SEQ ID NO: 3749332 - RNA, 16 nt, Human
ggcugguggcccagga

SEQ ID NO: 3749333 - RNA, 17 nt, Human
ggcuggugggaggggcg

SEQ ID NO: 3749334 - RNA, 15 nt, Human
ggcuggugugguaca

SEQ ID NO: 3749335 - RNA, 17 nt, Human
ggcuggugugguacaga

SEQ ID NO: 3749336 - RNA, 19 nt, Human
ggcuggugugguacagaga

SEQ ID NO: 3749337 - RNA, 22 nt, Human
ggcugguucggauuuggggugg

SEQ ID NO: 3749338 - RNA, 14 nt, Human
ggcuguaaggcucu

SEQ ID NO: 3749339 - RNA, 20 nt, Human
ggcuguacugcucaggcugc

SEQ ID NO: 3749340 - RNA, 21 nt, Human
ggcuguacugcucaggcugca

SEQ ID NO: 3749341 - RNA, 19 nt, Human
ggcuguaucccaugagccu

SEQ ID NO: 3749342 - RNA, 23 nt, Human
ggcugucaaugggaccuguggcu

SEQ ID NO: 3749343 - RNA, 17 nt, Human
ggcugucagcaggaagc

SEQ ID NO: 3749344 - RNA, 22 nt, Human
ggcuguccuuuccaguggccug

SEQ ID NO: 3749345 - RNA, 15 nt, Human
ggcugucggcgcugc

SEQ ID NO: 3749346 - RNA, 17 nt, Human
ggcugucuguuguauuc

SEQ ID NO: 3749347 - RNA, 23 nt, Human
ggcugucuucucaggcucugccc

SEQ ID NO: 3749348 - RNA, 10 nt, Human
ggcugugcua

SEQ ID NO: 3749349 - RNA, 13 nt, Human
ggcugugcuggga

SEQ ID NO: 3749350 - RNA, 16 nt, Human
ggcugugcugggagaa

SEQ ID NO: 3749351 - RNA, 16 nt, Human
ggcuguggcuggugag

SEQ ID NO: 3749352 - RNA, 22 nt, Human
ggcugugggccucaaggacuug

SEQ ID NO: 3749353 - RNA, 14 nt, Human
ggcugugggcguga

SEQ ID NO: 3749354 - RNA, 22 nt, Human
ggcugugggcucccuuccuccc

SEQ ID NO: 3749355 - RNA, 14 nt, Human
ggcugugucuaaac

SEQ ID NO: 3749356 - RNA, 18 nt, Human
ggcuguguuuccaucuca

SEQ ID NO: 3749357 - RNA, 20 nt, Human
ggcuguguuugcagccugcu

SEQ ID NO: 3749358 - RNA, 15 nt, Human
ggcuguucugcacug

SEQ ID NO: 3749359 - RNA, 17 nt, Human
ggcuguucugcacugaa

SEQ ID NO: 3749360 - RNA, 19 nt, Human
ggcuguucugcacugaaaa

SEQ ID NO: 3749361 - RNA, 21 nt, Human
ggcuguucugcacugaaaagg

SEQ ID NO: 3749362 - RNA, 17 nt, Human
ggcuguuggcacucaca

SEQ ID NO: 3749363 - RNA, 14 nt, Human
ggcuguuggcuggg

SEQ ID NO: 3749364 - RNA, 14 nt, Human
ggcuguuugaggau

SEQ ID NO: 3749365 - RNA, 16 nt, Human
ggcuuaaugcuucuuu

SEQ ID NO: 3749366 - RNA, 13 nt, Human
ggcuuacacccac

SEQ ID NO: 3749367 - RNA, 14 nt, Human
ggcuuaccuggccc

SEQ ID NO: 3749368 - RNA, 22 nt, Human
ggcuuacuacaugugggagcuu

SEQ ID NO: 3749369 - RNA, 20 nt, Human
ggcuuagacccucaugcugc

SEQ ID NO: 3749370 - RNA, 22 nt, Human
ggcuuagacccucaugcugcca

SEQ ID NO: 3749371 - RNA, 23 nt, Human
ggcuuagacccucaugcugccaa

SEQ ID NO: 3749372 - RNA, 21 nt, Human
ggcuuagucacugagacagcc

SEQ ID NO: 3749373 - RNA, 23 nt, Human
ggcuuaguguuuuaaaacaccuc

SEQ ID NO: 3749374 - RNA, 22 nt, Human
ggcuuaguuuguguguugucuc

SEQ ID NO: 3749375 - RNA, 14 nt, Human
ggcuuauaaaacag

SEQ ID NO: 3749376 - RNA, 19 nt, Human
ggcuuauaauaaaggacug

SEQ ID NO: 3749377 - RNA, 20 nt, Human
ggcuuauauucaaccaugga

SEQ ID NO: 3749378 - RNA, 23 nt, Human
ggcuuauauucaaccauggacuu

SEQ ID NO: 3749379 - RNA, 12 nt, Human
ggcuuauuuuaa

SEQ ID NO: 3749380 - RNA, 20 nt, Human
ggcuuauuuuaaugugauga

SEQ ID NO: 3749381 - RNA, 21 nt, Human
ggcuucacggaagagccuugc

SEQ ID NO: 3749382 - RNA, 22 nt, Human
ggcuucacuguauaaauaggag

SEQ ID NO: 3749383 - RNA, 17 nt, Human
ggcuucagcauauuuau

SEQ ID NO: 3749384 - RNA, 13 nt, Human
ggcuucagcucca

SEQ ID NO: 3749385 - RNA, 15 nt, Human
ggcuucagcuccagc

SEQ ID NO: 3749386 - RNA, 20 nt, Human
ggcuucagcuccagccccuu

SEQ ID NO: 3749387 - RNA, 19 nt, Human
ggcuucaggcaauucuccu

SEQ ID NO: 3749388 - RNA, 16 nt, Human
ggcuucagggcaggug

SEQ ID NO: 3749389 - RNA, 18 nt, Human
ggcuucagggcagguggg

SEQ ID NO: 3749390 - RNA, 16 nt, Human
ggcuucaguggcagcu

SEQ ID NO: 3749391 - RNA, 15 nt, Human
ggcuucaugccagcu

SEQ ID NO: 3749392 - RNA, 17 nt, Human
ggcuucauucaagucua

SEQ ID NO: 3749393 - RNA, 22 nt, Human
ggcuuccaagguggucugcucg

SEQ ID NO: 3749394 - RNA, 17 nt, Human
ggcuuccauuugugugu

SEQ ID NO: 3749395 - RNA, 12 nt, Human
ggcuucccaagg

SEQ ID NO: 3749396 - RNA, 19 nt, Human
ggcuucccaguggcugcug

SEQ ID NO: 3749397 - RNA, 17 nt, Human
ggcuucccauccccagc

SEQ ID NO: 3749398 - RNA, 17 nt, Human
ggcuucccgcucagccc

SEQ ID NO: 3749399 - RNA, 21 nt, Human
ggcuuccucaguuccugcccu

SEQ ID NO: 3749400 - RNA, 14 nt, Human
ggcuuccuggagca

SEQ ID NO: 3749401 - RNA, 21 nt, Human
ggcuuccuggagcagaagcag

SEQ ID NO: 3749402 - RNA, 12 nt, Human
ggcuuccuggug

SEQ ID NO: 3749403 - RNA, 12 nt, Human
ggcuuccuuucu

SEQ ID NO: 3749404 - RNA, 16 nt, Human
ggcuucuccgccagcc

SEQ ID NO: 3749405 - RNA, 16 nt, Human
ggcuucuccugaccca

SEQ ID NO: 3749406 - RNA, 11 nt, Human
ggcuucucucu

SEQ ID NO: 3749407 - RNA, 15 nt, Human
ggcuucucucucacc

SEQ ID NO: 3749408 - RNA, 22 nt, Human
ggcuucugagcagcgagccugc

SEQ ID NO: 3749409 - RNA, 18 nt, Human
ggcuucugcacccuccac

SEQ ID NO: 3749410 - RNA, 20 nt, Human
ggcuucugcacccuccaccc

SEQ ID NO: 3749411 - RNA, 12 nt, Human
ggcuucugcugg

SEQ ID NO: 3749412 - RNA, 15 nt, Human
ggcuucugcuggggc

SEQ ID NO: 3749413 - RNA, 19 nt, Human
ggcuucugcuggggccugg

SEQ ID NO: 3749414 - RNA, 21 nt, Human
ggcuucugcuggggccuggga

SEQ ID NO: 3749415 - RNA, 18 nt, Human
ggcuucuggccaggaagc

SEQ ID NO: 3749416 - RNA, 18 nt, Human
ggcuucugugaugagcug

SEQ ID NO: 3749417 - RNA, 21 nt, Human
ggcuucugugaugagcugauc

SEQ ID NO: 3749418 - RNA, 22 nt, Human
ggcuucugugcaccugggcucu

SEQ ID NO: 3749419 - RNA, 16 nt, Human
ggcuucugugcccaga

SEQ ID NO: 3749420 - RNA, 20 nt, Human
ggcuugaagccaaagaaaaa

SEQ ID NO: 3749421 - RNA, 13 nt, Human
ggcuugaagcugu

SEQ ID NO: 3749422 - RNA, 18 nt, Human
ggcuugaauaaggaaaug

SEQ ID NO: 3749423 - RNA, 15 nt, Human
ggcuugacucaggau

SEQ ID NO: 3749424 - RNA, 21 nt, Human
ggcuugagaaauauggacacu

SEQ ID NO: 3749425 - RNA, 20 nt, Human
ggcuugagcccccgcgccca

SEQ ID NO: 3749426 - RNA, 22 nt, Human
ggcuugaguuuaaauuguaaua

SEQ ID NO: 3749427 - RNA, 23 nt, Human
ggcuugcaaguauguuuuagcau

SEQ ID NO: 3749428 - RNA, 15 nt, Human
ggcuugccacacccc

SEQ ID NO: 3749429 - RNA, 15 nt, Human
ggcuugcuauucugu

SEQ ID NO: 3749430 - RNA, 17 nt, Human
ggcuuggccacagccag

SEQ ID NO: 3749431 - RNA, 18 nt, Human
ggcuuggccacagccagg

SEQ ID NO: 3749432 - RNA, 14 nt, Human
ggcuuggccugcug

SEQ ID NO: 3749433 - RNA, 15 nt, Human
ggcuuggccugcugu

SEQ ID NO: 3749434 - RNA, 16 nt, Human
ggcuuggccugcugug

SEQ ID NO: 3749435 - RNA, 13 nt, Human
ggcuugggccuag

SEQ ID NO: 3749436 - RNA, 18 nt, Human
ggcuugggccuaggcugc

SEQ ID NO: 3749437 - RNA, 23 nt, Human
ggcuugggcuuccauuugugugu

SEQ ID NO: 3749438 - RNA, 22 nt, Human
ggcuuggggcucacacaccugu

SEQ ID NO: 3749439 - RNA, 15 nt, Human
ggcuuggggcuuccu

SEQ ID NO: 3749440 - RNA, 16 nt, Human
ggcuugucagagcugg

SEQ ID NO: 3749441 - RNA, 16 nt, Human
ggcuugucauagccag

SEQ ID NO: 3749442 - RNA, 22 nt, Human
ggcuugucuauacuccuucccu

SEQ ID NO: 3749443 - RNA, 16 nt, Human
ggcuuguggggccugg

SEQ ID NO: 3749444 - RNA, 19 nt, Human
ggcuuguucaucauccaga

SEQ ID NO: 3749445 - RNA, 15 nt, Human
ggcuuguuguaaagc

SEQ ID NO: 3749446 - RNA, 13 nt, Human
ggcuuuagacacu

SEQ ID NO: 3749447 - RNA, 15 nt, Human
ggcuuuauccucuuu

SEQ ID NO: 3749448 - RNA, 20 nt, Human
ggcuuuauccucuuuagagu

SEQ ID NO: 3749449 - RNA, 20 nt, Human
ggcuuuaugauaauagauuc

SEQ ID NO: 3749450 - RNA, 22 nt, Human
ggcuuuauuuuuuugaacucuu

SEQ ID NO: 3749451 - RNA, 19 nt, Human
ggcuuucagaaaacgggaa

SEQ ID NO: 3749452 - RNA, 13 nt, Human
ggcuuucagcuua

SEQ ID NO: 3749453 - RNA, 19 nt, Human
ggcuuuccugugccaggug

SEQ ID NO: 3749454 - RNA, 13 nt, Human
ggcuuuccuugug

SEQ ID NO: 3749455 - RNA, 22 nt, Human
ggcuuucguccacagcuuccug

SEQ ID NO: 3749456 - RNA, 14 nt, Human
ggcuuucuggggcc

SEQ ID NO: 3749457 - RNA, 15 nt, Human
ggcuuucuguugcca

SEQ ID NO: 3749458 - RNA, 24 nt, Human
ggcuuugauuccaucuccuugucu

SEQ ID NO: 3749459 - RNA, 18 nt, Human
ggcuuugccauuaaaaug

SEQ ID NO: 3749460 - RNA, 13 nt, Human
ggcuuuucacugc

SEQ ID NO: 3749461 - RNA, 15 nt, Human
ggcuuuucucagcug

SEQ ID NO: 3749462 - RNA, 12 nt, Human
ggcuuuucugau

SEQ ID NO: 3749463 - RNA, 17 nt, Human
ggcuuuucugauccagu

SEQ ID NO: 3749464 - RNA, 14 nt, Human
ggcuuuugugcauu

SEQ ID NO: 3749465 - RNA, 15 nt, Human
gggaaaaaaauguug

SEQ ID NO: 3749466 - RNA, 23 nt, Human
gggaaaaucagccugcuccagcu

SEQ ID NO: 3749467 - RNA, 21 nt, Human
gggaaaauguuuuguaagaaa

SEQ ID NO: 3749468 - RNA, 18 nt, Human
gggaaaauuauuugcaua

SEQ ID NO: 3749469 - RNA, 13 nt, Human
gggaaagacacug

SEQ ID NO: 3749470 - RNA, 18 nt, Human
gggaaagacacugccugg

SEQ ID NO: 3749471 - RNA, 22 nt, Human
gggaaagacacugccugggcug

SEQ ID NO: 3749472 - RNA, 14 nt, Human
gggaaagcaaagca

SEQ ID NO: 3749473 - RNA, 22 nt, Human
gggaaaucaaaagggccaaaga

SEQ ID NO: 3749474 - RNA, 14 nt, Human
gggaaauggugccu

SEQ ID NO: 3749475 - RNA, 21 nt, Human
gggaacaauuuggcaauuuug

SEQ ID NO: 3749476 - RNA, 22 nt, Human
gggaacacuggggacuuggccu

SEQ ID NO: 3749477 - RNA, 15 nt, Human
gggaacagacaggag

SEQ ID NO: 3749478 - RNA, 18 nt, Human
gggaacagacaggagaaa

SEQ ID NO: 3749479 - RNA, 10 nt, Human
gggaacauuu

SEQ ID NO: 3749480 - RNA, 21 nt, Human
gggaacauuuauuuuaugaga

SEQ ID NO: 3749481 - RNA, 22 nt, Human
gggaaccaagcuauuccuuucc

SEQ ID NO: 3749482 - RNA, 19 nt, Human
gggaaccaugaagacagga

SEQ ID NO: 3749483 - RNA, 20 nt, Human
gggaacccaaguccaagcau

SEQ ID NO: 3749484 - RNA, 14 nt, Human
gggaaccccuuucc

SEQ ID NO: 3749485 - RNA, 19 nt, Human
gggaaccucacucuugcca

SEQ ID NO: 3749486 - RNA, 15 nt, Human
gggaaccuguguccg

SEQ ID NO: 3749487 - RNA, 16 nt, Human
gggaacgaugugucug

SEQ ID NO: 3749488 - RNA, 14 nt, Human
gggaacgugacugc

SEQ ID NO: 3749489 - RNA, 17 nt, Human
gggaacgugacugcccc

SEQ ID NO: 3749490 - RNA, 18 nt, Human
gggaacgugacugcccca

SEQ ID NO: 3749491 - RNA, 22 nt, Human
gggaacucaccuggggcugcug

SEQ ID NO: 3749492 - RNA, 23 nt, Human
gggaacucaccuggggcugcugg

SEQ ID NO: 3749493 - RNA, 22 nt, Human
gggaacucccaagaacagcagg

SEQ ID NO: 3749494 - RNA, 13 nt, Human
gggaacucugaca

SEQ ID NO: 3749495 - RNA, 13 nt, Human
gggaacuggccaa

SEQ ID NO: 3749496 - RNA, 19 nt, Human
gggaacuggccaagcugag

SEQ ID NO: 3749497 - RNA, 19 nt, Human
gggaagaagcagagagaug

SEQ ID NO: 3749498 - RNA, 17 nt, Human
gggaagacgccugagcu

SEQ ID NO: 3749499 - RNA, 14 nt, Human
gggaagagaaacag

SEQ ID NO: 3749500 - RNA, 13 nt, Human
gggaagagacuug

SEQ ID NO: 3749501 - RNA, 24 nt, Human
gggaagagaggaguucaaugaucu

SEQ ID NO: 3749502 - RNA, 14 nt, Human
gggaagagcacagc

SEQ ID NO: 3749503 - RNA, 18 nt, Human
gggaagagcacagcccuc

SEQ ID NO: 3749504 - RNA, 22 nt, Human
gggaagagcacagcccucccgc

SEQ ID NO: 3749505 - RNA, 19 nt, Human
gggaagaggguuaggaggg

SEQ ID NO: 3749506 - RNA, 23 nt, Human
gggaagaggguuaggaggguuuc

SEQ ID NO: 3749507 - RNA, 21 nt, Human
gggaagagugacucuccaggg

SEQ ID NO: 3749508 - RNA, 17 nt, Human
gggaagaguggaggugg

SEQ ID NO: 3749509 - RNA, 22 nt, Human
gggaagcaaaaacgaaagcugg

SEQ ID NO: 3749510 - RNA, 17 nt, Human
gggaagcagcagccucg

SEQ ID NO: 3749511 - RNA, 13 nt, Human
gggaagcccagcu

SEQ ID NO: 3749512 - RNA, 14 nt, Human
gggaagcccagcuc

SEQ ID NO: 3749513 - RNA, 19 nt, Human
gggaagcccauccugacca

SEQ ID NO: 3749514 - RNA, 12 nt, Human
gggaagccuuua

SEQ ID NO: 3749515 - RNA, 14 nt, Human
gggaaggacagaaa

SEQ ID NO: 3749516 - RNA, 13 nt, Human
gggaaggagccag

SEQ ID NO: 3749517 - RNA, 15 nt, Human
gggaaggaggagccu

SEQ ID NO: 3749518 - RNA, 21 nt, Human
gggaaggaggguacagcuggg

SEQ ID NO: 3749519 - RNA, 16 nt, Human
gggaaggauacaaaag

SEQ ID NO: 3749520 - RNA, 21 nt, Human
gggaaggauacaaaagcaugu

SEQ ID NO: 3749521 - RNA, 21 nt, Human
gggaaggauucugcuggccuc

SEQ ID NO: 3749522 - RNA, 18 nt, Human
gggaaggccaccugcagg

SEQ ID NO: 3749523 - RNA, 15 nt, Human
gggaaggccugacuu

SEQ ID NO: 3749524 - RNA, 22 nt, Human
gggaaggcuacuucggggcugg

SEQ ID NO: 3749525 - RNA, 14 nt, Human
gggaagggacacac

SEQ ID NO: 3749526 - RNA, 13 nt, Human
gggaagggccagu

SEQ ID NO: 3749527 - RNA, 14 nt, Human
gggaagggggcugg

SEQ ID NO: 3749528 - RNA, 21 nt, Human
gggaaggugggguccuggagc

SEQ ID NO: 3749529 - RNA, 16 nt, Human
gggaaguaguccuugg

SEQ ID NO: 3749530 - RNA, 23 nt, Human
gggaagugaagacuggaagcuaa

SEQ ID NO: 3749531 - RNA, 23 nt, Human
gggaagugacuuagcagaugcug

SEQ ID NO: 3749532 - RNA, 17 nt, Human
gggaaguuaaagggaag

SEQ ID NO: 3749533 - RNA, 22 nt, Human
gggaaguuaaagggaagaaaac

SEQ ID NO: 3749534 - RNA, 14 nt, Human
gggaauaaauaugc

SEQ ID NO: 3749535 - RNA, 19 nt, Human
gggaauacuagggagaagg

SEQ ID NO: 3749536 - RNA, 23 nt, Human
gggaauagucuagauggcuccuc

SEQ ID NO: 3749537 - RNA, 22 nt, Human
gggaauaugagugcguggugcg

SEQ ID NO: 3749538 - RNA, 22 nt, Human
gggaauccccgaaggugcugga

SEQ ID NO: 3749539 - RNA, 22 nt, Human
gggaaucuaagagagcugccau

SEQ ID NO: 3749540 - RNA, 13 nt, Human
gggaaugaagaua

SEQ ID NO: 3749541 - RNA, 22 nt, Human
gaaacagacuuguauauucuau

SEQ ID NO: 3749542 - RNA, 14 nt, Human
gaaacagagacagg

SEQ ID NO: 3749543 - RNA, 15 nt, Human
gaaacagauaccaua

SEQ ID NO: 3749544 - RNA, 14 nt, Human
gaaacagauuuggu

SEQ ID NO: 3749545 - RNA, 15 nt, Human
gaaacagccagcaag

SEQ ID NO: 3749546 - RNA, 16 nt, Human
gaaacagccugugucu

SEQ ID NO: 3749547 - RNA, 13 nt, Human
gaaacagcugccu

SEQ ID NO: 3749548 - RNA, 15 nt, Human
gaaacagcugccuua

SEQ ID NO: 3749549 - RNA, 16 nt, Human
gaaacagcugccuuag

SEQ ID NO: 3749550 - RNA, 20 nt, Human
gaaacagcugccuuagcuuc

SEQ ID NO: 3749551 - RNA, 16 nt, Human
gaaacagcuuucaagu

SEQ ID NO: 3749552 - RNA, 18 nt, Human
gaaacagcuuucaagugc

SEQ ID NO: 3749553 - RNA, 17 nt, Human
gaaacaggagagaaagg

SEQ ID NO: 3749554 - RNA, 18 nt, Human
gaaacaguugguaacuuu

SEQ ID NO: 3749555 - RNA, 19 nt, Human
gaaacaguugguaacuuuu

SEQ ID NO: 3749556 - RNA, 23 nt, Human
gaaacaucaguuacucugaaggg

SEQ ID NO: 3749557 - RNA, 15 nt, Human
gaaacaucauagaaa

SEQ ID NO: 3749558 - RNA, 13 nt, Human
gaaacaugacacu

SEQ ID NO: 3749559 - RNA, 18 nt, Human
gaaacauugcuuuuaaaa

SEQ ID NO: 3749560 - RNA, 13 nt, Human
gaaacauuggaag

SEQ ID NO: 3749561 - RNA, 12 nt, Human
gaaacauuuaua

SEQ ID NO: 3749562 - RNA, 13 nt, Human
gaaacauuuauau

SEQ ID NO: 3749563 - RNA, 19 nt, Human
gaaacauuuauauuuuuau

SEQ ID NO: 3749564 - RNA, 16 nt, Human
gaaacauuuuuuaaaa

SEQ ID NO: 3749565 - RNA, 22 nt, Human
gaaaccaaagauauauacacag

SEQ ID NO: 3749566 - RNA, 21 nt, Human
gaaaccaaucaagauaaagga

SEQ ID NO: 3749567 - RNA, 13 nt, Human
gaaaccagcuucc

SEQ ID NO: 3749568 - RNA, 22 nt, Human
gaaaccagcuuccuucagagag

SEQ ID NO: 3749569 - RNA, 23 nt, Human
gaaaccagcuuccuucagagagc

SEQ ID NO: 3749570 - RNA, 18 nt, Human
gaaacccaagcuccuccu

SEQ ID NO: 3749571 - RNA, 23 nt, Human
gaaacccaagcuccuccucggaa

SEQ ID NO: 3749572 - RNA, 21 nt, Human
gaaacccagacugaacuuacc

SEQ ID NO: 3749573 - RNA, 19 nt, Human
gaaacccagcucuggucca

SEQ ID NO: 3749574 - RNA, 19 nt, Human
gaaacccauaggcccacac

SEQ ID NO: 3749575 - RNA, 21 nt, Human
gaaacccauaggcccacacac

SEQ ID NO: 3749576 - RNA, 16 nt, Human
gaaacccccacacaca

SEQ ID NO: 3749577 - RNA, 17 nt, Human
gaaacccccacacacac

SEQ ID NO: 3749578 - RNA, 19 nt, Human
gaaaccccuguaggccuca

SEQ ID NO: 3749579 - RNA, 19 nt, Human
gaaaccccuucucugugac

SEQ ID NO: 3749580 - RNA, 20 nt, Human
gaaaccccuucucugugacc

SEQ ID NO: 3749581 - RNA, 21 nt, Human
gaaacccugcacccauuagca

SEQ ID NO: 3749582 - RNA, 21 nt, Human
gaaacccuggaccaguggucu

SEQ ID NO: 3749583 - RNA, 14 nt, Human
gaaacccugucucu

SEQ ID NO: 3749584 - RNA, 17 nt, Human
gaaaccuacagaauacu

SEQ ID NO: 3749585 - RNA, 18 nt, Human
gaaaccugaaaaaaaguu

SEQ ID NO: 3749586 - RNA, 13 nt, Human
gaaaccugcccug

SEQ ID NO: 3749587 - RNA, 14 nt, Human
gaaaccugcccugc

SEQ ID NO: 3749588 - RNA, 18 nt, Human
gaaaccugcccugccuga

SEQ ID NO: 3749589 - RNA, 19 nt, Human
gaaaccugcucuguaggag

SEQ ID NO: 3749590 - RNA, 18 nt, Human
gaaaccuguauaacccug

SEQ ID NO: 3749591 - RNA, 19 nt, Human
gaaaccuuuagggcagcuu

SEQ ID NO: 3749592 - RNA, 20 nt, Human
gaaacgaagccaucuuucuu

SEQ ID NO: 3749593 - RNA, 13 nt, Human
gaaacgcuaccuc

SEQ ID NO: 3749594 - RNA, 20 nt, Human
gaaacgcuaccucucugucc

SEQ ID NO: 3749595 - RNA, 13 nt, Human
gaaacuaaagcaa

SEQ ID NO: 3749596 - RNA, 14 nt, Human
gaaacuaauaaaau

SEQ ID NO: 3749597 - RNA, 16 nt, Human
gaaacuaauaaaauau

SEQ ID NO: 3749598 - RNA, 22 nt, Human
gaaacuaauaaaauauuuucug

SEQ ID NO: 3749599 - RNA, 23 nt, Human
gaaacuacugccuuuagaaaaua

SEQ ID NO: 3749600 - RNA, 22 nt, Human
gaaacuagacuugaggaaacca

SEQ ID NO: 3749601 - RNA, 13 nt, Human
gaaacuaggucug

SEQ ID NO: 3749602 - RNA, 19 nt, Human
gaaacuauguguuuuucuc

SEQ ID NO: 3749603 - RNA, 17 nt, Human
gaaacucaccauguaaa

SEQ ID NO: 3749604 - RNA, 21 nt, Human
gaaacucacccccaaggggca

SEQ ID NO: 3749605 - RNA, 23 nt, Human
gaaacucauaauagacuucccac

SEQ ID NO: 3749606 - RNA, 20 nt, Human
gaaacuccaccuugcgggga

SEQ ID NO: 3749607 - RNA, 18 nt, Human
gaaacucccauguaugga

SEQ ID NO: 3749608 - RNA, 22 nt, Human
gaaacuccgucuuagaagugga

SEQ ID NO: 3749609 - RNA, 23 nt, Human
gaaacucuuaucucagucaugca

SEQ ID NO: 3749610 - RNA, 22 nt, Human
gaaacucuugcuauugaauuga

SEQ ID NO: 3749611 - RNA, 13 nt, Human
gaaacuggauuaa

SEQ ID NO: 3749612 - RNA, 17 nt, Human
gaaacuggauuaaacuu

SEQ ID NO: 3749613 - RNA, 14 nt, Human
gaaacuggccaugg

SEQ ID NO: 3749614 - RNA, 12 nt, Human
gaaacuggcccc

SEQ ID NO: 3749615 - RNA, 15 nt, Human
gaaacuggccccgga

SEQ ID NO: 3749616 - RNA, 16 nt, Human
gaaacuggccccggau

SEQ ID NO: 3749617 - RNA, 17 nt, Human
gaaacuggguuccugca

SEQ ID NO: 3749618 - RNA, 20 nt, Human
gaaacuguucccaccugcug

SEQ ID NO: 3749619 - RNA, 21 nt, Human
gaaacuuaaauguuauuaucu

SEQ ID NO: 3749620 - RNA, 21 nt, Human
gaaacuuaucuuacaaagugu

SEQ ID NO: 3749621 - RNA, 19 nt, Human
gaaacuuauuuuuuucuga

SEQ ID NO: 3749622 - RNA, 13 nt, Human
gaaacuuccaaga

SEQ ID NO: 3749623 - RNA, 11 nt, Human
gaaacuuggau

SEQ ID NO: 3749624 - RNA, 17 nt, Human
gaaacuuguuagaaaug

SEQ ID NO: 3749625 - RNA, 16 nt, Human
gaaacuuguuauugug

SEQ ID NO: 3749626 - RNA, 17 nt, Human
gaaacuuuauacauuag

SEQ ID NO: 3749627 - RNA, 19 nt, Human
gaaacuuuauacauuagua

SEQ ID NO: 3749628 - RNA, 20 nt, Human
gaaacuuuauacauuaguaa

SEQ ID NO: 3749629 - RNA, 22 nt, Human
gaaacuuugagaucuaaaaaua

SEQ ID NO: 3749630 - RNA, 15 nt, Human
gaaacuuuuggaagg

SEQ ID NO: 3749631 - RNA, 21 nt, Human
gaaacuuuuguaaagaaauuu

SEQ ID NO: 3749632 - RNA, 22 nt, Human
gaaagaaaguugcacggcugcu

SEQ ID NO: 3749633 - RNA, 20 nt, Human
gaaagaacauggacuuguau

SEQ ID NO: 3749634 - RNA, 17 nt, Human
gaaagaacuaucuucau

SEQ ID NO: 3749635 - RNA, 21 nt, Human
gaaagaacuaucuucaucuga

SEQ ID NO: 3749636 - RNA, 19 nt, Human
gaaagaagagccggagccu

SEQ ID NO: 3749637 - RNA, 13 nt, Human
gaaagaauagaaa

SEQ ID NO: 3749638 - RNA, 19 nt, Human
gaaagaaugaaagaguaaa

SEQ ID NO: 3749639 - RNA, 13 nt, Human
gaaagacacugcc

SEQ ID NO: 3749640 - RNA, 17 nt, Human
gaaagacagcuucucau

SEQ ID NO: 3749641 - RNA, 14 nt, Human
gaaagacaucuuuc

SEQ ID NO: 3749642 - RNA, 15 nt, Human
gaaagacgcacuuug

SEQ ID NO: 3749643 - RNA, 21 nt, Human
gaaagacggauugcauuagaa

SEQ ID NO: 3749644 - RNA, 15 nt, Human
gaaagacuauucaaa

SEQ ID NO: 3749645 - RNA, 22 nt, Human
gaaagacuauucaaacagucuc

SEQ ID NO: 3749646 - RNA, 15 nt, Human
gaaaugcugccugcc

SEQ ID NO: 3749647 - RNA, 16 nt, Human
gaaaugcugcuggcca

SEQ ID NO: 3749648 - RNA, 19 nt, Human
gaaaugcugggcugacggu

SEQ ID NO: 3749649 - RNA, 21 nt, Human
gaaauggaggaucucuaaaga

SEQ ID NO: 3749650 - RNA, 24 nt, Human
gaaauggaggaucucuaaagagca

SEQ ID NO: 3749651 - RNA, 17 nt, Human
gaaauggaugcaaagua

SEQ ID NO: 3749652 - RNA, 18 nt, Human
gaaauggcuugaagccaa

SEQ ID NO: 3749653 - RNA, 19 nt, Human
gaaaugggacuuaacuccu

SEQ ID NO: 3749654 - RNA, 15 nt, Human
gaaaugggcagagca

SEQ ID NO: 3749655 - RNA, 15 nt, Human
gaaaugguggaacug

SEQ ID NO: 3749656 - RNA, 19 nt, Human
gaaaugguuguauuagaug

SEQ ID NO: 3749657 - RNA, 20 nt, Human
gaaaugguuguauuagaugu

SEQ ID NO: 3749658 - RNA, 22 nt, Human
gaaauguaagggaaacugccag

SEQ ID NO: 3749659 - RNA, 18 nt, Human
gaaauguagguccucaga

SEQ ID NO: 3749660 - RNA, 21 nt, Human
gaaaugucacguacugucuga

SEQ ID NO: 3749661 - RNA, 17 nt, Human
gaaaugucaguucugau

SEQ ID NO: 3749662 - RNA, 15 nt, Human
gaaaugucccuuucu

SEQ ID NO: 3749663 - RNA, 17 nt, Human
gaaaugucccuuucuuc

SEQ ID NO: 3749664 - RNA, 20 nt, Human
gaaaugugaauuuuuauugu

SEQ ID NO: 3749665 - RNA, 23 nt, Human
gaaaugugguagccucacuuuua

SEQ ID NO: 3749666 - RNA, 16 nt, Human
gaaaugugugugaugu

SEQ ID NO: 3749667 - RNA, 23 nt, Human
gaaauguuacaaaaauaaacuau

SEQ ID NO: 3749668 - RNA, 21 nt, Human
gaaauguuacagcauauuuua

SEQ ID NO: 3749669 - RNA, 21 nt, Human
gaaauguuauuuuuuaauuau

SEQ ID NO: 3749670 - RNA, 22 nt, Human
gaaauguuauuuuuuaauuauu

SEQ ID NO: 3749671 - RNA, 16 nt, Human
gaaauguuugcugaac

SEQ ID NO: 3749672 - RNA, 22 nt, Human
gaaauguuuuuaauaaaagaaa

SEQ ID NO: 3749673 - RNA, 13 nt, Human
gaaauuaagaaga

SEQ ID NO: 3749674 - RNA, 17 nt, Human
gaaauuaagaaggcaaa

SEQ ID NO: 3749675 - RNA, 20 nt, Human
gaaauuaccagaguuguucu

SEQ ID NO: 3749676 - RNA, 17 nt, Human
gaaauuaccuguggaua

SEQ ID NO: 3749677 - RNA, 19 nt, Human
gaaauuaccuguggauauu

SEQ ID NO: 3749678 - RNA, 21 nt, Human
gaaauuacuuaucauccacau

SEQ ID NO: 3749679 - RNA, 13 nt, Human
gaaauuagccggg

SEQ ID NO: 3749680 - RNA, 16 nt, Human
gaaauuagcuguguga

SEQ ID NO: 3749681 - RNA, 18 nt, Human
gaaauuagguugaaacau

SEQ ID NO: 3749682 - RNA, 20 nt, Human
gaaauuagguugaaacauau

SEQ ID NO: 3749683 - RNA, 23 nt, Human
gaaauuauauaaguauucuaaau

SEQ ID NO: 3749684 - RNA, 15 nt, Human
gaaauuauaucugug

SEQ ID NO: 3749685 - RNA, 19 nt, Human
gaaauuauaucuguggucu

SEQ ID NO: 3749686 - RNA, 22 nt, Human
gaaauuaugugacauuuuacau

SEQ ID NO: 3749687 - RNA, 13 nt, Human
gaaauuauuuaau

SEQ ID NO: 3749688 - RNA, 15 nt, Human
gaaauuauuuaauaa

SEQ ID NO: 3749689 - RNA, 23 nt, Human
gaaauucaacguuaauaauucug

SEQ ID NO: 3749690 - RNA, 15 nt, Human
gaaauucccuggacc

SEQ ID NO: 3749691 - RNA, 18 nt, Human
gaaauucccuggaccaga

SEQ ID NO: 3749692 - RNA, 22 nt, Human
gaaauucccuggaccagaugcu

SEQ ID NO: 3749693 - RNA, 12 nt, Human
gaaauuccugua

SEQ ID NO: 3749694 - RNA, 16 nt, Human
gaaauuccuguagcau

SEQ ID NO: 3749695 - RNA, 17 nt, Human
gaaauucguguguuuuu

SEQ ID NO: 3749696 - RNA, 20 nt, Human
gaaauucuauuuauaauaca

SEQ ID NO: 3749697 - RNA, 14 nt, Human
gaaauucuccugga

SEQ ID NO: 3749698 - RNA, 16 nt, Human
gaaauucuccuggagg

SEQ ID NO: 3749699 - RNA, 16 nt, Human
gaaauucugaauuugc

SEQ ID NO: 3749700 - RNA, 18 nt, Human
gaaauucugaauuugcaa

SEQ ID NO: 3749701 - RNA, 12 nt, Human
gaaauucuguuu

SEQ ID NO: 3749702 - RNA, 18 nt, Human
gaaauucuuuauacauuc

SEQ ID NO: 3749703 - RNA, 16 nt, Human
gaaauucuuucagcua

SEQ ID NO: 3749704 - RNA, 22 nt, Human
gaaauucuuucccagucugucg

SEQ ID NO: 3749705 - RNA, 14 nt, Human
gaaauugaaccuuu

SEQ ID NO: 3749706 - RNA, 21 nt, Human
gaaauugaaccuuugugcccu

SEQ ID NO: 3749707 - RNA, 17 nt, Human
gaaauugagcugcuuuu

SEQ ID NO: 3749708 - RNA, 20 nt, Human
gaaauugccuauccugcugu

SEQ ID NO: 3749709 - RNA, 21 nt, Human
gaaauugccuauccugcuguu

SEQ ID NO: 3749710 - RNA, 17 nt, Human
gaaauuguaauuauauc

SEQ ID NO: 3749711 - RNA, 16 nt, Human
gaaauuguauuacaaa

SEQ ID NO: 3749712 - RNA, 18 nt, Human
gaaauuguauuacaaauc

SEQ ID NO: 3749713 - RNA, 20 nt, Human
gaaauugucuagcagagcag

SEQ ID NO: 3749714 - RNA, 13 nt, Human
gaaauuuaaacua

SEQ ID NO: 3749715 - RNA, 12 nt, Human
gaaauuuagcau

SEQ ID NO: 3749716 - RNA, 14 nt, Human
gaaauuuagcauug

SEQ ID NO: 3749717 - RNA, 16 nt, Human
gaaauuuagcauugua

SEQ ID NO: 3749718 - RNA, 21 nt, Human
gaaauuuauuaguuaauauau

SEQ ID NO: 3749719 - RNA, 12 nt, Human
gaaauuucacgu

SEQ ID NO: 3749720 - RNA, 11 nt, Human
gaaauuucaga

SEQ ID NO: 3749721 - RNA, 19 nt, Human
gaaauuuccacucaggucu

SEQ ID NO: 3749722 - RNA, 17 nt, Human
gaaauuucucaucacag

SEQ ID NO: 3749723 - RNA, 14 nt, Human
gaaauuucugugaa

SEQ ID NO: 3749724 - RNA, 24 nt, Human
gaaauuugaauuuuguguuagaga

SEQ ID NO: 3749725 - RNA, 15 nt, Human
gaaauuugauuucua

SEQ ID NO: 3749726 - RNA, 23 nt, Human
gaaauuugggagagccauacaua

SEQ ID NO: 3749727 - RNA, 15 nt, Human
gaaauuuuacaauag

SEQ ID NO: 3749728 - RNA, 12 nt, Human
gaaauuuuacca

SEQ ID NO: 3749729 - RNA, 16 nt, Human
ggcccccagagcgccc

SEQ ID NO: 3749730 - RNA, 19 nt, Human
ggcccccagagcgccccuc

SEQ ID NO: 3749731 - RNA, 18 nt, Human
ggcccccagcccagggcu

SEQ ID NO: 3749732 - RNA, 19 nt, Human
ggcccccaucauccucugg

SEQ ID NO: 3749733 - RNA, 15 nt, Human
ggccccccagcucag

SEQ ID NO: 3749734 - RNA, 21 nt, Human
ggccccccagcucaggggcag

SEQ ID NO: 3749735 - RNA, 19 nt, Human
ggcccccgccuuggccugu

SEQ ID NO: 3749736 - RNA, 23 nt, Human
ggcccccgccuuggccuguguuc

SEQ ID NO: 3749737 - RNA, 13 nt, Human
ggcccccucccug

SEQ ID NO: 3749738 - RNA, 11 nt, Human
ggcccccugcc

SEQ ID NO: 3749739 - RNA, 17 nt, Human
ggcccccuuucccgggc

SEQ ID NO: 3749740 - RNA, 18 nt, Human
ggccccgaggacccagac

SEQ ID NO: 3749741 - RNA, 14 nt, Human
ggccccgcccaggc

SEQ ID NO: 3749742 - RNA, 14 nt, Human
ggccccgccgccug

SEQ ID NO: 3749743 - RNA, 17 nt, Human
ggccccggaucagagca

SEQ ID NO: 3749744 - RNA, 21 nt, Human
ggccccggccccagccagagu

SEQ ID NO: 3749745 - RNA, 22 nt, Human
ggccccucacccugccuuaucu

SEQ ID NO: 3749746 - RNA, 16 nt, Human
ggccccucaggguccc

SEQ ID NO: 3749747 - RNA, 22 nt, Human
ggccccucccacacacacccac

SEQ ID NO: 3749748 - RNA, 22 nt, Human
ggccccucccacacccaaagcu

SEQ ID NO: 3749749 - RNA, 17 nt, Human
ggccccucccuaccuca

SEQ ID NO: 3749750 - RNA, 12 nt, Human
ggccccucucag

SEQ ID NO: 3749751 - RNA, 16 nt, Human
ggccccucucagcccu

SEQ ID NO: 3749752 - RNA, 14 nt, Human
ggccccucugaccu

SEQ ID NO: 3749753 - RNA, 13 nt, Human
ggccccugccacc

SEQ ID NO: 3749754 - RNA, 16 nt, Human
ggccccugccacccug

SEQ ID NO: 3749755 - RNA, 17 nt, Human
ggccccugccagacccc

SEQ ID NO: 3749756 - RNA, 20 nt, Human
ggccccugcccggcugcgga

SEQ ID NO: 3749757 - RNA, 13 nt, Human
ggccccugccucu

SEQ ID NO: 3749758 - RNA, 14 nt, Human
ggccccugccuugg

SEQ ID NO: 3749759 - RNA, 19 nt, Human
ggccccugcuucuccagcc

SEQ ID NO: 3749760 - RNA, 21 nt, Human
ggccccugcuucuccagccug

SEQ ID NO: 3749761 - RNA, 13 nt, Human
ggccccuggagcc

SEQ ID NO: 3749762 - RNA, 22 nt, Human
ggccccuggaggcugccuccca

SEQ ID NO: 3749763 - RNA, 13 nt, Human
ggccccuggccca

SEQ ID NO: 3749764 - RNA, 22 nt, Human
ggccccugggcuuggccugcug

SEQ ID NO: 3749765 - RNA, 23 nt, Human
ggccccugggucagucugguggg

SEQ ID NO: 3749766 - RNA, 22 nt, Human
ggccccuucacuucugaccaca

SEQ ID NO: 3749767 - RNA, 18 nt, Human
ggccccuuuucacucccu

SEQ ID NO: 3749768 - RNA, 13 nt, Human
ggcccgagcagcu

SEQ ID NO: 3749769 - RNA, 16 nt, Human
ggcccgagcagcugag

SEQ ID NO: 3749770 - RNA, 13 nt, Human
ggcccgcuugccu

SEQ ID NO: 3749771 - RNA, 14 nt, Human
ggcccgcuugccuc

SEQ ID NO: 3749772 - RNA, 22 nt, Human
ggcccgcuugccucggcuccug

SEQ ID NO: 3749773 - RNA, 21 nt, Human
ggcccgucuguccaucugccc

SEQ ID NO: 3749774 - RNA, 23 nt, Human
ggcccguggggccggggcuucug

SEQ ID NO: 3749775 - RNA, 23 nt, Human
ggcccguugucucccuggcccuc

SEQ ID NO: 3749776 - RNA, 21 nt, Human
ggcccuaccagcgcccgcugg

SEQ ID NO: 3749777 - RNA, 22 nt, Human
ggcccuaccagcgcccgcuggg

SEQ ID NO: 3749778 - RNA, 18 nt, Human
ggcccucaaggccuccca

SEQ ID NO: 3749779 - RNA, 20 nt, Human
ggcccucaccccugcccugg

SEQ ID NO: 3749780 - RNA, 21 nt, Human
ggcccucaccccugcccuggg

SEQ ID NO: 3749781 - RNA, 22 nt, Human
ggcccucaucuaugaggaaagg

SEQ ID NO: 3749782 - RNA, 20 nt, Human
ggcccucauuaaugacacuu

SEQ ID NO: 3749783 - RNA, 16 nt, Human
ggcccuccacaccugc

SEQ ID NO: 3749784 - RNA, 21 nt, Human
ggcccuccacaccugcggccc

SEQ ID NO: 3749785 - RNA, 17 nt, Human
ggcccuccagagcccca

SEQ ID NO: 3749786 - RNA, 23 nt, Human
ggcccucccuuggaaaccugccc

SEQ ID NO: 3749787 - RNA, 20 nt, Human
ggcccuccuacccugcgccc

SEQ ID NO: 3749788 - RNA, 16 nt, Human
ggcccucgcugccagc

SEQ ID NO: 3749789 - RNA, 23 nt, Human
ggcccucgcugccagcucuguau

SEQ ID NO: 3749790 - RNA, 20 nt, Human
ggcccucgggcccagccccc

SEQ ID NO: 3749791 - RNA, 13 nt, Human
ggcccucuacccc

SEQ ID NO: 3749792 - RNA, 15 nt, Human
ggcccucuccccugc

SEQ ID NO: 3749793 - RNA, 15 nt, Human
ggcccucucugcucu

SEQ ID NO: 3749794 - RNA, 12 nt, Human
ggcccucucuuc

SEQ ID NO: 3749795 - RNA, 20 nt, Human
ggcccucugcccacucccug

SEQ ID NO: 3749796 - RNA, 18 nt, Human
ggcccucuggaguggcca

SEQ ID NO: 3749797 - RNA, 22 nt, Human
ggcccugaggugugggggcugc

SEQ ID NO: 3749798 - RNA, 19 nt, Human
ggcccugcaaaaggacucu

SEQ ID NO: 3749799 - RNA, 15 nt, Human
ggcccugcacugucc

SEQ ID NO: 3749800 - RNA, 19 nt, Human
ggcccugcacuguccugcu

SEQ ID NO: 3749801 - RNA, 10 nt, Human
ggcccugcau

SEQ ID NO: 3749802 - RNA, 20 nt, Human
ggcccugccaucuucccagc

SEQ ID NO: 3749803 - RNA, 15 nt, Human
ggcccugcccucucc

SEQ ID NO: 3749804 - RNA, 21 nt, Human
ggcccugcccucuccuuccuu

SEQ ID NO: 3749805 - RNA, 14 nt, Human
ggcccugcccugag

SEQ ID NO: 3749806 - RNA, 20 nt, Human
ggcccugcccugguuuccug

SEQ ID NO: 3749807 - RNA, 13 nt, Human
ggcccugccuccu

SEQ ID NO: 3749808 - RNA, 14 nt, Human
ggcccugccuccuu

SEQ ID NO: 3749809 - RNA, 15 nt, Human
ggcccugccuccuuu

SEQ ID NO: 3749810 - RNA, 17 nt, Human
ggcccugcuccugcagc

SEQ ID NO: 3749811 - RNA, 20 nt, Human
ggcccugcugagucaucugu

SEQ ID NO: 3749812 - RNA, 16 nt, Human
ggcccuggagcagcca

SEQ ID NO: 3749813 - RNA, 12 nt, Human
ggcccuggaggc

SEQ ID NO: 3749814 - RNA, 17 nt, Human
ggcccuggaucagcgug

SEQ ID NO: 3749815 - RNA, 18 nt, Human
ggcccuggaucagcgugg

SEQ ID NO: 3749816 - RNA, 23 nt, Human
ggcccuggaucagcguggccuug

SEQ ID NO: 3749817 - RNA, 12 nt, Human
ggcccuggcccu

SEQ ID NO: 3749818 - RNA, 17 nt, Human
ggcccuggccuccccug

SEQ ID NO: 3749819 - RNA, 22 nt, Human
ggcccuggccugcugggcucuc

SEQ ID NO: 3749820 - RNA, 13 nt, Human
ggcccuggccuug

SEQ ID NO: 3749821 - RNA, 22 nt, Human
ggcccuggcucccacaggcccu

SEQ ID NO: 3749822 - RNA, 15 nt, Human
ggcccuggcucugcu

SEQ ID NO: 3749823 - RNA, 21 nt, Human
ggcccugggcucggaggcugc

SEQ ID NO: 3749824 - RNA, 14 nt, Human
ggcccugggcugga

SEQ ID NO: 3749825 - RNA, 13 nt, Human
ggcccuggggccu

SEQ ID NO: 3749826 - RNA, 15 nt, Human
ggcccuggggccugu

SEQ ID NO: 3749827 - RNA, 15 nt, Human
ggcccugggguccca

SEQ ID NO: 3749828 - RNA, 15 nt, Human
ggcccuggguuccuc

SEQ ID NO: 3749829 - RNA, 15 nt, Human
ggcccugguccuucc

SEQ ID NO: 3749830 - RNA, 22 nt, Human
ggcccuggugcgaauggacuuu

SEQ ID NO: 3749831 - RNA, 18 nt, Human
ggcccugucccucccacc

SEQ ID NO: 3749832 - RNA, 23 nt, Human
ggcccugucccucccaccucugu

SEQ ID NO: 3749833 - RNA, 15 nt, Human
ggcccugugugcagg

SEQ ID NO: 3749834 - RNA, 22 nt, Human
ggcccuuccucuccacugccuu

SEQ ID NO: 3749835 - RNA, 23 nt, Human
ggcccuuccucuccacugccuuc

SEQ ID NO: 3749836 - RNA, 13 nt, Human
ggcccuuccugga

SEQ ID NO: 3749837 - RNA, 14 nt, Human
ggcccuuccuggac

SEQ ID NO: 3749838 - RNA, 14 nt, Human
ggcccuuccuuuuc

SEQ ID NO: 3749839 - RNA, 17 nt, Human
ggcccuucucuccagcc

SEQ ID NO: 3749840 - RNA, 20 nt, Human
ggcccuucucuccagccccu

SEQ ID NO: 3749841 - RNA, 19 nt, Human
ggcccuucuugcugcccug

SEQ ID NO: 3749842 - RNA, 19 nt, Human
ggcccuugaguccccauug

SEQ ID NO: 3749843 - RNA, 17 nt, Human
ggcccuugucggcccca

SEQ ID NO: 3749844 - RNA, 16 nt, Human
ggccgaaggcagugca

SEQ ID NO: 3749845 - RNA, 19 nt, Human
ggccgacauugucucccgc

SEQ ID NO: 3749846 - RNA, 19 nt, Human
ggccgagccugccuccugc

SEQ ID NO: 3749847 - RNA, 13 nt, Human
ggccgaggacuuu

SEQ ID NO: 3749848 - RNA, 14 nt, Human
ggccgaggcgggug

SEQ ID NO: 3749849 - RNA, 13 nt, Human
ggccgaguccaag

SEQ ID NO: 3749850 - RNA, 16 nt, Human
ggccgaguccaagcug

SEQ ID NO: 3749851 - RNA, 19 nt, Human
ggccgaucggggcacugca

SEQ ID NO: 3749852 - RNA, 16 nt, Human
ggccgauggggcaguc

SEQ ID NO: 3749853 - RNA, 22 nt, Human
ggccgcaccuaaagcagccagc

SEQ ID NO: 3749854 - RNA, 23 nt, Human
ggccgcccccagcccccuccugg

SEQ ID NO: 3749855 - RNA, 18 nt, Human
ggccgcccccugcccccc

SEQ ID NO: 3749856 - RNA, 19 nt, Human
ggccgcccccugcccccca

SEQ ID NO: 3749857 - RNA, 22 nt, Human
ggccgccggcaauaaaagccca

SEQ ID NO: 3749858 - RNA, 23 nt, Human
ggccgccggcaauaaaagcccag

SEQ ID NO: 3749859 - RNA, 12 nt, Human
ggccgccucacc

SEQ ID NO: 3749860 - RNA, 14 nt, Human
ggccgccucacccc

SEQ ID NO: 3749861 - RNA, 13 nt, Human
ggccgcuagaggc

SEQ ID NO: 3749862 - RNA, 20 nt, Human
ggccgcuagaggccugagga

SEQ ID NO: 3749863 - RNA, 16 nt, Human
ggccgcuccaccagca

SEQ ID NO: 3749864 - RNA, 13 nt, Human
ggccgcuccaggg

SEQ ID NO: 3749865 - RNA, 21 nt, Human
ggccgcugccacccaccuccc

SEQ ID NO: 3749866 - RNA, 22 nt, Human
ggccgcugccacccaccucccu

SEQ ID NO: 3749867 - RNA, 16 nt, Human
ggccgcuguucaccca

SEQ ID NO: 3749868 - RNA, 14 nt, Human
ggccggccaggugg

SEQ ID NO: 3749869 - RNA, 16 nt, Human
ggccggccaggugggc

SEQ ID NO: 3749870 - RNA, 12 nt, Human
ggccggcccugu

SEQ ID NO: 3749871 - RNA, 14 nt, Human
ggccggcccugugu

SEQ ID NO: 3749872 - RNA, 15 nt, Human
ggccggcccugugug

SEQ ID NO: 3749873 - RNA, 18 nt, Human
ggccggcggccucagagu

SEQ ID NO: 3749874 - RNA, 19 nt, Human
ggccggcugugcucagaga

SEQ ID NO: 3749875 - RNA, 12 nt, Human
ggccgggcacag

SEQ ID NO: 3749876 - RNA, 16 nt, Human
ggccgggcagaggggc

SEQ ID NO: 3749877 - RNA, 18 nt, Human
ggccggggaacuggccaa

SEQ ID NO: 3749878 - RNA, 13 nt, Human
ggccggggcugag

SEQ ID NO: 3749879 - RNA, 11 nt, Human
gggcccaggga

SEQ ID NO: 3749880 - RNA, 13 nt, Human
gggcccaucucuu

SEQ ID NO: 3749881 - RNA, 15 nt, Human
gggccccaccaccua

SEQ ID NO: 3749882 - RNA, 14 nt, Human
gggccccagaggcu

SEQ ID NO: 3749883 - RNA, 12 nt, Human
gggccccagccc

SEQ ID NO: 3749884 - RNA, 13 nt, Human
gggccccagccca

SEQ ID NO: 3749885 - RNA, 14 nt, Human
gggccccagcccac

SEQ ID NO: 3749886 - RNA, 16 nt, Human
gggccccagcccaccc

SEQ ID NO: 3749887 - RNA, 17 nt, Human
gggccccagucagccuc

SEQ ID NO: 3749888 - RNA, 23 nt, Human
gggcccccagcgagagucccugc

SEQ ID NO: 3749889 - RNA, 23 nt, Human
gggccccccagcucaggggcagc

SEQ ID NO: 3749890 - RNA, 17 nt, Human
gggccccccuccuugcu

SEQ ID NO: 3749891 - RNA, 19 nt, Human
gggccccccuccuugcucu

SEQ ID NO: 3749892 - RNA, 19 nt, Human
gggccccucacccugccuu

SEQ ID NO: 3749893 - RNA, 15 nt, Human
gggccccuccagcuu

SEQ ID NO: 3749894 - RNA, 20 nt, Human
gggccccucccuaccucaac

SEQ ID NO: 3749895 - RNA, 14 nt, Human
gggccccucucagc

SEQ ID NO: 3749896 - RNA, 15 nt, Human
gggccccucucagcc

SEQ ID NO: 3749897 - RNA, 15 nt, Human
gggccccucugccca

SEQ ID NO: 3749898 - RNA, 15 nt, Human
gggccccugccucuc

SEQ ID NO: 3749899 - RNA, 18 nt, Human
gggccccugccucucugc

SEQ ID NO: 3749900 - RNA, 19 nt, Human
gggccccugccucucugca

SEQ ID NO: 3749901 - RNA, 21 nt, Human
gggccccugccucucugcagg

SEQ ID NO: 3749902 - RNA, 14 nt, Human
gggccccugggcuu

SEQ ID NO: 3749903 - RNA, 20 nt, Human
gggcccgccuggcagaacug

SEQ ID NO: 3749904 - RNA, 23 nt, Human
gggcccgcuugccucggcuccug

SEQ ID NO: 3749905 - RNA, 12 nt, Human
gggcccggacgc

SEQ ID NO: 3749906 - RNA, 21 nt, Human
gggcccggguugggucaccag

SEQ ID NO: 3749907 - RNA, 14 nt, Human
gggcccucccuugg

SEQ ID NO: 3749908 - RNA, 16 nt, Human
gggcccuccgacagcc

SEQ ID NO: 3749909 - RNA, 19 nt, Human
gggcccuccgacagccccc

SEQ ID NO: 3749910 - RNA, 23 nt, Human
gggcccuccugaaacuuacacac

SEQ ID NO: 3749911 - RNA, 22 nt, Human
gggcccugagcucgguggaccc

SEQ ID NO: 3749912 - RNA, 21 nt, Human
gggcccugcagcucucaugcu

SEQ ID NO: 3749913 - RNA, 15 nt, Human
gggcccuggagcagc

SEQ ID NO: 3749914 - RNA, 12 nt, Human
gggcccuggagg

SEQ ID NO: 3749915 - RNA, 17 nt, Human
gggcccugggccugccu

SEQ ID NO: 3749916 - RNA, 14 nt, Human
gggcccuggggccu

SEQ ID NO: 3749917 - RNA, 15 nt, Human
gggcccuggggccug

SEQ ID NO: 3749918 - RNA, 21 nt, Human
gggcccugguguuucuagcac

SEQ ID NO: 3749919 - RNA, 21 nt, Human
gggcccuucacugccuuugcu

SEQ ID NO: 3749920 - RNA, 19 nt, Human
gggcccuucuugcugcccu

SEQ ID NO: 3749921 - RNA, 17 nt, Human
gggcccuuugagugcag

SEQ ID NO: 3749922 - RNA, 20 nt, Human
gggccgaccagaggagccuu

SEQ ID NO: 3749923 - RNA, 16 nt, Human
gggccgaugcccagag

SEQ ID NO: 3749924 - RNA, 20 nt, Human
gggccgcccgggcccagagg

SEQ ID NO: 3749925 - RNA, 20 nt, Human
gggccgcguggugccauccc

SEQ ID NO: 3749926 - RNA, 15 nt, Human
gggccgcugccaccc

SEQ ID NO: 3749927 - RNA, 15 nt, Human
gggccggagggucag

SEQ ID NO: 3749928 - RNA, 20 nt, Human
gggccggggaacuggccaag

SEQ ID NO: 3749929 - RNA, 15 nt, Human
gggccguaccccacc

SEQ ID NO: 3749930 - RNA, 16 nt, Human
gggccguaccccaccc

SEQ ID NO: 3749931 - RNA, 16 nt, Human
gggccguaucuccggc

SEQ ID NO: 3749932 - RNA, 24 nt, Human
gggccguaucuccggcucccagcc

SEQ ID NO: 3749933 - RNA, 13 nt, Human
gggccgugcccag

SEQ ID NO: 3749934 - RNA, 14 nt, Human
gggccgugcccagg

SEQ ID NO: 3749935 - RNA, 21 nt, Human
gggccuagcgaucucuccugg

SEQ ID NO: 3749936 - RNA, 23 nt, Human
gggccuagcgaucucuccuggcc

SEQ ID NO: 3749937 - RNA, 23 nt, Human
gggccuagcugcuacaaagaaga

SEQ ID NO: 3749938 - RNA, 17 nt, Human
gggccuaggccucagcc

SEQ ID NO: 3749939 - RNA, 15 nt, Human
gggccuaggcugcau

SEQ ID NO: 3749940 - RNA, 15 nt, Human
gggccuaucagugug

SEQ ID NO: 3749941 - RNA, 20 nt, Human
gggccuaucagugugccccc

SEQ ID NO: 3749942 - RNA, 16 nt, Human
gggccuauggagagcc

SEQ ID NO: 3749943 - RNA, 20 nt, Human
gggccuauggagagcccugg

SEQ ID NO: 3749944 - RNA, 22 nt, Human
gggccuauggagagcccuggga

SEQ ID NO: 3749945 - RNA, 13 nt, Human
gggccucacucca

SEQ ID NO: 3749946 - RNA, 14 nt, Human
gggccucacuccag

SEQ ID NO: 3749947 - RNA, 19 nt, Human
gggccucagggcagccugc

SEQ ID NO: 3749948 - RNA, 19 nt, Human
gggccuccauuccuggagc

SEQ ID NO: 3749949 - RNA, 22 nt, Human
gggccucggacuuagcugggag

SEQ ID NO: 3749950 - RNA, 15 nt, Human
gggccucggagccuc

SEQ ID NO: 3749951 - RNA, 23 nt, Human
gggccucugcggagcacacuggc

SEQ ID NO: 3749952 - RNA, 23 nt, Human
gggccucugguuuggggcgaggc

SEQ ID NO: 3749953 - RNA, 23 nt, Human
gggccucuugcggucccuucuua

SEQ ID NO: 3749954 - RNA, 18 nt, Human
gggccugaccucccccuc

SEQ ID NO: 3749955 - RNA, 19 nt, Human
gggccugaccucccccucc

SEQ ID NO: 3749956 - RNA, 17 nt, Human
gggccugacugcucaga

SEQ ID NO: 3749957 - RNA, 20 nt, Human
gggccugagcaguccuuggc

SEQ ID NO: 3749958 - RNA, 17 nt, Human
gggccugaggcuccuua

SEQ ID NO: 3749959 - RNA, 18 nt, Human
gggccugcaggaccugcc

SEQ ID NO: 3749960 - RNA, 11 nt, Human
gggccugccac

SEQ ID NO: 3749961 - RNA, 13 nt, Human
gggccugccaccu

SEQ ID NO: 3749962 - RNA, 16 nt, Human
gggccugccaccugga

SEQ ID NO: 3749963 - RNA, 18 nt, Human
gggccugccaccuggacc

SEQ ID NO: 3749964 - RNA, 23 nt, Human
gggccugccaccuggaccccugc

SEQ ID NO: 3749965 - RNA, 15 nt, Human
gggccugccgggcug

SEQ ID NO: 3749966 - RNA, 20 nt, Human
gggccugccgggcugagggc

SEQ ID NO: 3749967 - RNA, 17 nt, Human
gggccugcuccagaccu

SEQ ID NO: 3749968 - RNA, 11 nt, Human
gggccugcugc

SEQ ID NO: 3749969 - RNA, 12 nt, Human
gggccugcugcu

SEQ ID NO: 3749970 - RNA, 15 nt, Human
gggccugcugcugag

SEQ ID NO: 3749971 - RNA, 18 nt, Human
gggccugcugcugagaac

SEQ ID NO: 3749972 - RNA, 19 nt, Human
gggccugcugcugagaacc

SEQ ID NO: 3749973 - RNA, 14 nt, Human
gggccuggaccugc

SEQ ID NO: 3749974 - RNA, 12 nt, Human
gggccuggaugc

SEQ ID NO: 3749975 - RNA, 21 nt, Human
gggccuggauucauuuccugc

SEQ ID NO: 3749976 - RNA, 12 nt, Human
gggccuggcuca

SEQ ID NO: 3749977 - RNA, 14 nt, Human
gggccuggcuggcu

SEQ ID NO: 3749978 - RNA, 21 nt, Human
gggccuggcuggcugagggca

SEQ ID NO: 3749979 - RNA, 22 nt, Human
gggccuggcuggcugagggcag

SEQ ID NO: 3749980 - RNA, 12 nt, Human
gggccugggcag

SEQ ID NO: 3749981 - RNA, 15 nt, Human
gggccugggcaggag

SEQ ID NO: 3749982 - RNA, 17 nt, Human
gggccugggcaggaggg

SEQ ID NO: 3749983 - RNA, 11 nt, Human
gggccugggcc

SEQ ID NO: 3749984 - RNA, 16 nt, Human
gggccugggcuccugg

SEQ ID NO: 3749985 - RNA, 19 nt, Human
gggccuggucccugggagg

SEQ ID NO: 3749986 - RNA, 20 nt, Human
gggccuggucucacccugga

SEQ ID NO: 3749987 - RNA, 12 nt, Human
gggccuguacag

SEQ ID NO: 3749988 - RNA, 16 nt, Human
gggccuguacugccug

SEQ ID NO: 3749989 - RNA, 20 nt, Human
gggccuguacugccugcuug

SEQ ID NO: 3749990 - RNA, 23 nt, Human
gggccuguccacaggcuucugag

SEQ ID NO: 3749991 - RNA, 22 nt, Human
gggccuguggaaugagugugca

SEQ ID NO: 3749992 - RNA, 12 nt, Human
gggccuguugcc

SEQ ID NO: 3749993 - RNA, 16 nt, Human
gggccuuaaaagccau

SEQ ID NO: 3749994 - RNA, 20 nt, Human
gggccuuagugggccagggc

SEQ ID NO: 3749995 - RNA, 23 nt, Human
gggccuuaucgggcuccagccau

SEQ ID NO: 3749996 - RNA, 15 nt, Human
gggccuugcccagag

SEQ ID NO: 3749997 - RNA, 17 nt, Human
gggccuugcccagagau

SEQ ID NO: 3749998 - RNA, 22 nt, Human
gggccuuggccuccccugcuga

SEQ ID NO: 3749999 - RNA, 16 nt, Human
gggccuuggccuggag

SEQ ID NO: 3750000 - RNA, 17 nt, Human
gggccuuggccuggagc

SEQ ID NO: 3750001 - RNA, 24 nt, Human
gggccuugggcuccgugugggaga

SEQ ID NO: 3750002 - RNA, 16 nt, Human
gggccuuuggcaggug

SEQ ID NO: 3750003 - RNA, 16 nt, Human
gggcgaggcagaggac

SEQ ID NO: 3750004 - RNA, 18 nt, Human
gggcgaucgcggcggagc

SEQ ID NO: 3750005 - RNA, 12 nt, Human
gggcgcaggccg

SEQ ID NO: 3750006 - RNA, 19 nt, Human
gggcgccccccccucccca

SEQ ID NO: 3750007 - RNA, 22 nt, Human
gggcgccgugcugggcagcccg

SEQ ID NO: 3750008 - RNA, 22 nt, Human
gggcgccuguagucccagccac

SEQ ID NO: 3750009 - RNA, 16 nt, Human
gggcgcgguggcucac

SEQ ID NO: 3750010 - RNA, 20 nt, Human
gggcgcucgcuuccgcaucc

SEQ ID NO: 3750011 - RNA, 14 nt, Human
gggcggcagagagg

SEQ ID NO: 3750012 - RNA, 15 nt, Human
gggcggcaggaggga

SEQ ID NO: 3750013 - RNA, 21 nt, Human
gggcggcaggggccuggagau

SEQ ID NO: 3750014 - RNA, 15 nt, Human
gggcggcucugaagc

SEQ ID NO: 3750015 - RNA, 12 nt, Human
gggcggcugggu

SEQ ID NO: 3750016 - RNA, 17 nt, Human
gggcgggacccaggcac

SEQ ID NO: 3750017 - RNA, 15 nt, Human
gggcgggaggauguu

SEQ ID NO: 3750018 - RNA, 17 nt, Human
gggcgggcagagggcug

SEQ ID NO: 3750019 - RNA, 15 nt, Human
gggcgggcagcacag

SEQ ID NO: 3750020 - RNA, 16 nt, Human
gggcgugacucaccca

SEQ ID NO: 3750021 - RNA, 14 nt, Human
gggcgugagguccc

SEQ ID NO: 3750022 - RNA, 16 nt, Human
gggcgugaggucccag

SEQ ID NO: 3750023 - RNA, 13 nt, Human
gggcguggagggc

SEQ ID NO: 3750024 - RNA, 14 nt, Human
gggcguguuguuuu

SEQ ID NO: 3750025 - RNA, 20 nt, Human
gggcuaagagcuagcgcugc

SEQ ID NO: 3750026 - RNA, 15 nt, Human
gggcuacaaggaccc

SEQ ID NO: 3750027 - RNA, 20 nt, Human
gggcuacccgugagcccuuc

SEQ ID NO: 3750028 - RNA, 16 nt, Human
gggcuacccugagcug

SEQ ID NO: 3750029 - RNA, 14 nt, Human
ggccguaccccacc

SEQ ID NO: 3750030 - RNA, 22 nt, Human
ggccguaccccacccucagcac

SEQ ID NO: 3750031 - RNA, 19 nt, Human
ggccguaucuccggcuccc

SEQ ID NO: 3750032 - RNA, 20 nt, Human
ggccguaucuccggcuccca

SEQ ID NO: 3750033 - RNA, 21 nt, Human
ggccguaucuccggcucccag

SEQ ID NO: 3750034 - RNA, 22 nt, Human
ggccguaucuccggcucccagc

SEQ ID NO: 3750035 - RNA, 21 nt, Human
ggccguccucccgggcccucc

SEQ ID NO: 3750036 - RNA, 22 nt, Human
ggccguccucccgggcccuccc

SEQ ID NO: 3750037 - RNA, 13 nt, Human
ggccguggcugcc

SEQ ID NO: 3750038 - RNA, 13 nt, Human
ggccguggcugcu

SEQ ID NO: 3750039 - RNA, 14 nt, Human
ggccguggcugcug

SEQ ID NO: 3750040 - RNA, 17 nt, Human
ggccuaaaaguaaacau

SEQ ID NO: 3750041 - RNA, 14 nt, Human
ggccuaaacuucag

SEQ ID NO: 3750042 - RNA, 19 nt, Human
ggccuaaauuuauuaaaua

SEQ ID NO: 3750043 - RNA, 22 nt, Human
ggccuaagaggcugcccuccug

SEQ ID NO: 3750044 - RNA, 19 nt, Human
ggccuaagaguugagcucu

SEQ ID NO: 3750045 - RNA, 22 nt, Human
ggccuaauaaaacugaugugaa

SEQ ID NO: 3750046 - RNA, 20 nt, Human
ggccuacagcuuugaucccu

SEQ ID NO: 3750047 - RNA, 18 nt, Human
ggccuacaugcuuuguga

SEQ ID NO: 3750048 - RNA, 14 nt, Human
ggccuacuccuguc

SEQ ID NO: 3750049 - RNA, 18 nt, Human
ggccuacuggggaucaga

SEQ ID NO: 3750050 - RNA, 14 nt, Human
ggccuagaccagca

SEQ ID NO: 3750051 - RNA, 18 nt, Human
ggccuagacucugucuac

SEQ ID NO: 3750052 - RNA, 13 nt, Human
ggccuagaggccu

SEQ ID NO: 3750053 - RNA, 20 nt, Human
ggccuagcauacguacacau

SEQ ID NO: 3750054 - RNA, 19 nt, Human
ggccuagcgaucucuccug

SEQ ID NO: 3750055 - RNA, 22 nt, Human
ggccuagcgaucucuccuggcc

SEQ ID NO: 3750056 - RNA, 23 nt, Human
ggccuagcgaucucuccuggccu

SEQ ID NO: 3750057 - RNA, 16 nt, Human
ggccuagcugcuacaa

SEQ ID NO: 3750058 - RNA, 20 nt, Human
ggccuagcugcuacaaagaa

SEQ ID NO: 3750059 - RNA, 13 nt, Human
ggccuaggauucu

SEQ ID NO: 3750060 - RNA, 14 nt, Human
ggccuaggccucag

SEQ ID NO: 3750061 - RNA, 20 nt, Human
ggccuaggccucagccagag

SEQ ID NO: 3750062 - RNA, 12 nt, Human
ggccuaggcugc

SEQ ID NO: 3750063 - RNA, 15 nt, Human
ggccuaucagugugc

SEQ ID NO: 3750064 - RNA, 17 nt, Human
ggccuaucagugugccc

SEQ ID NO: 3750065 - RNA, 20 nt, Human
ggccuaugcacauauggacu

SEQ ID NO: 3750066 - RNA, 21 nt, Human
ggccuaugcacauauggacuc

SEQ ID NO: 3750067 - RNA, 22 nt, Human
ggccuauggagagcccugggac

SEQ ID NO: 3750068 - RNA, 14 nt, Human
ggccuauuucauca

SEQ ID NO: 3750069 - RNA, 23 nt, Human
ggccucaaagcaagcauucagaa

SEQ ID NO: 3750070 - RNA, 18 nt, Human
ggccucaaaggcccgcuc

SEQ ID NO: 3750071 - RNA, 20 nt, Human
ggccucaaaggcccgcucua

SEQ ID NO: 3750072 - RNA, 16 nt, Human
ggccucaacccucccu

SEQ ID NO: 3750073 - RNA, 19 nt, Human
ggccucaacccucccucag

SEQ ID NO: 3750074 - RNA, 21 nt, Human
ggccucaacccucccucagcc

SEQ ID NO: 3750075 - RNA, 12 nt, Human
ggccucaagauc

SEQ ID NO: 3750076 - RNA, 23 nt, Human
ggccucaagugauucuccugccu

SEQ ID NO: 3750077 - RNA, 18 nt, Human
ggccucacuccaggaagg

SEQ ID NO: 3750078 - RNA, 21 nt, Human
ggccucagcaccccugucucu

SEQ ID NO: 3750079 - RNA, 20 nt, Human
ggccucagccagagaagcua

SEQ ID NO: 3750080 - RNA, 15 nt, Human
ggccucagcugccuc

SEQ ID NO: 3750081 - RNA, 11 nt, Human
ggccucagggc

SEQ ID NO: 3750082 - RNA, 13 nt, Human
ggccucagggcuc

SEQ ID NO: 3750083 - RNA, 14 nt, Human
ggccucagggcucc

SEQ ID NO: 3750084 - RNA, 15 nt, Human
ggccucagggcuccu

SEQ ID NO: 3750085 - RNA, 18 nt, Human
ggccucagggcuccuugu

SEQ ID NO: 3750086 - RNA, 16 nt, Human
ggccucaggugcuguc

SEQ ID NO: 3750087 - RNA, 20 nt, Human
ggccucagucucccuucucc

SEQ ID NO: 3750088 - RNA, 13 nt, Human
ggccucagugcca

SEQ ID NO: 3750089 - RNA, 16 nt, Human
ggccucauguggcugg

SEQ ID NO: 3750090 - RNA, 22 nt, Human
ggccuccagcccucucacugug

SEQ ID NO: 3750091 - RNA, 23 nt, Human
ggccuccaggcccgucuguccau

SEQ ID NO: 3750092 - RNA, 23 nt, Human
ggccuccauuccuggagcccgag

SEQ ID NO: 3750093 - RNA, 13 nt, Human
ggccucccaaagu

SEQ ID NO: 3750094 - RNA, 23 nt, Human
ggccucccaacucaccccagccc

SEQ ID NO: 3750095 - RNA, 17 nt, Human
ggccucccacagacuca

SEQ ID NO: 3750096 - RNA, 15 nt, Human
ggccucccacaguga

SEQ ID NO: 3750097 - RNA, 15 nt, Human
ggccuccccugcuga

SEQ ID NO: 3750098 - RNA, 12 nt, Human
ggccucccugcc

SEQ ID NO: 3750099 - RNA, 13 nt, Human
ggccucccugcca

SEQ ID NO: 3750100 - RNA, 14 nt, Human
ggccuccggccucc

SEQ ID NO: 3750101 - RNA, 14 nt, Human
ggccuccucuucac

SEQ ID NO: 3750102 - RNA, 14 nt, Human
ggccuccugccucu

SEQ ID NO: 3750103 - RNA, 17 nt, Human
ggccuccuugcuuguua

SEQ ID NO: 3750104 - RNA, 15 nt, Human
ggccucgccuggccu

SEQ ID NO: 3750105 - RNA, 17 nt, Human
ggccucggacuuagcug

SEQ ID NO: 3750106 - RNA, 20 nt, Human
ggccucggacuuagcuggga

SEQ ID NO: 3750107 - RNA, 22 nt, Human
ggccucggagccucauccgagg

SEQ ID NO: 3750108 - RNA, 16 nt, Human
ggccucgggacaccug

SEQ ID NO: 3750109 - RNA, 23 nt, Human
ggccucgggacaccugcccugcc

SEQ ID NO: 3750110 - RNA, 20 nt, Human
ggccucgguguggagaagcg

SEQ ID NO: 3750111 - RNA, 23 nt, Human
ggccucucaccucugugccucug

SEQ ID NO: 3750112 - RNA, 20 nt, Human
ggccucucauuccagaggaa

SEQ ID NO: 3750113 - RNA, 19 nt, Human
ggccucuccagccucagcc

SEQ ID NO: 3750114 - RNA, 19 nt, Human
ggccucuccuuguggccug

SEQ ID NO: 3750115 - RNA, 22 nt, Human
ggccucucuauccucucuuccu

SEQ ID NO: 3750116 - RNA, 16 nt, Human
ggccucucuggccucc

SEQ ID NO: 3750117 - RNA, 20 nt, Human
ggccucucuggccucccacc

SEQ ID NO: 3750118 - RNA, 13 nt, Human
ggccucugcacuc

SEQ ID NO: 3750119 - RNA, 15 nt, Human
ggccucugcacuccc

SEQ ID NO: 3750120 - RNA, 18 nt, Human
ggccucugcacuccccug

SEQ ID NO: 3750121 - RNA, 19 nt, Human
ggccucugcacuccccugc

SEQ ID NO: 3750122 - RNA, 21 nt, Human
ggccucuggaaagcaaagggc

SEQ ID NO: 3750123 - RNA, 16 nt, Human
ggccucugugccuucu

SEQ ID NO: 3750124 - RNA, 16 nt, Human
ggccucuucucucaga

SEQ ID NO: 3750125 - RNA, 13 nt, Human
ggccucuugagca

SEQ ID NO: 3750126 - RNA, 17 nt, Human
ggccucuuggaccucug

SEQ ID NO: 3750127 - RNA, 22 nt, Human
ggccucuuggaccucugcucug

SEQ ID NO: 3750128 - RNA, 19 nt, Human
ggccucuugggucccccac

SEQ ID NO: 3750129 - RNA, 16 nt, Human
ggccugaaauccuggu

SEQ ID NO: 3750130 - RNA, 13 nt, Human
ggccugaagaguc

SEQ ID NO: 3750131 - RNA, 19 nt, Human
ggccugaagaguccucuga

SEQ ID NO: 3750132 - RNA, 16 nt, Human
ggccugaagccagcug

SEQ ID NO: 3750133 - RNA, 17 nt, Human
ggccugaagccagcugc

SEQ ID NO: 3750134 - RNA, 17 nt, Human
ggccugaaucaugagcc

SEQ ID NO: 3750135 - RNA, 21 nt, Human
ggccugaaucaugagccugcu

SEQ ID NO: 3750136 - RNA, 22 nt, Human
ggccugaaucaugagccugcug

SEQ ID NO: 3750137 - RNA, 16 nt, Human
ggccugaauccaaaag

SEQ ID NO: 3750138 - RNA, 16 nt, Human
ggccugacugccaagc

SEQ ID NO: 3750139 - RNA, 19 nt, Human
ggccugacugccaagccau

SEQ ID NO: 3750140 - RNA, 20 nt, Human
ggccugacugccaagccaug

SEQ ID NO: 3750141 - RNA, 17 nt, Human
ggccugagacccaggac

SEQ ID NO: 3750142 - RNA, 18 nt, Human
ggccugagacccaggacu

SEQ ID NO: 3750143 - RNA, 21 nt, Human
ggccugagagucagcucucug

SEQ ID NO: 3750144 - RNA, 15 nt, Human
ggccugagcugggau

SEQ ID NO: 3750145 - RNA, 17 nt, Human
ggccugaggagcagcag

SEQ ID NO: 3750146 - RNA, 19 nt, Human
ggccugaggaugagcugga

SEQ ID NO: 3750147 - RNA, 21 nt, Human
ggccugaggucucgcugaugc

SEQ ID NO: 3750148 - RNA, 22 nt, Human
ggccugaggucucgcugaugcu

SEQ ID NO: 3750149 - RNA, 21 nt, Human
ggccugaggucuggcugcuug

SEQ ID NO: 3750150 - RNA, 20 nt, Human
ggccugagugagaggggagg

SEQ ID NO: 3750151 - RNA, 17 nt, Human
ggccugaugcucccucc

SEQ ID NO: 3750152 - RNA, 15 nt, Human
ggccugcaaacuggg

SEQ ID NO: 3750153 - RNA, 14 nt, Human
ggccugcacacaag

SEQ ID NO: 3750154 - RNA, 19 nt, Human
ggccugcacggugggccuu

SEQ ID NO: 3750155 - RNA, 19 nt, Human
ggccugcagcaggaguggu

SEQ ID NO: 3750156 - RNA, 18 nt, Human
ggccugccaccuggaccc

SEQ ID NO: 3750157 - RNA, 19 nt, Human
ggccugccaccuggacccc

SEQ ID NO: 3750158 - RNA, 22 nt, Human
ggccugccaccuggaccccugc

SEQ ID NO: 3750159 - RNA, 23 nt, Human
ggccugccaccuggaccccugca

SEQ ID NO: 3750160 - RNA, 13 nt, Human
ggccugccaggag

SEQ ID NO: 3750161 - RNA, 15 nt, Human
ggccugcccaguugc

SEQ ID NO: 3750162 - RNA, 17 nt, Human
ggccugccuagcacuca

SEQ ID NO: 3750163 - RNA, 14 nt, Human
ggccugccuggccc

SEQ ID NO: 3750164 - RNA, 23 nt, Human
ggccugccuggccccucgccugu

SEQ ID NO: 3750165 - RNA, 16 nt, Human
ggccugcgacccuggg

SEQ ID NO: 3750166 - RNA, 18 nt, Human
ggccugcgccaguccugc

SEQ ID NO: 3750167 - RNA, 13 nt, Human
ggccugcuccaga

SEQ ID NO: 3750168 - RNA, 15 nt, Human
ggccugcuccagacc

SEQ ID NO: 3750169 - RNA, 17 nt, Human
ggccugcuccagaccug

SEQ ID NO: 3750170 - RNA, 17 nt, Human
ggccugcucccagcagc

SEQ ID NO: 3750171 - RNA, 19 nt, Human
ggccugcugcugagaaccu

SEQ ID NO: 3750172 - RNA, 20 nt, Human
ggccugcugcugagaaccug

SEQ ID NO: 3750173 - RNA, 18 nt, Human
ggccugcuggaggccuca

SEQ ID NO: 3750174 - RNA, 17 nt, Human
ggccugcugggcucucc

SEQ ID NO: 3750175 - RNA, 19 nt, Human
ggccugcugggcucuccac

SEQ ID NO: 3750176 - RNA, 20 nt, Human
ggccugcugggcucuccacc

SEQ ID NO: 3750177 - RNA, 15 nt, Human
gaaauuuuauaugcu

SEQ ID NO: 3750178 - RNA, 19 nt, Human
gaaauuuuauaugcuuacu

SEQ ID NO: 3750179 - RNA, 14 nt, Human
gaaauuuuccaaug

SEQ ID NO: 3750180 - RNA, 16 nt, Human
gaaauuuugcaaauau

SEQ ID NO: 3750181 - RNA, 14 nt, Human
gaaauuuuguaaga

SEQ ID NO: 3750182 - RNA, 19 nt, Human
gaaauuuuuauuaaauuau

SEQ ID NO: 3750183 - RNA, 17 nt, Human
gaaauuuuucagaugcu

SEQ ID NO: 3750184 - RNA, 20 nt, Human
gaaauuuuucagaugcuucu

SEQ ID NO: 3750185 - RNA, 16 nt, Human
gaaauuuuucauauuu

SEQ ID NO: 3750186 - RNA, 19 nt, Human
gaacaaaaaaaucugcaga

SEQ ID NO: 3750187 - RNA, 13 nt, Human
gaacaaaaggguc

SEQ ID NO: 3750188 - RNA, 14 nt, Human
gaacaaaauaaauu

SEQ ID NO: 3750189 - RNA, 14 nt, Human
gaacaaaauuauuu

SEQ ID NO: 3750190 - RNA, 14 nt, Human
gaacaaagcagcca

SEQ ID NO: 3750191 - RNA, 16 nt, Human
gaacaaagcagccacg

SEQ ID NO: 3750192 - RNA, 19 nt, Human
gaacaaagcagccacgagg

SEQ ID NO: 3750193 - RNA, 15 nt, Human
gaacaaagcuguuaa

SEQ ID NO: 3750194 - RNA, 15 nt, Human
gaacaaagugagaca

SEQ ID NO: 3750195 - RNA, 13 nt, Human
gaacaaaucuucc

SEQ ID NO: 3750196 - RNA, 14 nt, Human
gaacaaaucuuccu

SEQ ID NO: 3750197 - RNA, 17 nt, Human
gaacaaauuuacagaga

SEQ ID NO: 3750198 - RNA, 16 nt, Human
gaacaaccucggcucc

SEQ ID NO: 3750199 - RNA, 21 nt, Human
gaacaaggcaaggcugucaau

SEQ ID NO: 3750200 - RNA, 21 nt, Human
gaacaaguuguuucauugacu

SEQ ID NO: 3750201 - RNA, 20 nt, Human
gaacaauauugacuuugucu

SEQ ID NO: 3750202 - RNA, 16 nt, Human
gaacaauauuuuaugg

SEQ ID NO: 3750203 - RNA, 21 nt, Human
gaacaaugugcuaugugaaga

SEQ ID NO: 3750204 - RNA, 13 nt, Human
gaacaauuuucuu

SEQ ID NO: 3750205 - RNA, 22 nt, Human
gaacacaaacacauuguuauuu

SEQ ID NO: 3750206 - RNA, 19 nt, Human
gaacacaaacuguaaauaa

SEQ ID NO: 3750207 - RNA, 14 nt, Human
gaacacacuccauc

SEQ ID NO: 3750208 - RNA, 13 nt, Human
gaacacagaacug

SEQ ID NO: 3750209 - RNA, 20 nt, Human
gaacacagcaguucugcaga

SEQ ID NO: 3750210 - RNA, 17 nt, Human
gaacacauaauucagga

SEQ ID NO: 3750211 - RNA, 20 nt, Human
gaacacauaauucaggaagc

SEQ ID NO: 3750212 - RNA, 14 nt, Human
gaacacccucgaag

SEQ ID NO: 3750213 - RNA, 18 nt, Human
gaacaccuaugcaaagau

SEQ ID NO: 3750214 - RNA, 22 nt, Human
gaacacggccacaucaaagagg

SEQ ID NO: 3750215 - RNA, 22 nt, Human
gaacacguccagaauuuuucau

SEQ ID NO: 3750216 - RNA, 17 nt, Human
gaacacuagacaagcca

SEQ ID NO: 3750217 - RNA, 19 nt, Human
gaacacuagacaagccaga

SEQ ID NO: 3750218 - RNA, 16 nt, Human
gaacacuccuucacag

SEQ ID NO: 3750219 - RNA, 21 nt, Human
gaacacucuauaacaaaggau

SEQ ID NO: 3750220 - RNA, 17 nt, Human
gaacacugcccucgcac

SEQ ID NO: 3750221 - RNA, 13 nt, Human
gaacacuggggac

SEQ ID NO: 3750222 - RNA, 16 nt, Human
gaacacugggggaggg

SEQ ID NO: 3750223 - RNA, 17 nt, Human
gaacacugggggagggg

SEQ ID NO: 3750224 - RNA, 20 nt, Human
gaacacugggggaggggaca

SEQ ID NO: 3750225 - RNA, 11 nt, Human
gaacagaaaac

SEQ ID NO: 3750226 - RNA, 12 nt, Human
gaacagaaaaca

SEQ ID NO: 3750227 - RNA, 13 nt, Human
gaacagaaaacaa

SEQ ID NO: 3750228 - RNA, 23 nt, Human
gaacagaaaacaacaaaaaauaa

SEQ ID NO: 3750229 - RNA, 13 nt, Human
gaacagaagaaaa

SEQ ID NO: 3750230 - RNA, 14 nt, Human
gaacagaagaaaau

SEQ ID NO: 3750231 - RNA, 19 nt, Human
gaacagaaggaugaaugag

SEQ ID NO: 3750232 - RNA, 19 nt, Human
gaacagacaacagaaguca

SEQ ID NO: 3750233 - RNA, 16 nt, Human
gaacagacaggagaaa

SEQ ID NO: 3750234 - RNA, 15 nt, Human
gaacagacuggaagc

SEQ ID NO: 3750235 - RNA, 19 nt, Human
gaacagacuggaagcacag

SEQ ID NO: 3750236 - RNA, 15 nt, Human
gaacagacuggccug

SEQ ID NO: 3750237 - RNA, 21 nt, Human
gaacagagagacccuuguggg

SEQ ID NO: 3750238 - RNA, 17 nt, Human
gaacagauaaucccugu

SEQ ID NO: 3750239 - RNA, 20 nt, Human
gaacagcagacucagcucug

SEQ ID NO: 3750240 - RNA, 14 nt, Human
gaacagcaggccca

SEQ ID NO: 3750241 - RNA, 15 nt, Human
gaacagcaggcccac

SEQ ID NO: 3750242 - RNA, 21 nt, Human
gaacagcaggcccaccuaccu

SEQ ID NO: 3750243 - RNA, 13 nt, Human
gaacagcauggca

SEQ ID NO: 3750244 - RNA, 18 nt, Human
gaacagcauggcacuccc

SEQ ID NO: 3750245 - RNA, 21 nt, Human
gaacagcgaaguagcuugcuc

SEQ ID NO: 3750246 - RNA, 14 nt, Human
gaacagcuggugua

SEQ ID NO: 3750247 - RNA, 15 nt, Human
gaacagcugguguag

SEQ ID NO: 3750248 - RNA, 12 nt, Human
gaacagcuguug

SEQ ID NO: 3750249 - RNA, 14 nt, Human
gaacagcuucaggu

SEQ ID NO: 3750250 - RNA, 14 nt, Human
gaacaggcugggcu

SEQ ID NO: 3750251 - RNA, 21 nt, Human
gaacagggaaaauaggcagga

SEQ ID NO: 3750252 - RNA, 13 nt, Human
gaacaguaaacau

SEQ ID NO: 3750253 - RNA, 21 nt, Human
gaacagugauuuuuuuuuaga

SEQ ID NO: 3750254 - RNA, 21 nt, Human
gaacaguuaagcagccgccac

SEQ ID NO: 3750255 - RNA, 22 nt, Human
gaacaguuguguuugaagcaca

SEQ ID NO: 3750256 - RNA, 23 nt, Human
gaacaguuuaugcagugcugcuu

SEQ ID NO: 3750257 - RNA, 14 nt, Human
gaacaguuuguaca

SEQ ID NO: 3750258 - RNA, 18 nt, Human
gaacauaaaaaggacauc

SEQ ID NO: 3750259 - RNA, 22 nt, Human
gaacauaaagcaaauagacaca

SEQ ID NO: 3750260 - RNA, 21 nt, Human
gaacauaaagguaaaacaaaa

SEQ ID NO: 3750261 - RNA, 13 nt, Human
gaacauacaaaug

SEQ ID NO: 3750262 - RNA, 22 nt, Human
gaacauacuguucacucacucu

SEQ ID NO: 3750263 - RNA, 12 nt, Human
gaacauauuguu

SEQ ID NO: 3750264 - RNA, 12 nt, Human
gaacauccaagg

SEQ ID NO: 3750265 - RNA, 20 nt, Human
gaacauccaaggagaaacag

SEQ ID NO: 3750266 - RNA, 23 nt, Human
gaacauccuuugcagggcagccc

SEQ ID NO: 3750267 - RNA, 22 nt, Human
gaacaucgcgaugggaaccgau

SEQ ID NO: 3750268 - RNA, 17 nt, Human
gaacaucugaguccugg

SEQ ID NO: 3750269 - RNA, 15 nt, Human
gaacaugaaucaaaa

SEQ ID NO: 3750270 - RNA, 15 nt, Human
gaacaugcaguuuga

SEQ ID NO: 3750271 - RNA, 18 nt, Human
gaacaugcaguuugaaau

SEQ ID NO: 3750272 - RNA, 19 nt, Human
gaacaugcaguuugaaauu

SEQ ID NO: 3750273 - RNA, 15 nt, Human
gaacauggggaggag

SEQ ID NO: 3750274 - RNA, 20 nt, Human
gaacauguagaaaacaaaau

SEQ ID NO: 3750275 - RNA, 17 nt, Human
gaacauguugguauuua

SEQ ID NO: 3750276 - RNA, 20 nt, Human
gaacauguugguauuuaucu

SEQ ID NO: 3750277 - RNA, 21 nt, Human
gaacauugcauauaacuuaua

SEQ ID NO: 3750278 - RNA, 23 nt, Human
gaacauugcauauaacuuauauu

SEQ ID NO: 3750279 - RNA, 22 nt, Human
gaacauuggaauguucucagau

SEQ ID NO: 3750280 - RNA, 16 nt, Human
gaacauuuauuuuaug

SEQ ID NO: 3750281 - RNA, 18 nt, Human
gaacauuuauuuuaugag

SEQ ID NO: 3750282 - RNA, 19 nt, Human
gaacauuuauuuuaugaga

SEQ ID NO: 3750283 - RNA, 13 nt, Human
gaacauuugugau

SEQ ID NO: 3750284 - RNA, 20 nt, Human
gaaccaaaacauuccguuua

SEQ ID NO: 3750285 - RNA, 21 nt, Human
gaaccaaagagacuggagcau

SEQ ID NO: 3750286 - RNA, 20 nt, Human
gaaccaaagcgaauuuuaaa

SEQ ID NO: 3750287 - RNA, 19 nt, Human
gaaccaacaaguaaauauu

SEQ ID NO: 3750288 - RNA, 23 nt, Human
gaaccaaguggaccuugagacca

SEQ ID NO: 3750289 - RNA, 19 nt, Human
gaaccaauaaaauaauuuu

SEQ ID NO: 3750290 - RNA, 23 nt, Human
gaaccaccacacccagcccacuu

SEQ ID NO: 3750291 - RNA, 21 nt, Human
gaaccacgcgggggccuugag

SEQ ID NO: 3750292 - RNA, 19 nt, Human
gaaccacuacaugcagccc

SEQ ID NO: 3750293 - RNA, 11 nt, Human
gaaccagacuc

SEQ ID NO: 3750294 - RNA, 12 nt, Human
gaaccagagcca

SEQ ID NO: 3750295 - RNA, 19 nt, Human
gaaccagagccauggacuc

SEQ ID NO: 3750296 - RNA, 17 nt, Human
gaaccagccggggccuu

SEQ ID NO: 3750297 - RNA, 15 nt, Human
gaaccaggcuuggaa

SEQ ID NO: 3750298 - RNA, 18 nt, Human
gaaccagggagaccgagc

SEQ ID NO: 3750299 - RNA, 13 nt, Human
gaaccauaaauuc

SEQ ID NO: 3750300 - RNA, 23 nt, Human
gaaccauaguuacuguaaaaugc

SEQ ID NO: 3750301 - RNA, 22 nt, Human
gaaccauaguugacaguuccaa

SEQ ID NO: 3750302 - RNA, 18 nt, Human
gaaccaugaagacaggau

SEQ ID NO: 3750303 - RNA, 13 nt, Human
gaacccacacugc

SEQ ID NO: 3750304 - RNA, 12 nt, Human
gaacccaccugc

SEQ ID NO: 3750305 - RNA, 13 nt, Human
gaacccagacuca

SEQ ID NO: 3750306 - RNA, 17 nt, Human
gaacccagacucagaca

SEQ ID NO: 3750307 - RNA, 19 nt, Human
gaacccagcaguucuguua

SEQ ID NO: 3750308 - RNA, 15 nt, Human
gaacccaggacgcuu

SEQ ID NO: 3750309 - RNA, 14 nt, Human
gaacccaggaggca

SEQ ID NO: 3750310 - RNA, 14 nt, Human
gaacccagggcucu

SEQ ID NO: 3750311 - RNA, 21 nt, Human
gaacccagggcucugccccag

SEQ ID NO: 3750312 - RNA, 23 nt, Human
gaacccauuccauuuaucuuucu

SEQ ID NO: 3750313 - RNA, 18 nt, Human
gaaccccuggcuccaggc

SEQ ID NO: 3750314 - RNA, 17 nt, Human
gaaccccuucauccucu

SEQ ID NO: 3750315 - RNA, 19 nt, Human
gaacccgggaggcagaggu

SEQ ID NO: 3750316 - RNA, 22 nt, Human
gaacccugccauggaacuguuu

SEQ ID NO: 3750317 - RNA, 16 nt, Human
gaacccuggggccuga

SEQ ID NO: 3750318 - RNA, 17 nt, Human
gaacccuggggccugac

SEQ ID NO: 3750319 - RNA, 13 nt, Human
gaacccuuuauuu

SEQ ID NO: 3750320 - RNA, 20 nt, Human
gaacccuuuguuucuuguuu

SEQ ID NO: 3750321 - RNA, 23 nt, Human
gaacccuuuguuucuuguuuauu

SEQ ID NO: 3750322 - RNA, 15 nt, Human
gaaccgcacagcuca

SEQ ID NO: 3750323 - RNA, 21 nt, Human
gaaccgcagaagccuccccag

SEQ ID NO: 3750324 - RNA, 16 nt, Human
gaaccgcaggaagcug

SEQ ID NO: 3750325 - RNA, 20 nt, Human
gaaccgcaggaagcugcucc

SEQ ID NO: 3750326 - RNA, 16 nt, Human
gaaccgcucaccuaga

SEQ ID NO: 3750327 - RNA, 22 nt, Human
gggcuacccugagcugaggcag

SEQ ID NO: 3750328 - RNA, 14 nt, Human
gggcuagaaccugg

SEQ ID NO: 3750329 - RNA, 15 nt, Human
gggcuagaaccugga

SEQ ID NO: 3750330 - RNA, 17 nt, Human
gggcuagaaccuggaga

SEQ ID NO: 3750331 - RNA, 21 nt, Human
gggcuauuuuguuugcuucau

SEQ ID NO: 3750332 - RNA, 21 nt, Human
gggcucaaucucugggggcug

SEQ ID NO: 3750333 - RNA, 22 nt, Human
gggcucagcaaaagaugcuucu

SEQ ID NO: 3750334 - RNA, 16 nt, Human
gggcucagcaaggcca

SEQ ID NO: 3750335 - RNA, 19 nt, Human
gggcucagcaaggccaccu

SEQ ID NO: 3750336 - RNA, 18 nt, Human
gggcucaguucuggacug

SEQ ID NO: 3750337 - RNA, 10 nt, Human
gggcuccaga

SEQ ID NO: 3750338 - RNA, 23 nt, Human
gggcuccagccccucuuggagaa

SEQ ID NO: 3750339 - RNA, 19 nt, Human
gggcucccagccaggcccu

SEQ ID NO: 3750340 - RNA, 13 nt, Human
gggcucccagggc

SEQ ID NO: 3750341 - RNA, 23 nt, Human
gggcucccaggggucucccuggc

SEQ ID NO: 3750342 - RNA, 12 nt, Human
gggcuccccucu

SEQ ID NO: 3750343 - RNA, 14 nt, Human
gggcucccuuccca

SEQ ID NO: 3750344 - RNA, 18 nt, Human
gggcuccgugugggagac

SEQ ID NO: 3750345 - RNA, 23 nt, Human
gggcuccuccaggguggcagcaa

SEQ ID NO: 3750346 - RNA, 11 nt, Human
gggcuccugca

SEQ ID NO: 3750347 - RNA, 14 nt, Human
gggcuccugcaggc

SEQ ID NO: 3750348 - RNA, 17 nt, Human
gggcuccugccuucugu

SEQ ID NO: 3750349 - RNA, 11 nt, Human
gggcuccugga
